United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 48

SEQ ID NO: 2151347 - RNA, 23 nt, Human herpesvirus 8 [Kaposi`s sarcoma-associated h
gucagguuacuggacguggccag

SEQ ID NO: 2151348 - RNA, 14 nt, Human herpesvirus 8 [Kaposi`s sarcoma-associated h
aucuggcaugcugg

SEQ ID NO: 2151349 - RNA, 14 nt, Human herpesvirus 8 [Kaposi`s sarcoma-associated h
ugaaagcaauaaag

SEQ ID NO: 2151350 - RNA, 17 nt, Human herpesvirus 8 [Kaposi`s sarcoma-associated h
ucucccuucgugcccca

SEQ ID NO: 2151351 - RNA, 20 nt, Human herpesvirus 8 [Kaposi`s sarcoma-associated h
uuaccgcuacugugggugca

SEQ ID NO: 2151352 - RNA, 18 nt, Human herpesvirus 8 [Kaposi`s sarcoma-associated h
uggccaaacucacugagu

SEQ ID NO: 2151353 - RNA, 15 nt, Human herpesvirus 8 [Kaposi`s sarcoma-associated h
guccgauugcuucau

SEQ ID NO: 2151354 - RNA, 18 nt, Human herpesvirus 8 [Kaposi`s sarcoma-associated h
gcaguguuugcugcugua

SEQ ID NO: 2151355 - RNA, 21 nt, Human herpesvirus 8 [Kaposi`s sarcoma-associated h
cggaagauugguguccagaca

SEQ ID NO: 2151356 - RNA, 18 nt, Human herpesvirus 8 [Kaposi`s sarcoma-associated h
agguauguuuuuaccagu

SEQ ID NO: 2151357 - RNA, 17 nt, Human herpesvirus 8 [Kaposi`s sarcoma-associated h
ugauaugcaugugucug

SEQ ID NO: 2151358 - RNA, 16 nt, Human herpesvirus 8 [Kaposi`s sarcoma-associated h
uaagauuauaaugggu

SEQ ID NO: 2151359 - RNA, 20 nt, Human herpesvirus 8 [Kaposi`s sarcoma-associated h
ggaucgaacagaagacccag

SEQ ID NO: 2151360 - RNA, 16 nt, Human herpesvirus 8 [Kaposi`s sarcoma-associated h
cuguuacaauaaagcu

SEQ ID NO: 2151361 - RNA, 14 nt, Human herpesvirus 8 [Kaposi`s sarcoma-associated h
aggcgccugcgucu

SEQ ID NO: 2151362 - RNA, 19 nt, Human herpesvirus 8 [Kaposi`s sarcoma-associated h
gacacugauguguuuggga

SEQ ID NO: 2151363 - RNA, 20 nt, Human herpesvirus 8 [Kaposi`s sarcoma-associated h
gugagccuaacccacgucac

SEQ ID NO: 2151364 - RNA, 17 nt, Human herpesvirus 8 [Kaposi`s sarcoma-associated h
ggcagcaauauuaaagg

SEQ ID NO: 2151365 - RNA, 18 nt, Human herpesvirus 8 [Kaposi`s sarcoma-associated h
aaaauaacgggggaugga

SEQ ID NO: 2151366 - RNA, 11 nt, Human herpesvirus 8 [Kaposi`s sarcoma-associated h
acaauaaagcc

SEQ ID NO: 2151367 - RNA, 20 nt, Human herpesvirus 8 [Kaposi`s sarcoma-associated h
augccgcguuagcagccaug

SEQ ID NO: 2151368 - RNA, 17 nt, Human herpesvirus 8 [Kaposi`s sarcoma-associated h
cauauggcgcaggaguc

SEQ ID NO: 2151369 - RNA, 19 nt, Human herpesvirus 8 [Kaposi`s sarcoma-associated h
cccucuucuguugccaggc

SEQ ID NO: 2151370 - RNA, 12 nt, Human herpesvirus 8 [Kaposi`s sarcoma-associated h
accaaaccuggu

SEQ ID NO: 2151371 - RNA, 19 nt, Human herpesvirus 8 [Kaposi`s sarcoma-associated h
aacacagucacaguucaga

SEQ ID NO: 2151372 - RNA, 19 nt, Human herpesvirus 8 [Kaposi`s sarcoma-associated h
acguuagcuucagcuucag

SEQ ID NO: 2151373 - RNA, 17 nt, Human herpesvirus 8 [Kaposi`s sarcoma-associated h
ugcgguauuugcagaca

SEQ ID NO: 2151374 - RNA, 15 nt, Human herpesvirus 8 [Kaposi`s sarcoma-associated h
gccgguugguggugu

SEQ ID NO: 2151375 - RNA, 13 nt, Human herpesvirus 8 [Kaposi`s sarcoma-associated h
auugccaccucug

SEQ ID NO: 2151376 - RNA, 17 nt, Human herpesvirus 8 [Kaposi`s sarcoma-associated h
ccaaucacgggaggcuu

SEQ ID NO: 2151377 - RNA, 18 nt, Human herpesvirus 8 [Kaposi`s sarcoma-associated h
aucuuugcagugucuaug

SEQ ID NO: 2151378 - RNA, 23 nt, Human herpesvirus 8 [Kaposi`s sarcoma-associated h
cacagcaugccgucagggcccac

SEQ ID NO: 2151379 - RNA, 18 nt, Human herpesvirus 8 [Kaposi`s sarcoma-associated h
uggcauuugucagaaguu

SEQ ID NO: 2151380 - RNA, 16 nt, Human herpesvirus 8 [Kaposi`s sarcoma-associated h
cguugacauguggagc

SEQ ID NO: 2151381 - RNA, 20 nt, Human herpesvirus 8 [Kaposi`s sarcoma-associated h
guuucugaucccuaaggguc

SEQ ID NO: 2151382 - RNA, 19 nt, Human herpesvirus 8 [Kaposi`s sarcoma-associated h
uuuguaaugaauaacuuua

SEQ ID NO: 2151383 - RNA, 23 nt, Human herpesvirus 8 [Kaposi`s sarcoma-associated h
uacgucccucuuggcuguuacaa

SEQ ID NO: 2151384 - RNA, 16 nt, Human herpesvirus 8 [Kaposi`s sarcoma-associated h
ugucccgugcccaggc

SEQ ID NO: 2151385 - RNA, 18 nt, Human herpesvirus 8 [Kaposi`s sarcoma-associated h
caaacacaggcggagagc

SEQ ID NO: 2151386 - RNA, 21 nt, Human herpesvirus 8 [Kaposi`s sarcoma-associated h
caaauggcguccgcucuccca

SEQ ID NO: 2151387 - RNA, 13 nt, Human herpesvirus 8 [Kaposi`s sarcoma-associated h
gacaaccuucaga

SEQ ID NO: 2151388 - RNA, 22 nt, Human herpesvirus 8 [Kaposi`s sarcoma-associated h
ucuugcgccauuuuuguggcug

SEQ ID NO: 2151389 - RNA, 21 nt, Human herpesvirus 8 [Kaposi`s sarcoma-associated h
gagugggcggaaguacuggga

SEQ ID NO: 2151390 - RNA, 21 nt, Human herpesvirus 8 [Kaposi`s sarcoma-associated h
uucccuccugcauuuggacac

SEQ ID NO: 2151391 - RNA, 16 nt, Human herpesvirus 8 [Kaposi`s sarcoma-associated h
agcauaugcugccaag

SEQ ID NO: 2151392 - RNA, 15 nt, Human herpesvirus 8 [Kaposi`s sarcoma-associated h
ugcugaccacggcac

SEQ ID NO: 2151393 - RNA, 14 nt, Human herpesvirus 8 [Kaposi`s sarcoma-associated h
aaggcaacaccggc

SEQ ID NO: 2151394 - RNA, 19 nt, Human herpesvirus 8 [Kaposi`s sarcoma-associated h
ccaagagcgagugugccuc

SEQ ID NO: 2151395 - RNA, 22 nt, Human herpesvirus 8 [Kaposi`s sarcoma-associated h
ggaccuuacgauggaagaccua

SEQ ID NO: 2151396 - RNA, 17 nt, Human herpesvirus 8 [Kaposi`s sarcoma-associated h
gacagcaacacccagcu

SEQ ID NO: 2151397 - RNA, 23 nt, Human herpesvirus 8 [Kaposi`s sarcoma-associated h
gaaugaagugcaaccugcugcag

SEQ ID NO: 2151398 - RNA, 20 nt, Human herpesvirus 8 [Kaposi`s sarcoma-associated h
ucgcaagggcgucugugccu

SEQ ID NO: 2151399 - RNA, 15 nt, Human herpesvirus 8 [Kaposi`s sarcoma-associated h
ugcaaccugcugcag

SEQ ID NO: 2151400 - RNA, 21 nt, Human herpesvirus 8 [Kaposi`s sarcoma-associated h
gcaagccgggugaggccaaug

SEQ ID NO: 2151401 - RNA, 15 nt, Human herpesvirus 8 [Kaposi`s sarcoma-associated h
guggaugagaggguu

SEQ ID NO: 2151402 - RNA, 21 nt, Human herpesvirus 8 [Kaposi`s sarcoma-associated h
cccuucauaccgggucugugc

SEQ ID NO: 2151403 - RNA, 13 nt, Human herpesvirus 8 [Kaposi`s sarcoma-associated h
gcgcacccagcgu

SEQ ID NO: 2151404 - RNA, 14 nt, Human herpesvirus 8 [Kaposi`s sarcoma-associated h
agauaggagaaauc

SEQ ID NO: 2151405 - RNA, 18 nt, Human herpesvirus 8 [Kaposi`s sarcoma-associated h
gucgacagagccagccug

SEQ ID NO: 2151406 - RNA, 19 nt, Human herpesvirus 8 [Kaposi`s sarcoma-associated h
uuacauuugacaacacgca

SEQ ID NO: 2151407 - RNA, 20 nt, Human herpesvirus 8 [Kaposi`s sarcoma-associated h
cuuacuaagagaacagcaca

SEQ ID NO: 2151408 - RNA, 15 nt, Human herpesvirus 8 [Kaposi`s sarcoma-associated h
gaccugcuucacuua

SEQ ID NO: 2151409 - RNA, 17 nt, Human herpesvirus 8 [Kaposi`s sarcoma-associated h
gacugccacggccgccu

SEQ ID NO: 2151410 - RNA, 22 nt, Human herpesvirus 8 [Kaposi`s sarcoma-associated h
uucuaaucuuagucuuacuguc

SEQ ID NO: 2151411 - RNA, 21 nt, Human herpesvirus 8 [Kaposi`s sarcoma-associated h
uuacuugcaaaauugugugua

SEQ ID NO: 2151412 - RNA, 21 nt, Human herpesvirus 8 [Kaposi`s sarcoma-associated h
acaccauucuuuuauuuauca

SEQ ID NO: 2151413 - RNA, 19 nt, Human herpesvirus 8 [Kaposi`s sarcoma-associated h
cccuuacgccccugguggg

SEQ ID NO: 2151414 - RNA, 17 nt, Human herpesvirus 8 [Kaposi`s sarcoma-associated h
ucaccgcgguccauuag

SEQ ID NO: 2151415 - RNA, 23 nt, Human herpesvirus 8 [Kaposi`s sarcoma-associated h
ggacuugauaaucuccuggagaa

SEQ ID NO: 2151416 - RNA, 13 nt, Human herpesvirus 8 [Kaposi`s sarcoma-associated h
aucaaagaaaggu

SEQ ID NO: 2151417 - RNA, 14 nt, Human herpesvirus 8 [Kaposi`s sarcoma-associated h
ccuaucgcacagac

SEQ ID NO: 2151418 - RNA, 12 nt, Human herpesvirus 8 [Kaposi`s sarcoma-associated h
acugcagcacua

SEQ ID NO: 2151419 - RNA, 19 nt, Human herpesvirus 8 [Kaposi`s sarcoma-associated h
guuaagcuuugcagccagg

SEQ ID NO: 2151420 - RNA, 18 nt, Human herpesvirus 8 [Kaposi`s sarcoma-associated h
cuagaauuggagcacuuu

SEQ ID NO: 2151421 - RNA, 21 nt, Human herpesvirus 8 [Kaposi`s sarcoma-associated h
aacugucuccagaagagcauu

SEQ ID NO: 2151422 - RNA, 16 nt, Human herpesvirus 8 [Kaposi`s sarcoma-associated h
ccgaggacacgccauc

SEQ ID NO: 2151423 - RNA, 24 nt, Human herpesvirus 8 [Kaposi`s sarcoma-associated h
caucauaaaguacuuuuccauggc

SEQ ID NO: 2151424 - RNA, 19 nt, Human herpesvirus 8 [Kaposi`s sarcoma-associated h
auggcuucuauaagcaccu

SEQ ID NO: 2151425 - RNA, 21 nt, Human herpesvirus 8 [Kaposi`s sarcoma-associated h
gcuacguacccaauguuaaug

SEQ ID NO: 2151426 - RNA, 14 nt, Human herpesvirus 8 [Kaposi`s sarcoma-associated h
uggacguggccagc

SEQ ID NO: 2151427 - RNA, 19 nt, Human herpesvirus 8 [Kaposi`s sarcoma-associated h
uguccucgcccaacuuugu

SEQ ID NO: 2151428 - RNA, 18 nt, Human herpesvirus 8 [Kaposi`s sarcoma-associated h
aacggcuagcguacucuc

SEQ ID NO: 2151429 - RNA, 21 nt, Human herpesvirus 8 [Kaposi`s sarcoma-associated h
acugcuaggauucgugcagcc

SEQ ID NO: 2151430 - RNA, 13 nt, Human herpesvirus 8 [Kaposi`s sarcoma-associated h
gcaguggacacag

SEQ ID NO: 2151431 - RNA, 14 nt, Human herpesvirus 8 [Kaposi`s sarcoma-associated h
ggcccgagaaacac

SEQ ID NO: 2151432 - RNA, 15 nt, Human herpesvirus 8 [Kaposi`s sarcoma-associated h
gcuacaaauguuuua

SEQ ID NO: 2151433 - RNA, 16 nt, Human herpesvirus 8 [Kaposi`s sarcoma-associated h
uaaaguacuuuuccau

SEQ ID NO: 2151434 - RNA, 16 nt, Human herpesvirus 8 [Kaposi`s sarcoma-associated h
gaggggguggugcgag

SEQ ID NO: 2151435 - RNA, 13 nt, Human herpesvirus 8 [Kaposi`s sarcoma-associated h
aaugugccagcag

SEQ ID NO: 2151436 - RNA, 22 nt, Human herpesvirus 8 [Kaposi`s sarcoma-associated h
cuacagggaaguuucagagccu

SEQ ID NO: 2151437 - RNA, 18 nt, Human herpesvirus 8 [Kaposi`s sarcoma-associated h
agcacuuuuugaagcccu

SEQ ID NO: 2151438 - RNA, 16 nt, Human herpesvirus 8 [Kaposi`s sarcoma-associated h
accauguucagguggu

SEQ ID NO: 2151439 - RNA, 14 nt, Human herpesvirus 8 [Kaposi`s sarcoma-associated h
augacagggaagug

SEQ ID NO: 2151440 - RNA, 22 nt, Human herpesvirus 8 [Kaposi`s sarcoma-associated h
uccuccgggcucacuaguauug

SEQ ID NO: 2151441 - RNA, 21 nt, Human herpesvirus 8 [Kaposi`s sarcoma-associated h
accaggcaacacaagggugaa

SEQ ID NO: 2151442 - RNA, 18 nt, Human herpesvirus 8 [Kaposi`s sarcoma-associated h
cagagguuugaggcgcug

SEQ ID NO: 2151443 - RNA, 19 nt, Human herpesvirus 8 [Kaposi`s sarcoma-associated h
cgacacgauguuuuccagc

SEQ ID NO: 2151444 - RNA, 17 nt, Human herpesvirus 8 [Kaposi`s sarcoma-associated h
uccaccucuuucaucac

SEQ ID NO: 2151445 - RNA, 22 nt, Human herpesvirus 8 [Kaposi`s sarcoma-associated h
uggguguuaugcaccgugcagg

SEQ ID NO: 2151446 - RNA, 18 nt, Human herpesvirus 8 [Kaposi`s sarcoma-associated h
cuuuaacauugaggaccu

SEQ ID NO: 2151447 - RNA, 17 nt, Human herpesvirus 8 [Kaposi`s sarcoma-associated h
agcauccggacugagau

SEQ ID NO: 2151448 - RNA, 22 nt, Human herpesvirus 8 [Kaposi`s sarcoma-associated h
gggcguccacauggcagcugaa

SEQ ID NO: 2151449 - RNA, 16 nt, Human herpesvirus 8 [Kaposi`s sarcoma-associated h
acaugugcuuuugcuu

SEQ ID NO: 2151450 - RNA, 16 nt, Human herpesvirus 8 [Kaposi`s sarcoma-associated h
ucacuaguauuguguu

SEQ ID NO: 2151451 - RNA, 16 nt, Human herpesvirus 8 [Kaposi`s sarcoma-associated h
ugacuccggggagcug

SEQ ID NO: 2151452 - RNA, 15 nt, Human herpesvirus 8 [Kaposi`s sarcoma-associated h
gauacacuacuuaug

SEQ ID NO: 2151453 - RNA, 23 nt, Human herpesvirus 8 [Kaposi`s sarcoma-associated h
ggcuacacaucauaaaguacuuu

SEQ ID NO: 2151454 - RNA, 20 nt, Human herpesvirus 8 [Kaposi`s sarcoma-associated h
ucugccgaagucagugccac

SEQ ID NO: 2151455 - RNA, 12 nt, Human herpesvirus 8 [Kaposi`s sarcoma-associated h
uggcggccaugg

SEQ ID NO: 2151456 - RNA, 17 nt, Human herpesvirus 8 [Kaposi`s sarcoma-associated h
acgucuugaccucuccg

SEQ ID NO: 2151457 - RNA, 20 nt, Human herpesvirus 8 [Kaposi`s sarcoma-associated h
ggcuccuggguagcuaugcc

SEQ ID NO: 2151458 - RNA, 16 nt, Human herpesvirus 8 [Kaposi`s sarcoma-associated h
gauacugaucacugcg

SEQ ID NO: 2151459 - RNA, 22 nt, Human herpesvirus 8 [Kaposi`s sarcoma-associated h
aggugccgucgucgagcacucc

SEQ ID NO: 2151460 - RNA, 16 nt, Human herpesvirus 8 [Kaposi`s sarcoma-associated h
guacgacgcaggcguc

SEQ ID NO: 2151461 - RNA, 21 nt, Human herpesvirus 8 [Kaposi`s sarcoma-associated h
caacuauuuccuuuuuucaaa

SEQ ID NO: 2151462 - RNA, 21 nt, Human herpesvirus 8 [Kaposi`s sarcoma-associated h
ugugaaugucagacacacacu

SEQ ID NO: 2151463 - RNA, 14 nt, Human herpesvirus 8 [Kaposi`s sarcoma-associated h
gcacacagacacaa

SEQ ID NO: 2151464 - RNA, 24 nt, Human herpesvirus 8 [Kaposi`s sarcoma-associated h
gagggcuguucucgccuggagcag

SEQ ID NO: 2151465 - RNA, 17 nt, Human herpesvirus 8 [Kaposi`s sarcoma-associated h
auuucuuuuugccagag

SEQ ID NO: 2151466 - RNA, 17 nt, Human herpesvirus 8 [Kaposi`s sarcoma-associated h
uagcguuggcuagucau

SEQ ID NO: 2151467 - RNA, 16 nt, Human herpesvirus 8 [Kaposi`s sarcoma-associated h
aguauuaugccaggga

SEQ ID NO: 2151468 - RNA, 16 nt, Human herpesvirus 8 [Kaposi`s sarcoma-associated h
caaacuucggaauuuc

SEQ ID NO: 2151469 - RNA, 16 nt, Human herpesvirus 8 [Kaposi`s sarcoma-associated h
auguccugauuuucca

SEQ ID NO: 2151470 - RNA, 14 nt, Human herpesvirus 8 [Kaposi`s sarcoma-associated h
gcgacaugcugaug

SEQ ID NO: 2151471 - RNA, 19 nt, Human herpesvirus 8 [Kaposi`s sarcoma-associated h
gccgagccacaaaguacau

SEQ ID NO: 2151472 - RNA, 17 nt, Human herpesvirus 8 [Kaposi`s sarcoma-associated h
acacauuugucuuuauu

SEQ ID NO: 2151473 - RNA, 23 nt, Human herpesvirus 8 [Kaposi`s sarcoma-associated h
cgaaagcuucaucguggugcccu

SEQ ID NO: 2151474 - RNA, 19 nt, Human herpesvirus 8 [Kaposi`s sarcoma-associated h
cuucaucguggugcccugc

SEQ ID NO: 2151475 - RNA, 15 nt, Human herpesvirus 8 [Kaposi`s sarcoma-associated h
cccgauggcccuuca

SEQ ID NO: 2151476 - RNA, 12 nt, Human herpesvirus 8 [Kaposi`s sarcoma-associated h
acaaaccaaauu

SEQ ID NO: 2151477 - RNA, 14 nt, Human herpesvirus 8 [Kaposi`s sarcoma-associated h
ucaguguccagcca

SEQ ID NO: 2151478 - RNA, 22 nt, Human herpesvirus 8 [Kaposi`s sarcoma-associated h
acagccuuggugcuaggcaguc

SEQ ID NO: 2151479 - RNA, 19 nt, Human herpesvirus 8 [Kaposi`s sarcoma-associated h
ccacgcccgggggccagga

SEQ ID NO: 2151480 - RNA, 22 nt, Human herpesvirus 8 [Kaposi`s sarcoma-associated h
gggccagagguuugaggcgcug

SEQ ID NO: 2151481 - RNA, 12 nt, Human herpesvirus 8 [Kaposi`s sarcoma-associated h
cucacugagugg

SEQ ID NO: 2151482 - RNA, 23 nt, Human herpesvirus 8 [Kaposi`s sarcoma-associated h
gcgacggaaguuggccuccagca

SEQ ID NO: 2151483 - RNA, 18 nt, Human herpesvirus 8 [Kaposi`s sarcoma-associated h
cucccuucgugccccagc

SEQ ID NO: 2151484 - RNA, 16 nt, Human herpesvirus 8 [Kaposi`s sarcoma-associated h
aucucgguacugcgca

SEQ ID NO: 2151485 - RNA, 15 nt, Human herpesvirus 8 [Kaposi`s sarcoma-associated h
cuggugggacacacg

SEQ ID NO: 2151486 - RNA, 18 nt, Human herpesvirus 8 [Kaposi`s sarcoma-associated h
gcgucuucuauacaugcc

SEQ ID NO: 2151487 - RNA, 15 nt, Human herpesvirus 8 [Kaposi`s sarcoma-associated h
aaacagccuuggugc

SEQ ID NO: 2151488 - RNA, 14 nt, Human herpesvirus 8 [Kaposi`s sarcoma-associated h
gcggccuuuucugg

SEQ ID NO: 2151489 - RNA, 23 nt, Human herpesvirus 8 [Kaposi`s sarcoma-associated h
auuccucuccgcauuaaagcacu

SEQ ID NO: 2151490 - RNA, 15 nt, Human herpesvirus 8 [Kaposi`s sarcoma-associated h
ucccgaugccacugu

SEQ ID NO: 2151491 - RNA, 21 nt, Human herpesvirus 8 [Kaposi`s sarcoma-associated h
ugugagggacguuugcagaua

SEQ ID NO: 2151492 - RNA, 16 nt, Human herpesvirus 8 [Kaposi`s sarcoma-associated h
uucggacgcuauuugu

SEQ ID NO: 2151493 - RNA, 16 nt, Human herpesvirus 8 [Kaposi`s sarcoma-associated h
ugcauagggcuuugau

SEQ ID NO: 2151494 - RNA, 19 nt, Human herpesvirus 8 [Kaposi`s sarcoma-associated h
cgcaggagucagagcagug

SEQ ID NO: 2151495 - RNA, 17 nt, Human herpesvirus 8 [Kaposi`s sarcoma-associated h
acucagcugccaaggca

SEQ ID NO: 2151496 - RNA, 13 nt, Human herpesvirus 8 [Kaposi`s sarcoma-associated h
acucccucaagca

SEQ ID NO: 2151497 - RNA, 17 nt, Human herpesvirus 8 [Kaposi`s sarcoma-associated h
ucucacccaauacuuaa

SEQ ID NO: 2151498 - RNA, 21 nt, Human herpesvirus 8 [Kaposi`s sarcoma-associated h
guuuauaacaaugaaacgaca

SEQ ID NO: 2151499 - RNA, 17 nt, Human herpesvirus 8 [Kaposi`s sarcoma-associated h
uaacccgcccucgggac

SEQ ID NO: 2151500 - RNA, 12 nt, Human herpesvirus 8 [Kaposi`s sarcoma-associated h
uuacuugcagca

SEQ ID NO: 2151501 - RNA, 22 nt, Human herpesvirus 8 [Kaposi`s sarcoma-associated h
cccugaaaugaucguccacgga

SEQ ID NO: 2151502 - RNA, 15 nt, Human herpesvirus 8 [Kaposi`s sarcoma-associated h
gcaacugaccauguu

SEQ ID NO: 2151503 - RNA, 16 nt, Human herpesvirus 8 [Kaposi`s sarcoma-associated h
uacguauuagacguac

SEQ ID NO: 2151504 - RNA, 23 nt, Human herpesvirus 8 [Kaposi`s sarcoma-associated h
cucaagcauugaguuugccgagc

SEQ ID NO: 2151505 - RNA, 13 nt, Human herpesvirus 8 [Kaposi`s sarcoma-associated h
gcucugcugccug

SEQ ID NO: 2151506 - RNA, 16 nt, Human herpesvirus 8 [Kaposi`s sarcoma-associated h
ggggaagucaugcuca

SEQ ID NO: 2151507 - RNA, 14 nt, Human herpesvirus 8 [Kaposi`s sarcoma-associated h
agaauggcgugcca

SEQ ID NO: 2151508 - RNA, 19 nt, Human herpesvirus 8 [Kaposi`s sarcoma-associated h
cuaacggguaacugcaugc

SEQ ID NO: 2151509 - RNA, 16 nt, Human herpesvirus 8 [Kaposi`s sarcoma-associated h
cacgcacuuggcccug

SEQ ID NO: 2151510 - RNA, 16 nt, Human herpesvirus 8 [Kaposi`s sarcoma-associated h
cugcccugguucuaau

SEQ ID NO: 2151511 - RNA, 18 nt, Human herpesvirus 8 [Kaposi`s sarcoma-associated h
ucccuucgugccccagcg

SEQ ID NO: 2151512 - RNA, 14 nt, Human herpesvirus 8 [Kaposi`s sarcoma-associated h
ggguggacagugcc

SEQ ID NO: 2151513 - RNA, 17 nt, Human herpesvirus 8 [Kaposi`s sarcoma-associated h
cgggacguuggcggcga

SEQ ID NO: 2151514 - RNA, 18 nt, Human herpesvirus 8 [Kaposi`s sarcoma-associated h
aggccaccauuccucucc

SEQ ID NO: 2151515 - RNA, 16 nt, Human herpesvirus 8 [Kaposi`s sarcoma-associated h
agggucgggugggacg

SEQ ID NO: 2151516 - RNA, 17 nt, Human herpesvirus 8 [Kaposi`s sarcoma-associated h
uaaaguacuuuuccaug

SEQ ID NO: 2151517 - RNA, 17 nt, Human herpesvirus 8 [Kaposi`s sarcoma-associated h
ccaggaugcggguuggg

SEQ ID NO: 2151518 - RNA, 15 nt, Human herpesvirus 8 [Kaposi`s sarcoma-associated h
gaccugucgaggaag

SEQ ID NO: 2151519 - RNA, 17 nt, Human herpesvirus 8 [Kaposi`s sarcoma-associated h
gaguccauggcagugga

SEQ ID NO: 2151520 - RNA, 11 nt, Human herpesvirus 8 [Kaposi`s sarcoma-associated h
ugagccagaau

SEQ ID NO: 2151521 - RNA, 17 nt, Human herpesvirus 8 [Kaposi`s sarcoma-associated h
ucuuagucuuacuguca

SEQ ID NO: 2151522 - RNA, 17 nt, Human herpesvirus 8 [Kaposi`s sarcoma-associated h
ccuagaaaguuuccucu

SEQ ID NO: 2151523 - RNA, 16 nt, Human herpesvirus 8 [Kaposi`s sarcoma-associated h
gcugaugaucgccacc

SEQ ID NO: 2151524 - RNA, 21 nt, Human herpesvirus 8 [Kaposi`s sarcoma-associated h
gacaccuauaauggucuguau

SEQ ID NO: 2151525 - RNA, 13 nt, Human herpesvirus 8 [Kaposi`s sarcoma-associated h
ccgugaugggcca

SEQ ID NO: 2151526 - RNA, 15 nt, Human herpesvirus 8 [Kaposi`s sarcoma-associated h
uggcugccuggacag

SEQ ID NO: 2151527 - RNA, 23 nt, Human herpesvirus 8 [Kaposi`s sarcoma-associated h
aagggccaagcuacuggccuggc

SEQ ID NO: 2151528 - RNA, 18 nt, Human herpesvirus 8 [Kaposi`s sarcoma-associated h
cucaugauuacagaguca

SEQ ID NO: 2151529 - RNA, 14 nt, Human herpesvirus 8 [Kaposi`s sarcoma-associated h
ggugcguugugaag

SEQ ID NO: 2151530 - RNA, 14 nt, Human herpesvirus 8 [Kaposi`s sarcoma-associated h
ucucgccuggagca

SEQ ID NO: 2151531 - RNA, 15 nt, Human herpesvirus 8 [Kaposi`s sarcoma-associated h
aaugcagcaguagac

SEQ ID NO: 2151532 - RNA, 22 nt, Human herpesvirus 8 [Kaposi`s sarcoma-associated h
caauauaacagcaacauguuua

SEQ ID NO: 2151533 - RNA, 20 nt, Human herpesvirus 8 [Kaposi`s sarcoma-associated h
gacaaaugugugggugggaa

SEQ ID NO: 2151534 - RNA, 15 nt, Human herpesvirus 8 [Kaposi`s sarcoma-associated h
acguuagcuucagcu

SEQ ID NO: 2151535 - RNA, 19 nt, Human herpesvirus 8 [Kaposi`s sarcoma-associated h
auagacuuaaaaugucucg

SEQ ID NO: 2151536 - RNA, 22 nt, Human herpesvirus 8 [Kaposi`s sarcoma-associated h
cacaguguaucccccacaggac

SEQ ID NO: 2151537 - RNA, 22 nt, Human herpesvirus 8 [Kaposi`s sarcoma-associated h
cacagagucuacgugccagugg

SEQ ID NO: 2151538 - RNA, 18 nt, Human herpesvirus 8 [Kaposi`s sarcoma-associated h
agguucacuugggagcug

SEQ ID NO: 2151539 - RNA, 13 nt, Human herpesvirus 8 [Kaposi`s sarcoma-associated h
gaucacggagccg

SEQ ID NO: 2151540 - RNA, 13 nt, Human herpesvirus 8 [Kaposi`s sarcoma-associated h
auacaugagagac

SEQ ID NO: 2151541 - RNA, 15 nt, Human herpesvirus 8 [Kaposi`s sarcoma-associated h
guuuaccugcacucc

SEQ ID NO: 2151542 - RNA, 14 nt, Human herpesvirus 8 [Kaposi`s sarcoma-associated h
gagaccucuguggc

SEQ ID NO: 2151543 - RNA, 18 nt, Human herpesvirus 8 [Kaposi`s sarcoma-associated h
uacacagccaauguuuuu

SEQ ID NO: 2151544 - RNA, 14 nt, Human herpesvirus 8 [Kaposi`s sarcoma-associated h
ucaggucugucacu

SEQ ID NO: 2151545 - RNA, 18 nt, Human herpesvirus 8 [Kaposi`s sarcoma-associated h
gaccccgauaugcaccuc

SEQ ID NO: 2151546 - RNA, 16 nt, Human herpesvirus 8 [Kaposi`s sarcoma-associated h
gaagcaguuucaggac

SEQ ID NO: 2151547 - RNA, 20 nt, Human herpesvirus 8 [Kaposi`s sarcoma-associated h
cacgacauuucgccaauuau

SEQ ID NO: 2151548 - RNA, 15 nt, Human herpesvirus 8 [Kaposi`s sarcoma-associated h
cuguugaaugugauc

SEQ ID NO: 2151549 - RNA, 14 nt, Human herpesvirus 8 [Kaposi`s sarcoma-associated h
cguccgacaugugc

SEQ ID NO: 2151550 - RNA, 12 nt, Human herpesvirus 8 [Kaposi`s sarcoma-associated h
cgggacuucugg

SEQ ID NO: 2151551 - RNA, 14 nt, Human herpesvirus 8 [Kaposi`s sarcoma-associated h
cagacgguccaaag

SEQ ID NO: 2151552 - RNA, 14 nt, Human herpesvirus 8 [Kaposi`s sarcoma-associated h
ugccugguggagca

SEQ ID NO: 2151553 - RNA, 15 nt, Human herpesvirus 8 [Kaposi`s sarcoma-associated h
guagacggggagcug

SEQ ID NO: 2151554 - RNA, 14 nt, Human herpesvirus 8 [Kaposi`s sarcoma-associated h
uacucaaaugggaa

SEQ ID NO: 2151555 - RNA, 19 nt, Human herpesvirus 8 [Kaposi`s sarcoma-associated h
gcagccagguaacaaagcc

SEQ ID NO: 2151556 - RNA, 20 nt, Human herpesvirus 8 [Kaposi`s sarcoma-associated h
agcgugucgcccgucacugg

SEQ ID NO: 2151557 - RNA, 17 nt, Human herpesvirus 8 [Kaposi`s sarcoma-associated h
cuagaauuggagcacuu

SEQ ID NO: 2151558 - RNA, 16 nt, Human herpesvirus 8 [Kaposi`s sarcoma-associated h
cgcggauaggcugggg

SEQ ID NO: 2151559 - RNA, 16 nt, Human herpesvirus 8 [Kaposi`s sarcoma-associated h
gucgccgaggaccuca

SEQ ID NO: 2151560 - RNA, 18 nt, Human herpesvirus 8 [Kaposi`s sarcoma-associated h
uaucaggcuagugcugua

SEQ ID NO: 2151561 - RNA, 17 nt, Human herpesvirus 8 [Kaposi`s sarcoma-associated h
aagaggacccagggugc

SEQ ID NO: 2151562 - RNA, 22 nt, Human herpesvirus 8 [Kaposi`s sarcoma-associated h
cacauuuccacccaccuacuuc

SEQ ID NO: 2151563 - RNA, 17 nt, Human herpesvirus 8 [Kaposi`s sarcoma-associated h
ggcgcagcagcugcuug

SEQ ID NO: 2151564 - RNA, 16 nt, Human herpesvirus 8 [Kaposi`s sarcoma-associated h
auaaagccgagccaca

SEQ ID NO: 2151565 - RNA, 13 nt, Human herpesvirus 8 [Kaposi`s sarcoma-associated h
uccucuugcgcua

SEQ ID NO: 2151566 - RNA, 16 nt, Human herpesvirus 8 [Kaposi`s sarcoma-associated h
acccuacuuagugaaa

SEQ ID NO: 2151567 - RNA, 22 nt, Human herpesvirus 8 [Kaposi`s sarcoma-associated h
gcaguggaccgcgagacaucag

SEQ ID NO: 2151568 - RNA, 15 nt, Human herpesvirus 8 [Kaposi`s sarcoma-associated h
uuauaacagugcucu

SEQ ID NO: 2151569 - RNA, 21 nt, Human herpesvirus 8 [Kaposi`s sarcoma-associated h
gcccugguucuaaucuuaguc

SEQ ID NO: 2151570 - RNA, 14 nt, Human herpesvirus 8 [Kaposi`s sarcoma-associated h
auuuuauggacauu

SEQ ID NO: 2151571 - RNA, 15 nt, Human herpesvirus 8 [Kaposi`s sarcoma-associated h
gagcgagugugccuc

SEQ ID NO: 2151572 - RNA, 15 nt, Human herpesvirus 8 [Kaposi`s sarcoma-associated h
auuaacauccacagg

SEQ ID NO: 2151573 - RNA, 22 nt, Human herpesvirus 8 [Kaposi`s sarcoma-associated h
cgcgguuguuuacgcagggugc

SEQ ID NO: 2151574 - RNA, 15 nt, Human herpesvirus 8 [Kaposi`s sarcoma-associated h
gaccugaugcaggcc

SEQ ID NO: 2151575 - RNA, 12 nt, Human herpesvirus 8 [Kaposi`s sarcoma-associated h
guggcaccugag

SEQ ID NO: 2151576 - RNA, 23 nt, Human herpesvirus 8 [Kaposi`s sarcoma-associated h
cgcuggaagagaauggagaggag

SEQ ID NO: 2151577 - RNA, 18 nt, Human herpesvirus 8 [Kaposi`s sarcoma-associated h
uagucagagucugaaccc

SEQ ID NO: 2151578 - RNA, 20 nt, Human herpesvirus 8 [Kaposi`s sarcoma-associated h
agaauggcgugccaguggag

SEQ ID NO: 2151579 - RNA, 17 nt, Human herpesvirus 8 [Kaposi`s sarcoma-associated h
cgaaugguaccauggca

SEQ ID NO: 2151580 - RNA, 20 nt, Human herpesvirus 8 [Kaposi`s sarcoma-associated h
cuaagaauccccuucucucu

SEQ ID NO: 2151581 - RNA, 17 nt, Human herpesvirus 8 [Kaposi`s sarcoma-associated h
gcacuauaaauaucauu

SEQ ID NO: 2151582 - RNA, 14 nt, Human herpesvirus 8 [Kaposi`s sarcoma-associated h
gaacaucagagaug

SEQ ID NO: 2151583 - RNA, 18 nt, Human herpesvirus 8 [Kaposi`s sarcoma-associated h
aucguugacauguggagc

SEQ ID NO: 2151584 - RNA, 15 nt, Human herpesvirus 8 [Kaposi`s sarcoma-associated h
ccagacugguccaag

SEQ ID NO: 2151585 - RNA, 13 nt, Human herpesvirus 8 [Kaposi`s sarcoma-associated h
uaguagucagagu

SEQ ID NO: 2151586 - RNA, 22 nt, Human herpesvirus 8 [Kaposi`s sarcoma-associated h
ugggcuucauuaugcaugcaau

SEQ ID NO: 2151587 - RNA, 14 nt, Human herpesvirus 8 [Kaposi`s sarcoma-associated h
uggauggggcaugg

SEQ ID NO: 2151588 - RNA, 18 nt, Human herpesvirus 8 [Kaposi`s sarcoma-associated h
ccaguagauuuaguacgu

SEQ ID NO: 2151589 - RNA, 20 nt, Human herpesvirus 8 [Kaposi`s sarcoma-associated h
caauagggauacuguuuaua

SEQ ID NO: 2151590 - RNA, 20 nt, Human herpesvirus 8 [Kaposi`s sarcoma-associated h
uuugaaggcgaauaaaacag

SEQ ID NO: 2151591 - RNA, 17 nt, Human herpesvirus 8 [Kaposi`s sarcoma-associated h
gcccuccugggccaggc

SEQ ID NO: 2151592 - RNA, 23 nt, Human herpesvirus 8 [Kaposi`s sarcoma-associated h
caacauguaaauuggccacugca

SEQ ID NO: 2151593 - RNA, 23 nt, Human herpesvirus 8 [Kaposi`s sarcoma-associated h
gugguagagaccgacgccaucaa

SEQ ID NO: 2151594 - RNA, 20 nt, Human herpesvirus 8 [Kaposi`s sarcoma-associated h
gugcucuucccacacccggc

SEQ ID NO: 2151595 - RNA, 15 nt, Human herpesvirus 8 [Kaposi`s sarcoma-associated h
ugagcgcugugcuuu

SEQ ID NO: 2151596 - RNA, 19 nt, Human herpesvirus 8 [Kaposi`s sarcoma-associated h
acaacuuguccggagcugc

SEQ ID NO: 2151597 - RNA, 13 nt, Human herpesvirus 8 [Kaposi`s sarcoma-associated h
guugacagggacg

SEQ ID NO: 2151598 - RNA, 12 nt, Human herpesvirus 8 [Kaposi`s sarcoma-associated h
auauaaugugaa

SEQ ID NO: 2151599 - RNA, 19 nt, Human herpesvirus 8 [Kaposi`s sarcoma-associated h
aaucuuuauugucuagaca

SEQ ID NO: 2151600 - RNA, 13 nt, Human herpesvirus 8 [Kaposi`s sarcoma-associated h
gcucccgugcguu

SEQ ID NO: 2151601 - RNA, 20 nt, Human herpesvirus 8 [Kaposi`s sarcoma-associated h
caggcgccuaugacuaggag

SEQ ID NO: 2151602 - RNA, 21 nt, Human herpesvirus 8 [Kaposi`s sarcoma-associated h
agaccccgauaugcaccucca

SEQ ID NO: 2151603 - RNA, 17 nt, Human herpesvirus 8 [Kaposi`s sarcoma-associated h
cagcugcagccaggaag

SEQ ID NO: 2151604 - RNA, 12 nt, Human herpesvirus 8 [Kaposi`s sarcoma-associated h
ccuucacagugc

SEQ ID NO: 2151605 - RNA, 20 nt, Human herpesvirus 8 [Kaposi`s sarcoma-associated h
accuguccaugucgcacacu

SEQ ID NO: 2151606 - RNA, 15 nt, Human herpesvirus 8 [Kaposi`s sarcoma-associated h
ccaggaaguucaaug

SEQ ID NO: 2151607 - RNA, 17 nt, Human herpesvirus 8 [Kaposi`s sarcoma-associated h
uucaagagggccaguuu

SEQ ID NO: 2151608 - RNA, 24 nt, Human herpesvirus 8 [Kaposi`s sarcoma-associated h
cugaagucccgaugccacuguugu

SEQ ID NO: 2151609 - RNA, 21 nt, Human herpesvirus 8 [Kaposi`s sarcoma-associated h
uggcccugauaugcauguguc

SEQ ID NO: 2151610 - RNA, 22 nt, Human herpesvirus 8 [Kaposi`s sarcoma-associated h
uauugcuuucaaauaaaacggu

SEQ ID NO: 2151611 - RNA, 20 nt, Human herpesvirus 8 [Kaposi`s sarcoma-associated h
ccacgcccgggggccaggac

SEQ ID NO: 2151612 - RNA, 12 nt, Human herpesvirus 8 [Kaposi`s sarcoma-associated h
aucggcuugcac

SEQ ID NO: 2151613 - RNA, 19 nt, Human herpesvirus 8 [Kaposi`s sarcoma-associated h
gucaugcacgguauagaga

SEQ ID NO: 2151614 - RNA, 23 nt, Human herpesvirus 8 [Kaposi`s sarcoma-associated h
uacauccaaauuaugcaguaucu

SEQ ID NO: 2151615 - RNA, 20 nt, Human herpesvirus 8 [Kaposi`s sarcoma-associated h
ccggaugcagggccuggccu

SEQ ID NO: 2151616 - RNA, 23 nt, Human herpesvirus 8 [Kaposi`s sarcoma-associated h
acauauugguauaugacuacugu

SEQ ID NO: 2151617 - RNA, 15 nt, Human herpesvirus 8 [Kaposi`s sarcoma-associated h
ccgacaaccggcugg

SEQ ID NO: 2151618 - RNA, 20 nt, Human herpesvirus 8 [Kaposi`s sarcoma-associated h
ccuucgcaccccauccaccg

SEQ ID NO: 2151619 - RNA, 17 nt, Human herpesvirus 8 [Kaposi`s sarcoma-associated h
acacuaaaagucuggcc

SEQ ID NO: 2151620 - RNA, 14 nt, Human herpesvirus 8 [Kaposi`s sarcoma-associated h
cgucgacagagcca

SEQ ID NO: 2151621 - RNA, 12 nt, Human herpesvirus 8 [Kaposi`s sarcoma-associated h
agugccuggcau

SEQ ID NO: 2151622 - RNA, 17 nt, Human herpesvirus 8 [Kaposi`s sarcoma-associated h
aggggcagacccaaaaa

SEQ ID NO: 2151623 - RNA, 16 nt, Human herpesvirus 8 [Kaposi`s sarcoma-associated h
acccacgccgucacag

SEQ ID NO: 2151624 - RNA, 23 nt, Human herpesvirus 8 [Kaposi`s sarcoma-associated h
gcagaagaccgcguccuccaccc

SEQ ID NO: 2151625 - RNA, 23 nt, Human herpesvirus 8 [Kaposi`s sarcoma-associated h
aucguaggccaauacugcccaag

SEQ ID NO: 2151626 - RNA, 16 nt, Human herpesvirus 8 [Kaposi`s sarcoma-associated h
cuguucucgccuggag

SEQ ID NO: 2151627 - RNA, 14 nt, Human herpesvirus 8 [Kaposi`s sarcoma-associated h
uacaugugucuauc

SEQ ID NO: 2151628 - RNA, 22 nt, Human herpesvirus 8 [Kaposi`s sarcoma-associated h
aaaaucuggcaugcugggauuu

SEQ ID NO: 2151629 - RNA, 21 nt, Human herpesvirus 8 [Kaposi`s sarcoma-associated h
cagccucacggacaacgccau

SEQ ID NO: 2151630 - RNA, 17 nt, Human herpesvirus 8 [Kaposi`s sarcoma-associated h
uuggcuguuacaauaaa

SEQ ID NO: 2151631 - RNA, 24 nt, Human herpesvirus 8 [Kaposi`s sarcoma-associated h
ucggauuuugauaugugugcccaa

SEQ ID NO: 2151632 - RNA, 21 nt, Human herpesvirus 8 [Kaposi`s sarcoma-associated h
gacgcggccauccgcgagcca

SEQ ID NO: 2151633 - RNA, 14 nt, Human herpesvirus 8 [Kaposi`s sarcoma-associated h
caauacugcccaag

SEQ ID NO: 2151634 - RNA, 17 nt, Human herpesvirus 8 [Kaposi`s sarcoma-associated h
cacagacgacugggcca

SEQ ID NO: 2151635 - RNA, 18 nt, Human herpesvirus 8 [Kaposi`s sarcoma-associated h
aucaaucugagaaaaguu

SEQ ID NO: 2151636 - RNA, 24 nt, Human herpesvirus 8 [Kaposi`s sarcoma-associated h
cagcgcgacggaaguuggccucca

SEQ ID NO: 2151637 - RNA, 20 nt, Human herpesvirus 8 [Kaposi`s sarcoma-associated h
uaacgagguuacugccagac

SEQ ID NO: 2151638 - RNA, 19 nt, Human herpesvirus 8 [Kaposi`s sarcoma-associated h
gccagaaagacacaugaga

SEQ ID NO: 2151639 - RNA, 22 nt, Human herpesvirus 8 [Kaposi`s sarcoma-associated h
gccuuggaagauauguugugcg

SEQ ID NO: 2151640 - RNA, 14 nt, Human herpesvirus 8 [Kaposi`s sarcoma-associated h
ggaggagggcaggu

SEQ ID NO: 2151641 - RNA, 13 nt, Human herpesvirus 8 [Kaposi`s sarcoma-associated h
cucccucacaaug

SEQ ID NO: 2151642 - RNA, 23 nt, Human herpesvirus 8 [Kaposi`s sarcoma-associated h
ccagcaauaaacccacagcccau

SEQ ID NO: 2151643 - RNA, 19 nt, Human herpesvirus 8 [Kaposi`s sarcoma-associated h
cguguguuuggugguguca

SEQ ID NO: 2151644 - RNA, 16 nt, Human herpesvirus 8 [Kaposi`s sarcoma-associated h
aaggucaccuggccca

SEQ ID NO: 2151645 - RNA, 23 nt, Human herpesvirus 8 [Kaposi`s sarcoma-associated h
uccgaggaucugugugugaagca

SEQ ID NO: 2151646 - RNA, 18 nt, Human herpesvirus 8 [Kaposi`s sarcoma-associated h
ugacucuguauuugggac

SEQ ID NO: 2151647 - RNA, 15 nt, Human herpesvirus 8 [Kaposi`s sarcoma-associated h
caauguacugccaug

SEQ ID NO: 2151648 - RNA, 14 nt, Human herpesvirus 8 [Kaposi`s sarcoma-associated h
uuggagaaacagug

SEQ ID NO: 2151649 - RNA, 15 nt, Human herpesvirus 8 [Kaposi`s sarcoma-associated h
gccaagcuacuggcc

SEQ ID NO: 2151650 - RNA, 14 nt, Human herpesvirus 8 [Kaposi`s sarcoma-associated h
aguacgugguaagg

SEQ ID NO: 2151651 - RNA, 20 nt, Human herpesvirus 8 [Kaposi`s sarcoma-associated h
auaugggcuuguacaugugu

SEQ ID NO: 2151652 - RNA, 20 nt, Human herpesvirus 8 [Kaposi`s sarcoma-associated h
ucuagcauaugcugccaaga

SEQ ID NO: 2151653 - RNA, 23 nt, Human herpesvirus 8 [Kaposi`s sarcoma-associated h
ucaaugggagaaccaaccucucc

SEQ ID NO: 2151654 - RNA, 18 nt, Human herpesvirus 8 [Kaposi`s sarcoma-associated h
acacuaaaagucuggccc

SEQ ID NO: 2151655 - RNA, 13 nt, Human herpesvirus 8 [Kaposi`s sarcoma-associated h
auagcgcucugcc

SEQ ID NO: 2151656 - RNA, 20 nt, Human herpesvirus 8 [Kaposi`s sarcoma-associated h
acauugaggaccuugucaca

SEQ ID NO: 2151657 - RNA, 19 nt, Human herpesvirus 8 [Kaposi`s sarcoma-associated h
acagucuguaaagaaagua

SEQ ID NO: 2151658 - RNA, 23 nt, Human herpesvirus 8 [Kaposi`s sarcoma-associated h
cuggacaaugggaucgaacagaa

SEQ ID NO: 2151659 - RNA, 20 nt, Human herpesvirus 8 [Kaposi`s sarcoma-associated h
gagucgccgguagcugccug

SEQ ID NO: 2151660 - RNA, 20 nt, Human herpesvirus 8 [Kaposi`s sarcoma-associated h
ggaucuucucauucagagac

SEQ ID NO: 2151661 - RNA, 17 nt, Human herpesvirus 8 [Kaposi`s sarcoma-associated h
cuaugggaaugugccua

SEQ ID NO: 2151662 - RNA, 22 nt, Human herpesvirus 8 [Kaposi`s sarcoma-associated h
cucugcggcuuuguuaccuggc

SEQ ID NO: 2151663 - RNA, 13 nt, Human herpesvirus 8 [Kaposi`s sarcoma-associated h
ggauccacucagg

SEQ ID NO: 2151664 - RNA, 22 nt, Human herpesvirus 8 [Kaposi`s sarcoma-associated h
cccagugaguccuggcccccgg

SEQ ID NO: 2151665 - RNA, 18 nt, Human herpesvirus 8 [Kaposi`s sarcoma-associated h
cagggugcggugcugccc

SEQ ID NO: 2151666 - RNA, 15 nt, Human herpesvirus 8 [Kaposi`s sarcoma-associated h
cauccuaggugacug

SEQ ID NO: 2151667 - RNA, 17 nt, Human herpesvirus 8 [Kaposi`s sarcoma-associated h
guagaggggguggaaaa

SEQ ID NO: 2151668 - RNA, 14 nt, Human herpesvirus 8 [Kaposi`s sarcoma-associated h
gcccuccugggcca

SEQ ID NO: 2151669 - RNA, 19 nt, Human herpesvirus 8 [Kaposi`s sarcoma-associated h
ugucgcaggccgaauaccu

SEQ ID NO: 2151670 - RNA, 14 nt, Human herpesvirus 8 [Kaposi`s sarcoma-associated h
agagacccugggcg

SEQ ID NO: 2151671 - RNA, 13 nt, Human herpesvirus 8 [Kaposi`s sarcoma-associated h
gccucugaagcac

SEQ ID NO: 2151672 - RNA, 21 nt, Human herpesvirus 8 [Kaposi`s sarcoma-associated h
cacagaaacucccccaaccuc

SEQ ID NO: 2151673 - RNA, 13 nt, Human herpesvirus 8 [Kaposi`s sarcoma-associated h
uggccgcauuugg

SEQ ID NO: 2151674 - RNA, 15 nt, Human herpesvirus 8 [Kaposi`s sarcoma-associated h
cgcugcgucucccuc

SEQ ID NO: 2151675 - RNA, 23 nt, Human herpesvirus 8 [Kaposi`s sarcoma-associated h
ugagggaguguuuuuugccaugg

SEQ ID NO: 2151676 - RNA, 14 nt, Human herpesvirus 8 [Kaposi`s sarcoma-associated h
cagguggaggcuug

SEQ ID NO: 2151677 - RNA, 18 nt, Human herpesvirus 8 [Kaposi`s sarcoma-associated h
gggcuguucucgccugga

SEQ ID NO: 2151678 - RNA, 17 nt, Human herpesvirus 8 [Kaposi`s sarcoma-associated h
auuuccugcugucuauc

SEQ ID NO: 2151679 - RNA, 17 nt, Human herpesvirus 8 [Kaposi`s sarcoma-associated h
ggacacugaacccuggg

SEQ ID NO: 2151680 - RNA, 20 nt, Human herpesvirus 8 [Kaposi`s sarcoma-associated h
caagcuugagcuuuucaaag

SEQ ID NO: 2151681 - RNA, 18 nt, Human herpesvirus 8 [Kaposi`s sarcoma-associated h
caaucuggauguguaucu

SEQ ID NO: 2151682 - RNA, 14 nt, Human herpesvirus 8 [Kaposi`s sarcoma-associated h
cacaucugcugucu

SEQ ID NO: 2151683 - RNA, 14 nt, Human herpesvirus 8 [Kaposi`s sarcoma-associated h
cauucccgguccca

SEQ ID NO: 2151684 - RNA, 21 nt, Human herpesvirus 8 [Kaposi`s sarcoma-associated h
ucaaccgucuccgccagggac

SEQ ID NO: 2151685 - RNA, 17 nt, Human herpesvirus 8 [Kaposi`s sarcoma-associated h
aggcaucggcagccucu

SEQ ID NO: 2151686 - RNA, 22 nt, Human herpesvirus 8 [Kaposi`s sarcoma-associated h
cgccuggagcagcgccagugga

SEQ ID NO: 2151687 - RNA, 18 nt, Human herpesvirus 8 [Kaposi`s sarcoma-associated h
aguggcugaucucagagg

SEQ ID NO: 2151688 - RNA, 16 nt, Human herpesvirus 8 [Kaposi`s sarcoma-associated h
gacuacgcucaccauc

SEQ ID NO: 2151689 - RNA, 22 nt, Human herpesvirus 8 [Kaposi`s sarcoma-associated h
uccucuaucagcugcagccagg

SEQ ID NO: 2151690 - RNA, 18 nt, Human herpesvirus 8 [Kaposi`s sarcoma-associated h
ugcuggaucccagugccu

SEQ ID NO: 2151691 - RNA, 13 nt, Human herpesvirus 8 [Kaposi`s sarcoma-associated h
gcuguggcaccaa

SEQ ID NO: 2151692 - RNA, 22 nt, Human herpesvirus 8 [Kaposi`s sarcoma-associated h
guagggcuuuacccucuggccu

SEQ ID NO: 2151693 - RNA, 15 nt, Human herpesvirus 8 [Kaposi`s sarcoma-associated h
ccacccagcuacugg

SEQ ID NO: 2151694 - RNA, 14 nt, Human herpesvirus 8 [Kaposi`s sarcoma-associated h
cccagcgacucuca

SEQ ID NO: 2151695 - RNA, 13 nt, Human herpesvirus 8 [Kaposi`s sarcoma-associated h
uccccaauuucag

SEQ ID NO: 2151696 - RNA, 14 nt, Human herpesvirus 8 [Kaposi`s sarcoma-associated h
cauccgcugccacc

SEQ ID NO: 2151697 - RNA, 21 nt, Human herpesvirus 8 [Kaposi`s sarcoma-associated h
aaagcagcgcccacuggugua

SEQ ID NO: 2151698 - RNA, 23 nt, Human herpesvirus 8 [Kaposi`s sarcoma-associated h
gcgccacucccaccauguugaag

SEQ ID NO: 2151699 - RNA, 14 nt, Human herpesvirus 8 [Kaposi`s sarcoma-associated h
ggagaacaugcugg

SEQ ID NO: 2151700 - RNA, 18 nt, Human herpesvirus 8 [Kaposi`s sarcoma-associated h
ugcaaagcuuaaccacau

SEQ ID NO: 2151701 - RNA, 20 nt, Human herpesvirus 8 [Kaposi`s sarcoma-associated h
cugugcccccuuaauccuua

SEQ ID NO: 2151702 - RNA, 13 nt, Human herpesvirus 8 [Kaposi`s sarcoma-associated h
auacaaaaacaca

SEQ ID NO: 2151703 - RNA, 21 nt, Human herpesvirus 8 [Kaposi`s sarcoma-associated h
auacgguguaggcauuuugua

SEQ ID NO: 2151704 - RNA, 22 nt, Human herpesvirus 8 [Kaposi`s sarcoma-associated h
gguggcucgcaugaauacccug

SEQ ID NO: 2151705 - RNA, 21 nt, Human herpesvirus 8 [Kaposi`s sarcoma-associated h
aggaacagauuauuuuccuuc

SEQ ID NO: 2151706 - RNA, 14 nt, Human herpesvirus 8 [Kaposi`s sarcoma-associated h
gccgggugaggcca

SEQ ID NO: 2151707 - RNA, 15 nt, Human herpesvirus 8 [Kaposi`s sarcoma-associated h
uaguucaacugcauu

SEQ ID NO: 2151708 - RNA, 13 nt, Human herpesvirus 8 [Kaposi`s sarcoma-associated h
caaggcgggccag

SEQ ID NO: 2151709 - RNA, 16 nt, Human herpesvirus 8 [Kaposi`s sarcoma-associated h
accugauacgccacgg

SEQ ID NO: 2151710 - RNA, 19 nt, Human herpesvirus 8 [Kaposi`s sarcoma-associated h
gauuugccccauggggauc

SEQ ID NO: 2151711 - RNA, 23 nt, Human herpesvirus 8 [Kaposi`s sarcoma-associated h
caucugcugucuaguggagaggg

SEQ ID NO: 2151712 - RNA, 17 nt, Human herpesvirus 8 [Kaposi`s sarcoma-associated h
gucacaguucagauggc

SEQ ID NO: 2151713 - RNA, 15 nt, Human herpesvirus 8 [Kaposi`s sarcoma-associated h
gcuuugcagccaggu

SEQ ID NO: 2151714 - RNA, 18 nt, Human herpesvirus 8 [Kaposi`s sarcoma-associated h
gcccuccugggccaggca

SEQ ID NO: 2151715 - RNA, 17 nt, Human herpesvirus 8 [Kaposi`s sarcoma-associated h
caaggcgcggacaggca

SEQ ID NO: 2151716 - RNA, 12 nt, Human herpesvirus 8 [Kaposi`s sarcoma-associated h
uggcaugcuggg

SEQ ID NO: 2151717 - RNA, 20 nt, Human herpesvirus 8 [Kaposi`s sarcoma-associated h
gaaacuggguguaagcugua

SEQ ID NO: 2151718 - RNA, 13 nt, Human herpesvirus 8 [Kaposi`s sarcoma-associated h
ccuaucgcacaga

SEQ ID NO: 2151719 - RNA, 19 nt, Human herpesvirus 8 [Kaposi`s sarcoma-associated h
uggcagcuuggugaagcag

SEQ ID NO: 2151720 - RNA, 19 nt, Human herpesvirus 8 [Kaposi`s sarcoma-associated h
auacaaacaacauaaacau

SEQ ID NO: 2151721 - RNA, 16 nt, Human herpesvirus 8 [Kaposi`s sarcoma-associated h
cccgugcccaggccgc

SEQ ID NO: 2151722 - RNA, 19 nt, Human herpesvirus 8 [Kaposi`s sarcoma-associated h
gcgcguaugggaacacaau

SEQ ID NO: 2151723 - RNA, 14 nt, Human herpesvirus 8 [Kaposi`s sarcoma-associated h
aacagaagacccag

SEQ ID NO: 2151724 - RNA, 17 nt, Human herpesvirus 8 [Kaposi`s sarcoma-associated h
gcggcuaggcacccgga

SEQ ID NO: 2151725 - RNA, 15 nt, Human herpesvirus 8 [Kaposi`s sarcoma-associated h
uaccucccuuugucu

SEQ ID NO: 2151726 - RNA, 18 nt, Human herpesvirus 8 [Kaposi`s sarcoma-associated h
gccucgagggcggccagu

SEQ ID NO: 2151727 - RNA, 15 nt, Human herpesvirus 8 [Kaposi`s sarcoma-associated h
cagcgaaaccccccu

SEQ ID NO: 2151728 - RNA, 16 nt, Human herpesvirus 8 [Kaposi`s sarcoma-associated h
cccgugauccaggagc

SEQ ID NO: 2151729 - RNA, 20 nt, Human herpesvirus 8 [Kaposi`s sarcoma-associated h
uuggaguuaaagcugucacu

SEQ ID NO: 2151730 - RNA, 21 nt, Human herpesvirus 8 [Kaposi`s sarcoma-associated h
ugucacaaauuuuaacagcca

SEQ ID NO: 2151731 - RNA, 14 nt, Human herpesvirus 8 [Kaposi`s sarcoma-associated h
gcaguggacacagu

SEQ ID NO: 2151732 - RNA, 21 nt, Human herpesvirus 8 [Kaposi`s sarcoma-associated h
aggaagugucgggaggcaugu

SEQ ID NO: 2151733 - RNA, 23 nt, Human herpesvirus 8 [Kaposi`s sarcoma-associated h
ggacagcaacacccagcuagcag

SEQ ID NO: 2151734 - RNA, 22 nt, Human herpesvirus 8 [Kaposi`s sarcoma-associated h
cgccauuuuuguggcugccugg

SEQ ID NO: 2151735 - RNA, 17 nt, Human herpesvirus 8 [Kaposi`s sarcoma-associated h
acagugccugggugcug

SEQ ID NO: 2151736 - RNA, 20 nt, Human herpesvirus 8 [Kaposi`s sarcoma-associated h
ucuauccaagugcacacucg

SEQ ID NO: 2151737 - RNA, 18 nt, Human herpesvirus 8 [Kaposi`s sarcoma-associated h
gcucgagaacugucgaga

SEQ ID NO: 2151738 - RNA, 21 nt, Human herpesvirus 8 [Kaposi`s sarcoma-associated h
cugcagcuggacuggagucag

SEQ ID NO: 2151739 - RNA, 21 nt, Human herpesvirus 8 [Kaposi`s sarcoma-associated h
uccacagagccuaccccaacu

SEQ ID NO: 2151740 - RNA, 20 nt, Human herpesvirus 8 [Kaposi`s sarcoma-associated h
gcgcaggagucagagcagug

SEQ ID NO: 2151741 - RNA, 15 nt, Human herpesvirus 8 [Kaposi`s sarcoma-associated h
gcugcagccaggaag

SEQ ID NO: 2151742 - RNA, 15 nt, Human herpesvirus 8 [Kaposi`s sarcoma-associated h
ccaugagccucccuu

SEQ ID NO: 2151743 - RNA, 16 nt, Human herpesvirus 8 [Kaposi`s sarcoma-associated h
agccucuguacaugga

SEQ ID NO: 2151744 - RNA, 18 nt, Human herpesvirus 8 [Kaposi`s sarcoma-associated h
gcggggacguucaccgug

SEQ ID NO: 2151745 - RNA, 16 nt, Human herpesvirus 8 [Kaposi`s sarcoma-associated h
augggucaugcgucgc

SEQ ID NO: 2151746 - RNA, 17 nt, Human herpesvirus 8 [Kaposi`s sarcoma-associated h
cgucuugaccucuccgg

SEQ ID NO: 2151747 - RNA, 20 nt, Human herpesvirus 8 [Kaposi`s sarcoma-associated h
ugggccaugacaacugccac

SEQ ID NO: 2151748 - RNA, 13 nt, Human herpesvirus 8 [Kaposi`s sarcoma-associated h
gguuacugccaga

SEQ ID NO: 2151749 - RNA, 18 nt, Human herpesvirus 8 [Kaposi`s sarcoma-associated h
caagcagcaaacggagac

SEQ ID NO: 2151750 - RNA, 16 nt, Human herpesvirus 8 [Kaposi`s sarcoma-associated h
cgacagagccagccug

SEQ ID NO: 2151751 - RNA, 13 nt, Human herpesvirus 8 [Kaposi`s sarcoma-associated h
gucccacugcugc

SEQ ID NO: 2151752 - RNA, 13 nt, Human herpesvirus 8 [Kaposi`s sarcoma-associated h
ccuggugaggaag

SEQ ID NO: 2151753 - RNA, 17 nt, Human herpesvirus 8 [Kaposi`s sarcoma-associated h
ugagagacugcaggcca

SEQ ID NO: 2151754 - RNA, 17 nt, Human herpesvirus 8 [Kaposi`s sarcoma-associated h
gcucaucggacaggacg

SEQ ID NO: 2151755 - RNA, 20 nt, Human herpesvirus 8 [Kaposi`s sarcoma-associated h
cgaacagguugccauggaga

SEQ ID NO: 2151756 - RNA, 13 nt, Human herpesvirus 8 [Kaposi`s sarcoma-associated h
agucuucuuguca

SEQ ID NO: 2151757 - RNA, 21 nt, Human herpesvirus 8 [Kaposi`s sarcoma-associated h
ucgcugcaccuggaccccgcg

SEQ ID NO: 2151758 - RNA, 18 nt, Human herpesvirus 8 [Kaposi`s sarcoma-associated h
cucgccucccaacaugua

SEQ ID NO: 2151759 - RNA, 18 nt, Human herpesvirus 8 [Kaposi`s sarcoma-associated h
gcggggacggggggugag

SEQ ID NO: 2151760 - RNA, 22 nt, Human herpesvirus 8 [Kaposi`s sarcoma-associated h
uugcaccaagcacaacauuaaa

SEQ ID NO: 2151761 - RNA, 20 nt, Human herpesvirus 8 [Kaposi`s sarcoma-associated h
agguuguaacacaaaagcaa

SEQ ID NO: 2151762 - RNA, 23 nt, Human herpesvirus 8 [Kaposi`s sarcoma-associated h
guuuauaaugccaauauaucagc

SEQ ID NO: 2151763 - RNA, 17 nt, Human herpesvirus 8 [Kaposi`s sarcoma-associated h
cuuccauuuuccaaggc

SEQ ID NO: 2151764 - RNA, 16 nt, Human herpesvirus 8 [Kaposi`s sarcoma-associated h
gcaccuuaaacacaac

SEQ ID NO: 2151765 - RNA, 15 nt, Human herpesvirus 8 [Kaposi`s sarcoma-associated h
cuguaugacugcccu

SEQ ID NO: 2151766 - RNA, 21 nt, Human herpesvirus 8 [Kaposi`s sarcoma-associated h
acgcagacccggcaacacugg

SEQ ID NO: 2151767 - RNA, 13 nt, Human herpesvirus 8 [Kaposi`s sarcoma-associated h
guggacaccacau

SEQ ID NO: 2151768 - RNA, 15 nt, Human herpesvirus 8 [Kaposi`s sarcoma-associated h
auaaaaugggccaug

SEQ ID NO: 2151769 - RNA, 14 nt, Human herpesvirus 8 [Kaposi`s sarcoma-associated h
cuaccgucuaccug

SEQ ID NO: 2151770 - RNA, 18 nt, Human herpesvirus 8 [Kaposi`s sarcoma-associated h
ugcuuccaauugaaggag

SEQ ID NO: 2151771 - RNA, 22 nt, Human herpesvirus 8 [Kaposi`s sarcoma-associated h
agggcggaaaaauaaauuuucc

SEQ ID NO: 2151772 - RNA, 15 nt, Human herpesvirus 8 [Kaposi`s sarcoma-associated h
ccuccugggccaggc

SEQ ID NO: 2151773 - RNA, 18 nt, Human herpesvirus 8 [Kaposi`s sarcoma-associated h
guggauuuccuuucugag

SEQ ID NO: 2151774 - RNA, 23 nt, Human herpesvirus 8 [Kaposi`s sarcoma-associated h
gaaaauggcacacgguuacuagc

SEQ ID NO: 2151775 - RNA, 17 nt, Human herpesvirus 8 [Kaposi`s sarcoma-associated h
acgccggcaucguggaa

SEQ ID NO: 2151776 - RNA, 20 nt, Human herpesvirus 8 [Kaposi`s sarcoma-associated h
cuuacugucagauuucucua

SEQ ID NO: 2151777 - RNA, 18 nt, Human herpesvirus 8 [Kaposi`s sarcoma-associated h
cgguaguugugcuuccug

SEQ ID NO: 2151778 - RNA, 13 nt, Human herpesvirus 8 [Kaposi`s sarcoma-associated h
ccagcaugccugc

SEQ ID NO: 2151779 - RNA, 12 nt, Human herpesvirus 8 [Kaposi`s sarcoma-associated h
ggugggugggga

SEQ ID NO: 2151780 - RNA, 18 nt, Human herpesvirus 8 [Kaposi`s sarcoma-associated h
ucagggugccggaguuca

SEQ ID NO: 2151781 - RNA, 20 nt, Human herpesvirus 8 [Kaposi`s sarcoma-associated h
uaacccgcuccgccacgcag

SEQ ID NO: 2151782 - RNA, 19 nt, Human herpesvirus 8 [Kaposi`s sarcoma-associated h
ccacauuucccccaucguc

SEQ ID NO: 2151783 - RNA, 14 nt, Human herpesvirus 8 [Kaposi`s sarcoma-associated h
caggcaucggcagc

SEQ ID NO: 2151784 - RNA, 19 nt, Human herpesvirus 8 [Kaposi`s sarcoma-associated h
uaaccagcuacgcacugag

SEQ ID NO: 2151785 - RNA, 20 nt, Human herpesvirus 8 [Kaposi`s sarcoma-associated h
acgggaggcuugguggccau

SEQ ID NO: 2151786 - RNA, 21 nt, Human herpesvirus 8 [Kaposi`s sarcoma-associated h
cacccaccuacuuccagggcc

SEQ ID NO: 2151787 - RNA, 15 nt, Human herpesvirus 8 [Kaposi`s sarcoma-associated h
uccugcauuuggaca

SEQ ID NO: 2151788 - RNA, 22 nt, Human herpesvirus 8 [Kaposi`s sarcoma-associated h
ggccagagguuugaggcgcuga

SEQ ID NO: 2151789 - RNA, 19 nt, Human herpesvirus 8 [Kaposi`s sarcoma-associated h
gaacuggccgcccuucagu

SEQ ID NO: 2151790 - RNA, 21 nt, Human herpesvirus 8 [Kaposi`s sarcoma-associated h
gggacuugauaaucuccugga

SEQ ID NO: 2151791 - RNA, 19 nt, Human herpesvirus 8 [Kaposi`s sarcoma-associated h
cgcggaccucaaagaagag

SEQ ID NO: 2151792 - RNA, 16 nt, Human herpesvirus 8 [Kaposi`s sarcoma-associated h
gacgaggaugaggaag

SEQ ID NO: 2151793 - RNA, 18 nt, Human herpesvirus 8 [Kaposi`s sarcoma-associated h
gaaaaucuggcaugcugg

SEQ ID NO: 2151794 - RNA, 18 nt, Human herpesvirus 8 [Kaposi`s sarcoma-associated h
ccgcaaggagcagccugc

SEQ ID NO: 2151795 - RNA, 10 nt, Human herpesvirus 8 [Kaposi`s sarcoma-associated h
gauuaagcaa

SEQ ID NO: 2151796 - RNA, 23 nt, Human herpesvirus 8 [Kaposi`s sarcoma-associated h
gcauccuaucgcacagacacgag

SEQ ID NO: 2151797 - RNA, 15 nt, Human herpesvirus 8 [Kaposi`s sarcoma-associated h
aacagaagacccaga

SEQ ID NO: 2151798 - RNA, 15 nt, Human herpesvirus 8 [Kaposi`s sarcoma-associated h
uuaagacaaacacug

SEQ ID NO: 2151799 - RNA, 21 nt, Human herpesvirus 8 [Kaposi`s sarcoma-associated h
cccacguggugcugccuagga

SEQ ID NO: 2151800 - RNA, 15 nt, Human herpesvirus 8 [Kaposi`s sarcoma-associated h
ucgcccgccugugug

SEQ ID NO: 2151801 - RNA, 19 nt, Human herpesvirus 8 [Kaposi`s sarcoma-associated h
agugcacacucgcuguccu

SEQ ID NO: 2151802 - RNA, 14 nt, Human herpesvirus 8 [Kaposi`s sarcoma-associated h
acauuaaacacaua

SEQ ID NO: 2151803 - RNA, 19 nt, Human herpesvirus 8 [Kaposi`s sarcoma-associated h
caaaccuggugaggaagca

SEQ ID NO: 2151804 - RNA, 21 nt, Human herpesvirus 8 [Kaposi`s sarcoma-associated h
gggaggcauguuuagggcucg

SEQ ID NO: 2151805 - RNA, 18 nt, Human herpesvirus 8 [Kaposi`s sarcoma-associated h
ccauggcagcccagccuc

SEQ ID NO: 2151806 - RNA, 23 nt, Human herpesvirus 8 [Kaposi`s sarcoma-associated h
ccagggaagaugaaggacacggg

SEQ ID NO: 2151807 - RNA, 17 nt, Human herpesvirus 8 [Kaposi`s sarcoma-associated h
gcuaacuugccggacag

SEQ ID NO: 2151808 - RNA, 23 nt, Human herpesvirus 8 [Kaposi`s sarcoma-associated h
gcgcagauuugugcggcgcagca

SEQ ID NO: 2151809 - RNA, 15 nt, Human herpesvirus 8 [Kaposi`s sarcoma-associated h
gacauguggagccac

SEQ ID NO: 2151810 - RNA, 23 nt, Human herpesvirus 8 [Kaposi`s sarcoma-associated h
ugacgggguaucgccgccagagg

SEQ ID NO: 2151811 - RNA, 20 nt, Human herpesvirus 8 [Kaposi`s sarcoma-associated h
uccucuaguuuucgggugau

SEQ ID NO: 2151812 - RNA, 12 nt, Human herpesvirus 8 [Kaposi`s sarcoma-associated h
gggugcacugag

SEQ ID NO: 2151813 - RNA, 15 nt, Human herpesvirus 8 [Kaposi`s sarcoma-associated h
cuuauaacagugcuc

SEQ ID NO: 2151814 - RNA, 12 nt, Human herpesvirus 8 [Kaposi`s sarcoma-associated h
cgcucugugccc

SEQ ID NO: 2151815 - RNA, 18 nt, Human herpesvirus 8 [Kaposi`s sarcoma-associated h
aguguuaucuuugcagug

SEQ ID NO: 2151816 - RNA, 12 nt, Human herpesvirus 8 [Kaposi`s sarcoma-associated h
cuuuuauugugg

SEQ ID NO: 2151817 - RNA, 14 nt, Human herpesvirus 8 [Kaposi`s sarcoma-associated h
caggccaagaucca

SEQ ID NO: 2151818 - RNA, 16 nt, Human herpesvirus 8 [Kaposi`s sarcoma-associated h
gucgcucuucaguuau

SEQ ID NO: 2151819 - RNA, 13 nt, Human herpesvirus 8 [Kaposi`s sarcoma-associated h
guucaucagccuc

SEQ ID NO: 2151820 - RNA, 17 nt, Human herpesvirus 8 [Kaposi`s sarcoma-associated h
gcugccacugccacgga

SEQ ID NO: 2151821 - RNA, 17 nt, Human herpesvirus 8 [Kaposi`s sarcoma-associated h
agcucaucaaugggaga

SEQ ID NO: 2151822 - RNA, 19 nt, Human herpesvirus 8 [Kaposi`s sarcoma-associated h
agggcaugaggcuggaccu

SEQ ID NO: 2151823 - RNA, 13 nt, Human herpesvirus 8 [Kaposi`s sarcoma-associated h
cgggcuacguggu

SEQ ID NO: 2151824 - RNA, 20 nt, Human herpesvirus 8 [Kaposi`s sarcoma-associated h
ccggaugcgggcgauuacag

SEQ ID NO: 2151825 - RNA, 15 nt, Human herpesvirus 8 [Kaposi`s sarcoma-associated h
ccauguucagguggu

SEQ ID NO: 2151826 - RNA, 20 nt, Human herpesvirus 8 [Kaposi`s sarcoma-associated h
agcugcugguucaggauuuc

SEQ ID NO: 2151827 - RNA, 15 nt, Human herpesvirus 8 [Kaposi`s sarcoma-associated h
cuuuuuaacuucuga

SEQ ID NO: 2151828 - RNA, 23 nt, Human herpesvirus 8 [Kaposi`s sarcoma-associated h
caacuauuuccuuuuuucaaaag

SEQ ID NO: 2151829 - RNA, 13 nt, Human herpesvirus 8 [Kaposi`s sarcoma-associated h
cugcugcagcugg

SEQ ID NO: 2151830 - RNA, 18 nt, Human herpesvirus 8 [Kaposi`s sarcoma-associated h
ucgcgacagacugccucc

SEQ ID NO: 2151831 - RNA, 16 nt, Human herpesvirus 8 [Kaposi`s sarcoma-associated h
gccacguggagccaac

SEQ ID NO: 2151832 - RNA, 13 nt, Human herpesvirus 8 [Kaposi`s sarcoma-associated h
guaucuuaaagcg

SEQ ID NO: 2151833 - RNA, 18 nt, Human herpesvirus 8 [Kaposi`s sarcoma-associated h
cccuuaucagcucacugu

SEQ ID NO: 2151834 - RNA, 21 nt, Human herpesvirus 8 [Kaposi`s sarcoma-associated h
cgccauuuuuguggcugccug

SEQ ID NO: 2151835 - RNA, 17 nt, Human herpesvirus 8 [Kaposi`s sarcoma-associated h
cuuaguuacgcagaccc

SEQ ID NO: 2151836 - RNA, 13 nt, Human herpesvirus 8 [Kaposi`s sarcoma-associated h
acccgagccacau

SEQ ID NO: 2151837 - RNA, 13 nt, Human herpesvirus 8 [Kaposi`s sarcoma-associated h
ccugucgaggaag

SEQ ID NO: 2151838 - RNA, 21 nt, Human herpesvirus 8 [Kaposi`s sarcoma-associated h
aagcgucugggucguggcgcc

SEQ ID NO: 2151839 - RNA, 22 nt, Human herpesvirus 8 [Kaposi`s sarcoma-associated h
ucgcgcgaacacguaccugacc

SEQ ID NO: 2151840 - RNA, 15 nt, Human herpesvirus 8 [Kaposi`s sarcoma-associated h
ggcugccuggacagu

SEQ ID NO: 2151841 - RNA, 15 nt, Human herpesvirus 8 [Kaposi`s sarcoma-associated h
agacgcgcaaagggg

SEQ ID NO: 2151842 - RNA, 15 nt, Human herpesvirus 8 [Kaposi`s sarcoma-associated h
auagugugcguuucu

SEQ ID NO: 2151843 - RNA, 16 nt, Human herpesvirus 8 [Kaposi`s sarcoma-associated h
caacgccaugcagcgg

SEQ ID NO: 2151844 - RNA, 17 nt, Human herpesvirus 8 [Kaposi`s sarcoma-associated h
acgagguugggaagagg

SEQ ID NO: 2151845 - RNA, 21 nt, Human herpesvirus 8 [Kaposi`s sarcoma-associated h
uacggaagggggcucccuggg

SEQ ID NO: 2151846 - RNA, 17 nt, Human herpesvirus 8 [Kaposi`s sarcoma-associated h
gccucucaucauuucug

SEQ ID NO: 2151847 - RNA, 13 nt, Human herpesvirus 8 [Kaposi`s sarcoma-associated h
guuuugcccugcc

SEQ ID NO: 2151848 - RNA, 18 nt, Human herpesvirus 8 [Kaposi`s sarcoma-associated h
ucgcccgucacuggaugu

SEQ ID NO: 2151849 - RNA, 14 nt, Human herpesvirus 8 [Kaposi`s sarcoma-associated h
gucugugcccugcg

SEQ ID NO: 2151850 - RNA, 24 nt, Human herpesvirus 8 [Kaposi`s sarcoma-associated h
gcccgccgcaaggagcagccugca

SEQ ID NO: 2151851 - RNA, 17 nt, Human herpesvirus 8 [Kaposi`s sarcoma-associated h
cagcagcaagcacagaa

SEQ ID NO: 2151852 - RNA, 14 nt, Human herpesvirus 8 [Kaposi`s sarcoma-associated h
augugacugaacau

SEQ ID NO: 2151853 - RNA, 18 nt, Human herpesvirus 8 [Kaposi`s sarcoma-associated h
uaauguguuuuauguuua

SEQ ID NO: 2151854 - RNA, 19 nt, Human herpesvirus 8 [Kaposi`s sarcoma-associated h
cgcugucccgugcccaggc

SEQ ID NO: 2151855 - RNA, 17 nt, Human herpesvirus 8 [Kaposi`s sarcoma-associated h
augcucaggucugucac

SEQ ID NO: 2151856 - RNA, 14 nt, Human herpesvirus 8 [Kaposi`s sarcoma-associated h
gagccuucacggca

SEQ ID NO: 2151857 - RNA, 15 nt, Human herpesvirus 8 [Kaposi`s sarcoma-associated h
cggugcugcccagga

SEQ ID NO: 2151858 - RNA, 14 nt, Human herpesvirus 8 [Kaposi`s sarcoma-associated h
cucgcuacacggag

SEQ ID NO: 2151859 - RNA, 16 nt, Human herpesvirus 8 [Kaposi`s sarcoma-associated h
auuaaagcacucggug

SEQ ID NO: 2151860 - RNA, 15 nt, Human herpesvirus 8 [Kaposi`s sarcoma-associated h
gccaacccucagugu

SEQ ID NO: 2151861 - RNA, 19 nt, Human herpesvirus 8 [Kaposi`s sarcoma-associated h
auguccugauuuuccaggg

SEQ ID NO: 2151862 - RNA, 12 nt, Human herpesvirus 8 [Kaposi`s sarcoma-associated h
ccccgugaaguu

SEQ ID NO: 2151863 - RNA, 15 nt, Human herpesvirus 8 [Kaposi`s sarcoma-associated h
aaagccgagccacaa

SEQ ID NO: 2151864 - RNA, 21 nt, Human herpesvirus 8 [Kaposi`s sarcoma-associated h
ccgucgccaaacaggcgcaga

SEQ ID NO: 2151865 - RNA, 16 nt, Human herpesvirus 8 [Kaposi`s sarcoma-associated h
ucacccgagccacauc

SEQ ID NO: 2151866 - RNA, 20 nt, Human herpesvirus 8 [Kaposi`s sarcoma-associated h
ccucuggccugugcccaaau

SEQ ID NO: 2151867 - RNA, 18 nt, Human herpesvirus 8 [Kaposi`s sarcoma-associated h
augcuagcgugucugaaa

SEQ ID NO: 2151868 - RNA, 17 nt, Human herpesvirus 8 [Kaposi`s sarcoma-associated h
ucaucguggugcccugc

SEQ ID NO: 2151869 - RNA, 13 nt, Human herpesvirus 8 [Kaposi`s sarcoma-associated h
uccugugggcuaa

SEQ ID NO: 2151870 - RNA, 17 nt, Human herpesvirus 8 [Kaposi`s sarcoma-associated h
accagcgguaaaggcgc

SEQ ID NO: 2151871 - RNA, 23 nt, Human herpesvirus 8 [Kaposi`s sarcoma-associated h
cagccacaucagcuuggcgaccu

SEQ ID NO: 2151872 - RNA, 22 nt, Human herpesvirus 8 [Kaposi`s sarcoma-associated h
aucucgaaaaaaauaaugcaga

SEQ ID NO: 2151873 - RNA, 20 nt, Human herpesvirus 8 [Kaposi`s sarcoma-associated h
gcgccucgcagacgaccccc

SEQ ID NO: 2151874 - RNA, 20 nt, Human herpesvirus 8 [Kaposi`s sarcoma-associated h
ugggagcggguugucuacau

SEQ ID NO: 2151875 - RNA, 20 nt, Human herpesvirus 8 [Kaposi`s sarcoma-associated h
cuuauugaagcauguugcgc

SEQ ID NO: 2151876 - RNA, 16 nt, Human herpesvirus 8 [Kaposi`s sarcoma-associated h
aagaaccaaaggacau

SEQ ID NO: 2151877 - RNA, 21 nt, Human herpesvirus 8 [Kaposi`s sarcoma-associated h
gugcguuugcagugugcagua

SEQ ID NO: 2151878 - RNA, 13 nt, Human herpesvirus 8 [Kaposi`s sarcoma-associated h
ccagcaaagcaca

SEQ ID NO: 2151879 - RNA, 13 nt, Human herpesvirus 8 [Kaposi`s sarcoma-associated h
acguggugcugcc

SEQ ID NO: 2151880 - RNA, 17 nt, Human herpesvirus 8 [Kaposi`s sarcoma-associated h
gugacggugacauugca

SEQ ID NO: 2151881 - RNA, 15 nt, Human herpesvirus 8 [Kaposi`s sarcoma-associated h
gcucugcgugcugga

SEQ ID NO: 2151882 - RNA, 17 nt, Human herpesvirus 8 [Kaposi`s sarcoma-associated h
cagggcacccuccccca

SEQ ID NO: 2151883 - RNA, 16 nt, Human herpesvirus 8 [Kaposi`s sarcoma-associated h
accggaguagugcaag

SEQ ID NO: 2151884 - RNA, 21 nt, Human herpesvirus 8 [Kaposi`s sarcoma-associated h
gcacggugaacguccccgcgu

SEQ ID NO: 2151885 - RNA, 17 nt, Human herpesvirus 8 [Kaposi`s sarcoma-associated h
ccgcguuagcagccaug

SEQ ID NO: 2151886 - RNA, 19 nt, Human herpesvirus 8 [Kaposi`s sarcoma-associated h
ccagcaauaaacccacagc

SEQ ID NO: 2151887 - RNA, 16 nt, Human herpesvirus 8 [Kaposi`s sarcoma-associated h
cucgcaugaauacccu

SEQ ID NO: 2151888 - RNA, 16 nt, Human herpesvirus 8 [Kaposi`s sarcoma-associated h
ucagaaaagggcaugu

SEQ ID NO: 2151889 - RNA, 21 nt, Human herpesvirus 8 [Kaposi`s sarcoma-associated h
caugccaucuuugggcuagug

SEQ ID NO: 2151890 - RNA, 20 nt, Human herpesvirus 8 [Kaposi`s sarcoma-associated h
cacccuauccaucagucagg

SEQ ID NO: 2151891 - RNA, 22 nt, Human herpesvirus 8 [Kaposi`s sarcoma-associated h
uccgucauucacccgagccaca

SEQ ID NO: 2151892 - RNA, 12 nt, Human herpesvirus 8 [Kaposi`s sarcoma-associated h
uugauugugacu

SEQ ID NO: 2151893 - RNA, 19 nt, Human herpesvirus 8 [Kaposi`s sarcoma-associated h
ugcuaggauucgugcagcc

SEQ ID NO: 2151894 - RNA, 21 nt, Human herpesvirus 8 [Kaposi`s sarcoma-associated h
caaugggaucgaacagaagac

SEQ ID NO: 2151895 - RNA, 18 nt, Human herpesvirus 8 [Kaposi`s sarcoma-associated h
uuggcguuuaccugcacu

SEQ ID NO: 2151896 - RNA, 18 nt, Human herpesvirus 8 [Kaposi`s sarcoma-associated h
cagaguccgccaucacca

SEQ ID NO: 2151897 - RNA, 20 nt, Human herpesvirus 8 [Kaposi`s sarcoma-associated h
caaagugagguggcauuugu

SEQ ID NO: 2151898 - RNA, 19 nt, Human herpesvirus 8 [Kaposi`s sarcoma-associated h
uugagaagcaguuucagga

SEQ ID NO: 2151899 - RNA, 21 nt, Human herpesvirus 8 [Kaposi`s sarcoma-associated h
gcugucuaguggagagggcca

SEQ ID NO: 2151900 - RNA, 23 nt, Human herpesvirus 8 [Kaposi`s sarcoma-associated h
aucuccggacuacauccaaauua

SEQ ID NO: 2151901 - RNA, 16 nt, Human herpesvirus 8 [Kaposi`s sarcoma-associated h
cacagucgagccgcca

SEQ ID NO: 2151902 - RNA, 16 nt, Human herpesvirus 8 [Kaposi`s sarcoma-associated h
cacgccauaccccugg

SEQ ID NO: 2151903 - RNA, 17 nt, Human herpesvirus 8 [Kaposi`s sarcoma-associated h
cagugaguccuggcccc

SEQ ID NO: 2151904 - RNA, 21 nt, Human herpesvirus 8 [Kaposi`s sarcoma-associated h
caguguaucccccacaggaca

SEQ ID NO: 2151905 - RNA, 20 nt, Human herpesvirus 8 [Kaposi`s sarcoma-associated h
uuggaugcucugcgugcugg

SEQ ID NO: 2151906 - RNA, 14 nt, Human herpesvirus 8 [Kaposi`s sarcoma-associated h
cuaugggugaccac

SEQ ID NO: 2151907 - RNA, 13 nt, Human herpesvirus 8 [Kaposi`s sarcoma-associated h
agccgccaggaac

SEQ ID NO: 2151908 - RNA, 19 nt, Human herpesvirus 8 [Kaposi`s sarcoma-associated h
agcauuuuaaaaugcguuu

SEQ ID NO: 2151909 - RNA, 15 nt, Human herpesvirus 8 [Kaposi`s sarcoma-associated h
ugggagcugucccac

SEQ ID NO: 2151910 - RNA, 20 nt, Human herpesvirus 8 [Kaposi`s sarcoma-associated h
gauuuugauaugugugccca

SEQ ID NO: 2151911 - RNA, 17 nt, Human herpesvirus 8 [Kaposi`s sarcoma-associated h
aacuaaacauuaccaau

SEQ ID NO: 2151912 - RNA, 16 nt, Human herpesvirus 8 [Kaposi`s sarcoma-associated h
gugucgccagugccug

SEQ ID NO: 2151913 - RNA, 14 nt, Human herpesvirus 8 [Kaposi`s sarcoma-associated h
aagccgagccacaa

SEQ ID NO: 2151914 - RNA, 21 nt, Human herpesvirus 8 [Kaposi`s sarcoma-associated h
aaauuguguguaccuagcccu

SEQ ID NO: 2151915 - RNA, 13 nt, Human herpesvirus 8 [Kaposi`s sarcoma-associated h
cuacgagguuggg

SEQ ID NO: 2151916 - RNA, 18 nt, Human herpesvirus 8 [Kaposi`s sarcoma-associated h
cucaaccggucgcagugg

SEQ ID NO: 2151917 - RNA, 13 nt, Human herpesvirus 8 [Kaposi`s sarcoma-associated h
uuccucuugcgcu

SEQ ID NO: 2151918 - RNA, 23 nt, Human herpesvirus 8 [Kaposi`s sarcoma-associated h
agggugccuuggacggacggcac

SEQ ID NO: 2151919 - RNA, 21 nt, Human herpesvirus 8 [Kaposi`s sarcoma-associated h
acugucuccagaagagcauuu

SEQ ID NO: 2151920 - RNA, 19 nt, Human herpesvirus 8 [Kaposi`s sarcoma-associated h
uacugugaaguuuacauua

SEQ ID NO: 2151921 - RNA, 20 nt, Human herpesvirus 8 [Kaposi`s sarcoma-associated h
cagcauggccuuuuuaagac

SEQ ID NO: 2151922 - RNA, 13 nt, Human herpesvirus 8 [Kaposi`s sarcoma-associated h
gugacccggccug

SEQ ID NO: 2151923 - RNA, 21 nt, Human herpesvirus 8 [Kaposi`s sarcoma-associated h
cggccgcaaucaugccugugg

SEQ ID NO: 2151924 - RNA, 15 nt, Human herpesvirus 8 [Kaposi`s sarcoma-associated h
ccagaaugaaggaca

SEQ ID NO: 2151925 - RNA, 19 nt, Human herpesvirus 8 [Kaposi`s sarcoma-associated h
cagggucucauccgcggca

SEQ ID NO: 2151926 - RNA, 17 nt, Human herpesvirus 8 [Kaposi`s sarcoma-associated h
aucacgccauaccccug

SEQ ID NO: 2151927 - RNA, 17 nt, Human herpesvirus 8 [Kaposi`s sarcoma-associated h
ucaucuacuuuggacag

SEQ ID NO: 2151928 - RNA, 14 nt, Human herpesvirus 8 [Kaposi`s sarcoma-associated h
gaggaaggaugugg

SEQ ID NO: 2151929 - RNA, 20 nt, Human herpesvirus 8 [Kaposi`s sarcoma-associated h
ugaaagcaggacguccaggc

SEQ ID NO: 2151930 - RNA, 14 nt, Human herpesvirus 8 [Kaposi`s sarcoma-associated h
acggaucaggcggg

SEQ ID NO: 2151931 - RNA, 20 nt, Human herpesvirus 8 [Kaposi`s sarcoma-associated h
gaggagggggugggggagac

SEQ ID NO: 2151932 - RNA, 20 nt, Human herpesvirus 8 [Kaposi`s sarcoma-associated h
caauacuuaagucccugaag

SEQ ID NO: 2151933 - RNA, 22 nt, Human herpesvirus 8 [Kaposi`s sarcoma-associated h
aagcacugggauccacugccga

SEQ ID NO: 2151934 - RNA, 20 nt, Human herpesvirus 8 [Kaposi`s sarcoma-associated h
uugccgagcccguuguggca

SEQ ID NO: 2151935 - RNA, 18 nt, Human herpesvirus 8 [Kaposi`s sarcoma-associated h
cuggccugugcccaaauc

SEQ ID NO: 2151936 - RNA, 18 nt, Human herpesvirus 8 [Kaposi`s sarcoma-associated h
uggccacccuggggacug

SEQ ID NO: 2151937 - RNA, 15 nt, Human herpesvirus 8 [Kaposi`s sarcoma-associated h
cuggucgguucacug

SEQ ID NO: 2151938 - RNA, 16 nt, Human herpesvirus 8 [Kaposi`s sarcoma-associated h
ugcaugcucggcaaca

SEQ ID NO: 2151939 - RNA, 20 nt, Human herpesvirus 8 [Kaposi`s sarcoma-associated h
gguuagggucgggugggacg

SEQ ID NO: 2151940 - RNA, 15 nt, Human herpesvirus 8 [Kaposi`s sarcoma-associated h
uaaugguguguuuau

SEQ ID NO: 2151941 - RNA, 21 nt, Human herpesvirus 8 [Kaposi`s sarcoma-associated h
cgcugccagucacgcacuugg

SEQ ID NO: 2151942 - RNA, 22 nt, Human herpesvirus 8 [Kaposi`s sarcoma-associated h
cuagcggcgagauuggaggcac

SEQ ID NO: 2151943 - RNA, 20 nt, Human herpesvirus 8 [Kaposi`s sarcoma-associated h
cugggccacaaaacugccaa

SEQ ID NO: 2151944 - RNA, 12 nt, Human herpesvirus 8 [Kaposi`s sarcoma-associated h
ugauuuuccagg

SEQ ID NO: 2151945 - RNA, 14 nt, Human herpesvirus 8 [Kaposi`s sarcoma-associated h
caccacgccacaac

SEQ ID NO: 2151946 - RNA, 15 nt, Human herpesvirus 8 [Kaposi`s sarcoma-associated h
auuggagcacuuuug

SEQ ID NO: 2151947 - RNA, 16 nt, Human herpesvirus 8 [Kaposi`s sarcoma-associated h
aaggacauuguauaac

SEQ ID NO: 2151948 - RNA, 18 nt, Human herpesvirus 8 [Kaposi`s sarcoma-associated h
augcucaucuacccugau

SEQ ID NO: 2151949 - RNA, 23 nt, Human herpesvirus 8 [Kaposi`s sarcoma-associated h
caacgaccugaugcaggccaccc

SEQ ID NO: 2151950 - RNA, 18 nt, Human herpesvirus 8 [Kaposi`s sarcoma-associated h
ccgugguucaucagccuc

SEQ ID NO: 2151951 - RNA, 20 nt, Human herpesvirus 8 [Kaposi`s sarcoma-associated h
agcacuccuguuagcacauu

SEQ ID NO: 2151952 - RNA, 14 nt, Human herpesvirus 8 [Kaposi`s sarcoma-associated h
caccuggcccaaac

SEQ ID NO: 2151953 - RNA, 23 nt, Human herpesvirus 8 [Kaposi`s sarcoma-associated h
ucguaggccaauacugcccaagu

SEQ ID NO: 2151954 - RNA, 14 nt, Human herpesvirus 8 [Kaposi`s sarcoma-associated h
ugcuucuguuugaa

SEQ ID NO: 2151955 - RNA, 14 nt, Human herpesvirus 8 [Kaposi`s sarcoma-associated h
cgcugcgcauggcu

SEQ ID NO: 2151956 - RNA, 11 nt, Human herpesvirus 8 [Kaposi`s sarcoma-associated h
caugugucuau

SEQ ID NO: 2151957 - RNA, 11 nt, Human herpesvirus 8 [Kaposi`s sarcoma-associated h
gggcaaaacac

SEQ ID NO: 2151958 - RNA, 15 nt, Human herpesvirus 8 [Kaposi`s sarcoma-associated h
cucuuggcuguuaca

SEQ ID NO: 2151959 - RNA, 22 nt, Human herpesvirus 8 [Kaposi`s sarcoma-associated h
cacauccccggauuccuccgca

SEQ ID NO: 2151960 - RNA, 21 nt, Human herpesvirus 8 [Kaposi`s sarcoma-associated h
ucagcaguguuugcugcugua

SEQ ID NO: 2151961 - RNA, 16 nt, Human herpesvirus 8 [Kaposi`s sarcoma-associated h
gguuuccuagccagau

SEQ ID NO: 2151962 - RNA, 16 nt, Human herpesvirus 8 [Kaposi`s sarcoma-associated h
cgacacgauguuuucc

SEQ ID NO: 2151963 - RNA, 20 nt, Human herpesvirus 8 [Kaposi`s sarcoma-associated h
uguguauccuagaaugaagu

SEQ ID NO: 2151964 - RNA, 12 nt, Human herpesvirus 8 [Kaposi`s sarcoma-associated h
uggcuguuacaa

SEQ ID NO: 2151965 - RNA, 17 nt, Human herpesvirus 8 [Kaposi`s sarcoma-associated h
acugugaaguuuacauu

SEQ ID NO: 2151966 - RNA, 20 nt, Human herpesvirus 8 [Kaposi`s sarcoma-associated h
gaagcggguuggacuggcag

SEQ ID NO: 2151967 - RNA, 16 nt, Human herpesvirus 8 [Kaposi`s sarcoma-associated h
gugcuuuaaugcggag

SEQ ID NO: 2151968 - RNA, 17 nt, Human herpesvirus 8 [Kaposi`s sarcoma-associated h
ccauuuuuuacggacaa

SEQ ID NO: 2151969 - RNA, 14 nt, Human herpesvirus 8 [Kaposi`s sarcoma-associated h
cuggaauggaucug

SEQ ID NO: 2151970 - RNA, 21 nt, Human herpesvirus 8 [Kaposi`s sarcoma-associated h
gcccaacucugcaagcuguug

SEQ ID NO: 2151971 - RNA, 15 nt, Human herpesvirus 8 [Kaposi`s sarcoma-associated h
aggaaugcauaugga

SEQ ID NO: 2151972 - RNA, 13 nt, Human herpesvirus 8 [Kaposi`s sarcoma-associated h
gacccuagucacu

SEQ ID NO: 2151973 - RNA, 17 nt, Human herpesvirus 8 [Kaposi`s sarcoma-associated h
guuucuaaagcacgcca

SEQ ID NO: 2151974 - RNA, 20 nt, Human herpesvirus 8 [Kaposi`s sarcoma-associated h
guccugauuuuccagggaca

SEQ ID NO: 2151975 - RNA, 19 nt, Human herpesvirus 8 [Kaposi`s sarcoma-associated h
aacaugcccuccugggcca

SEQ ID NO: 2151976 - RNA, 15 nt, Human herpesvirus 8 [Kaposi`s sarcoma-associated h
ugugguaagaaggaa

SEQ ID NO: 2151977 - RNA, 18 nt, Human herpesvirus 8 [Kaposi`s sarcoma-associated h
agucuaaggccagcgaga

SEQ ID NO: 2151978 - RNA, 16 nt, Human herpesvirus 8 [Kaposi`s sarcoma-associated h
gcuggagggcacagau

SEQ ID NO: 2151979 - RNA, 13 nt, Human herpesvirus 8 [Kaposi`s sarcoma-associated h
guggaccgugugu

SEQ ID NO: 2151980 - RNA, 16 nt, Human herpesvirus 8 [Kaposi`s sarcoma-associated h
cugaucucagaggccc

SEQ ID NO: 2151981 - RNA, 21 nt, Human herpesvirus 8 [Kaposi`s sarcoma-associated h
gucuagcacacacgaugaaga

SEQ ID NO: 2151982 - RNA, 14 nt, Human herpesvirus 8 [Kaposi`s sarcoma-associated h
cagagucugaaccc

SEQ ID NO: 2151983 - RNA, 15 nt, Human herpesvirus 8 [Kaposi`s sarcoma-associated h
uaugggcuuguacau

SEQ ID NO: 2151984 - RNA, 15 nt, Human herpesvirus 8 [Kaposi`s sarcoma-associated h
ccacauggcagcuga

SEQ ID NO: 2151985 - RNA, 17 nt, Human herpesvirus 8 [Kaposi`s sarcoma-associated h
cugacgacggucgccuc

SEQ ID NO: 2151986 - RNA, 17 nt, Human herpesvirus 8 [Kaposi`s sarcoma-associated h
uugcacucagaacauaa

SEQ ID NO: 2151987 - RNA, 20 nt, Human herpesvirus 8 [Kaposi`s sarcoma-associated h
gcggaggcccgagaaacacu

SEQ ID NO: 2151988 - RNA, 14 nt, Human herpesvirus 8 [Kaposi`s sarcoma-associated h
ucuuggcuguuaca

SEQ ID NO: 2151989 - RNA, 14 nt, Human herpesvirus 8 [Kaposi`s sarcoma-associated h
acgucccucuuggc

SEQ ID NO: 2151990 - RNA, 17 nt, Human herpesvirus 8 [Kaposi`s sarcoma-associated h
gagcgagugugccuccu

SEQ ID NO: 2151991 - RNA, 18 nt, Human herpesvirus 8 [Kaposi`s sarcoma-associated h
acaacuauguuuccuagc

SEQ ID NO: 2151992 - RNA, 17 nt, Human herpesvirus 8 [Kaposi`s sarcoma-associated h
uaaucuaaauauucucu

SEQ ID NO: 2151993 - RNA, 15 nt, Human herpesvirus 8 [Kaposi`s sarcoma-associated h
acacuuuacugugua

SEQ ID NO: 2151994 - RNA, 15 nt, Human herpesvirus 8 [Kaposi`s sarcoma-associated h
gagauggagaccccg

SEQ ID NO: 2151995 - RNA, 16 nt, Human herpesvirus 8 [Kaposi`s sarcoma-associated h
uuuagacugcgugcau

SEQ ID NO: 2151996 - RNA, 16 nt, Human herpesvirus 8 [Kaposi`s sarcoma-associated h
gacaccauucuuuuau

SEQ ID NO: 2151997 - RNA, 11 nt, Human herpesvirus 8 [Kaposi`s sarcoma-associated h
cugugcccaaa

SEQ ID NO: 2151998 - RNA, 17 nt, Human herpesvirus 8 [Kaposi`s sarcoma-associated h
cagagcagugcucccgu

SEQ ID NO: 2151999 - RNA, 19 nt, Human herpesvirus 8 [Kaposi`s sarcoma-associated h
aggucgcagagaccucuug

SEQ ID NO: 2152000 - RNA, 14 nt, Human herpesvirus 8 [Kaposi`s sarcoma-associated h
acauccgcugccac

SEQ ID NO: 2152001 - RNA, 18 nt, Human herpesvirus 8 [Kaposi`s sarcoma-associated h
auucggagaacaugcugg

SEQ ID NO: 2152002 - RNA, 15 nt, Human herpesvirus 8 [Kaposi`s sarcoma-associated h
uccccggcagcaccu

SEQ ID NO: 2152003 - RNA, 17 nt, Human herpesvirus 8 [Kaposi`s sarcoma-associated h
acacacggaaggcagug

SEQ ID NO: 2152004 - RNA, 16 nt, Human herpesvirus 8 [Kaposi`s sarcoma-associated h
aaaauguuuacugggu

SEQ ID NO: 2152005 - RNA, 16 nt, Human herpesvirus 8 [Kaposi`s sarcoma-associated h
aagcuuugcagccagg

SEQ ID NO: 2152006 - RNA, 17 nt, Human herpesvirus 8 [Kaposi`s sarcoma-associated h
auguaaauuggccacug

SEQ ID NO: 2152007 - RNA, 13 nt, Human herpesvirus 8 [Kaposi`s sarcoma-associated h
agugaccugcugu

SEQ ID NO: 2152008 - RNA, 21 nt, Human herpesvirus 8 [Kaposi`s sarcoma-associated h
ccuacgcguuaagaagccacu

SEQ ID NO: 2152009 - RNA, 14 nt, Human herpesvirus 8 [Kaposi`s sarcoma-associated h
cuccgccagggacg

SEQ ID NO: 2152010 - RNA, 17 nt, Human herpesvirus 8 [Kaposi`s sarcoma-associated h
cgugcaggucgcagaga

SEQ ID NO: 2152011 - RNA, 16 nt, Human herpesvirus 8 [Kaposi`s sarcoma-associated h
gaguauaucaggggaa

SEQ ID NO: 2152012 - RNA, 23 nt, Human herpesvirus 8 [Kaposi`s sarcoma-associated h
aguaagacaaacaugugggcuuc

SEQ ID NO: 2152013 - RNA, 15 nt, Human herpesvirus 8 [Kaposi`s sarcoma-associated h
aggaccuuucugcug

SEQ ID NO: 2152014 - RNA, 15 nt, Human herpesvirus 8 [Kaposi`s sarcoma-associated h
gcuagauuaaauuaa

SEQ ID NO: 2152015 - RNA, 16 nt, Human herpesvirus 8 [Kaposi`s sarcoma-associated h
aacaugcugccacugc

SEQ ID NO: 2152016 - RNA, 21 nt, Human herpesvirus 8 [Kaposi`s sarcoma-associated h
uuaacuucaccuccagacucu

SEQ ID NO: 2152017 - RNA, 16 nt, Human herpesvirus 8 [Kaposi`s sarcoma-associated h
cgugacacuacuaaug

SEQ ID NO: 2152018 - RNA, 23 nt, Human herpesvirus 8 [Kaposi`s sarcoma-associated h
gggccuuggaguuaaagcuguca

SEQ ID NO: 2152019 - RNA, 14 nt, Human herpesvirus 8 [Kaposi`s sarcoma-associated h
cgggcugcgccagc

SEQ ID NO: 2152020 - RNA, 19 nt, Human herpesvirus 8 [Kaposi`s sarcoma-associated h
cagauccuccacagagccu

SEQ ID NO: 2152021 - RNA, 12 nt, Human herpesvirus 8 [Kaposi`s sarcoma-associated h
cgcggaccucaa

SEQ ID NO: 2152022 - RNA, 23 nt, Human herpesvirus 8 [Kaposi`s sarcoma-associated h
guauuagaggguggacagugccu

SEQ ID NO: 2152023 - RNA, 16 nt, Human herpesvirus 8 [Kaposi`s sarcoma-associated h
ggcggguggcucacau

SEQ ID NO: 2152024 - RNA, 20 nt, Human herpesvirus 8 [Kaposi`s sarcoma-associated h
ugauuaaagggggugguauu

SEQ ID NO: 2152025 - RNA, 14 nt, Human herpesvirus 8 [Kaposi`s sarcoma-associated h
cgucuaccugccgg

SEQ ID NO: 2152026 - RNA, 15 nt, Human herpesvirus 8 [Kaposi`s sarcoma-associated h
cuugaggauggugcu

SEQ ID NO: 2152027 - RNA, 15 nt, Human herpesvirus 8 [Kaposi`s sarcoma-associated h
gucuuauaacagugc

SEQ ID NO: 2152028 - RNA, 17 nt, Human herpesvirus 8 [Kaposi`s sarcoma-associated h
uuccuuuuuucaaaagu

SEQ ID NO: 2152029 - RNA, 17 nt, Human herpesvirus 8 [Kaposi`s sarcoma-associated h
gugagagaccccgugau

SEQ ID NO: 2152030 - RNA, 20 nt, Human herpesvirus 8 [Kaposi`s sarcoma-associated h
acggugucguguaugccaau

SEQ ID NO: 2152031 - RNA, 14 nt, Human herpesvirus 8 [Kaposi`s sarcoma-associated h
caccgucuggcugg

SEQ ID NO: 2152032 - RNA, 18 nt, Human herpesvirus 8 [Kaposi`s sarcoma-associated h
ccagauaccccugcaccu

SEQ ID NO: 2152033 - RNA, 12 nt, Human herpesvirus 8 [Kaposi`s sarcoma-associated h
ccguggucauug

SEQ ID NO: 2152034 - RNA, 17 nt, Human herpesvirus 8 [Kaposi`s sarcoma-associated h
acaaucuggauguguau

SEQ ID NO: 2152035 - RNA, 19 nt, Human herpesvirus 8 [Kaposi`s sarcoma-associated h
acgccaggagcuagcuucc

SEQ ID NO: 2152036 - RNA, 19 nt, Human herpesvirus 8 [Kaposi`s sarcoma-associated h
uuaaguacauuaaaaggac

SEQ ID NO: 2152037 - RNA, 16 nt, Human herpesvirus 8 [Kaposi`s sarcoma-associated h
agcuuugcagccaggu

SEQ ID NO: 2152038 - RNA, 13 nt, Human herpesvirus 8 [Kaposi`s sarcoma-associated h
gcaccgcaagcag

SEQ ID NO: 2152039 - RNA, 16 nt, Human herpesvirus 8 [Kaposi`s sarcoma-associated h
ccugauaugcaugugu

SEQ ID NO: 2152040 - RNA, 24 nt, Human herpesvirus 8 [Kaposi`s sarcoma-associated h
gccucacggacaacgccaugcagc

SEQ ID NO: 2152041 - RNA, 18 nt, Human herpesvirus 8 [Kaposi`s sarcoma-associated h
auaagagcacacugugug

SEQ ID NO: 2152042 - RNA, 21 nt, Human herpesvirus 8 [Kaposi`s sarcoma-associated h
accagagcgacgcgggucuca

SEQ ID NO: 2152043 - RNA, 22 nt, Human herpesvirus 8 [Kaposi`s sarcoma-associated h
uccuuacuugguaacucccuca

SEQ ID NO: 2152044 - RNA, 20 nt, Human herpesvirus 8 [Kaposi`s sarcoma-associated h
uuagccugcaguguggggau

SEQ ID NO: 2152045 - RNA, 19 nt, Human herpesvirus 8 [Kaposi`s sarcoma-associated h
acagcccauaguauguaaa

SEQ ID NO: 2152046 - RNA, 15 nt, Human herpesvirus 8 [Kaposi`s sarcoma-associated h
ugcucagacagauuc

SEQ ID NO: 2152047 - RNA, 19 nt, Human herpesvirus 8 [Kaposi`s sarcoma-associated h
acauaaaacgaagcaaagu

SEQ ID NO: 2152048 - RNA, 11 nt, Human herpesvirus 8 [Kaposi`s sarcoma-associated h
ggcuguuacaa

SEQ ID NO: 2152049 - RNA, 11 nt, Human herpesvirus 8 [Kaposi`s sarcoma-associated h
ccgagccacaa

SEQ ID NO: 2152050 - RNA, 13 nt, Human herpesvirus 8 [Kaposi`s sarcoma-associated h
cuagacaauaaag

SEQ ID NO: 2152051 - RNA, 18 nt, Human herpesvirus 8 [Kaposi`s sarcoma-associated h
ccuuaagaaaguggauaa

SEQ ID NO: 2152052 - RNA, 17 nt, Human herpesvirus 8 [Kaposi`s sarcoma-associated h
ccacggcgcuguacagu

SEQ ID NO: 2152053 - RNA, 14 nt, Human herpesvirus 8 [Kaposi`s sarcoma-associated h
cugauuagcacugu

SEQ ID NO: 2152054 - RNA, 15 nt, Human herpesvirus 8 [Kaposi`s sarcoma-associated h
gcauaauaaaacaaa

SEQ ID NO: 2152055 - RNA, 17 nt, Human herpesvirus 8 [Kaposi`s sarcoma-associated h
acggccaccgagaagga

SEQ ID NO: 2152056 - RNA, 21 nt, Human herpesvirus 8 [Kaposi`s sarcoma-associated h
cggggagcgggguuuccaggg

SEQ ID NO: 2152057 - RNA, 18 nt, Human herpesvirus 8 [Kaposi`s sarcoma-associated h
uuauuaaaagcauugucu

SEQ ID NO: 2152058 - RNA, 15 nt, Human herpesvirus 8 [Kaposi`s sarcoma-associated h
cugugaaguuuacau

SEQ ID NO: 2152059 - RNA, 19 nt, Human herpesvirus 8 [Kaposi`s sarcoma-associated h
ccaauuaauuggagcucuu

SEQ ID NO: 2152060 - RNA, 22 nt, Human herpesvirus 8 [Kaposi`s sarcoma-associated h
ccucgucgacagagccagccug

SEQ ID NO: 2152061 - RNA, 23 nt, Human herpesvirus 8 [Kaposi`s sarcoma-associated h
agcaugccugcgcugcgcauggc

SEQ ID NO: 2152062 - RNA, 14 nt, Human herpesvirus 8 [Kaposi`s sarcoma-associated h
ugaccaacaggcug

SEQ ID NO: 2152063 - RNA, 19 nt, Human herpesvirus 8 [Kaposi`s sarcoma-associated h
gaacgccauggcccacggg

SEQ ID NO: 2152064 - RNA, 22 nt, Human herpesvirus 8 [Kaposi`s sarcoma-associated h
gcaccaagguaggccagcugcg

SEQ ID NO: 2152065 - RNA, 15 nt, Human herpesvirus 8 [Kaposi`s sarcoma-associated h
cgcggauaggcuggg

SEQ ID NO: 2152066 - RNA, 14 nt, Human herpesvirus 8 [Kaposi`s sarcoma-associated h
acuggaacgccaug

SEQ ID NO: 2152067 - RNA, 14 nt, Human herpesvirus 8 [Kaposi`s sarcoma-associated h
caccacaucugcug

SEQ ID NO: 2152068 - RNA, 19 nt, Human herpesvirus 8 [Kaposi`s sarcoma-associated h
cuucauucucuccacuaga

SEQ ID NO: 2152069 - RNA, 16 nt, Human herpesvirus 8 [Kaposi`s sarcoma-associated h
auggguuaacagugga

SEQ ID NO: 2152070 - RNA, 13 nt, Human herpesvirus 8 [Kaposi`s sarcoma-associated h
gaagagguggccg

SEQ ID NO: 2152071 - RNA, 23 nt, Human herpesvirus 8 [Kaposi`s sarcoma-associated h
gcgaugcauaucguugacaugug

SEQ ID NO: 2152072 - RNA, 15 nt, Human herpesvirus 8 [Kaposi`s sarcoma-associated h
acaacauauguuaaa

SEQ ID NO: 2152073 - RNA, 22 nt, Human herpesvirus 8 [Kaposi`s sarcoma-associated h
gaucuauuauuugucgcgccag

SEQ ID NO: 2152074 - RNA, 15 nt, Human herpesvirus 8 [Kaposi`s sarcoma-associated h
gcuucauuaugcaug

SEQ ID NO: 2152075 - RNA, 20 nt, Human herpesvirus 8 [Kaposi`s sarcoma-associated h
gccaggacccguaccacaag

SEQ ID NO: 2152076 - RNA, 19 nt, Human herpesvirus 8 [Kaposi`s sarcoma-associated h
ggaagaugaagaugaagaa

SEQ ID NO: 2152077 - RNA, 19 nt, Human herpesvirus 8 [Kaposi`s sarcoma-associated h
uccgcacagacgacugggc

SEQ ID NO: 2152078 - RNA, 14 nt, Human herpesvirus 8 [Kaposi`s sarcoma-associated h
ugaacagggcauga

SEQ ID NO: 2152079 - RNA, 19 nt, Human herpesvirus 8 [Kaposi`s sarcoma-associated h
ccaaacucgggaucggaaa

SEQ ID NO: 2152080 - RNA, 22 nt, Human herpesvirus 8 [Kaposi`s sarcoma-associated h
aggaccuuucugcugcaucacg

SEQ ID NO: 2152081 - RNA, 20 nt, Human herpesvirus 8 [Kaposi`s sarcoma-associated h
uagaugcgcuggaagagaau

SEQ ID NO: 2152082 - RNA, 23 nt, Human herpesvirus 8 [Kaposi`s sarcoma-associated h
gacagauguuagauagacccggc

SEQ ID NO: 2152083 - RNA, 14 nt, Human herpesvirus 8 [Kaposi`s sarcoma-associated h
ggcgagauuggagg

SEQ ID NO: 2152084 - RNA, 20 nt, Human herpesvirus 8 [Kaposi`s sarcoma-associated h
cacgguggcccugccuagug

SEQ ID NO: 2152085 - RNA, 13 nt, Human herpesvirus 8 [Kaposi`s sarcoma-associated h
uuaauuggagcuc

SEQ ID NO: 2152086 - RNA, 18 nt, Human herpesvirus 8 [Kaposi`s sarcoma-associated h
acuaguagucagagucug

SEQ ID NO: 2152087 - RNA, 22 nt, Human herpesvirus 8 [Kaposi`s sarcoma-associated h
guuuugcacuauaaauaucauu

SEQ ID NO: 2152088 - RNA, 18 nt, Human herpesvirus 8 [Kaposi`s sarcoma-associated h
accggaguagugcaagug

SEQ ID NO: 2152089 - RNA, 14 nt, Human herpesvirus 8 [Kaposi`s sarcoma-associated h
cagacaccaaagac

SEQ ID NO: 2152090 - RNA, 22 nt, Human herpesvirus 8 [Kaposi`s sarcoma-associated h
gucuguguuuuguaaacugaug

SEQ ID NO: 2152091 - RNA, 18 nt, Human herpesvirus 8 [Kaposi`s sarcoma-associated h
ucgcacguuagaaacccc

SEQ ID NO: 2152092 - RNA, 15 nt, Human herpesvirus 8 [Kaposi`s sarcoma-associated h
cacagauuguggcau

SEQ ID NO: 2152093 - RNA, 19 nt, Human herpesvirus 8 [Kaposi`s sarcoma-associated h
ggcgcgccugucgacaggc

SEQ ID NO: 2152094 - RNA, 19 nt, Human herpesvirus 8 [Kaposi`s sarcoma-associated h
ccagaguuuuaugggcuca

SEQ ID NO: 2152095 - RNA, 21 nt, Human herpesvirus 8 [Kaposi`s sarcoma-associated h
acauagugacuguagacaguu

SEQ ID NO: 2152096 - RNA, 15 nt, Human herpesvirus 8 [Kaposi`s sarcoma-associated h
acgcaggcgccuaug

SEQ ID NO: 2152097 - RNA, 23 nt, Human herpesvirus 8 [Kaposi`s sarcoma-associated h
gugcaggaaauagcccuggggga

SEQ ID NO: 2152098 - RNA, 15 nt, Human herpesvirus 8 [Kaposi`s sarcoma-associated h
aguccagccacggcc

SEQ ID NO: 2152099 - RNA, 21 nt, Human herpesvirus 8 [Kaposi`s sarcoma-associated h
cggcaacacuggacacuaaaa

SEQ ID NO: 2152100 - RNA, 12 nt, Human herpesvirus 8 [Kaposi`s sarcoma-associated h
ggcaugggcacc

SEQ ID NO: 2152101 - RNA, 16 nt, Human herpesvirus 8 [Kaposi`s sarcoma-associated h
aggacucacugggggu

SEQ ID NO: 2152102 - RNA, 19 nt, Human herpesvirus 8 [Kaposi`s sarcoma-associated h
guuguaaacuauauauaag

SEQ ID NO: 2152103 - RNA, 16 nt, Human herpesvirus 8 [Kaposi`s sarcoma-associated h
gccaggaaguucaaug

SEQ ID NO: 2152104 - RNA, 15 nt, Human herpesvirus 8 [Kaposi`s sarcoma-associated h
gucucccugcgugga

SEQ ID NO: 2152105 - RNA, 14 nt, Human herpesvirus 8 [Kaposi`s sarcoma-associated h
ccagugccucagca

SEQ ID NO: 2152106 - RNA, 23 nt, Human herpesvirus 8 [Kaposi`s sarcoma-associated h
ggcuguuacaauaaagccgagcc

SEQ ID NO: 2152107 - RNA, 17 nt, Human herpesvirus 8 [Kaposi`s sarcoma-associated h
caccauuccucuccgca

SEQ ID NO: 2152108 - RNA, 21 nt, Human herpesvirus 8 [Kaposi`s sarcoma-associated h
caugcucaucuacccugauua

SEQ ID NO: 2152109 - RNA, 14 nt, Human herpesvirus 8 [Kaposi`s sarcoma-associated h
uggcgugccagugg

SEQ ID NO: 2152110 - RNA, 12 nt, Human herpesvirus 8 [Kaposi`s sarcoma-associated h
ucucuucucuac

SEQ ID NO: 2152111 - RNA, 22 nt, Human herpesvirus 8 [Kaposi`s sarcoma-associated h
cgauagggggaugagccagaau

SEQ ID NO: 2152112 - RNA, 17 nt, Human herpesvirus 8 [Kaposi`s sarcoma-associated h
aagguaggccagcugcg

SEQ ID NO: 2152113 - RNA, 22 nt, Human herpesvirus 8 [Kaposi`s sarcoma-associated h
uggggcuacacaucauaaagua

SEQ ID NO: 2152114 - RNA, 16 nt, Human herpesvirus 8 [Kaposi`s sarcoma-associated h
caucucucacacccug

SEQ ID NO: 2152115 - RNA, 17 nt, Human herpesvirus 8 [Kaposi`s sarcoma-associated h
cugcuauuuuucaucug

SEQ ID NO: 2152116 - RNA, 14 nt, Human herpesvirus 8 [Kaposi`s sarcoma-associated h
caggagucagagca

SEQ ID NO: 2152117 - RNA, 19 nt, Human herpesvirus 8 [Kaposi`s sarcoma-associated h
ugggucuaucuggaaaaca

SEQ ID NO: 2152118 - RNA, 22 nt, Human herpesvirus 8 [Kaposi`s sarcoma-associated h
agcaaucggguuugauagcaga

SEQ ID NO: 2152119 - RNA, 22 nt, Human herpesvirus 8 [Kaposi`s sarcoma-associated h
agggaaguuucagagccuucac

SEQ ID NO: 2152120 - RNA, 13 nt, Human herpesvirus 8 [Kaposi`s sarcoma-associated h
acugaucacugcg

SEQ ID NO: 2152121 - RNA, 15 nt, Human herpesvirus 8 [Kaposi`s sarcoma-associated h
gauagacauggacau

SEQ ID NO: 2152122 - RNA, 19 nt, Human herpesvirus 8 [Kaposi`s sarcoma-associated h
gucuuuccgugucuccuug

SEQ ID NO: 2152123 - RNA, 20 nt, Human herpesvirus 8 [Kaposi`s sarcoma-associated h
accacauuuccacccaccua

SEQ ID NO: 2152124 - RNA, 16 nt, Human herpesvirus 8 [Kaposi`s sarcoma-associated h
cugugaagucucccug

SEQ ID NO: 2152125 - RNA, 21 nt, Human herpesvirus 8 [Kaposi`s sarcoma-associated h
gccauggcggggcggcugugg

SEQ ID NO: 2152126 - RNA, 16 nt, Human herpesvirus 8 [Kaposi`s sarcoma-associated h
cccaggccgccgacca

SEQ ID NO: 2152127 - RNA, 16 nt, Human herpesvirus 8 [Kaposi`s sarcoma-associated h
gcaaacuauacacaaa

SEQ ID NO: 2152128 - RNA, 17 nt, Human herpesvirus 8 [Kaposi`s sarcoma-associated h
cggagugccggcuggcc

SEQ ID NO: 2152129 - RNA, 19 nt, Human herpesvirus 8 [Kaposi`s sarcoma-associated h
uuggaguuaaagcugucac

SEQ ID NO: 2152130 - RNA, 14 nt, Human herpesvirus 8 [Kaposi`s sarcoma-associated h
agcaguguuugcug

SEQ ID NO: 2152131 - RNA, 13 nt, Human herpesvirus 8 [Kaposi`s sarcoma-associated h
gcguguugggaca

SEQ ID NO: 2152132 - RNA, 15 nt, Human herpesvirus 8 [Kaposi`s sarcoma-associated h
gugcgcgguguggca

SEQ ID NO: 2152133 - RNA, 21 nt, Human herpesvirus 8 [Kaposi`s sarcoma-associated h
ccagucacgcacuuggcccug

SEQ ID NO: 2152134 - RNA, 22 nt, Human herpesvirus 8 [Kaposi`s sarcoma-associated h
gaaucggugacuuuuugugaga

SEQ ID NO: 2152135 - RNA, 19 nt, Human herpesvirus 8 [Kaposi`s sarcoma-associated h
uuuaaaagacucuagauaa

SEQ ID NO: 2152136 - RNA, 15 nt, Human herpesvirus 8 [Kaposi`s sarcoma-associated h
guucccaugagccuc

SEQ ID NO: 2152137 - RNA, 20 nt, Human herpesvirus 8 [Kaposi`s sarcoma-associated h
caauauaacagcaacauguu

SEQ ID NO: 2152138 - RNA, 21 nt, Human herpesvirus 8 [Kaposi`s sarcoma-associated h
cggugaccacgcacuauagug

SEQ ID NO: 2152139 - RNA, 13 nt, Human herpesvirus 8 [Kaposi`s sarcoma-associated h
cgacaugugcuuu

SEQ ID NO: 2152140 - RNA, 22 nt, Human herpesvirus 8 [Kaposi`s sarcoma-associated h
uucccaaacacaucaguguccu

SEQ ID NO: 2152141 - RNA, 19 nt, Human herpesvirus 8 [Kaposi`s sarcoma-associated h
uugaggaagaucuaagccu

SEQ ID NO: 2152142 - RNA, 22 nt, Human herpesvirus 8 [Kaposi`s sarcoma-associated h
gaauguauguaucugauuuaau

SEQ ID NO: 2152143 - RNA, 19 nt, Human herpesvirus 8 [Kaposi`s sarcoma-associated h
cggaaguuggccuccagca

SEQ ID NO: 2152144 - RNA, 16 nt, Human herpesvirus 8 [Kaposi`s sarcoma-associated h
uucuuuauucugucaa

SEQ ID NO: 2152145 - RNA, 16 nt, Human herpesvirus 8 [Kaposi`s sarcoma-associated h
uuuacggacaauacug

SEQ ID NO: 2152146 - RNA, 20 nt, Human herpesvirus 8 [Kaposi`s sarcoma-associated h
cagacucuguguccuccucu

SEQ ID NO: 2152147 - RNA, 15 nt, Human herpesvirus 8 [Kaposi`s sarcoma-associated h
uagcagaguguccag

SEQ ID NO: 2152148 - RNA, 19 nt, Human herpesvirus 8 [Kaposi`s sarcoma-associated h
acgcugcaauguacugcca

SEQ ID NO: 2152149 - RNA, 22 nt, Human herpesvirus 8 [Kaposi`s sarcoma-associated h
uuacauuuucucgugugcccuu

SEQ ID NO: 2152150 - RNA, 23 nt, Human herpesvirus 8 [Kaposi`s sarcoma-associated h
augguaccauggcaaaaaacacu

SEQ ID NO: 2152151 - RNA, 14 nt, Human herpesvirus 8 [Kaposi`s sarcoma-associated h
gcuuugcagccagg

SEQ ID NO: 2152152 - RNA, 16 nt, Human herpesvirus 8 [Kaposi`s sarcoma-associated h
cuguuacaauaaagcc

SEQ ID NO: 2152153 - RNA, 14 nt, Human herpesvirus 8 [Kaposi`s sarcoma-associated h
ccaugaaagguggu

SEQ ID NO: 2152154 - RNA, 17 nt, Human herpesvirus 8 [Kaposi`s sarcoma-associated h
cucgcuguccuggagga

SEQ ID NO: 2152155 - RNA, 12 nt, Human herpesvirus 8 [Kaposi`s sarcoma-associated h
cgaagcaaagug

SEQ ID NO: 2152156 - RNA, 21 nt, Human herpesvirus 8 [Kaposi`s sarcoma-associated h
cuggugaggaagcaucugguc

SEQ ID NO: 2152157 - RNA, 16 nt, Human herpesvirus 8 [Kaposi`s sarcoma-associated h
cgccauuuuuguggcu

SEQ ID NO: 2152158 - RNA, 19 nt, Human herpesvirus 8 [Kaposi`s sarcoma-associated h
uagcacacacgaugaagag

SEQ ID NO: 2152159 - RNA, 14 nt, Human herpesvirus 8 [Kaposi`s sarcoma-associated h
auaacauuuuguaa

SEQ ID NO: 2152160 - RNA, 18 nt, Human herpesvirus 8 [Kaposi`s sarcoma-associated h
aagcggauugaguguaaa

SEQ ID NO: 2152161 - RNA, 14 nt, Human herpesvirus 8 [Kaposi`s sarcoma-associated h
ucuuuauugcuuuc

SEQ ID NO: 2152162 - RNA, 15 nt, Human herpesvirus 8 [Kaposi`s sarcoma-associated h
guucacuugggagcu

SEQ ID NO: 2152163 - RNA, 23 nt, Human herpesvirus 8 [Kaposi`s sarcoma-associated h
cagacgacaaaacgcacacgaau

SEQ ID NO: 2152164 - RNA, 17 nt, Human herpesvirus 8 [Kaposi`s sarcoma-associated h
auggccggcacgcggug

SEQ ID NO: 2152165 - RNA, 19 nt, Human herpesvirus 8 [Kaposi`s sarcoma-associated h
gggcgauucgaucccgcaa

SEQ ID NO: 2152166 - RNA, 19 nt, Human herpesvirus 8 [Kaposi`s sarcoma-associated h
gcgcaggagucagagcagu

SEQ ID NO: 2152167 - RNA, 11 nt, Human herpesvirus 8 [Kaposi`s sarcoma-associated h
gguugguggug

SEQ ID NO: 2152168 - RNA, 18 nt, Human herpesvirus 8 [Kaposi`s sarcoma-associated h
gcgcuguaugacugcccu

SEQ ID NO: 2152169 - RNA, 17 nt, Human herpesvirus 8 [Kaposi`s sarcoma-associated h
auacuuugcgugucuag

SEQ ID NO: 2152170 - RNA, 11 nt, Human herpesvirus 8 [Kaposi`s sarcoma-associated h
ucugguggugg

SEQ ID NO: 2152171 - RNA, 12 nt, Human herpesvirus 8 [Kaposi`s sarcoma-associated h
ggacaccacauu

SEQ ID NO: 2152172 - RNA, 22 nt, Human herpesvirus 8 [Kaposi`s sarcoma-associated h
cagacccggcaacacuggacac

SEQ ID NO: 2152173 - RNA, 18 nt, Human herpesvirus 8 [Kaposi`s sarcoma-associated h
gagagcuggagggcacag

SEQ ID NO: 2152174 - RNA, 15 nt, Human herpesvirus 8 [Kaposi`s sarcoma-associated h
guauaugacuacugu

SEQ ID NO: 2152175 - RNA, 15 nt, Human herpesvirus 8 [Kaposi`s sarcoma-associated h
cccggcaacacugga

SEQ ID NO: 2152176 - RNA, 16 nt, Human herpesvirus 8 [Kaposi`s sarcoma-associated h
cuguucuaccagguag

SEQ ID NO: 2152177 - RNA, 16 nt, Human herpesvirus 8 [Kaposi`s sarcoma-associated h
uguuaucuuugcagug

SEQ ID NO: 2152178 - RNA, 19 nt, Human herpesvirus 8 [Kaposi`s sarcoma-associated h
cugccuggacaguauucuc

SEQ ID NO: 2152179 - RNA, 15 nt, Human herpesvirus 8 [Kaposi`s sarcoma-associated h
cucaucauuucugaa

SEQ ID NO: 2152180 - RNA, 20 nt, Human herpesvirus 8 [Kaposi`s sarcoma-associated h
uaucuucaaggcccuguacu

SEQ ID NO: 2152181 - RNA, 19 nt, Human herpesvirus 8 [Kaposi`s sarcoma-associated h
uuaacaguggaugaccaac

SEQ ID NO: 2152182 - RNA, 13 nt, Human herpesvirus 8 [Kaposi`s sarcoma-associated h
uaaugcagacaga

SEQ ID NO: 2152183 - RNA, 20 nt, Human herpesvirus 8 [Kaposi`s sarcoma-associated h
acgcguuaucuccugcucau

SEQ ID NO: 2152184 - RNA, 18 nt, Human herpesvirus 8 [Kaposi`s sarcoma-associated h
gccugcguuaacuuccca

SEQ ID NO: 2152185 - RNA, 13 nt, Human herpesvirus 8 [Kaposi`s sarcoma-associated h
gcauuaaagcacu

SEQ ID NO: 2152186 - RNA, 19 nt, Human herpesvirus 8 [Kaposi`s sarcoma-associated h
ucugcgcgucagcaguguu

SEQ ID NO: 2152187 - RNA, 20 nt, Human herpesvirus 8 [Kaposi`s sarcoma-associated h
acauaauccccggcagcacc

SEQ ID NO: 2152188 - RNA, 18 nt, Human herpesvirus 8 [Kaposi`s sarcoma-associated h
ucaucgccgccgccaaac

SEQ ID NO: 2152189 - RNA, 19 nt, Human herpesvirus 8 [Kaposi`s sarcoma-associated h
uucauaccgggucugugcg

SEQ ID NO: 2152190 - RNA, 19 nt, Human herpesvirus 8 [Kaposi`s sarcoma-associated h
gcacaacauuaaacacaua

SEQ ID NO: 2152191 - RNA, 21 nt, Human herpesvirus 8 [Kaposi`s sarcoma-associated h
acccuuccuacccuacucccc

SEQ ID NO: 2152192 - RNA, 21 nt, Human herpesvirus 8 [Kaposi`s sarcoma-associated h
cgucugccgaagucagugcca

SEQ ID NO: 2152193 - RNA, 21 nt, Human herpesvirus 8 [Kaposi`s sarcoma-associated h
gucagguucacuugggagcug

SEQ ID NO: 2152194 - RNA, 17 nt, Human herpesvirus 8 [Kaposi`s sarcoma-associated h
uuacgguggugugccug

SEQ ID NO: 2152195 - RNA, 16 nt, Human herpesvirus 8 [Kaposi`s sarcoma-associated h
aagcacauuuugcacg

SEQ ID NO: 2152196 - RNA, 12 nt, Human herpesvirus 8 [Kaposi`s sarcoma-associated h
gcuggacccacg

SEQ ID NO: 2152197 - RNA, 22 nt, Human herpesvirus 8 [Kaposi`s sarcoma-associated h
accuaacugcguccgguggcaa

SEQ ID NO: 2152198 - RNA, 22 nt, Human herpesvirus 8 [Kaposi`s sarcoma-associated h
agaaggguggguggggaugggu

SEQ ID NO: 2152199 - RNA, 14 nt, Human herpesvirus 8 [Kaposi`s sarcoma-associated h
uaaaggagggauuu

SEQ ID NO: 2152200 - RNA, 17 nt, Human herpesvirus 8 [Kaposi`s sarcoma-associated h
auaaagcgcgaacaaga

SEQ ID NO: 2152201 - RNA, 13 nt, Human herpesvirus 8 [Kaposi`s sarcoma-associated h
cgguagcugccug

SEQ ID NO: 2152202 - RNA, 15 nt, Human herpesvirus 8 [Kaposi`s sarcoma-associated h
ucuguguccuccucu

SEQ ID NO: 2152203 - RNA, 13 nt, Human herpesvirus 8 [Kaposi`s sarcoma-associated h
gcugcagcuggac

SEQ ID NO: 2152204 - RNA, 19 nt, Human herpesvirus 8 [Kaposi`s sarcoma-associated h
ccugaagucccgaugccac

SEQ ID NO: 2152205 - RNA, 17 nt, Human herpesvirus 8 [Kaposi`s sarcoma-associated h
ggacaauugucggauuu

SEQ ID NO: 2152206 - RNA, 18 nt, Human herpesvirus 8 [Kaposi`s sarcoma-associated h
gccucccaacauguaaau

SEQ ID NO: 2152207 - RNA, 19 nt, Human herpesvirus 8 [Kaposi`s sarcoma-associated h
auugcaacugaccauguuc

SEQ ID NO: 2152208 - RNA, 14 nt, Human herpesvirus 8 [Kaposi`s sarcoma-associated h
agagaagagaccac

SEQ ID NO: 2152209 - RNA, 21 nt, Human herpesvirus 8 [Kaposi`s sarcoma-associated h
cugcaguuaucaacccuacuc

SEQ ID NO: 2152210 - RNA, 17 nt, Human herpesvirus 8 [Kaposi`s sarcoma-associated h
aucagcugcagccagga

SEQ ID NO: 2152211 - RNA, 19 nt, Human herpesvirus 8 [Kaposi`s sarcoma-associated h
aaagccugguccaggccuc

SEQ ID NO: 2152212 - RNA, 21 nt, Human herpesvirus 8 [Kaposi`s sarcoma-associated h
guguugguuacacuaaccaca

SEQ ID NO: 2152213 - RNA, 13 nt, Human herpesvirus 8 [Kaposi`s sarcoma-associated h
uuacauggaauac

SEQ ID NO: 2152214 - RNA, 22 nt, Human herpesvirus 8 [Kaposi`s sarcoma-associated h
acccguaccacaagggccaagc

SEQ ID NO: 2152215 - RNA, 19 nt, Human herpesvirus 8 [Kaposi`s sarcoma-associated h
uggccauucgcaccaggac

SEQ ID NO: 2152216 - RNA, 15 nt, Human herpesvirus 8 [Kaposi`s sarcoma-associated h
uggcucagacaccgu

SEQ ID NO: 2152217 - RNA, 18 nt, Human herpesvirus 8 [Kaposi`s sarcoma-associated h
cgcggugucaaccaggcc

SEQ ID NO: 2152218 - RNA, 18 nt, Human herpesvirus 8 [Kaposi`s sarcoma-associated h
uguuaucuuugcaguguc

SEQ ID NO: 2152219 - RNA, 17 nt, Human herpesvirus 8 [Kaposi`s sarcoma-associated h
gccaggcaccuguugga

SEQ ID NO: 2152220 - RNA, 13 nt, Human herpesvirus 8 [Kaposi`s sarcoma-associated h
gaagcgaaaagcc

SEQ ID NO: 2152221 - RNA, 22 nt, Human herpesvirus 8 [Kaposi`s sarcoma-associated h
uauuuauuuuuuacuacaggua

SEQ ID NO: 2152222 - RNA, 20 nt, Human herpesvirus 8 [Kaposi`s sarcoma-associated h
aggguuuauagaagagccug

SEQ ID NO: 2152223 - RNA, 16 nt, Human herpesvirus 8 [Kaposi`s sarcoma-associated h
cagaugaucccgccuu

SEQ ID NO: 2152224 - RNA, 12 nt, Human herpesvirus 8 [Kaposi`s sarcoma-associated h
ucuccugcucau

SEQ ID NO: 2152225 - RNA, 22 nt, Human herpesvirus 8 [Kaposi`s sarcoma-associated h
ugcggguugggucgcugcaccu

SEQ ID NO: 2152226 - RNA, 23 nt, Human herpesvirus 8 [Kaposi`s sarcoma-associated h
cugggacuugauaaucuccugga

SEQ ID NO: 2152227 - RNA, 19 nt, Human herpesvirus 8 [Kaposi`s sarcoma-associated h
cuuuggacaguuucuggag

SEQ ID NO: 2152228 - RNA, 15 nt, Human herpesvirus 8 [Kaposi`s sarcoma-associated h
ugacgcccugggugu

SEQ ID NO: 2152229 - RNA, 19 nt, Human herpesvirus 8 [Kaposi`s sarcoma-associated h
ugacuuuuuaaaggggacg

SEQ ID NO: 2152230 - RNA, 13 nt, Human herpesvirus 8 [Kaposi`s sarcoma-associated h
caugugggcuuca

SEQ ID NO: 2152231 - RNA, 17 nt, Human herpesvirus 8 [Kaposi`s sarcoma-associated h
gaagucucuuggacaag

SEQ ID NO: 2152232 - RNA, 17 nt, Human herpesvirus 8 [Kaposi`s sarcoma-associated h
gaucaacacuucguccc

SEQ ID NO: 2152233 - RNA, 16 nt, Human herpesvirus 8 [Kaposi`s sarcoma-associated h
gacagagccagccugg

SEQ ID NO: 2152234 - RNA, 23 nt, Human herpesvirus 8 [Kaposi`s sarcoma-associated h
cacuauauaaccuggcugccagg

SEQ ID NO: 2152235 - RNA, 14 nt, Human herpesvirus 8 [Kaposi`s sarcoma-associated h
ccagaggacagggu

SEQ ID NO: 2152236 - RNA, 16 nt, Human herpesvirus 8 [Kaposi`s sarcoma-associated h
accgucuaccugccgg

SEQ ID NO: 2152237 - RNA, 14 nt, Human herpesvirus 8 [Kaposi`s sarcoma-associated h
auuuaauaaacacu

SEQ ID NO: 2152238 - RNA, 22 nt, Human herpesvirus 8 [Kaposi`s sarcoma-associated h
gucaucucuaaucgaguacccc

SEQ ID NO: 2152239 - RNA, 23 nt, Human herpesvirus 8 [Kaposi`s sarcoma-associated h
auuuacgguggugugccuggugg

SEQ ID NO: 2152240 - RNA, 20 nt, Human herpesvirus 8 [Kaposi`s sarcoma-associated h
cuuggugugcugauguugua

SEQ ID NO: 2152241 - RNA, 15 nt, Human herpesvirus 8 [Kaposi`s sarcoma-associated h
gcuaaccaccacagu

SEQ ID NO: 2152242 - RNA, 13 nt, Human herpesvirus 8 [Kaposi`s sarcoma-associated h
aaucuccuggaga

SEQ ID NO: 2152243 - RNA, 19 nt, Human herpesvirus 8 [Kaposi`s sarcoma-associated h
caugcucucaccgcacccc

SEQ ID NO: 2152244 - RNA, 21 nt, Human herpesvirus 8 [Kaposi`s sarcoma-associated h
guuguagugguggcagaaaau

SEQ ID NO: 2152245 - RNA, 18 nt, Human herpesvirus 8 [Kaposi`s sarcoma-associated h
aauacccccaaaaugucc

SEQ ID NO: 2152246 - RNA, 14 nt, Human herpesvirus 8 [Kaposi`s sarcoma-associated h
auuaauaaccauga

SEQ ID NO: 2152247 - RNA, 16 nt, Human herpesvirus 8 [Kaposi`s sarcoma-associated h
accagacacugaggga

SEQ ID NO: 2152248 - RNA, 12 nt, Human herpesvirus 8 [Kaposi`s sarcoma-associated h
gguggcauuugu

SEQ ID NO: 2152249 - RNA, 18 nt, Human herpesvirus 8 [Kaposi`s sarcoma-associated h
gacuggugcgcacaggcc

SEQ ID NO: 2152250 - RNA, 22 nt, Human herpesvirus 8 [Kaposi`s sarcoma-associated h
guuagcgccaccguguggcugc

SEQ ID NO: 2152251 - RNA, 16 nt, Human herpesvirus 8 [Kaposi`s sarcoma-associated h
gaucacggagccggcc

SEQ ID NO: 2152252 - RNA, 20 nt, Human herpesvirus 8 [Kaposi`s sarcoma-associated h
auggcccacggggacaugga

SEQ ID NO: 2152253 - RNA, 14 nt, Human herpesvirus 8 [Kaposi`s sarcoma-associated h
gcucucgcugcuca

SEQ ID NO: 2152254 - RNA, 22 nt, Human herpesvirus 8 [Kaposi`s sarcoma-associated h
gcuugcacgccaacccucagug

SEQ ID NO: 2152255 - RNA, 22 nt, Human herpesvirus 8 [Kaposi`s sarcoma-associated h
ccgucugugaagucucccugcg

SEQ ID NO: 2152256 - RNA, 16 nt, Human herpesvirus 8 [Kaposi`s sarcoma-associated h
cugucuacagucacua

SEQ ID NO: 2152257 - RNA, 16 nt, Human herpesvirus 8 [Kaposi`s sarcoma-associated h
ccagaucacccagugu

SEQ ID NO: 2152258 - RNA, 13 nt, Human herpesvirus 8 [Kaposi`s sarcoma-associated h
agaaaacugucuc

SEQ ID NO: 2152259 - RNA, 15 nt, Human herpesvirus 8 [Kaposi`s sarcoma-associated h
ugagauagccacaua

SEQ ID NO: 2152260 - RNA, 19 nt, Human herpesvirus 8 [Kaposi`s sarcoma-associated h
uggggguuggguggggaga

SEQ ID NO: 2152261 - RNA, 19 nt, Human herpesvirus 8 [Kaposi`s sarcoma-associated h
cucccggaaacggacgcca

SEQ ID NO: 2152262 - RNA, 17 nt, Human herpesvirus 8 [Kaposi`s sarcoma-associated h
ugcgcgucagcaguguu

SEQ ID NO: 2152263 - RNA, 18 nt, Human herpesvirus 8 [Kaposi`s sarcoma-associated h
ggacucugguacgcaagg

SEQ ID NO: 2152264 - RNA, 17 nt, Human herpesvirus 8 [Kaposi`s sarcoma-associated h
ucggaaggcacaacucu

SEQ ID NO: 2152265 - RNA, 15 nt, Human herpesvirus 8 [Kaposi`s sarcoma-associated h
uggcagcccagccuc

SEQ ID NO: 2152266 - RNA, 22 nt, Human herpesvirus 8 [Kaposi`s sarcoma-associated h
augaaaaguguucccaaaaaac

SEQ ID NO: 2152267 - RNA, 16 nt, Human herpesvirus 8 [Kaposi`s sarcoma-associated h
gauaaucuccuggaga

SEQ ID NO: 2152268 - RNA, 14 nt, Human herpesvirus 8 [Kaposi`s sarcoma-associated h
gauacacuacuuau

SEQ ID NO: 2152269 - RNA, 14 nt, Human herpesvirus 8 [Kaposi`s sarcoma-associated h
acaugcugccacug

SEQ ID NO: 2152270 - RNA, 17 nt, Human herpesvirus 8 [Kaposi`s sarcoma-associated h
ugaguuccacacagauu

SEQ ID NO: 2152271 - RNA, 12 nt, Human herpesvirus 8 [Kaposi`s sarcoma-associated h
gagggaucccag

SEQ ID NO: 2152272 - RNA, 16 nt, Human herpesvirus 8 [Kaposi`s sarcoma-associated h
ccgucuccgccaggga

SEQ ID NO: 2152273 - RNA, 16 nt, Human herpesvirus 8 [Kaposi`s sarcoma-associated h
ucccacgaugggaacu

SEQ ID NO: 2152274 - RNA, 14 nt, Human herpesvirus 8 [Kaposi`s sarcoma-associated h
agauggguccguau

SEQ ID NO: 2152275 - RNA, 21 nt, Human herpesvirus 8 [Kaposi`s sarcoma-associated h
ggccaacaucaacaggagggc

SEQ ID NO: 2152276 - RNA, 19 nt, Human herpesvirus 8 [Kaposi`s sarcoma-associated h
cgugccuucgaggccaggc

SEQ ID NO: 2152277 - RNA, 23 nt, Human herpesvirus 8 [Kaposi`s sarcoma-associated h
ggagugcugaccacggcacagga

SEQ ID NO: 2152278 - RNA, 14 nt, Human herpesvirus 8 [Kaposi`s sarcoma-associated h
uaaacgacagcucg

SEQ ID NO: 2152279 - RNA, 15 nt, Human herpesvirus 8 [Kaposi`s sarcoma-associated h
aacaugcaacaagca

SEQ ID NO: 2152280 - RNA, 17 nt, Human herpesvirus 8 [Kaposi`s sarcoma-associated h
cugcccucaaauucuca

SEQ ID NO: 2152281 - RNA, 20 nt, Human herpesvirus 8 [Kaposi`s sarcoma-associated h
ugucugcguuccacaaacac

SEQ ID NO: 2152282 - RNA, 18 nt, Human herpesvirus 8 [Kaposi`s sarcoma-associated h
caggccaagauccaaccc

SEQ ID NO: 2152283 - RNA, 11 nt, Human herpesvirus 8 [Kaposi`s sarcoma-associated h
cggcagcaccu

SEQ ID NO: 2152284 - RNA, 21 nt, Human herpesvirus 8 [Kaposi`s sarcoma-associated h
ggccagagguuugaggcgcug

SEQ ID NO: 2152285 - RNA, 19 nt, Human herpesvirus 8 [Kaposi`s sarcoma-associated h
caaacuucggaauuuccua

SEQ ID NO: 2152286 - RNA, 16 nt, Human herpesvirus 8 [Kaposi`s sarcoma-associated h
gcugcagcuggacugg

SEQ ID NO: 2152287 - RNA, 16 nt, Human herpesvirus 8 [Kaposi`s sarcoma-associated h
aacaaggaaugcauau

SEQ ID NO: 2152288 - RNA, 21 nt, Human herpesvirus 8 [Kaposi`s sarcoma-associated h
cauuugcgugcaaaaugugcu

SEQ ID NO: 2152289 - RNA, 22 nt, Human herpesvirus 8 [Kaposi`s sarcoma-associated h
gccucccguucccaugaugcag

SEQ ID NO: 2152290 - RNA, 23 nt, Human herpesvirus 8 [Kaposi`s sarcoma-associated h
gaccacauaauuggauggggcau

SEQ ID NO: 2152291 - RNA, 17 nt, Human herpesvirus 8 [Kaposi`s sarcoma-associated h
gcgcagcuuuccuguga

SEQ ID NO: 2152292 - RNA, 19 nt, Human herpesvirus 8 [Kaposi`s sarcoma-associated h
aggaagcauccggacugag

SEQ ID NO: 2152293 - RNA, 20 nt, Human herpesvirus 8 [Kaposi`s sarcoma-associated h
acaucuguguacaaaccaaa

SEQ ID NO: 2152294 - RNA, 14 nt, Human herpesvirus 8 [Kaposi`s sarcoma-associated h
ucacuccauucccg

SEQ ID NO: 2152295 - RNA, 19 nt, Human herpesvirus 8 [Kaposi`s sarcoma-associated h
acuagaauuggagcacuuu

SEQ ID NO: 2152296 - RNA, 23 nt, Human herpesvirus 8 [Kaposi`s sarcoma-associated h
cccaguuaaccggcuuguacagu

SEQ ID NO: 2152297 - RNA, 23 nt, Human herpesvirus 8 [Kaposi`s sarcoma-associated h
caugucgcacacuuccaccuccc

SEQ ID NO: 2152298 - RNA, 16 nt, Human herpesvirus 8 [Kaposi`s sarcoma-associated h
ccaguguguuucugug

SEQ ID NO: 2152299 - RNA, 17 nt, Human herpesvirus 8 [Kaposi`s sarcoma-associated h
cacuagcagaaaacugu

SEQ ID NO: 2152300 - RNA, 17 nt, Human herpesvirus 8 [Kaposi`s sarcoma-associated h
cacucagguguuuucca

SEQ ID NO: 2152301 - RNA, 16 nt, Human herpesvirus 8 [Kaposi`s sarcoma-associated h
cacgucgcucuuuacu

SEQ ID NO: 2152302 - RNA, 17 nt, Human herpesvirus 8 [Kaposi`s sarcoma-associated h
cuggucgguucacugcu

SEQ ID NO: 2152303 - RNA, 17 nt, Human herpesvirus 8 [Kaposi`s sarcoma-associated h
gcgccacagucgagccg

SEQ ID NO: 2152304 - RNA, 13 nt, Human herpesvirus 8 [Kaposi`s sarcoma-associated h
gcgcggaccuguu

SEQ ID NO: 2152305 - RNA, 15 nt, Human herpesvirus 8 [Kaposi`s sarcoma-associated h
ucccagugccucagc

SEQ ID NO: 2152306 - RNA, 22 nt, Human herpesvirus 8 [Kaposi`s sarcoma-associated h
gcgagaauggcgugccagugga

SEQ ID NO: 2152307 - RNA, 18 nt, Human herpesvirus 8 [Kaposi`s sarcoma-associated h
ccagugccucagcaacug

SEQ ID NO: 2152308 - RNA, 15 nt, Human herpesvirus 8 [Kaposi`s sarcoma-associated h
gucuccgccagggac

SEQ ID NO: 2152309 - RNA, 16 nt, Human herpesvirus 8 [Kaposi`s sarcoma-associated h
cagagucuacgugcca

SEQ ID NO: 2152310 - RNA, 15 nt, Human herpesvirus 8 [Kaposi`s sarcoma-associated h
cgguggguggcuugg

SEQ ID NO: 2152311 - RNA, 20 nt, Human herpesvirus 8 [Kaposi`s sarcoma-associated h
cuauuugccguccuguggac

SEQ ID NO: 2152312 - RNA, 15 nt, Human herpesvirus 8 [Kaposi`s sarcoma-associated h
auuuuucaucugaaa

SEQ ID NO: 2152313 - RNA, 11 nt, Human herpesvirus 8 [Kaposi`s sarcoma-associated h
uguuuccugca

SEQ ID NO: 2152314 - RNA, 22 nt, Human herpesvirus 8 [Kaposi`s sarcoma-associated h
ucgagggcauacccguggcuca

SEQ ID NO: 2152315 - RNA, 21 nt, Human herpesvirus 8 [Kaposi`s sarcoma-associated h
uaacauaauuguaauguguuu

SEQ ID NO: 2152316 - RNA, 17 nt, Human herpesvirus 8 [Kaposi`s sarcoma-associated h
cagucgagccgccagga

SEQ ID NO: 2152317 - RNA, 19 nt, Human herpesvirus 8 [Kaposi`s sarcoma-associated h
uccuccuaaacguguucau

SEQ ID NO: 2152318 - RNA, 17 nt, Human herpesvirus 8 [Kaposi`s sarcoma-associated h
ucagagagacccugggc

SEQ ID NO: 2152319 - RNA, 19 nt, Human herpesvirus 8 [Kaposi`s sarcoma-associated h
cgauuucacugucacuuuc

SEQ ID NO: 2152320 - RNA, 20 nt, Human herpesvirus 8 [Kaposi`s sarcoma-associated h
cuuaacuguuuacugcuguu

SEQ ID NO: 2152321 - RNA, 19 nt, Human herpesvirus 8 [Kaposi`s sarcoma-associated h
accccagccccuugguucc

SEQ ID NO: 2152322 - RNA, 13 nt, Human herpesvirus 8 [Kaposi`s sarcoma-associated h
acuaaucaguguu

SEQ ID NO: 2152323 - RNA, 16 nt, Human herpesvirus 8 [Kaposi`s sarcoma-associated h
guuaugggugugugcc

SEQ ID NO: 2152324 - RNA, 17 nt, Human herpesvirus 8 [Kaposi`s sarcoma-associated h
acggccaguuauaugca

SEQ ID NO: 2152325 - RNA, 20 nt, Human herpesvirus 8 [Kaposi`s sarcoma-associated h
auuaaacgacaaagugauuc

SEQ ID NO: 2152326 - RNA, 17 nt, Human herpesvirus 8 [Kaposi`s sarcoma-associated h
gaucucuggagacggcc

SEQ ID NO: 2152327 - RNA, 21 nt, Human herpesvirus 8 [Kaposi`s sarcoma-associated h
auggccuccacccaccaagcu

SEQ ID NO: 2152328 - RNA, 12 nt, Human herpesvirus 8 [Kaposi`s sarcoma-associated h
guuugagucuuu

SEQ ID NO: 2152329 - RNA, 22 nt, Human herpesvirus 8 [Kaposi`s sarcoma-associated h
uacaagcgaucacgacggauuu

SEQ ID NO: 2152330 - RNA, 19 nt, Human herpesvirus 8 [Kaposi`s sarcoma-associated h
ccuaggugggugugcauuu

SEQ ID NO: 2152331 - RNA, 19 nt, Human herpesvirus 8 [Kaposi`s sarcoma-associated h
agcguuggcuagucauggc

SEQ ID NO: 2152332 - RNA, 18 nt, Human herpesvirus 8 [Kaposi`s sarcoma-associated h
auuagugacauacaugag

SEQ ID NO: 2152333 - RNA, 13 nt, Human herpesvirus 8 [Kaposi`s sarcoma-associated h
ccucgcaagcuug

SEQ ID NO: 2152334 - RNA, 23 nt, Human herpesvirus 8 [Kaposi`s sarcoma-associated h
ccacuacggucccguugucccuc

SEQ ID NO: 2152335 - RNA, 18 nt, Human herpesvirus 8 [Kaposi`s sarcoma-associated h
cccgacaaccggcugggg

SEQ ID NO: 2152336 - RNA, 19 nt, Human herpesvirus 8 [Kaposi`s sarcoma-associated h
auuggaggcacauaaggaa

SEQ ID NO: 2152337 - RNA, 15 nt, Human herpesvirus 8 [Kaposi`s sarcoma-associated h
uguuuauaacaauga

SEQ ID NO: 2152338 - RNA, 18 nt, Human herpesvirus 8 [Kaposi`s sarcoma-associated h
ggauagugucuggcuggc

SEQ ID NO: 2152339 - RNA, 21 nt, Human herpesvirus 8 [Kaposi`s sarcoma-associated h
augucucgugacggugacauu

SEQ ID NO: 2152340 - RNA, 10 nt, Human herpesvirus 8 [Kaposi`s sarcoma-associated h
aaugugacaa

SEQ ID NO: 2152341 - RNA, 19 nt, Human herpesvirus 8 [Kaposi`s sarcoma-associated h
cugcaauguacugccauga

SEQ ID NO: 2152342 - RNA, 21 nt, Human herpesvirus 8 [Kaposi`s sarcoma-associated h
cuuugcagugucuaugucugu

SEQ ID NO: 2152343 - RNA, 16 nt, Human herpesvirus 8 [Kaposi`s sarcoma-associated h
ccaaggccugugccca

SEQ ID NO: 2152344 - RNA, 23 nt, Human herpesvirus 8 [Kaposi`s sarcoma-associated h
acgcugucccgugcccaggccgc

SEQ ID NO: 2152345 - RNA, 19 nt, Human herpesvirus 8 [Kaposi`s sarcoma-associated h
aggugccgucgucgagcac

SEQ ID NO: 2152346 - RNA, 20 nt, Human herpesvirus 8 [Kaposi`s sarcoma-associated h
cagcagcugcuuggcgccca

SEQ ID NO: 2152347 - RNA, 18 nt, Human herpesvirus 8 [Kaposi`s sarcoma-associated h
ccggaugcagggccuggc

SEQ ID NO: 2152348 - RNA, 21 nt, Human herpesvirus 8 [Kaposi`s sarcoma-associated h
ggugucaagucucaugcuuua

SEQ ID NO: 2152349 - RNA, 15 nt, Human herpesvirus 8 [Kaposi`s sarcoma-associated h
agcuauaggacagaa

SEQ ID NO: 2152350 - RNA, 19 nt, Human herpesvirus 8 [Kaposi`s sarcoma-associated h
cagcacauaugucucccuu

SEQ ID NO: 2152351 - RNA, 15 nt, Human herpesvirus 8 [Kaposi`s sarcoma-associated h
uaagauaaucuaaau

SEQ ID NO: 2152352 - RNA, 16 nt, Human herpesvirus 8 [Kaposi`s sarcoma-associated h
aacuuuauuacaggua

SEQ ID NO: 2152353 - RNA, 18 nt, Human herpesvirus 8 [Kaposi`s sarcoma-associated h
caggucgcagagaccucu

SEQ ID NO: 2152354 - RNA, 20 nt, Human herpesvirus 8 [Kaposi`s sarcoma-associated h
ugcgauagggggaugagcca

SEQ ID NO: 2152355 - RNA, 16 nt, Human herpesvirus 8 [Kaposi`s sarcoma-associated h
caucguggugcccugc

SEQ ID NO: 2152356 - RNA, 23 nt, Human herpesvirus 8 [Kaposi`s sarcoma-associated h
guccccaauuucaguacuccuuc

SEQ ID NO: 2152357 - RNA, 15 nt, Human herpesvirus 8 [Kaposi`s sarcoma-associated h
cggaugacagggaag

SEQ ID NO: 2152358 - RNA, 20 nt, Human herpesvirus 8 [Kaposi`s sarcoma-associated h
gaccuaaccgcaaagauaag

SEQ ID NO: 2152359 - RNA, 18 nt, Human herpesvirus 8 [Kaposi`s sarcoma-associated h
cugguggaacaugcugcc

SEQ ID NO: 2152360 - RNA, 14 nt, Human herpesvirus 8 [Kaposi`s sarcoma-associated h
gccagauccuccac

SEQ ID NO: 2152361 - RNA, 23 nt, Human herpesvirus 8 [Kaposi`s sarcoma-associated h
gaacggacaauucugagaaagau

SEQ ID NO: 2152362 - RNA, 15 nt, Human herpesvirus 8 [Kaposi`s sarcoma-associated h
gcucucgcugcucag

SEQ ID NO: 2152363 - RNA, 17 nt, Human herpesvirus 8 [Kaposi`s sarcoma-associated h
cagggcagcgugucgcc

SEQ ID NO: 2152364 - RNA, 18 nt, Human herpesvirus 8 [Kaposi`s sarcoma-associated h
uaaagagggaucccaggc

SEQ ID NO: 2152365 - RNA, 18 nt, Human herpesvirus 8 [Kaposi`s sarcoma-associated h
ugccauggagaauaucca

SEQ ID NO: 2152366 - RNA, 12 nt, Human herpesvirus 8 [Kaposi`s sarcoma-associated h
acuuacagcaug

SEQ ID NO: 2152367 - RNA, 15 nt, Human herpesvirus 8 [Kaposi`s sarcoma-associated h
cuacggaucaugcuc

SEQ ID NO: 2152368 - RNA, 20 nt, Human herpesvirus 8 [Kaposi`s sarcoma-associated h
gccugcguuaacuucccagg

SEQ ID NO: 2152369 - RNA, 17 nt, Human herpesvirus 8 [Kaposi`s sarcoma-associated h
uguaaaacacuguuugg

SEQ ID NO: 2152370 - RNA, 22 nt, Human herpesvirus 8 [Kaposi`s sarcoma-associated h
gccuucgcaaguuuaucucaga

SEQ ID NO: 2152371 - RNA, 21 nt, Human herpesvirus 8 [Kaposi`s sarcoma-associated h
cuacgaaaaucuggcaugcug

SEQ ID NO: 2152372 - RNA, 18 nt, Human herpesvirus 8 [Kaposi`s sarcoma-associated h
augcucaggucugucacu

SEQ ID NO: 2152373 - RNA, 20 nt, Human herpesvirus 8 [Kaposi`s sarcoma-associated h
gucgccgguagcugccuggu

SEQ ID NO: 2152374 - RNA, 21 nt, Human herpesvirus 8 [Kaposi`s sarcoma-associated h
gagggcuccucgucuguguca

SEQ ID NO: 2152375 - RNA, 17 nt, Human herpesvirus 8 [Kaposi`s sarcoma-associated h
ggucucucuugcugguc

SEQ ID NO: 2152376 - RNA, 18 nt, Human herpesvirus 8 [Kaposi`s sarcoma-associated h
gaaacaaagcacuggcug

SEQ ID NO: 2152377 - RNA, 23 nt, Human herpesvirus 8 [Kaposi`s sarcoma-associated h
gccaggaacacgcgaaugcagca

SEQ ID NO: 2152378 - RNA, 24 nt, Human herpesvirus 8 [Kaposi`s sarcoma-associated h
cauugugugguuuggcagucacuu

SEQ ID NO: 2152379 - RNA, 12 nt, Human herpesvirus 8 [Kaposi`s sarcoma-associated h
uugcauugcucu

SEQ ID NO: 2152380 - RNA, 20 nt, Human herpesvirus 8 [Kaposi`s sarcoma-associated h
uggcauuauaaacccauccc

SEQ ID NO: 2152381 - RNA, 21 nt, Human herpesvirus 8 [Kaposi`s sarcoma-associated h
caugggaccguguguggcugu

SEQ ID NO: 2152382 - RNA, 14 nt, Human herpesvirus 8 [Kaposi`s sarcoma-associated h
agcugcagccagga

SEQ ID NO: 2152383 - RNA, 18 nt, Human herpesvirus 8 [Kaposi`s sarcoma-associated h
guaaauuuaggaaacacg

SEQ ID NO: 2152384 - RNA, 14 nt, Human herpesvirus 8 [Kaposi`s sarcoma-associated h
guaagaggacccag

SEQ ID NO: 2152385 - RNA, 16 nt, Human herpesvirus 8 [Kaposi`s sarcoma-associated h
cauacgucccucuugg

SEQ ID NO: 2152386 - RNA, 17 nt, Human herpesvirus 8 [Kaposi`s sarcoma-associated h
gcauuuuucccuccugc

SEQ ID NO: 2152387 - RNA, 18 nt, Human herpesvirus 8 [Kaposi`s sarcoma-associated h
aauccuuaagaaagugga

SEQ ID NO: 2152388 - RNA, 12 nt, Human herpesvirus 8 [Kaposi`s sarcoma-associated h
agagccagccug

SEQ ID NO: 2152389 - RNA, 23 nt, Human herpesvirus 8 [Kaposi`s sarcoma-associated h
uuaacagccacgacguggcccac

SEQ ID NO: 2152390 - RNA, 16 nt, Human herpesvirus 8 [Kaposi`s sarcoma-associated h
gcugucccgugcccag

SEQ ID NO: 2152391 - RNA, 18 nt, Human herpesvirus 8 [Kaposi`s sarcoma-associated h
auagggggaugagccaga

SEQ ID NO: 2152392 - RNA, 22 nt, Human herpesvirus 8 [Kaposi`s sarcoma-associated h
uggaggaagcauccggacugag

SEQ ID NO: 2152393 - RNA, 20 nt, Human herpesvirus 8 [Kaposi`s sarcoma-associated h
uugaaaaaaaauaaacauac

SEQ ID NO: 2152394 - RNA, 15 nt, Human herpesvirus 8 [Kaposi`s sarcoma-associated h
cugauuagcacugua

SEQ ID NO: 2152395 - RNA, 17 nt, Human herpesvirus 8 [Kaposi`s sarcoma-associated h
uggaggaagagggaugg

SEQ ID NO: 2152396 - RNA, 16 nt, Human herpesvirus 8 [Kaposi`s sarcoma-associated h
caucucgguacugcgc

SEQ ID NO: 2152397 - RNA, 22 nt, Human herpesvirus 8 [Kaposi`s sarcoma-associated h
aggagggcagguuaacguuucc

SEQ ID NO: 2152398 - RNA, 19 nt, Human herpesvirus 8 [Kaposi`s sarcoma-associated h
cacuuccucuaucagcugc

SEQ ID NO: 2152399 - RNA, 19 nt, Human herpesvirus 8 [Kaposi`s sarcoma-associated h
aucaggcuagugcuguaau

SEQ ID NO: 2152400 - RNA, 23 nt, Human herpesvirus 8 [Kaposi`s sarcoma-associated h
gagugucuucccguacuggggga

SEQ ID NO: 2152401 - RNA, 13 nt, Human herpesvirus 8 [Kaposi`s sarcoma-associated h
aggaggagggcag

SEQ ID NO: 2152402 - RNA, 21 nt, Human herpesvirus 8 [Kaposi`s sarcoma-associated h
accugccggacacugaacccu

SEQ ID NO: 2152403 - RNA, 19 nt, Human herpesvirus 8 [Kaposi`s sarcoma-associated h
cuggcagggugggaggaag

SEQ ID NO: 2152404 - RNA, 19 nt, Human herpesvirus 8 [Kaposi`s sarcoma-associated h
ccaccguggaguugccugu

SEQ ID NO: 2152405 - RNA, 14 nt, Human herpesvirus 8 [Kaposi`s sarcoma-associated h
auuaacaaacaagg

SEQ ID NO: 2152406 - RNA, 22 nt, Human herpesvirus 8 [Kaposi`s sarcoma-associated h
caggccaagauccaacccagca

SEQ ID NO: 2152407 - RNA, 14 nt, Human herpesvirus 8 [Kaposi`s sarcoma-associated h
uaugaaaauacagg

SEQ ID NO: 2152408 - RNA, 14 nt, Human herpesvirus 8 [Kaposi`s sarcoma-associated h
cgggguuuccaggg

SEQ ID NO: 2152409 - RNA, 19 nt, Human herpesvirus 8 [Kaposi`s sarcoma-associated h
uaucaggggaaccacggcg

SEQ ID NO: 2152410 - RNA, 21 nt, Human herpesvirus 8 [Kaposi`s sarcoma-associated h
uauuuugaugguguuggacac

SEQ ID NO: 2152411 - RNA, 15 nt, Human herpesvirus 8 [Kaposi`s sarcoma-associated h
cuggagacggggaag

SEQ ID NO: 2152412 - RNA, 19 nt, Human herpesvirus 8 [Kaposi`s sarcoma-associated h
gguguguugaaggacggau

SEQ ID NO: 2152413 - RNA, 18 nt, Human herpesvirus 8 [Kaposi`s sarcoma-associated h
cauucguaagaggaccca

SEQ ID NO: 2152414 - RNA, 17 nt, Human herpesvirus 8 [Kaposi`s sarcoma-associated h
ggcgagcccguguggga

SEQ ID NO: 2152415 - RNA, 15 nt, Human herpesvirus 8 [Kaposi`s sarcoma-associated h
auauaauuaucacgg

SEQ ID NO: 2152416 - RNA, 17 nt, Human herpesvirus 8 [Kaposi`s sarcoma-associated h
ccacguggugcugccua

SEQ ID NO: 2152417 - RNA, 13 nt, Human herpesvirus 8 [Kaposi`s sarcoma-associated h
agacuuucuaaag

SEQ ID NO: 2152418 - RNA, 14 nt, Human herpesvirus 8 [Kaposi`s sarcoma-associated h
caccaagaaggaau

SEQ ID NO: 2152419 - RNA, 15 nt, Human herpesvirus 8 [Kaposi`s sarcoma-associated h
cauucgugugguuug

SEQ ID NO: 2152420 - RNA, 16 nt, Human herpesvirus 8 [Kaposi`s sarcoma-associated h
ccuccacccaccaagc

SEQ ID NO: 2152421 - RNA, 17 nt, Human herpesvirus 8 [Kaposi`s sarcoma-associated h
ugcacauuuucagauau

SEQ ID NO: 2152422 - RNA, 15 nt, Human herpesvirus 8 [Kaposi`s sarcoma-associated h
cauccauuauagcac

SEQ ID NO: 2152423 - RNA, 13 nt, Human herpesvirus 8 [Kaposi`s sarcoma-associated h
ugcagugugcagu

SEQ ID NO: 2152424 - RNA, 17 nt, Human herpesvirus 8 [Kaposi`s sarcoma-associated h
acccugccaaaugccca

SEQ ID NO: 2152425 - RNA, 15 nt, Human herpesvirus 8 [Kaposi`s sarcoma-associated h
gccggcaccauggcc

SEQ ID NO: 2152426 - RNA, 21 nt, Human herpesvirus 8 [Kaposi`s sarcoma-associated h
cuuccucuaaggcccccacca

SEQ ID NO: 2152427 - RNA, 17 nt, Human herpesvirus 8 [Kaposi`s sarcoma-associated h
uaaaagagagaauuaga

SEQ ID NO: 2152428 - RNA, 22 nt, Human herpesvirus 8 [Kaposi`s sarcoma-associated h
cuuuaucaugugaacaauaaac

SEQ ID NO: 2152429 - RNA, 14 nt, Human herpesvirus 8 [Kaposi`s sarcoma-associated h
cccauagccaucca

SEQ ID NO: 2152430 - RNA, 20 nt, Human herpesvirus 8 [Kaposi`s sarcoma-associated h
uagagcgacugcuggcuuca

SEQ ID NO: 2152431 - RNA, 16 nt, Human herpesvirus 8 [Kaposi`s sarcoma-associated h
aggucuccgagcacug

SEQ ID NO: 2152432 - RNA, 12 nt, Human herpesvirus 8 [Kaposi`s sarcoma-associated h
gcgucuuggggg

SEQ ID NO: 2152433 - RNA, 17 nt, Human herpesvirus 8 [Kaposi`s sarcoma-associated h
gagucuuucuagcagag

SEQ ID NO: 2152434 - RNA, 19 nt, Human herpesvirus 8 [Kaposi`s sarcoma-associated h
cguguuugggcaaaacaca

SEQ ID NO: 2152435 - RNA, 20 nt, Human herpesvirus 8 [Kaposi`s sarcoma-associated h
caagcuguuggcgcuuugcu

SEQ ID NO: 2152436 - RNA, 16 nt, Human herpesvirus 8 [Kaposi`s sarcoma-associated h
ggcggccgcuaagaaa

SEQ ID NO: 2152437 - RNA, 14 nt, Human herpesvirus 8 [Kaposi`s sarcoma-associated h
cucguguguuuucg

SEQ ID NO: 2152438 - RNA, 15 nt, Human herpesvirus 8 [Kaposi`s sarcoma-associated h
gccguacauggagcg

SEQ ID NO: 2152439 - RNA, 18 nt, Human herpesvirus 8 [Kaposi`s sarcoma-associated h
aggaccucgucuagcaca

SEQ ID NO: 2152440 - RNA, 16 nt, Human herpesvirus 8 [Kaposi`s sarcoma-associated h
cagguaaaacggccaa

SEQ ID NO: 2152441 - RNA, 23 nt, Human herpesvirus 8 [Kaposi`s sarcoma-associated h
cuugcgucuucaccuucuggcuu

SEQ ID NO: 2152442 - RNA, 20 nt, Human herpesvirus 8 [Kaposi`s sarcoma-associated h
aggugguucuauauccacca

SEQ ID NO: 2152443 - RNA, 16 nt, Human herpesvirus 8 [Kaposi`s sarcoma-associated h
gagcggacgccauuug

SEQ ID NO: 2152444 - RNA, 13 nt, Human herpesvirus 8 [Kaposi`s sarcoma-associated h
ccaacuugcgucu

SEQ ID NO: 2152445 - RNA, 22 nt, Human herpesvirus 8 [Kaposi`s sarcoma-associated h
ccgaaugcguucuccugcauac

SEQ ID NO: 2152446 - RNA, 20 nt, Human herpesvirus 8 [Kaposi`s sarcoma-associated h
aaacgccccucuuggcuguu

SEQ ID NO: 2152447 - RNA, 14 nt, Human herpesvirus 8 [Kaposi`s sarcoma-associated h
ggagccguccacca

SEQ ID NO: 2152448 - RNA, 18 nt, Human herpesvirus 8 [Kaposi`s sarcoma-associated h
aaugaaauuguggcacug

SEQ ID NO: 2152449 - RNA, 21 nt, Human herpesvirus 8 [Kaposi`s sarcoma-associated h
ccuggagcagacgugcccaga

SEQ ID NO: 2152450 - RNA, 13 nt, Human herpesvirus 8 [Kaposi`s sarcoma-associated h
gcagugugcagua

SEQ ID NO: 2152451 - RNA, 12 nt, Human herpesvirus 8 [Kaposi`s sarcoma-associated h
gagucaggcgug

SEQ ID NO: 2152452 - RNA, 18 nt, Human herpesvirus 8 [Kaposi`s sarcoma-associated h
agacuaaaaaggccaccg

SEQ ID NO: 2152453 - RNA, 23 nt, Human herpesvirus 8 [Kaposi`s sarcoma-associated h
uaagaguuccccgggaacggaca

SEQ ID NO: 2152454 - RNA, 16 nt, Human herpesvirus 8 [Kaposi`s sarcoma-associated h
uacgaggcaauugcca

SEQ ID NO: 2152455 - RNA, 23 nt, Human herpesvirus 8 [Kaposi`s sarcoma-associated h
aggcccucuucuguugccaggcg

SEQ ID NO: 2152456 - RNA, 16 nt, Human herpesvirus 8 [Kaposi`s sarcoma-associated h
guuuaccugcacucca

SEQ ID NO: 2152457 - RNA, 14 nt, Human herpesvirus 8 [Kaposi`s sarcoma-associated h
ucccagcaauaaac

SEQ ID NO: 2152458 - RNA, 18 nt, Human herpesvirus 8 [Kaposi`s sarcoma-associated h
guugcugauuacgaaaag

SEQ ID NO: 2152459 - RNA, 21 nt, Human herpesvirus 8 [Kaposi`s sarcoma-associated h
agaaaauuucuguuuccagug

SEQ ID NO: 2152460 - RNA, 20 nt, Human herpesvirus 8 [Kaposi`s sarcoma-associated h
agucgccgguagcugccugg

SEQ ID NO: 2152461 - RNA, 21 nt, Human herpesvirus 8 [Kaposi`s sarcoma-associated h
aaccauuuuuuacggacaaua

SEQ ID NO: 2152462 - RNA, 16 nt, Human herpesvirus 8 [Kaposi`s sarcoma-associated h
auaaagcugagccaca

SEQ ID NO: 2152463 - RNA, 20 nt, Human herpesvirus 8 [Kaposi`s sarcoma-associated h
ucacggccguguuuuucugg

SEQ ID NO: 2152464 - RNA, 19 nt, Human herpesvirus 8 [Kaposi`s sarcoma-associated h
aggaccuuacgauggaaga

SEQ ID NO: 2152465 - RNA, 17 nt, Human herpesvirus 8 [Kaposi`s sarcoma-associated h
gucugcuuuugcgcagg

SEQ ID NO: 2152466 - RNA, 17 nt, Human herpesvirus 8 [Kaposi`s sarcoma-associated h
aagcuuugcagccaggu

SEQ ID NO: 2152467 - RNA, 20 nt, Human herpesvirus 8 [Kaposi`s sarcoma-associated h
cacauccgcugccaccugcg

SEQ ID NO: 2152468 - RNA, 20 nt, Human herpesvirus 8 [Kaposi`s sarcoma-associated h
cgccggagagcgucaucugc

SEQ ID NO: 2152469 - RNA, 16 nt, Human herpesvirus 8 [Kaposi`s sarcoma-associated h
ucguugaucuucuuga

SEQ ID NO: 2152470 - RNA, 22 nt, Human herpesvirus 8 [Kaposi`s sarcoma-associated h
gaauguggaauauaaugugaaa

SEQ ID NO: 2152471 - RNA, 20 nt, Human herpesvirus 8 [Kaposi`s sarcoma-associated h
uaaccgcaaagauaagccaa

SEQ ID NO: 2152472 - RNA, 13 nt, Human herpesvirus 8 [Kaposi`s sarcoma-associated h
ucagcugcagcca

SEQ ID NO: 2152473 - RNA, 13 nt, Human herpesvirus 8 [Kaposi`s sarcoma-associated h
cccuagccaugga

SEQ ID NO: 2152474 - RNA, 14 nt, Human herpesvirus 8 [Kaposi`s sarcoma-associated h
gcccaggggcagac

SEQ ID NO: 2152475 - RNA, 12 nt, Human herpesvirus 8 [Kaposi`s sarcoma-associated h
gaccugcuucac

SEQ ID NO: 2152476 - RNA, 13 nt, Human herpesvirus 8 [Kaposi`s sarcoma-associated h
aaugcggagagga

SEQ ID NO: 2152477 - RNA, 11 nt, Human herpesvirus 8 [Kaposi`s sarcoma-associated h
gcgcugugcuu

SEQ ID NO: 2152478 - RNA, 13 nt, Human herpesvirus 8 [Kaposi`s sarcoma-associated h
agagccagccugg

SEQ ID NO: 2152479 - RNA, 14 nt, Human herpesvirus 8 [Kaposi`s sarcoma-associated h
ggauucgugcagcc

SEQ ID NO: 2152480 - RNA, 19 nt, Human herpesvirus 8 [Kaposi`s sarcoma-associated h
ugcgcgcuggcucagacac

SEQ ID NO: 2152481 - RNA, 15 nt, Human herpesvirus 8 [Kaposi`s sarcoma-associated h
cuguucucgccugga

SEQ ID NO: 2152482 - RNA, 19 nt, Human herpesvirus 8 [Kaposi`s sarcoma-associated h
uccaagacuaaaaaggcca

SEQ ID NO: 2152483 - RNA, 15 nt, Human herpesvirus 8 [Kaposi`s sarcoma-associated h
gauccgcaaugucag

SEQ ID NO: 2152484 - RNA, 14 nt, Human herpesvirus 8 [Kaposi`s sarcoma-associated h
guaaagaaaguaga

SEQ ID NO: 2152485 - RNA, 15 nt, Human herpesvirus 8 [Kaposi`s sarcoma-associated h
acucuucgcugauga

SEQ ID NO: 2152486 - RNA, 15 nt, Human herpesvirus 8 [Kaposi`s sarcoma-associated h
gaggcuaggugccca

SEQ ID NO: 2152487 - RNA, 11 nt, Human herpesvirus 8 [Kaposi`s sarcoma-associated h
aauaaauguga

SEQ ID NO: 2152488 - RNA, 16 nt, Human herpesvirus 8 [Kaposi`s sarcoma-associated h
caaccuggcaagcagu

SEQ ID NO: 2152489 - RNA, 23 nt, Human herpesvirus 8 [Kaposi`s sarcoma-associated h
ccagccugaaacgucgcccaaau

SEQ ID NO: 2152490 - RNA, 20 nt, Human herpesvirus 8 [Kaposi`s sarcoma-associated h
gauaauugagcgcugugcuu

SEQ ID NO: 2152491 - RNA, 16 nt, Human herpesvirus 8 [Kaposi`s sarcoma-associated h
agggggaugagccaga

SEQ ID NO: 2152492 - RNA, 21 nt, Human herpesvirus 8 [Kaposi`s sarcoma-associated h
uacaauaaagccgagccacaa

SEQ ID NO: 2152493 - RNA, 21 nt, Human herpesvirus 8 [Kaposi`s sarcoma-associated h
agcuccuauugcaacugacca

SEQ ID NO: 2152494 - RNA, 17 nt, Human herpesvirus 8 [Kaposi`s sarcoma-associated h
ggccacauacgcucgcc

SEQ ID NO: 2152495 - RNA, 17 nt, Human herpesvirus 8 [Kaposi`s sarcoma-associated h
auccuuugggccguggu

SEQ ID NO: 2152496 - RNA, 22 nt, Human herpesvirus 8 [Kaposi`s sarcoma-associated h
gucuacaggggcuugacagagu

SEQ ID NO: 2152497 - RNA, 18 nt, Human herpesvirus 8 [Kaposi`s sarcoma-associated h
uuuucaaaugagugaaaa

SEQ ID NO: 2152498 - RNA, 19 nt, Human herpesvirus 8 [Kaposi`s sarcoma-associated h
ugccaacgaccugaugcag

SEQ ID NO: 2152499 - RNA, 15 nt, Human herpesvirus 8 [Kaposi`s sarcoma-associated h
cgaaagcuaugguuu

SEQ ID NO: 2152500 - RNA, 19 nt, Human herpesvirus 8 [Kaposi`s sarcoma-associated h
cuaucagcugcagccagga

SEQ ID NO: 2152501 - RNA, 17 nt, Human herpesvirus 8 [Kaposi`s sarcoma-associated h
ccugccaaaugcccaga

SEQ ID NO: 2152502 - RNA, 17 nt, Human herpesvirus 8 [Kaposi`s sarcoma-associated h
caugcgucgccguagug

SEQ ID NO: 2152503 - RNA, 16 nt, Human herpesvirus 8 [Kaposi`s sarcoma-associated h
acgugcaccagcucag

SEQ ID NO: 2152504 - RNA, 16 nt, Human herpesvirus 8 [Kaposi`s sarcoma-associated h
gccaugacaacugcca

SEQ ID NO: 2152505 - RNA, 11 nt, Human herpesvirus 8 [Kaposi`s sarcoma-associated h
auguaaauugg

SEQ ID NO: 2152506 - RNA, 14 nt, Human herpesvirus 8 [Kaposi`s sarcoma-associated h
uugugaagcauuuu

SEQ ID NO: 2152507 - RNA, 18 nt, Human herpesvirus 8 [Kaposi`s sarcoma-associated h
gaguccauggcaguggac

SEQ ID NO: 2152508 - RNA, 17 nt, Human herpesvirus 8 [Kaposi`s sarcoma-associated h
gauuccuccgcacagac

SEQ ID NO: 2152509 - RNA, 18 nt, Human herpesvirus 8 [Kaposi`s sarcoma-associated h
gaggguggacagugccug

SEQ ID NO: 2152510 - RNA, 21 nt, Human herpesvirus 8 [Kaposi`s sarcoma-associated h
acaggacccauuaacuuuccu

SEQ ID NO: 2152511 - RNA, 13 nt, Human herpesvirus 8 [Kaposi`s sarcoma-associated h
augguauggcgcu

SEQ ID NO: 2152512 - RNA, 17 nt, Human herpesvirus 8 [Kaposi`s sarcoma-associated h
guccauggcaguggaca

SEQ ID NO: 2152513 - RNA, 17 nt, Human herpesvirus 8 [Kaposi`s sarcoma-associated h
aaaacauagugccucau

SEQ ID NO: 2152514 - RNA, 12 nt, Human herpesvirus 8 [Kaposi`s sarcoma-associated h
guggugugccug

SEQ ID NO: 2152515 - RNA, 17 nt, Human herpesvirus 8 [Kaposi`s sarcoma-associated h
ucuggccugugcccaaa

SEQ ID NO: 2152516 - RNA, 19 nt, Human herpesvirus 8 [Kaposi`s sarcoma-associated h
ggauguaaguccggccacc

SEQ ID NO: 2152517 - RNA, 17 nt, Human herpesvirus 8 [Kaposi`s sarcoma-associated h
cagcaguagacgcaggc

SEQ ID NO: 2152518 - RNA, 23 nt, Human herpesvirus 8 [Kaposi`s sarcoma-associated h
cggcacacuacucccccuccuca

SEQ ID NO: 2152519 - RNA, 16 nt, Human herpesvirus 8 [Kaposi`s sarcoma-associated h
gcggagggcuguucuc

SEQ ID NO: 2152520 - RNA, 16 nt, Human herpesvirus 8 [Kaposi`s sarcoma-associated h
acgcggauaggcuggg

SEQ ID NO: 2152521 - RNA, 22 nt, Human herpesvirus 8 [Kaposi`s sarcoma-associated h
cugaugaaaucgagugggcgga

SEQ ID NO: 2152522 - RNA, 14 nt, Human herpesvirus 8 [Kaposi`s sarcoma-associated h
uguaugacugcccu

SEQ ID NO: 2152523 - RNA, 17 nt, Human herpesvirus 8 [Kaposi`s sarcoma-associated h
ggccauucuaggagacg

SEQ ID NO: 2152524 - RNA, 14 nt, Human herpesvirus 8 [Kaposi`s sarcoma-associated h
agaugagcaugacu

SEQ ID NO: 2152525 - RNA, 13 nt, Human herpesvirus 8 [Kaposi`s sarcoma-associated h
ggacuggcagggu

SEQ ID NO: 2152526 - RNA, 16 nt, Human herpesvirus 8 [Kaposi`s sarcoma-associated h
guauuaugccagggaa

SEQ ID NO: 2152527 - RNA, 21 nt, Human herpesvirus 8 [Kaposi`s sarcoma-associated h
ugacgcgugucccuuauuuca

SEQ ID NO: 2152528 - RNA, 19 nt, Human herpesvirus 8 [Kaposi`s sarcoma-associated h
gacuugauaaucuccugga

SEQ ID NO: 2152529 - RNA, 14 nt, Human herpesvirus 8 [Kaposi`s sarcoma-associated h
cucgugugcccuuc

SEQ ID NO: 2152530 - RNA, 13 nt, Human herpesvirus 8 [Kaposi`s sarcoma-associated h
gugagagaccccg

SEQ ID NO: 2152531 - RNA, 21 nt, Human herpesvirus 8 [Kaposi`s sarcoma-associated h
uuccaagagcgagugugccuc

SEQ ID NO: 2152532 - RNA, 16 nt, Human herpesvirus 8 [Kaposi`s sarcoma-associated h
gccaccgagaaggaag

SEQ ID NO: 2152533 - RNA, 19 nt, Human herpesvirus 8 [Kaposi`s sarcoma-associated h
uggguuguggugacgcugu

SEQ ID NO: 2152534 - RNA, 22 nt, Human herpesvirus 8 [Kaposi`s sarcoma-associated h
gucaugggaccguguguggcug

SEQ ID NO: 2152535 - RNA, 23 nt, Human herpesvirus 8 [Kaposi`s sarcoma-associated h
gacagggguguuaggucuggugg

SEQ ID NO: 2152536 - RNA, 23 nt, Human herpesvirus 8 [Kaposi`s sarcoma-associated h
cauucgugugguuugggagagcg

SEQ ID NO: 2152537 - RNA, 13 nt, Human herpesvirus 8 [Kaposi`s sarcoma-associated h
agagguuggucug

SEQ ID NO: 2152538 - RNA, 21 nt, Human herpesvirus 8 [Kaposi`s sarcoma-associated h
acuaggaggaagagcacuguu

SEQ ID NO: 2152539 - RNA, 18 nt, Human herpesvirus 8 [Kaposi`s sarcoma-associated h
uaaaagccugguccaggc

SEQ ID NO: 2152540 - RNA, 21 nt, Human herpesvirus 8 [Kaposi`s sarcoma-associated h
cugccuagaacuaaccacuca

SEQ ID NO: 2152541 - RNA, 23 nt, Human herpesvirus 8 [Kaposi`s sarcoma-associated h
gcagugcacgcaccaggauccag

SEQ ID NO: 2152542 - RNA, 23 nt, Human herpesvirus 8 [Kaposi`s sarcoma-associated h
auaaacagccuuggugcuaggca

SEQ ID NO: 2152543 - RNA, 17 nt, Human herpesvirus 8 [Kaposi`s sarcoma-associated h
gucuuuauugcuuucaa

SEQ ID NO: 2152544 - RNA, 19 nt, Human herpesvirus 8 [Kaposi`s sarcoma-associated h
auuaguguuauaagaaauu

SEQ ID NO: 2152545 - RNA, 17 nt, Human herpesvirus 8 [Kaposi`s sarcoma-associated h
ugucugaaacgggacau

SEQ ID NO: 2152546 - RNA, 15 nt, Human herpesvirus 8 [Kaposi`s sarcoma-associated h
ccagcgucggccaga

SEQ ID NO: 2152547 - RNA, 13 nt, Human herpesvirus 8 [Kaposi`s sarcoma-associated h
cggucgccagggu

SEQ ID NO: 2152548 - RNA, 14 nt, Human herpesvirus 8 [Kaposi`s sarcoma-associated h
ccagggaaacaugc

SEQ ID NO: 2152549 - RNA, 14 nt, Human herpesvirus 8 [Kaposi`s sarcoma-associated h
ggauaggcuggggg

SEQ ID NO: 2152550 - RNA, 14 nt, Human herpesvirus 8 [Kaposi`s sarcoma-associated h
gcgcuggcucagac

SEQ ID NO: 2152551 - RNA, 15 nt, Human herpesvirus 8 [Kaposi`s sarcoma-associated h
gacaucagaagaugc

SEQ ID NO: 2152552 - RNA, 13 nt, Human herpesvirus 8 [Kaposi`s sarcoma-associated h
acauaaaauuucu

SEQ ID NO: 2152553 - RNA, 15 nt, Human herpesvirus 8 [Kaposi`s sarcoma-associated h
aucugguccuaagag

SEQ ID NO: 2152554 - RNA, 20 nt, Human herpesvirus 8 [Kaposi`s sarcoma-associated h
augcaugugucugugcccug

SEQ ID NO: 2152555 - RNA, 12 nt, Human herpesvirus 8 [Kaposi`s sarcoma-associated h
ucgcccacggaa

SEQ ID NO: 2152556 - RNA, 19 nt, Human herpesvirus 8 [Kaposi`s sarcoma-associated h
cagacgugcccagacacca

SEQ ID NO: 2152557 - RNA, 19 nt, Human herpesvirus 8 [Kaposi`s sarcoma-associated h
acgcgcgacgcaucgucgc

SEQ ID NO: 2152558 - RNA, 22 nt, Human herpesvirus 8 [Kaposi`s sarcoma-associated h
ugacugccacggccgccuuugu

SEQ ID NO: 2152559 - RNA, 16 nt, Human herpesvirus 8 [Kaposi`s sarcoma-associated h
uaggcccaugugggcu

SEQ ID NO: 2152560 - RNA, 22 nt, Human herpesvirus 8 [Kaposi`s sarcoma-associated h
gcacaagcgcugacgaaagcua

SEQ ID NO: 2152561 - RNA, 13 nt, Human herpesvirus 8 [Kaposi`s sarcoma-associated h
cuggcaugcuggg

SEQ ID NO: 2152562 - RNA, 20 nt, Human herpesvirus 8 [Kaposi`s sarcoma-associated h
gcaaaauacauuuuaugagg

SEQ ID NO: 2152563 - RNA, 19 nt, Human herpesvirus 8 [Kaposi`s sarcoma-associated h
uaaaacggccaaagcaaag

SEQ ID NO: 2152564 - RNA, 22 nt, Human herpesvirus 8 [Kaposi`s sarcoma-associated h
gccauuuuuguggcugccugga

SEQ ID NO: 2152565 - RNA, 23 nt, Human herpesvirus 8 [Kaposi`s sarcoma-associated h
ggcuguuacaauaaagcugagcc

SEQ ID NO: 2152566 - RNA, 15 nt, Human herpesvirus 8 [Kaposi`s sarcoma-associated h
accggcuuguacagu

SEQ ID NO: 2152567 - RNA, 13 nt, Human herpesvirus 8 [Kaposi`s sarcoma-associated h
auggcguccgcuc

SEQ ID NO: 2152568 - RNA, 14 nt, Human herpesvirus 8 [Kaposi`s sarcoma-associated h
gcacuccaagccag

SEQ ID NO: 2152569 - RNA, 13 nt, Human herpesvirus 8 [Kaposi`s sarcoma-associated h
gccucccaacaug

SEQ ID NO: 2152570 - RNA, 14 nt, Human herpesvirus 8 [Kaposi`s sarcoma-associated h
gucuacccugccac

SEQ ID NO: 2152571 - RNA, 14 nt, Human herpesvirus 8 [Kaposi`s sarcoma-associated h
agaaaugaucaugu

SEQ ID NO: 2152572 - RNA, 18 nt, Human herpesvirus 8 [Kaposi`s sarcoma-associated h
gcggcuaagaauccccuu

SEQ ID NO: 2152573 - RNA, 11 nt, Human herpesvirus 8 [Kaposi`s sarcoma-associated h
cgucuucccac

SEQ ID NO: 2152574 - RNA, 21 nt, Human herpesvirus 8 [Kaposi`s sarcoma-associated h
ugccgucgucgagcacuccug

SEQ ID NO: 2152575 - RNA, 22 nt, Human herpesvirus 8 [Kaposi`s sarcoma-associated h
aaugacauaggcgacaaaguga

SEQ ID NO: 2152576 - RNA, 17 nt, Human herpesvirus 8 [Kaposi`s sarcoma-associated h
guaccaccaagaaggaa

SEQ ID NO: 2152577 - RNA, 16 nt, Human herpesvirus 8 [Kaposi`s sarcoma-associated h
ucuucuguugccaggc

SEQ ID NO: 2152578 - RNA, 20 nt, Human herpesvirus 8 [Kaposi`s sarcoma-associated h
caagauccaacccagcaugc

SEQ ID NO: 2152579 - RNA, 15 nt, Human herpesvirus 8 [Kaposi`s sarcoma-associated h
agagaauacagugcu

SEQ ID NO: 2152580 - RNA, 19 nt, Human herpesvirus 8 [Kaposi`s sarcoma-associated h
agccagguaacaaagccgc

SEQ ID NO: 2152581 - RNA, 18 nt, Human herpesvirus 8 [Kaposi`s sarcoma-associated h
ggcggugcaugugacccg

SEQ ID NO: 2152582 - RNA, 13 nt, Human herpesvirus 8 [Kaposi`s sarcoma-associated h
ugccugggugcug

SEQ ID NO: 2152583 - RNA, 17 nt, Human herpesvirus 8 [Kaposi`s sarcoma-associated h
uuaucuuugcagugucu

SEQ ID NO: 2152584 - RNA, 21 nt, Human herpesvirus 8 [Kaposi`s sarcoma-associated h
ccaccggcaggcagccaagaa

SEQ ID NO: 2152585 - RNA, 17 nt, Human herpesvirus 8 [Kaposi`s sarcoma-associated h
ccucgucgacagagcca

SEQ ID NO: 2152586 - RNA, 16 nt, Human herpesvirus 8 [Kaposi`s sarcoma-associated h
guacacagaugugacu

SEQ ID NO: 2152587 - RNA, 14 nt, Human herpesvirus 8 [Kaposi`s sarcoma-associated h
gguuccccguccac

SEQ ID NO: 2152588 - RNA, 12 nt, Human herpesvirus 8 [Kaposi`s sarcoma-associated h
aggauuucucgc

SEQ ID NO: 2152589 - RNA, 18 nt, Human herpesvirus 8 [Kaposi`s sarcoma-associated h
cuacuaauguaaccuaaa

SEQ ID NO: 2152590 - RNA, 15 nt, Human herpesvirus 8 [Kaposi`s sarcoma-associated h
caauaaacccacagc

SEQ ID NO: 2152591 - RNA, 17 nt, Human herpesvirus 8 [Kaposi`s sarcoma-associated h
ugccuucgaggccaggc

SEQ ID NO: 2152592 - RNA, 16 nt, Human herpesvirus 8 [Kaposi`s sarcoma-associated h
uuccggguauuggaga

SEQ ID NO: 2152593 - RNA, 18 nt, Human herpesvirus 8 [Kaposi`s sarcoma-associated h
caggcuguccucgcaagc

SEQ ID NO: 2152594 - RNA, 19 nt, Human herpesvirus 8 [Kaposi`s sarcoma-associated h
uuagauaguguugagguaa

SEQ ID NO: 2152595 - RNA, 19 nt, Human herpesvirus 8 [Kaposi`s sarcoma-associated h
cucaucauuucugaaacag

SEQ ID NO: 2152596 - RNA, 15 nt, Human herpesvirus 8 [Kaposi`s sarcoma-associated h
ucgguucaaccugga

SEQ ID NO: 2152597 - RNA, 14 nt, Human herpesvirus 8 [Kaposi`s sarcoma-associated h
cgguggugugccug

SEQ ID NO: 2152598 - RNA, 13 nt, Human herpesvirus 8 [Kaposi`s sarcoma-associated h
uagaccucacccc

SEQ ID NO: 2152599 - RNA, 17 nt, Human herpesvirus 8 [Kaposi`s sarcoma-associated h
gucucccuucgugcccc

SEQ ID NO: 2152600 - RNA, 17 nt, Human herpesvirus 8 [Kaposi`s sarcoma-associated h
ccccaagcggggagaag

SEQ ID NO: 2152601 - RNA, 18 nt, Human herpesvirus 8 [Kaposi`s sarcoma-associated h
acuucaccuccagacucu

SEQ ID NO: 2152602 - RNA, 18 nt, Human herpesvirus 8 [Kaposi`s sarcoma-associated h
gccuggagcagcgccagu

SEQ ID NO: 2152603 - RNA, 21 nt, Human herpesvirus 8 [Kaposi`s sarcoma-associated h
cagggcaugaggcuggaccuc

SEQ ID NO: 2152604 - RNA, 13 nt, Human herpesvirus 8 [Kaposi`s sarcoma-associated h
aguggaguggugu

SEQ ID NO: 2152605 - RNA, 16 nt, Human herpesvirus 8 [Kaposi`s sarcoma-associated h
gcuggucccgugguca

SEQ ID NO: 2152606 - RNA, 16 nt, Human herpesvirus 8 [Kaposi`s sarcoma-associated h
gagcacacuguguggu

SEQ ID NO: 2152607 - RNA, 12 nt, Human herpesvirus 8 [Kaposi`s sarcoma-associated h
ccugcugucuau

SEQ ID NO: 2152608 - RNA, 14 nt, Human herpesvirus 8 [Kaposi`s sarcoma-associated h
gcaaggcgggccag

SEQ ID NO: 2152609 - RNA, 15 nt, Human herpesvirus 8 [Kaposi`s sarcoma-associated h
augacaacugccaca

SEQ ID NO: 2152610 - RNA, 21 nt, Human herpesvirus 8 [Kaposi`s sarcoma-associated h
gcagggugcggugcugcccag

SEQ ID NO: 2152611 - RNA, 17 nt, Human herpesvirus 8 [Kaposi`s sarcoma-associated h
gggccaugacaacugcc

SEQ ID NO: 2152612 - RNA, 16 nt, Human herpesvirus 8 [Kaposi`s sarcoma-associated h
gaugccgcgcuugggu

SEQ ID NO: 2152613 - RNA, 17 nt, Human herpesvirus 8 [Kaposi`s sarcoma-associated h
uacagugaguggcugua

SEQ ID NO: 2152614 - RNA, 16 nt, Human herpesvirus 8 [Kaposi`s sarcoma-associated h
caguauuaugccaggg

SEQ ID NO: 2152615 - RNA, 18 nt, Human herpesvirus 8 [Kaposi`s sarcoma-associated h
cgcaugguugcaacagac

SEQ ID NO: 2152616 - RNA, 18 nt, Human herpesvirus 8 [Kaposi`s sarcoma-associated h
agugggguugggguccag

SEQ ID NO: 2152617 - RNA, 22 nt, Human herpesvirus 8 [Kaposi`s sarcoma-associated h
cgccgguguaugacccugagcu

SEQ ID NO: 2152618 - RNA, 12 nt, Human herpesvirus 8 [Kaposi`s sarcoma-associated h
auaacuucuggg

SEQ ID NO: 2152619 - RNA, 21 nt, Human herpesvirus 8 [Kaposi`s sarcoma-associated h
gcgccauuuuuguggcugccu

SEQ ID NO: 2152620 - RNA, 16 nt, Human herpesvirus 8 [Kaposi`s sarcoma-associated h
guggagcacgaagaca

SEQ ID NO: 2152621 - RNA, 19 nt, Human herpesvirus 8 [Kaposi`s sarcoma-associated h
agccgcgcuuuuuaacuuc

SEQ ID NO: 2152622 - RNA, 17 nt, Human herpesvirus 8 [Kaposi`s sarcoma-associated h
gggacagucuaaaaaag

SEQ ID NO: 2152623 - RNA, 18 nt, Human herpesvirus 8 [Kaposi`s sarcoma-associated h
cagacgaccccagccccu

SEQ ID NO: 2152624 - RNA, 15 nt, Human herpesvirus 8 [Kaposi`s sarcoma-associated h
cauauugguauauga

SEQ ID NO: 2152625 - RNA, 17 nt, Human herpesvirus 8 [Kaposi`s sarcoma-associated h
aggaccaccggcaggca

SEQ ID NO: 2152626 - RNA, 15 nt, Human herpesvirus 8 [Kaposi`s sarcoma-associated h
cgaacaucgccgugg

SEQ ID NO: 2152627 - RNA, 23 nt, Human herpesvirus 8 [Kaposi`s sarcoma-associated h
ggauuuaucuaccuuagaagacc

SEQ ID NO: 2152628 - RNA, 12 nt, Human herpesvirus 8 [Kaposi`s sarcoma-associated h
cugcagccagga

SEQ ID NO: 2152629 - RNA, 15 nt, Human herpesvirus 8 [Kaposi`s sarcoma-associated h
ugauuuuccagggac

SEQ ID NO: 2152630 - RNA, 17 nt, Human herpesvirus 8 [Kaposi`s sarcoma-associated h
gcagccucuacccugcc

SEQ ID NO: 2152631 - RNA, 17 nt, Human herpesvirus 8 [Kaposi`s sarcoma-associated h
acucguucacacucuuu

SEQ ID NO: 2152632 - RNA, 19 nt, Human herpesvirus 8 [Kaposi`s sarcoma-associated h
ggaucaucugcagacccuu

SEQ ID NO: 2152633 - RNA, 19 nt, Human herpesvirus 8 [Kaposi`s sarcoma-associated h
ugcccucccaaagaguguc

SEQ ID NO: 2152634 - RNA, 21 nt, Human herpesvirus 8 [Kaposi`s sarcoma-associated h
uacaaauguuuuaugcaaaau

SEQ ID NO: 2152635 - RNA, 22 nt, Human herpesvirus 8 [Kaposi`s sarcoma-associated h
caugcccuccugggccaggcac

SEQ ID NO: 2152636 - RNA, 17 nt, Human herpesvirus 8 [Kaposi`s sarcoma-associated h
ucucgcugcucagacag

SEQ ID NO: 2152637 - RNA, 17 nt, Human herpesvirus 8 [Kaposi`s sarcoma-associated h
ccucagaaaguggauug

SEQ ID NO: 2152638 - RNA, 22 nt, Human herpesvirus 8 [Kaposi`s sarcoma-associated h
ccggcgacugcgcagaacagua

SEQ ID NO: 2152639 - RNA, 23 nt, Human herpesvirus 8 [Kaposi`s sarcoma-associated h
agugguuauuuuuuuccuaggcg

SEQ ID NO: 2152640 - RNA, 14 nt, Human herpesvirus 8 [Kaposi`s sarcoma-associated h
aaguuucaaagucg

SEQ ID NO: 2152641 - RNA, 15 nt, Human herpesvirus 8 [Kaposi`s sarcoma-associated h
gacaccaaagacaag

SEQ ID NO: 2152642 - RNA, 12 nt, Human herpesvirus 8 [Kaposi`s sarcoma-associated h
aggccugugccc

SEQ ID NO: 2152643 - RNA, 16 nt, Human herpesvirus 8 [Kaposi`s sarcoma-associated h
cuagacacgcaaagua

SEQ ID NO: 2152644 - RNA, 22 nt, Human herpesvirus 8 [Kaposi`s sarcoma-associated h
auaugcaccguuuccacacagg

SEQ ID NO: 2152645 - RNA, 18 nt, Human herpesvirus 8 [Kaposi`s sarcoma-associated h
cucgggcgcggcgagccc

SEQ ID NO: 2152646 - RNA, 18 nt, Human herpesvirus 8 [Kaposi`s sarcoma-associated h
agacaguuaaucuuuauu

SEQ ID NO: 2152647 - RNA, 14 nt, Human herpesvirus 8 [Kaposi`s sarcoma-associated h
auagccgccgggag

SEQ ID NO: 2152648 - RNA, 18 nt, Human herpesvirus 8 [Kaposi`s sarcoma-associated h
ugcggugcugcccaggac

SEQ ID NO: 2152649 - RNA, 23 nt, Human herpesvirus 8 [Kaposi`s sarcoma-associated h
ucgaaaaaaauaaugcagacaga

SEQ ID NO: 2152650 - RNA, 19 nt, Human herpesvirus 8 [Kaposi`s sarcoma-associated h
gccagcaaccccucuggau

SEQ ID NO: 2152651 - RNA, 21 nt, Human herpesvirus 8 [Kaposi`s sarcoma-associated h
guugagagucagagaauacag

SEQ ID NO: 2152652 - RNA, 16 nt, Human herpesvirus 8 [Kaposi`s sarcoma-associated h
acccaauaaaagagag

SEQ ID NO: 2152653 - RNA, 23 nt, Human herpesvirus 8 [Kaposi`s sarcoma-associated h
gugucauugccacccagcuacug

SEQ ID NO: 2152654 - RNA, 16 nt, Human herpesvirus 8 [Kaposi`s sarcoma-associated h
gcguuuaccugcacuc

SEQ ID NO: 2152655 - RNA, 16 nt, Human herpesvirus 8 [Kaposi`s sarcoma-associated h
gcugucauugaggaag

SEQ ID NO: 2152656 - RNA, 22 nt, Human herpesvirus 8 [Kaposi`s sarcoma-associated h
agcgccuagaaaguuuccucuu

SEQ ID NO: 2152657 - RNA, 19 nt, Human herpesvirus 8 [Kaposi`s sarcoma-associated h
ggaaauggggaacacagaa

SEQ ID NO: 2152658 - RNA, 19 nt, Human herpesvirus 8 [Kaposi`s sarcoma-associated h
caaaugauauuuugauggu

SEQ ID NO: 2152659 - RNA, 15 nt, Human herpesvirus 8 [Kaposi`s sarcoma-associated h
auagcuacaaauguu

SEQ ID NO: 2152660 - RNA, 12 nt, Human herpesvirus 8 [Kaposi`s sarcoma-associated h
ccgucgcacccg

SEQ ID NO: 2152661 - RNA, 17 nt, Human herpesvirus 8 [Kaposi`s sarcoma-associated h
aauguuuguaauuuccu

SEQ ID NO: 2152662 - RNA, 12 nt, Human herpesvirus 8 [Kaposi`s sarcoma-associated h
cagcaaagcaca

SEQ ID NO: 2152663 - RNA, 13 nt, Human herpesvirus 8 [Kaposi`s sarcoma-associated h
aggagucagagca

SEQ ID NO: 2152664 - RNA, 23 nt, Human herpesvirus 8 [Kaposi`s sarcoma-associated h
ucggacaggacgcggccauccgc

SEQ ID NO: 2152665 - RNA, 12 nt, Human herpesvirus 8 [Kaposi`s sarcoma-associated h
gaagcccuugag

SEQ ID NO: 2152666 - RNA, 16 nt, Human herpesvirus 8 [Kaposi`s sarcoma-associated h
acaauagggauacugu

SEQ ID NO: 2152667 - RNA, 13 nt, Human herpesvirus 8 [Kaposi`s sarcoma-associated h
gguguucugucaa

SEQ ID NO: 2152668 - RNA, 13 nt, Human herpesvirus 8 [Kaposi`s sarcoma-associated h
gugaucucuggag

SEQ ID NO: 2152669 - RNA, 16 nt, Human herpesvirus 8 [Kaposi`s sarcoma-associated h
auuuauugcauggcau

SEQ ID NO: 2152670 - RNA, 22 nt, Human herpesvirus 8 [Kaposi`s sarcoma-associated h
agccacaaacgccccucuuggc

SEQ ID NO: 2152671 - RNA, 19 nt, Human herpesvirus 8 [Kaposi`s sarcoma-associated h
gaagagaauggagaggaga

SEQ ID NO: 2152672 - RNA, 20 nt, Human herpesvirus 8 [Kaposi`s sarcoma-associated h
uuaaccggcuuguacaguga

SEQ ID NO: 2152673 - RNA, 21 nt, Human herpesvirus 8 [Kaposi`s sarcoma-associated h
cgcaccugguaagcagggcgg

SEQ ID NO: 2152674 - RNA, 21 nt, Human herpesvirus 8 [Kaposi`s sarcoma-associated h
gacgcaucgucgcgccuggcg

SEQ ID NO: 2152675 - RNA, 23 nt, Human herpesvirus 8 [Kaposi`s sarcoma-associated h
gcggcccagcgucgucgauggga

SEQ ID NO: 2152676 - RNA, 23 nt, Human herpesvirus 8 [Kaposi`s sarcoma-associated h
uuauacaaacaacauaaacauua

SEQ ID NO: 2152677 - RNA, 15 nt, Human herpesvirus 8 [Kaposi`s sarcoma-associated h
uguaccuagcccugu

SEQ ID NO: 2152678 - RNA, 21 nt, Human herpesvirus 8 [Kaposi`s sarcoma-associated h
uuaagagugccacuaaaaccg

SEQ ID NO: 2152679 - RNA, 23 nt, Human herpesvirus 8 [Kaposi`s sarcoma-associated h
ccugccaaaugcccagaaugaag

SEQ ID NO: 2152680 - RNA, 19 nt, Human herpesvirus 8 [Kaposi`s sarcoma-associated h
cgagcucaugcccacccug

SEQ ID NO: 2152681 - RNA, 17 nt, Human herpesvirus 8 [Kaposi`s sarcoma-associated h
gcguccacauggcagcu

SEQ ID NO: 2152682 - RNA, 15 nt, Human herpesvirus 8 [Kaposi`s sarcoma-associated h
cagcugcagccagga

SEQ ID NO: 2152683 - RNA, 18 nt, Human herpesvirus 8 [Kaposi`s sarcoma-associated h
acaaugugucuguggcua

SEQ ID NO: 2152684 - RNA, 17 nt, Human herpesvirus 8 [Kaposi`s sarcoma-associated h
agcgccaccguguggcu

SEQ ID NO: 2152685 - RNA, 13 nt, Human herpesvirus 8 [Kaposi`s sarcoma-associated h
gagccggcccuga

SEQ ID NO: 2152686 - RNA, 19 nt, Human herpesvirus 8 [Kaposi`s sarcoma-associated h
gagcugucccaccagagcg

SEQ ID NO: 2152687 - RNA, 19 nt, Human herpesvirus 8 [Kaposi`s sarcoma-associated h
ggaccucgucuagcacaca

SEQ ID NO: 2152688 - RNA, 12 nt, Human herpesvirus 8 [Kaposi`s sarcoma-associated h
caugccugugga

SEQ ID NO: 2152689 - RNA, 20 nt, Human herpesvirus 8 [Kaposi`s sarcoma-associated h
caccgucgccaaacaggcgc

SEQ ID NO: 2152690 - RNA, 14 nt, Human herpesvirus 8 [Kaposi`s sarcoma-associated h
uacauaacacacac

SEQ ID NO: 2152691 - RNA, 21 nt, Human herpesvirus 8 [Kaposi`s sarcoma-associated h
gacgucuucgccgaggacacg

SEQ ID NO: 2152692 - RNA, 16 nt, Human herpesvirus 8 [Kaposi`s sarcoma-associated h
auugugucaaccaggg

SEQ ID NO: 2152693 - RNA, 17 nt, Human herpesvirus 8 [Kaposi`s sarcoma-associated h
acucugcaagcuguugg

SEQ ID NO: 2152694 - RNA, 19 nt, Human herpesvirus 8 [Kaposi`s sarcoma-associated h
cugcgcagaacaguaccca

SEQ ID NO: 2152695 - RNA, 21 nt, Human herpesvirus 8 [Kaposi`s sarcoma-associated h
uagagacuggcggguggcuca

SEQ ID NO: 2152696 - RNA, 12 nt, Human herpesvirus 8 [Kaposi`s sarcoma-associated h
uacuagcaccac

SEQ ID NO: 2152697 - RNA, 13 nt, Human herpesvirus 8 [Kaposi`s sarcoma-associated h
uggcgccaugggu

SEQ ID NO: 2152698 - RNA, 13 nt, Human herpesvirus 8 [Kaposi`s sarcoma-associated h
uacuguccauuac

SEQ ID NO: 2152699 - RNA, 14 nt, Human herpesvirus 8 [Kaposi`s sarcoma-associated h
ccgcauuaaagcac

SEQ ID NO: 2152700 - RNA, 18 nt, Human herpesvirus 8 [Kaposi`s sarcoma-associated h
acagucuguaaagaaagu

SEQ ID NO: 2152701 - RNA, 22 nt, Human herpesvirus 8 [Kaposi`s sarcoma-associated h
aaugaagugcaaccugcugcag

SEQ ID NO: 2152702 - RNA, 22 nt, Human herpesvirus 8 [Kaposi`s sarcoma-associated h
caucuacccugauuagcacugu

SEQ ID NO: 2152703 - RNA, 15 nt, Human herpesvirus 8 [Kaposi`s sarcoma-associated h
gacaaaugugugggu

SEQ ID NO: 2152704 - RNA, 21 nt, Human herpesvirus 8 [Kaposi`s sarcoma-associated h
uuaugaggucggauacuuauu

SEQ ID NO: 2152705 - RNA, 20 nt, Human herpesvirus 8 [Kaposi`s sarcoma-associated h
cgagcucaugcccacccugu

SEQ ID NO: 2152706 - RNA, 19 nt, Human herpesvirus 8 [Kaposi`s sarcoma-associated h
gauccaacccagcaugccu

SEQ ID NO: 2152707 - RNA, 14 nt, Human herpesvirus 8 [Kaposi`s sarcoma-associated h
uuggcgagaagccc

SEQ ID NO: 2152708 - RNA, 12 nt, Human herpesvirus 8 [Kaposi`s sarcoma-associated h
cgggggccagga

SEQ ID NO: 2152709 - RNA, 15 nt, Human herpesvirus 8 [Kaposi`s sarcoma-associated h
guuaucuuugcagug

SEQ ID NO: 2152710 - RNA, 20 nt, Human herpesvirus 8 [Kaposi`s sarcoma-associated h
agucugaaccccguguggga

SEQ ID NO: 2152711 - RNA, 20 nt, Human herpesvirus 8 [Kaposi`s sarcoma-associated h
ggaccucaaagaagaggugg

SEQ ID NO: 2152712 - RNA, 17 nt, Human herpesvirus 8 [Kaposi`s sarcoma-associated h
ccgggccuucgcacccc

SEQ ID NO: 2152713 - RNA, 15 nt, Human herpesvirus 8 [Kaposi`s sarcoma-associated h
ccaggacggagccgu

SEQ ID NO: 2152714 - RNA, 20 nt, Human herpesvirus 8 [Kaposi`s sarcoma-associated h
acaaugaauggggaccagag

SEQ ID NO: 2152715 - RNA, 13 nt, Human herpesvirus 8 [Kaposi`s sarcoma-associated h
uguagauaauuga

SEQ ID NO: 2152716 - RNA, 12 nt, Human herpesvirus 8 [Kaposi`s sarcoma-associated h
caaaaacacaau

SEQ ID NO: 2152717 - RNA, 18 nt, Human herpesvirus 8 [Kaposi`s sarcoma-associated h
gcugcaauguacugccau

SEQ ID NO: 2152718 - RNA, 18 nt, Human herpesvirus 8 [Kaposi`s sarcoma-associated h
cggaauggcucacggacu

SEQ ID NO: 2152719 - RNA, 21 nt, Human herpesvirus 8 [Kaposi`s sarcoma-associated h
uacaauaaagcugagccacaa

SEQ ID NO: 2152720 - RNA, 23 nt, Human herpesvirus 8 [Kaposi`s sarcoma-associated h
gcaccuguguacaauacgccuuc

SEQ ID NO: 2152721 - RNA, 13 nt, Human herpesvirus 8 [Kaposi`s sarcoma-associated h
uacugcuguuacc

SEQ ID NO: 2152722 - RNA, 18 nt, Human herpesvirus 8 [Kaposi`s sarcoma-associated h
cugguucaggauuucgaa

SEQ ID NO: 2152723 - RNA, 14 nt, Human herpesvirus 8 [Kaposi`s sarcoma-associated h
gacauguggagcca

SEQ ID NO: 2152724 - RNA, 14 nt, Human herpesvirus 8 [Kaposi`s sarcoma-associated h
aucuagacugcuag

SEQ ID NO: 2152725 - RNA, 23 nt, Human herpesvirus 8 [Kaposi`s sarcoma-associated h
ccaggccaccauuccucuccgca

SEQ ID NO: 2152726 - RNA, 13 nt, Human herpesvirus 8 [Kaposi`s sarcoma-associated h
ccguguggcugca

SEQ ID NO: 2152727 - RNA, 21 nt, Human herpesvirus 8 [Kaposi`s sarcoma-associated h
cugggacuugauaaucuccug

SEQ ID NO: 2152728 - RNA, 13 nt, Human herpesvirus 8 [Kaposi`s sarcoma-associated h
cauuuuguaauga

SEQ ID NO: 2152729 - RNA, 15 nt, Human herpesvirus 8 [Kaposi`s sarcoma-associated h
cguuuaguguggauc

SEQ ID NO: 2152730 - RNA, 19 nt, Human herpesvirus 8 [Kaposi`s sarcoma-associated h
acuagaguccaaccuggca

SEQ ID NO: 2152731 - RNA, 16 nt, Human herpesvirus 8 [Kaposi`s sarcoma-associated h
cugcaggggagcacac

SEQ ID NO: 2152732 - RNA, 13 nt, Human herpesvirus 8 [Kaposi`s sarcoma-associated h
ugcagccagguaa

SEQ ID NO: 2152733 - RNA, 23 nt, Human herpesvirus 8 [Kaposi`s sarcoma-associated h
ugggccgugguucaucagccuca

SEQ ID NO: 2152734 - RNA, 14 nt, Human herpesvirus 8 [Kaposi`s sarcoma-associated h
ccaccuacacccgg

SEQ ID NO: 2152735 - RNA, 16 nt, Human herpesvirus 8 [Kaposi`s sarcoma-associated h
uaaacccacagcccau

SEQ ID NO: 2152736 - RNA, 20 nt, Human herpesvirus 8 [Kaposi`s sarcoma-associated h
uucugaaacagaaacugcuc

SEQ ID NO: 2152737 - RNA, 17 nt, Human herpesvirus 8 [Kaposi`s sarcoma-associated h
cgccgguagcugccugg

SEQ ID NO: 2152738 - RNA, 23 nt, Human herpesvirus 8 [Kaposi`s sarcoma-associated h
ucguugacauguggagccacugg

SEQ ID NO: 2152739 - RNA, 15 nt, Human herpesvirus 8 [Kaposi`s sarcoma-associated h
agcaauaaagacaaa

SEQ ID NO: 2152740 - RNA, 13 nt, Human herpesvirus 8 [Kaposi`s sarcoma-associated h
ccuuccucagcga

SEQ ID NO: 2152741 - RNA, 17 nt, Human herpesvirus 8 [Kaposi`s sarcoma-associated h
gagacgcgcaaaggggg

SEQ ID NO: 2152742 - RNA, 17 nt, Human herpesvirus 8 [Kaposi`s sarcoma-associated h
aucuaucucugguggug

SEQ ID NO: 2152743 - RNA, 19 nt, Human herpesvirus 8 [Kaposi`s sarcoma-associated h
cggcgcaaaaacagcugga

SEQ ID NO: 2152744 - RNA, 17 nt, Human herpesvirus 8 [Kaposi`s sarcoma-associated h
uuacuaagagaacagca

SEQ ID NO: 2152745 - RNA, 20 nt, Human herpesvirus 8 [Kaposi`s sarcoma-associated h
uaaagagggaucccaggcag

SEQ ID NO: 2152746 - RNA, 24 nt, Human herpesvirus 8 [Kaposi`s sarcoma-associated h
cagcuccuauugcaacugaccaug

SEQ ID NO: 2152747 - RNA, 19 nt, Human herpesvirus 8 [Kaposi`s sarcoma-associated h
cacucgcuguccuggagga

SEQ ID NO: 2152748 - RNA, 22 nt, Human herpesvirus 8 [Kaposi`s sarcoma-associated h
cugcgcagaacaguacccacga

SEQ ID NO: 2152749 - RNA, 19 nt, Human herpesvirus 8 [Kaposi`s sarcoma-associated h
uaagacaaacaugugggcu

SEQ ID NO: 2152750 - RNA, 13 nt, Human herpesvirus 8 [Kaposi`s sarcoma-associated h
gcugcagccagga

SEQ ID NO: 2152751 - RNA, 23 nt, Human herpesvirus 8 [Kaposi`s sarcoma-associated h
acuuaacgugucugaauguggaa

SEQ ID NO: 2152752 - RNA, 22 nt, Human herpesvirus 8 [Kaposi`s sarcoma-associated h
ugacuaggaggaagagcacugu

SEQ ID NO: 2152753 - RNA, 16 nt, Human herpesvirus 8 [Kaposi`s sarcoma-associated h
ugguauauugguccag

SEQ ID NO: 2152754 - RNA, 18 nt, Human herpesvirus 8 [Kaposi`s sarcoma-associated h
cagacaguuaccauucau

SEQ ID NO: 2152755 - RNA, 16 nt, Human herpesvirus 8 [Kaposi`s sarcoma-associated h
cuucuauaagcaccuu

SEQ ID NO: 2152756 - RNA, 15 nt, Human herpesvirus 8 [Kaposi`s sarcoma-associated h
auacaagacaacuaa

SEQ ID NO: 2152757 - RNA, 23 nt, Human herpesvirus 8 [Kaposi`s sarcoma-associated h
auuuuccaaggccugugcccaac

SEQ ID NO: 2152758 - RNA, 17 nt, Human herpesvirus 8 [Kaposi`s sarcoma-associated h
ggcgcaggcgaucgccg

SEQ ID NO: 2152759 - RNA, 17 nt, Human herpesvirus 8 [Kaposi`s sarcoma-associated h
cgguuuacuugcagcag

SEQ ID NO: 2152760 - RNA, 23 nt, Human herpesvirus 8 [Kaposi`s sarcoma-associated h
caacccacgccgucacagucgcc

SEQ ID NO: 2152761 - RNA, 18 nt, Human herpesvirus 8 [Kaposi`s sarcoma-associated h
cgagcaccucagaaagug

SEQ ID NO: 2152762 - RNA, 16 nt, Human herpesvirus 8 [Kaposi`s sarcoma-associated h
caccacaucugcuguc

SEQ ID NO: 2152763 - RNA, 16 nt, Human herpesvirus 8 [Kaposi`s sarcoma-associated h
cagccggucgccaggg

SEQ ID NO: 2152764 - RNA, 17 nt, Human herpesvirus 8 [Kaposi`s sarcoma-associated h
ucacgcacuuggcccug

SEQ ID NO: 2152765 - RNA, 17 nt, Human herpesvirus 8 [Kaposi`s sarcoma-associated h
gugcccaaaucuguccu

SEQ ID NO: 2152766 - RNA, 23 nt, Human herpesvirus 8 [Kaposi`s sarcoma-associated h
auuucucgccucccaacauguaa

SEQ ID NO: 2152767 - RNA, 17 nt, Human herpesvirus 8 [Kaposi`s sarcoma-associated h
aucaauaaagagaccaa

SEQ ID NO: 2152768 - RNA, 24 nt, Human herpesvirus 8 [Kaposi`s sarcoma-associated h
cauuugcgugcaaaaugugcuuug

SEQ ID NO: 2152769 - RNA, 19 nt, Human herpesvirus 8 [Kaposi`s sarcoma-associated h
ucugaaacuaccagccauc

SEQ ID NO: 2152770 - RNA, 15 nt, Human herpesvirus 8 [Kaposi`s sarcoma-associated h
gagggaauggccucc

SEQ ID NO: 2152771 - RNA, 15 nt, Human herpesvirus 8 [Kaposi`s sarcoma-associated h
cggaaacugggcacg

SEQ ID NO: 2152772 - RNA, 19 nt, Human herpesvirus 8 [Kaposi`s sarcoma-associated h
ccauccccccaccccucau

SEQ ID NO: 2152773 - RNA, 13 nt, Human herpesvirus 8 [Kaposi`s sarcoma-associated h
agauuuaagauua

SEQ ID NO: 2152774 - RNA, 18 nt, Human herpesvirus 8 [Kaposi`s sarcoma-associated h
cagcaauaaacccacagc

SEQ ID NO: 2152775 - RNA, 23 nt, Human herpesvirus 8 [Kaposi`s sarcoma-associated h
cagguaugaccggcuuguuuaua

SEQ ID NO: 2152776 - RNA, 19 nt, Human herpesvirus 8 [Kaposi`s sarcoma-associated h
uuguggcaccugaggugcu

SEQ ID NO: 2152777 - RNA, 15 nt, Human herpesvirus 8 [Kaposi`s sarcoma-associated h
ugcugccacugccac

SEQ ID NO: 2152778 - RNA, 21 nt, Human herpesvirus 8 [Kaposi`s sarcoma-associated h
caacccagcaugccugcgcug

SEQ ID NO: 2152779 - RNA, 14 nt, Human herpesvirus 8 [Kaposi`s sarcoma-associated h
ccagaagagcauuu

SEQ ID NO: 2152780 - RNA, 21 nt, Human herpesvirus 8 [Kaposi`s sarcoma-associated h
gucucaggugucugcgggaca

SEQ ID NO: 2152781 - RNA, 18 nt, Human herpesvirus 8 [Kaposi`s sarcoma-associated h
ccgucagggcccacggug

SEQ ID NO: 2152782 - RNA, 15 nt, Human herpesvirus 8 [Kaposi`s sarcoma-associated h
gccguucccaugagc

SEQ ID NO: 2152783 - RNA, 15 nt, Human herpesvirus 8 [Kaposi`s sarcoma-associated h
gucugaaacgggaca

SEQ ID NO: 2152784 - RNA, 20 nt, Human herpesvirus 8 [Kaposi`s sarcoma-associated h
agaugaauaugauccuguag

SEQ ID NO: 2152785 - RNA, 13 nt, Human herpesvirus 8 [Kaposi`s sarcoma-associated h
cugccuaggaccu

SEQ ID NO: 2152786 - RNA, 21 nt, Human herpesvirus 8 [Kaposi`s sarcoma-associated h
gccuaucaaucugagaaaagu

SEQ ID NO: 2152787 - RNA, 21 nt, Human herpesvirus 8 [Kaposi`s sarcoma-associated h
uggggguggggggaggaggaa

SEQ ID NO: 2152788 - RNA, 16 nt, Human herpesvirus 8 [Kaposi`s sarcoma-associated h
cauggaauuguauaga

SEQ ID NO: 2152789 - RNA, 18 nt, Human herpesvirus 8 [Kaposi`s sarcoma-associated h
ggugaucuuaggccagga

SEQ ID NO: 2152790 - RNA, 16 nt, Human herpesvirus 8 [Kaposi`s sarcoma-associated h
aacacguaccugaccu

SEQ ID NO: 2152791 - RNA, 18 nt, Human herpesvirus 8 [Kaposi`s sarcoma-associated h
accgagcucugcugccug

SEQ ID NO: 2152792 - RNA, 12 nt, Human herpesvirus 8 [Kaposi`s sarcoma-associated h
aggccaggaccc

SEQ ID NO: 2152793 - RNA, 16 nt, Human herpesvirus 8 [Kaposi`s sarcoma-associated h
ugaaccccguguggga

SEQ ID NO: 2152794 - RNA, 17 nt, Human herpesvirus 8 [Kaposi`s sarcoma-associated h
augagugaaaaggaagc

SEQ ID NO: 2152795 - RNA, 20 nt, Human herpesvirus 8 [Kaposi`s sarcoma-associated h
gcugccccaaaaggcgaggc

SEQ ID NO: 2152796 - RNA, 13 nt, Human herpesvirus 8 [Kaposi`s sarcoma-associated h
gcugcucagacag

SEQ ID NO: 2152797 - RNA, 14 nt, Human herpesvirus 8 [Kaposi`s sarcoma-associated h
cccagacgacccca

SEQ ID NO: 2152798 - RNA, 13 nt, Human herpesvirus 8 [Kaposi`s sarcoma-associated h
guaauguguuuua

SEQ ID NO: 2152799 - RNA, 16 nt, Human herpesvirus 8 [Kaposi`s sarcoma-associated h
caucgcucaaacucau

SEQ ID NO: 2152800 - RNA, 12 nt, Human herpesvirus 8 [Kaposi`s sarcoma-associated h
gcaagcacagaa

SEQ ID NO: 2152801 - RNA, 22 nt, Human herpesvirus 8 [Kaposi`s sarcoma-associated h
ggcuagauuaaauuaaggggga

SEQ ID NO: 2152802 - RNA, 21 nt, Human herpesvirus 8 [Kaposi`s sarcoma-associated h
ugcagggcgcugcucuuguca

SEQ ID NO: 2152803 - RNA, 20 nt, Human herpesvirus 8 [Kaposi`s sarcoma-associated h
agacauagugacuguagaca

SEQ ID NO: 2152804 - RNA, 23 nt, Human herpesvirus 8 [Kaposi`s sarcoma-associated h
augaauaacuuuauuacagguau

SEQ ID NO: 2152805 - RNA, 17 nt, Human herpesvirus 8 [Kaposi`s sarcoma-associated h
cucagacaccgucgcca

SEQ ID NO: 2152806 - RNA, 11 nt, Human herpesvirus 8 [Kaposi`s sarcoma-associated h
ucccacugcug

SEQ ID NO: 2152807 - RNA, 14 nt, Human herpesvirus 8 [Kaposi`s sarcoma-associated h
auggcaacugccaa

SEQ ID NO: 2152808 - RNA, 19 nt, Human herpesvirus 8 [Kaposi`s sarcoma-associated h
cugccugucagauuuacaa

SEQ ID NO: 2152809 - RNA, 13 nt, Human herpesvirus 8 [Kaposi`s sarcoma-associated h
ugucugauucuua

SEQ ID NO: 2152810 - RNA, 18 nt, Human herpesvirus 8 [Kaposi`s sarcoma-associated h
acugcuuguucaggagcu

SEQ ID NO: 2152811 - RNA, 19 nt, Human herpesvirus 8 [Kaposi`s sarcoma-associated h
ccacaugauuugauacagg

SEQ ID NO: 2152812 - RNA, 15 nt, Human herpesvirus 8 [Kaposi`s sarcoma-associated h
acagacgacugggcc

SEQ ID NO: 2152813 - RNA, 15 nt, Human herpesvirus 8 [Kaposi`s sarcoma-associated h
uagcuucagcuucag

SEQ ID NO: 2152814 - RNA, 15 nt, Human herpesvirus 8 [Kaposi`s sarcoma-associated h
aaguagucagacauu

SEQ ID NO: 2152815 - RNA, 14 nt, Human herpesvirus 8 [Kaposi`s sarcoma-associated h
aagccgagcucggg

SEQ ID NO: 2152816 - RNA, 15 nt, Human herpesvirus 8 [Kaposi`s sarcoma-associated h
uacugguaccagaga

SEQ ID NO: 2152817 - RNA, 14 nt, Human herpesvirus 8 [Kaposi`s sarcoma-associated h
gccuucgcacccca

SEQ ID NO: 2152818 - RNA, 20 nt, Human herpesvirus 8 [Kaposi`s sarcoma-associated h
agcgcgcucugucgcucuuc

SEQ ID NO: 2152819 - RNA, 22 nt, Human herpesvirus 8 [Kaposi`s sarcoma-associated h
ugccagugggguugggguccag

SEQ ID NO: 2152820 - RNA, 19 nt, Human herpesvirus 8 [Kaposi`s sarcoma-associated h
caguguuaucuuugcagug

SEQ ID NO: 2152821 - RNA, 17 nt, Human herpesvirus 8 [Kaposi`s sarcoma-associated h
acgccgauagggcggcc

SEQ ID NO: 2152822 - RNA, 12 nt, Human herpesvirus 8 [Kaposi`s sarcoma-associated h
gcggugcugccc

SEQ ID NO: 2152823 - RNA, 19 nt, Human herpesvirus 8 [Kaposi`s sarcoma-associated h
uacgucccucuuggcuguu

SEQ ID NO: 2152824 - RNA, 22 nt, Human herpesvirus 8 [Kaposi`s sarcoma-associated h
gauaauugagcgcugugcuuuu

SEQ ID NO: 2152825 - RNA, 16 nt, Human herpesvirus 8 [Kaposi`s sarcoma-associated h
gcaggagucagagcag

SEQ ID NO: 2152826 - RNA, 16 nt, Human herpesvirus 8 [Kaposi`s sarcoma-associated h
uggaaagcuccucgag

SEQ ID NO: 2152827 - RNA, 23 nt, Human herpesvirus 8 [Kaposi`s sarcoma-associated h
aucccccccgcaggccagccacc

SEQ ID NO: 2152828 - RNA, 16 nt, Human herpesvirus 8 [Kaposi`s sarcoma-associated h
cggcuccguccuggug

SEQ ID NO: 2152829 - RNA, 14 nt, Human herpesvirus 8 [Kaposi`s sarcoma-associated h
gcuauaggacagaa

SEQ ID NO: 2152830 - RNA, 15 nt, Human herpesvirus 8 [Kaposi`s sarcoma-associated h
ugggaucgaacagaa

SEQ ID NO: 2152831 - RNA, 15 nt, Human herpesvirus 8 [Kaposi`s sarcoma-associated h
uauagugguuuacau

SEQ ID NO: 2152832 - RNA, 16 nt, Human herpesvirus 8 [Kaposi`s sarcoma-associated h
ccaguucccccacacc

SEQ ID NO: 2152833 - RNA, 19 nt, Human herpesvirus 8 [Kaposi`s sarcoma-associated h
aucugcugucuaguggaga

SEQ ID NO: 2152834 - RNA, 22 nt, Human herpesvirus 8 [Kaposi`s sarcoma-associated h
uccaccgccgcgcaugguguau

SEQ ID NO: 2152835 - RNA, 22 nt, Human herpesvirus 8 [Kaposi`s sarcoma-associated h
ccuucuggcuuggcgcuuagcc

SEQ ID NO: 2152836 - RNA, 18 nt, Human herpesvirus 8 [Kaposi`s sarcoma-associated h
aauuucuuauaacacuaa

SEQ ID NO: 2152837 - RNA, 13 nt, Human herpesvirus 8 [Kaposi`s sarcoma-associated h
aaucgaagccagg

SEQ ID NO: 2152838 - RNA, 15 nt, Human herpesvirus 8 [Kaposi`s sarcoma-associated h
accggcaucugcaag

SEQ ID NO: 2152839 - RNA, 16 nt, Human herpesvirus 8 [Kaposi`s sarcoma-associated h
auucccaaacacauca

SEQ ID NO: 2152840 - RNA, 17 nt, Human herpesvirus 8 [Kaposi`s sarcoma-associated h
agguugaaagccggggu

SEQ ID NO: 2152841 - RNA, 17 nt, Human herpesvirus 8 [Kaposi`s sarcoma-associated h
gacugggucuaucugga

SEQ ID NO: 2152842 - RNA, 19 nt, Human herpesvirus 8 [Kaposi`s sarcoma-associated h
gucuacuucgcuaacugua

SEQ ID NO: 2152843 - RNA, 17 nt, Human herpesvirus 8 [Kaposi`s sarcoma-associated h
ucuguuacuggcaccua

SEQ ID NO: 2152844 - RNA, 20 nt, Human herpesvirus 8 [Kaposi`s sarcoma-associated h
ggcgcgccacagucgagccg

SEQ ID NO: 2152845 - RNA, 21 nt, Human herpesvirus 8 [Kaposi`s sarcoma-associated h
caccacgcccgggggccagga

SEQ ID NO: 2152846 - RNA, 14 nt, Human herpesvirus 8 [Kaposi`s sarcoma-associated h
aggaagcauccgga

SEQ ID NO: 2152847 - RNA, 14 nt, Human herpesvirus 8 [Kaposi`s sarcoma-associated h
auaaaagagagaau

SEQ ID NO: 2152848 - RNA, 18 nt, Human herpesvirus 8 [Kaposi`s sarcoma-associated h
aacgcacaucagcggcac

SEQ ID NO: 2152849 - RNA, 17 nt, Human herpesvirus 8 [Kaposi`s sarcoma-associated h
gcauaauaaaacaaaua

SEQ ID NO: 2152850 - RNA, 13 nt, Human herpesvirus 8 [Kaposi`s sarcoma-associated h
gauguuuuccagc

SEQ ID NO: 2152851 - RNA, 15 nt, Human herpesvirus 8 [Kaposi`s sarcoma-associated h
cggagccggaagaua

SEQ ID NO: 2152852 - RNA, 22 nt, Human herpesvirus 8 [Kaposi`s sarcoma-associated h
cgacaaggacuuuuauagauuu

SEQ ID NO: 2152853 - RNA, 20 nt, Human herpesvirus 8 [Kaposi`s sarcoma-associated h
gcaugugguuaagcuuugca

SEQ ID NO: 2152854 - RNA, 17 nt, Human herpesvirus 8 [Kaposi`s sarcoma-associated h
cacggaaggcaguggag

SEQ ID NO: 2152855 - RNA, 17 nt, Human herpesvirus 8 [Kaposi`s sarcoma-associated h
ugcaauacccuguuuca

SEQ ID NO: 2152856 - RNA, 14 nt, Human herpesvirus 8 [Kaposi`s sarcoma-associated h
cgucgccuuaccau

SEQ ID NO: 2152857 - RNA, 17 nt, Human herpesvirus 8 [Kaposi`s sarcoma-associated h
aguguuaucuuugcagu

SEQ ID NO: 2152858 - RNA, 13 nt, Human herpesvirus 8 [Kaposi`s sarcoma-associated h
uugcagugugcag

SEQ ID NO: 2152859 - RNA, 16 nt, Human herpesvirus 8 [Kaposi`s sarcoma-associated h
augcucaggucuguca

SEQ ID NO: 2152860 - RNA, 12 nt, Human herpesvirus 8 [Kaposi`s sarcoma-associated h
cggcgcgccugu

SEQ ID NO: 2152861 - RNA, 15 nt, Human herpesvirus 8 [Kaposi`s sarcoma-associated h
ccacaucggugccuu

SEQ ID NO: 2152862 - RNA, 16 nt, Human herpesvirus 8 [Kaposi`s sarcoma-associated h
gcuaggauucgugcag

SEQ ID NO: 2152863 - RNA, 20 nt, Human herpesvirus 8 [Kaposi`s sarcoma-associated h
caacaugcccuuuucugaaa

SEQ ID NO: 2152864 - RNA, 13 nt, Human herpesvirus 8 [Kaposi`s sarcoma-associated h
gugaaguucauau

SEQ ID NO: 2152865 - RNA, 22 nt, Human herpesvirus 8 [Kaposi`s sarcoma-associated h
guucauauucccaccuccaccu

SEQ ID NO: 2152866 - RNA, 17 nt, Human herpesvirus 8 [Kaposi`s sarcoma-associated h
agacaaacaugugggcu

SEQ ID NO: 2152867 - RNA, 15 nt, Human herpesvirus 8 [Kaposi`s sarcoma-associated h
cagaagagcauuuuu

SEQ ID NO: 2152868 - RNA, 15 nt, Human herpesvirus 8 [Kaposi`s sarcoma-associated h
ccuucgaggccaggc

SEQ ID NO: 2152869 - RNA, 19 nt, Human herpesvirus 8 [Kaposi`s sarcoma-associated h
uaaaagcauugucuuaagu

SEQ ID NO: 2152870 - RNA, 22 nt, Human herpesvirus 8 [Kaposi`s sarcoma-associated h
accauccccccaccccucauuu

SEQ ID NO: 2152871 - RNA, 23 nt, Human herpesvirus 8 [Kaposi`s sarcoma-associated h
gaaucgaacaauaauaaaaacau

SEQ ID NO: 2152872 - RNA, 18 nt, Human herpesvirus 8 [Kaposi`s sarcoma-associated h
ugguugauugugacuauu

SEQ ID NO: 2152873 - RNA, 23 nt, Human herpesvirus 8 [Kaposi`s sarcoma-associated h
ccaacauguaaauuggccacugc

SEQ ID NO: 2152874 - RNA, 17 nt, Human herpesvirus 8 [Kaposi`s sarcoma-associated h
ugcucuuccuccuaguc

SEQ ID NO: 2152875 - RNA, 12 nt, Human herpesvirus 8 [Kaposi`s sarcoma-associated h
cggacgccagga

SEQ ID NO: 2152876 - RNA, 14 nt, Human herpesvirus 8 [Kaposi`s sarcoma-associated h
uuuuguugugagca

SEQ ID NO: 2152877 - RNA, 16 nt, Human herpesvirus 8 [Kaposi`s sarcoma-associated h
gaacagaagacccaga

SEQ ID NO: 2152878 - RNA, 17 nt, Human herpesvirus 8 [Kaposi`s sarcoma-associated h
aaucuggcaugcuggga

SEQ ID NO: 2152879 - RNA, 21 nt, Human herpesvirus 8 [Kaposi`s sarcoma-associated h
accugaggugcucuucccaca

SEQ ID NO: 2152880 - RNA, 13 nt, Human herpesvirus 8 [Kaposi`s sarcoma-associated h
acuaccagccauc

SEQ ID NO: 2152881 - RNA, 23 nt, Human herpesvirus 8 [Kaposi`s sarcoma-associated h
guggcaacauacauuuuucugaa

SEQ ID NO: 2152882 - RNA, 17 nt, Human herpesvirus 8 [Kaposi`s sarcoma-associated h
cgccaccuagcgggcac

SEQ ID NO: 2152883 - RNA, 20 nt, Human herpesvirus 8 [Kaposi`s sarcoma-associated h
guguaucccccacaggacaa

SEQ ID NO: 2152884 - RNA, 17 nt, Human herpesvirus 8 [Kaposi`s sarcoma-associated h
uuagauggcacagaguc

SEQ ID NO: 2152885 - RNA, 21 nt, Human herpesvirus 8 [Kaposi`s sarcoma-associated h
uggcaagaaauccgagcaccu

SEQ ID NO: 2152886 - RNA, 18 nt, Human herpesvirus 8 [Kaposi`s sarcoma-associated h
gaagcaaagugucucacc

SEQ ID NO: 2152887 - RNA, 23 nt, Human herpesvirus 8 [Kaposi`s sarcoma-associated h
uaaaagacucuagauaaaugggu

SEQ ID NO: 2152888 - RNA, 22 nt, Human herpesvirus 8 [Kaposi`s sarcoma-associated h
auggcaguggacacagucuggg

SEQ ID NO: 2152889 - RNA, 24 nt, Human herpesvirus 8 [Kaposi`s sarcoma-associated h
agucgggacucgcgcaugcgugaa

SEQ ID NO: 2152890 - RNA, 18 nt, Human herpesvirus 8 [Kaposi`s sarcoma-associated h
cggugcaugugacccggc

SEQ ID NO: 2152891 - RNA, 20 nt, Human herpesvirus 8 [Kaposi`s sarcoma-associated h
agcccuguuucugugccccc

SEQ ID NO: 2152892 - RNA, 14 nt, Human herpesvirus 8 [Kaposi`s sarcoma-associated h
ccauagcagucgcc

SEQ ID NO: 2152893 - RNA, 19 nt, Human herpesvirus 8 [Kaposi`s sarcoma-associated h
ccaagaucuuccagucucc

SEQ ID NO: 2152894 - RNA, 19 nt, Human herpesvirus 8 [Kaposi`s sarcoma-associated h
ccaacuucaucacaucccc

SEQ ID NO: 2152895 - RNA, 22 nt, Human herpesvirus 8 [Kaposi`s sarcoma-associated h
augucauuuuuacuuuuacaag

SEQ ID NO: 2152896 - RNA, 16 nt, Human herpesvirus 8 [Kaposi`s sarcoma-associated h
cgccccuggugggaca

SEQ ID NO: 2152897 - RNA, 13 nt, Human herpesvirus 8 [Kaposi`s sarcoma-associated h
cccggauuccucc

SEQ ID NO: 2152898 - RNA, 21 nt, Human herpesvirus 8 [Kaposi`s sarcoma-associated h
ucauguaccuggcguccagcu

SEQ ID NO: 2152899 - RNA, 22 nt, Human herpesvirus 8 [Kaposi`s sarcoma-associated h
cacuauggggucaggguggacg

SEQ ID NO: 2152900 - RNA, 19 nt, Human herpesvirus 8 [Kaposi`s sarcoma-associated h
agacggucuuuaggggcac

SEQ ID NO: 2152901 - RNA, 20 nt, Human herpesvirus 8 [Kaposi`s sarcoma-associated h
cacccuauuggucacaucuc

SEQ ID NO: 2152902 - RNA, 14 nt, Human herpesvirus 8 [Kaposi`s sarcoma-associated h
acgcagggugcggu

SEQ ID NO: 2152903 - RNA, 20 nt, Human herpesvirus 8 [Kaposi`s sarcoma-associated h
cagccucacggacaacgcca

SEQ ID NO: 2152904 - RNA, 15 nt, Human herpesvirus 8 [Kaposi`s sarcoma-associated h
gcagacgaccccccg

SEQ ID NO: 2152905 - RNA, 17 nt, Human herpesvirus 8 [Kaposi`s sarcoma-associated h
cugguucaggauuucga

SEQ ID NO: 2152906 - RNA, 14 nt, Human herpesvirus 8 [Kaposi`s sarcoma-associated h
cugucagauuuaca

SEQ ID NO: 2152907 - RNA, 14 nt, Human herpesvirus 8 [Kaposi`s sarcoma-associated h
cgacagcucgggcg

SEQ ID NO: 2152908 - RNA, 21 nt, Human herpesvirus 8 [Kaposi`s sarcoma-associated h
cgaaguguugauccuggggcg

SEQ ID NO: 2152909 - RNA, 12 nt, Human herpesvirus 8 [Kaposi`s sarcoma-associated h
ccacgcuaugug

SEQ ID NO: 2152910 - RNA, 19 nt, Human herpesvirus 8 [Kaposi`s sarcoma-associated h
aucugguugacacccugga

SEQ ID NO: 2152911 - RNA, 20 nt, Human herpesvirus 8 [Kaposi`s sarcoma-associated h
caugcugccacugccacgga

SEQ ID NO: 2152912 - RNA, 12 nt, Human herpesvirus 8 [Kaposi`s sarcoma-associated h
cauaauccccgg

SEQ ID NO: 2152913 - RNA, 17 nt, Human herpesvirus 8 [Kaposi`s sarcoma-associated h
aguauagugguuuacau

SEQ ID NO: 2152914 - RNA, 15 nt, Human herpesvirus 8 [Kaposi`s sarcoma-associated h
aacgugccugccaag

SEQ ID NO: 2152915 - RNA, 22 nt, Human herpesvirus 8 [Kaposi`s sarcoma-associated h
ucccagggugcgaaggaccuga

SEQ ID NO: 2152916 - RNA, 14 nt, Human herpesvirus 8 [Kaposi`s sarcoma-associated h
acuaaaaaggccac

SEQ ID NO: 2152917 - RNA, 20 nt, Human herpesvirus 8 [Kaposi`s sarcoma-associated h
caccaagccucccgugauug

SEQ ID NO: 2152918 - RNA, 17 nt, Human herpesvirus 8 [Kaposi`s sarcoma-associated h
cacggugcacugaagcg

SEQ ID NO: 2152919 - RNA, 19 nt, Human herpesvirus 8 [Kaposi`s sarcoma-associated h
acaucccccccgcaggcca

SEQ ID NO: 2152920 - RNA, 22 nt, Human herpesvirus 8 [Kaposi`s sarcoma-associated h
acaugagagacugcaggccauc

SEQ ID NO: 2152921 - RNA, 23 nt, Human herpesvirus 8 [Kaposi`s sarcoma-associated h
aaggcacaacucuacugcacaaa

SEQ ID NO: 2152922 - RNA, 16 nt, Human herpesvirus 8 [Kaposi`s sarcoma-associated h
caagaucuuccagucu

SEQ ID NO: 2152923 - RNA, 19 nt, Human herpesvirus 8 [Kaposi`s sarcoma-associated h
caacuucaucacauccccg

SEQ ID NO: 2152924 - RNA, 12 nt, Human herpesvirus 8 [Kaposi`s sarcoma-associated h
aucaucgguagc

SEQ ID NO: 2152925 - RNA, 23 nt, Human herpesvirus 8 [Kaposi`s sarcoma-associated h
cacacguagggcuuuacccucug

SEQ ID NO: 2152926 - RNA, 17 nt, Human herpesvirus 8 [Kaposi`s sarcoma-associated h
ccaugggugcuggugug

SEQ ID NO: 2152927 - RNA, 20 nt, Human herpesvirus 8 [Kaposi`s sarcoma-associated h
cuggcaugcugggauuuaga

SEQ ID NO: 2152928 - RNA, 19 nt, Human herpesvirus 8 [Kaposi`s sarcoma-associated h
cgggguccacggcgauguc

SEQ ID NO: 2152929 - RNA, 13 nt, Human herpesvirus 8 [Kaposi`s sarcoma-associated h
gccauucgcacca

SEQ ID NO: 2152930 - RNA, 20 nt, Human herpesvirus 8 [Kaposi`s sarcoma-associated h
ggaauacguccgucgguagc

SEQ ID NO: 2152931 - RNA, 16 nt, Human herpesvirus 8 [Kaposi`s sarcoma-associated h
gugacgugacgcccug

SEQ ID NO: 2152932 - RNA, 21 nt, Human herpesvirus 8 [Kaposi`s sarcoma-associated h
gccuagugggguggcgcgcca

SEQ ID NO: 2152933 - RNA, 23 nt, Human herpesvirus 8 [Kaposi`s sarcoma-associated h
ugaugguguuggacaccaccguc

SEQ ID NO: 2152934 - RNA, 23 nt, Human herpesvirus 8 [Kaposi`s sarcoma-associated h
guggcuuuugccuaaaaagaugc

SEQ ID NO: 2152935 - RNA, 20 nt, Human herpesvirus 8 [Kaposi`s sarcoma-associated h
uucacccgagccacaucguc

SEQ ID NO: 2152936 - RNA, 13 nt, Human herpesvirus 8 [Kaposi`s sarcoma-associated h
uucccccaucguc

SEQ ID NO: 2152937 - RNA, 19 nt, Human herpesvirus 8 [Kaposi`s sarcoma-associated h
uugugcucgacggagacac

SEQ ID NO: 2152938 - RNA, 19 nt, Human herpesvirus 8 [Kaposi`s sarcoma-associated h
uuggguugggaggugaccc

SEQ ID NO: 2152939 - RNA, 20 nt, Human herpesvirus 8 [Kaposi`s sarcoma-associated h
uguccucauuagucgggacu

SEQ ID NO: 2152940 - RNA, 16 nt, Human herpesvirus 8 [Kaposi`s sarcoma-associated h
ccgcccccuggugcuc

SEQ ID NO: 2152941 - RNA, 16 nt, Human herpesvirus 8 [Kaposi`s sarcoma-associated h
uccuccggugacugga

SEQ ID NO: 2152942 - RNA, 13 nt, Human herpesvirus 8 [Kaposi`s sarcoma-associated h
ggcgcucagggug

SEQ ID NO: 2152943 - RNA, 20 nt, Human herpesvirus 8 [Kaposi`s sarcoma-associated h
aggaucggaucuuuuacaau

SEQ ID NO: 2152944 - RNA, 20 nt, Human herpesvirus 8 [Kaposi`s sarcoma-associated h
agauaacggugucuaacugc

SEQ ID NO: 2152945 - RNA, 23 nt, Human herpesvirus 8 [Kaposi`s sarcoma-associated h
agcacacugugugguugguggug

SEQ ID NO: 2152946 - RNA, 17 nt, Human herpesvirus 8 [Kaposi`s sarcoma-associated h
agcacuagguuagguug

SEQ ID NO: 2152947 - RNA, 16 nt, Human herpesvirus 8 [Kaposi`s sarcoma-associated h
accugaugcaggccac

SEQ ID NO: 2152948 - RNA, 20 nt, Human herpesvirus 8 [Kaposi`s sarcoma-associated h
cauccgcgagccauucaucg

SEQ ID NO: 2152949 - RNA, 13 nt, Human herpesvirus 8 [Kaposi`s sarcoma-associated h
ccacagcaucccc

SEQ ID NO: 2152950 - RNA, 20 nt, Human herpesvirus 8 [Kaposi`s sarcoma-associated h
ccacaggacaagcugaugug

SEQ ID NO: 2152951 - RNA, 15 nt, Human herpesvirus 8 [Kaposi`s sarcoma-associated h
cguaaaccucgggcc

SEQ ID NO: 2152952 - RNA, 23 nt, Human herpesvirus 8 [Kaposi`s sarcoma-associated h
gaaugguaccauggcaaaaaaca

SEQ ID NO: 2152953 - RNA, 20 nt, Human herpesvirus 8 [Kaposi`s sarcoma-associated h
ucaccggaggaaugguggac

SEQ ID NO: 2152954 - RNA, 17 nt, Human herpesvirus 8 [Kaposi`s sarcoma-associated h
ugccaauaacccgcccu

SEQ ID NO: 2152955 - RNA, 22 nt, Human herpesvirus 8 [Kaposi`s sarcoma-associated h
ucacggacuuuauuauagaugc

SEQ ID NO: 2152956 - RNA, 23 nt, Human herpesvirus 8 [Kaposi`s sarcoma-associated h
gagugucaguaaaauaaaauaca

SEQ ID NO: 2152957 - RNA, 13 nt, Human herpesvirus 8 [Kaposi`s sarcoma-associated h
gagguuugaggcg

SEQ ID NO: 2152958 - RNA, 19 nt, Human herpesvirus 8 [Kaposi`s sarcoma-associated h
gcaccacggauggaauccg

SEQ ID NO: 2152959 - RNA, 23 nt, Human
agcuucuuaauauaacugccuua

SEQ ID NO: 2152960 - RNA, 22 nt, Human
agcuucuuaauauaacugccuu

SEQ ID NO: 2152961 - RNA, 21 nt, Human
agcuucuuaauauaacugccu

SEQ ID NO: 2152962 - RNA, 20 nt, Human
agcuucuuaauauaacugcc

SEQ ID NO: 2152963 - RNA, 23 nt, Human
agcuuccuuuguuuuuuuuuccu

SEQ ID NO: 2152964 - RNA, 20 nt, Human
agggacucaucauuuccauu

SEQ ID NO: 2152965 - RNA, 14 nt, Human
agaugaccccuccc

SEQ ID NO: 2152966 - RNA, 18 nt, Human
agagaggacgugggcggc

SEQ ID NO: 2152967 - RNA, 23 nt, Human
agcccaaagugguauagaaaugc

SEQ ID NO: 2152968 - RNA, 20 nt, Human
agcccaaagugguauagaaa

SEQ ID NO: 2152969 - RNA, 11 nt, Human
agccuccugag

SEQ ID NO: 2152970 - RNA, 11 nt, Human
augaccccucc

SEQ ID NO: 2152971 - RNA, 15 nt, Human
aucucucuucuuuuc

SEQ ID NO: 2152972 - RNA, 16 nt, Human
agucaaggaguggcuu

SEQ ID NO: 2152973 - RNA, 16 nt, Human
aguccacaguggaacc

SEQ ID NO: 2152974 - RNA, 23 nt, Human
aguuguuaauaaaaguacauguu

SEQ ID NO: 2152975 - RNA, 17 nt, Human
auaugcaguuuuccuua

SEQ ID NO: 2152976 - RNA, 24 nt, Human
acaacuugcacguauuuuaauagc

SEQ ID NO: 2152977 - RNA, 16 nt, Human
acauccaagcuuccuu

SEQ ID NO: 2152978 - RNA, 17 nt, Human
acauguuaaacuuacuu

SEQ ID NO: 2152979 - RNA, 20 nt, Human
agaaaagggaacugaacauu

SEQ ID NO: 2152980 - RNA, 19 nt, Human
acgugauuuugcuguagaa

SEQ ID NO: 2152981 - RNA, 14 nt, Human
aacuuuuuuuuaag

SEQ ID NO: 2152982 - RNA, 20 nt, Human
aacuuuuuuuuaaguuacac

SEQ ID NO: 2152983 - RNA, 14 nt, Human
aacugaauuuuguc

SEQ ID NO: 2152984 - RNA, 15 nt, Human
aacugaauuuugucu

SEQ ID NO: 2152985 - RNA, 23 nt, Human
aaagugagacuuugaggguguau

SEQ ID NO: 2152986 - RNA, 12 nt, Human
aaagugcuggga

SEQ ID NO: 2152987 - RNA, 21 nt, Human
aaagggaacugaacauuccag

SEQ ID NO: 2152988 - RNA, 16 nt, Human
aaagggaacugaacau

SEQ ID NO: 2152989 - RNA, 22 nt, Human
aauauaacugccuuaaaacuuu

SEQ ID NO: 2152990 - RNA, 21 nt, Human
aagaaauuuccacucaggucu

SEQ ID NO: 2152991 - RNA, 15 nt, Human
aaguuguuaauaaaa

SEQ ID NO: 2152992 - RNA, 17 nt, Human
aagugguauagaaaugc

SEQ ID NO: 2152993 - RNA, 13 nt, Human
aagugguauagaa

SEQ ID NO: 2152994 - RNA, 20 nt, Human
cugaguagcuggauuacagg

SEQ ID NO: 2152995 - RNA, 19 nt, Human
cugaguagcuggauuacag

SEQ ID NO: 2152996 - RNA, 21 nt, Human
cucgugguaggacuguagaaa

SEQ ID NO: 2152997 - RNA, 12 nt, Human
cucucaccuccu

SEQ ID NO: 2152998 - RNA, 17 nt, Human
cuccuaaaguagacuuc

SEQ ID NO: 2152999 - RNA, 13 nt, Human
cucaaacuccuga

SEQ ID NO: 2153000 - RNA, 14 nt, Human
cucaaacuccugac

SEQ ID NO: 2153001 - RNA, 13 nt, Human
cuacaguguacag

SEQ ID NO: 2153002 - RNA, 17 nt, Human
cgacugccaucuuggac

SEQ ID NO: 2153003 - RNA, 18 nt, Human
cgugauuuugcuguagaa

SEQ ID NO: 2153004 - RNA, 11 nt, Human
cccagcuguuu

SEQ ID NO: 2153005 - RNA, 21 nt, Human
ccuguccuucucucaccuccu

SEQ ID NO: 2153006 - RNA, 23 nt, Human
ccgcaggauuugggcucuuggaa

SEQ ID NO: 2153007 - RNA, 16 nt, Human
cauguuggccaggcug

SEQ ID NO: 2153008 - RNA, 17 nt, Human
cagucaaggaguggcuu

SEQ ID NO: 2153009 - RNA, 17 nt, Human
caggccacggcagccua

SEQ ID NO: 2153010 - RNA, 21 nt, Human
cagcuguuuaugcauagauaa

SEQ ID NO: 2153011 - RNA, 23 nt, Human
caccuacaguguacagucuugua

SEQ ID NO: 2153012 - RNA, 18 nt, Human
cacauuuuucagauauaa

SEQ ID NO: 2153013 - RNA, 14 nt, Human
cacauuuuucagau

SEQ ID NO: 2153014 - RNA, 22 nt, Human
caaguaauccaccugccucggc

SEQ ID NO: 2153015 - RNA, 13 nt, Human
auuuuuaaagaaa

SEQ ID NO: 2153016 - RNA, 20 nt, Human
auuuuuaaagaaaaguuuug

SEQ ID NO: 2153017 - RNA, 13 nt, Human
auuguacaguuuu

SEQ ID NO: 2153018 - RNA, 15 nt, Human
auuucagauuuguga

SEQ ID NO: 2153019 - RNA, 16 nt, Human
ggauuuuugucuugug

SEQ ID NO: 2153020 - RNA, 14 nt, Human
ggauuuuugucuug

SEQ ID NO: 2153021 - RNA, 21 nt, Human
gguuccggaauccuguccuca

SEQ ID NO: 2153022 - RNA, 21 nt, Human
aaaguauccugcuucugauau

SEQ ID NO: 2153023 - RNA, 20 nt, Human
aaagugguauagaaaugcug

SEQ ID NO: 2153024 - RNA, 17 nt, Human
aaagugguauagaaaug

SEQ ID NO: 2153025 - RNA, 16 nt, Human
aaagugguauagaaau

SEQ ID NO: 2153026 - RNA, 14 nt, Human
aaagcuagaaauga

SEQ ID NO: 2153027 - RNA, 15 nt, Human
guaaagcuagaaaug

SEQ ID NO: 2153028 - RNA, 16 nt, Human
guaaagcuagaaauga

SEQ ID NO: 2153029 - RNA, 17 nt, Human
gggggccaccuccccag

SEQ ID NO: 2153030 - RNA, 13 nt, Human
gguauagaaaugc

SEQ ID NO: 2153031 - RNA, 14 nt, Human
gggcugggcagcug

SEQ ID NO: 2153032 - RNA, 13 nt, Human
gggcugggcagcu

SEQ ID NO: 2153033 - RNA, 15 nt, Human
aaaaucugcuaggga

SEQ ID NO: 2153034 - RNA, 22 nt, Human
gcuuuugcuggucacugccaug

SEQ ID NO: 2153035 - RNA, 21 nt, Human
gcuuuugcuggucacugccau

SEQ ID NO: 2153036 - RNA, 19 nt, Human
gcuuuugcuggucacugcc

SEQ ID NO: 2153037 - RNA, 15 nt, Human
gcuuuugcuggucac

SEQ ID NO: 2153038 - RNA, 12 nt, Human
gcggcagagagg

SEQ ID NO: 2153039 - RNA, 12 nt, Human
gcccccagacgc

SEQ ID NO: 2153040 - RNA, 22 nt, Human
gauggaaaaaccacccccaaau

SEQ ID NO: 2153041 - RNA, 17 nt, Human
gagaggacgugggcggc

SEQ ID NO: 2153042 - RNA, 16 nt, Human
gagaggacgugggcgg

SEQ ID NO: 2153043 - RNA, 22 nt, Human
gaggacgugggcggcagagagg

SEQ ID NO: 2153044 - RNA, 20 nt, Human
gaggacgugggcggcagaga

SEQ ID NO: 2153045 - RNA, 18 nt, Human
gaggacgugggcggcaga

SEQ ID NO: 2153046 - RNA, 16 nt, Human
gaggacgugggcggca

SEQ ID NO: 2153047 - RNA, 15 nt, Human
gaggacgugggcggc

SEQ ID NO: 2153048 - RNA, 23 nt, Human
gaggacuguugacauccaagcuu

SEQ ID NO: 2153049 - RNA, 14 nt, Human
cuuuuuuuuaaguu

SEQ ID NO: 2153050 - RNA, 16 nt, Human
cugguuuuucaguuuu

SEQ ID NO: 2153051 - RNA, 15 nt, Human
cugguuuuucaguuu

SEQ ID NO: 2153052 - RNA, 14 nt, Human
cugguuuuucaguu

SEQ ID NO: 2153053 - RNA, 23 nt, Human
cuguccuucucucaccuccuaaa

SEQ ID NO: 2153054 - RNA, 20 nt, Human
cuguccuucucucaccuccu

SEQ ID NO: 2153055 - RNA, 15 nt, Human
cuguccuucucucac

SEQ ID NO: 2153056 - RNA, 14 nt, Human
uuuugcuguagaag

SEQ ID NO: 2153057 - RNA, 13 nt, Human
uuuugcuguagaa

SEQ ID NO: 2153058 - RNA, 19 nt, Human
uuuuguuucauauugaugu

SEQ ID NO: 2153059 - RNA, 12 nt, Human
uuuuguuucaua

SEQ ID NO: 2153060 - RNA, 13 nt, Human
auuaaguuguuaa

SEQ ID NO: 2153061 - RNA, 20 nt, Human
auuaaguuguuaauaaaagu

SEQ ID NO: 2153062 - RNA, 19 nt, Human
auuaaguuguuaauaaaag

SEQ ID NO: 2153063 - RNA, 14 nt, Human
auuaaguuguuaau

SEQ ID NO: 2153064 - RNA, 14 nt, Human
augugcccccagac

SEQ ID NO: 2153065 - RNA, 12 nt, Human
augugcccccag

SEQ ID NO: 2153066 - RNA, 20 nt, Human
uuuuaggccaaaaaaaugua

SEQ ID NO: 2153067 - RNA, 12 nt, Human
uuuucaguuuuc

SEQ ID NO: 2153068 - RNA, 14 nt, Human
uuuucaguuuucag

SEQ ID NO: 2153069 - RNA, 18 nt, Human
auucuccugccucagccu

SEQ ID NO: 2153070 - RNA, 22 nt, Human
auuuccacucaggucuguuuuc

SEQ ID NO: 2153071 - RNA, 16 nt, Human
auuuuacuuuuuccug

SEQ ID NO: 2153072 - RNA, 17 nt, Human
auuuuacuuuuuccugg

SEQ ID NO: 2153073 - RNA, 21 nt, Human
augagccaccgcgcccagccu

SEQ ID NO: 2153074 - RNA, 18 nt, Human
augagccaccgcgcccag

SEQ ID NO: 2153075 - RNA, 16 nt, Human
uuucucaaagaaauuu

SEQ ID NO: 2153076 - RNA, 15 nt, Human
uuucucaaagaaauu

SEQ ID NO: 2153077 - RNA, 14 nt, Human
uuucucaaagaaau

SEQ ID NO: 2153078 - RNA, 21 nt, Human
uuucuuuaguuuuugugaagu

SEQ ID NO: 2153079 - RNA, 19 nt, Human
uuuccuuaaauuaucuaaa

SEQ ID NO: 2153080 - RNA, 21 nt, Human
uuuaaagaaaaguuuuguaaa

SEQ ID NO: 2153081 - RNA, 17 nt, Human
uuuaaagaaaaguuuug

SEQ ID NO: 2153082 - RNA, 15 nt, Human
uuuaaagaaaaguuu

SEQ ID NO: 2153083 - RNA, 13 nt, Human
uuuaaagaaaagu

SEQ ID NO: 2153084 - RNA, 19 nt, Human
uuuauuaaauguagaaagu

SEQ ID NO: 2153085 - RNA, 15 nt, Human
uuucaguuuucagga

SEQ ID NO: 2153086 - RNA, 22 nt, Human
uucagauauaaaagacugacca

SEQ ID NO: 2153087 - RNA, 20 nt, Human
uucauaucuauuuauuaaau

SEQ ID NO: 2153088 - RNA, 19 nt, Human
uuccuaacaggauuagaca

SEQ ID NO: 2153089 - RNA, 21 nt, Human
uuccggaauccuguccucagc

SEQ ID NO: 2153090 - RNA, 16 nt, Human
aucaauucauaucuau

SEQ ID NO: 2153091 - RNA, 12 nt, Human
auauuguacagu

SEQ ID NO: 2153092 - RNA, 14 nt, Human
auauuguacaguuu

SEQ ID NO: 2153093 - RNA, 13 nt, Human
auauuguacaguu

SEQ ID NO: 2153094 - RNA, 18 nt, Human
auccuguccucagcuucu

SEQ ID NO: 2153095 - RNA, 17 nt, Human
auccuguccucagcuuc

SEQ ID NO: 2153096 - RNA, 14 nt, Human
auccuguccucagc

SEQ ID NO: 2153097 - RNA, 21 nt, Human
auccugcuucugauaugcagu

SEQ ID NO: 2153098 - RNA, 19 nt, Human
auccugcuucugauaugca

SEQ ID NO: 2153099 - RNA, 13 nt, Human
uucucucaccucc

SEQ ID NO: 2153100 - RNA, 16 nt, Human
aucccacuugccccug

SEQ ID NO: 2153101 - RNA, 13 nt, Human
auccaauuggaua

SEQ ID NO: 2153102 - RNA, 23 nt, Human
uggcuuacuacaugugggagcuu

SEQ ID NO: 2153103 - RNA, 20 nt, Human
uggcuuacuacaugugggag

SEQ ID NO: 2153104 - RNA, 17 nt, Human
uggcugcggcacccuug

SEQ ID NO: 2153105 - RNA, 16 nt, Human
uggcugcggcacccuu

SEQ ID NO: 2153106 - RNA, 13 nt, Human
uggcugcccacac

SEQ ID NO: 2153107 - RNA, 13 nt, Human
aggccacggcagc

SEQ ID NO: 2153108 - RNA, 22 nt, Human
aggccaacccaaaauaagcagg

SEQ ID NO: 2153109 - RNA, 13 nt, Human
aggccaaaaaaau

SEQ ID NO: 2153110 - RNA, 16 nt, Human
uggccaaguucuuagu

SEQ ID NO: 2153111 - RNA, 19 nt, Human
ugccugcggaguugugcac

SEQ ID NO: 2153112 - RNA, 17 nt, Human
ugccucagccuccugag

SEQ ID NO: 2153113 - RNA, 13 nt, Human
ugauucuccugcc

SEQ ID NO: 2153114 - RNA, 20 nt, Human
ugauuucagcaccuacagug

SEQ ID NO: 2153115 - RNA, 21 nt, Human
ugauuucagcaccuacagugu

SEQ ID NO: 2153116 - RNA, 16 nt, Human
aguguacagucuugua

SEQ ID NO: 2153117 - RNA, 15 nt, Human
aguguacagucuugu

SEQ ID NO: 2153118 - RNA, 13 nt, Human
aguguacagucuu

SEQ ID NO: 2153119 - RNA, 16 nt, Human
uguucuuaagacguga

SEQ ID NO: 2153120 - RNA, 17 nt, Human
aguguacagucuuguau

SEQ ID NO: 2153121 - RNA, 13 nt, Human
uuaccuaauuaga

SEQ ID NO: 2153122 - RNA, 18 nt, Human
auaacugccuuaaaacuu

SEQ ID NO: 2153123 - RNA, 20 nt, Human
auaaccaaagcccaaagugg

SEQ ID NO: 2153124 - RNA, 22 nt, Human
ugggucuucagggggccaggug

SEQ ID NO: 2153125 - RNA, 20 nt, Human
uggugaacauugcaauagaa

SEQ ID NO: 2153126 - RNA, 15 nt, Human
uggugaacauugcaa

SEQ ID NO: 2153127 - RNA, 22 nt, Human
ugugaagaucacguuccuuccc

SEQ ID NO: 2153128 - RNA, 13 nt, Human
agucuuuuccaug

SEQ ID NO: 2153129 - RNA, 15 nt, Human
agucuuuuccaugaa

SEQ ID NO: 2153130 - RNA, 20 nt, Human
ugucucgugguaggacugua

SEQ ID NO: 2153131 - RNA, 19 nt, Human
ugucucgugguaggacugu

SEQ ID NO: 2153132 - RNA, 18 nt, Human
ugucucgugguaggacug

SEQ ID NO: 2153133 - RNA, 21 nt, Human
ugucucgugguaggacuguag

SEQ ID NO: 2153134 - RNA, 18 nt, Human
ugucuuguguuucuuuag

SEQ ID NO: 2153135 - RNA, 19 nt, Human
uguccuucucucaccuccu

SEQ ID NO: 2153136 - RNA, 18 nt, Human
uguccuucucucaccucc

SEQ ID NO: 2153137 - RNA, 21 nt, Human
uguccuucucucaccuccuaa

SEQ ID NO: 2153138 - RNA, 20 nt, Human
ugucccuuucugugugaaga

SEQ ID NO: 2153139 - RNA, 21 nt, Human
uguauuaaguuguuaauaaaa

SEQ ID NO: 2153140 - RNA, 17 nt, Human
aguagcuggauuacagg

SEQ ID NO: 2153141 - RNA, 23 nt, Human
ucuuuuuuuuuuuuuaaagacag

SEQ ID NO: 2153142 - RNA, 21 nt, Human
agcaccuacaguguacagucu

SEQ ID NO: 2153143 - RNA, 19 nt, Human
agcaccuacaguguacagu

SEQ ID NO: 2153144 - RNA, 15 nt, Human
agcaccuacagugua

SEQ ID NO: 2153145 - RNA, 14 nt, Human
agcaccuacagugu

SEQ ID NO: 2153146 - RNA, 22 nt, Human
agcaccuacaguguacagucuu

SEQ ID NO: 2153147 - RNA, 16 nt, Human
agaucguucucugccu

SEQ ID NO: 2153148 - RNA, 16 nt, Human
ugaccugccaggcaca

SEQ ID NO: 2153149 - RNA, 19 nt, Human
ugaccugccaggcacacug

SEQ ID NO: 2153150 - RNA, 19 nt, Human
ugacuauuuuucagaaucu

SEQ ID NO: 2153151 - RNA, 16 nt, Human
ucuguugcccaggcug

SEQ ID NO: 2153152 - RNA, 19 nt, Human
agaagauggcacuuauaac

SEQ ID NO: 2153153 - RNA, 20 nt, Human
agaaagcccuuaggaagaau

SEQ ID NO: 2153154 - RNA, 22 nt, Human
agaaagcccuuaggaagaauuu

SEQ ID NO: 2153155 - RNA, 16 nt, Human
acugaacauuccagag

SEQ ID NO: 2153156 - RNA, 13 nt, Human
acugaacauucca

SEQ ID NO: 2153157 - RNA, 14 nt, Human
acugcaacuucugc

SEQ ID NO: 2153158 - RNA, 16 nt, Human
acugcaacuucugccu

SEQ ID NO: 2153159 - RNA, 22 nt, Human
acgucccuccacguucaccccu

SEQ ID NO: 2153160 - RNA, 12 nt, Human
acgucccuccac

SEQ ID NO: 2153161 - RNA, 13 nt, Human
acguucaccccuc

SEQ ID NO: 2153162 - RNA, 18 nt, Human
acguaaagcuagaaauga

SEQ ID NO: 2153163 - RNA, 17 nt, Human
acguaaagcuagaaaug

SEQ ID NO: 2153164 - RNA, 20 nt, Human
acucaagacuuccagagccu

SEQ ID NO: 2153165 - RNA, 16 nt, Human
ucaguuuucaggagug

SEQ ID NO: 2153166 - RNA, 13 nt, Human
ucagggggccagg

SEQ ID NO: 2153167 - RNA, 12 nt, Human
ucagggggccag

SEQ ID NO: 2153168 - RNA, 12 nt, Human
acccuucuuuuc

SEQ ID NO: 2153169 - RNA, 14 nt, Human
acauugcaauagaa

SEQ ID NO: 2153170 - RNA, 16 nt, Human
acauugcaauagaaau

SEQ ID NO: 2153171 - RNA, 15 nt, Human
acauugcaauagaaa

SEQ ID NO: 2153172 - RNA, 18 nt, Human
ucacguaaagcuagaaau

SEQ ID NO: 2153173 - RNA, 20 nt, Human
ucacguaaagcuagaaauga

SEQ ID NO: 2153174 - RNA, 19 nt, Human
ucacguaaagcuagaaaug

SEQ ID NO: 2153175 - RNA, 15 nt, Human
ucaccauguuggcca

SEQ ID NO: 2153176 - RNA, 21 nt, Human
ucaccauguuggccaggcugg

SEQ ID NO: 2153177 - RNA, 23 nt, Human
aauauuguacaguuuuuauugcu

SEQ ID NO: 2153178 - RNA, 17 nt, Human
aauauuguacaguuuuu

SEQ ID NO: 2153179 - RNA, 15 nt, Human
aauauuguacaguuu

SEQ ID NO: 2153180 - RNA, 14 nt, Human
aauauuguacaguu

SEQ ID NO: 2153181 - RNA, 12 nt, Human
aauauuccagag

SEQ ID NO: 2153182 - RNA, 20 nt, Human
uaacuagaacugaauuuugu

SEQ ID NO: 2153183 - RNA, 17 nt, Human
uaacuagaacugaauuu

SEQ ID NO: 2153184 - RNA, 14 nt, Human
uaacuagaacugaa

SEQ ID NO: 2153185 - RNA, 12 nt, Human
uaacuagaacug

SEQ ID NO: 2153186 - RNA, 18 nt, Human
uaacauggugugcuucuu

SEQ ID NO: 2153187 - RNA, 21 nt, Human
aauccuguccucagcuucuua

SEQ ID NO: 2153188 - RNA, 18 nt, Human
aauccuguccucagcuuc

SEQ ID NO: 2153189 - RNA, 15 nt, Human
aauccuguccucagc

SEQ ID NO: 2153190 - RNA, 14 nt, Human
aauccuggggaaca

SEQ ID NO: 2153191 - RNA, 21 nt, Human
aauccuggggaacauagaacu

SEQ ID NO: 2153192 - RNA, 13 nt, Human
aaucuuucugcag

SEQ ID NO: 2153193 - RNA, 13 nt, Human
aaugacacagucu

SEQ ID NO: 2153194 - RNA, 19 nt, Human
uaauagcgucauaacuaga

SEQ ID NO: 2153195 - RNA, 18 nt, Human
aaugcugguuuuucaguu

SEQ ID NO: 2153196 - RNA, 13 nt, Human
aaugugcccccag

SEQ ID NO: 2153197 - RNA, 13 nt, Human
uacaugugggagc

SEQ ID NO: 2153198 - RNA, 14 nt, Human
aauugacuuauuua

SEQ ID NO: 2153199 - RNA, 22 nt, Human
acagucaaggaguggcuuacua

SEQ ID NO: 2153200 - RNA, 21 nt, Human
uagugaaucacguaaagcuag

SEQ ID NO: 2153201 - RNA, 14 nt, Human
uaggacuguagaaa

SEQ ID NO: 2153202 - RNA, 13 nt, Human
uaggacuguagaa

SEQ ID NO: 2153203 - RNA, 19 nt, Human
aagaaagcccuuaggaaga

SEQ ID NO: 2153204 - RNA, 19 nt, Human
gugaaguuuaauugacuua

SEQ ID NO: 2153205 - RNA, 17 nt, Human
aacguuuuuccuguucu

SEQ ID NO: 2153206 - RNA, 20 nt, Human
gucuuguguuucuuuaguuu

SEQ ID NO: 2153207 - RNA, 20 nt, Human
gucacugccauggaggcaca

SEQ ID NO: 2153208 - RNA, 16 nt, Human
gucacugccauggagg

SEQ ID NO: 2153209 - RNA, 17 nt, Human
aaauuucucuacugucu

SEQ ID NO: 2153210 - RNA, 23 nt, Human
gucuaggcaggaccuguggccaa

SEQ ID NO: 2153211 - RNA, 13 nt, Human
uaaaacugucccu

SEQ ID NO: 2153212 - RNA, 20 nt, Human
uaaaaguacauguuaaacuu

SEQ ID NO: 2153213 - RNA, 21 nt, Human
aagugauucuccugccucagc

SEQ ID NO: 2153214 - RNA, 14 nt, Human
aaguuacacauuuu

SEQ ID NO: 2153215 - RNA, 22 nt, Human
guuccggaauccuguccucagc

SEQ ID NO: 2153216 - RNA, 19 nt, Human
guuccggaauccuguccuc

SEQ ID NO: 2153217 - RNA, 23 nt, Human
aagcuuccuuuguuuuuuuuucc

SEQ ID NO: 2153218 - RNA, 16 nt, Human
guucuuaagacgugau

SEQ ID NO: 2153219 - RNA, 22 nt, Human
guuagaguccaacguggggcag

SEQ ID NO: 2153220 - RNA, 12 nt, Human
guuaauaaaagu

SEQ ID NO: 2153221 - RNA, 16 nt, Human
guguuucuuuaguuuu

SEQ ID NO: 2153222 - RNA, 13 nt, Human
guguuucuuuagu

SEQ ID NO: 2153223 - RNA, 23 nt, Human
aagauggcacuuauaaccaaagc

SEQ ID NO: 2153224 - RNA, 19 nt, Human
cacaguggaaccagcccag

SEQ ID NO: 2153225 - RNA, 20 nt, Human
caaagugcugggauuacagg

SEQ ID NO: 2153226 - RNA, 19 nt, Human
caaagugcugggauuacag

SEQ ID NO: 2153227 - RNA, 14 nt, Human
caauauuguacagu

SEQ ID NO: 2153228 - RNA, 19 nt, Human
uuaugauuuuuaaagaaaa

SEQ ID NO: 2153229 - RNA, 16 nt, Human
uuaugauuuuuaaaga

SEQ ID NO: 2153230 - RNA, 13 nt, Human
uucauuuuuccua

SEQ ID NO: 2153231 - RNA, 15 nt, Human
uucauuuuuccuaac

SEQ ID NO: 2153232 - RNA, 13 nt, Human
uuccagagccuca

SEQ ID NO: 2153233 - RNA, 12 nt, Human
uucagauauaaa

SEQ ID NO: 2153234 - RNA, 15 nt, Human
uucagauauaaaaga

SEQ ID NO: 2153235 - RNA, 14 nt, Human
uucagauauaaaag

SEQ ID NO: 2153236 - RNA, 19 nt, Human
uucagauauaaaagacuga

SEQ ID NO: 2153237 - RNA, 13 nt, Human
uucugugugaaga

SEQ ID NO: 2153238 - RNA, 23 nt, Human
uucuuaguugcuguaugucucgu

SEQ ID NO: 2153239 - RNA, 15 nt, Human
uucuuaguugcugua

SEQ ID NO: 2153240 - RNA, 14 nt, Human
uucuuaguugcugu

SEQ ID NO: 2153241 - RNA, 22 nt, Human
uucugauaugcaguuuuccuua

SEQ ID NO: 2153242 - RNA, 23 nt, Human
uuucagcaccuacaguguacagu

SEQ ID NO: 2153243 - RNA, 18 nt, Human
uuucagauauaaaagacu

SEQ ID NO: 2153244 - RNA, 16 nt, Human
uuucagauauaaaaga

SEQ ID NO: 2153245 - RNA, 14 nt, Human
uuucagauauaaaa

SEQ ID NO: 2153246 - RNA, 21 nt, Human
uuuaauagcgucauaacuaga

SEQ ID NO: 2153247 - RNA, 22 nt, Human
uuuaauagcgucauaacuagaa

SEQ ID NO: 2153248 - RNA, 18 nt, Human
uuuaaguuacacauuuuu

SEQ ID NO: 2153249 - RNA, 19 nt, Human
uuguuaauaaaaguacaug

SEQ ID NO: 2153250 - RNA, 14 nt, Human
uuguuaauaaaagu

SEQ ID NO: 2153251 - RNA, 21 nt, Human
uuguuaauaaaaguacauguu

SEQ ID NO: 2153252 - RNA, 19 nt, Human
uuguguuucuuuaguuuuu

SEQ ID NO: 2153253 - RNA, 19 nt, Human
uugcacguauuuuaauagc

SEQ ID NO: 2153254 - RNA, 20 nt, Human
uuuuuaauaaagacaggguu

SEQ ID NO: 2153255 - RNA, 17 nt, Human
uuuuuaauaaagacagg

SEQ ID NO: 2153256 - RNA, 18 nt, Human
uuuuuaaguuacacauuu

SEQ ID NO: 2153257 - RNA, 15 nt, Human
uuuuucaguuuucag

SEQ ID NO: 2153258 - RNA, 12 nt, Human
uuuuucaguuuu

SEQ ID NO: 2153259 - RNA, 15 nt, Human
uuuucagauauaaaa

SEQ ID NO: 2153260 - RNA, 14 nt, Human
ugcaacuucugccu

SEQ ID NO: 2153261 - RNA, 13 nt, Human
ugcaacuucugcc

SEQ ID NO: 2153262 - RNA, 16 nt, Human
ugauuuugcuguagaa

SEQ ID NO: 2153263 - RNA, 14 nt, Human
ugauuuugcuguag

SEQ ID NO: 2153264 - RNA, 19 nt, Human
ugauuuugcuguagaagau

SEQ ID NO: 2153265 - RNA, 17 nt, Human
ugauuuugcuguagaag

SEQ ID NO: 2153266 - RNA, 19 nt, Human
ugauuuuuaaagaaaaguu

SEQ ID NO: 2153267 - RNA, 21 nt, Human
ugcaaugacacagucuuggcu

SEQ ID NO: 2153268 - RNA, 19 nt, Human
ugauaugcaguuuuccuua

SEQ ID NO: 2153269 - RNA, 18 nt, Human
uggggcagcacagagagg

SEQ ID NO: 2153270 - RNA, 16 nt, Human
uggggcagcacagaga

SEQ ID NO: 2153271 - RNA, 22 nt, Human
uggggcagcacagagagggggc

SEQ ID NO: 2153272 - RNA, 14 nt, Human
uggggcagcacaga

SEQ ID NO: 2153273 - RNA, 13 nt, Human
uggggcagcacag

SEQ ID NO: 2153274 - RNA, 23 nt, Human
uggccuccaaguccacaguggaa

SEQ ID NO: 2153275 - RNA, 13 nt, Human
uggccuccaaguc

SEQ ID NO: 2153276 - RNA, 19 nt, Human
ugucuaggcaggaccugug

SEQ ID NO: 2153277 - RNA, 17 nt, Human
ugucuaggcaggaccug

SEQ ID NO: 2153278 - RNA, 20 nt, Human
ugguuccggaauccuguccu

SEQ ID NO: 2153279 - RNA, 20 nt, Human
ugguggggcugccaggggag

SEQ ID NO: 2153280 - RNA, 16 nt, Human
ugguuuuucaguuuuc

SEQ ID NO: 2153281 - RNA, 23 nt, Human
ucccguggaacguuuuuccuguu

SEQ ID NO: 2153282 - RNA, 22 nt, Human
ucccguggaacguuuuuccugu

SEQ ID NO: 2153283 - RNA, 16 nt, Human
ucccguggaacguuuu

SEQ ID NO: 2153284 - RNA, 23 nt, Human
uccuuuguuuuuuuuuccugucc

SEQ ID NO: 2153285 - RNA, 19 nt, Human
uccuuuguuuuuuuuuccu

SEQ ID NO: 2153286 - RNA, 22 nt, Human
uccuguccuucucucaccuccu

SEQ ID NO: 2153287 - RNA, 16 nt, Human
uccuguccucagcuuc

SEQ ID NO: 2153288 - RNA, 14 nt, Human
uccugccucagccu

SEQ ID NO: 2153289 - RNA, 22 nt, Human
ucucaaagaaauuuccacucag

SEQ ID NO: 2153290 - RNA, 21 nt, Human
ucucaaagaaauuuccacuca

SEQ ID NO: 2153291 - RNA, 19 nt, Human
ucucaaagaaauuuccacu

SEQ ID NO: 2153292 - RNA, 22 nt, Human
ucgagguuucucaaagaaauuu

SEQ ID NO: 2153293 - RNA, 16 nt, Human
ucgagguuucucaaag

SEQ ID NO: 2153294 - RNA, 19 nt, Human
ucucgugguaggacuguag

SEQ ID NO: 2153295 - RNA, 21 nt, Human
ucucgugguaggacuguagaa

SEQ ID NO: 2153296 - RNA, 19 nt, Human
ucuucuuuuugcuucaaaa

SEQ ID NO: 2153297 - RNA, 20 nt, Human
ucaaagaaauuuccacucag

SEQ ID NO: 2153298 - RNA, 19 nt, Human
ucaaagaaauuuccacuca

SEQ ID NO: 2153299 - RNA, 13 nt, Human
ucaaagaaauuuc

SEQ ID NO: 2153300 - RNA, 12 nt, Human
ucaaagaaauuu

SEQ ID NO: 2153301 - RNA, 15 nt, Human
ucaaaugagaaaaug

SEQ ID NO: 2153302 - RNA, 13 nt, Human
uauuuauauaaau

SEQ ID NO: 2153303 - RNA, 18 nt, Human
ucaagugauucuccugcc

SEQ ID NO: 2153304 - RNA, 19 nt, Human
ucaagugauucuccugccu

SEQ ID NO: 2153305 - RNA, 21 nt, Human
uauugcuugcacaaaccaauu

SEQ ID NO: 2153306 - RNA, 19 nt, Human
uauugcuuguuggauuuuu

SEQ ID NO: 2153307 - RNA, 17 nt, Human
ucaccccuccacccuug

SEQ ID NO: 2153308 - RNA, 12 nt, Human
ucaccccuccac

SEQ ID NO: 2153309 - RNA, 17 nt, Human
ucagauauaaaagacug

SEQ ID NO: 2153310 - RNA, 14 nt, Human
ucagauauaaaaga

SEQ ID NO: 2153311 - RNA, 20 nt, Human
ucagauauaaaagacugacc

SEQ ID NO: 2153312 - RNA, 18 nt, Human
ucagauauaaaagacuga

SEQ ID NO: 2153313 - RNA, 21 nt, Human
ucagccuccugaguagcugga

SEQ ID NO: 2153314 - RNA, 13 nt, Human
ucagccuccugag

SEQ ID NO: 2153315 - RNA, 20 nt, Human
ucagccuccugaguagcugg

SEQ ID NO: 2153316 - RNA, 21 nt, Human
ucagggagugggcuaagcacg

SEQ ID NO: 2153317 - RNA, 16 nt, Human
ggccguggcugcccac

SEQ ID NO: 2153318 - RNA, 13 nt, Human
ggccguggcugcc

SEQ ID NO: 2153319 - RNA, 17 nt, Human
ggaggcacacagcugca

SEQ ID NO: 2153320 - RNA, 16 nt, Human
ggaggcacacagcugc

SEQ ID NO: 2153321 - RNA, 16 nt, Human
gccuuaaaacuuuaau

SEQ ID NO: 2153322 - RNA, 15 nt, Human
gcugcggcacccuug

SEQ ID NO: 2153323 - RNA, 14 nt, Human
gcugcggcacccuu

SEQ ID NO: 2153324 - RNA, 22 nt, Human
gcuuacaagccagcuggagaaa

SEQ ID NO: 2153325 - RNA, 13 nt, Human
gcuguuagagucc

SEQ ID NO: 2153326 - RNA, 18 nt, Human
gcuggucacugccaugga

SEQ ID NO: 2153327 - RNA, 15 nt, Human
gcuggucacugccau

SEQ ID NO: 2153328 - RNA, 13 nt, Human
gcuggucacugcc

SEQ ID NO: 2153329 - RNA, 19 nt, Human
gcuggucucaaacuccuga

SEQ ID NO: 2153330 - RNA, 20 nt, Human
gcuggucucaaacuccugac

SEQ ID NO: 2153331 - RNA, 21 nt, Human
gcuuacuacaugugggagcuu

SEQ ID NO: 2153332 - RNA, 14 nt, Human
gcuuguuggauuuu

SEQ ID NO: 2153333 - RNA, 15 nt, Human
gcagaugaccccucc

SEQ ID NO: 2153334 - RNA, 16 nt, Human
gcagaugaccccuccc

SEQ ID NO: 2153335 - RNA, 12 nt, Human
gccaaguucuua

SEQ ID NO: 2153336 - RNA, 13 nt, Human
gccacggcagccu

SEQ ID NO: 2153337 - RNA, 17 nt, Human
gccaccuccccaggccg

SEQ ID NO: 2153338 - RNA, 15 nt, Human
gccaccuccccaggc

SEQ ID NO: 2153339 - RNA, 17 nt, Human
gccaccgcgcccagccu

SEQ ID NO: 2153340 - RNA, 21 nt, Human
gauggcacuuauaaccaaagc

SEQ ID NO: 2153341 - RNA, 12 nt, Human
gaguagcuggau

SEQ ID NO: 2153342 - RNA, 18 nt, Human
gagccaccgcgcccagcc

SEQ ID NO: 2153343 - RNA, 24 nt, Human
gaggcacacagcugcagagacaga

SEQ ID NO: 2153344 - RNA, 20 nt, Human
gaggcacacagcugcagaga

SEQ ID NO: 2153345 - RNA, 20 nt, Human
gaggcggccccggccggggu

SEQ ID NO: 2153346 - RNA, 16 nt, Human
cucaagacuuccagag

SEQ ID NO: 2153347 - RNA, 14 nt, Human
cucaagacuuccag

SEQ ID NO: 2153348 - RNA, 18 nt, Human
cuccacguucaccccucc

SEQ ID NO: 2153349 - RNA, 16 nt, Human
cuccacguucaccccu

SEQ ID NO: 2153350 - RNA, 20 nt, Human
cuccacguucaccccuccac

SEQ ID NO: 2153351 - RNA, 23 nt, Human
cuccaaguccacaguggaaccag

SEQ ID NO: 2153352 - RNA, 13 nt, Human
cucauuaaaaaaa

SEQ ID NO: 2153353 - RNA, 20 nt, Human
cuccuuagaaguggaaguag

SEQ ID NO: 2153354 - RNA, 17 nt, Human
cuccuuagaaguggaag

SEQ ID NO: 2153355 - RNA, 13 nt, Human
cuccuuagaagug

SEQ ID NO: 2153356 - RNA, 21 nt, Human
cuccugccucagccuccugag

SEQ ID NO: 2153357 - RNA, 21 nt, Human
cugcggcacccuugcgcuuuu

SEQ ID NO: 2153358 - RNA, 15 nt, Human
cugaacauuccagag

SEQ ID NO: 2153359 - RNA, 20 nt, Human
cucuuuguucuaaagaugga

SEQ ID NO: 2153360 - RNA, 22 nt, Human
cucuguugcccaggcuggagug

SEQ ID NO: 2153361 - RNA, 20 nt, Human
cucuguugcccaggcuggag

SEQ ID NO: 2153362 - RNA, 23 nt, Human
gaaaugcugguuuuucaguuuuc

SEQ ID NO: 2153363 - RNA, 22 nt, Human
gaauccuguccucagcuucuua

SEQ ID NO: 2153364 - RNA, 18 nt, Human
gaaguuuaauugacuuau

SEQ ID NO: 2153365 - RNA, 18 nt, Human
cuuuguucuaaagaugga

SEQ ID NO: 2153366 - RNA, 21 nt, Human
cuuguuggauuuuugucuugu

SEQ ID NO: 2153367 - RNA, 21 nt, Human
cuuguguuucuuuaguuuuug

SEQ ID NO: 2153368 - RNA, 23 nt, Human
cuuguuggauuuuugucuugugu

SEQ ID NO: 2153369 - RNA, 15 nt, Human
cuuuaguuuuuguga

SEQ ID NO: 2153370 - RNA, 13 nt, Human
cuuuaguuuuugu

SEQ ID NO: 2153371 - RNA, 17 nt, Human
cuuuauuaaauguagaa

SEQ ID NO: 2153372 - RNA, 17 nt, Human
cuucauuuuuccuaaca

SEQ ID NO: 2153373 - RNA, 16 nt, Human
cuucauuuuuccuaac

SEQ ID NO: 2153374 - RNA, 14 nt, Human
cuucauuuuuccua

SEQ ID NO: 2153375 - RNA, 13 nt, Human
cuucauuuuuccu

SEQ ID NO: 2153376 - RNA, 22 nt, Human
cuuccuuuguuuuuuuuuccug

SEQ ID NO: 2153377 - RNA, 20 nt, Human
cuucccccgcaaugugcccc

SEQ ID NO: 2153378 - RNA, 23 nt, Human
cuguugacauccaagcuuccuuu

SEQ ID NO: 2153379 - RNA, 20 nt, Human
cuguugacauccaagcuucc

SEQ ID NO: 2153380 - RNA, 18 nt, Human
cuguucuuaagacgugau

SEQ ID NO: 2153381 - RNA, 16 nt, Human
cuuagaaguggaagua

SEQ ID NO: 2153382 - RNA, 21 nt, Human
ccuaccggcaauuuccggcca

SEQ ID NO: 2153383 - RNA, 20 nt, Human
ccuaccggcaauuuccggcc

SEQ ID NO: 2153384 - RNA, 21 nt, Human
ccgcaaugugcccccagacgc

SEQ ID NO: 2153385 - RNA, 18 nt, Human
ccuccacguucaccccuc

SEQ ID NO: 2153386 - RNA, 17 nt, Human
ccuccacguucaccccu

SEQ ID NO: 2153387 - RNA, 13 nt, Human
cccacacacccca

SEQ ID NO: 2153388 - RNA, 18 nt, Human
cccuccacguucaccccu

SEQ ID NO: 2153389 - RNA, 12 nt, Human
cccuaaugccug

SEQ ID NO: 2153390 - RNA, 17 nt, Human
cccgucgacguagaacc

SEQ ID NO: 2153391 - RNA, 16 nt, Human
ccuucucucaccuccu

SEQ ID NO: 2153392 - RNA, 18 nt, Human
ccuucucucaccuccuaa

SEQ ID NO: 2153393 - RNA, 17 nt, Human
ccuucucucaccuccua

SEQ ID NO: 2153394 - RNA, 19 nt, Human
ccuucucucaccuccuaaa

SEQ ID NO: 2153395 - RNA, 23 nt, Human
ccuuaaaacuuuaaucccacuug

SEQ ID NO: 2153396 - RNA, 14 nt, Human
ccuuagaaguggaa

SEQ ID NO: 2153397 - RNA, 23 nt, Human
ccaccuccccaggccguggcugc

SEQ ID NO: 2153398 - RNA, 16 nt, Human
ccaccuccccaggccg

SEQ ID NO: 2153399 - RNA, 13 nt, Human
ccaccuccccagg

SEQ ID NO: 2153400 - RNA, 17 nt, Human
ccacguucaccccucca

SEQ ID NO: 2153401 - RNA, 15 nt, Human
ccacguucaccccuc

SEQ ID NO: 2153402 - RNA, 14 nt, Human
ccacguucaccccu

SEQ ID NO: 2153403 - RNA, 12 nt, Human
ccacacacccca

SEQ ID NO: 2153404 - RNA, 13 nt, Human
ccacacaccccaa

SEQ ID NO: 2153405 - RNA, 19 nt, Human
ccagccucaucucuuuguu

SEQ ID NO: 2153406 - RNA, 16 nt, Human
ccaggccguggcugcc

SEQ ID NO: 2153407 - RNA, 14 nt, Human
ccaggccguggcug

SEQ ID NO: 2153408 - RNA, 18 nt, Human
ccaggccguggcugccca

SEQ ID NO: 2153409 - RNA, 21 nt, Human
cccaaagugguauagaaaugc

SEQ ID NO: 2153410 - RNA, 20 nt, Human
cccaaagugguauagaaaug

SEQ ID NO: 2153411 - RNA, 22 nt, Human
cauuuuacuuuuuccuggcuca

SEQ ID NO: 2153412 - RNA, 20 nt, Human
cauuuuacuuuuuccuggcu

SEQ ID NO: 2153413 - RNA, 17 nt, Human
cauuuuacuuuuuccug

SEQ ID NO: 2153414 - RNA, 22 nt, Human
cauuuacccuucuuuucugacu

SEQ ID NO: 2153415 - RNA, 20 nt, Human
cauggaggcacacagcugca

SEQ ID NO: 2153416 - RNA, 19 nt, Human
cauggaggcacacagcugc

SEQ ID NO: 2153417 - RNA, 16 nt, Human
cauggaggcacacagc

SEQ ID NO: 2153418 - RNA, 13 nt, Human
cauggaggcacac

SEQ ID NO: 2153419 - RNA, 20 nt, Human
caugcgggcugggcagcugu

SEQ ID NO: 2153420 - RNA, 19 nt, Human
caugcgggcugggcagcug

SEQ ID NO: 2153421 - RNA, 18 nt, Human
caugcgggcugggcagcu

SEQ ID NO: 2153422 - RNA, 15 nt, Human
caugcgggcugggca

SEQ ID NO: 2153423 - RNA, 21 nt, Human
caugcgggcugggcagcuguu

SEQ ID NO: 2153424 - RNA, 22 nt, Human
cauuaaaaaaaaaaaaaaaagu

SEQ ID NO: 2153425 - RNA, 14 nt, Human
cauguguuccaagg

SEQ ID NO: 2153426 - RNA, 19 nt, Human
cagggggccaggugcacag

SEQ ID NO: 2153427 - RNA, 11 nt, Human
cagggggccag

SEQ ID NO: 2153428 - RNA, 16 nt, Human
cagggggccaggugca

SEQ ID NO: 2153429 - RNA, 13 nt, Human
cagggggccaggu

SEQ ID NO: 2153430 - RNA, 23 nt, Human
caggcuggucucaaacuccugac

SEQ ID NO: 2153431 - RNA, 17 nt, Human
caggaguggguugauuu

SEQ ID NO: 2153432 - RNA, 17 nt, Human
cagucuuguauuaaguu

SEQ ID NO: 2153433 - RNA, 16 nt, Human
cagucuuggcucacug

SEQ ID NO: 2153434 - RNA, 22 nt, Human
cagcuucuuaauauaacugccu

SEQ ID NO: 2153435 - RNA, 17 nt, Human
caggaccuguggccaag

SEQ ID NO: 2153436 - RNA, 18 nt, Human
cagcuggagaaauauggu

SEQ ID NO: 2153437 - RNA, 20 nt, Human
cagccuccugaguagcugga

SEQ ID NO: 2153438 - RNA, 17 nt, Human
cagacgcacgugggucu

SEQ ID NO: 2153439 - RNA, 15 nt, Human
cagacgucccuccac

SEQ ID NO: 2153440 - RNA, 19 nt, Human
cagaaaacgguuaaaacug

SEQ ID NO: 2153441 - RNA, 20 nt, Human
cagaaaacgguuaaaacugu

SEQ ID NO: 2153442 - RNA, 16 nt, Human
cagagacagagaggac

SEQ ID NO: 2153443 - RNA, 14 nt, Human
cagagacagagagg

SEQ ID NO: 2153444 - RNA, 18 nt, Human
cagaugaccccuccccua

SEQ ID NO: 2153445 - RNA, 14 nt, Human
cagaugaccccucc

SEQ ID NO: 2153446 - RNA, 13 nt, Human
cagaugaccccuc

SEQ ID NO: 2153447 - RNA, 23 nt, Human
cagagucucgcucuguugcccag

SEQ ID NO: 2153448 - RNA, 15 nt, Human
caccuccccaggccg

SEQ ID NO: 2153449 - RNA, 14 nt, Human
caccuccccaggcc

SEQ ID NO: 2153450 - RNA, 21 nt, Human
caccuccccaggccguggcug

SEQ ID NO: 2153451 - RNA, 23 nt, Human
caccugguuccggaauccugucc

SEQ ID NO: 2153452 - RNA, 21 nt, Human
caccugguuccggaauccugu

SEQ ID NO: 2153453 - RNA, 20 nt, Human
caccugguuccggaauccug

SEQ ID NO: 2153454 - RNA, 16 nt, Human
caccugguuccggaau

SEQ ID NO: 2153455 - RNA, 23 nt, Human
cacguaguagggucaggccacgg

SEQ ID NO: 2153456 - RNA, 21 nt, Human
cacguaguagggucaggccac

SEQ ID NO: 2153457 - RNA, 20 nt, Human
cacguaguagggucaggcca

SEQ ID NO: 2153458 - RNA, 19 nt, Human
cacguaguagggucaggcc

SEQ ID NO: 2153459 - RNA, 17 nt, Human
cacguaguagggucagg

SEQ ID NO: 2153460 - RNA, 20 nt, Human
cacguuccuucccccgcaau

SEQ ID NO: 2153461 - RNA, 13 nt, Human
cacguucaccccu

SEQ ID NO: 2153462 - RNA, 16 nt, Human
cacucaggucuguuuu

SEQ ID NO: 2153463 - RNA, 18 nt, Human
cacuugccccuguuaccu

SEQ ID NO: 2153464 - RNA, 22 nt, Human
cacugccauggaggcacacagc

SEQ ID NO: 2153465 - RNA, 19 nt, Human
cacugccauggaggcacac

SEQ ID NO: 2153466 - RNA, 17 nt, Human
cacugccauggaggcac

SEQ ID NO: 2153467 - RNA, 17 nt, Human
cacugcaacuucugccu

SEQ ID NO: 2153468 - RNA, 16 nt, Human
cacugcaacuucugcc

SEQ ID NO: 2153469 - RNA, 12 nt, Human
auggaggcacac

SEQ ID NO: 2153470 - RNA, 19 nt, Human
aguggcuuacuacaugugg

SEQ ID NO: 2153471 - RNA, 16 nt, Human
aguuguuaauaaaagu

SEQ ID NO: 2153472 - RNA, 22 nt, Human
auaaauuuuuuuuguuucauau

SEQ ID NO: 2153473 - RNA, 19 nt, Human
auaaauuuuuuuuguuuca

SEQ ID NO: 2153474 - RNA, 18 nt, Human
aggaguggguugauuuca

SEQ ID NO: 2153475 - RNA, 16 nt, Human
agaggacgugggcggc

SEQ ID NO: 2153476 - RNA, 14 nt, Human
agaggacgugggcg

SEQ ID NO: 2153477 - RNA, 14 nt, Human
agacgucccuccac

SEQ ID NO: 2153478 - RNA, 17 nt, Human
agacgugauuuugcugu

SEQ ID NO: 2153479 - RNA, 16 nt, Human
aaucucuccauucccg

SEQ ID NO: 2153480 - RNA, 20 nt, Human
aaugauccccagcuguuuau

SEQ ID NO: 2153481 - RNA, 19 nt, Human
aaugauccccagcuguuua

SEQ ID NO: 2153482 - RNA, 22 nt, Human
aaugauccccagcuguuuaugc

SEQ ID NO: 2153483 - RNA, 16 nt, Human
aaugauccccagcugu

SEQ ID NO: 2153484 - RNA, 12 nt, Human
aauguuuccuuu

SEQ ID NO: 2153485 - RNA, 13 nt, Human
aauguuuccuuua

SEQ ID NO: 2153486 - RNA, 15 nt, Human
aaguaguggagcccc

SEQ ID NO: 2153487 - RNA, 18 nt, Human
aaguauccugcuucugau

SEQ ID NO: 2153488 - RNA, 19 nt, Human
aaguccacaguggaaccag

SEQ ID NO: 2153489 - RNA, 14 nt, Human
aaguccacagugga

SEQ ID NO: 2153490 - RNA, 19 nt, Human
aaagcccuuaggaagaauu

SEQ ID NO: 2153491 - RNA, 18 nt, Human
aaauuuuuuuuguuucau

SEQ ID NO: 2153492 - RNA, 17 nt, Human
aaauuuuuuuuguuuca

SEQ ID NO: 2153493 - RNA, 18 nt, Human
accccuccccuaaugccu

SEQ ID NO: 2153494 - RNA, 15 nt, Human
accagcccagacccu

SEQ ID NO: 2153495 - RNA, 14 nt, Human
acacauuuuucaga

SEQ ID NO: 2153496 - RNA, 15 nt, Human
acuuauuuauauaaa

SEQ ID NO: 2153497 - RNA, 18 nt, Human
acuauuuuucagaaucuc

SEQ ID NO: 2153498 - RNA, 14 nt, Human
acuauuuuucagaa

SEQ ID NO: 2153499 - RNA, 17 nt, Human
cucgugguaggacugua

SEQ ID NO: 2153500 - RNA, 16 nt, Human
cucgugguaggacugu

SEQ ID NO: 2153501 - RNA, 15 nt, Human
cucgugguaggacug

SEQ ID NO: 2153502 - RNA, 21 nt, Human
cgagguuucucaaagaaauuu

SEQ ID NO: 2153503 - RNA, 22 nt, Human
cucaaagaaauuuccacucagg

SEQ ID NO: 2153504 - RNA, 14 nt, Human
cuauuuuucagaau

SEQ ID NO: 2153505 - RNA, 20 nt, Human
ccugguuccggaauccuguc

SEQ ID NO: 2153506 - RNA, 21 nt, Human
ccugguuccggaauccugucc

SEQ ID NO: 2153507 - RNA, 23 nt, Human
ccuaauuagagcagaugaccccu

SEQ ID NO: 2153508 - RNA, 14 nt, Human
ccuaauuagagcag

SEQ ID NO: 2153509 - RNA, 14 nt, Human
ccucaaaugagaaa

SEQ ID NO: 2153510 - RNA, 21 nt, Human
ccucgagguuucucaaagaaa

SEQ ID NO: 2153511 - RNA, 20 nt, Human
cccaggcuggagugcaauga

SEQ ID NO: 2153512 - RNA, 12 nt, Human
caagauuucaga

SEQ ID NO: 2153513 - RNA, 20 nt, Human
cagaaagguuuucuucuuuu

SEQ ID NO: 2153514 - RNA, 22 nt, Human
caaaugagaaaaugucuuuauu

SEQ ID NO: 2153515 - RNA, 16 nt, Human
auugcuuguuggauuu

SEQ ID NO: 2153516 - RNA, 14 nt, Human
auugcuugcacaaa

SEQ ID NO: 2153517 - RNA, 15 nt, Human
cagucaaggaguggc

SEQ ID NO: 2153518 - RNA, 23 nt, Human
caggugcacagacgucccuccac

SEQ ID NO: 2153519 - RNA, 15 nt, Human
caggugcacagacgu

SEQ ID NO: 2153520 - RNA, 15 nt, Human
cagcugcagagacag

SEQ ID NO: 2153521 - RNA, 16 nt, Human
cagcugcagagacaga

SEQ ID NO: 2153522 - RNA, 20 nt, Human
cagcacagagagggggccac

SEQ ID NO: 2153523 - RNA, 17 nt, Human
cagcacagagagggggc

SEQ ID NO: 2153524 - RNA, 13 nt, Human
cagcacagagagg

SEQ ID NO: 2153525 - RNA, 12 nt, Human
cagcacagagag

SEQ ID NO: 2153526 - RNA, 15 nt, Human
cagcaccuacagugu

SEQ ID NO: 2153527 - RNA, 20 nt, Human
cagcaccuacaguguacagu

SEQ ID NO: 2153528 - RNA, 22 nt, Human
ccaaagugguauagaaaugcug

SEQ ID NO: 2153529 - RNA, 22 nt, Human
cauagcuuacaagccagcugga

SEQ ID NO: 2153530 - RNA, 19 nt, Human
cuguagaaaagggaacuga

SEQ ID NO: 2153531 - RNA, 20 nt, Human
cuuacauuuuacuuuuuccu

SEQ ID NO: 2153532 - RNA, 17 nt, Human
cuuacaagccagcugga

SEQ ID NO: 2153533 - RNA, 16 nt, Human
cuuacaagccagcugg

SEQ ID NO: 2153534 - RNA, 15 nt, Human
cuuaggaagaauuuu

SEQ ID NO: 2153535 - RNA, 23 nt, Human
cuuggguucaagugauucuccug

SEQ ID NO: 2153536 - RNA, 18 nt, Human
cuucuuaauauaacugcc

SEQ ID NO: 2153537 - RNA, 20 nt, Human
cuucuuaauauaacugccuu

SEQ ID NO: 2153538 - RNA, 19 nt, Human
gcacacagcugcagagaca

SEQ ID NO: 2153539 - RNA, 21 nt, Human
gcaccuacaguguacagucuu

SEQ ID NO: 2153540 - RNA, 19 nt, Human
gcaccuacaguguacaguc

SEQ ID NO: 2153541 - RNA, 18 nt, Human
gcaccuacaguguacagu

SEQ ID NO: 2153542 - RNA, 14 nt, Human
gcagcuguuagagu

SEQ ID NO: 2153543 - RNA, 17 nt, Human
gcagcuguuagagucca

SEQ ID NO: 2153544 - RNA, 17 nt, Human
gacaggguuucaccaug

SEQ ID NO: 2153545 - RNA, 22 nt, Human
gaguccaacguggggcagcaca

SEQ ID NO: 2153546 - RNA, 20 nt, Human
gaguccaacguggggcagca

SEQ ID NO: 2153547 - RNA, 16 nt, Human
aaaacgguuaaaacug

SEQ ID NO: 2153548 - RNA, 18 nt, Human
aaaacgguuaaaacuguc

SEQ ID NO: 2153549 - RNA, 12 nt, Human
guagaagauggc

SEQ ID NO: 2153550 - RNA, 14 nt, Human
guacucauuaaaaa

SEQ ID NO: 2153551 - RNA, 16 nt, Human
aaaguacauguuaaac

SEQ ID NO: 2153552 - RNA, 15 nt, Human
guaauccaccugccu

SEQ ID NO: 2153553 - RNA, 14 nt, Human
gggggccaggugca

SEQ ID NO: 2153554 - RNA, 17 nt, Human
aaacgguuaaaacuguc

SEQ ID NO: 2153555 - RNA, 15 nt, Human
aaacgguuaaaacug

SEQ ID NO: 2153556 - RNA, 12 nt, Human
aaacugucccuu

SEQ ID NO: 2153557 - RNA, 19 nt, Human
aaagacugaccaauauugu

SEQ ID NO: 2153558 - RNA, 9 nt, Human
aaagacaga

SEQ ID NO: 2153559 - RNA, 15 nt, Human
gccccugcucuggug

SEQ ID NO: 2153560 - RNA, 23 nt, Human
ggacuuucuuuucgccguggcug

SEQ ID NO: 2153561 - RNA, 21 nt, Human
ggacuuucuuuucgccguggc

SEQ ID NO: 2153562 - RNA, 19 nt, Human
ggaauccuguccucagcuu

SEQ ID NO: 2153563 - RNA, 14 nt, Human
ggaauccuguccuc

SEQ ID NO: 2153564 - RNA, 13 nt, Human
auuugucaacaaa

SEQ ID NO: 2153565 - RNA, 15 nt, Human
auuugucaacaaagu

SEQ ID NO: 2153566 - RNA, 16 nt, Human
auuuccacucaggucu

SEQ ID NO: 2153567 - RNA, 16 nt, Human
auuggauuugucuuug

SEQ ID NO: 2153568 - RNA, 21 nt, Human
auuguacaguuuuuauugcuu

SEQ ID NO: 2153569 - RNA, 15 nt, Human
auuguacaguuuuua

SEQ ID NO: 2153570 - RNA, 14 nt, Human
auuguacaguuuuu

SEQ ID NO: 2153571 - RNA, 20 nt, Human
auuuugcuguagaagauggc

SEQ ID NO: 2153572 - RNA, 18 nt, Human
auuuuguauauuuguauu

SEQ ID NO: 2153573 - RNA, 12 nt, Human
auuuugucuuua

SEQ ID NO: 2153574 - RNA, 16 nt, Human
auuuuucagauauaaa

SEQ ID NO: 2153575 - RNA, 14 nt, Human
auuuuugucuugug

SEQ ID NO: 2153576 - RNA, 19 nt, Human
auuccagagcguguaguga

SEQ ID NO: 2153577 - RNA, 19 nt, Human
auuaucuaaaaucugcuag

SEQ ID NO: 2153578 - RNA, 18 nt, Human
augcgggcugggcagcug

SEQ ID NO: 2153579 - RNA, 17 nt, Human
augcgggcugggcagcu

SEQ ID NO: 2153580 - RNA, 19 nt, Human
augcgggcugggcagcugu

SEQ ID NO: 2153581 - RNA, 14 nt, Human
uuucugcagaaaca

SEQ ID NO: 2153582 - RNA, 17 nt, Human
auguaaaagacuuuuuu

SEQ ID NO: 2153583 - RNA, 19 nt, Human
uuugucuuuggugaacauu

SEQ ID NO: 2153584 - RNA, 21 nt, Human
uuugucuuguguuucuuuagu

SEQ ID NO: 2153585 - RNA, 16 nt, Human
augucucgugguagga

SEQ ID NO: 2153586 - RNA, 15 nt, Human
augucucgugguagg

SEQ ID NO: 2153587 - RNA, 19 nt, Human
augucucgugguaggacug

SEQ ID NO: 2153588 - RNA, 19 nt, Human
auguaugaggaauuucugu

SEQ ID NO: 2153589 - RNA, 18 nt, Human
aucaguagccagcaucug

SEQ ID NO: 2153590 - RNA, 21 nt, Human
uucuucuuuuugcuucaaaaa

SEQ ID NO: 2153591 - RNA, 17 nt, Human
uucuucuuuuugcuuca

SEQ ID NO: 2153592 - RNA, 23 nt, Human
uucuuaagacgugauuuugcugu

SEQ ID NO: 2153593 - RNA, 21 nt, Human
uucuuaagacgugauuuugcu

SEQ ID NO: 2153594 - RNA, 24 nt, Human
uuccuguccuucucucaccuccua

SEQ ID NO: 2153595 - RNA, 23 nt, Human
uuccuguccuucucucaccuccu

SEQ ID NO: 2153596 - RNA, 23 nt, Human
uucccguggaacguuuuuccugu

SEQ ID NO: 2153597 - RNA, 14 nt, Human
aucguucucugccu

SEQ ID NO: 2153598 - RNA, 20 nt, Human
aucugcuagggaauaucaau

SEQ ID NO: 2153599 - RNA, 21 nt, Human
uuggugaacauugcaauagaa

SEQ ID NO: 2153600 - RNA, 13 nt, Human
aucuuucugcaga

SEQ ID NO: 2153601 - RNA, 21 nt, Human
uuaguuuuugugaaguuuaau

SEQ ID NO: 2153602 - RNA, 18 nt, Human
uuaguuuuugugaaguuu

SEQ ID NO: 2153603 - RNA, 18 nt, Human
auaacuuuuuuuuaaguu

SEQ ID NO: 2153604 - RNA, 20 nt, Human
uuacagggaugagccaccgc

SEQ ID NO: 2153605 - RNA, 16 nt, Human
uuaauaaaaguacaug

SEQ ID NO: 2153606 - RNA, 20 nt, Human
aguuuuuauugcuuguugga

SEQ ID NO: 2153607 - RNA, 13 nt, Human
auacgauaaauaa

SEQ ID NO: 2153608 - RNA, 22 nt, Human
auagaaaugcugguuuuucagu

SEQ ID NO: 2153609 - RNA, 19 nt, Human
auagaaaugcugguuuuuc

SEQ ID NO: 2153610 - RNA, 13 nt, Human
auagaaaugcugg

SEQ ID NO: 2153611 - RNA, 19 nt, Human
agucucgcucuguugccca

SEQ ID NO: 2153612 - RNA, 18 nt, Human
agugguauagaaaugcug

SEQ ID NO: 2153613 - RNA, 16 nt, Human
agugguauagaaaugc

SEQ ID NO: 2153614 - RNA, 15 nt, Human
agugguauagaaaug

SEQ ID NO: 2153615 - RNA, 14 nt, Human
agugguauagaaau

SEQ ID NO: 2153616 - RNA, 19 nt, Human
uguuaauaaaaguacaugu

SEQ ID NO: 2153617 - RNA, 18 nt, Human
uguuaauaaaaguacaug

SEQ ID NO: 2153618 - RNA, 13 nt, Human
uguuaauaaaagu

SEQ ID NO: 2153619 - RNA, 22 nt, Human
uguagugaaucacguaaagcua

SEQ ID NO: 2153620 - RNA, 12 nt, Human
uguacaguuuuu

SEQ ID NO: 2153621 - RNA, 16 nt, Human
agguuucucaaagaaa

SEQ ID NO: 2153622 - RNA, 19 nt, Human
agguuucucaaagaaauuu

SEQ ID NO: 2153623 - RNA, 21 nt, Human
uggcucacugcaacuucugcc

SEQ ID NO: 2153624 - RNA, 20 nt, Human
aggccguggcugcccacaca

SEQ ID NO: 2153625 - RNA, 12 nt, Human
aggccguggcug

SEQ ID NO: 2153626 - RNA, 14 nt, Human
uggaaguaguggag

SEQ ID NO: 2153627 - RNA, 17 nt, Human
uggaaguaguggagccc

SEQ ID NO: 2153628 - RNA, 17 nt, Human
agcuggagaaauauggu

SEQ ID NO: 2153629 - RNA, 16 nt, Human
ugcccacacaccccaa

SEQ ID NO: 2153630 - RNA, 22 nt, Human
agccuaccggcaauuuccggcc

SEQ ID NO: 2153631 - RNA, 24 nt, Human
ugcagagacagagaggacgugggc

SEQ ID NO: 2153632 - RNA, 19 nt, Human
ugcacguaguagggucagg

SEQ ID NO: 2153633 - RNA, 22 nt, Human
ugcacguaguagggucaggcca

SEQ ID NO: 2153634 - RNA, 17 nt, Human
ugcacguauuuuaauag

SEQ ID NO: 2153635 - RNA, 12 nt, Human
ugcaguuuuccu

SEQ ID NO: 2153636 - RNA, 19 nt, Human
acuuugaggguguauauuu

SEQ ID NO: 2153637 - RNA, 15 nt, Human
acuuuuuuuuaaguu

SEQ ID NO: 2153638 - RNA, 20 nt, Human
agaaaacgguuaaaacuguc

SEQ ID NO: 2153639 - RNA, 15 nt, Human
agaaagaagaugaau

SEQ ID NO: 2153640 - RNA, 15 nt, Human
ucugcagaaacagaa

SEQ ID NO: 2153641 - RNA, 21 nt, Human
agaacucaugacggaagaguu

SEQ ID NO: 2153642 - RNA, 15 nt, Human
ucuuaauauaacugc

SEQ ID NO: 2153643 - RNA, 19 nt, Human
ucuuaauauaacugccuua

SEQ ID NO: 2153644 - RNA, 18 nt, Human
ucuuaauauaacugccuu

SEQ ID NO: 2153645 - RNA, 19 nt, Human
agacaggguuucaccaugu

SEQ ID NO: 2153646 - RNA, 19 nt, Human
agaccuaacgagaaauaga

SEQ ID NO: 2153647 - RNA, 17 nt, Human
agcagaugaccccuccc

SEQ ID NO: 2153648 - RNA, 18 nt, Human
agaucacguuccuucccc

SEQ ID NO: 2153649 - RNA, 21 nt, Human
agcaaaaccaaauauuccaga

SEQ ID NO: 2153650 - RNA, 21 nt, Human
ugacuuauuuauauaaauuuu

SEQ ID NO: 2153651 - RNA, 17 nt, Human
ugacuuauuuauauaaa

SEQ ID NO: 2153652 - RNA, 20 nt, Human
ugacuuauuuauauaaauuu

SEQ ID NO: 2153653 - RNA, 20 nt, Human
accuccccaggccguggcug

SEQ ID NO: 2153654 - RNA, 19 nt, Human
accuccccaggccguggcu

SEQ ID NO: 2153655 - RNA, 14 nt, Human
accuccccaggccg

SEQ ID NO: 2153656 - RNA, 13 nt, Human
accuccccaggcc

SEQ ID NO: 2153657 - RNA, 17 nt, Human
uccacguucaccccucc

SEQ ID NO: 2153658 - RNA, 22 nt, Human
accugguuccggaauccugucc

SEQ ID NO: 2153659 - RNA, 18 nt, Human
uccaacguggggcagcac

SEQ ID NO: 2153660 - RNA, 17 nt, Human
uccaacguggggcagca

SEQ ID NO: 2153661 - RNA, 19 nt, Human
uccaacguggggcagcaca

SEQ ID NO: 2153662 - RNA, 14 nt, Human
uccacagugacucc

SEQ ID NO: 2153663 - RNA, 20 nt, Human
uccacaguggaaccagccca

SEQ ID NO: 2153664 - RNA, 16 nt, Human
uccacaguggaaccag

SEQ ID NO: 2153665 - RNA, 19 nt, Human
uccugaguagcuggauuac

SEQ ID NO: 2153666 - RNA, 19 nt, Human
uccuguucuuaagacguga

SEQ ID NO: 2153667 - RNA, 23 nt, Human
acuguagaaaagggaacugaaca

SEQ ID NO: 2153668 - RNA, 23 nt, Human
uccccaggccguggcugcccaca

SEQ ID NO: 2153669 - RNA, 21 nt, Human
uccccaggccguggcugccca

SEQ ID NO: 2153670 - RNA, 19 nt, Human
uccccaggccguggcugcc

SEQ ID NO: 2153671 - RNA, 17 nt, Human
acucaagacuuccagag

SEQ ID NO: 2153672 - RNA, 15 nt, Human
acuccugaccucaag

SEQ ID NO: 2153673 - RNA, 15 nt, Human
acagagaggacgugg

SEQ ID NO: 2153674 - RNA, 21 nt, Human
acagagagggggccaccuccc

SEQ ID NO: 2153675 - RNA, 17 nt, Human
uauuguacaguuuuuau

SEQ ID NO: 2153676 - RNA, 15 nt, Human
uauuguacaguuuuu

SEQ ID NO: 2153677 - RNA, 14 nt, Human
uauuguacaguuuu

SEQ ID NO: 2153678 - RNA, 13 nt, Human
uauuguacaguuu

SEQ ID NO: 2153679 - RNA, 12 nt, Human
uauuguacaguu

SEQ ID NO: 2153680 - RNA, 11 nt, Human
uauuguacagu

SEQ ID NO: 2153681 - RNA, 18 nt, Human
acagucaaggaguggcuu

SEQ ID NO: 2153682 - RNA, 17 nt, Human
acagucaaggaguggcu

SEQ ID NO: 2153683 - RNA, 21 nt, Human
acaguuaaaugagaacaugaa

SEQ ID NO: 2153684 - RNA, 14 nt, Human
acagucuuguauua

SEQ ID NO: 2153685 - RNA, 22 nt, Human
acagucuuguauuaaguuguua

SEQ ID NO: 2153686 - RNA, 18 nt, Human
acagucuuguauuaaguu

SEQ ID NO: 2153687 - RNA, 15 nt, Human
acagucuuguauuaa

SEQ ID NO: 2153688 - RNA, 16 nt, Human
aauuucucuacugucu

SEQ ID NO: 2153689 - RNA, 21 nt, Human
uagaaccucgagguuucucaa

SEQ ID NO: 2153690 - RNA, 22 nt, Human
uagaacugaauuuugucuuuau

SEQ ID NO: 2153691 - RNA, 17 nt, Human
uagaacugaauuuuguc

SEQ ID NO: 2153692 - RNA, 13 nt, Human
uagaacugaauuu

SEQ ID NO: 2153693 - RNA, 18 nt, Human
uagaagauggcacuuaua

SEQ ID NO: 2153694 - RNA, 19 nt, Human
uagagcagaugaccccucc

SEQ ID NO: 2153695 - RNA, 15 nt, Human
acaagccagcuggag

SEQ ID NO: 2153696 - RNA, 13 nt, Human
acaagccagcugg

SEQ ID NO: 2153697 - RNA, 13 nt, Human
uaauuuuuuacua

SEQ ID NO: 2153698 - RNA, 22 nt, Human
uaauuuuuguguuuuuaauaaa

SEQ ID NO: 2153699 - RNA, 18 nt, Human
uacaagccagcuggagaa

SEQ ID NO: 2153700 - RNA, 12 nt, Human
uacagucuugua

SEQ ID NO: 2153701 - RNA, 13 nt, Human
uacagucuuguau

SEQ ID NO: 2153702 - RNA, 14 nt, Human
aaguuuaauugacu

SEQ ID NO: 2153703 - RNA, 19 nt, Human
guuuuuuuuuccuguccuu

SEQ ID NO: 2153704 - RNA, 20 nt, Human
guuuuuuuuuccuguccuuc

SEQ ID NO: 2153705 - RNA, 17 nt, Human
aaguuacacauuuuuca

SEQ ID NO: 2153706 - RNA, 13 nt, Human
uaaagauggaaaa

SEQ ID NO: 2153707 - RNA, 9 nt, Human
uaaagacag

SEQ ID NO: 2153708 - RNA, 10 nt, Human
uaaagacaga

SEQ ID NO: 2153709 - RNA, 19 nt, Human
uaaacccaguaguggugac

SEQ ID NO: 2153710 - RNA, 19 nt, Human
uaaauuuuuuuuguuucau

SEQ ID NO: 2153711 - RNA, 22 nt, Human
aagaaaaguuuuguaaauuucu

SEQ ID NO: 2153712 - RNA, 21 nt, Human
aagaaaaguuuuguaaauuuc

SEQ ID NO: 2153713 - RNA, 16 nt, Human
aagaaaaguuuuguaa

SEQ ID NO: 2153714 - RNA, 15 nt, Human
aagaaaaguuuugua

SEQ ID NO: 2153715 - RNA, 14 nt, Human
aacuuggaaauagu

SEQ ID NO: 2153716 - RNA, 16 nt, Human
aagcaagauuucagau

SEQ ID NO: 2153717 - RNA, 16 nt, Human
aaccaaauauuccaga

SEQ ID NO: 2153718 - RNA, 16 nt, Human
gucucaaacuccugac

SEQ ID NO: 2153719 - RNA, 18 nt, Human
gucuucagggggccaggu

SEQ ID NO: 2153720 - RNA, 18 nt, Human
aacguggggcagcacaga

SEQ ID NO: 2153721 - RNA, 17 nt, Human
aacguggggcagcacag

SEQ ID NO: 2153722 - RNA, 22 nt, Human
aacguggggcagcacagagagg

SEQ ID NO: 2153723 - RNA, 17 nt, Human
aacuagaacugaauuuu

SEQ ID NO: 2153724 - RNA, 22 nt, Human
gugacaugcgggcugggcagcu

SEQ ID NO: 2153725 - RNA, 21 nt, Human
gugacaugcgggcugggcagc

SEQ ID NO: 2153726 - RNA, 20 nt, Human
gugacaugcgggcugggcag

SEQ ID NO: 2153727 - RNA, 16 nt, Human
gugacaugcgggcugg

SEQ ID NO: 2153728 - RNA, 15 nt, Human
aacugaacauuccag

SEQ ID NO: 2153729 - RNA, 14 nt, Human
caagugauucuccu

SEQ ID NO: 2153730 - RNA, 21 nt, Human
caagugauucuccugccucag

SEQ ID NO: 2153731 - RNA, 22 nt, Human
caagugauucuccugccucagc

SEQ ID NO: 2153732 - RNA, 16 nt, Human
caagugauucuccugc

SEQ ID NO: 2153733 - RNA, 22 nt, Human
cacagagagggggccaccuccc

SEQ ID NO: 2153734 - RNA, 16 nt, Human
cacagacgucccucca

SEQ ID NO: 2153735 - RNA, 21 nt, Human
caaugacacagucuuggcuca

SEQ ID NO: 2153736 - RNA, 19 nt, Human
caaugacacagucuuggcu

SEQ ID NO: 2153737 - RNA, 14 nt, Human
caaugacacagucu

SEQ ID NO: 2153738 - RNA, 13 nt, Human
uucugugcagcca

SEQ ID NO: 2153739 - RNA, 18 nt, Human
uugcagcgauuaauaaca

SEQ ID NO: 2153740 - RNA, 19 nt, Human
uugcagcgauuaauaacag

SEQ ID NO: 2153741 - RNA, 19 nt, Human
uugucuuuggugaacauug

SEQ ID NO: 2153742 - RNA, 22 nt, Human
uuuccuaacaggauuagacagu

SEQ ID NO: 2153743 - RNA, 18 nt, Human
uuuccuaacaggauuaga

SEQ ID NO: 2153744 - RNA, 17 nt, Human
uuuccacucaggucugu

SEQ ID NO: 2153745 - RNA, 21 nt, Human
uuugaggguguauauuuucug

SEQ ID NO: 2153746 - RNA, 15 nt, Human
uuaguugcuguaugu

SEQ ID NO: 2153747 - RNA, 13 nt, Human
uuaguugcuguau

SEQ ID NO: 2153748 - RNA, 14 nt, Human
uuaugcauagauaa

SEQ ID NO: 2153749 - RNA, 19 nt, Human
uuauugcagcgauuaauaa

SEQ ID NO: 2153750 - RNA, 18 nt, Human
uuccacucaggucuguuu

SEQ ID NO: 2153751 - RNA, 15 nt, Human
uucuaaagauggaaa

SEQ ID NO: 2153752 - RNA, 18 nt, Human
uuacuacaugugggagcu

SEQ ID NO: 2153753 - RNA, 21 nt, Human
uuagagcagaugaccccuccc

SEQ ID NO: 2153754 - RNA, 22 nt, Human
uuaggccaaaaaaauguaagau

SEQ ID NO: 2153755 - RNA, 20 nt, Human
uguuucauauugaugugugu

SEQ ID NO: 2153756 - RNA, 23 nt, Human
uuaauauaacugccuuaaaacuu

SEQ ID NO: 2153757 - RNA, 15 nt, Human
uuaauauaacugccu

SEQ ID NO: 2153758 - RNA, 12 nt, Human
uuaaagacagag

SEQ ID NO: 2153759 - RNA, 11 nt, Human
uuaaagacaga

SEQ ID NO: 2153760 - RNA, 21 nt, Human
ugguaugugacaugcgggcug

SEQ ID NO: 2153761 - RNA, 17 nt, Human
uggaggcacacagcugc

SEQ ID NO: 2153762 - RNA, 17 nt, Human
uggauuuuugucuugug

SEQ ID NO: 2153763 - RNA, 13 nt, Human
uggccaggcuggu

SEQ ID NO: 2153764 - RNA, 18 nt, Human
ugcgcuuuugcuggucac

SEQ ID NO: 2153765 - RNA, 17 nt, Human
ugcgcuuuugcugguca

SEQ ID NO: 2153766 - RNA, 16 nt, Human
ugcuggucacugccau

SEQ ID NO: 2153767 - RNA, 15 nt, Human
ugcugguuuuucagu

SEQ ID NO: 2153768 - RNA, 12 nt, Human
ugcugguuuuuc

SEQ ID NO: 2153769 - RNA, 18 nt, Human
ugcugguuuuucaguuuu

SEQ ID NO: 2153770 - RNA, 16 nt, Human
ugcugguuuuucaguu

SEQ ID NO: 2153771 - RNA, 18 nt, Human
ugaacauugcaauagaaa

SEQ ID NO: 2153772 - RNA, 12 nt, Human
ucuuguguuucu

SEQ ID NO: 2153773 - RNA, 20 nt, Human
ucgugguaggacuguagaaa

SEQ ID NO: 2153774 - RNA, 15 nt, Human
ucgugguaggacugu

SEQ ID NO: 2153775 - RNA, 14 nt, Human
ucgugguaggacug

SEQ ID NO: 2153776 - RNA, 14 nt, Human
uccuuagaagugga

SEQ ID NO: 2153777 - RNA, 15 nt, Human
uauugcuugcacaaa

SEQ ID NO: 2153778 - RNA, 22 nt, Human
uauugcagcgauuaauaacagg

SEQ ID NO: 2153779 - RNA, 15 nt, Human
uauuaaguuguuaau

SEQ ID NO: 2153780 - RNA, 18 nt, Human
uauguugguagauucuaa

SEQ ID NO: 2153781 - RNA, 16 nt, Human
guggcugcccacacac

SEQ ID NO: 2153782 - RNA, 18 nt, Human
uauacgauaaauaacuuu

SEQ ID NO: 2153783 - RNA, 23 nt, Human
uauauaaauuuuuuuuguuucau

SEQ ID NO: 2153784 - RNA, 23 nt, Human
uaugauuuuuaaagaaaaguuuu

SEQ ID NO: 2153785 - RNA, 12 nt, Human
uaugauuuuuaa

SEQ ID NO: 2153786 - RNA, 12 nt, Human
uaugaauaacau

SEQ ID NO: 2153787 - RNA, 14 nt, Human
guggccaaguucuu

SEQ ID NO: 2153788 - RNA, 22 nt, Human
guggaacguuuuuccuguucuu

SEQ ID NO: 2153789 - RNA, 16 nt, Human
gugagcuccuaagcca

SEQ ID NO: 2153790 - RNA, 18 nt, Human
gugaaucacguaaagcua

SEQ ID NO: 2153791 - RNA, 16 nt, Human
gugaaucacguaaagc

SEQ ID NO: 2153792 - RNA, 12 nt, Human
gugcccccagac

SEQ ID NO: 2153793 - RNA, 16 nt, Human
gugauuuugcuguaga

SEQ ID NO: 2153794 - RNA, 13 nt, Human
gugauucuccugc

SEQ ID NO: 2153795 - RNA, 13 nt, Human
guccucagcuucu

SEQ ID NO: 2153796 - RNA, 17 nt, Human
guccucagcuucuuaau

SEQ ID NO: 2153797 - RNA, 13 nt, Human
gucucgugguagg

SEQ ID NO: 2153798 - RNA, 15 nt, Human
gucaaggaguggcuu

SEQ ID NO: 2153799 - RNA, 17 nt, Human
gucauaacuagaacuga

SEQ ID NO: 2153800 - RNA, 22 nt, Human
gucauaacuagaacugaauuuu

SEQ ID NO: 2153801 - RNA, 14 nt, Human
ggggcugccagggg

SEQ ID NO: 2153802 - RNA, 20 nt, Human
ggguuucaccauguuggcca

SEQ ID NO: 2153803 - RNA, 14 nt, Human
ggugaacauugcaa

SEQ ID NO: 2153804 - RNA, 19 nt, Human
guaagaucguucucugccu

SEQ ID NO: 2153805 - RNA, 15 nt, Human
guaaaagacuuuuuu

SEQ ID NO: 2153806 - RNA, 14 nt, Human
guacagucuuguau

SEQ ID NO: 2153807 - RNA, 13 nt, Human
guacagucuugua

SEQ ID NO: 2153808 - RNA, 16 nt, Human
guacagucuuguauua

SEQ ID NO: 2153809 - RNA, 13 nt, Human
guacaguuuuuau

SEQ ID NO: 2153810 - RNA, 12 nt, Human
guacaguuuuua

SEQ ID NO: 2153811 - RNA, 20 nt, Human
guagaaaagggaacugaaca

SEQ ID NO: 2153812 - RNA, 16 nt, Human
gcgggcugggcagcug

SEQ ID NO: 2153813 - RNA, 14 nt, Human
gcgggcugggcagc

SEQ ID NO: 2153814 - RNA, 18 nt, Human
gccucagccuccugagua

SEQ ID NO: 2153815 - RNA, 16 nt, Human
gccucagccuccugag

SEQ ID NO: 2153816 - RNA, 20 nt, Human
ggagugcaaugacacagucu

SEQ ID NO: 2153817 - RNA, 20 nt, Human
gagggggccaccuccccagg

SEQ ID NO: 2153818 - RNA, 18 nt, Human
gagggggccaccucccca

SEQ ID NO: 2153819 - RNA, 22 nt, Human
gagggggccaccuccccaggcc

SEQ ID NO: 2153820 - RNA, 15 nt, Human
gaguggguugauuuc

SEQ ID NO: 2153821 - RNA, 20 nt, Human
gagguuucucaaagaaauuu

SEQ ID NO: 2153822 - RNA, 17 nt, Human
gcacagagagggggcca

SEQ ID NO: 2153823 - RNA, 15 nt, Human
gcacagagagggggc

SEQ ID NO: 2153824 - RNA, 18 nt, Human
gcacagacgucccuccac

SEQ ID NO: 2153825 - RNA, 23 nt, Human
gcacagagagggggccaccuccc

SEQ ID NO: 2153826 - RNA, 19 nt, Human
gcacagagagggggccacc

SEQ ID NO: 2153827 - RNA, 18 nt, Human
gauuacaggcaugugcca

SEQ ID NO: 2153828 - RNA, 16 nt, Human
gauuuugcuguagaag

SEQ ID NO: 2153829 - RNA, 20 nt, Human
gauuacagggaugagccacc

SEQ ID NO: 2153830 - RNA, 18 nt, Human
gauuacagggaugagcca

SEQ ID NO: 2153831 - RNA, 19 nt, Human
gacagagaggacgugggcg

SEQ ID NO: 2153832 - RNA, 18 nt, Human
gacagagaggacgugggc

SEQ ID NO: 2153833 - RNA, 15 nt, Human
gacaugcgggcuggg

SEQ ID NO: 2153834 - RNA, 14 nt, Human
gacaugcgggcugg

SEQ ID NO: 2153835 - RNA, 22 nt, Human
gacaugcgggcugggcagcugu

SEQ ID NO: 2153836 - RNA, 21 nt, Human
gacaugcgggcugggcagcug

SEQ ID NO: 2153837 - RNA, 20 nt, Human
gacaugcgggcugggcagcu

SEQ ID NO: 2153838 - RNA, 18 nt, Human
gacaugcgggcugggcag

SEQ ID NO: 2153839 - RNA, 19 nt, Human
gaccccuccccuaaugccu

SEQ ID NO: 2153840 - RNA, 18 nt, Human
gagagggggccaccuccc

SEQ ID NO: 2153841 - RNA, 21 nt, Human
gagccagcagccuggcucucc

SEQ ID NO: 2153842 - RNA, 19 nt, Human
cuggcaguggaacuaagaa

SEQ ID NO: 2153843 - RNA, 17 nt, Human
cugguuccggaauccug

SEQ ID NO: 2153844 - RNA, 18 nt, Human
cugguuccggaauccugu

SEQ ID NO: 2153845 - RNA, 15 nt, Human
cuguccucagcuucu

SEQ ID NO: 2153846 - RNA, 17 nt, Human
cuguccucagcuucuua

SEQ ID NO: 2153847 - RNA, 18 nt, Human
cuguggccaaguucuuag

SEQ ID NO: 2153848 - RNA, 16 nt, Human
cuguggccaaguucuu

SEQ ID NO: 2153849 - RNA, 20 nt, Human
cuucuccuuagaaguggaag

SEQ ID NO: 2153850 - RNA, 19 nt, Human
gaaaaguuuuguaaauuuc

SEQ ID NO: 2153851 - RNA, 19 nt, Human
ccuuuguuuuuuuuuccug

SEQ ID NO: 2153852 - RNA, 17 nt, Human
cggaauccuguccucag

SEQ ID NO: 2153853 - RNA, 18 nt, Human
cggaauccuguccucagc

SEQ ID NO: 2153854 - RNA, 15 nt, Human
cggaauccuguccuc

SEQ ID NO: 2153855 - RNA, 18 nt, Human
cgcacgugggucuucagg

SEQ ID NO: 2153856 - RNA, 13 nt, Human
ccugccucagccu

SEQ ID NO: 2153857 - RNA, 17 nt, Human
cuacaugugggagcuuu

SEQ ID NO: 2153858 - RNA, 16 nt, Human
cuacaugugggagcuu

SEQ ID NO: 2153859 - RNA, 14 nt, Human
cuaauuagagcaga

SEQ ID NO: 2153860 - RNA, 22 nt, Human
cuccaaguccacaguggaacca

SEQ ID NO: 2153861 - RNA, 14 nt, Human
ccguggcugcggca

SEQ ID NO: 2153862 - RNA, 15 nt, Human
ccuacaguguacagu

SEQ ID NO: 2153863 - RNA, 20 nt, Human
ccuacaguguacagucuugu

SEQ ID NO: 2153864 - RNA, 16 nt, Human
ccuacaguguacaguc

SEQ ID NO: 2153865 - RNA, 23 nt, Human
ccagagccucaaaugagaaaaug

SEQ ID NO: 2153866 - RNA, 20 nt, Human
ccagagccucaaaugagaaa

SEQ ID NO: 2153867 - RNA, 16 nt, Human
ccaggugcacagacgu

SEQ ID NO: 2153868 - RNA, 13 nt, Human
ccaggugcacaga

SEQ ID NO: 2153869 - RNA, 19 nt, Human
ccaggugcacagacguccc

SEQ ID NO: 2153870 - RNA, 14 nt, Human
ccaggcuggucuca

SEQ ID NO: 2153871 - RNA, 17 nt, Human
accggcaauuuccggcc

SEQ ID NO: 2153872 - RNA, 18 nt, Human
accggcaauuuccggcca

SEQ ID NO: 2153873 - RNA, 19 nt, Human
acgcacgugggucuucagg

SEQ ID NO: 2153874 - RNA, 20 nt, Human
acgcacgugggucuucaggg

SEQ ID NO: 2153875 - RNA, 19 nt, Human
accuguggccaaguucuua

SEQ ID NO: 2153876 - RNA, 18 nt, Human
accuguggccaaguucuu

SEQ ID NO: 2153877 - RNA, 14 nt, Human
acuaaucuuucugc

SEQ ID NO: 2153878 - RNA, 17 nt, Human
acuauugcuugcacaaa

SEQ ID NO: 2153879 - RNA, 13 nt, Human
acuucugccucuu

SEQ ID NO: 2153880 - RNA, 21 nt, Human
acugaccaauauuguacaguu

SEQ ID NO: 2153881 - RNA, 20 nt, Human
acugaccaauauuguacagu

SEQ ID NO: 2153882 - RNA, 22 nt, Human
acugaccaauauuguacaguuu

SEQ ID NO: 2153883 - RNA, 21 nt, Human
acagcugcagagacagagagg

SEQ ID NO: 2153884 - RNA, 17 nt, Human
acagcugcagagacaga

SEQ ID NO: 2153885 - RNA, 15 nt, Human
acagcugcagagaca

SEQ ID NO: 2153886 - RNA, 17 nt, Human
acaguguacagucuugu

SEQ ID NO: 2153887 - RNA, 15 nt, Human
acaguguacagucuu

SEQ ID NO: 2153888 - RNA, 18 nt, Human
acaguguacagucuugua

SEQ ID NO: 2153889 - RNA, 13 nt, Human
acaguguacaguc

SEQ ID NO: 2153890 - RNA, 12 nt, Human
acaguguacagu

SEQ ID NO: 2153891 - RNA, 23 nt, Human
aaguagacuucauuuuuccuaac

SEQ ID NO: 2153892 - RNA, 19 nt, Human
aaguagacuucauuuuucc

SEQ ID NO: 2153893 - RNA, 14 nt, Human
aacuuacuuagugu

SEQ ID NO: 2153894 - RNA, 19 nt, Human
aauccaccugccucggccu

SEQ ID NO: 2153895 - RNA, 18 nt, Human
aauccaccugccucggcc

SEQ ID NO: 2153896 - RNA, 13 nt, Human
aauauaacugccu

SEQ ID NO: 2153897 - RNA, 16 nt, Human
aauagaaauccaauug

SEQ ID NO: 2153898 - RNA, 17 nt, Human
aauagaaauggggaacu

SEQ ID NO: 2153899 - RNA, 22 nt, Human
aaguucuuaguugcuguauguc

SEQ ID NO: 2153900 - RNA, 15 nt, Human
aaguucuuaguugcu

SEQ ID NO: 2153901 - RNA, 16 nt, Human
aacaggauuagacagu

SEQ ID NO: 2153902 - RNA, 19 nt, Human
aacaggauuagacagucaa

SEQ ID NO: 2153903 - RNA, 14 nt, Human
aacgguuaaaacug

SEQ ID NO: 2153904 - RNA, 13 nt, Human
aacgguuaaaacu

SEQ ID NO: 2153905 - RNA, 18 nt, Human
aaagcccaaagugguaua

SEQ ID NO: 2153906 - RNA, 16 nt, Human
aggaccuguggccaag

SEQ ID NO: 2153907 - RNA, 22 nt, Human
aggcuggucucaaacuccugac

SEQ ID NO: 2153908 - RNA, 11 nt, Human
agacagagucu

SEQ ID NO: 2153909 - RNA, 12 nt, Human
agagggggccac

SEQ ID NO: 2153910 - RNA, 19 nt, Human
agagagggggccaccuccc

SEQ ID NO: 2153911 - RNA, 16 nt, Human
agagagggggccaccu

SEQ ID NO: 2153912 - RNA, 14 nt, Human
agagagggggccac

SEQ ID NO: 2153913 - RNA, 17 nt, Human
agagccucaaaugagaa

SEQ ID NO: 2153914 - RNA, 14 nt, Human
agagccucaaauga

SEQ ID NO: 2153915 - RNA, 22 nt, Human
agacugaccaauauuguacagu

SEQ ID NO: 2153916 - RNA, 16 nt, Human
augccugcggaguugu

SEQ ID NO: 2153917 - RNA, 19 nt, Human
auggaggcacacagcugca

SEQ ID NO: 2153918 - RNA, 23 nt, Human
aguccaacguggggcagcacaga

SEQ ID NO: 2153919 - RNA, 22 nt, Human
aguccaacguggggcagcacag

SEQ ID NO: 2153920 - RNA, 20 nt, Human
aguccaacguggggcagcac

SEQ ID NO: 2153921 - RNA, 19 nt, Human
aguccaacguggggcagca

SEQ ID NO: 2153922 - RNA, 18 nt, Human
aguccaacguggggcagc

SEQ ID NO: 2153923 - RNA, 16 nt, Human
auaugcaguuuuccuu

SEQ ID NO: 2153924 - RNA, 22 nt, Human
cucagccuccugaguagcugga

SEQ ID NO: 2153925 - RNA, 14 nt, Human
cucagccuccugag

SEQ ID NO: 2153926 - RNA, 20 nt, Human
cguggggcagcacagagagg

SEQ ID NO: 2153927 - RNA, 22 nt, Human
cgugggucuucagggggccagg

SEQ ID NO: 2153928 - RNA, 17 nt, Human
cggcucuggccuccaag

SEQ ID NO: 2153929 - RNA, 17 nt, Human
cuacaguguacagucuu

SEQ ID NO: 2153930 - RNA, 16 nt, Human
cuacaguguacagucu

SEQ ID NO: 2153931 - RNA, 14 nt, Human
cuacaguguacagu

SEQ ID NO: 2153932 - RNA, 15 nt, Human
cuacaguguacaguc

SEQ ID NO: 2153933 - RNA, 20 nt, Human
cuacaguguacagucuugua

SEQ ID NO: 2153934 - RNA, 15 nt, Human
cuagaacugaauuuu

SEQ ID NO: 2153935 - RNA, 23 nt, Human
cuagaaaugauccccagcuguuu

SEQ ID NO: 2153936 - RNA, 13 nt, Human
cgccguggcugcg

SEQ ID NO: 2153937 - RNA, 20 nt, Human
ccuucugaaaaaguauccug

SEQ ID NO: 2153938 - RNA, 21 nt, Human
ccuccaaguccacaguggaac

SEQ ID NO: 2153939 - RNA, 18 nt, Human
ccuccaaguccacagugg

SEQ ID NO: 2153940 - RNA, 14 nt, Human
ccucagccuccuga

SEQ ID NO: 2153941 - RNA, 19 nt, Human
ccugaguagcuggauuaca

SEQ ID NO: 2153942 - RNA, 15 nt, Human
ccugaguagcuggau

SEQ ID NO: 2153943 - RNA, 20 nt, Human
ccugaguagcuggauuacag

SEQ ID NO: 2153944 - RNA, 22 nt, Human
cagcuguuagaguccaacgugg

SEQ ID NO: 2153945 - RNA, 16 nt, Human
caggccacggcagccu

SEQ ID NO: 2153946 - RNA, 21 nt, Human
cagagaggacgugggcggcag

SEQ ID NO: 2153947 - RNA, 18 nt, Human
cagagaggacgugggcgg

SEQ ID NO: 2153948 - RNA, 17 nt, Human
cagagaggacgugggcg

SEQ ID NO: 2153949 - RNA, 16 nt, Human
cagagaggacgugggc

SEQ ID NO: 2153950 - RNA, 17 nt, Human
ccaagcuuccuuuguuu

SEQ ID NO: 2153951 - RNA, 22 nt, Human
ccaaagugcugggauuacaggg

SEQ ID NO: 2153952 - RNA, 20 nt, Human
ccaacguggggcagcacaga

SEQ ID NO: 2153953 - RNA, 16 nt, Human
ccaacguggggcagca

SEQ ID NO: 2153954 - RNA, 15 nt, Human
ccaacguggggcagc

SEQ ID NO: 2153955 - RNA, 19 nt, Human
ccaaagugguauagaaaug

SEQ ID NO: 2153956 - RNA, 15 nt, Human
cacacagcugcagag

SEQ ID NO: 2153957 - RNA, 17 nt, Human
caaguccacaguggaac

SEQ ID NO: 2153958 - RNA, 23 nt, Human
caccugccucggccucccaaagu

SEQ ID NO: 2153959 - RNA, 17 nt, Human
caccuacaguguacagu

SEQ ID NO: 2153960 - RNA, 16 nt, Human
caccuacaguguacag

SEQ ID NO: 2153961 - RNA, 13 nt, Human
caccuacagugua

SEQ ID NO: 2153962 - RNA, 20 nt, Human
caccuacaguguacagucuu

SEQ ID NO: 2153963 - RNA, 19 nt, Human
auuagcauuugucaacaaa

SEQ ID NO: 2153964 - RNA, 13 nt, Human
cuggcucaucucu

SEQ ID NO: 2153965 - RNA, 12 nt, Human
cugggcagcugu

SEQ ID NO: 2153966 - RNA, 23 nt, Human
cuuuuuuuuuuuuuaaagacaga

SEQ ID NO: 2153967 - RNA, 22 nt, Human
cuuuuuuuuuuuuuaaagacag

SEQ ID NO: 2153968 - RNA, 19 nt, Human
cuugcgcuuuugcugguca

SEQ ID NO: 2153969 - RNA, 17 nt, Human
gauacgacaacuugcac

SEQ ID NO: 2153970 - RNA, 18 nt, Human
gauaugcaguuuuccuua

SEQ ID NO: 2153971 - RNA, 22 nt, Human
gacagucaaggaguggcuuacu

SEQ ID NO: 2153972 - RNA, 19 nt, Human
gacagucaaggaguggcuu

SEQ ID NO: 2153973 - RNA, 17 nt, Human
gacagucaaggaguggc

SEQ ID NO: 2153974 - RNA, 16 nt, Human
gacagucaaggagugg

SEQ ID NO: 2153975 - RNA, 23 nt, Human
ggccuccaaguccacaguggaac

SEQ ID NO: 2153976 - RNA, 14 nt, Human
gggcggcagagagg

SEQ ID NO: 2153977 - RNA, 13 nt, Human
aaaaugucuuuau

SEQ ID NO: 2153978 - RNA, 19 nt, Human
ggucuucagggggccaggu

SEQ ID NO: 2153979 - RNA, 19 nt, Human
gguuucaccauguuggcca

SEQ ID NO: 2153980 - RNA, 19 nt, Human
gcuuacaagccagcuggag

SEQ ID NO: 2153981 - RNA, 13 nt, Human
gcuuacaagccag

SEQ ID NO: 2153982 - RNA, 19 nt, Human
gcuucuuaauauaacugcc

SEQ ID NO: 2153983 - RNA, 22 nt, Human
gcuucuuaauauaacugccuua

SEQ ID NO: 2153984 - RNA, 21 nt, Human
gcuucuuaauauaacugccuu

SEQ ID NO: 2153985 - RNA, 17 nt, Human
ggaacugaacauuccag

SEQ ID NO: 2153986 - RNA, 18 nt, Human
gcugcagagacagagagg

SEQ ID NO: 2153987 - RNA, 15 nt, Human
gccauguguuccaag

SEQ ID NO: 2153988 - RNA, 16 nt, Human
gccauguguuccaagg

SEQ ID NO: 2153989 - RNA, 11 nt, Human
gcuagaaauga

SEQ ID NO: 2153990 - RNA, 16 nt, Human
uugaugugugucuagg

SEQ ID NO: 2153991 - RNA, 19 nt, Human
uugcacaaaccaauuaaac

SEQ ID NO: 2153992 - RNA, 17 nt, Human
augagaaaaugucuuua

SEQ ID NO: 2153993 - RNA, 13 nt, Human
augcugguuuuuc

SEQ ID NO: 2153994 - RNA, 22 nt, Human
uuuaugggucagaguuccgacu

SEQ ID NO: 2153995 - RNA, 15 nt, Human
augcaguuuuccuua

SEQ ID NO: 2153996 - RNA, 16 nt, Human
augauuuuuaaagaaa

SEQ ID NO: 2153997 - RNA, 14 nt, Human
augauuuuuaaaga

SEQ ID NO: 2153998 - RNA, 21 nt, Human
uucgccguggcugcggcaccc

SEQ ID NO: 2153999 - RNA, 20 nt, Human
uucgccguggcugcggcacc

SEQ ID NO: 2154000 - RNA, 14 nt, Human
uucgccguggcugc

SEQ ID NO: 2154001 - RNA, 23 nt, Human
uucuuuucgccguggcugcggca

SEQ ID NO: 2154002 - RNA, 20 nt, Human
auauaacugccuuaaaacuu

SEQ ID NO: 2154003 - RNA, 13 nt, Human
auauaacugccuu

SEQ ID NO: 2154004 - RNA, 16 nt, Human
auauaaaagacugacc

SEQ ID NO: 2154005 - RNA, 12 nt, Human
auugcaauagaa

SEQ ID NO: 2154006 - RNA, 19 nt, Human
auuuacccuucuuuucuga

SEQ ID NO: 2154007 - RNA, 21 nt, Human
auuagagcagaugaccccucc

SEQ ID NO: 2154008 - RNA, 17 nt, Human
uuuucagauauaaaaga

SEQ ID NO: 2154009 - RNA, 21 nt, Human
uuuucagauauaaaagacuga

SEQ ID NO: 2154010 - RNA, 19 nt, Human
uuuucagauauaaaagacu

SEQ ID NO: 2154011 - RNA, 22 nt, Human
uuuucagauauaaaagacugac

SEQ ID NO: 2154012 - RNA, 22 nt, Human
uuuuaaguuacacauuuuucag

SEQ ID NO: 2154013 - RNA, 21 nt, Human
uuuuaaguuacacauuuuuca

SEQ ID NO: 2154014 - RNA, 16 nt, Human
auguuggccaggcugg

SEQ ID NO: 2154015 - RNA, 21 nt, Human
uuugcuguagaagauggcacu

SEQ ID NO: 2154016 - RNA, 13 nt, Human
uuugcuguagaag

SEQ ID NO: 2154017 - RNA, 15 nt, Human
uuugcuucaaaaaca

SEQ ID NO: 2154018 - RNA, 23 nt, Human
uuagacagucaaggaguggcuua

SEQ ID NO: 2154019 - RNA, 18 nt, Human
auaaucucuccauucccg

SEQ ID NO: 2154020 - RNA, 15 nt, Human
aguuuaauugacuua

SEQ ID NO: 2154021 - RNA, 14 nt, Human
aguuuaauugacuu

SEQ ID NO: 2154022 - RNA, 18 nt, Human
aguuuaauugacuuauuu

SEQ ID NO: 2154023 - RNA, 21 nt, Human
uuaauugacuuauuuauauaa

SEQ ID NO: 2154024 - RNA, 15 nt, Human
aguuuuguaaauuuc

SEQ ID NO: 2154025 - RNA, 12 nt, Human
aguuuuguaaau

SEQ ID NO: 2154026 - RNA, 15 nt, Human
aguuuuuauugcuug

SEQ ID NO: 2154027 - RNA, 16 nt, Human
aguggaaccagcccag

SEQ ID NO: 2154028 - RNA, 21 nt, Human
uguugcccaggcuggagugca

SEQ ID NO: 2154029 - RNA, 14 nt, Human
uguugcccaggcug

SEQ ID NO: 2154030 - RNA, 15 nt, Human
uguugcccaggcugg

SEQ ID NO: 2154031 - RNA, 22 nt, Human
agugauucuccugccucagccu

SEQ ID NO: 2154032 - RNA, 16 nt, Human
agugcaaugacacagu

SEQ ID NO: 2154033 - RNA, 18 nt, Human
agugcaaugacacagucu

SEQ ID NO: 2154034 - RNA, 20 nt, Human
ugugucuaggcaggaccugu

SEQ ID NO: 2154035 - RNA, 19 nt, Human
ugugucuaggcaggaccug

SEQ ID NO: 2154036 - RNA, 17 nt, Human
agugcugggauuacagg

SEQ ID NO: 2154037 - RNA, 22 nt, Human
aggugcacagacgucccuccac

SEQ ID NO: 2154038 - RNA, 23 nt, Human
aggugcacagacgucccuccacg

SEQ ID NO: 2154039 - RNA, 20 nt, Human
uguaagaucguucucugccu

SEQ ID NO: 2154040 - RNA, 19 nt, Human
uguaagaucguucucugcc

SEQ ID NO: 2154041 - RNA, 14 nt, Human
aguaauccaccugc

SEQ ID NO: 2154042 - RNA, 17 nt, Human
ugguacucauuaaaaaa

SEQ ID NO: 2154043 - RNA, 18 nt, Human
uggucucaaacuccugac

SEQ ID NO: 2154044 - RNA, 15 nt, Human
ugccuuaaaacuuua

SEQ ID NO: 2154045 - RNA, 16 nt, Human
ugcgggcugggcagcu

SEQ ID NO: 2154046 - RNA, 15 nt, Human
ugcgggcugggcagc

SEQ ID NO: 2154047 - RNA, 14 nt, Human
ugcgggcugggcag

SEQ ID NO: 2154048 - RNA, 13 nt, Human
ugcgggcugggca

SEQ ID NO: 2154049 - RNA, 17 nt, Human
ugcgggcugggcagcug

SEQ ID NO: 2154050 - RNA, 21 nt, Human
ugcuucaaaaacauucuuaca

SEQ ID NO: 2154051 - RNA, 13 nt, Human
ugcuucaaaaaca

SEQ ID NO: 2154052 - RNA, 13 nt, Human
uggauuggauuug

SEQ ID NO: 2154053 - RNA, 12 nt, Human
agccucaucucu

SEQ ID NO: 2154054 - RNA, 19 nt, Human
ugauucuccugccucagcc

SEQ ID NO: 2154055 - RNA, 11 nt, Human
agcuagaaaug

SEQ ID NO: 2154056 - RNA, 12 nt, Human
agcuagaaauga

SEQ ID NO: 2154057 - RNA, 13 nt, Human
ugaguagcuggau

SEQ ID NO: 2154058 - RNA, 19 nt, Human
ugauauguugguagauucu

SEQ ID NO: 2154059 - RNA, 14 nt, Human
agcaagauuucaga

SEQ ID NO: 2154060 - RNA, 23 nt, Human
ugacacagucuuggcucacugca

SEQ ID NO: 2154061 - RNA, 22 nt, Human
ugacacagucuuggcucacugc

SEQ ID NO: 2154062 - RNA, 21 nt, Human
ucuuuauuaaauguagaaagu

SEQ ID NO: 2154063 - RNA, 17 nt, Human
ucuuuauuaaauguaga

SEQ ID NO: 2154064 - RNA, 16 nt, Human
ucuuuaugauuuuuaa

SEQ ID NO: 2154065 - RNA, 22 nt, Human
ucuuuggugaacauugcaauag

SEQ ID NO: 2154066 - RNA, 16 nt, Human
ucuuuggugaacauug

SEQ ID NO: 2154067 - RNA, 22 nt, Human
ugaaaaaguauccugcuucuga

SEQ ID NO: 2154068 - RNA, 21 nt, Human
agaacugaauuuugucuuuau

SEQ ID NO: 2154069 - RNA, 21 nt, Human
agaaaugcugguuuuucaguu

SEQ ID NO: 2154070 - RNA, 20 nt, Human
agaaaugcugguuuuucagu

SEQ ID NO: 2154071 - RNA, 14 nt, Human
ucucuccauucccg

SEQ ID NO: 2154072 - RNA, 17 nt, Human
ucucgcucuguugccca

SEQ ID NO: 2154073 - RNA, 21 nt, Human
ucuccuuagaaguggaaguag

SEQ ID NO: 2154074 - RNA, 15 nt, Human
ucuccuuagaagugg

SEQ ID NO: 2154075 - RNA, 21 nt, Human
acuuucuuuucgccguggcug

SEQ ID NO: 2154076 - RNA, 20 nt, Human
acuuucuuuucgccguggcu

SEQ ID NO: 2154077 - RNA, 23 nt, Human
acuuugaggguguauauuuucug

SEQ ID NO: 2154078 - RNA, 14 nt, Human
ucgccguggcugcg

SEQ ID NO: 2154079 - RNA, 21 nt, Human
ucgcucuguugcccaggcugg

SEQ ID NO: 2154080 - RNA, 13 nt, Human
ucguucucugccu

SEQ ID NO: 2154081 - RNA, 18 nt, Human
ucacugcaacuucugccu

SEQ ID NO: 2154082 - RNA, 17 nt, Human
ucacugcaacuucugcc

SEQ ID NO: 2154083 - RNA, 16 nt, Human
ucaggccacggcagcc

SEQ ID NO: 2154084 - RNA, 14 nt, Human
ucaggccacggcag

SEQ ID NO: 2154085 - RNA, 17 nt, Human
ucaggccacggcagccu

SEQ ID NO: 2154086 - RNA, 13 nt, Human
ucauaacuagaac

SEQ ID NO: 2154087 - RNA, 15 nt, Human
ucauaacuagaacug

SEQ ID NO: 2154088 - RNA, 11 nt, Human
acauuuuguau

SEQ ID NO: 2154089 - RNA, 18 nt, Human
acauuuuacuuuuuccug

SEQ ID NO: 2154090 - RNA, 21 nt, Human
acauuuuucagauauaaaaga

SEQ ID NO: 2154091 - RNA, 19 nt, Human
ucaaguaauccaccugccu

SEQ ID NO: 2154092 - RNA, 17 nt, Human
ucaagcaagauuucaga

SEQ ID NO: 2154093 - RNA, 16 nt, Human
ucacagccacuuggga

SEQ ID NO: 2154094 - RNA, 20 nt, Human
ucccaaagugcugggauuac

SEQ ID NO: 2154095 - RNA, 23 nt, Human
acuagaacugaauuuugucuuua

SEQ ID NO: 2154096 - RNA, 19 nt, Human
acuagaacugaauuuuguc

SEQ ID NO: 2154097 - RNA, 18 nt, Human
acuagaacugaauuuugu

SEQ ID NO: 2154098 - RNA, 17 nt, Human
acuagaacugaauuuug

SEQ ID NO: 2154099 - RNA, 16 nt, Human
acuagaacugaauuuu

SEQ ID NO: 2154100 - RNA, 15 nt, Human
uaggcaggaccugug

SEQ ID NO: 2154101 - RNA, 14 nt, Human
uaggcaggaccugu

SEQ ID NO: 2154102 - RNA, 19 nt, Human
uauaacugccuuaaaacuu

SEQ ID NO: 2154103 - RNA, 20 nt, Human
uauaacugccuuaaaacuuu

SEQ ID NO: 2154104 - RNA, 16 nt, Human
acagacgucccuccac

SEQ ID NO: 2154105 - RNA, 15 nt, Human
acagacgucccucca

SEQ ID NO: 2154106 - RNA, 20 nt, Human
acagaaaacgguuaaaacug

SEQ ID NO: 2154107 - RNA, 16 nt, Human
acagaaagguuuucuu

SEQ ID NO: 2154108 - RNA, 21 nt, Human
uaugucucgugguaggacugu

SEQ ID NO: 2154109 - RNA, 22 nt, Human
aauuagagcagaugaccccucc

SEQ ID NO: 2154110 - RNA, 12 nt, Human
aauuagagcaga

SEQ ID NO: 2154111 - RNA, 20 nt, Human
aaugagaaaaugucuuuauu

SEQ ID NO: 2154112 - RNA, 21 nt, Human
uaaguuacacauuuuucagau

SEQ ID NO: 2154113 - RNA, 20 nt, Human
aaucacguaaagcuagaaau

SEQ ID NO: 2154114 - RNA, 21 nt, Human
aaucacguaaagcuagaaaug

SEQ ID NO: 2154115 - RNA, 15 nt, Human
aaucacguaaagcua

SEQ ID NO: 2154116 - RNA, 18 nt, Human
aauagcgucauaacuaga

SEQ ID NO: 2154117 - RNA, 18 nt, Human
aagacuuccagagccuca

SEQ ID NO: 2154118 - RNA, 16 nt, Human
aagacuuccagagccu

SEQ ID NO: 2154119 - RNA, 22 nt, Human
aagacgugauuuugcuguagaa

SEQ ID NO: 2154120 - RNA, 16 nt, Human
aagacgugauuuugcu

SEQ ID NO: 2154121 - RNA, 23 nt, Human
aagacgugauuuugcuguagaag

SEQ ID NO: 2154122 - RNA, 17 nt, Human
aagaucguucucugccu

SEQ ID NO: 2154123 - RNA, 16 nt, Human
aagaucguucucugcc

SEQ ID NO: 2154124 - RNA, 13 nt, Human
uaaaacuuuaauc

SEQ ID NO: 2154125 - RNA, 13 nt, Human
uaaaagacuuuuu

SEQ ID NO: 2154126 - RNA, 21 nt, Human
aaguaauccaccugccucggc

SEQ ID NO: 2154127 - RNA, 18 nt, Human
aagugagacuuugagggu

SEQ ID NO: 2154128 - RNA, 14 nt, Human
guuuuucaguuuuc

SEQ ID NO: 2154129 - RNA, 19 nt, Human
guuuuuccuguucuuaaga

SEQ ID NO: 2154130 - RNA, 18 nt, Human
guuucucaaagaaauuuc

SEQ ID NO: 2154131 - RNA, 17 nt, Human
guuucucaaagaaauuu

SEQ ID NO: 2154132 - RNA, 14 nt, Human
guuucucaaagaaa

SEQ ID NO: 2154133 - RNA, 21 nt, Human
guccaacguggggcagcacag

SEQ ID NO: 2154134 - RNA, 20 nt, Human
guccaacguggggcagcaca

SEQ ID NO: 2154135 - RNA, 18 nt, Human
guccaacguggggcagca

SEQ ID NO: 2154136 - RNA, 15 nt, Human
gucaggccacggcag

SEQ ID NO: 2154137 - RNA, 14 nt, Human
gucaggccacggca

SEQ ID NO: 2154138 - RNA, 12 nt, Human
gucaggccacgg

SEQ ID NO: 2154139 - RNA, 18 nt, Human
gucaggccacggcagccu

SEQ ID NO: 2154140 - RNA, 16 nt, Human
gucaggccacggcagc

SEQ ID NO: 2154141 - RNA, 13 nt, Human
gucauaacuagaa

SEQ ID NO: 2154142 - RNA, 22 nt, Human
aaauguaagaucguucucugcc

SEQ ID NO: 2154143 - RNA, 14 nt, Human
aaauguaagaucgu

SEQ ID NO: 2154144 - RNA, 22 nt, Human
guauauuuguauuuaaaugaaa

SEQ ID NO: 2154145 - RNA, 16 nt, Human
gucuuuggugaacauu

SEQ ID NO: 2154146 - RNA, 22 nt, Human
aaccucgagguuucucaaagaa

SEQ ID NO: 2154147 - RNA, 21 nt, Human
aaccucgagguuucucaaaga

SEQ ID NO: 2154148 - RNA, 17 nt, Human
aacugccuuaaaacuuu

SEQ ID NO: 2154149 - RNA, 22 nt, Human
gugcacagacgucccuccacgu

SEQ ID NO: 2154150 - RNA, 20 nt, Human
gugcacagacgucccuccac

SEQ ID NO: 2154151 - RNA, 22 nt, Human
aacuucuccccugguagaaaga

SEQ ID NO: 2154152 - RNA, 13 nt, Human
cacaguggaacca

SEQ ID NO: 2154153 - RNA, 19 nt, Human
cacagcugcagagacagag

SEQ ID NO: 2154154 - RNA, 18 nt, Human
cacagcugcagagacaga

SEQ ID NO: 2154155 - RNA, 13 nt, Human
caaugugccccca

SEQ ID NO: 2154156 - RNA, 19 nt, Human
caauagauauuuaccuuuu

SEQ ID NO: 2154157 - RNA, 18 nt, Human
caacguggggcagcacag

SEQ ID NO: 2154158 - RNA, 17 nt, Human
caacguggggcagcaca

SEQ ID NO: 2154159 - RNA, 15 nt, Human
caacguggggcagca

SEQ ID NO: 2154160 - RNA, 12 nt, Human
caacguggggca

SEQ ID NO: 2154161 - RNA, 19 nt, Human
caaagaaauuuccacucag

SEQ ID NO: 2154162 - RNA, 18 nt, Human
caaagaaauuuccacuca

SEQ ID NO: 2154163 - RNA, 12 nt, Human
caaagaaauuuc

SEQ ID NO: 2154164 - RNA, 20 nt, Human
uguuggauuuuugucuugug

SEQ ID NO: 2154165 - RNA, 19 nt, Human
uguugacauccaagcuucc

SEQ ID NO: 2154166 - RNA, 17 nt, Human
uguugacauccaagcuu

SEQ ID NO: 2154167 - RNA, 20 nt, Human
uguuaccuaauuagagcaga

SEQ ID NO: 2154168 - RNA, 23 nt, Human
ugugugaagaucacguuccuucc

SEQ ID NO: 2154169 - RNA, 20 nt, Human
uguguuuuuaauaaagacag

SEQ ID NO: 2154170 - RNA, 15 nt, Human
uguguuuuuaauaaa

SEQ ID NO: 2154171 - RNA, 22 nt, Human
ugugugucuaggcaggaccugu

SEQ ID NO: 2154172 - RNA, 14 nt, Human
uuaaaacuuuaauc

SEQ ID NO: 2154173 - RNA, 18 nt, Human
uuaaagaaaaguuuugua

SEQ ID NO: 2154174 - RNA, 15 nt, Human
uuacacauuuuucag

SEQ ID NO: 2154175 - RNA, 23 nt, Human
uuacacauuuuucagauauaaaa

SEQ ID NO: 2154176 - RNA, 17 nt, Human
uuacacauuuuucagau

SEQ ID NO: 2154177 - RNA, 15 nt, Human
uuaaauguagaaagu

SEQ ID NO: 2154178 - RNA, 14 nt, Human
uguccucagcuucu

SEQ ID NO: 2154179 - RNA, 21 nt, Human
uguacagucuuguauuaaguu

SEQ ID NO: 2154180 - RNA, 17 nt, Human
uguacagucuuguauua

SEQ ID NO: 2154181 - RNA, 13 nt, Human
ugcccaggcugga

SEQ ID NO: 2154182 - RNA, 20 nt, Human
ugcccaggcuggagugcaau

SEQ ID NO: 2154183 - RNA, 18 nt, Human
ugcccaggcuggagugca

SEQ ID NO: 2154184 - RNA, 21 nt, Human
ugggauuacagggaugagcca

SEQ ID NO: 2154185 - RNA, 16 nt, Human
ugguauagaaaugcug

SEQ ID NO: 2154186 - RNA, 14 nt, Human
ugguauagaaaugc

SEQ ID NO: 2154187 - RNA, 22 nt, Human
ugguauagaaaugcugguuuuu

SEQ ID NO: 2154188 - RNA, 13 nt, Human
ugguauagaaaug

SEQ ID NO: 2154189 - RNA, 21 nt, Human
uggaacguuuuuccuguucuu

SEQ ID NO: 2154190 - RNA, 22 nt, Human
uccggaauccuguccucagcuu

SEQ ID NO: 2154191 - RNA, 18 nt, Human
uccggaauccuguccuca

SEQ ID NO: 2154192 - RNA, 15 nt, Human
uccggaauccugucc

SEQ ID NO: 2154193 - RNA, 15 nt, Human
ucccacuugccccug

SEQ ID NO: 2154194 - RNA, 22 nt, Human
ucagcaccuacaguguacaguc

SEQ ID NO: 2154195 - RNA, 21 nt, Human
ucagcaccuacaguguacagu

SEQ ID NO: 2154196 - RNA, 20 nt, Human
ucagcaccuacaguguacag

SEQ ID NO: 2154197 - RNA, 18 nt, Human
ugaaaacagaaaacgguu

SEQ ID NO: 2154198 - RNA, 22 nt, Human
ucuuuucgccguggcugcggca

SEQ ID NO: 2154199 - RNA, 20 nt, Human
ucugccucacauagcuuaca

SEQ ID NO: 2154200 - RNA, 14 nt, Human
ugacucuuggcaca

SEQ ID NO: 2154201 - RNA, 19 nt, Human
ugacucuuggcacagcaug

SEQ ID NO: 2154202 - RNA, 18 nt, Human
ugacaugcgggcugggca

SEQ ID NO: 2154203 - RNA, 17 nt, Human
ugacaugcgggcugggc

SEQ ID NO: 2154204 - RNA, 22 nt, Human
ugacaugcgggcugggcagcug

SEQ ID NO: 2154205 - RNA, 21 nt, Human
ugacaugcgggcugggcagcu

SEQ ID NO: 2154206 - RNA, 20 nt, Human
ugacaugcgggcugggcagc

SEQ ID NO: 2154207 - RNA, 19 nt, Human
ugacaugcgggcugggcag

SEQ ID NO: 2154208 - RNA, 13 nt, Human
ugacauccaagcu

SEQ ID NO: 2154209 - RNA, 17 nt, Human
ugacauccaagcuuccu

SEQ ID NO: 2154210 - RNA, 17 nt, Human
ugaaucacguaaagcua

SEQ ID NO: 2154211 - RNA, 23 nt, Human
ugaaucacguaaagcuagaaaug

SEQ ID NO: 2154212 - RNA, 15 nt, Human
uaccuaauuagagca

SEQ ID NO: 2154213 - RNA, 20 nt, Human
uaccuaauuagagcagauga

SEQ ID NO: 2154214 - RNA, 17 nt, Human
uaccuaauuagagcaga

SEQ ID NO: 2154215 - RNA, 11 nt, Human
uauagaaaugc

SEQ ID NO: 2154216 - RNA, 15 nt, Human
uaagccaugggagac

SEQ ID NO: 2154217 - RNA, 22 nt, Human
uaauuagagcagaugaccccuc

SEQ ID NO: 2154218 - RNA, 11 nt, Human
uaauguuuccu

SEQ ID NO: 2154219 - RNA, 15 nt, Human
uaaauguagaaagug

SEQ ID NO: 2154220 - RNA, 22 nt, Human
uaaagaaaaguuuuguaaauuu

SEQ ID NO: 2154221 - RNA, 16 nt, Human
uaaagaaaaguuuugu

SEQ ID NO: 2154222 - RNA, 17 nt, Human
guuuuuaauaaagacag

SEQ ID NO: 2154223 - RNA, 15 nt, Human
guuguuaauaaaagu

SEQ ID NO: 2154224 - RNA, 14 nt, Human
guuuuguaaauuuc

SEQ ID NO: 2154225 - RNA, 12 nt, Human
guuuuguaaauu

SEQ ID NO: 2154226 - RNA, 24 nt, Human
guuuucaggaguggguugauuuca

SEQ ID NO: 2154227 - RNA, 16 nt, Human
guuucuuuaguuuuug

SEQ ID NO: 2154228 - RNA, 16 nt, Human
guucaccccuccaccc

SEQ ID NO: 2154229 - RNA, 14 nt, Human
guucaccccuccac

SEQ ID NO: 2154230 - RNA, 12 nt, Human
guucaccccucc

SEQ ID NO: 2154231 - RNA, 19 nt, Human
guuaccuaauuagagcaga

SEQ ID NO: 2154232 - RNA, 10 nt, Human
guuaccuaau

SEQ ID NO: 2154233 - RNA, 20 nt, Human
guuggauuuuugucuugugu

SEQ ID NO: 2154234 - RNA, 14 nt, Human
guuggauuuuuguc

SEQ ID NO: 2154235 - RNA, 23 nt, Human
guugauuucagcaccuacagugu

SEQ ID NO: 2154236 - RNA, 14 nt, Human
guucuaaagaugga

SEQ ID NO: 2154237 - RNA, 20 nt, Human
guucuaaagauggaaaaacc

SEQ ID NO: 2154238 - RNA, 17 nt, Human
guucuaaagauggaaaa

SEQ ID NO: 2154239 - RNA, 23 nt, Human
guucuaaagauggaaaaaccacc

SEQ ID NO: 2154240 - RNA, 18 nt, Human
guggcugcggcacccuug

SEQ ID NO: 2154241 - RNA, 20 nt, Human
guggcuuacuacauguggga

SEQ ID NO: 2154242 - RNA, 23 nt, Human
guggggcagcacagagagggggc

SEQ ID NO: 2154243 - RNA, 19 nt, Human
guggggcagcacagagagg

SEQ ID NO: 2154244 - RNA, 14 nt, Human
guggggcagcacag

SEQ ID NO: 2154245 - RNA, 12 nt, Human
guggggcagcac

SEQ ID NO: 2154246 - RNA, 16 nt, Human
gugggcggcagagagg

SEQ ID NO: 2154247 - RNA, 13 nt, Human
gugggcggcagag

SEQ ID NO: 2154248 - RNA, 12 nt, Human
gugggcuaagca

SEQ ID NO: 2154249 - RNA, 14 nt, Human
gugguauagaaaug

SEQ ID NO: 2154250 - RNA, 22 nt, Human
guguacagucuuguauuaaguu

SEQ ID NO: 2154251 - RNA, 16 nt, Human
guguacagucuuguau

SEQ ID NO: 2154252 - RNA, 13 nt, Human
guguacagucuug

SEQ ID NO: 2154253 - RNA, 17 nt, Human
guuacacauuuuucaga

SEQ ID NO: 2154254 - RNA, 16 nt, Human
guuacacauuuuucag

SEQ ID NO: 2154255 - RNA, 12 nt, Human
guuaaaacuguc

SEQ ID NO: 2154256 - RNA, 19 nt, Human
guuaaacuuacuuaguguu

SEQ ID NO: 2154257 - RNA, 19 nt, Human
gugucuaggcaggaccugu

SEQ ID NO: 2154258 - RNA, 19 nt, Human
gucucgugguaggacugua

SEQ ID NO: 2154259 - RNA, 22 nt, Human
guauuaaguuguuaauaaaagu

SEQ ID NO: 2154260 - RNA, 21 nt, Human
gucccuccacguucaccccuc

SEQ ID NO: 2154261 - RNA, 20 nt, Human
gucccuccacguucaccccu

SEQ ID NO: 2154262 - RNA, 19 nt, Human
gucccuccacguucacccc

SEQ ID NO: 2154263 - RNA, 21 nt, Human
guccacaguggaaccagccca

SEQ ID NO: 2154264 - RNA, 19 nt, Human
guccacaguggaaccagcc

SEQ ID NO: 2154265 - RNA, 16 nt, Human
guccacaguggaacca

SEQ ID NO: 2154266 - RNA, 18 nt, Human
guaguagggucaggccac

SEQ ID NO: 2154267 - RNA, 22 nt, Human
guagggucaggccacggcagcc

SEQ ID NO: 2154268 - RNA, 21 nt, Human
guagggucaggccacggcagc

SEQ ID NO: 2154269 - RNA, 14 nt, Human
guauagaaaugcug

SEQ ID NO: 2154270 - RNA, 22 nt, Human
guauagaaaugcugguuuuuca

SEQ ID NO: 2154271 - RNA, 15 nt, Human
guauagaaaugcugg

SEQ ID NO: 2154272 - RNA, 23 nt, Human
guauagaaaugcugguuuuucag

SEQ ID NO: 2154273 - RNA, 14 nt, Human
uuuuaaagaaaagu

SEQ ID NO: 2154274 - RNA, 15 nt, Human
uuuuaaagaaaaguu

SEQ ID NO: 2154275 - RNA, 22 nt, Human
uuuggugaacauugcaauagaa

SEQ ID NO: 2154276 - RNA, 23 nt, Human
uuuggugaacauugcaauagaaa

SEQ ID NO: 2154277 - RNA, 14 nt, Human
uuuuuccuguccuu

SEQ ID NO: 2154278 - RNA, 13 nt, Human
uuuuuuguuucau

SEQ ID NO: 2154279 - RNA, 12 nt, Human
uuuuuuguuuca

SEQ ID NO: 2154280 - RNA, 17 nt, Human
uuuuuaaagacagaguc

SEQ ID NO: 2154281 - RNA, 20 nt, Human
uuuuuaaagaaaaguuuugu

SEQ ID NO: 2154282 - RNA, 12 nt, Human
uuuuuaaagaaa

SEQ ID NO: 2154283 - RNA, 13 nt, Human
uuuugucuugugu

SEQ ID NO: 2154284 - RNA, 13 nt, Human
gccuuaaaacuuu

SEQ ID NO: 2154285 - RNA, 12 nt, Human
gccuuaaaacuu

SEQ ID NO: 2154286 - RNA, 22 nt, Human
gccccuguuaccuaauuagagc

SEQ ID NO: 2154287 - RNA, 15 nt, Human
gcccaggcuggagug

SEQ ID NO: 2154288 - RNA, 15 nt, Human
gauuuuugucuugug

SEQ ID NO: 2154289 - RNA, 22 nt, Human
gauuugucuuuggugaacauug

SEQ ID NO: 2154290 - RNA, 20 nt, Human
gauuugucuuuggugaacau

SEQ ID NO: 2154291 - RNA, 14 nt, Human
gauccccagcuguu

SEQ ID NO: 2154292 - RNA, 21 nt, Human
gauaaauaacuuuuuuuuaag

SEQ ID NO: 2154293 - RNA, 16 nt, Human
gauaaauaacuuuuuu

SEQ ID NO: 2154294 - RNA, 14 nt, Human
gcagcacagagagg

SEQ ID NO: 2154295 - RNA, 23 nt, Human
gcacgugggucuucagggggcca

SEQ ID NO: 2154296 - RNA, 21 nt, Human
gcacguaguagggucaggcca

SEQ ID NO: 2154297 - RNA, 20 nt, Human
gcacguaguagggucaggcc

SEQ ID NO: 2154298 - RNA, 16 nt, Human
gcacguaguaggguca

SEQ ID NO: 2154299 - RNA, 15 nt, Human
gcacguauuuuaaua

SEQ ID NO: 2154300 - RNA, 14 nt, Human
gcacguauuuuaau

SEQ ID NO: 2154301 - RNA, 22 nt, Human
gacgucccuccacguucacccc

SEQ ID NO: 2154302 - RNA, 12 nt, Human
gacgucccucca

SEQ ID NO: 2154303 - RNA, 22 nt, Human
gagacagagaggacgugggcgg

SEQ ID NO: 2154304 - RNA, 23 nt, Human
gaacaugaaaacagaaaacgguu

SEQ ID NO: 2154305 - RNA, 19 nt, Human
gaaauuuccacucaggucu

SEQ ID NO: 2154306 - RNA, 20 nt, Human
gaaauuuccacucaggucug

SEQ ID NO: 2154307 - RNA, 16 nt, Human
cuuuucgccguggcug

SEQ ID NO: 2154308 - RNA, 21 nt, Human
cuuuguuuuuuuuuccugucc

SEQ ID NO: 2154309 - RNA, 16 nt, Human
cuuuguuuuuuuuucc

SEQ ID NO: 2154310 - RNA, 23 nt, Human
cuuuguuuuuuuuuccuguccuu

SEQ ID NO: 2154311 - RNA, 21 nt, Human
cuuucuuuucgccguggcugc

SEQ ID NO: 2154312 - RNA, 24 nt, Human
cuuggcucacugcaacuucugccu

SEQ ID NO: 2154313 - RNA, 17 nt, Human
cuuguauuaaguuguua

SEQ ID NO: 2154314 - RNA, 13 nt, Human
cuuguauuaaguu

SEQ ID NO: 2154315 - RNA, 23 nt, Human
cuuguauuaaguuguuaauaaaa

SEQ ID NO: 2154316 - RNA, 22 nt, Human
cuuguauuaaguuguuaauaaa

SEQ ID NO: 2154317 - RNA, 19 nt, Human
cuugcacguauuuuaauag

SEQ ID NO: 2154318 - RNA, 23 nt, Human
cugccauggaggcacacagcugc

SEQ ID NO: 2154319 - RNA, 21 nt, Human
cugccauggaggcacacagcu

SEQ ID NO: 2154320 - RNA, 14 nt, Human
cuggucacugccau

SEQ ID NO: 2154321 - RNA, 22 nt, Human
cuggucacugccauggaggcac

SEQ ID NO: 2154322 - RNA, 20 nt, Human
cuguaugucucgugguagga

SEQ ID NO: 2154323 - RNA, 19 nt, Human
cucuuggguucaagugauu

SEQ ID NO: 2154324 - RNA, 21 nt, Human
cugaccaauauuguacaguuu

SEQ ID NO: 2154325 - RNA, 20 nt, Human
cugaccaauauuguacaguu

SEQ ID NO: 2154326 - RNA, 19 nt, Human
cugaccaauauuguacagu

SEQ ID NO: 2154327 - RNA, 18 nt, Human
cugaccaauauuguacag

SEQ ID NO: 2154328 - RNA, 15 nt, Human
cugaccaauauugua

SEQ ID NO: 2154329 - RNA, 21 nt, Human
cuccccaggccguggcugccc

SEQ ID NO: 2154330 - RNA, 22 nt, Human
cucccaaagugcugggauuaca

SEQ ID NO: 2154331 - RNA, 19 nt, Human
cgcuuuugcuggucacugc

SEQ ID NO: 2154332 - RNA, 13 nt, Human
cggcagagaggac

SEQ ID NO: 2154333 - RNA, 11 nt, Human
cggcagagagg

SEQ ID NO: 2154334 - RNA, 16 nt, Human
cgggguggauuggauu

SEQ ID NO: 2154335 - RNA, 18 nt, Human
cguggggcagcacagaga

SEQ ID NO: 2154336 - RNA, 12 nt, Human
cguggggcagca

SEQ ID NO: 2154337 - RNA, 17 nt, Human
cgugggcggcagagagg

SEQ ID NO: 2154338 - RNA, 15 nt, Human
cguggaacguuuuuc

SEQ ID NO: 2154339 - RNA, 20 nt, Human
cguggaacguuuuuccuguu

SEQ ID NO: 2154340 - RNA, 20 nt, Human
cucacauagcuuacaagcca

SEQ ID NO: 2154341 - RNA, 16 nt, Human
cuaggcaggaccugug

SEQ ID NO: 2154342 - RNA, 15 nt, Human
cuaggcaggaccugu

SEQ ID NO: 2154343 - RNA, 23 nt, Human
cuaagcacgggccauaugaauaa

SEQ ID NO: 2154344 - RNA, 20 nt, Human
cuaagcacgggccauaugaa

SEQ ID NO: 2154345 - RNA, 21 nt, Human
cccuccccuaaugccugcgga

SEQ ID NO: 2154346 - RNA, 18 nt, Human
cccgcaaugugcccccag

SEQ ID NO: 2154347 - RNA, 22 nt, Human
cccgcaaugugcccccagacgc

SEQ ID NO: 2154348 - RNA, 11 nt, Human
cccuucuuuuu

SEQ ID NO: 2154349 - RNA, 23 nt, Human
ccucccaaagugcugggauuaca

SEQ ID NO: 2154350 - RNA, 20 nt, Human
ccauggaggcacacagcugc

SEQ ID NO: 2154351 - RNA, 17 nt, Human
ccauggaggcacacagc

SEQ ID NO: 2154352 - RNA, 21 nt, Human
ccauggaggcacacagcugca

SEQ ID NO: 2154353 - RNA, 13 nt, Human
ccauggaggcaca

SEQ ID NO: 2154354 - RNA, 23 nt, Human
ccauguuggccaggcuggucuca

SEQ ID NO: 2154355 - RNA, 12 nt, Human
caugugggagcu

SEQ ID NO: 2154356 - RNA, 18 nt, Human
ccaauauuguacaguuuu

SEQ ID NO: 2154357 - RNA, 16 nt, Human
ccaauauuguacaguu

SEQ ID NO: 2154358 - RNA, 15 nt, Human
ccaauauuguacagu

SEQ ID NO: 2154359 - RNA, 14 nt, Human
ccaauauuguacag

SEQ ID NO: 2154360 - RNA, 14 nt, Human
cauugcaauagaaa

SEQ ID NO: 2154361 - RNA, 15 nt, Human
cauugcaauagaaau

SEQ ID NO: 2154362 - RNA, 13 nt, Human
cauugcaauagaa

SEQ ID NO: 2154363 - RNA, 16 nt, Human
caguggaaccagccca

SEQ ID NO: 2154364 - RNA, 15 nt, Human
caguguacagucuug

SEQ ID NO: 2154365 - RNA, 12 nt, Human
caguguacaguc

SEQ ID NO: 2154366 - RNA, 18 nt, Human
caguguacagucuuguau

SEQ ID NO: 2154367 - RNA, 17 nt, Human
caguguacagucuugua

SEQ ID NO: 2154368 - RNA, 15 nt, Human
caguuuuuauugcuu

SEQ ID NO: 2154369 - RNA, 13 nt, Human
cauaacuagaacu

SEQ ID NO: 2154370 - RNA, 15 nt, Human
aaagcccaaaguggu

SEQ ID NO: 2154371 - RNA, 22 nt, Human
aaaugcugguuuuucaguuuuc

SEQ ID NO: 2154372 - RNA, 12 nt, Human
aagacagagucu

SEQ ID NO: 2154373 - RNA, 13 nt, Human
aagcuagaaauga

SEQ ID NO: 2154374 - RNA, 12 nt, Human
aauaaagacagg

SEQ ID NO: 2154375 - RNA, 11 nt, Human
aauaaagacag

SEQ ID NO: 2154376 - RNA, 21 nt, Human
aauuuccacucaggucuguuu

SEQ ID NO: 2154377 - RNA, 22 nt, Human
aauuggauacgacaacuugcac

SEQ ID NO: 2154378 - RNA, 13 nt, Human
acauccaagcuuc

SEQ ID NO: 2154379 - RNA, 22 nt, Human
acaugcgggcugggcagcuguu

SEQ ID NO: 2154380 - RNA, 21 nt, Human
acaugcgggcugggcagcugu

SEQ ID NO: 2154381 - RNA, 19 nt, Human
acaugcgggcugggcagcu

SEQ ID NO: 2154382 - RNA, 17 nt, Human
acaugcgggcugggcag

SEQ ID NO: 2154383 - RNA, 16 nt, Human
acaugcgggcugggca

SEQ ID NO: 2154384 - RNA, 14 nt, Human
acaugcgggcuggg

SEQ ID NO: 2154385 - RNA, 15 nt, Human
acaggauuagacagu

SEQ ID NO: 2154386 - RNA, 18 nt, Human
acaguggaaccagcccag

SEQ ID NO: 2154387 - RNA, 17 nt, Human
accuguggccaaguucu

SEQ ID NO: 2154388 - RNA, 21 nt, Human
acugccauggaggcacacagc

SEQ ID NO: 2154389 - RNA, 18 nt, Human
acugccauggaggcacac

SEQ ID NO: 2154390 - RNA, 20 nt, Human
acugauguaugaggaauuuc

SEQ ID NO: 2154391 - RNA, 22 nt, Human
aggcaugugccacccacccaac

SEQ ID NO: 2154392 - RNA, 12 nt, Human
agacugaccaau

SEQ ID NO: 2154393 - RNA, 21 nt, Human
agacugaccaauauuguacag

SEQ ID NO: 2154394 - RNA, 18 nt, Human
agaagaugaaugagcaaa

SEQ ID NO: 2154395 - RNA, 12 nt, Human
agcacagagagg

SEQ ID NO: 2154396 - RNA, 23 nt, Human
agcacagagagggggccaccucc

SEQ ID NO: 2154397 - RNA, 21 nt, Human
agcacagagagggggccaccu

SEQ ID NO: 2154398 - RNA, 20 nt, Human
agcacagagagggggccacc

SEQ ID NO: 2154399 - RNA, 19 nt, Human
agcacagagagggggccac

SEQ ID NO: 2154400 - RNA, 15 nt, Human
agauauaaaagacug

SEQ ID NO: 2154401 - RNA, 11 nt, Human
auaaagacagg

SEQ ID NO: 2154402 - RNA, 19 nt, Human
aguuacacauuuuucagau

SEQ ID NO: 2154403 - RNA, 16 nt, Human
aguuacacauuuuuca

SEQ ID NO: 2154404 - RNA, 13 nt, Human
aguuacacauuuu

SEQ ID NO: 2154405 - RNA, 19 nt, Human
agugauucuccugccucag

SEQ ID NO: 2154406 - RNA, 16 nt, Human
cuccccuaaugccugc

SEQ ID NO: 2154407 - RNA, 15 nt, Human
cuccccuaaugccug

SEQ ID NO: 2154408 - RNA, 21 nt, Human
ccuugcgcuuuugcuggucac

SEQ ID NO: 2154409 - RNA, 23 nt, Human
ccuguuaccuaauuagagcagau

SEQ ID NO: 2154410 - RNA, 22 nt, Human
ccuguuaccuaauuagagcaga

SEQ ID NO: 2154411 - RNA, 21 nt, Human
ccuguuaccuaauuagagcag

SEQ ID NO: 2154412 - RNA, 20 nt, Human
cguucaccccuccacccuug

SEQ ID NO: 2154413 - RNA, 15 nt, Human
cguucaccccuccac

SEQ ID NO: 2154414 - RNA, 17 nt, Human
cuaaaguagacuucauu

SEQ ID NO: 2154415 - RNA, 22 nt, Human
cuaagaaagcccuuaggaagaa

SEQ ID NO: 2154416 - RNA, 22 nt, Human
cgcucuguugcccaggcuggag

SEQ ID NO: 2154417 - RNA, 19 nt, Human
cgcucuguugcccaggcug

SEQ ID NO: 2154418 - RNA, 17 nt, Human
cgggcugggcagcuguu

SEQ ID NO: 2154419 - RNA, 16 nt, Human
cgggcugggcagcugu

SEQ ID NO: 2154420 - RNA, 15 nt, Human
cgggcugggcagcug

SEQ ID NO: 2154421 - RNA, 14 nt, Human
cgggcugggcagcu

SEQ ID NO: 2154422 - RNA, 16 nt, Human
cguaaagcuagaaaug

SEQ ID NO: 2154423 - RNA, 17 nt, Human
cguaaagcuagaaauga

SEQ ID NO: 2154424 - RNA, 23 nt, Human
ccagacgcacgugggucuucagg

SEQ ID NO: 2154425 - RNA, 18 nt, Human
ccagacgcacgugggucu

SEQ ID NO: 2154426 - RNA, 13 nt, Human
ccuccccaggccg

SEQ ID NO: 2154427 - RNA, 15 nt, Human
ccucagccuccugag

SEQ ID NO: 2154428 - RNA, 16 nt, Human
ccucgagguuucucaa

SEQ ID NO: 2154429 - RNA, 11 nt, Human
caguuuuccuu

SEQ ID NO: 2154430 - RNA, 19 nt, Human
caggccguggcugcccaca

SEQ ID NO: 2154431 - RNA, 17 nt, Human
caggccguggcugccca

SEQ ID NO: 2154432 - RNA, 15 nt, Human
caggccguggcugcc

SEQ ID NO: 2154433 - RNA, 15 nt, Human
cagagagggggccac

SEQ ID NO: 2154434 - RNA, 22 nt, Human
cagagagggggccaccucccca

SEQ ID NO: 2154435 - RNA, 20 nt, Human
cagagagggggccaccuccc

SEQ ID NO: 2154436 - RNA, 22 nt, Human
cagauauaaaagacugaccaau

SEQ ID NO: 2154437 - RNA, 15 nt, Human
auuuuuuuuguuuca

SEQ ID NO: 2154438 - RNA, 15 nt, Human
auuuauauaaauuuu

SEQ ID NO: 2154439 - RNA, 16 nt, Human
caauauuguacaguuu

SEQ ID NO: 2154440 - RNA, 15 nt, Human
caauauuguacaguu

SEQ ID NO: 2154441 - RNA, 18 nt, Human
caauauuguacaguuuuu

SEQ ID NO: 2154442 - RNA, 17 nt, Human
caauauuguacaguuuu

SEQ ID NO: 2154443 - RNA, 20 nt, Human
caauuggauacgacaacuug

SEQ ID NO: 2154444 - RNA, 14 nt, Human
cugcaacuucugcc

SEQ ID NO: 2154445 - RNA, 15 nt, Human
cugcaacuucugccu

SEQ ID NO: 2154446 - RNA, 21 nt, Human
cugggcagcuguuagagucca

SEQ ID NO: 2154447 - RNA, 16 nt, Human
cuuuuaggccaaaaaa

SEQ ID NO: 2154448 - RNA, 18 nt, Human
cuuuuaggccaaaaaaau

SEQ ID NO: 2154449 - RNA, 15 nt, Human
cuuuggugaacauug

SEQ ID NO: 2154450 - RNA, 18 nt, Human
gauguaaaagacuuuuuu

SEQ ID NO: 2154451 - RNA, 18 nt, Human
gauucuccugccucagcc

SEQ ID NO: 2154452 - RNA, 19 nt, Human
gagugcaaugacacagucu

SEQ ID NO: 2154453 - RNA, 21 nt, Human
gaagggcuuggacucaagcaa

SEQ ID NO: 2154454 - RNA, 11 nt, Human
gacuguagaaa

SEQ ID NO: 2154455 - RNA, 19 nt, Human
ggcugcccacacaccccaa

SEQ ID NO: 2154456 - RNA, 17 nt, Human
ggcugcccacacacccc

SEQ ID NO: 2154457 - RNA, 20 nt, Human
ggcugcccacacaccccaau

SEQ ID NO: 2154458 - RNA, 16 nt, Human
gggcagcacagagagg

SEQ ID NO: 2154459 - RNA, 19 nt, Human
gggcagcuguuagagucca

SEQ ID NO: 2154460 - RNA, 18 nt, Human
aaaagggaacugaacauu

SEQ ID NO: 2154461 - RNA, 20 nt, Human
ggugcacagacgucccucca

SEQ ID NO: 2154462 - RNA, 13 nt, Human
aaagcuagaaaug

SEQ ID NO: 2154463 - RNA, 21 nt, Human
gggucaggccacggcagccua

SEQ ID NO: 2154464 - RNA, 17 nt, Human
gggucaggccacggcag

SEQ ID NO: 2154465 - RNA, 15 nt, Human
gggucaggccacggc

SEQ ID NO: 2154466 - RNA, 11 nt, Human
aaacuccugac

SEQ ID NO: 2154467 - RNA, 13 nt, Human
ggccucccaaagu

SEQ ID NO: 2154468 - RNA, 14 nt, Human
ggccaggugcacag

SEQ ID NO: 2154469 - RNA, 23 nt, Human
ggacuguugacauccaagcuucc

SEQ ID NO: 2154470 - RNA, 13 nt, Human
gcugggcagcugu

SEQ ID NO: 2154471 - RNA, 12 nt, Human
gcugggcagcug

SEQ ID NO: 2154472 - RNA, 14 nt, Human
gcugggcagcuguu

SEQ ID NO: 2154473 - RNA, 17 nt, Human
gcugggauuacagggau

SEQ ID NO: 2154474 - RNA, 17 nt, Human
gcugcccacacacccca

SEQ ID NO: 2154475 - RNA, 15 nt, Human
gcugguuuuucaguu

SEQ ID NO: 2154476 - RNA, 14 nt, Human
gcugguuuuucagu

SEQ ID NO: 2154477 - RNA, 23 nt, Human
gcuuccuuuguuuuuuuuuccug

SEQ ID NO: 2154478 - RNA, 22 nt, Human
gcuuccuuuguuuuuuuuuccu

SEQ ID NO: 2154479 - RNA, 17 nt, Human
gcucuggccuccaaguc

SEQ ID NO: 2154480 - RNA, 15 nt, Human
gcucuggccuccaag

SEQ ID NO: 2154481 - RNA, 22 nt, Human
gccuaccggcaauuuccggcca

SEQ ID NO: 2154482 - RNA, 21 nt, Human
auguuaaacuuacuuaguguu

SEQ ID NO: 2154483 - RNA, 19 nt, Human
augugacaugcgggcuggg

SEQ ID NO: 2154484 - RNA, 13 nt, Human
uuuguuucauauu

SEQ ID NO: 2154485 - RNA, 21 nt, Human
uuuugugaaguuuaauugacu

SEQ ID NO: 2154486 - RNA, 21 nt, Human
uuuaaaugaaagugagacuuu

SEQ ID NO: 2154487 - RNA, 13 nt, Human
uuuaaaugaaagu

SEQ ID NO: 2154488 - RNA, 20 nt, Human
uuuacccuucuuuucugacu

SEQ ID NO: 2154489 - RNA, 15 nt, Human
uugcaauagaaaucc

SEQ ID NO: 2154490 - RNA, 22 nt, Human
uugcaauagaaauccaauugga

SEQ ID NO: 2154491 - RNA, 22 nt, Human
aucucuuuguucuaaagaugga

SEQ ID NO: 2154492 - RNA, 16 nt, Human
augaaagugagacuuu

SEQ ID NO: 2154493 - RNA, 14 nt, Human
uuguaaauuucucu

SEQ ID NO: 2154494 - RNA, 22 nt, Human
uucagggggccaggugcacaga

SEQ ID NO: 2154495 - RNA, 13 nt, Human
uucagggggccag

SEQ ID NO: 2154496 - RNA, 22 nt, Human
auauaaauuuuuuuuguuucau

SEQ ID NO: 2154497 - RNA, 17 nt, Human
auauaaauuuuuuuugu

SEQ ID NO: 2154498 - RNA, 22 nt, Human
uucagcaccuacaguguacagu

SEQ ID NO: 2154499 - RNA, 23 nt, Human
uucagcaccuacaguguacaguc

SEQ ID NO: 2154500 - RNA, 22 nt, Human
auagcuuacaagccagcuggag

SEQ ID NO: 2154501 - RNA, 20 nt, Human
uucaagugauucuccugccu

SEQ ID NO: 2154502 - RNA, 18 nt, Human
auagcgucauaacuagaa

SEQ ID NO: 2154503 - RNA, 20 nt, Human
auagcgucauaacuagaacu

SEQ ID NO: 2154504 - RNA, 20 nt, Human
uuccuguucuuaagacguga

SEQ ID NO: 2154505 - RNA, 21 nt, Human
uuccuuuguuuuuuuuuccug

SEQ ID NO: 2154506 - RNA, 21 nt, Human
aucacguaaagcuagaaauga

SEQ ID NO: 2154507 - RNA, 14 nt, Human
aucacguaaagcua

SEQ ID NO: 2154508 - RNA, 13 nt, Human
auauugaugugug

SEQ ID NO: 2154509 - RNA, 20 nt, Human
auauuuguauuuaaaugaaa

SEQ ID NO: 2154510 - RNA, 22 nt, Human
ugugcccccagacgcacguggg

SEQ ID NO: 2154511 - RNA, 16 nt, Human
ugugcccccagacgca

SEQ ID NO: 2154512 - RNA, 18 nt, Human
uguggccaaguucuuagu

SEQ ID NO: 2154513 - RNA, 18 nt, Human
agucuuguauuaaguugu

SEQ ID NO: 2154514 - RNA, 16 nt, Human
agucuuguauuaaguu

SEQ ID NO: 2154515 - RNA, 15 nt, Human
agucuuggcucacug

SEQ ID NO: 2154516 - RNA, 22 nt, Human
agucuuguauuaaguuguuaau

SEQ ID NO: 2154517 - RNA, 15 nt, Human
ugucuuguguuucuu

SEQ ID NO: 2154518 - RNA, 17 nt, Human
aguggaaguaguggagc

SEQ ID NO: 2154519 - RNA, 16 nt, Human
aguucuuaguugcugu

SEQ ID NO: 2154520 - RNA, 15 nt, Human
uuaaauuucuaccgc

SEQ ID NO: 2154521 - RNA, 21 nt, Human
aguucuuaguugcuguauguc

SEQ ID NO: 2154522 - RNA, 20 nt, Human
aguucuuaguugcuguaugu

SEQ ID NO: 2154523 - RNA, 14 nt, Human
auaaauaacuuuuu

SEQ ID NO: 2154524 - RNA, 12 nt, Human
auaaauaacuuu

SEQ ID NO: 2154525 - RNA, 19 nt, Human
auaacuagaacugaauuuu

SEQ ID NO: 2154526 - RNA, 21 nt, Human
auaaaaguacauguuaaacuu

SEQ ID NO: 2154527 - RNA, 15 nt, Human
auaaaaguacauguu

SEQ ID NO: 2154528 - RNA, 22 nt, Human
uuaaguuacacauuuuucagau

SEQ ID NO: 2154529 - RNA, 14 nt, Human
uuaauaaagacagg

SEQ ID NO: 2154530 - RNA, 13 nt, Human
uuaauaaagacag

SEQ ID NO: 2154531 - RNA, 15 nt, Human
agggggccaggugca

SEQ ID NO: 2154532 - RNA, 19 nt, Human
agggggccaccuccccagg

SEQ ID NO: 2154533 - RNA, 15 nt, Human
agggggccaccuccc

SEQ ID NO: 2154534 - RNA, 10 nt, Human
agggggccac

SEQ ID NO: 2154535 - RNA, 22 nt, Human
uggucacugccauggaggcaca

SEQ ID NO: 2154536 - RNA, 14 nt, Human
uggucacugccaug

SEQ ID NO: 2154537 - RNA, 13 nt, Human
uggucacugccau

SEQ ID NO: 2154538 - RNA, 14 nt, Human
aguacauguuaaac

SEQ ID NO: 2154539 - RNA, 21 nt, Human
uguagaaaagggaacugaaca

SEQ ID NO: 2154540 - RNA, 20 nt, Human
uguagaaaagggaacugaac

SEQ ID NO: 2154541 - RNA, 19 nt, Human
uguagaaaagggaacugaa

SEQ ID NO: 2154542 - RNA, 18 nt, Human
uguagaaaagggaacuga

SEQ ID NO: 2154543 - RNA, 23 nt, Human
uguagaaaagggaacugaacauu

SEQ ID NO: 2154544 - RNA, 13 nt, Human
aguagggucaggc

SEQ ID NO: 2154545 - RNA, 18 nt, Human
uguaugucucgugguagg

SEQ ID NO: 2154546 - RNA, 19 nt, Human
agcugcagagacagagagg

SEQ ID NO: 2154547 - RNA, 18 nt, Human
agcugcagagacagagag

SEQ ID NO: 2154548 - RNA, 17 nt, Human
agcugcagagacagaga

SEQ ID NO: 2154549 - RNA, 15 nt, Human
agcugcagagacaga

SEQ ID NO: 2154550 - RNA, 19 nt, Human
agcuuacaagccagcugga

SEQ ID NO: 2154551 - RNA, 17 nt, Human
agcuuacaagccagcug

SEQ ID NO: 2154552 - RNA, 15 nt, Human
agcuuacaagccagc

SEQ ID NO: 2154553 - RNA, 13 nt, Human
agcuguuuaugca

SEQ ID NO: 2154554 - RNA, 23 nt, Human
aggcacacagcugcagagacaga

SEQ ID NO: 2154555 - RNA, 18 nt, Human
aggcacacagcugcagag

SEQ ID NO: 2154556 - RNA, 14 nt, Human
aggcacacagcugc

SEQ ID NO: 2154557 - RNA, 17 nt, Human
uggagugcaaugacaca

SEQ ID NO: 2154558 - RNA, 20 nt, Human
aggacgugggcggcagagag

SEQ ID NO: 2154559 - RNA, 14 nt, Human
aggacgugggcggc

SEQ ID NO: 2154560 - RNA, 21 nt, Human
aggaccuguggccaaguucuu

SEQ ID NO: 2154561 - RNA, 19 nt, Human
agccuccugaguagcugga

SEQ ID NO: 2154562 - RNA, 16 nt, Human
agcauuugucaacaaa

SEQ ID NO: 2154563 - RNA, 21 nt, Human
ugaccaauauuguacaguuuu

SEQ ID NO: 2154564 - RNA, 19 nt, Human
ugaccaauauuguacaguu

SEQ ID NO: 2154565 - RNA, 18 nt, Human
ugaccaauauuguacagu

SEQ ID NO: 2154566 - RNA, 17 nt, Human
ugaccaauauuguacag

SEQ ID NO: 2154567 - RNA, 15 nt, Human
ucuuuaguuuuugug

SEQ ID NO: 2154568 - RNA, 21 nt, Human
ucuuucugcagaaacagaaag

SEQ ID NO: 2154569 - RNA, 22 nt, Human
ucuuucugcagaaacagaaagg

SEQ ID NO: 2154570 - RNA, 13 nt, Human
agagacagagagg

SEQ ID NO: 2154571 - RNA, 17 nt, Human
agacuucauuuuuccua

SEQ ID NO: 2154572 - RNA, 15 nt, Human
agacuuccagagccu

SEQ ID NO: 2154573 - RNA, 17 nt, Human
agacagucaaggagugg

SEQ ID NO: 2154574 - RNA, 20 nt, Human
agacagucaaggaguggcuu

SEQ ID NO: 2154575 - RNA, 22 nt, Human
agaaauuuccacucaggucugu

SEQ ID NO: 2154576 - RNA, 16 nt, Human
agaaauuuccacucag

SEQ ID NO: 2154577 - RNA, 16 nt, Human
acugccuuaaaacuuu

SEQ ID NO: 2154578 - RNA, 15 nt, Human
acugccuuaaaacuu

SEQ ID NO: 2154579 - RNA, 14 nt, Human
acugccuuaaaacu

SEQ ID NO: 2154580 - RNA, 20 nt, Human
uccuucucucaccuccuaaa

SEQ ID NO: 2154581 - RNA, 21 nt, Human
uccuuuaauuuuuuacuauuu

SEQ ID NO: 2154582 - RNA, 20 nt, Human
ucccuccacguucaccccuc

SEQ ID NO: 2154583 - RNA, 19 nt, Human
ucccuccacguucaccccu

SEQ ID NO: 2154584 - RNA, 18 nt, Human
ucccuccacguucacccc

SEQ ID NO: 2154585 - RNA, 13 nt, Human
uccccuaaugccu

SEQ ID NO: 2154586 - RNA, 16 nt, Human
acguucaccccuccac

SEQ ID NO: 2154587 - RNA, 14 nt, Human
acguucaccccucc

SEQ ID NO: 2154588 - RNA, 20 nt, Human
acguggggcagcacagagag

SEQ ID NO: 2154589 - RNA, 19 nt, Human
acguggggcagcacagaga

SEQ ID NO: 2154590 - RNA, 15 nt, Human
acguggggcagcaca

SEQ ID NO: 2154591 - RNA, 14 nt, Human
acguggggcagcac

SEQ ID NO: 2154592 - RNA, 22 nt, Human
acgugggucuucagggggccag

SEQ ID NO: 2154593 - RNA, 15 nt, Human
acgugggcggcagag

SEQ ID NO: 2154594 - RNA, 20 nt, Human
acgugggcggcagagaggac

SEQ ID NO: 2154595 - RNA, 20 nt, Human
accuacaguguacagucuug

SEQ ID NO: 2154596 - RNA, 18 nt, Human
accuacaguguacagucu

SEQ ID NO: 2154597 - RNA, 17 nt, Human
accuacaguguacaguc

SEQ ID NO: 2154598 - RNA, 16 nt, Human
accuacaguguacagu

SEQ ID NO: 2154599 - RNA, 16 nt, Human
accuaauuagagcaga

SEQ ID NO: 2154600 - RNA, 15 nt, Human
accuaauuagagcag

SEQ ID NO: 2154601 - RNA, 19 nt, Human
accuaauuagagcagauga

SEQ ID NO: 2154602 - RNA, 15 nt, Human
accuacaguguacag

SEQ ID NO: 2154603 - RNA, 14 nt, Human
uccagagacuggga

SEQ ID NO: 2154604 - RNA, 17 nt, Human
uccacucaggucuguuu

SEQ ID NO: 2154605 - RNA, 19 nt, Human
uccaaguccacaguggaac

SEQ ID NO: 2154606 - RNA, 15 nt, Human
acaguuuuuauugcu

SEQ ID NO: 2154607 - RNA, 21 nt, Human
acauagcuuacaagccagcug

SEQ ID NO: 2154608 - RNA, 15 nt, Human
ucaagacuuccagag

SEQ ID NO: 2154609 - RNA, 13 nt, Human
ucagcuucuuaau

SEQ ID NO: 2154610 - RNA, 14 nt, Human
ucagcuucuuaaua

SEQ ID NO: 2154611 - RNA, 16 nt, Human
acccccaaauuuucuu

SEQ ID NO: 2154612 - RNA, 17 nt, Human
ucagaaucucucuucuu

SEQ ID NO: 2154613 - RNA, 17 nt, Human
accaauauuguacaguu

SEQ ID NO: 2154614 - RNA, 16 nt, Human
accaauauuguacagu

SEQ ID NO: 2154615 - RNA, 14 nt, Human
accaauauuguaca

SEQ ID NO: 2154616 - RNA, 15 nt, Human
accaauauuguacag

SEQ ID NO: 2154617 - RNA, 19 nt, Human
accaauauuguacaguuuu

SEQ ID NO: 2154618 - RNA, 18 nt, Human
accaauauuguacaguuu

SEQ ID NO: 2154619 - RNA, 19 nt, Human
acacagcugcagagacaga

SEQ ID NO: 2154620 - RNA, 19 nt, Human
acacagucuuggcucacug

SEQ ID NO: 2154621 - RNA, 14 nt, Human
uauaaaagacugac

SEQ ID NO: 2154622 - RNA, 10 nt, Human
uaguuuuugu

SEQ ID NO: 2154623 - RNA, 20 nt, Human
acagauguaaaagacuuuuu

SEQ ID NO: 2154624 - RNA, 21 nt, Human
aauugacuuauuuauauaaau

SEQ ID NO: 2154625 - RNA, 21 nt, Human
uagcuuacaagccagcuggag

SEQ ID NO: 2154626 - RNA, 13 nt, Human
uacuuuuuccugg

SEQ ID NO: 2154627 - RNA, 15 nt, Human
aaguuuuguaaauuu

SEQ ID NO: 2154628 - RNA, 13 nt, Human
uaaauaacuuuuu

SEQ ID NO: 2154629 - RNA, 12 nt, Human
aauaacuuuuuu

SEQ ID NO: 2154630 - RNA, 13 nt, Human
aauauuguacagu

SEQ ID NO: 2154631 - RNA, 17 nt, Human
uaauaaaaguacauguu

SEQ ID NO: 2154632 - RNA, 21 nt, Human
uaauagcgucauaacuagaac

SEQ ID NO: 2154633 - RNA, 14 nt, Human
aaugugacucaaga

SEQ ID NO: 2154634 - RNA, 19 nt, Human
uacacauuuuucagauaua

SEQ ID NO: 2154635 - RNA, 21 nt, Human
uacacauuuuucagauauaaa

SEQ ID NO: 2154636 - RNA, 17 nt, Human
uacacauuuuucagaua

SEQ ID NO: 2154637 - RNA, 15 nt, Human
uacacauuuuucaga

SEQ ID NO: 2154638 - RNA, 19 nt, Human
guggaaguaguggagcccc

SEQ ID NO: 2154639 - RNA, 21 nt, Human
gugggucuucagggggccagg

SEQ ID NO: 2154640 - RNA, 17 nt, Human
gugggucuucagggggc

SEQ ID NO: 2154641 - RNA, 13 nt, Human
gugggucuucagg

SEQ ID NO: 2154642 - RNA, 15 nt, Human
aagcaagauuucaga

SEQ ID NO: 2154643 - RNA, 14 nt, Human
guucuucaucuaag

SEQ ID NO: 2154644 - RNA, 19 nt, Human
guucuuaguugcuguaugu

SEQ ID NO: 2154645 - RNA, 19 nt, Human
guccuucucucaccuccua

SEQ ID NO: 2154646 - RNA, 18 nt, Human
guccuucucucaccuccu

SEQ ID NO: 2154647 - RNA, 17 nt, Human
guccuucucucaccucc

SEQ ID NO: 2154648 - RNA, 16 nt, Human
aacauugcaauagaaa

SEQ ID NO: 2154649 - RNA, 15 nt, Human
aacauugcaauagaa

SEQ ID NO: 2154650 - RNA, 14 nt, Human
aacauugcaauaga

SEQ ID NO: 2154651 - RNA, 17 nt, Human
aacauugcaauagaaau

SEQ ID NO: 2154652 - RNA, 23 nt, Human
aaaugauccccagcuguuuaugc

SEQ ID NO: 2154653 - RNA, 14 nt, Human
aaaugaaagugaga

SEQ ID NO: 2154654 - RNA, 17 nt, Human
guagcuggauuacaggc

SEQ ID NO: 2154655 - RNA, 15 nt, Human
guaggacuguagaaa

SEQ ID NO: 2154656 - RNA, 14 nt, Human
aaauuuccacucag

SEQ ID NO: 2154657 - RNA, 22 nt, Human
aaauuuccacucaggucuguuu

SEQ ID NO: 2154658 - RNA, 13 nt, Human
cacacaccccaau

SEQ ID NO: 2154659 - RNA, 20 nt, Human
caagugauucuccugccuca

SEQ ID NO: 2154660 - RNA, 14 nt, Human
caagccagcuggag

SEQ ID NO: 2154661 - RNA, 17 nt, Human
caaagcccaaaguggua

SEQ ID NO: 2154662 - RNA, 19 nt, Human
caaagcccaaagugguaua

SEQ ID NO: 2154663 - RNA, 13 nt, Human
caaauauuccaga

SEQ ID NO: 2154664 - RNA, 17 nt, Human
caaauauuccagagacu

SEQ ID NO: 2154665 - RNA, 19 nt, Human
caaagugguauagaaaugc

SEQ ID NO: 2154666 - RNA, 18 nt, Human
caaagugguauagaaaug

SEQ ID NO: 2154667 - RNA, 19 nt, Human
caccauguuggccaggcug

SEQ ID NO: 2154668 - RNA, 23 nt, Human
uuguauuuaaaugaaagugagac

SEQ ID NO: 2154669 - RNA, 13 nt, Human
uuuauugcuuguu

SEQ ID NO: 2154670 - RNA, 12 nt, Human
uucaguuuucag

SEQ ID NO: 2154671 - RNA, 13 nt, Human
uucuaaagaugga

SEQ ID NO: 2154672 - RNA, 20 nt, Human
uucucaaagaaauuuccacu

SEQ ID NO: 2154673 - RNA, 19 nt, Human
uucucaaagaaauuuccac

SEQ ID NO: 2154674 - RNA, 15 nt, Human
uucucaaagaaauuu

SEQ ID NO: 2154675 - RNA, 13 nt, Human
uucucaaagaaau

SEQ ID NO: 2154676 - RNA, 15 nt, Human
uugcuggucacugcc

SEQ ID NO: 2154677 - RNA, 20 nt, Human
uugcuguagaagauggcacu

SEQ ID NO: 2154678 - RNA, 18 nt, Human
uuggauuuuugucuugug

SEQ ID NO: 2154679 - RNA, 13 nt, Human
uuguacaguuuuu

SEQ ID NO: 2154680 - RNA, 12 nt, Human
uuguacaguuuu

SEQ ID NO: 2154681 - RNA, 16 nt, Human
uuguacaguuuuuauu

SEQ ID NO: 2154682 - RNA, 21 nt, Human
ugugacaugcgggcugggcag

SEQ ID NO: 2154683 - RNA, 19 nt, Human
ugugacaugcgggcugggc

SEQ ID NO: 2154684 - RNA, 17 nt, Human
ugugacaugcgggcugg

SEQ ID NO: 2154685 - RNA, 18 nt, Human
ugguaggacuguagaaaa

SEQ ID NO: 2154686 - RNA, 17 nt, Human
ugguaggacuguagaaa

SEQ ID NO: 2154687 - RNA, 12 nt, Human
uguacagucuug

SEQ ID NO: 2154688 - RNA, 15 nt, Human
uguacagucuuguau

SEQ ID NO: 2154689 - RNA, 14 nt, Human
uguacagucuugua

SEQ ID NO: 2154690 - RNA, 15 nt, Human
uguauuuaaaugaaa

SEQ ID NO: 2154691 - RNA, 23 nt, Human
uguuagaguccaacguggggcag

SEQ ID NO: 2154692 - RNA, 18 nt, Human
uguuagaguccaacgugg

SEQ ID NO: 2154693 - RNA, 17 nt, Human
uguuggauuuuugucuu

SEQ ID NO: 2154694 - RNA, 14 nt, Human
uguuggccaggcug

SEQ ID NO: 2154695 - RNA, 20 nt, Human
uuaauagcgucauaacuaga

SEQ ID NO: 2154696 - RNA, 19 nt, Human
ugcacagacgucccuccac

SEQ ID NO: 2154697 - RNA, 23 nt, Human
ugccauggaggcacacagcugca

SEQ ID NO: 2154698 - RNA, 18 nt, Human
ugccauggaggcacacag

SEQ ID NO: 2154699 - RNA, 17 nt, Human
ugccauggaggcacaca

SEQ ID NO: 2154700 - RNA, 16 nt, Human
ugccauggaggcacac

SEQ ID NO: 2154701 - RNA, 19 nt, Human
ugggcggcagagaggacug

SEQ ID NO: 2154702 - RNA, 15 nt, Human
ugggcggcagagagg

SEQ ID NO: 2154703 - RNA, 13 nt, Human
ugggcggcagaga

SEQ ID NO: 2154704 - RNA, 19 nt, Human
uggaggcacacagcugcag

SEQ ID NO: 2154705 - RNA, 18 nt, Human
uggaggcacacagcugca

SEQ ID NO: 2154706 - RNA, 22 nt, Human
uggaggcacacagcugcagaga

SEQ ID NO: 2154707 - RNA, 19 nt, Human
uggauacgacaacuugcac

SEQ ID NO: 2154708 - RNA, 14 nt, Human
ugcuuguuggauuu

SEQ ID NO: 2154709 - RNA, 20 nt, Human
uggaaaaaccacccccaaau

SEQ ID NO: 2154710 - RNA, 15 nt, Human
ucuucagggggccag

SEQ ID NO: 2154711 - RNA, 22 nt, Human
ucuuguauuaaguuguuaauaa

SEQ ID NO: 2154712 - RNA, 18 nt, Human
ucuuguauuaaguuguua

SEQ ID NO: 2154713 - RNA, 16 nt, Human
ucuuguauuaaguugu

SEQ ID NO: 2154714 - RNA, 16 nt, Human
ucuuuuuauacuauua

SEQ ID NO: 2154715 - RNA, 17 nt, Human
ugaacauugcaauagaa

SEQ ID NO: 2154716 - RNA, 15 nt, Human
ugaacauugcaauag

SEQ ID NO: 2154717 - RNA, 14 nt, Human
ugaacauuccagag

SEQ ID NO: 2154718 - RNA, 13 nt, Human
ugaacauuccaga

SEQ ID NO: 2154719 - RNA, 17 nt, Human
ucucaaagaaauuucca

SEQ ID NO: 2154720 - RNA, 14 nt, Human
ucucaaacuccuga

SEQ ID NO: 2154721 - RNA, 21 nt, Human
ucucuacugucucaguuuaca

SEQ ID NO: 2154722 - RNA, 17 nt, Human
ucucuuuguucuaaaga

SEQ ID NO: 2154723 - RNA, 21 nt, Human
ucccaaagugcugggauuaca

SEQ ID NO: 2154724 - RNA, 13 nt, Human
uccccuucacucc

SEQ ID NO: 2154725 - RNA, 21 nt, Human
ucccccgcaaugugcccccag

SEQ ID NO: 2154726 - RNA, 20 nt, Human
ucccccgcaaugugccccca

SEQ ID NO: 2154727 - RNA, 14 nt, Human
uccccagcuguuua

SEQ ID NO: 2154728 - RNA, 15 nt, Human
uccccagcuguuuau

SEQ ID NO: 2154729 - RNA, 15 nt, Human
ucaaaaacauucuua

SEQ ID NO: 2154730 - RNA, 12 nt, Human
guuuuucaguuu

SEQ ID NO: 2154731 - RNA, 15 nt, Human
uaaagcuagaaauga

SEQ ID NO: 2154732 - RNA, 14 nt, Human
uaaagcuagaaaug

SEQ ID NO: 2154733 - RNA, 18 nt, Human
uaacugccuuaaaacuuu

SEQ ID NO: 2154734 - RNA, 16 nt, Human
uaacaggauuagacag

SEQ ID NO: 2154735 - RNA, 18 nt, Human
uaagaucguucucugccu

SEQ ID NO: 2154736 - RNA, 12 nt, Human
uaauuagagcag

SEQ ID NO: 2154737 - RNA, 23 nt, Human
uaauauaacugccuuaaaacuuu

SEQ ID NO: 2154738 - RNA, 22 nt, Human
uaauauaacugccuuaaaacuu

SEQ ID NO: 2154739 - RNA, 21 nt, Human
uaauauaacugccuuaaaacu

SEQ ID NO: 2154740 - RNA, 16 nt, Human
uaauauaacugccuua

SEQ ID NO: 2154741 - RNA, 13 nt, Human
uaauaaagacagg

SEQ ID NO: 2154742 - RNA, 15 nt, Human
uagaaagaagaugaa

SEQ ID NO: 2154743 - RNA, 18 nt, Human
uacuacaugugggagcuu

SEQ ID NO: 2154744 - RNA, 15 nt, Human
uacgacaacuugcac

SEQ ID NO: 2154745 - RNA, 14 nt, Human
uacgacaacuugca

SEQ ID NO: 2154746 - RNA, 21 nt, Human
uacauuuuguauauuuguauu

SEQ ID NO: 2154747 - RNA, 16 nt, Human
uacaguguacagucuu

SEQ ID NO: 2154748 - RNA, 15 nt, Human
uacaguguacagucu

SEQ ID NO: 2154749 - RNA, 22 nt, Human
uacaguguacagucuuguauua

SEQ ID NO: 2154750 - RNA, 13 nt, Human
uacaguguacagu

SEQ ID NO: 2154751 - RNA, 22 nt, Human
uagaguccaacguggggcagca

SEQ ID NO: 2154752 - RNA, 19 nt, Human
uagaguccaacguggggca

SEQ ID NO: 2154753 - RNA, 22 nt, Human
uauccugcuucugauaugcagu

SEQ ID NO: 2154754 - RNA, 21 nt, Human
uauaaauuuuuuuuguuucau

SEQ ID NO: 2154755 - RNA, 17 nt, Human
uauaaauuuuuuuuguu

SEQ ID NO: 2154756 - RNA, 12 nt, Human
ggccaaguucuu

SEQ ID NO: 2154757 - RNA, 16 nt, Human
gcuggauuacaggcau

SEQ ID NO: 2154758 - RNA, 19 nt, Human
ggaaaaaccacccccaaau

SEQ ID NO: 2154759 - RNA, 14 nt, Human
ggcugggcagcugu

SEQ ID NO: 2154760 - RNA, 13 nt, Human
ggcugggcagcug

SEQ ID NO: 2154761 - RNA, 22 nt, Human
ggcuuacuacaugugggagcuu

SEQ ID NO: 2154762 - RNA, 17 nt, Human
gggccaccuccccaggc

SEQ ID NO: 2154763 - RNA, 16 nt, Human
gggccaccuccccagg

SEQ ID NO: 2154764 - RNA, 15 nt, Human
gggccaccuccccag

SEQ ID NO: 2154765 - RNA, 22 nt, Human
gggccaccuccccaggccgugg

SEQ ID NO: 2154766 - RNA, 19 nt, Human
gggccaccuccccaggccg

SEQ ID NO: 2154767 - RNA, 20 nt, Human
gggucuucagggggccaggu

SEQ ID NO: 2154768 - RNA, 15 nt, Human
ggucacugccaugga

SEQ ID NO: 2154769 - RNA, 16 nt, Human
ggucaggccacggcag

SEQ ID NO: 2154770 - RNA, 13 nt, Human
gguuaaaacuguc

SEQ ID NO: 2154771 - RNA, 11 nt, Human
gguuaaaacug

SEQ ID NO: 2154772 - RNA, 17 nt, Human
ggucucaaacuccugac

SEQ ID NO: 2154773 - RNA, 17 nt, Human
gcgcuuuugcuggucac

SEQ ID NO: 2154774 - RNA, 15 nt, Human
gccguggcugcggca

SEQ ID NO: 2154775 - RNA, 14 nt, Human
gccguggcugcggc

SEQ ID NO: 2154776 - RNA, 18 nt, Human
gccguggcugcggcaccc

SEQ ID NO: 2154777 - RNA, 12 nt, Human
gccgggguggau

SEQ ID NO: 2154778 - RNA, 14 nt, Human
gccacggcagccua

SEQ ID NO: 2154779 - RNA, 13 nt, Human
gccagcuggagaa

SEQ ID NO: 2154780 - RNA, 18 nt, Human
gccauggaggcacacagc

SEQ ID NO: 2154781 - RNA, 16 nt, Human
gccauggaggcacaca

SEQ ID NO: 2154782 - RNA, 15 nt, Human
gccauggaggcacac

SEQ ID NO: 2154783 - RNA, 21 nt, Human
gccauggaggcacacagcugc

SEQ ID NO: 2154784 - RNA, 13 nt, Human
gcccacacacccc

SEQ ID NO: 2154785 - RNA, 19 nt, Human
gcccaaagugguauagaaa

SEQ ID NO: 2154786 - RNA, 15 nt, Human
gcagagacagagagg

SEQ ID NO: 2154787 - RNA, 17 nt, Human
gaugaccccuccccuaa

SEQ ID NO: 2154788 - RNA, 16 nt, Human
gaugaccccuccccua

SEQ ID NO: 2154789 - RNA, 12 nt, Human
gaugaccccucc

SEQ ID NO: 2154790 - RNA, 16 nt, Human
gacuucauuuuuccua

SEQ ID NO: 2154791 - RNA, 15 nt, Human
gacuucauuuuuccu

SEQ ID NO: 2154792 - RNA, 18 nt, Human
gauauaaaagacugacca

SEQ ID NO: 2154793 - RNA, 23 nt, Human
gaaguaguggagccccugcucug

SEQ ID NO: 2154794 - RNA, 17 nt, Human
gaacauugcaauagaaa

SEQ ID NO: 2154795 - RNA, 15 nt, Human
gaacauugcaauaga

SEQ ID NO: 2154796 - RNA, 13 nt, Human
gaacauugcaaua

SEQ ID NO: 2154797 - RNA, 15 nt, Human
gaacguuuuuccugu

SEQ ID NO: 2154798 - RNA, 12 nt, Human
gaacguuuuucc

SEQ ID NO: 2154799 - RNA, 16 nt, Human
gacgugauuuugcugu

SEQ ID NO: 2154800 - RNA, 17 nt, Human
gacgugauuuugcugua

SEQ ID NO: 2154801 - RNA, 19 nt, Human
gaccuguggccaaguucuu

SEQ ID NO: 2154802 - RNA, 16 nt, Human
gacuuauuuauauaaa

SEQ ID NO: 2154803 - RNA, 22 nt, Human
gacugaccaauauuguacaguu

SEQ ID NO: 2154804 - RNA, 21 nt, Human
gacugaccaauauuguacagu

SEQ ID NO: 2154805 - RNA, 16 nt, Human
gacauccaagcuuccu

SEQ ID NO: 2154806 - RNA, 15 nt, Human
gacauccaagcuucc

SEQ ID NO: 2154807 - RNA, 17 nt, Human
gacauccaagcuuccuu

SEQ ID NO: 2154808 - RNA, 21 nt, Human
gaccaauauuguacaguuuuu

SEQ ID NO: 2154809 - RNA, 19 nt, Human
gaccaauauuguacaguuu

SEQ ID NO: 2154810 - RNA, 18 nt, Human
gaccaauauuguacaguu

SEQ ID NO: 2154811 - RNA, 17 nt, Human
gaccaauauuguacagu

SEQ ID NO: 2154812 - RNA, 17 nt, Human
gaaaacgguuaaaacug

SEQ ID NO: 2154813 - RNA, 18 nt, Human
gaaaagggaacugaacau

SEQ ID NO: 2154814 - RNA, 15 nt, Human
cuuucugcagaaaca

SEQ ID NO: 2154815 - RNA, 18 nt, Human
cuucucucaccuccuaaa

SEQ ID NO: 2154816 - RNA, 16 nt, Human
cuucucucaccuccua

SEQ ID NO: 2154817 - RNA, 15 nt, Human
cuucucucaccuccu

SEQ ID NO: 2154818 - RNA, 14 nt, Human
cuucucucaccucc

SEQ ID NO: 2154819 - RNA, 23 nt, Human
cuucagggggccaggugcacaga

SEQ ID NO: 2154820 - RNA, 15 nt, Human
cuucagggggccagg

SEQ ID NO: 2154821 - RNA, 14 nt, Human
cuucagggggccag

SEQ ID NO: 2154822 - RNA, 18 nt, Human
cuuacuacaugugggagc

SEQ ID NO: 2154823 - RNA, 20 nt, Human
cuuacuacaugugggagcuu

SEQ ID NO: 2154824 - RNA, 14 nt, Human
cuuacuuaguguua

SEQ ID NO: 2154825 - RNA, 21 nt, Human
cucuccauucccguggaacgu

SEQ ID NO: 2154826 - RNA, 24 nt, Human
cuccauucccguggaacguuuuuc

SEQ ID NO: 2154827 - RNA, 15 nt, Human
cucaggucuguuuuc

SEQ ID NO: 2154828 - RNA, 17 nt, Human
cucgagguuucucaaag

SEQ ID NO: 2154829 - RNA, 21 nt, Human
cuccugaguagcuggauuaca

SEQ ID NO: 2154830 - RNA, 17 nt, Human
cugcagagacagagagg

SEQ ID NO: 2154831 - RNA, 17 nt, Human
cugccauggaggcacac

SEQ ID NO: 2154832 - RNA, 20 nt, Human
cugccauggaggcacacagc

SEQ ID NO: 2154833 - RNA, 18 nt, Human
cuggucucaaacuccuga

SEQ ID NO: 2154834 - RNA, 22 nt, Human
ccggaauccuguccucagcuuc

SEQ ID NO: 2154835 - RNA, 20 nt, Human
ccggaauccuguccucagcu

SEQ ID NO: 2154836 - RNA, 19 nt, Human
ccggaauccuguccucagc

SEQ ID NO: 2154837 - RNA, 19 nt, Human
ccuaaaguagacuucauuu

SEQ ID NO: 2154838 - RNA, 18 nt, Human
ccccuaaugccugcggag

SEQ ID NO: 2154839 - RNA, 19 nt, Human
ccccuccccuaaugccugc

SEQ ID NO: 2154840 - RNA, 15 nt, Human
ccuguccucagcuuc

SEQ ID NO: 2154841 - RNA, 20 nt, Human
ccuguggccaaguucuuagu

SEQ ID NO: 2154842 - RNA, 19 nt, Human
cguggcugcggcacccuug

SEQ ID NO: 2154843 - RNA, 21 nt, Human
cguggcugcccacacacccca

SEQ ID NO: 2154844 - RNA, 12 nt, Human
cguucucugccu

SEQ ID NO: 2154845 - RNA, 17 nt, Human
cguaguagggucaggcc

SEQ ID NO: 2154846 - RNA, 17 nt, Human
cgucauaacuagaacug

SEQ ID NO: 2154847 - RNA, 16 nt, Human
cgucauaacuagaacu

SEQ ID NO: 2154848 - RNA, 14 nt, Human
cgucauaacuagaa

SEQ ID NO: 2154849 - RNA, 16 nt, Human
cgucgacguagaaccu

SEQ ID NO: 2154850 - RNA, 20 nt, Human
cgcaaugugcccccagacgc

SEQ ID NO: 2154851 - RNA, 18 nt, Human
cgcaaugugcccccagac

SEQ ID NO: 2154852 - RNA, 21 nt, Human
cggaauccuguccucagcuuc

SEQ ID NO: 2154853 - RNA, 16 nt, Human
cggcaauuuccggcca

SEQ ID NO: 2154854 - RNA, 14 nt, Human
cggccucccaaagu

SEQ ID NO: 2154855 - RNA, 15 nt, Human
cccaggccguggcug

SEQ ID NO: 2154856 - RNA, 14 nt, Human
cccacacaccccaa

SEQ ID NO: 2154857 - RNA, 24 nt, Human
ccagcuggagaaauaugguacuca

SEQ ID NO: 2154858 - RNA, 21 nt, Human
ccaccugguuccggaauccug

SEQ ID NO: 2154859 - RNA, 16 nt, Human
ccacucaggucuguuu

SEQ ID NO: 2154860 - RNA, 11 nt, Human
ccacucagguc

SEQ ID NO: 2154861 - RNA, 20 nt, Human
ccacaguggaaccagcccag

SEQ ID NO: 2154862 - RNA, 17 nt, Human
ccaaauuuucuuuuuau

SEQ ID NO: 2154863 - RNA, 18 nt, Human
cauuuuuccuaacaggau

SEQ ID NO: 2154864 - RNA, 13 nt, Human
cauuuuuccuaac

SEQ ID NO: 2154865 - RNA, 20 nt, Human
cauuuuucagauauaaaaga

SEQ ID NO: 2154866 - RNA, 18 nt, Human
cauuuuucagauauaaaa

SEQ ID NO: 2154867 - RNA, 18 nt, Human
caccaguuccuuucaaug

SEQ ID NO: 2154868 - RNA, 16 nt, Human
caccagguagaacaca

SEQ ID NO: 2154869 - RNA, 16 nt, Human
caccagucauuuuuca

SEQ ID NO: 2154870 - RNA, 20 nt, Human
cacaugcccuaaugucugua

SEQ ID NO: 2154871 - RNA, 19 nt, Human
cacaugcccuaaugucugu

SEQ ID NO: 2154872 - RNA, 18 nt, Human
cacaugcccuaaugucug

SEQ ID NO: 2154873 - RNA, 19 nt, Human
cacagugagggagauccca

SEQ ID NO: 2154874 - RNA, 16 nt, Human
cacaggaugaagcauu

SEQ ID NO: 2154875 - RNA, 20 nt, Human
cacacgccucccacuggggu

SEQ ID NO: 2154876 - RNA, 17 nt, Human
cacacgccucccacugg

SEQ ID NO: 2154877 - RNA, 19 nt, Human
cacagcccaaagaaggaaa

SEQ ID NO: 2154878 - RNA, 13 nt, Human
caccauucagguc

SEQ ID NO: 2154879 - RNA, 13 nt, Human
caccauugaaggc

SEQ ID NO: 2154880 - RNA, 17 nt, Human
caccauuuaaaaacagg

SEQ ID NO: 2154881 - RNA, 15 nt, Human
caccauugaacugua

SEQ ID NO: 2154882 - RNA, 16 nt, Human
caccauugaaggcuua

SEQ ID NO: 2154883 - RNA, 14 nt, Human
caccauugaaggcu

SEQ ID NO: 2154884 - RNA, 15 nt, Human
caccauugaaggcuu

SEQ ID NO: 2154885 - RNA, 20 nt, Human
cacccaagaccucagggcac

SEQ ID NO: 2154886 - RNA, 22 nt, Human
caaagggcuccucuccagucug

SEQ ID NO: 2154887 - RNA, 14 nt, Human
caaagggcccagau

SEQ ID NO: 2154888 - RNA, 12 nt, Human
caaagggcccag

SEQ ID NO: 2154889 - RNA, 16 nt, Human
caaagagaaaaagaaa

SEQ ID NO: 2154890 - RNA, 15 nt, Human
caaagagaaaaagaa

SEQ ID NO: 2154891 - RNA, 21 nt, Human
auuuuaagacguguuuguguu

SEQ ID NO: 2154892 - RNA, 21 nt, Human
auuuuaaugcaccugaauguu

SEQ ID NO: 2154893 - RNA, 16 nt, Human
caagcccccccuucca

SEQ ID NO: 2154894 - RNA, 14 nt, Human
caagcccccccuuc

SEQ ID NO: 2154895 - RNA, 17 nt, Human
caagcccccccuuccac

SEQ ID NO: 2154896 - RNA, 16 nt, Human
caagacuguuagcccu

SEQ ID NO: 2154897 - RNA, 24 nt, Human
caagaccucagggcacaaagaugg

SEQ ID NO: 2154898 - RNA, 23 nt, Human
caagaccucagggcacaaagaug

SEQ ID NO: 2154899 - RNA, 16 nt, Human
caagaccucagggcac

SEQ ID NO: 2154900 - RNA, 15 nt, Human
caagaccucagggca

SEQ ID NO: 2154901 - RNA, 22 nt, Human
caagguaacuguacugggccau

SEQ ID NO: 2154902 - RNA, 16 nt, Human
caagguaacuguacug

SEQ ID NO: 2154903 - RNA, 21 nt, Human
caagguuauaugcacuuucuc

SEQ ID NO: 2154904 - RNA, 15 nt, Human
caaccuauuuugaag

SEQ ID NO: 2154905 - RNA, 16 nt, Human
caaccuauuuugaagu

SEQ ID NO: 2154906 - RNA, 22 nt, Human
cacaaucucauugaggagcauu

SEQ ID NO: 2154907 - RNA, 19 nt, Human
cacacagcaagucaggguu

SEQ ID NO: 2154908 - RNA, 20 nt, Human
caaugguuugcaaggaagcc

SEQ ID NO: 2154909 - RNA, 19 nt, Human
caaugguuugcaaggaagc

SEQ ID NO: 2154910 - RNA, 18 nt, Human
caaugguuugcaaggaag

SEQ ID NO: 2154911 - RNA, 17 nt, Human
caaugguuugcaaggaa

SEQ ID NO: 2154912 - RNA, 16 nt, Human
caaugguuugcaagga

SEQ ID NO: 2154913 - RNA, 13 nt, Human
caaugguuugcaa

SEQ ID NO: 2154914 - RNA, 13 nt, Human
cacaaaguggcau

SEQ ID NO: 2154915 - RNA, 14 nt, Human
caauaucagacuuu

SEQ ID NO: 2154916 - RNA, 15 nt, Human
guauuuuuuaaagcu

SEQ ID NO: 2154917 - RNA, 15 nt, Human
aaauuacucuuucuc

SEQ ID NO: 2154918 - RNA, 14 nt, Human
aaauuacucuuucu

SEQ ID NO: 2154919 - RNA, 19 nt, Human
guaucaauaccaaauagcu

SEQ ID NO: 2154920 - RNA, 21 nt, Human
guaucacucugugucugagug

SEQ ID NO: 2154921 - RNA, 20 nt, Human
aaauguaccuucagaauaag

SEQ ID NO: 2154922 - RNA, 18 nt, Human
guaggacccaagcagaga

SEQ ID NO: 2154923 - RNA, 14 nt, Human
aaaucuacaguaca

SEQ ID NO: 2154924 - RNA, 18 nt, Human
aaaucuaggaaaauauuu

SEQ ID NO: 2154925 - RNA, 20 nt, Human
aaaucuaggaaaauauuuug

SEQ ID NO: 2154926 - RNA, 16 nt, Human
aaaucuaggaaaauau

SEQ ID NO: 2154927 - RNA, 14 nt, Human
aaaucuauauuuug

SEQ ID NO: 2154928 - RNA, 19 nt, Human
aaaugaacgauauguagca

SEQ ID NO: 2154929 - RNA, 22 nt, Human
aaaugaacgauauguagcagaa

SEQ ID NO: 2154930 - RNA, 23 nt, Human
aaaugaacgauauguagcagaaa

SEQ ID NO: 2154931 - RNA, 21 nt, Human
aaaugaguuaccuacauuuua

SEQ ID NO: 2154932 - RNA, 16 nt, Human
aaaugaucuuuucaag

SEQ ID NO: 2154933 - RNA, 16 nt, Human
aaaugcaaaaaucucu

SEQ ID NO: 2154934 - RNA, 15 nt, Human
aaaugcaaaaaucuc

SEQ ID NO: 2154935 - RNA, 16 nt, Human
aaaugcaacaacaugu

SEQ ID NO: 2154936 - RNA, 13 nt, Human
guccucugaauga

SEQ ID NO: 2154937 - RNA, 17 nt, Human
guccucugaaugaaccu

SEQ ID NO: 2154938 - RNA, 14 nt, Human
guccuuccaccucg

SEQ ID NO: 2154939 - RNA, 19 nt, Human
aacagacucgauucauauu

SEQ ID NO: 2154940 - RNA, 16 nt, Human
aacaauauugucugaa

SEQ ID NO: 2154941 - RNA, 20 nt, Human
aacaaugacuaauucuugca

SEQ ID NO: 2154942 - RNA, 21 nt, Human
aacaaugacuaauucuugcau

SEQ ID NO: 2154943 - RNA, 14 nt, Human
aacacugcuugugu

SEQ ID NO: 2154944 - RNA, 23 nt, Human
aacacugauuuccccuuuugcau

SEQ ID NO: 2154945 - RNA, 17 nt, Human
aacacugcuuguguuuu

SEQ ID NO: 2154946 - RNA, 22 nt, Human
aacacugauuuccccuuuugca

SEQ ID NO: 2154947 - RNA, 15 nt, Human
aacacugauuucccc

SEQ ID NO: 2154948 - RNA, 14 nt, Human
aacacugauuuccc

SEQ ID NO: 2154949 - RNA, 16 nt, Human
aacacugucuugaaga

SEQ ID NO: 2154950 - RNA, 15 nt, Human
guccuucucauucau

SEQ ID NO: 2154951 - RNA, 13 nt, Human
gucuccuggcggu

SEQ ID NO: 2154952 - RNA, 13 nt, Human
aacauuuuuggua

SEQ ID NO: 2154953 - RNA, 16 nt, Human
aaccaaucuacaaucu

SEQ ID NO: 2154954 - RNA, 20 nt, Human
aacccccacuggacugaccu

SEQ ID NO: 2154955 - RNA, 12 nt, Human
aaccuauuucuc

SEQ ID NO: 2154956 - RNA, 18 nt, Human
aaccuauuucucuuucuu

SEQ ID NO: 2154957 - RNA, 15 nt, Human
aaccuauuucucuuu

SEQ ID NO: 2154958 - RNA, 15 nt, Human
aaccuauuuugaagu

SEQ ID NO: 2154959 - RNA, 16 nt, Human
aaccauggugcuuguu

SEQ ID NO: 2154960 - RNA, 17 nt, Human
aacccauauuguaaaac

SEQ ID NO: 2154961 - RNA, 21 nt, Human
aacccauauuguaaaacaggu

SEQ ID NO: 2154962 - RNA, 17 nt, Human
aacccagucacugugag

SEQ ID NO: 2154963 - RNA, 18 nt, Human
aacuagcuuggaaacugg

SEQ ID NO: 2154964 - RNA, 19 nt, Human
aacuacagaaaaaccagag

SEQ ID NO: 2154965 - RNA, 17 nt, Human
gucuuucuuuuuggaca

SEQ ID NO: 2154966 - RNA, 21 nt, Human
aaccucuccucauguucugcu

SEQ ID NO: 2154967 - RNA, 15 nt, Human
guucucuagaaagaa

SEQ ID NO: 2154968 - RNA, 14 nt, Human
guucucuagaaaga

SEQ ID NO: 2154969 - RNA, 12 nt, Human
guucucuagaaa

SEQ ID NO: 2154970 - RNA, 23 nt, Human
guucccauccucuucuuuuagca

SEQ ID NO: 2154971 - RNA, 21 nt, Human
guucccauccucuucuuuuag

SEQ ID NO: 2154972 - RNA, 15 nt, Human
aagcuuuaccagcug

SEQ ID NO: 2154973 - RNA, 13 nt, Human
guuaaugcuuucu

SEQ ID NO: 2154974 - RNA, 17 nt, Human
guuacacagugugaaua

SEQ ID NO: 2154975 - RNA, 14 nt, Human
guuaaguucuauug

SEQ ID NO: 2154976 - RNA, 22 nt, Human
guuaaguuuuucccuucaucug

SEQ ID NO: 2154977 - RNA, 15 nt, Human
guuaaugcuuucuga

SEQ ID NO: 2154978 - RNA, 16 nt, Human
guuaagcuuugacacu

SEQ ID NO: 2154979 - RNA, 11 nt, Human
guguuuguguu

SEQ ID NO: 2154980 - RNA, 14 nt, Human
guuaagcuuugaca

SEQ ID NO: 2154981 - RNA, 17 nt, Human
aaggccagaccugcaga

SEQ ID NO: 2154982 - RNA, 20 nt, Human
aaggccagaccugcagacgc

SEQ ID NO: 2154983 - RNA, 18 nt, Human
aaggccagaccugcagac

SEQ ID NO: 2154984 - RNA, 19 nt, Human
guuuaauuuuauaaacaaa

SEQ ID NO: 2154985 - RNA, 15 nt, Human
guuuaauuuaaagcc

SEQ ID NO: 2154986 - RNA, 14 nt, Human
guuuaauuuaaagc

SEQ ID NO: 2154987 - RNA, 19 nt, Human
guuuacaagcccccccuuc

SEQ ID NO: 2154988 - RNA, 18 nt, Human
guuuacaagcccccccuu

SEQ ID NO: 2154989 - RNA, 22 nt, Human
guuuacaagcccccccuuccac

SEQ ID NO: 2154990 - RNA, 14 nt, Human
guuguacuucauuu

SEQ ID NO: 2154991 - RNA, 23 nt, Human
guuguauacuuccuuaugcuucu

SEQ ID NO: 2154992 - RNA, 23 nt, Human
guuuuaggucuagccuaugugga

SEQ ID NO: 2154993 - RNA, 21 nt, Human
guuuuaauuuauacuggcaug

SEQ ID NO: 2154994 - RNA, 22 nt, Human
guuuuaauuuauacuggcaugc

SEQ ID NO: 2154995 - RNA, 15 nt, Human
guuugcaaggaagcc

SEQ ID NO: 2154996 - RNA, 14 nt, Human
guuugcaaggaagc

SEQ ID NO: 2154997 - RNA, 13 nt, Human
guuugcaaggaag

SEQ ID NO: 2154998 - RNA, 22 nt, Human
guuugcaaggaagccacagcug

SEQ ID NO: 2154999 - RNA, 17 nt, Human
guuugcaaggaagccac

SEQ ID NO: 2155000 - RNA, 18 nt, Human
guuugccgguggugcagg

SEQ ID NO: 2155001 - RNA, 19 nt, Human
guuugccgguggugcaggu

SEQ ID NO: 2155002 - RNA, 19 nt, Human
guuugggauccuauugaac

SEQ ID NO: 2155003 - RNA, 13 nt, Human
aagcaagacugag

SEQ ID NO: 2155004 - RNA, 14 nt, Human
aagcaaagggcucc

SEQ ID NO: 2155005 - RNA, 13 nt, Human
gugggagggggag

SEQ ID NO: 2155006 - RNA, 15 nt, Human
aagaccucagggcac

SEQ ID NO: 2155007 - RNA, 22 nt, Human
guggaccaucgcugucaugagu

SEQ ID NO: 2155008 - RNA, 17 nt, Human
guggauuauuucauuuu

SEQ ID NO: 2155009 - RNA, 23 nt, Human
aagaaauaucugagcucuuugca

SEQ ID NO: 2155010 - RNA, 17 nt, Human
aagaaggaaaaggcagg

SEQ ID NO: 2155011 - RNA, 20 nt, Human
aacuugucaaaaaacaaaaa

SEQ ID NO: 2155012 - RNA, 13 nt, Human
aacuuuaaauuau

SEQ ID NO: 2155013 - RNA, 13 nt, Human
aauguauuuucuu

SEQ ID NO: 2155014 - RNA, 23 nt, Human
aauguauuuucuucaccucugcu

SEQ ID NO: 2155015 - RNA, 18 nt, Human
aauguacgaugagaaauu

SEQ ID NO: 2155016 - RNA, 20 nt, Human
aauguacuaggauacugcug

SEQ ID NO: 2155017 - RNA, 19 nt, Human
uaauuuauacuggcaugcu

SEQ ID NO: 2155018 - RNA, 21 nt, Human
uaauuucagcuucuauauauu

SEQ ID NO: 2155019 - RNA, 14 nt, Human
uaauuuauacuggc

SEQ ID NO: 2155020 - RNA, 13 nt, Human
aaugcuuucugaa

SEQ ID NO: 2155021 - RNA, 19 nt, Human
aaugcuuuagaaagguuuu

SEQ ID NO: 2155022 - RNA, 17 nt, Human
aaugcuuucugaagcuu

SEQ ID NO: 2155023 - RNA, 20 nt, Human
aaugcagucuguccaggcuc

SEQ ID NO: 2155024 - RNA, 19 nt, Human
aaugcagucuguccaggcu

SEQ ID NO: 2155025 - RNA, 14 nt, Human
uaauacuguauuug

SEQ ID NO: 2155026 - RNA, 12 nt, Human
uaauacuguauu

SEQ ID NO: 2155027 - RNA, 20 nt, Human
uaauacgaauuguuucacaa

SEQ ID NO: 2155028 - RNA, 12 nt, Human
uaauacuauauu

SEQ ID NO: 2155029 - RNA, 15 nt, Human
uaaugguuugaauau

SEQ ID NO: 2155030 - RNA, 20 nt, Human
aaugacucaggacauccccc

SEQ ID NO: 2155031 - RNA, 20 nt, Human
aaucuacugugguguuuugu

SEQ ID NO: 2155032 - RNA, 16 nt, Human
aaucuaggaaaauauu

SEQ ID NO: 2155033 - RNA, 18 nt, Human
aaucuaggaaaauauuuu

SEQ ID NO: 2155034 - RNA, 21 nt, Human
aauauuuuccaugaaaaugca

SEQ ID NO: 2155035 - RNA, 12 nt, Human
aauauccuuugc

SEQ ID NO: 2155036 - RNA, 23 nt, Human
aauagccacugcauaccaaccug

SEQ ID NO: 2155037 - RNA, 18 nt, Human
aauagauacagcagaggc

SEQ ID NO: 2155038 - RNA, 15 nt, Human
aauagcuuuuguguc

SEQ ID NO: 2155039 - RNA, 17 nt, Human
aauaaaacauuuucaca

SEQ ID NO: 2155040 - RNA, 19 nt, Human
aauaaaacauuuucacaca

SEQ ID NO: 2155041 - RNA, 19 nt, Human
aauaaaguuggucuuuuga

SEQ ID NO: 2155042 - RNA, 21 nt, Human
aauaaauauugucuuuuugua

SEQ ID NO: 2155043 - RNA, 16 nt, Human
aauaaauauugucuuu

SEQ ID NO: 2155044 - RNA, 23 nt, Human
aauaaauauugucuuuuuguaug

SEQ ID NO: 2155045 - RNA, 17 nt, Human
aauaaccaaucuacaau

SEQ ID NO: 2155046 - RNA, 22 nt, Human
uacuuuguucugcuguucucua

SEQ ID NO: 2155047 - RNA, 14 nt, Human
uacuuuguucugcu

SEQ ID NO: 2155048 - RNA, 19 nt, Human
aauuuuguuuucuugauuu

SEQ ID NO: 2155049 - RNA, 19 nt, Human
acaaaguggcauaaaaaac

SEQ ID NO: 2155050 - RNA, 19 nt, Human
acaaaguuccaaaaugcca

SEQ ID NO: 2155051 - RNA, 15 nt, Human
aauuuuuuuuuccuu

SEQ ID NO: 2155052 - RNA, 21 nt, Human
acaaucucccuucacaaguuu

SEQ ID NO: 2155053 - RNA, 17 nt, Human
acaaucucccuucacaa

SEQ ID NO: 2155054 - RNA, 18 nt, Human
acaauauugacuuugucu

SEQ ID NO: 2155055 - RNA, 15 nt, Human
acaauauugacuuug

SEQ ID NO: 2155056 - RNA, 14 nt, Human
acaauaccuuauuu

SEQ ID NO: 2155057 - RNA, 13 nt, Human
acaaauguaugau

SEQ ID NO: 2155058 - RNA, 14 nt, Human
acaagcccccccuu

SEQ ID NO: 2155059 - RNA, 18 nt, Human
acaagcccccccuuccac

SEQ ID NO: 2155060 - RNA, 17 nt, Human
acaagcccccccuucca

SEQ ID NO: 2155061 - RNA, 15 nt, Human
acaagcaaacccaga

SEQ ID NO: 2155062 - RNA, 18 nt, Human
aauugagcugcagaaacg

SEQ ID NO: 2155063 - RNA, 17 nt, Human
uacugacugagaauaua

SEQ ID NO: 2155064 - RNA, 20 nt, Human
uacugggccauguugugccu

SEQ ID NO: 2155065 - RNA, 22 nt, Human
aaugugucuuucuuuuuggaca

SEQ ID NO: 2155066 - RNA, 14 nt, Human
uacggacacccccu

SEQ ID NO: 2155067 - RNA, 13 nt, Human
uacggacaccccc

SEQ ID NO: 2155068 - RNA, 15 nt, Human
uacuaggauacugcu

SEQ ID NO: 2155069 - RNA, 22 nt, Human
uacuuccuuaugcuucuuucaa

SEQ ID NO: 2155070 - RNA, 16 nt, Human
aauuuauaaaaaggug

SEQ ID NO: 2155071 - RNA, 22 nt, Human
aauuuauaaaaagguguuuuga

SEQ ID NO: 2155072 - RNA, 16 nt, Human
uauauuuauacuguau

SEQ ID NO: 2155073 - RNA, 15 nt, Human
acagagcaagacucu

SEQ ID NO: 2155074 - RNA, 21 nt, Human
acagagcugggauguuucugu

SEQ ID NO: 2155075 - RNA, 18 nt, Human
acagagcugggauguuuc

SEQ ID NO: 2155076 - RNA, 10 nt, Human
acagagcugg

SEQ ID NO: 2155077 - RNA, 14 nt, Human
acagagcugggaug

SEQ ID NO: 2155078 - RNA, 19 nt, Human
acacucaccucuaaaacag

SEQ ID NO: 2155079 - RNA, 18 nt, Human
acacucaccucuaaaaca

SEQ ID NO: 2155080 - RNA, 15 nt, Human
acacucacuucucuu

SEQ ID NO: 2155081 - RNA, 22 nt, Human
acacugaaauauacacacagca

SEQ ID NO: 2155082 - RNA, 17 nt, Human
acacugaaauauacaca

SEQ ID NO: 2155083 - RNA, 18 nt, Human
acacugaaauauacacac

SEQ ID NO: 2155084 - RNA, 20 nt, Human
acacugaaauauacacacag

SEQ ID NO: 2155085 - RNA, 21 nt, Human
acacugaaauauacacacagc

SEQ ID NO: 2155086 - RNA, 20 nt, Human
acacucugggcuccagagug

SEQ ID NO: 2155087 - RNA, 12 nt, Human
uaguuuugcaua

SEQ ID NO: 2155088 - RNA, 17 nt, Human
uaguaaggaguucauuu

SEQ ID NO: 2155089 - RNA, 13 nt, Human
acaauggcagaug

SEQ ID NO: 2155090 - RNA, 13 nt, Human
accacacuggacu

SEQ ID NO: 2155091 - RNA, 16 nt, Human
accacacuggacuccg

SEQ ID NO: 2155092 - RNA, 15 nt, Human
accaauugcuuuguc

SEQ ID NO: 2155093 - RNA, 18 nt, Human
accacugcacucuagccu

SEQ ID NO: 2155094 - RNA, 12 nt, Human
ucaccucugcua

SEQ ID NO: 2155095 - RNA, 19 nt, Human
accaggcuugccugcaggc

SEQ ID NO: 2155096 - RNA, 20 nt, Human
ucaccucuaaaacaguccuu

SEQ ID NO: 2155097 - RNA, 18 nt, Human
accaggcuugccugcagg

SEQ ID NO: 2155098 - RNA, 16 nt, Human
ucaccuucaguaaccc

SEQ ID NO: 2155099 - RNA, 22 nt, Human
ucacuacgggggggagaaggaa

SEQ ID NO: 2155100 - RNA, 21 nt, Human
ucacuacgggggggagaagga

SEQ ID NO: 2155101 - RNA, 21 nt, Human
ucagaagggagcuagccagag

SEQ ID NO: 2155102 - RNA, 23 nt, Human
ucagaagggagcuagccagagga

SEQ ID NO: 2155103 - RNA, 22 nt, Human
acccagacggcuccacuaggac

SEQ ID NO: 2155104 - RNA, 21 nt, Human
acccagacggcuccacuagga

SEQ ID NO: 2155105 - RNA, 17 nt, Human
acccagacggcuccacu

SEQ ID NO: 2155106 - RNA, 20 nt, Human
accauguuuguggcuauuaa

SEQ ID NO: 2155107 - RNA, 18 nt, Human
accauuaugaagaagaga

SEQ ID NO: 2155108 - RNA, 15 nt, Human
accauugaacuguac

SEQ ID NO: 2155109 - RNA, 16 nt, Human
accauugaaggcuuaa

SEQ ID NO: 2155110 - RNA, 13 nt, Human
accauugaaggcu

SEQ ID NO: 2155111 - RNA, 14 nt, Human
ucacucuucucagc

SEQ ID NO: 2155112 - RNA, 13 nt, Human
ucacucuucucag

SEQ ID NO: 2155113 - RNA, 17 nt, Human
ucacucuucucagccac

SEQ ID NO: 2155114 - RNA, 18 nt, Human
ucacucuucucagccacu

SEQ ID NO: 2155115 - RNA, 18 nt, Human
ucagcauugauauuugug

SEQ ID NO: 2155116 - RNA, 14 nt, Human
ucagccagggccug

SEQ ID NO: 2155117 - RNA, 13 nt, Human
acccccgcccccu

SEQ ID NO: 2155118 - RNA, 13 nt, Human
ucaaguagcauuu

SEQ ID NO: 2155119 - RNA, 13 nt, Human
acauucuuaaaaa

SEQ ID NO: 2155120 - RNA, 13 nt, Human
acauucaggagcu

SEQ ID NO: 2155121 - RNA, 17 nt, Human
uauuuuuaauuaaauaa

SEQ ID NO: 2155122 - RNA, 18 nt, Human
uauuuguguauuuaacag

SEQ ID NO: 2155123 - RNA, 17 nt, Human
uauuuguguauuuaaca

SEQ ID NO: 2155124 - RNA, 15 nt, Human
uauuuguguauuuaa

SEQ ID NO: 2155125 - RNA, 13 nt, Human
uauuuguguauuu

SEQ ID NO: 2155126 - RNA, 17 nt, Human
uauuugugcauuuucua

SEQ ID NO: 2155127 - RNA, 13 nt, Human
uauuugugcauuu

SEQ ID NO: 2155128 - RNA, 19 nt, Human
ucaaacaaacucucugaac

SEQ ID NO: 2155129 - RNA, 15 nt, Human
ucaaagccacacucu

SEQ ID NO: 2155130 - RNA, 14 nt, Human
ucaaaggccagacc

SEQ ID NO: 2155131 - RNA, 18 nt, Human
ucaaagcugcuuuauuca

SEQ ID NO: 2155132 - RNA, 12 nt, Human
ucaaaggccaga

SEQ ID NO: 2155133 - RNA, 19 nt, Human
acauagcgaauacaaaauu

SEQ ID NO: 2155134 - RNA, 12 nt, Human
acaucugauaac

SEQ ID NO: 2155135 - RNA, 13 nt, Human
acaguuuugugaa

SEQ ID NO: 2155136 - RNA, 10 nt, Human
acauacauug

SEQ ID NO: 2155137 - RNA, 14 nt, Human
acaguuuuuaaacu

SEQ ID NO: 2155138 - RNA, 12 nt, Human
acaguuuuuaaa

SEQ ID NO: 2155139 - RNA, 16 nt, Human
acauaccuaagcaaac

SEQ ID NO: 2155140 - RNA, 15 nt, Human
uaugaagaagagagu

SEQ ID NO: 2155141 - RNA, 22 nt, Human
accugccacccugggccuggca

SEQ ID NO: 2155142 - RNA, 18 nt, Human
accuguuuuuuuucuuuu

SEQ ID NO: 2155143 - RNA, 17 nt, Human
accuuauuuaaguaacu

SEQ ID NO: 2155144 - RNA, 22 nt, Human
accucaaagcaccugaacaguu

SEQ ID NO: 2155145 - RNA, 16 nt, Human
accuaaauaaccaauc

SEQ ID NO: 2155146 - RNA, 13 nt, Human
ucauccugcaggc

SEQ ID NO: 2155147 - RNA, 12 nt, Human
ucauccugcagg

SEQ ID NO: 2155148 - RNA, 18 nt, Human
ucauccuauucuuucgaa

SEQ ID NO: 2155149 - RNA, 17 nt, Human
ucauccccucacuugcc

SEQ ID NO: 2155150 - RNA, 16 nt, Human
accucaaccaaugcca

SEQ ID NO: 2155151 - RNA, 13 nt, Human
accucucccaggg

SEQ ID NO: 2155152 - RNA, 20 nt, Human
ucauugaauuauaaaagcca

SEQ ID NO: 2155153 - RNA, 18 nt, Human
ucauugaauuauaaaagc

SEQ ID NO: 2155154 - RNA, 18 nt, Human
accucuaaaacaguccuu

SEQ ID NO: 2155155 - RNA, 13 nt, Human
ucauuaccacagg

SEQ ID NO: 2155156 - RNA, 23 nt, Human
acgugggcugggcccacaaaggc

SEQ ID NO: 2155157 - RNA, 18 nt, Human
acguguacuacaauuuaa

SEQ ID NO: 2155158 - RNA, 14 nt, Human
acguuccuaagcug

SEQ ID NO: 2155159 - RNA, 20 nt, Human
acguauguuuuuguguauuu

SEQ ID NO: 2155160 - RNA, 19 nt, Human
uccauucucaccuauccac

SEQ ID NO: 2155161 - RNA, 15 nt, Human
uccaugaaaaugcaa

SEQ ID NO: 2155162 - RNA, 16 nt, Human
uccaugaaaaugcaac

SEQ ID NO: 2155163 - RNA, 18 nt, Human
ucccauccucuucuuuua

SEQ ID NO: 2155164 - RNA, 15 nt, Human
ucccauccccugugg

SEQ ID NO: 2155165 - RNA, 12 nt, Human
ucccagcaauuu

SEQ ID NO: 2155166 - RNA, 17 nt, Human
acuacaauuuaaagcaa

SEQ ID NO: 2155167 - RNA, 22 nt, Human
acuacaauuuaaagcaaaggag

SEQ ID NO: 2155168 - RNA, 21 nt, Human
acuacucauacuuaagcaaaa

SEQ ID NO: 2155169 - RNA, 20 nt, Human
uccccuugucugaacuggag

SEQ ID NO: 2155170 - RNA, 20 nt, Human
uccccuuuauguacaggaug

SEQ ID NO: 2155171 - RNA, 17 nt, Human
uccccuuuauguacagg

SEQ ID NO: 2155172 - RNA, 15 nt, Human
acucauguuauuuuu

SEQ ID NO: 2155173 - RNA, 19 nt, Human
ucccuggugagagggccgg

SEQ ID NO: 2155174 - RNA, 23 nt, Human
ucccuggugagagggccgggcag

SEQ ID NO: 2155175 - RNA, 21 nt, Human
ucccuggugagagggccgggc

SEQ ID NO: 2155176 - RNA, 14 nt, Human
ucccuggggugggg

SEQ ID NO: 2155177 - RNA, 20 nt, Human
uccuuguagccuuuugacuu

SEQ ID NO: 2155178 - RNA, 19 nt, Human
uccuuguagccuuuugacu

SEQ ID NO: 2155179 - RNA, 15 nt, Human
uccuuguagccuuuu

SEQ ID NO: 2155180 - RNA, 15 nt, Human
uccuuccagcccaga

SEQ ID NO: 2155181 - RNA, 12 nt, Human
uccuuccaccuc

SEQ ID NO: 2155182 - RNA, 20 nt, Human
ucgcggcggagcuggccccg

SEQ ID NO: 2155183 - RNA, 19 nt, Human
ucgcggcggagcuggcccc

SEQ ID NO: 2155184 - RNA, 18 nt, Human
ucgcggcggagcuggccc

SEQ ID NO: 2155185 - RNA, 16 nt, Human
ucgcggcggagcuggc

SEQ ID NO: 2155186 - RNA, 18 nt, Human
ucgagaccagccuggcca

SEQ ID NO: 2155187 - RNA, 14 nt, Human
ucgagaccagccug

SEQ ID NO: 2155188 - RNA, 17 nt, Human
ucgagaccagccuggcc

SEQ ID NO: 2155189 - RNA, 13 nt, Human
ucgagaccagccu

SEQ ID NO: 2155190 - RNA, 17 nt, Human
ucgacuucgggcuggcc

SEQ ID NO: 2155191 - RNA, 15 nt, Human
acugccucucacagc

SEQ ID NO: 2155192 - RNA, 22 nt, Human
acugccucucacagcugaguug

SEQ ID NO: 2155193 - RNA, 22 nt, Human
acugcauaccaaccugggcaau

SEQ ID NO: 2155194 - RNA, 16 nt, Human
acugcuuguguuuuua

SEQ ID NO: 2155195 - RNA, 18 nt, Human
acugcuuguguuuuuaac

SEQ ID NO: 2155196 - RNA, 13 nt, Human
ucuaaaaugaguu

SEQ ID NO: 2155197 - RNA, 19 nt, Human
acuguuauccuauuuagau

SEQ ID NO: 2155198 - RNA, 19 nt, Human
ucucccacuagacaagucc

SEQ ID NO: 2155199 - RNA, 20 nt, Human
ucucauugaauuauaaaagc

SEQ ID NO: 2155200 - RNA, 18 nt, Human
ucuccagggucagaaaca

SEQ ID NO: 2155201 - RNA, 21 nt, Human
ucuccagggucagaaacagga

SEQ ID NO: 2155202 - RNA, 19 nt, Human
acuugcucuggaccugccc

SEQ ID NO: 2155203 - RNA, 18 nt, Human
acuugcucuggaccugcc

SEQ ID NO: 2155204 - RNA, 17 nt, Human
acuugcucuggaccugc

SEQ ID NO: 2155205 - RNA, 16 nt, Human
acuugcucuggaccug

SEQ ID NO: 2155206 - RNA, 15 nt, Human
acuugcucuggaccu

SEQ ID NO: 2155207 - RNA, 14 nt, Human
acuugcucuggacc

SEQ ID NO: 2155208 - RNA, 12 nt, Human
acuugcucugga

SEQ ID NO: 2155209 - RNA, 14 nt, Human
acuucgggcuggcc

SEQ ID NO: 2155210 - RNA, 18 nt, Human
acuuccuuaugcuucuuu

SEQ ID NO: 2155211 - RNA, 14 nt, Human
ucucugcuuuaaag

SEQ ID NO: 2155212 - RNA, 14 nt, Human
agaaaaagaaaugc

SEQ ID NO: 2155213 - RNA, 19 nt, Human
agaaaaaccagaggcagcu

SEQ ID NO: 2155214 - RNA, 15 nt, Human
agaaaaagaaaugca

SEQ ID NO: 2155215 - RNA, 20 nt, Human
agaaacgaagccaucuuucu

SEQ ID NO: 2155216 - RNA, 13 nt, Human
agaaacaggaccg

SEQ ID NO: 2155217 - RNA, 16 nt, Human
agaauuagcugcuucu

SEQ ID NO: 2155218 - RNA, 13 nt, Human
ucugggcuccaga

SEQ ID NO: 2155219 - RNA, 14 nt, Human
agaauuagcugcuu

SEQ ID NO: 2155220 - RNA, 16 nt, Human
ucuguuuaugcuuuug

SEQ ID NO: 2155221 - RNA, 18 nt, Human
ucugugaauugagcugca

SEQ ID NO: 2155222 - RNA, 14 nt, Human
ucuguaucuuuucu

SEQ ID NO: 2155223 - RNA, 17 nt, Human
ucuguaucacucugugu

SEQ ID NO: 2155224 - RNA, 18 nt, Human
agacaguccuaacaauau

SEQ ID NO: 2155225 - RNA, 14 nt, Human
ucuuacaaacaugu

SEQ ID NO: 2155226 - RNA, 19 nt, Human
agacuguugucccugcacu

SEQ ID NO: 2155227 - RNA, 23 nt, Human
agacucgauucauauugaauaua

SEQ ID NO: 2155228 - RNA, 13 nt, Human
agagaaaaagaaa

SEQ ID NO: 2155229 - RNA, 20 nt, Human
agacucgauucauauugaau

SEQ ID NO: 2155230 - RNA, 17 nt, Human
ucuuguaaauaaagccc

SEQ ID NO: 2155231 - RNA, 13 nt, Human
ucuuguaaauaaa

SEQ ID NO: 2155232 - RNA, 18 nt, Human
ucuuguaaauaaagcccu

SEQ ID NO: 2155233 - RNA, 21 nt, Human
ucuuauucuuucguucaguua

SEQ ID NO: 2155234 - RNA, 18 nt, Human
ucuuauucaaagaaauau

SEQ ID NO: 2155235 - RNA, 14 nt, Human
ucuuauucuuucgu

SEQ ID NO: 2155236 - RNA, 19 nt, Human
agacaugcagccuaaggcu

SEQ ID NO: 2155237 - RNA, 15 nt, Human
agacucauauuacug

SEQ ID NO: 2155238 - RNA, 22 nt, Human
agacucauauuacugguaggaa

SEQ ID NO: 2155239 - RNA, 18 nt, Human
agaccuggacacaggccu

SEQ ID NO: 2155240 - RNA, 16 nt, Human
agaccuggacacaggc

SEQ ID NO: 2155241 - RNA, 20 nt, Human
agacucacaaccugaaccua

SEQ ID NO: 2155242 - RNA, 19 nt, Human
agaccuggacacaggccug

SEQ ID NO: 2155243 - RNA, 13 nt, Human
agacucaaaugcu

SEQ ID NO: 2155244 - RNA, 13 nt, Human
agaccucagggca

SEQ ID NO: 2155245 - RNA, 15 nt, Human
agaccucagggcaca

SEQ ID NO: 2155246 - RNA, 14 nt, Human
agaccucagggcac

SEQ ID NO: 2155247 - RNA, 21 nt, Human
ugacaguggccgcccaaggcc

SEQ ID NO: 2155248 - RNA, 22 nt, Human
agauguucuacuuuguucugcu

SEQ ID NO: 2155249 - RNA, 15 nt, Human
agauguucuacuuug

SEQ ID NO: 2155250 - RNA, 14 nt, Human
agauguucuacuuu

SEQ ID NO: 2155251 - RNA, 17 nt, Human
ugaagcacagaccccuu

SEQ ID NO: 2155252 - RNA, 20 nt, Human
agaguugugacaacuuccug

SEQ ID NO: 2155253 - RNA, 13 nt, Human
agauaaagccaga

SEQ ID NO: 2155254 - RNA, 13 nt, Human
agauaugcaaaag

SEQ ID NO: 2155255 - RNA, 17 nt, Human
agagccacaggucuuua

SEQ ID NO: 2155256 - RNA, 20 nt, Human
agagccacaggucuuuaugu

SEQ ID NO: 2155257 - RNA, 21 nt, Human
agagcaagacucugucuaaaa

SEQ ID NO: 2155258 - RNA, 18 nt, Human
agagcaagacucugucua

SEQ ID NO: 2155259 - RNA, 15 nt, Human
agagcaagacucugu

SEQ ID NO: 2155260 - RNA, 16 nt, Human
ugaaauauacacacag

SEQ ID NO: 2155261 - RNA, 17 nt, Human
ugaaauauacacacagc

SEQ ID NO: 2155262 - RNA, 15 nt, Human
ugaaauauacacaca

SEQ ID NO: 2155263 - RNA, 18 nt, Human
ugaaauaugcuggcugga

SEQ ID NO: 2155264 - RNA, 12 nt, Human
agagcuuucuuu

SEQ ID NO: 2155265 - RNA, 16 nt, Human
agagcuuucuuucaca

SEQ ID NO: 2155266 - RNA, 14 nt, Human
agagcuuucuuuca

SEQ ID NO: 2155267 - RNA, 17 nt, Human
agaggcagcuucuuugc

SEQ ID NO: 2155268 - RNA, 16 nt, Human
ugaaccuauuucucuu

SEQ ID NO: 2155269 - RNA, 22 nt, Human
ugaaccuaggagugccccauuc

SEQ ID NO: 2155270 - RNA, 21 nt, Human
ugaaccuaggagugccccauu

SEQ ID NO: 2155271 - RNA, 21 nt, Human
ugaacgauauguagcagaaag

SEQ ID NO: 2155272 - RNA, 20 nt, Human
ugaacgauauguagcagaaa

SEQ ID NO: 2155273 - RNA, 16 nt, Human
agcauuuacugugucu

SEQ ID NO: 2155274 - RNA, 13 nt, Human
agcauuuuccucu

SEQ ID NO: 2155275 - RNA, 12 nt, Human
agcauuuuccuc

SEQ ID NO: 2155276 - RNA, 15 nt, Human
agcauuuuguauuug

SEQ ID NO: 2155277 - RNA, 21 nt, Human
agcauuuuccucugcuuugaa

SEQ ID NO: 2155278 - RNA, 18 nt, Human
agcauuuuccucugcuuu

SEQ ID NO: 2155279 - RNA, 17 nt, Human
agcauuuuccucugcuu

SEQ ID NO: 2155280 - RNA, 14 nt, Human
agcauuuuccucug

SEQ ID NO: 2155281 - RNA, 22 nt, Human
agcauuuuccucugcuuugaaa

SEQ ID NO: 2155282 - RNA, 16 nt, Human
agccaaaacagaucca

SEQ ID NO: 2155283 - RNA, 15 nt, Human
agcauuuuuuaaaaa

SEQ ID NO: 2155284 - RNA, 19 nt, Human
agcauuaugauguggguca

SEQ ID NO: 2155285 - RNA, 16 nt, Human
agcauggguucauccu

SEQ ID NO: 2155286 - RNA, 17 nt, Human
agcaucacuugggauua

SEQ ID NO: 2155287 - RNA, 17 nt, Human
agccacaaccacauaca

SEQ ID NO: 2155288 - RNA, 13 nt, Human
agccacagcuggu

SEQ ID NO: 2155289 - RNA, 21 nt, Human
agccacacucugggcuccaga

SEQ ID NO: 2155290 - RNA, 20 nt, Human
agccacagugagggagaucc

SEQ ID NO: 2155291 - RNA, 22 nt, Human
agccacagugagggagauccca

SEQ ID NO: 2155292 - RNA, 21 nt, Human
ugauggcccauucuacuugcu

SEQ ID NO: 2155293 - RNA, 20 nt, Human
ugauggcccauucuacuugc

SEQ ID NO: 2155294 - RNA, 19 nt, Human
ugauggcccauucuacuug

SEQ ID NO: 2155295 - RNA, 18 nt, Human
ugauggcccauucuacuu

SEQ ID NO: 2155296 - RNA, 17 nt, Human
ugauggcccauucuacu

SEQ ID NO: 2155297 - RNA, 12 nt, Human
agcauacaacuu

SEQ ID NO: 2155298 - RNA, 13 nt, Human
agcaguaaaauag

SEQ ID NO: 2155299 - RNA, 23 nt, Human
ugaguuacaccagaccuguucug

SEQ ID NO: 2155300 - RNA, 23 nt, Human
ugaguggcuucacuccugcugua

SEQ ID NO: 2155301 - RNA, 22 nt, Human
ugaguggcuucacuccugcugu

SEQ ID NO: 2155302 - RNA, 19 nt, Human
ugaguggcuucacuccugc

SEQ ID NO: 2155303 - RNA, 15 nt, Human
ugcagguagaccugu

SEQ ID NO: 2155304 - RNA, 22 nt, Human
ugcagguagaccugucuccugg

SEQ ID NO: 2155305 - RNA, 18 nt, Human
ugcagguagaccugucuc

SEQ ID NO: 2155306 - RNA, 16 nt, Human
ugcaggugaaacccag

SEQ ID NO: 2155307 - RNA, 18 nt, Human
ugcaugaagguuucugaa

SEQ ID NO: 2155308 - RNA, 13 nt, Human
ugcaugaagguuu

SEQ ID NO: 2155309 - RNA, 21 nt, Human
ugcaugaagguuucugaaaau

SEQ ID NO: 2155310 - RNA, 19 nt, Human
ugcaugaagguuucugaaa

SEQ ID NO: 2155311 - RNA, 19 nt, Human
ugcauagagccacguaugu

SEQ ID NO: 2155312 - RNA, 17 nt, Human
ugcauagagccacguau

SEQ ID NO: 2155313 - RNA, 18 nt, Human
agccugguuuagccugga

SEQ ID NO: 2155314 - RNA, 13 nt, Human
ugcauggacugug

SEQ ID NO: 2155315 - RNA, 21 nt, Human
agccugguuuagccuggaugu

SEQ ID NO: 2155316 - RNA, 17 nt, Human
ugauuuccccuuuugca

SEQ ID NO: 2155317 - RNA, 23 nt, Human
ugauuuccccuuuugcauucucc

SEQ ID NO: 2155318 - RNA, 13 nt, Human
ugcaaggcaaaga

SEQ ID NO: 2155319 - RNA, 20 nt, Human
ugcaaggaagccacagcugg

SEQ ID NO: 2155320 - RNA, 19 nt, Human
ugcaaggaagccacagcug

SEQ ID NO: 2155321 - RNA, 23 nt, Human
ugcaagccccugcuccagaagau

SEQ ID NO: 2155322 - RNA, 15 nt, Human
ugcaacaacauguau

SEQ ID NO: 2155323 - RNA, 13 nt, Human
ugcaacaacaugu

SEQ ID NO: 2155324 - RNA, 14 nt, Human
ugcacucagcucuu

SEQ ID NO: 2155325 - RNA, 18 nt, Human
agcccugggaucacugug

SEQ ID NO: 2155326 - RNA, 16 nt, Human
agcccugggaucacug

SEQ ID NO: 2155327 - RNA, 19 nt, Human
aggacgugggcugggccca

SEQ ID NO: 2155328 - RNA, 15 nt, Human
aggacgugggcuggg

SEQ ID NO: 2155329 - RNA, 15 nt, Human
aggagccuaggccag

SEQ ID NO: 2155330 - RNA, 15 nt, Human
aggagcacacccagc

SEQ ID NO: 2155331 - RNA, 13 nt, Human
aggaucuuuugaa

SEQ ID NO: 2155332 - RNA, 18 nt, Human
aggaucuuuugaacccag

SEQ ID NO: 2155333 - RNA, 16 nt, Human
aggagccuaggccagg

SEQ ID NO: 2155334 - RNA, 14 nt, Human
ugcuuuguguucuu

SEQ ID NO: 2155335 - RNA, 23 nt, Human
uggaugcggaacccaaauuacgu

SEQ ID NO: 2155336 - RNA, 13 nt, Human
uggauuauuucau

SEQ ID NO: 2155337 - RNA, 13 nt, Human
aggccagcugccu

SEQ ID NO: 2155338 - RNA, 23 nt, Human
aggcccccgggugugaagcacag

SEQ ID NO: 2155339 - RNA, 20 nt, Human
aggcagcuuuuucucuccca

SEQ ID NO: 2155340 - RNA, 18 nt, Human
aggcaggugaauuguuug

SEQ ID NO: 2155341 - RNA, 21 nt, Human
ugcuacaggggccagaagaug

SEQ ID NO: 2155342 - RNA, 15 nt, Human
ugcuacaggggccag

SEQ ID NO: 2155343 - RNA, 21 nt, Human
ugcuaaugucaaacuugaguc

SEQ ID NO: 2155344 - RNA, 20 nt, Human
agcuuugcuucucucucuaa

SEQ ID NO: 2155345 - RNA, 20 nt, Human
aggaaaagcggacaucagcu

SEQ ID NO: 2155346 - RNA, 13 nt, Human
ugcuauuugcaau

SEQ ID NO: 2155347 - RNA, 14 nt, Human
aggaaacaacagcu

SEQ ID NO: 2155348 - RNA, 15 nt, Human
aggaaacaacagcuu

SEQ ID NO: 2155349 - RNA, 23 nt, Human
aggaauuaaguuagggaauggca

SEQ ID NO: 2155350 - RNA, 18 nt, Human
aggaagccacagcuggug

SEQ ID NO: 2155351 - RNA, 16 nt, Human
aggaagccacagcugg

SEQ ID NO: 2155352 - RNA, 15 nt, Human
aggaagccacagcug

SEQ ID NO: 2155353 - RNA, 20 nt, Human
aggaagaucucugcagggcc

SEQ ID NO: 2155354 - RNA, 21 nt, Human
aggaagaucucugcagggccg

SEQ ID NO: 2155355 - RNA, 21 nt, Human
agcugcagaaacgaagccauc

SEQ ID NO: 2155356 - RNA, 14 nt, Human
agcugcaggggcau

SEQ ID NO: 2155357 - RNA, 15 nt, Human
ugccucagcccugac

SEQ ID NO: 2155358 - RNA, 16 nt, Human
ugccucagcccugacc

SEQ ID NO: 2155359 - RNA, 13 nt, Human
agcucgcuaaagu

SEQ ID NO: 2155360 - RNA, 13 nt, Human
agcuccaguucga

SEQ ID NO: 2155361 - RNA, 22 nt, Human
agcucccaggugcagccagagg

SEQ ID NO: 2155362 - RNA, 21 nt, Human
agcucccaggugcagccagag

SEQ ID NO: 2155363 - RNA, 20 nt, Human
agcucccaggugcagccaga

SEQ ID NO: 2155364 - RNA, 15 nt, Human
agcucccaggugcag

SEQ ID NO: 2155365 - RNA, 18 nt, Human
ugccauacuguaugcagu

SEQ ID NO: 2155366 - RNA, 19 nt, Human
ugccucagcccugacccug

SEQ ID NO: 2155367 - RNA, 19 nt, Human
agcugggguucaugacaau

SEQ ID NO: 2155368 - RNA, 19 nt, Human
uguaucaguggauuuccca

SEQ ID NO: 2155369 - RNA, 23 nt, Human
uguaucacucugugucugagugg

SEQ ID NO: 2155370 - RNA, 17 nt, Human
uguauguuuuuuuucug

SEQ ID NO: 2155371 - RNA, 17 nt, Human
uguauucccaguuacuu

SEQ ID NO: 2155372 - RNA, 19 nt, Human
uguauguucagaagaaauu

SEQ ID NO: 2155373 - RNA, 11 nt, Human
uguacuuugug

SEQ ID NO: 2155374 - RNA, 19 nt, Human
aguaaaauaaauauugucu

SEQ ID NO: 2155375 - RNA, 22 nt, Human
aguaaaauaaauauugucuuuu

SEQ ID NO: 2155376 - RNA, 20 nt, Human
aguaaaauaaauauugucuu

SEQ ID NO: 2155377 - RNA, 22 nt, Human
aguagcauuuacugugucuuug

SEQ ID NO: 2155378 - RNA, 14 nt, Human
aguagcauuuacug

SEQ ID NO: 2155379 - RNA, 13 nt, Human
ugguuaaugccau

SEQ ID NO: 2155380 - RNA, 20 nt, Human
aggugauaaaugucaguagu

SEQ ID NO: 2155381 - RNA, 13 nt, Human
aggugucuguauc

SEQ ID NO: 2155382 - RNA, 18 nt, Human
uguaaauaaagcccuggg

SEQ ID NO: 2155383 - RNA, 14 nt, Human
uguaaauaaagccc

SEQ ID NO: 2155384 - RNA, 13 nt, Human
uguaaauaaagcc

SEQ ID NO: 2155385 - RNA, 21 nt, Human
uguaaaguuauucuugaaguc

SEQ ID NO: 2155386 - RNA, 15 nt, Human
uguaaaguccccaga

SEQ ID NO: 2155387 - RNA, 21 nt, Human
ugguuugccgguggugcaggu

SEQ ID NO: 2155388 - RNA, 22 nt, Human
ugguuaggauggcaggacgugg

SEQ ID NO: 2155389 - RNA, 12 nt, Human
ugguuaggaugg

SEQ ID NO: 2155390 - RNA, 19 nt, Human
ugggugaaggcuggcauga

SEQ ID NO: 2155391 - RNA, 16 nt, Human
ugggugagguaauaaa

SEQ ID NO: 2155392 - RNA, 16 nt, Human
uggggaggaaauagaa

SEQ ID NO: 2155393 - RNA, 14 nt, Human
ugggguccagggag

SEQ ID NO: 2155394 - RNA, 12 nt, Human
ugggcacugaag

SEQ ID NO: 2155395 - RNA, 23 nt, Human
agggcagcgggagccucccugcc

SEQ ID NO: 2155396 - RNA, 13 nt, Human
agggaaguuuugu

SEQ ID NO: 2155397 - RNA, 13 nt, Human
agggacaaagagg

SEQ ID NO: 2155398 - RNA, 16 nt, Human
agggaauugcagagua

SEQ ID NO: 2155399 - RNA, 15 nt, Human
agggaauggcacagc

SEQ ID NO: 2155400 - RNA, 22 nt, Human
agggagcuccaacucagaaggg

SEQ ID NO: 2155401 - RNA, 15 nt, Human
agggagcugcagggg

SEQ ID NO: 2155402 - RNA, 21 nt, Human
agggagcaaguccuucccuuu

SEQ ID NO: 2155403 - RNA, 19 nt, Human
agggagcaaguccuucccu

SEQ ID NO: 2155404 - RNA, 18 nt, Human
ugggagaaugucaguuca

SEQ ID NO: 2155405 - RNA, 15 nt, Human
uuaauuccuuuccag

SEQ ID NO: 2155406 - RNA, 14 nt, Human
uuaauuuaaagcca

SEQ ID NO: 2155407 - RNA, 16 nt, Human
uuaauuuauacuggca

SEQ ID NO: 2155408 - RNA, 18 nt, Human
uuaaguuagggaauggca

SEQ ID NO: 2155409 - RNA, 17 nt, Human
auaaaaucugauaugua

SEQ ID NO: 2155410 - RNA, 15 nt, Human
uuacagucuauuuga

SEQ ID NO: 2155411 - RNA, 24 nt, Human
auaaagugcugcggagcaagagga

SEQ ID NO: 2155412 - RNA, 24 nt, Human
uuacugguaggaacuugagaacuu

SEQ ID NO: 2155413 - RNA, 20 nt, Human
uuacugguaggaacuugaga

SEQ ID NO: 2155414 - RNA, 18 nt, Human
uuacaucaaggcuucaaa

SEQ ID NO: 2155415 - RNA, 13 nt, Human
uuaacagggaggg

SEQ ID NO: 2155416 - RNA, 15 nt, Human
aguucugcucauucu

SEQ ID NO: 2155417 - RNA, 21 nt, Human
aguucugcucauucuaaugau

SEQ ID NO: 2155418 - RNA, 14 nt, Human
uguuuucuugauuu

SEQ ID NO: 2155419 - RNA, 21 nt, Human
uguuugacgggaaacaaaacu

SEQ ID NO: 2155420 - RNA, 18 nt, Human
agugugaguaaucugaga

SEQ ID NO: 2155421 - RNA, 14 nt, Human
aguguacucccagg

SEQ ID NO: 2155422 - RNA, 15 nt, Human
aguguacucccaggg

SEQ ID NO: 2155423 - RNA, 23 nt, Human
agugugguguuuccugcaggcca

SEQ ID NO: 2155424 - RNA, 17 nt, Human
uguucccaccugcugga

SEQ ID NO: 2155425 - RNA, 18 nt, Human
uguucccauccucuucuu

SEQ ID NO: 2155426 - RNA, 21 nt, Human
ugugguguuuccugcaggcca

SEQ ID NO: 2155427 - RNA, 14 nt, Human
uguggugguuguga

SEQ ID NO: 2155428 - RNA, 13 nt, Human
ugugaaauuccca

SEQ ID NO: 2155429 - RNA, 19 nt, Human
ugugaccuugagaagauuc

SEQ ID NO: 2155430 - RNA, 14 nt, Human
agucuugcagcuga

SEQ ID NO: 2155431 - RNA, 17 nt, Human
agucuugacgaguguga

SEQ ID NO: 2155432 - RNA, 16 nt, Human
agugagggagauccca

SEQ ID NO: 2155433 - RNA, 16 nt, Human
uguggagucauucuca

SEQ ID NO: 2155434 - RNA, 14 nt, Human
ugugauugugccua

SEQ ID NO: 2155435 - RNA, 19 nt, Human
ugugccaaccuauuuugaa

SEQ ID NO: 2155436 - RNA, 21 nt, Human
ugugcauuuucuaaacagaga

SEQ ID NO: 2155437 - RNA, 19 nt, Human
ugugcauuuucuaaacaga

SEQ ID NO: 2155438 - RNA, 14 nt, Human
ugugcauuuucuaa

SEQ ID NO: 2155439 - RNA, 13 nt, Human
ugugcauuuucua

SEQ ID NO: 2155440 - RNA, 16 nt, Human
ugugccauuuugcauu

SEQ ID NO: 2155441 - RNA, 17 nt, Human
auauuuguguauuuaac

SEQ ID NO: 2155442 - RNA, 18 nt, Human
auauuugugcauuuucua

SEQ ID NO: 2155443 - RNA, 21 nt, Human
auauuugugcauuuucuaaac

SEQ ID NO: 2155444 - RNA, 17 nt, Human
auauuugugcauuuucu

SEQ ID NO: 2155445 - RNA, 14 nt, Human
auauuugugcauuu

SEQ ID NO: 2155446 - RNA, 19 nt, Human
auauuugguuuuccuguau

SEQ ID NO: 2155447 - RNA, 16 nt, Human
auauuugguuuuccug

SEQ ID NO: 2155448 - RNA, 21 nt, Human
auauugaauauaauauauuug

SEQ ID NO: 2155449 - RNA, 18 nt, Human
auauugaauauaauauau

SEQ ID NO: 2155450 - RNA, 23 nt, Human
auauucuggagucaucauucccu

SEQ ID NO: 2155451 - RNA, 16 nt, Human
uuccuuuggaagaaaa

SEQ ID NO: 2155452 - RNA, 20 nt, Human
uuccuuuuauuucuucacca

SEQ ID NO: 2155453 - RNA, 17 nt, Human
uuccuuuggaagaaaaa

SEQ ID NO: 2155454 - RNA, 21 nt, Human
aucaagaguugugacaacuuc

SEQ ID NO: 2155455 - RNA, 22 nt, Human
auauuuugaucuucaacaaauu

SEQ ID NO: 2155456 - RNA, 19 nt, Human
auauuuugaucuucaacaa

SEQ ID NO: 2155457 - RNA, 17 nt, Human
auauuuugaucuucaac

SEQ ID NO: 2155458 - RNA, 16 nt, Human
auauuuugaucuucaa

SEQ ID NO: 2155459 - RNA, 15 nt, Human
auauuuugaucuuca

SEQ ID NO: 2155460 - RNA, 12 nt, Human
auauuuugaucu

SEQ ID NO: 2155461 - RNA, 18 nt, Human
auauuuucauuaaaagcu

SEQ ID NO: 2155462 - RNA, 15 nt, Human
uuccucugcuuugaa

SEQ ID NO: 2155463 - RNA, 13 nt, Human
uuccucugcuuug

SEQ ID NO: 2155464 - RNA, 13 nt, Human
uucugggaagcaa

SEQ ID NO: 2155465 - RNA, 19 nt, Human
uucugaaaauuaacacugc

SEQ ID NO: 2155466 - RNA, 22 nt, Human
aucauucccuucgacagcauuu

SEQ ID NO: 2155467 - RNA, 15 nt, Human
aucaguggauuuccc

SEQ ID NO: 2155468 - RNA, 17 nt, Human
aucaguggauuucccau

SEQ ID NO: 2155469 - RNA, 16 nt, Human
aucaguggauuuccca

SEQ ID NO: 2155470 - RNA, 18 nt, Human
aucaguggauuucccauc

SEQ ID NO: 2155471 - RNA, 19 nt, Human
uucuauaaaauacugguau

SEQ ID NO: 2155472 - RNA, 15 nt, Human
uuccuuuugaaagaa

SEQ ID NO: 2155473 - RNA, 23 nt, Human
uuccuuuugaaagaaucagucuu

SEQ ID NO: 2155474 - RNA, 17 nt, Human
uucaaguuaaauuuuau

SEQ ID NO: 2155475 - RNA, 21 nt, Human
uucaauaaaaaaaagaaauga

SEQ ID NO: 2155476 - RNA, 23 nt, Human
uucaauaaaaaaaagaaaugaaa

SEQ ID NO: 2155477 - RNA, 17 nt, Human
uucaaggccauccuucc

SEQ ID NO: 2155478 - RNA, 16 nt, Human
uucaaggccauccuuc

SEQ ID NO: 2155479 - RNA, 21 nt, Human
uucaaaaaaaaaaaaaagaga

SEQ ID NO: 2155480 - RNA, 14 nt, Human
uuauuucuaaaaua

SEQ ID NO: 2155481 - RNA, 15 nt, Human
uucaaacauuuacca

SEQ ID NO: 2155482 - RNA, 21 nt, Human
auagcuucaccccaaucccag

SEQ ID NO: 2155483 - RNA, 22 nt, Human
auagcuucaccccaaucccagc

SEQ ID NO: 2155484 - RNA, 14 nt, Human
auauauacauauau

SEQ ID NO: 2155485 - RNA, 16 nt, Human
uucagaauaagcuucc

SEQ ID NO: 2155486 - RNA, 19 nt, Human
auauaaauguuaagaaaaa

SEQ ID NO: 2155487 - RNA, 15 nt, Human
auauaaacacuauau

SEQ ID NO: 2155488 - RNA, 13 nt, Human
auauaaacacuau

SEQ ID NO: 2155489 - RNA, 13 nt, Human
uucagggucauag

SEQ ID NO: 2155490 - RNA, 14 nt, Human
uucaguaggaacug

SEQ ID NO: 2155491 - RNA, 14 nt, Human
uucauauuugcacu

SEQ ID NO: 2155492 - RNA, 15 nt, Human
uucauauuucuuugg

SEQ ID NO: 2155493 - RNA, 15 nt, Human
uucauauuugcacua

SEQ ID NO: 2155494 - RNA, 14 nt, Human
auauccuuugccuc

SEQ ID NO: 2155495 - RNA, 21 nt, Human
uucauggccuuugauaaaugu

SEQ ID NO: 2155496 - RNA, 15 nt, Human
uugguuuuccuguau

SEQ ID NO: 2155497 - RNA, 13 nt, Human
uugguuuuccugu

SEQ ID NO: 2155498 - RNA, 22 nt, Human
uugguuaagcuuugacacugga

SEQ ID NO: 2155499 - RNA, 20 nt, Human
uugguuaagcuuugacacug

SEQ ID NO: 2155500 - RNA, 19 nt, Human
uugguuaagcuuugacacu

SEQ ID NO: 2155501 - RNA, 13 nt, Human
uugguguugacau

SEQ ID NO: 2155502 - RNA, 14 nt, Human
augaaccuucuggc

SEQ ID NO: 2155503 - RNA, 17 nt, Human
augaaccuucuggccuc

SEQ ID NO: 2155504 - RNA, 14 nt, Human
augaagcaaacaca

SEQ ID NO: 2155505 - RNA, 15 nt, Human
augaagcaaacacau

SEQ ID NO: 2155506 - RNA, 15 nt, Human
uugcucuggaccugc

SEQ ID NO: 2155507 - RNA, 16 nt, Human
uugcucuggaccugcc

SEQ ID NO: 2155508 - RNA, 16 nt, Human
uugcuuuguguucuuu

SEQ ID NO: 2155509 - RNA, 15 nt, Human
uugcuuuguguucuu

SEQ ID NO: 2155510 - RNA, 17 nt, Human
aucugugaauugagcug

SEQ ID NO: 2155511 - RNA, 22 nt, Human
aucuuguggcuuugcaaccauu

SEQ ID NO: 2155512 - RNA, 19 nt, Human
aucugaaaaauacuuuugg

SEQ ID NO: 2155513 - RNA, 21 nt, Human
aucugagaaacaaugacuaau

SEQ ID NO: 2155514 - RNA, 15 nt, Human
uugccaagaccuuuc

SEQ ID NO: 2155515 - RNA, 14 nt, Human
uugccaagaccuuu

SEQ ID NO: 2155516 - RNA, 17 nt, Human
uugccaagaccuuucaa

SEQ ID NO: 2155517 - RNA, 16 nt, Human
aucuaggaaaauauuu

SEQ ID NO: 2155518 - RNA, 22 nt, Human
aucuaggaaaauauuuugaucu

SEQ ID NO: 2155519 - RNA, 19 nt, Human
aucuaggaaaauauuuuga

SEQ ID NO: 2155520 - RNA, 17 nt, Human
aucuaggaaaauauuuu

SEQ ID NO: 2155521 - RNA, 20 nt, Human
aucuaggaaaauauuuugau

SEQ ID NO: 2155522 - RNA, 19 nt, Human
aucuaauuuauaaaaaggu

SEQ ID NO: 2155523 - RNA, 23 nt, Human
aucuaauuuauaaaaagguguuu

SEQ ID NO: 2155524 - RNA, 13 nt, Human
aucuaauuuauaa

SEQ ID NO: 2155525 - RNA, 14 nt, Human
aucuaauuuauaaa

SEQ ID NO: 2155526 - RNA, 15 nt, Human
aucuaauuuauaaaa

SEQ ID NO: 2155527 - RNA, 21 nt, Human
uugagaaaaaaagaauaguug

SEQ ID NO: 2155528 - RNA, 20 nt, Human
augcgacacugggaggccag

SEQ ID NO: 2155529 - RNA, 14 nt, Human
uuuacugaagccuu

SEQ ID NO: 2155530 - RNA, 19 nt, Human
uuuacuguuauccuauuua

SEQ ID NO: 2155531 - RNA, 18 nt, Human
uuuacuguuauccuauuu

SEQ ID NO: 2155532 - RNA, 17 nt, Human
augcucagaccagcucu

SEQ ID NO: 2155533 - RNA, 12 nt, Human
augcucagacca

SEQ ID NO: 2155534 - RNA, 14 nt, Human
augcucagaccagc

SEQ ID NO: 2155535 - RNA, 22 nt, Human
uuuaagggaguguacucccagg

SEQ ID NO: 2155536 - RNA, 19 nt, Human
uuuaagacguguuuguguu

SEQ ID NO: 2155537 - RNA, 17 nt, Human
uuuaagacguguuugug

SEQ ID NO: 2155538 - RNA, 14 nt, Human
augcacucagcucu

SEQ ID NO: 2155539 - RNA, 16 nt, Human
augauuuacagagaag

SEQ ID NO: 2155540 - RNA, 11 nt, Human
augcaaaaauc

SEQ ID NO: 2155541 - RNA, 19 nt, Human
uuguagccuuuugacuuuc

SEQ ID NO: 2155542 - RNA, 16 nt, Human
uuguagccuuuugacu

SEQ ID NO: 2155543 - RNA, 15 nt, Human
uuguagccuuuugac

SEQ ID NO: 2155544 - RNA, 23 nt, Human
augaguuagaauaauaaauauuu

SEQ ID NO: 2155545 - RNA, 19 nt, Human
augaguuagaauaauaaau

SEQ ID NO: 2155546 - RNA, 14 nt, Human
uuguguauuuaaca

SEQ ID NO: 2155547 - RNA, 13 nt, Human
uuguguauuuaac

SEQ ID NO: 2155548 - RNA, 21 nt, Human
uuguguauuuaacagggaggg

SEQ ID NO: 2155549 - RNA, 22 nt, Human
uugugucaacaugaacaaauuu

SEQ ID NO: 2155550 - RNA, 22 nt, Human
uuuuguucccauccucuucuuu

SEQ ID NO: 2155551 - RNA, 15 nt, Human
auuaagccuuccaca

SEQ ID NO: 2155552 - RNA, 12 nt, Human
uuuuuguauguu

SEQ ID NO: 2155553 - RNA, 13 nt, Human
uuuuuggacauuu

SEQ ID NO: 2155554 - RNA, 19 nt, Human
uuuuuauuuguuugugcau

SEQ ID NO: 2155555 - RNA, 16 nt, Human
auucaaagaaauaucu

SEQ ID NO: 2155556 - RNA, 14 nt, Human
auucaaagaaauau

SEQ ID NO: 2155557 - RNA, 18 nt, Human
auuaguuuugcauaauuu

SEQ ID NO: 2155558 - RNA, 12 nt, Human
auucacuucacg

SEQ ID NO: 2155559 - RNA, 13 nt, Human
auucacuucacgc

SEQ ID NO: 2155560 - RNA, 15 nt, Human
uuugugcauuuucua

SEQ ID NO: 2155561 - RNA, 13 nt, Human
uuugugcauuuuc

SEQ ID NO: 2155562 - RNA, 15 nt, Human
uuuguuuguuuuccu

SEQ ID NO: 2155563 - RNA, 23 nt, Human
augugacauucuuaaaaaaagaa

SEQ ID NO: 2155564 - RNA, 18 nt, Human
augugacauucuuaaaaa

SEQ ID NO: 2155565 - RNA, 22 nt, Human
auguauauauuuuuuaaaaauc

SEQ ID NO: 2155566 - RNA, 23 nt, Human
auguauaauauuuuuaauuaaau

SEQ ID NO: 2155567 - RNA, 14 nt, Human
auguauaauauuuu

SEQ ID NO: 2155568 - RNA, 22 nt, Human
uuugcuaacuagcuuggaaacu

SEQ ID NO: 2155569 - RNA, 14 nt, Human
uuucccuucaucug

SEQ ID NO: 2155570 - RNA, 15 nt, Human
uuucccuugaggaaa

SEQ ID NO: 2155571 - RNA, 22 nt, Human
uuucccugcuuaaugaaaagcu

SEQ ID NO: 2155572 - RNA, 18 nt, Human
uuugaucuucaacaaauu

SEQ ID NO: 2155573 - RNA, 15 nt, Human
uuugaucuucaacaa

SEQ ID NO: 2155574 - RNA, 12 nt, Human
uuugaucuucaa

SEQ ID NO: 2155575 - RNA, 14 nt, Human
uuugacuuucauug

SEQ ID NO: 2155576 - RNA, 18 nt, Human
auguguuuaugugagcug

SEQ ID NO: 2155577 - RNA, 20 nt, Human
auguugcugugcacggugga

SEQ ID NO: 2155578 - RNA, 19 nt, Human
uuuuauugaaucuauuuaa

SEQ ID NO: 2155579 - RNA, 15 nt, Human
uuuucuacuguuuua

SEQ ID NO: 2155580 - RNA, 23 nt, Human
uuuucuguuacuuuguuuuuuaa

SEQ ID NO: 2155581 - RNA, 23 nt, Human
auugaauauaauauauuugugua

SEQ ID NO: 2155582 - RNA, 16 nt, Human
auugaaucuauuuaag

SEQ ID NO: 2155583 - RNA, 14 nt, Human
auugaaucuauuua

SEQ ID NO: 2155584 - RNA, 10 nt, Human
auugaaucua

SEQ ID NO: 2155585 - RNA, 14 nt, Human
auugaacagcaaag

SEQ ID NO: 2155586 - RNA, 15 nt, Human
auugaaggcuuaaac

SEQ ID NO: 2155587 - RNA, 19 nt, Human
auugaaggcuuaaacccau

SEQ ID NO: 2155588 - RNA, 16 nt, Human
auugcauauauacaua

SEQ ID NO: 2155589 - RNA, 15 nt, Human
auuggaacagugaau

SEQ ID NO: 2155590 - RNA, 18 nt, Human
auugaaucuauuuaagua

SEQ ID NO: 2155591 - RNA, 13 nt, Human
auuucuucaccag

SEQ ID NO: 2155592 - RNA, 16 nt, Human
auuucuucaccagauu

SEQ ID NO: 2155593 - RNA, 21 nt, Human
auuugagaauauaaaaaacuu

SEQ ID NO: 2155594 - RNA, 14 nt, Human
auuugagaauauaa

SEQ ID NO: 2155595 - RNA, 20 nt, Human
auuugauaguauugugcaua

SEQ ID NO: 2155596 - RNA, 18 nt, Human
auuugguuuagaacauaa

SEQ ID NO: 2155597 - RNA, 16 nt, Human
auuuacagagaaguga

SEQ ID NO: 2155598 - RNA, 23 nt, Human
auuuauuggccccccgaccuugu

SEQ ID NO: 2155599 - RNA, 17 nt, Human
auuucuaaaauauaaga

SEQ ID NO: 2155600 - RNA, 17 nt, Human
gccucuggaaagcaaag

SEQ ID NO: 2155601 - RNA, 15 nt, Human
gccucuggaaagcaa

SEQ ID NO: 2155602 - RNA, 15 nt, Human
gccuccuggcccagg

SEQ ID NO: 2155603 - RNA, 19 nt, Human
gccuccuggcccaggugag

SEQ ID NO: 2155604 - RNA, 14 nt, Human
gccugcgagggcag

SEQ ID NO: 2155605 - RNA, 15 nt, Human
gccgccugguacuca

SEQ ID NO: 2155606 - RNA, 13 nt, Human
gccgccugguacu

SEQ ID NO: 2155607 - RNA, 18 nt, Human
gccgccugguacucaagc

SEQ ID NO: 2155608 - RNA, 14 nt, Human
gccgcccaaggccc

SEQ ID NO: 2155609 - RNA, 15 nt, Human
gcccuaaaagcacac

SEQ ID NO: 2155610 - RNA, 15 nt, Human
gcccuaaugucugua

SEQ ID NO: 2155611 - RNA, 23 nt, Human
gccacuuuuuuuuuuaaucucca

SEQ ID NO: 2155612 - RNA, 19 nt, Human
gccacugcauaccaaccug

SEQ ID NO: 2155613 - RNA, 18 nt, Human
gccacccugaggccucug

SEQ ID NO: 2155614 - RNA, 23 nt, Human
gccauguugugccucccugguga

SEQ ID NO: 2155615 - RNA, 22 nt, Human
gccauguugugccucccuggug

SEQ ID NO: 2155616 - RNA, 21 nt, Human
gccauguugugccucccuggu

SEQ ID NO: 2155617 - RNA, 20 nt, Human
gccauguugugccucccugg

SEQ ID NO: 2155618 - RNA, 19 nt, Human
gccauguugugccucccug

SEQ ID NO: 2155619 - RNA, 21 nt, Human
gccagaccugcagacgcccag

SEQ ID NO: 2155620 - RNA, 14 nt, Human
gccagaccugcaga

SEQ ID NO: 2155621 - RNA, 13 nt, Human
gccagaccugcag

SEQ ID NO: 2155622 - RNA, 19 nt, Human
gccagaagaugaacagacu

SEQ ID NO: 2155623 - RNA, 20 nt, Human
gccagaagaugaacagacug

SEQ ID NO: 2155624 - RNA, 13 nt, Human
gcucaccuuuguu

SEQ ID NO: 2155625 - RNA, 13 nt, Human
gcuucuuugccaa

SEQ ID NO: 2155626 - RNA, 20 nt, Human
gcuguaaauuuggcuucugu

SEQ ID NO: 2155627 - RNA, 22 nt, Human
gcuguaaauuuggcuucuguug

SEQ ID NO: 2155628 - RNA, 17 nt, Human
gcuguaaauuuggcuuc

SEQ ID NO: 2155629 - RNA, 19 nt, Human
gcuguaaauuuggcuucug

SEQ ID NO: 2155630 - RNA, 18 nt, Human
gcuguaaauuuggcuucu

SEQ ID NO: 2155631 - RNA, 20 nt, Human
gcuucacuccugcuguaaau

SEQ ID NO: 2155632 - RNA, 18 nt, Human
gcuucacuccugcuguaa

SEQ ID NO: 2155633 - RNA, 17 nt, Human
gcuucacuccugcugua

SEQ ID NO: 2155634 - RNA, 16 nt, Human
gcuucacuccugcugu

SEQ ID NO: 2155635 - RNA, 15 nt, Human
gcuucacuccugcug

SEQ ID NO: 2155636 - RNA, 17 nt, Human
gcuucagaauuaaaacu

SEQ ID NO: 2155637 - RNA, 20 nt, Human
gcuucaccccaaucccagcu

SEQ ID NO: 2155638 - RNA, 19 nt, Human
gcuucaccccaaucccagc

SEQ ID NO: 2155639 - RNA, 22 nt, Human
gcuuaaacccauauuguaaaac

SEQ ID NO: 2155640 - RNA, 22 nt, Human
gcugggcacacgccucccacug

SEQ ID NO: 2155641 - RNA, 20 nt, Human
gcugggcacacgccucccac

SEQ ID NO: 2155642 - RNA, 18 nt, Human
ggacuagagggaccucuc

SEQ ID NO: 2155643 - RNA, 19 nt, Human
ggacuagagggaccucucc

SEQ ID NO: 2155644 - RNA, 21 nt, Human
ggacuagagggaccucuccca

SEQ ID NO: 2155645 - RNA, 16 nt, Human
ggacuagagcuuucuu

SEQ ID NO: 2155646 - RNA, 20 nt, Human
ggaccggguggaagggaugg

SEQ ID NO: 2155647 - RNA, 16 nt, Human
ggaggugucuguauca

SEQ ID NO: 2155648 - RNA, 17 nt, Human
ggaggccagugagccac

SEQ ID NO: 2155649 - RNA, 16 nt, Human
ggaggccagugagcca

SEQ ID NO: 2155650 - RNA, 12 nt, Human
ggagcuggcccc

SEQ ID NO: 2155651 - RNA, 18 nt, Human
ggagcuggccccgccgcc

SEQ ID NO: 2155652 - RNA, 19 nt, Human
ggagcuuccuguccuccca

SEQ ID NO: 2155653 - RNA, 16 nt, Human
ggagcuggccccgccg

SEQ ID NO: 2155654 - RNA, 15 nt, Human
ggagcuggccccgcc

SEQ ID NO: 2155655 - RNA, 21 nt, Human
ggagcaggcggugggcaccca

SEQ ID NO: 2155656 - RNA, 14 nt, Human
ggcauuucccccac

SEQ ID NO: 2155657 - RNA, 13 nt, Human
ggccaacauggua

SEQ ID NO: 2155658 - RNA, 20 nt, Human
ggccaacccuucuccucuug

SEQ ID NO: 2155659 - RNA, 16 nt, Human
ggccaacccuucuccu

SEQ ID NO: 2155660 - RNA, 16 nt, Human
ggccaaggagggugag

SEQ ID NO: 2155661 - RNA, 23 nt, Human
ggcccauucuacuugcucuggac

SEQ ID NO: 2155662 - RNA, 22 nt, Human
ggcccauucuacuugcucugga

SEQ ID NO: 2155663 - RNA, 21 nt, Human
ggcccauucuacuugcucugg

SEQ ID NO: 2155664 - RNA, 19 nt, Human
ggcccauucuacuugcucu

SEQ ID NO: 2155665 - RNA, 18 nt, Human
ggcccauucuacuugcuc

SEQ ID NO: 2155666 - RNA, 15 nt, Human
ggcccauucuacuug

SEQ ID NO: 2155667 - RNA, 14 nt, Human
ggcccauucuacuu

SEQ ID NO: 2155668 - RNA, 21 nt, Human
ggaugacaugcacucagcucu

SEQ ID NO: 2155669 - RNA, 23 nt, Human
ggauguuucugucacaucagcuc

SEQ ID NO: 2155670 - RNA, 19 nt, Human
ggcaaaggguccagaagga

SEQ ID NO: 2155671 - RNA, 14 nt, Human
ggcaggacaggaaa

SEQ ID NO: 2155672 - RNA, 18 nt, Human
ggcaggacgugggcuggg

SEQ ID NO: 2155673 - RNA, 18 nt, Human
aaacuaaggcccucuuga

SEQ ID NO: 2155674 - RNA, 17 nt, Human
aaacuacaaaaauuaac

SEQ ID NO: 2155675 - RNA, 19 nt, Human
aaacgcucucuacucugcu

SEQ ID NO: 2155676 - RNA, 18 nt, Human
gggucagccagggccugc

SEQ ID NO: 2155677 - RNA, 16 nt, Human
gggucagccagggccu

SEQ ID NO: 2155678 - RNA, 16 nt, Human
gggucagaaacaggac

SEQ ID NO: 2155679 - RNA, 18 nt, Human
gggucagaaacaggaccg

SEQ ID NO: 2155680 - RNA, 22 nt, Human
ggggucgacuucgggcuggcca

SEQ ID NO: 2155681 - RNA, 22 nt, Human
ggggcgccgcaaaccacacugg

SEQ ID NO: 2155682 - RNA, 21 nt, Human
ggggcgaucgcggcggagcug

SEQ ID NO: 2155683 - RNA, 21 nt, Human
aaacauuuaccaaucauauua

SEQ ID NO: 2155684 - RNA, 20 nt, Human
aaacauuuaccaaucauauu

SEQ ID NO: 2155685 - RNA, 14 nt, Human
aaacauaagugcaa

SEQ ID NO: 2155686 - RNA, 19 nt, Human
aaagcggacaucagcuggu

SEQ ID NO: 2155687 - RNA, 20 nt, Human
aaagcacacucauccccuca

SEQ ID NO: 2155688 - RNA, 19 nt, Human
aaagcuugaguaaaauaaa

SEQ ID NO: 2155689 - RNA, 17 nt, Human
aaagcuugaguaaaaua

SEQ ID NO: 2155690 - RNA, 16 nt, Human
aaagcaaaaagugaug

SEQ ID NO: 2155691 - RNA, 17 nt, Human
aaagagaaaaagaaaug

SEQ ID NO: 2155692 - RNA, 22 nt, Human
aaagauuacuuuuucuuuaugu

SEQ ID NO: 2155693 - RNA, 19 nt, Human
aaagaugggugaaggcugg

SEQ ID NO: 2155694 - RNA, 18 nt, Human
gguauucgcuugagaaaa

SEQ ID NO: 2155695 - RNA, 20 nt, Human
gguccagaaggagacaggca

SEQ ID NO: 2155696 - RNA, 22 nt, Human
gggauuucaccacucaaaggcc

SEQ ID NO: 2155697 - RNA, 15 nt, Human
aaaaguaaauguaca

SEQ ID NO: 2155698 - RNA, 13 nt, Human
aaaauaaaguugg

SEQ ID NO: 2155699 - RNA, 21 nt, Human
aaaauaaauauugucuuuuug

SEQ ID NO: 2155700 - RNA, 23 nt, Human
aaaauaaauauugucuuuuugua

SEQ ID NO: 2155701 - RNA, 19 nt, Human
aaaacauuuucacacaaua

SEQ ID NO: 2155702 - RNA, 12 nt, Human
aaaaaucuguuu

SEQ ID NO: 2155703 - RNA, 18 nt, Human
aaaagcuguauuuugaaa

SEQ ID NO: 2155704 - RNA, 13 nt, Human
aaaagcugcucag

SEQ ID NO: 2155705 - RNA, 20 nt, Human
aaaagcuacaguuuugugaa

SEQ ID NO: 2155706 - RNA, 13 nt, Human
gggagaccuggac

SEQ ID NO: 2155707 - RNA, 19 nt, Human
ggcuccugagggagcucca

SEQ ID NO: 2155708 - RNA, 13 nt, Human
aaaaaaaaaccaa

SEQ ID NO: 2155709 - RNA, 11 nt, Human
aaaaaaaaugg

SEQ ID NO: 2155710 - RNA, 11 nt, Human
aaaaaaaagag

SEQ ID NO: 2155711 - RNA, 12 nt, Human
aaaaaagaaaug

SEQ ID NO: 2155712 - RNA, 13 nt, Human
gggaaaagcagcu

SEQ ID NO: 2155713 - RNA, 16 nt, Human
gacuguugucccugca

SEQ ID NO: 2155714 - RNA, 14 nt, Human
gacuguugucccug

SEQ ID NO: 2155715 - RNA, 13 nt, Human
gacuguugucccu

SEQ ID NO: 2155716 - RNA, 20 nt, Human
gacuguugucccugcacucu

SEQ ID NO: 2155717 - RNA, 15 nt, Human
gacuuucauuggaaa

SEQ ID NO: 2155718 - RNA, 12 nt, Human
gaccucucccag

SEQ ID NO: 2155719 - RNA, 14 nt, Human
gaccucucccaggg

SEQ ID NO: 2155720 - RNA, 24 nt, Human
gaccaugcgacacugggaggccag

SEQ ID NO: 2155721 - RNA, 18 nt, Human
gacauuuaccuuuuugaa

SEQ ID NO: 2155722 - RNA, 18 nt, Human
gacauuguuaaaauaaag

SEQ ID NO: 2155723 - RNA, 13 nt, Human
gacagaagaaggc

SEQ ID NO: 2155724 - RNA, 16 nt, Human
gacagugaauauucaa

SEQ ID NO: 2155725 - RNA, 23 nt, Human
gacauucaguauauaaaauaugu

SEQ ID NO: 2155726 - RNA, 16 nt, Human
gacacaggaugaagca

SEQ ID NO: 2155727 - RNA, 15 nt, Human
gacagaacacugucu

SEQ ID NO: 2155728 - RNA, 14 nt, Human
gacagaacacuguc

SEQ ID NO: 2155729 - RNA, 13 nt, Human
gacagaacacugu

SEQ ID NO: 2155730 - RNA, 16 nt, Human
gaaggggacccccgcc

SEQ ID NO: 2155731 - RNA, 15 nt, Human
gaaggccucgcagga

SEQ ID NO: 2155732 - RNA, 14 nt, Human
gaaggccucgcagg

SEQ ID NO: 2155733 - RNA, 18 nt, Human
gaaggcuggcaugaucca

SEQ ID NO: 2155734 - RNA, 14 nt, Human
gaaggcuggcauga

SEQ ID NO: 2155735 - RNA, 18 nt, Human
gaaggccucgcaggaaga

SEQ ID NO: 2155736 - RNA, 18 nt, Human
gaagcucuugaagacacu

SEQ ID NO: 2155737 - RNA, 22 nt, Human
gaagcugaggcaggugaauugu

SEQ ID NO: 2155738 - RNA, 19 nt, Human
gaagcucucgggcuaggaa

SEQ ID NO: 2155739 - RNA, 20 nt, Human
gaauauaauauauuugugua

SEQ ID NO: 2155740 - RNA, 19 nt, Human
gaauauaauauauuugugu

SEQ ID NO: 2155741 - RNA, 16 nt, Human
gaauauaauacuguau

SEQ ID NO: 2155742 - RNA, 14 nt, Human
gaauauaaacacua

SEQ ID NO: 2155743 - RNA, 21 nt, Human
gaauauaaacacuauauggca

SEQ ID NO: 2155744 - RNA, 13 nt, Human
gaauauaaacacu

SEQ ID NO: 2155745 - RNA, 23 nt, Human
gaauaguugaaccuauuucucuu

SEQ ID NO: 2155746 - RNA, 13 nt, Human
gaaguuaugggaa

SEQ ID NO: 2155747 - RNA, 21 nt, Human
gaaggggacccccgcccccug

SEQ ID NO: 2155748 - RNA, 20 nt, Human
gaaggggacccccgcccccu

SEQ ID NO: 2155749 - RNA, 18 nt, Human
gaaggggacccccgcccc

SEQ ID NO: 2155750 - RNA, 13 nt, Human
gaagcaaacacau

SEQ ID NO: 2155751 - RNA, 15 nt, Human
gaagcaaacacauua

SEQ ID NO: 2155752 - RNA, 17 nt, Human
gaagcaaacacauuaag

SEQ ID NO: 2155753 - RNA, 21 nt, Human
gaacugccuuuggcagaguuc

SEQ ID NO: 2155754 - RNA, 12 nt, Human
gaacugaacacc

SEQ ID NO: 2155755 - RNA, 21 nt, Human
gaacugaacaccauugaaggc

SEQ ID NO: 2155756 - RNA, 22 nt, Human
gaacugaacaccauugaaggcu

SEQ ID NO: 2155757 - RNA, 23 nt, Human
gaacugaacaccauugaaggcuu

SEQ ID NO: 2155758 - RNA, 17 nt, Human
gaacuggagccaugggc

SEQ ID NO: 2155759 - RNA, 18 nt, Human
gaacuggagccaugggca

SEQ ID NO: 2155760 - RNA, 21 nt, Human
gagugcaagccccugcuccag

SEQ ID NO: 2155761 - RNA, 23 nt, Human
gaggugaacaagcaaacccagac

SEQ ID NO: 2155762 - RNA, 14 nt, Human
gaggcauaaagacu

SEQ ID NO: 2155763 - RNA, 19 nt, Human
gauucuucccauucuccau

SEQ ID NO: 2155764 - RNA, 16 nt, Human
gauuuagauaugcaaa

SEQ ID NO: 2155765 - RNA, 12 nt, Human
gauggacagacu

SEQ ID NO: 2155766 - RNA, 13 nt, Human
gcaagucaggguu

SEQ ID NO: 2155767 - RNA, 20 nt, Human
cuuuuacugaagccuuucuu

SEQ ID NO: 2155768 - RNA, 21 nt, Human
cuuuggggcuuuuacaccagu

SEQ ID NO: 2155769 - RNA, 20 nt, Human
cuuuggggcuuuuacaccag

SEQ ID NO: 2155770 - RNA, 16 nt, Human
cuuuuagcaguaaaau

SEQ ID NO: 2155771 - RNA, 17 nt, Human
cuuuuauuucuuaaaca

SEQ ID NO: 2155772 - RNA, 20 nt, Human
cuuuuagggagcuggucuga

SEQ ID NO: 2155773 - RNA, 23 nt, Human
cuuucuccuuuguacuuugugcu

SEQ ID NO: 2155774 - RNA, 15 nt, Human
cuuugagguugcuuu

SEQ ID NO: 2155775 - RNA, 17 nt, Human
cuuugagguugcuuugu

SEQ ID NO: 2155776 - RNA, 12 nt, Human
cuuuaauauaaa

SEQ ID NO: 2155777 - RNA, 22 nt, Human
cuuuacaagauggguccaggau

SEQ ID NO: 2155778 - RNA, 17 nt, Human
cuugacagaacacuguc

SEQ ID NO: 2155779 - RNA, 16 nt, Human
cuugacagaacacugu

SEQ ID NO: 2155780 - RNA, 14 nt, Human
cuugacagaacacu

SEQ ID NO: 2155781 - RNA, 11 nt, Human
cuugaagucag

SEQ ID NO: 2155782 - RNA, 14 nt, Human
cuuccaugugaggg

SEQ ID NO: 2155783 - RNA, 14 nt, Human
cuucaccucugcua

SEQ ID NO: 2155784 - RNA, 16 nt, Human
cuucaccuccuuucaa

SEQ ID NO: 2155785 - RNA, 18 nt, Human
cuucacuguccuccaagc

SEQ ID NO: 2155786 - RNA, 21 nt, Human
cuucacuguccuccaagccag

SEQ ID NO: 2155787 - RNA, 19 nt, Human
cuucacugugaccuugaga

SEQ ID NO: 2155788 - RNA, 19 nt, Human
cuuauuaaauggaaacuga

SEQ ID NO: 2155789 - RNA, 19 nt, Human
cugugucugaguggcuuca

SEQ ID NO: 2155790 - RNA, 18 nt, Human
cugugaccuugagaagau

SEQ ID NO: 2155791 - RNA, 18 nt, Human
cugugucugaguggcuuc

SEQ ID NO: 2155792 - RNA, 15 nt, Human
cugugucugaguggc

SEQ ID NO: 2155793 - RNA, 11 nt, Human
cuuaaaaugau

SEQ ID NO: 2155794 - RNA, 11 nt, Human
cuuacacccac

SEQ ID NO: 2155795 - RNA, 20 nt, Human
cuuacacccacaguggaaag

SEQ ID NO: 2155796 - RNA, 20 nt, Human
cugggccauguugugccucc

SEQ ID NO: 2155797 - RNA, 19 nt, Human
cugggccauguugugccuc

SEQ ID NO: 2155798 - RNA, 17 nt, Human
cugggcccacaaaggca

SEQ ID NO: 2155799 - RNA, 19 nt, Human
cugggugacagagcaagac

SEQ ID NO: 2155800 - RNA, 14 nt, Human
cugcuuaaugaaaa

SEQ ID NO: 2155801 - RNA, 17 nt, Human
cugcaccguacugugga

SEQ ID NO: 2155802 - RNA, 14 nt, Human
cugaugacuugcuu

SEQ ID NO: 2155803 - RNA, 23 nt, Human
cugaugacucaagauucccagga

SEQ ID NO: 2155804 - RNA, 22 nt, Human
cugaugacucaagauucccagg

SEQ ID NO: 2155805 - RNA, 20 nt, Human
cugaugacucaagauuccca

SEQ ID NO: 2155806 - RNA, 18 nt, Human
cugaugacucaagauucc

SEQ ID NO: 2155807 - RNA, 15 nt, Human
cugaugacucaagau

SEQ ID NO: 2155808 - RNA, 14 nt, Human
cugaugacucaaga

SEQ ID NO: 2155809 - RNA, 18 nt, Human
cugcaggccaggccagcu

SEQ ID NO: 2155810 - RNA, 23 nt, Human
cugcaggccaggccagcugccuc

SEQ ID NO: 2155811 - RNA, 17 nt, Human
cugcaggccaggccagc

SEQ ID NO: 2155812 - RNA, 23 nt, Human
cugcccccgcauccccugccucc

SEQ ID NO: 2155813 - RNA, 22 nt, Human
cugcccccgcauccccugccuc

SEQ ID NO: 2155814 - RNA, 21 nt, Human
cugcccccgcauccccugccu

SEQ ID NO: 2155815 - RNA, 20 nt, Human
cugcccccgcauccccugcc

SEQ ID NO: 2155816 - RNA, 18 nt, Human
cugcccccgcauccccug

SEQ ID NO: 2155817 - RNA, 16 nt, Human
cugcccccgcaucccc

SEQ ID NO: 2155818 - RNA, 15 nt, Human
cugcccccgcauccc

SEQ ID NO: 2155819 - RNA, 14 nt, Human
cugcccccgcaucc

SEQ ID NO: 2155820 - RNA, 11 nt, Human
cugccagggcc

SEQ ID NO: 2155821 - RNA, 22 nt, Human
caauugcuuugucauauagcug

SEQ ID NO: 2155822 - RNA, 22 nt, Human
caauauuuuccaugaaaaugca

SEQ ID NO: 2155823 - RNA, 20 nt, Human
caauauuuuccaugaaaaug

SEQ ID NO: 2155824 - RNA, 19 nt, Human
caauauuuuccaugaaaau

SEQ ID NO: 2155825 - RNA, 16 nt, Human
caauauuuuccaugaa

SEQ ID NO: 2155826 - RNA, 15 nt, Human
caauauuuuccauga

SEQ ID NO: 2155827 - RNA, 13 nt, Human
caauauuuuccau

SEQ ID NO: 2155828 - RNA, 11 nt, Human
caauauuuucc

SEQ ID NO: 2155829 - RNA, 17 nt, Human
caauuucaaauuacucu

SEQ ID NO: 2155830 - RNA, 16 nt, Human
caaggcccagaugugg

SEQ ID NO: 2155831 - RNA, 23 nt, Human
caaggccauccuucccugucugc

SEQ ID NO: 2155832 - RNA, 17 nt, Human
caaggccauccuucccu

SEQ ID NO: 2155833 - RNA, 15 nt, Human
caaggccauccuucc

SEQ ID NO: 2155834 - RNA, 14 nt, Human
caagcaagacugag

SEQ ID NO: 2155835 - RNA, 13 nt, Human
caagcaagacuga

SEQ ID NO: 2155836 - RNA, 17 nt, Human
caagcaaacccagacgg

SEQ ID NO: 2155837 - RNA, 14 nt, Human
caagcaaacccaga

SEQ ID NO: 2155838 - RNA, 19 nt, Human
cacccugaggccucuggaa

SEQ ID NO: 2155839 - RNA, 23 nt, Human
caccugccacccugggccuggca

SEQ ID NO: 2155840 - RNA, 18 nt, Human
cacgcuuucagcgaauga

SEQ ID NO: 2155841 - RNA, 16 nt, Human
auuuaaguaacuuuaa

SEQ ID NO: 2155842 - RNA, 21 nt, Human
auuucaauuuccaagagcuga

SEQ ID NO: 2155843 - RNA, 23 nt, Human
auuucaccacucaaaggccagac

SEQ ID NO: 2155844 - RNA, 21 nt, Human
auuucaccacucaaaggccag

SEQ ID NO: 2155845 - RNA, 18 nt, Human
auuucucuuucuuuacaa

SEQ ID NO: 2155846 - RNA, 16 nt, Human
auuucucuuucuuuac

SEQ ID NO: 2155847 - RNA, 21 nt, Human
auuucuuaaacaaauguauga

SEQ ID NO: 2155848 - RNA, 13 nt, Human
auuucuuaaacaa

SEQ ID NO: 2155849 - RNA, 15 nt, Human
auuuuuuuuaaacaa

SEQ ID NO: 2155850 - RNA, 12 nt, Human
auuuuuauccau

SEQ ID NO: 2155851 - RNA, 18 nt, Human
caaacaugugguuaaugc

SEQ ID NO: 2155852 - RNA, 12 nt, Human
auuuguuaaugg

SEQ ID NO: 2155853 - RNA, 13 nt, Human
auuuuauaaacaa

SEQ ID NO: 2155854 - RNA, 19 nt, Human
auugagcugcagaaacgaa

SEQ ID NO: 2155855 - RNA, 17 nt, Human
auugagcugcagaaacg

SEQ ID NO: 2155856 - RNA, 14 nt, Human
auucgcuugagaaa

SEQ ID NO: 2155857 - RNA, 18 nt, Human
auuagaucuucaaacaga

SEQ ID NO: 2155858 - RNA, 19 nt, Human
auuagaucuucaaacagaa

SEQ ID NO: 2155859 - RNA, 20 nt, Human
auuagaucuucaaacagaau

SEQ ID NO: 2155860 - RNA, 21 nt, Human
auucaauaaaaaaaagaaaug

SEQ ID NO: 2155861 - RNA, 18 nt, Human
auucaauaaaaaaaagaa

SEQ ID NO: 2155862 - RNA, 12 nt, Human
auucaauaaaaa

SEQ ID NO: 2155863 - RNA, 22 nt, Human
auucaauaaaaaaaagaaauga

SEQ ID NO: 2155864 - RNA, 17 nt, Human
auucauauugaauauaa

SEQ ID NO: 2155865 - RNA, 14 nt, Human
auucauauugaaua

SEQ ID NO: 2155866 - RNA, 13 nt, Human
auucauauugaau

SEQ ID NO: 2155867 - RNA, 11 nt, Human
auuaacacugc

SEQ ID NO: 2155868 - RNA, 16 nt, Human
auuacagggcacaggc

SEQ ID NO: 2155869 - RNA, 15 nt, Human
auuacagggcacagg

SEQ ID NO: 2155870 - RNA, 15 nt, Human
cagccaggccccagg

SEQ ID NO: 2155871 - RNA, 16 nt, Human
cagacuguugucccug

SEQ ID NO: 2155872 - RNA, 18 nt, Human
cagacuguugucccugca

SEQ ID NO: 2155873 - RNA, 16 nt, Human
cagacugaucaggacc

SEQ ID NO: 2155874 - RNA, 17 nt, Human
cagacugaucaggaccu

SEQ ID NO: 2155875 - RNA, 22 nt, Human
cagacugaccuugaugagcugu

SEQ ID NO: 2155876 - RNA, 13 nt, Human
cagacugaccuug

SEQ ID NO: 2155877 - RNA, 22 nt, Human
cagacucgauucauauugaaua

SEQ ID NO: 2155878 - RNA, 23 nt, Human
cagacuccugacugucucccggg

SEQ ID NO: 2155879 - RNA, 16 nt, Human
caggccuuaucuccaa

SEQ ID NO: 2155880 - RNA, 17 nt, Human
caggccuuaucuccaag

SEQ ID NO: 2155881 - RNA, 22 nt, Human
caggccuuaucuccaagaccag

SEQ ID NO: 2155882 - RNA, 23 nt, Human
cagggcuuacggcccuggccuug

SEQ ID NO: 2155883 - RNA, 20 nt, Human
cagggcuuacggcccuggcc

SEQ ID NO: 2155884 - RNA, 18 nt, Human
cagggcuuacggcccugg

SEQ ID NO: 2155885 - RNA, 16 nt, Human
cagggcuuacggcccu

SEQ ID NO: 2155886 - RNA, 19 nt, Human
cagggagcauuuuccucca

SEQ ID NO: 2155887 - RNA, 21 nt, Human
cagggagcaggcggugggcac

SEQ ID NO: 2155888 - RNA, 20 nt, Human
cagggagaccuggacacagg

SEQ ID NO: 2155889 - RNA, 21 nt, Human
cagggagaccuggacacaggc

SEQ ID NO: 2155890 - RNA, 14 nt, Human
caggccaggccagc

SEQ ID NO: 2155891 - RNA, 23 nt, Human
caggaccuccaagccacugagca

SEQ ID NO: 2155892 - RNA, 20 nt, Human
caggaccuccaagccacuga

SEQ ID NO: 2155893 - RNA, 19 nt, Human
caggaccuccaagccacug

SEQ ID NO: 2155894 - RNA, 17 nt, Human
caggaccuccaagccac

SEQ ID NO: 2155895 - RNA, 24 nt, Human
caguuugaaugcagucuguccagg

SEQ ID NO: 2155896 - RNA, 20 nt, Human
caucagcuaaacaccacguc

SEQ ID NO: 2155897 - RNA, 18 nt, Human
caucagcuaaacaccacg

SEQ ID NO: 2155898 - RNA, 12 nt, Human
cauccugcaggc

SEQ ID NO: 2155899 - RNA, 22 nt, Human
caucguuuucuucacuguccuc

SEQ ID NO: 2155900 - RNA, 17 nt, Human
caucugguuaggauggc

SEQ ID NO: 2155901 - RNA, 16 nt, Human
cagucuauuugagacu

SEQ ID NO: 2155902 - RNA, 15 nt, Human
cagugcaacacugaa

SEQ ID NO: 2155903 - RNA, 22 nt, Human
caguucauguauguucagaaga

SEQ ID NO: 2155904 - RNA, 20 nt, Human
cauugggugagguaauaaac

SEQ ID NO: 2155905 - RNA, 23 nt, Human
ccaaaaaagcuguauuuugaaaa

SEQ ID NO: 2155906 - RNA, 20 nt, Human
ccaaaaaagcuguauuuuga

SEQ ID NO: 2155907 - RNA, 22 nt, Human
ccaaaaaagcuguauuuugaaa

SEQ ID NO: 2155908 - RNA, 14 nt, Human
ccaaaagcugcuca

SEQ ID NO: 2155909 - RNA, 23 nt, Human
ccaaggagaugaagcaaacacau

SEQ ID NO: 2155910 - RNA, 14 nt, Human
ccaaggagaugaag

SEQ ID NO: 2155911 - RNA, 20 nt, Human
ccaaggagggugagugcaag

SEQ ID NO: 2155912 - RNA, 11 nt, Human
ccaauucuuac

SEQ ID NO: 2155913 - RNA, 14 nt, Human
ccaacucagaaggg

SEQ ID NO: 2155914 - RNA, 14 nt, Human
cauguucugcuuuc

SEQ ID NO: 2155915 - RNA, 16 nt, Human
caugggaaggugggcg

SEQ ID NO: 2155916 - RNA, 18 nt, Human
ccucgaauuuuguuuucu

SEQ ID NO: 2155917 - RNA, 13 nt, Human
ccucgaauuuugu

SEQ ID NO: 2155918 - RNA, 16 nt, Human
ccuccuacccugcgcc

SEQ ID NO: 2155919 - RNA, 20 nt, Human
ccucccuggugagagggccg

SEQ ID NO: 2155920 - RNA, 13 nt, Human
ccucccacugggg

SEQ ID NO: 2155921 - RNA, 15 nt, Human
ccucccacugggguc

SEQ ID NO: 2155922 - RNA, 21 nt, Human
ccggcccuccuacccugcgcc

SEQ ID NO: 2155923 - RNA, 15 nt, Human
cccugcccuccccuc

SEQ ID NO: 2155924 - RNA, 14 nt, Human
cccugcccuccccu

SEQ ID NO: 2155925 - RNA, 12 nt, Human
cccugacccugu

SEQ ID NO: 2155926 - RNA, 19 nt, Human
cccugacccuguggaagca

SEQ ID NO: 2155927 - RNA, 15 nt, Human
cccugacccugugga

SEQ ID NO: 2155928 - RNA, 16 nt, Human
cccugacccuguauau

SEQ ID NO: 2155929 - RNA, 18 nt, Human
cccuccuacccugcgccc

SEQ ID NO: 2155930 - RNA, 17 nt, Human
cccuccuacccugcgcc

SEQ ID NO: 2155931 - RNA, 23 nt, Human
cccucgcuuggacggcugggcac

SEQ ID NO: 2155932 - RNA, 21 nt, Human
cccucgcuuggacggcugggc

SEQ ID NO: 2155933 - RNA, 21 nt, Human
ccagaccugcagacgcccaga

SEQ ID NO: 2155934 - RNA, 20 nt, Human
ccagaccugcagacgcccag

SEQ ID NO: 2155935 - RNA, 16 nt, Human
ccagaccugcagacgc

SEQ ID NO: 2155936 - RNA, 14 nt, Human
ccagaccugcagac

SEQ ID NO: 2155937 - RNA, 20 nt, Human
ccagacggcuccacuaggac

SEQ ID NO: 2155938 - RNA, 15 nt, Human
ccagacggcuccacu

SEQ ID NO: 2155939 - RNA, 16 nt, Human
ccagagaaagcgcaga

SEQ ID NO: 2155940 - RNA, 21 nt, Human
ccagacuccugacugucuccc

SEQ ID NO: 2155941 - RNA, 20 nt, Human
ccagacuccugacugucucc

SEQ ID NO: 2155942 - RNA, 23 nt, Human
ccagaucuacuugguugucaagu

SEQ ID NO: 2155943 - RNA, 17 nt, Human
ccagcgggaauggcagc

SEQ ID NO: 2155944 - RNA, 23 nt, Human
ccagcgggaauggcagcugccac

SEQ ID NO: 2155945 - RNA, 21 nt, Human
ccagcggacaguggcaggaca

SEQ ID NO: 2155946 - RNA, 19 nt, Human
ccagcggacaguggcagga

SEQ ID NO: 2155947 - RNA, 18 nt, Human
ccagcggacaguggcagg

SEQ ID NO: 2155948 - RNA, 17 nt, Human
ccagcggacaguggcag

SEQ ID NO: 2155949 - RNA, 16 nt, Human
ccagcggacaguggca

SEQ ID NO: 2155950 - RNA, 15 nt, Human
ccagcggacaguggc

SEQ ID NO: 2155951 - RNA, 17 nt, Human
ccaggaguucugcucau

SEQ ID NO: 2155952 - RNA, 16 nt, Human
ccaggaguucugcuca

SEQ ID NO: 2155953 - RNA, 15 nt, Human
ccaggaguucugcuc

SEQ ID NO: 2155954 - RNA, 23 nt, Human
ccaggcagggccaacccuucucc

SEQ ID NO: 2155955 - RNA, 19 nt, Human
ccaggcagggccaacccuu

SEQ ID NO: 2155956 - RNA, 17 nt, Human
ccaguccuuccaccucg

SEQ ID NO: 2155957 - RNA, 13 nt, Human
ccaguccuuccac

SEQ ID NO: 2155958 - RNA, 21 nt, Human
ccaugugaaaaggcaaaaagc

SEQ ID NO: 2155959 - RNA, 20 nt, Human
ccaugagauagcauuagcug

SEQ ID NO: 2155960 - RNA, 21 nt, Human
ccaugggcacaaagggcccag

SEQ ID NO: 2155961 - RNA, 14 nt, Human
cccacccugggacc

SEQ ID NO: 2155962 - RNA, 15 nt, Human
ccauuuaaaaacagg

SEQ ID NO: 2155963 - RNA, 14 nt, Human
cccaagcagagaag

SEQ ID NO: 2155964 - RNA, 15 nt, Human
ccccauucuuuugua

SEQ ID NO: 2155965 - RNA, 11 nt, Human
cccccuuccac

SEQ ID NO: 2155966 - RNA, 16 nt, Human
ccccgcauccccugcc

SEQ ID NO: 2155967 - RNA, 19 nt, Human
ccccgcauccccugccucc

SEQ ID NO: 2155968 - RNA, 17 nt, Human
ccccgcauccccugccu

SEQ ID NO: 2155969 - RNA, 21 nt, Human
ccccgcccccugcccuccccu

SEQ ID NO: 2155970 - RNA, 18 nt, Human
ccccgcccccugcccucc

SEQ ID NO: 2155971 - RNA, 17 nt, Human
ccccgcccccugcccuc

SEQ ID NO: 2155972 - RNA, 13 nt, Human
ccccgcccccugc

SEQ ID NO: 2155973 - RNA, 22 nt, Human
cccauucuuuuguaauuuaaau

SEQ ID NO: 2155974 - RNA, 21 nt, Human
cccauucuuuuguaauuuaaa

SEQ ID NO: 2155975 - RNA, 20 nt, Human
cccauucuuuuguaauuuaa

SEQ ID NO: 2155976 - RNA, 17 nt, Human
cccauucuuuuguaauu

SEQ ID NO: 2155977 - RNA, 14 nt, Human
cccauucuuuugua

SEQ ID NO: 2155978 - RNA, 23 nt, Human
cggugggcacccacccugggacc

SEQ ID NO: 2155979 - RNA, 19 nt, Human
cggugggcacccacccugg

SEQ ID NO: 2155980 - RNA, 18 nt, Human
cggugggcacccacccug

SEQ ID NO: 2155981 - RNA, 15 nt, Human
cggugggcacccacc

SEQ ID NO: 2155982 - RNA, 20 nt, Human
cgguggcucacgccuguaau

SEQ ID NO: 2155983 - RNA, 14 nt, Human
cgugaucaaagcca

SEQ ID NO: 2155984 - RNA, 18 nt, Human
cgugaucaaagccacacu

SEQ ID NO: 2155985 - RNA, 21 nt, Human
cgugaucaaagccacacucug

SEQ ID NO: 2155986 - RNA, 19 nt, Human
ccuuaugcuucuuucaaau

SEQ ID NO: 2155987 - RNA, 16 nt, Human
ccuuaucuccaagacc

SEQ ID NO: 2155988 - RNA, 22 nt, Human
ccuuaucuccaagaccagagau

SEQ ID NO: 2155989 - RNA, 16 nt, Human
ccuuucaaagccauuu

SEQ ID NO: 2155990 - RNA, 18 nt, Human
ccuucccugucugccagg

SEQ ID NO: 2155991 - RNA, 16 nt, Human
cucccccuagccauuu

SEQ ID NO: 2155992 - RNA, 23 nt, Human
cucccacugggguccagggagca

SEQ ID NO: 2155993 - RNA, 21 nt, Human
cuccggcccuccuacccugcg

SEQ ID NO: 2155994 - RNA, 18 nt, Human
cuccuacccugcgcccag

SEQ ID NO: 2155995 - RNA, 15 nt, Human
cuccuacccugcgcc

SEQ ID NO: 2155996 - RNA, 14 nt, Human
cuccuggcccaggu

SEQ ID NO: 2155997 - RNA, 12 nt, Human
cuccuggcccag

SEQ ID NO: 2155998 - RNA, 19 nt, Human
cucugcagggccgccaggg

SEQ ID NO: 2155999 - RNA, 13 nt, Human
cucugcagggccg

SEQ ID NO: 2156000 - RNA, 20 nt, Human
cuccuuuguacuuugugcuu

SEQ ID NO: 2156001 - RNA, 17 nt, Human
cuccuuuguacuuugug

SEQ ID NO: 2156002 - RNA, 14 nt, Human
cuccuuuguacuuu

SEQ ID NO: 2156003 - RNA, 13 nt, Human
cuccuuuguacuu

SEQ ID NO: 2156004 - RNA, 21 nt, Human
cucuccccucagagugcaagc

SEQ ID NO: 2156005 - RNA, 20 nt, Human
cucucccugacccuguauau

SEQ ID NO: 2156006 - RNA, 14 nt, Human
cucucccugacccu

SEQ ID NO: 2156007 - RNA, 13 nt, Human
cucucccugaccc

SEQ ID NO: 2156008 - RNA, 12 nt, Human
cucucccugacc

SEQ ID NO: 2156009 - RNA, 20 nt, Human
cucagggaaaagcagcucuc

SEQ ID NO: 2156010 - RNA, 22 nt, Human
cucagggaaaagcagcucuccc

SEQ ID NO: 2156011 - RNA, 17 nt, Human
cucagggaaaagcagcu

SEQ ID NO: 2156012 - RNA, 23 nt, Human
cucagggaaaagcagcucucccc

SEQ ID NO: 2156013 - RNA, 18 nt, Human
cucaggccucugugccgc

SEQ ID NO: 2156014 - RNA, 13 nt, Human
cucaggccucugu

SEQ ID NO: 2156015 - RNA, 16 nt, Human
cucagaccagcucuuc

SEQ ID NO: 2156016 - RNA, 14 nt, Human
cucagaccagcucu

SEQ ID NO: 2156017 - RNA, 15 nt, Human
cucagaccagcucuu

SEQ ID NO: 2156018 - RNA, 16 nt, Human
cuacaaaaauuaacug

SEQ ID NO: 2156019 - RNA, 13 nt, Human
cuaugucuuguuu

SEQ ID NO: 2156020 - RNA, 13 nt, Human
cucaauauuuucc

SEQ ID NO: 2156021 - RNA, 19 nt, Human
cucaauauuuuccaugaaa

SEQ ID NO: 2156022 - RNA, 18 nt, Human
cucaauauuuuccaugaa

SEQ ID NO: 2156023 - RNA, 22 nt, Human
cucaauauuuuccaugaaaaug

SEQ ID NO: 2156024 - RNA, 12 nt, Human
agugaauauuca

SEQ ID NO: 2156025 - RNA, 18 nt, Human
agugaauaacugcaaagu

SEQ ID NO: 2156026 - RNA, 15 nt, Human
agucuguccaggcuc

SEQ ID NO: 2156027 - RNA, 12 nt, Human
aguccucugaau

SEQ ID NO: 2156028 - RNA, 14 nt, Human
aguccucugaauga

SEQ ID NO: 2156029 - RNA, 13 nt, Human
aggggccagaaga

SEQ ID NO: 2156030 - RNA, 17 nt, Human
aggggccagaagaugaa

SEQ ID NO: 2156031 - RNA, 20 nt, Human
aguaacccccacuggacuga

SEQ ID NO: 2156032 - RNA, 19 nt, Human
auaaaaaaaagaaaugaaa

SEQ ID NO: 2156033 - RNA, 17 nt, Human
auaaaaaaaagaaauga

SEQ ID NO: 2156034 - RNA, 21 nt, Human
auaagcuaacaccagacagac

SEQ ID NO: 2156035 - RNA, 15 nt, Human
auacuguugugcgca

SEQ ID NO: 2156036 - RNA, 17 nt, Human
auacugucucuuucaug

SEQ ID NO: 2156037 - RNA, 18 nt, Human
augagcugugcacaaagu

SEQ ID NO: 2156038 - RNA, 22 nt, Human
augagcugugcacaaaguggca

SEQ ID NO: 2156039 - RNA, 18 nt, Human
augaccuucuaggaagcu

SEQ ID NO: 2156040 - RNA, 17 nt, Human
augaccuucuaggaagc

SEQ ID NO: 2156041 - RNA, 22 nt, Human
augcuuucugaagcuuuaccag

SEQ ID NO: 2156042 - RNA, 22 nt, Human
augggacaaaguuccaaaaugc

SEQ ID NO: 2156043 - RNA, 19 nt, Human
aucccccccaccucucccu

SEQ ID NO: 2156044 - RNA, 17 nt, Human
auccuuccucacaccag

SEQ ID NO: 2156045 - RNA, 13 nt, Human
auccuuuuuuaaa

SEQ ID NO: 2156046 - RNA, 16 nt, Human
auccuuuuuuaaaagu

SEQ ID NO: 2156047 - RNA, 22 nt, Human
auccuuuuuuaaaaguaaaugu

SEQ ID NO: 2156048 - RNA, 22 nt, Human
auccacuucuuucagcagacug

SEQ ID NO: 2156049 - RNA, 14 nt, Human
auccacuucuuuca

SEQ ID NO: 2156050 - RNA, 17 nt, Human
aucaugaccagcaaaua

SEQ ID NO: 2156051 - RNA, 21 nt, Human
agaugggugaaggcuggcaug

SEQ ID NO: 2156052 - RNA, 17 nt, Human
agaugggugaaggcugg

SEQ ID NO: 2156053 - RNA, 17 nt, Human
agaucucugcagggccg

SEQ ID NO: 2156054 - RNA, 16 nt, Human
agaucucugcagggcc

SEQ ID NO: 2156055 - RNA, 13 nt, Human
agcccaaagaagg

SEQ ID NO: 2156056 - RNA, 15 nt, Human
agccauuuuuacugu

SEQ ID NO: 2156057 - RNA, 19 nt, Human
agaagggagcuagccagag

SEQ ID NO: 2156058 - RNA, 18 nt, Human
agaagggagcuagccaga

SEQ ID NO: 2156059 - RNA, 13 nt, Human
agaagagccacag

SEQ ID NO: 2156060 - RNA, 11 nt, Human
agaagagccac

SEQ ID NO: 2156061 - RNA, 22 nt, Human
agaagagccacagugagggaga

SEQ ID NO: 2156062 - RNA, 14 nt, Human
agaagagccacagu

SEQ ID NO: 2156063 - RNA, 19 nt, Human
agaacauugguauucgcuu

SEQ ID NO: 2156064 - RNA, 13 nt, Human
agaaucucuuucg

SEQ ID NO: 2156065 - RNA, 21 nt, Human
agaacaauauugacuuugucu

SEQ ID NO: 2156066 - RNA, 20 nt, Human
agaacaauauugacuuuguc

SEQ ID NO: 2156067 - RNA, 16 nt, Human
agaacacaaggucauu

SEQ ID NO: 2156068 - RNA, 19 nt, Human
agaacaauauugacuuugu

SEQ ID NO: 2156069 - RNA, 17 nt, Human
agaacaauauugacuuu

SEQ ID NO: 2156070 - RNA, 11 nt, Human
agaacacuggu

SEQ ID NO: 2156071 - RNA, 19 nt, Human
agaacauguagaaaacaaa

SEQ ID NO: 2156072 - RNA, 18 nt, Human
agaacauguagaaaacaa

SEQ ID NO: 2156073 - RNA, 17 nt, Human
agaacauguagaaaaca

SEQ ID NO: 2156074 - RNA, 14 nt, Human
agaacauguagaaa

SEQ ID NO: 2156075 - RNA, 17 nt, Human
agaacauaaagcaaaua

SEQ ID NO: 2156076 - RNA, 16 nt, Human
agaacauaaagcaaau

SEQ ID NO: 2156077 - RNA, 14 nt, Human
agaacauaaagcaa

SEQ ID NO: 2156078 - RNA, 22 nt, Human
agagaggcagaagaacccuggc

SEQ ID NO: 2156079 - RNA, 15 nt, Human
agagaggcaauggcu

SEQ ID NO: 2156080 - RNA, 17 nt, Human
agacuauauuguacaca

SEQ ID NO: 2156081 - RNA, 16 nt, Human
agaccuuucaaagcca

SEQ ID NO: 2156082 - RNA, 19 nt, Human
agaccuuuuaacuccucaa

SEQ ID NO: 2156083 - RNA, 19 nt, Human
agaccuuucaaagccauuu

SEQ ID NO: 2156084 - RNA, 21 nt, Human
aggaugguaauucuuauucuu

SEQ ID NO: 2156085 - RNA, 18 nt, Human
aggagacaggcagagcug

SEQ ID NO: 2156086 - RNA, 13 nt, Human
aggagacaggcag

SEQ ID NO: 2156087 - RNA, 14 nt, Human
aggagacccacagg

SEQ ID NO: 2156088 - RNA, 23 nt, Human
aggaguucagggucauagcaugc

SEQ ID NO: 2156089 - RNA, 22 nt, Human
aggauggcaggacgugggcugg

SEQ ID NO: 2156090 - RNA, 15 nt, Human
aggauggcaggacgu

SEQ ID NO: 2156091 - RNA, 15 nt, Human
aggaguucugcucau

SEQ ID NO: 2156092 - RNA, 14 nt, Human
aggaguucugcuca

SEQ ID NO: 2156093 - RNA, 19 nt, Human
agggaucuauacuugcuuu

SEQ ID NO: 2156094 - RNA, 18 nt, Human
agggaucuauacuugcuu

SEQ ID NO: 2156095 - RNA, 13 nt, Human
aggggcaugggaa

SEQ ID NO: 2156096 - RNA, 19 nt, Human
agggcguggaaaggggcag

SEQ ID NO: 2156097 - RNA, 17 nt, Human
agggauuguuucuguuu

SEQ ID NO: 2156098 - RNA, 18 nt, Human
aggcucuguuuaugcuuu

SEQ ID NO: 2156099 - RNA, 16 nt, Human
aggcucuguuuaugcu

SEQ ID NO: 2156100 - RNA, 14 nt, Human
aggcuuacacccac

SEQ ID NO: 2156101 - RNA, 14 nt, Human
aggcuuaaacccau

SEQ ID NO: 2156102 - RNA, 22 nt, Human
agcuacaccuuucuccuuugua

SEQ ID NO: 2156103 - RNA, 21 nt, Human
agcuacaccuuucuccuuugu

SEQ ID NO: 2156104 - RNA, 15 nt, Human
agccuuucuuuugga

SEQ ID NO: 2156105 - RNA, 16 nt, Human
agcucuuggcuccacu

SEQ ID NO: 2156106 - RNA, 14 nt, Human
agcucuuugcacua

SEQ ID NO: 2156107 - RNA, 13 nt, Human
agcugacucacac

SEQ ID NO: 2156108 - RNA, 21 nt, Human
agcuggugguaucugaguuga

SEQ ID NO: 2156109 - RNA, 15 nt, Human
agcuguauuuugaaa

SEQ ID NO: 2156110 - RNA, 18 nt, Human
aggaagacccaacacaug

SEQ ID NO: 2156111 - RNA, 18 nt, Human
aggaacuugagaacuuua

SEQ ID NO: 2156112 - RNA, 21 nt, Human
aggaaaaaaaucguccaggga

SEQ ID NO: 2156113 - RNA, 22 nt, Human
aggaaaaaaaucguccagggag

SEQ ID NO: 2156114 - RNA, 18 nt, Human
acugaucaggaccuccaa

SEQ ID NO: 2156115 - RNA, 22 nt, Human
acugauuuccccuuuugcauuc

SEQ ID NO: 2156116 - RNA, 12 nt, Human
acugauuucccc

SEQ ID NO: 2156117 - RNA, 19 nt, Human
acugauuuccccuuuugca

SEQ ID NO: 2156118 - RNA, 17 nt, Human
acugauuuccccuuuug

SEQ ID NO: 2156119 - RNA, 23 nt, Human
acugauuuccccuuuugcauucu

SEQ ID NO: 2156120 - RNA, 21 nt, Human
acugauuuccccuuuugcauu

SEQ ID NO: 2156121 - RNA, 20 nt, Human
acugauuuccccuuuugcau

SEQ ID NO: 2156122 - RNA, 15 nt, Human
acuccggcccuccua

SEQ ID NO: 2156123 - RNA, 14 nt, Human
acuccggcccuccu

SEQ ID NO: 2156124 - RNA, 13 nt, Human
acuccggcccucc

SEQ ID NO: 2156125 - RNA, 23 nt, Human
acugcccagcggacaguggcagg

SEQ ID NO: 2156126 - RNA, 16 nt, Human
acugcccagcggacag

SEQ ID NO: 2156127 - RNA, 14 nt, Human
acugcccagcggac

SEQ ID NO: 2156128 - RNA, 16 nt, Human
acuucaaacugagauc

SEQ ID NO: 2156129 - RNA, 22 nt, Human
acuucuuggcuuggugaggaaa

SEQ ID NO: 2156130 - RNA, 14 nt, Human
accuguaaucccag

SEQ ID NO: 2156131 - RNA, 16 nt, Human
accuguaaucccagca

SEQ ID NO: 2156132 - RNA, 19 nt, Human
accuguaaucccagcacuu

SEQ ID NO: 2156133 - RNA, 16 nt, Human
acggacacccccucgc

SEQ ID NO: 2156134 - RNA, 15 nt, Human
acggacacccccucg

SEQ ID NO: 2156135 - RNA, 18 nt, Human
acgcaaacuuugagccuu

SEQ ID NO: 2156136 - RNA, 20 nt, Human
acccuguauauagcccagcc

SEQ ID NO: 2156137 - RNA, 18 nt, Human
acccuguauauagcccag

SEQ ID NO: 2156138 - RNA, 15 nt, Human
acccuguauauagcc

SEQ ID NO: 2156139 - RNA, 22 nt, Human
acccugggccuggcagcucagc

SEQ ID NO: 2156140 - RNA, 15 nt, Human
acccugggccuggca

SEQ ID NO: 2156141 - RNA, 12 nt, Human
acccugggaccu

SEQ ID NO: 2156142 - RNA, 23 nt, Human
acccugggaccuaggggcgccgc

SEQ ID NO: 2156143 - RNA, 16 nt, Human
acccuggccugagaag

SEQ ID NO: 2156144 - RNA, 19 nt, Human
acccuaaaaagcagagcuu

SEQ ID NO: 2156145 - RNA, 22 nt, Human
acccuaaggucauuaccacagg

SEQ ID NO: 2156146 - RNA, 21 nt, Human
acccuaauagacuaaaugaaa

SEQ ID NO: 2156147 - RNA, 17 nt, Human
accuccaagccacugag

SEQ ID NO: 2156148 - RNA, 13 nt, Human
acaggcagagcug

SEQ ID NO: 2156149 - RNA, 20 nt, Human
acaguggcaggacaggaaaa

SEQ ID NO: 2156150 - RNA, 18 nt, Human
acaguggcaggacaggaa

SEQ ID NO: 2156151 - RNA, 13 nt, Human
acaguggcaggac

SEQ ID NO: 2156152 - RNA, 12 nt, Human
acaguggcagga

SEQ ID NO: 2156153 - RNA, 23 nt, Human
acaugugguuacacagugugaau

SEQ ID NO: 2156154 - RNA, 18 nt, Human
acauccccccgccaaaag

SEQ ID NO: 2156155 - RNA, 18 nt, Human
acaugcacucagcucuug

SEQ ID NO: 2156156 - RNA, 17 nt, Human
acaugcacucagcucuu

SEQ ID NO: 2156157 - RNA, 14 nt, Human
aauucuaacuuuuu

SEQ ID NO: 2156158 - RNA, 14 nt, Human
aauuaucuaauuua

SEQ ID NO: 2156159 - RNA, 15 nt, Human
aauuaucuaauuuau

SEQ ID NO: 2156160 - RNA, 18 nt, Human
aauuaucuaauuuauaaa

SEQ ID NO: 2156161 - RNA, 19 nt, Human
aauuaucuaauuuauaaaa

SEQ ID NO: 2156162 - RNA, 19 nt, Human
acaaacaugugguuaaugc

SEQ ID NO: 2156163 - RNA, 14 nt, Human
acaaacauaagugc

SEQ ID NO: 2156164 - RNA, 16 nt, Human
acaaacaaacaaacaa

SEQ ID NO: 2156165 - RNA, 22 nt, Human
acaacauguauaauauuuuuaa

SEQ ID NO: 2156166 - RNA, 14 nt, Human
acaacauguauaau

SEQ ID NO: 2156167 - RNA, 18 nt, Human
acaaccacauacaacaca

SEQ ID NO: 2156168 - RNA, 22 nt, Human
acaaacucucugaaccccuccc

SEQ ID NO: 2156169 - RNA, 15 nt, Human
acaaacucucugaac

SEQ ID NO: 2156170 - RNA, 18 nt, Human
acaaguggcaaccugcuu

SEQ ID NO: 2156171 - RNA, 15 nt, Human
acacgcaggagcaca

SEQ ID NO: 2156172 - RNA, 14 nt, Human
acacgcaggagcac

SEQ ID NO: 2156173 - RNA, 13 nt, Human
acacgcaggagca

SEQ ID NO: 2156174 - RNA, 11 nt, Human
aauaaagcccu

SEQ ID NO: 2156175 - RNA, 15 nt, Human
aauaaagcccuggga

SEQ ID NO: 2156176 - RNA, 16 nt, Human
aaguugggacucugga

SEQ ID NO: 2156177 - RNA, 14 nt, Human
aaguggcauaaaaa

SEQ ID NO: 2156178 - RNA, 21 nt, Human
aagugcugcggagcaagagga

SEQ ID NO: 2156179 - RNA, 19 nt, Human
aagugcugcggagcaagag

SEQ ID NO: 2156180 - RNA, 13 nt, Human
aagugcugcggag

SEQ ID NO: 2156181 - RNA, 20 nt, Human
aaucugauauguauuguuug

SEQ ID NO: 2156182 - RNA, 22 nt, Human
aaugauggcccauucuacuugc

SEQ ID NO: 2156183 - RNA, 21 nt, Human
aaugauggcccauucuacuug

SEQ ID NO: 2156184 - RNA, 20 nt, Human
aaugauggcccauucuacuu

SEQ ID NO: 2156185 - RNA, 14 nt, Human
aaugauggcccauu

SEQ ID NO: 2156186 - RNA, 13 nt, Human
aaugauggcccau

SEQ ID NO: 2156187 - RNA, 19 nt, Human
aaugaugcuauuugcaauu

SEQ ID NO: 2156188 - RNA, 12 nt, Human
aaggcaacuggg

SEQ ID NO: 2156189 - RNA, 16 nt, Human
aagacagagcugggau

SEQ ID NO: 2156190 - RNA, 15 nt, Human
aagacagagcuggga

SEQ ID NO: 2156191 - RNA, 18 nt, Human
aagagaaaaagaaaugca

SEQ ID NO: 2156192 - RNA, 17 nt, Human
aagagaaaaagaaaugc

SEQ ID NO: 2156193 - RNA, 17 nt, Human
aagaacuucuauaauug

SEQ ID NO: 2156194 - RNA, 14 nt, Human
aagacacugaaaua

SEQ ID NO: 2156195 - RNA, 21 nt, Human
aagacacugaaauauacacac

SEQ ID NO: 2156196 - RNA, 22 nt, Human
aagacacugaaauauacacaca

SEQ ID NO: 2156197 - RNA, 23 nt, Human
aagacaauggcuuacuccaggag

SEQ ID NO: 2156198 - RNA, 23 nt, Human
aagaguguggagucauucucauu

SEQ ID NO: 2156199 - RNA, 22 nt, Human
aagaguguggagucauucucau

SEQ ID NO: 2156200 - RNA, 21 nt, Human
aagaguguggagucauucuca

SEQ ID NO: 2156201 - RNA, 15 nt, Human
aagaguccucugaau

SEQ ID NO: 2156202 - RNA, 14 nt, Human
aaaugcuuuagaaa

SEQ ID NO: 2156203 - RNA, 20 nt, Human
aaauagauggauuuguauca

SEQ ID NO: 2156204 - RNA, 17 nt, Human
aaauauuuugaucuuca

SEQ ID NO: 2156205 - RNA, 23 nt, Human
aaauauuuugaucuucaacaaau

SEQ ID NO: 2156206 - RNA, 22 nt, Human
aaauauuuugaucuucaacaaa

SEQ ID NO: 2156207 - RNA, 22 nt, Human
aacaugguaaacgcugucccua

SEQ ID NO: 2156208 - RNA, 18 nt, Human
aacagccacuacauuacu

SEQ ID NO: 2156209 - RNA, 15 nt, Human
aacaugaacaaauuu

SEQ ID NO: 2156210 - RNA, 16 nt, Human
aaagccauuuuaggcu

SEQ ID NO: 2156211 - RNA, 15 nt, Human
aaaaucuauauuuug

SEQ ID NO: 2156212 - RNA, 13 nt, Human
aaaacaggcagcu

SEQ ID NO: 2156213 - RNA, 12 nt, Human
aaaacagguaga

SEQ ID NO: 2156214 - RNA, 17 nt, Human
aaaacagguagaauuau

SEQ ID NO: 2156215 - RNA, 17 nt, Human
aaaacuuuuuauauuuu

SEQ ID NO: 2156216 - RNA, 20 nt, Human
aaaacuuuuuauauuuuaua

SEQ ID NO: 2156217 - RNA, 12 nt, Human
aaaagaaaugaa

SEQ ID NO: 2156218 - RNA, 17 nt, Human
aaaagaacaauauugac

SEQ ID NO: 2156219 - RNA, 13 nt, Human
aaaagacagggcu

SEQ ID NO: 2156220 - RNA, 22 nt, Human
aaaagucauaaaauguaucuuc

SEQ ID NO: 2156221 - RNA, 21 nt, Human
cauuuuucagaccuuuuaacu

SEQ ID NO: 2156222 - RNA, 23 nt, Human
cauuuuaggaaaaaaaaaagcau

SEQ ID NO: 2156223 - RNA, 18 nt, Human
cauuuguuuguuuuccuu

SEQ ID NO: 2156224 - RNA, 16 nt, Human
cauuuguuuguuuucc

SEQ ID NO: 2156225 - RNA, 19 nt, Human
cauuuuguaacaaaugaac

SEQ ID NO: 2156226 - RNA, 20 nt, Human
cauuugcuaacuagcuugga

SEQ ID NO: 2156227 - RNA, 15 nt, Human
cauuguauuagaucu

SEQ ID NO: 2156228 - RNA, 13 nt, Human
ccaacacgcagga

SEQ ID NO: 2156229 - RNA, 15 nt, Human
ccaagcaagacugag

SEQ ID NO: 2156230 - RNA, 12 nt, Human
ccaagccacuga

SEQ ID NO: 2156231 - RNA, 19 nt, Human
ccacagggcaccugccacc

SEQ ID NO: 2156232 - RNA, 11 nt, Human
ccacagggcac

SEQ ID NO: 2156233 - RNA, 15 nt, Human
ccacucaaaggccag

SEQ ID NO: 2156234 - RNA, 14 nt, Human
ccacucaaaggcca

SEQ ID NO: 2156235 - RNA, 17 nt, Human
ccagacagacaacacug

SEQ ID NO: 2156236 - RNA, 20 nt, Human
ccagaagaugaacagacuga

SEQ ID NO: 2156237 - RNA, 19 nt, Human
ccagaagaugaacagacug

SEQ ID NO: 2156238 - RNA, 23 nt, Human
ccagaagaugaacagacugaccu

SEQ ID NO: 2156239 - RNA, 22 nt, Human
ccagaagauagcuucaccccaa

SEQ ID NO: 2156240 - RNA, 18 nt, Human
ccagaagaugaacagacu

SEQ ID NO: 2156241 - RNA, 24 nt, Human
ccagaaacuguucccaccugcugg

SEQ ID NO: 2156242 - RNA, 12 nt, Human
ccagcugccucc

SEQ ID NO: 2156243 - RNA, 22 nt, Human
ccaguauaaaacaccuaaauaa

SEQ ID NO: 2156244 - RNA, 18 nt, Human
ccaggugcaaccagggag

SEQ ID NO: 2156245 - RNA, 21 nt, Human
ccaggugaguccuagagcuac

SEQ ID NO: 2156246 - RNA, 17 nt, Human
ccaggcuugccugcagg

SEQ ID NO: 2156247 - RNA, 18 nt, Human
ccaggcuugccugcaggc

SEQ ID NO: 2156248 - RNA, 12 nt, Human
ccaggcuuggaa

SEQ ID NO: 2156249 - RNA, 12 nt, Human
cccaaagaagga

SEQ ID NO: 2156250 - RNA, 14 nt, Human
ccaugccucagccc

SEQ ID NO: 2156251 - RNA, 12 nt, Human
ccaugccucagc

SEQ ID NO: 2156252 - RNA, 16 nt, Human
ccaugccucagcccug

SEQ ID NO: 2156253 - RNA, 15 nt, Human
ccaugccucagcccu

SEQ ID NO: 2156254 - RNA, 21 nt, Human
ccaugccucagcccugacccu

SEQ ID NO: 2156255 - RNA, 23 nt, Human
ccaugccucccccuagccauuuu

SEQ ID NO: 2156256 - RNA, 21 nt, Human
ccaugaagaggaugcugugaa

SEQ ID NO: 2156257 - RNA, 19 nt, Human
ccaugaagaggaugcugug

SEQ ID NO: 2156258 - RNA, 22 nt, Human
ccaucugguuaggauggcagga

SEQ ID NO: 2156259 - RNA, 21 nt, Human
cccaauucuuacaaacaugug

SEQ ID NO: 2156260 - RNA, 20 nt, Human
cccaaucccagcuaccucaa

SEQ ID NO: 2156261 - RNA, 19 nt, Human
cccaaucccagcuaccuca

SEQ ID NO: 2156262 - RNA, 18 nt, Human
cccaacacgcaggagcac

SEQ ID NO: 2156263 - RNA, 22 nt, Human
cccagcuaccucaaccaaugcc

SEQ ID NO: 2156264 - RNA, 14 nt, Human
cccagcuaccucaa

SEQ ID NO: 2156265 - RNA, 20 nt, Human
cccagcggacaguggcagga

SEQ ID NO: 2156266 - RNA, 18 nt, Human
cccagcggacaguggcag

SEQ ID NO: 2156267 - RNA, 23 nt, Human
cccagcggacaguggcaggacag

SEQ ID NO: 2156268 - RNA, 21 nt, Human
cccaggugcagccagaggcac

SEQ ID NO: 2156269 - RNA, 20 nt, Human
cccaggugcagccagaggca

SEQ ID NO: 2156270 - RNA, 15 nt, Human
cccaggugcagccag

SEQ ID NO: 2156271 - RNA, 23 nt, Human
cccaggcagggccaacccuucuc

SEQ ID NO: 2156272 - RNA, 15 nt, Human
cccaggcagggccaa

SEQ ID NO: 2156273 - RNA, 23 nt, Human
cccaggaguucugcucauucuaa

SEQ ID NO: 2156274 - RNA, 21 nt, Human
cccaggaguucugcucauucu

SEQ ID NO: 2156275 - RNA, 18 nt, Human
cccaggaguucugcucau

SEQ ID NO: 2156276 - RNA, 17 nt, Human
cccaggaguucugcuca

SEQ ID NO: 2156277 - RNA, 15 nt, Human
cccaggaguucugcu

SEQ ID NO: 2156278 - RNA, 14 nt, Human
cccaggaguucugc

SEQ ID NO: 2156279 - RNA, 24 nt, Human
cccauucuacuugcucuggaccug

SEQ ID NO: 2156280 - RNA, 23 nt, Human
cccauucuacuugcucuggaccu

SEQ ID NO: 2156281 - RNA, 22 nt, Human
cccauucuacuugcucuggacc

SEQ ID NO: 2156282 - RNA, 21 nt, Human
cccauucuacuugcucuggac

SEQ ID NO: 2156283 - RNA, 20 nt, Human
cccauucuacuugcucugga

SEQ ID NO: 2156284 - RNA, 19 nt, Human
cccauucuacuugcucugg

SEQ ID NO: 2156285 - RNA, 18 nt, Human
cccauucuacuugcucug

SEQ ID NO: 2156286 - RNA, 17 nt, Human
cccauucuacuugcucu

SEQ ID NO: 2156287 - RNA, 15 nt, Human
cccauucuacuugcu

SEQ ID NO: 2156288 - RNA, 14 nt, Human
cccauucuacuugc

SEQ ID NO: 2156289 - RNA, 13 nt, Human
cccauucuacuug

SEQ ID NO: 2156290 - RNA, 17 nt, Human
cggcugggcacacgccu

SEQ ID NO: 2156291 - RNA, 16 nt, Human
cggcugggcacacgcc

SEQ ID NO: 2156292 - RNA, 20 nt, Human
cggcugggcacacgccuccc

SEQ ID NO: 2156293 - RNA, 12 nt, Human
cggcugggcaca

SEQ ID NO: 2156294 - RNA, 23 nt, Human
cgggcaggggagggucagccagg

SEQ ID NO: 2156295 - RNA, 15 nt, Human
cggggagggugacag

SEQ ID NO: 2156296 - RNA, 22 nt, Human
cggggagggugacaguggccgc

SEQ ID NO: 2156297 - RNA, 14 nt, Human
cggacacccccucg

SEQ ID NO: 2156298 - RNA, 12 nt, Human
cggacacccccu

SEQ ID NO: 2156299 - RNA, 22 nt, Human
cgcucaccuuuguuuagaacac

SEQ ID NO: 2156300 - RNA, 21 nt, Human
cgauuucccugguuuuagucu

SEQ ID NO: 2156301 - RNA, 19 nt, Human
cgaucgcggcggagcuggc

SEQ ID NO: 2156302 - RNA, 17 nt, Human
cgagggcagcgggagcc

SEQ ID NO: 2156303 - RNA, 14 nt, Human
ccuuugauaaaugu

SEQ ID NO: 2156304 - RNA, 15 nt, Human
ccuuuggcagaguuc

SEQ ID NO: 2156305 - RNA, 14 nt, Human
ccuuucuccuuugu

SEQ ID NO: 2156306 - RNA, 15 nt, Human
ccuuucuccuuugua

SEQ ID NO: 2156307 - RNA, 19 nt, Human
cgcccccacccugagcgcc

SEQ ID NO: 2156308 - RNA, 12 nt, Human
cgcccccugccc

SEQ ID NO: 2156309 - RNA, 12 nt, Human
cgcccucccagg

SEQ ID NO: 2156310 - RNA, 13 nt, Human
cgcccucccaggc

SEQ ID NO: 2156311 - RNA, 21 nt, Human
cgcgucgcccucccaggcucu

SEQ ID NO: 2156312 - RNA, 16 nt, Human
cgucgcccucccaggc

SEQ ID NO: 2156313 - RNA, 15 nt, Human
cgucgcccucccagg

SEQ ID NO: 2156314 - RNA, 19 nt, Human
cgucauuacagggcacagg

SEQ ID NO: 2156315 - RNA, 11 nt, Human
cguccagggag

SEQ ID NO: 2156316 - RNA, 11 nt, Human
cgucaacaaau

SEQ ID NO: 2156317 - RNA, 20 nt, Human
cguaugaguuagaauaauaa

SEQ ID NO: 2156318 - RNA, 16 nt, Human
cgguggacccagacac

SEQ ID NO: 2156319 - RNA, 22 nt, Human
cggugcuguccucagguggcca

SEQ ID NO: 2156320 - RNA, 21 nt, Human
cggugcuguccucagguggcc

SEQ ID NO: 2156321 - RNA, 17 nt, Human
cggugcuguccucaggu

SEQ ID NO: 2156322 - RNA, 16 nt, Human
cggugcuguccucagg

SEQ ID NO: 2156323 - RNA, 13 nt, Human
cguucucccuggg

SEQ ID NO: 2156324 - RNA, 12 nt, Human
cguucucccugg

SEQ ID NO: 2156325 - RNA, 16 nt, Human
cguuuuguuuugugcc

SEQ ID NO: 2156326 - RNA, 20 nt, Human
cguuugaagacauugcacca

SEQ ID NO: 2156327 - RNA, 22 nt, Human
ccuucaguaacccccacuggac

SEQ ID NO: 2156328 - RNA, 16 nt, Human
ccuucaguaaccccca

SEQ ID NO: 2156329 - RNA, 22 nt, Human
ccuguccucccagcuccucacu

SEQ ID NO: 2156330 - RNA, 13 nt, Human
ccuguccucccag

SEQ ID NO: 2156331 - RNA, 16 nt, Human
ccugugccuccaucag

SEQ ID NO: 2156332 - RNA, 18 nt, Human
ccuguaggauuuuuuucu

SEQ ID NO: 2156333 - RNA, 18 nt, Human
ccugauuuagauaugcaa

SEQ ID NO: 2156334 - RNA, 21 nt, Human
ccugcuguaaauuuggcuucu

SEQ ID NO: 2156335 - RNA, 15 nt, Human
ccugcuuccauggcc

SEQ ID NO: 2156336 - RNA, 15 nt, Human
ccuggacuagaggga

SEQ ID NO: 2156337 - RNA, 22 nt, Human
ccuggacuagagggaccucucc

SEQ ID NO: 2156338 - RNA, 23 nt, Human
ccugggaggcgggcgcacugccu

SEQ ID NO: 2156339 - RNA, 19 nt, Human
ccccuagccauuuuuacug

SEQ ID NO: 2156340 - RNA, 14 nt, Human
ccccuagccauuuu

SEQ ID NO: 2156341 - RNA, 15 nt, Human
cccccgcauccccug

SEQ ID NO: 2156342 - RNA, 18 nt, Human
cccccgcauccccugccu

SEQ ID NO: 2156343 - RNA, 12 nt, Human
cccccgcccccu

SEQ ID NO: 2156344 - RNA, 16 nt, Human
cccccgcccccugccc

SEQ ID NO: 2156345 - RNA, 14 nt, Human
cccccgcccccugc

SEQ ID NO: 2156346 - RNA, 13 nt, Human
cccccgcccccug

SEQ ID NO: 2156347 - RNA, 13 nt, Human
ccccccuuccacu

SEQ ID NO: 2156348 - RNA, 12 nt, Human
ccccccuuccac

SEQ ID NO: 2156349 - RNA, 11 nt, Human
ccccccuucca

SEQ ID NO: 2156350 - RNA, 13 nt, Human
cccccugcccucc

SEQ ID NO: 2156351 - RNA, 13 nt, Human
cccccccuuccac

SEQ ID NO: 2156352 - RNA, 12 nt, Human
cccccccuucca

SEQ ID NO: 2156353 - RNA, 12 nt, Human
ccccacuggacu

SEQ ID NO: 2156354 - RNA, 20 nt, Human
ccccacuggacugaccuggu

SEQ ID NO: 2156355 - RNA, 19 nt, Human
ccccacuggacugaccugg

SEQ ID NO: 2156356 - RNA, 17 nt, Human
cccuuuugcauucuccc

SEQ ID NO: 2156357 - RNA, 21 nt, Human
ccuaaaccaaaaacugaaagu

SEQ ID NO: 2156358 - RNA, 22 nt, Human
ccucacacacagacucauauua

SEQ ID NO: 2156359 - RNA, 13 nt, Human
ccuagaggcccca

SEQ ID NO: 2156360 - RNA, 14 nt, Human
ccucuuuucucugc

SEQ ID NO: 2156361 - RNA, 17 nt, Human
ccugaacugaacaccau

SEQ ID NO: 2156362 - RNA, 13 nt, Human
ccugaaccuagga

SEQ ID NO: 2156363 - RNA, 24 nt, Human
ccucugguuugccgguggugcagg

SEQ ID NO: 2156364 - RNA, 16 nt, Human
ccucuggaaagcaaag

SEQ ID NO: 2156365 - RNA, 14 nt, Human
ccucugcuuugaaa

SEQ ID NO: 2156366 - RNA, 12 nt, Human
ccucucccaggg

SEQ ID NO: 2156367 - RNA, 12 nt, Human
ccucagguggcc

SEQ ID NO: 2156368 - RNA, 16 nt, Human
ccucagguggccaugc

SEQ ID NO: 2156369 - RNA, 15 nt, Human
ccucagguggccaug

SEQ ID NO: 2156370 - RNA, 21 nt, Human
ccucagguggccaugccucag

SEQ ID NO: 2156371 - RNA, 18 nt, Human
ccucagguggccaugccu

SEQ ID NO: 2156372 - RNA, 11 nt, Human
ccucagguggc

SEQ ID NO: 2156373 - RNA, 11 nt, Human
ccucagggcac

SEQ ID NO: 2156374 - RNA, 19 nt, Human
ccucaggccucugugccgc

SEQ ID NO: 2156375 - RNA, 14 nt, Human
ccucaggccucugu

SEQ ID NO: 2156376 - RNA, 16 nt, Human
ccuccccucucugcac

SEQ ID NO: 2156377 - RNA, 15 nt, Human
ccuccuggcccaggu

SEQ ID NO: 2156378 - RNA, 23 nt, Human
cugggcguaguggcucacaccug

SEQ ID NO: 2156379 - RNA, 13 nt, Human
cuggcuucucuga

SEQ ID NO: 2156380 - RNA, 17 nt, Human
cugggaggcgggcgcac

SEQ ID NO: 2156381 - RNA, 14 nt, Human
cugggaggccagug

SEQ ID NO: 2156382 - RNA, 23 nt, Human
cugggcacacgccucccacuggg

SEQ ID NO: 2156383 - RNA, 22 nt, Human
cugggcacacgccucccacugg

SEQ ID NO: 2156384 - RNA, 17 nt, Human
cugggcacacgccuccc

SEQ ID NO: 2156385 - RNA, 16 nt, Human
cugggcacacgccucc

SEQ ID NO: 2156386 - RNA, 20 nt, Human
cuggacuagagggaccucuc

SEQ ID NO: 2156387 - RNA, 21 nt, Human
cuggacuagagggaccucucc

SEQ ID NO: 2156388 - RNA, 23 nt, Human
cuggacuagagggaccucuccca

SEQ ID NO: 2156389 - RNA, 21 nt, Human
cuggagccaugggcacaaagg

SEQ ID NO: 2156390 - RNA, 15 nt, Human
cuggagccaugggca

SEQ ID NO: 2156391 - RNA, 19 nt, Human
cuggcaauguuuauuucau

SEQ ID NO: 2156392 - RNA, 17 nt, Human
cuggccucccacagacu

SEQ ID NO: 2156393 - RNA, 19 nt, Human
cuggccucccacagacuca

SEQ ID NO: 2156394 - RNA, 17 nt, Human
cuggccaacaugguaaa

SEQ ID NO: 2156395 - RNA, 20 nt, Human
cugcccuccccucucugcac

SEQ ID NO: 2156396 - RNA, 14 nt, Human
cugcccuccccucu

SEQ ID NO: 2156397 - RNA, 10 nt, Human
cugcccuccc

SEQ ID NO: 2156398 - RNA, 16 nt, Human
cugcaggggcauggga

SEQ ID NO: 2156399 - RNA, 19 nt, Human
cugcagggccgccagggag

SEQ ID NO: 2156400 - RNA, 18 nt, Human
cugcagggccgccaggga

SEQ ID NO: 2156401 - RNA, 17 nt, Human
cugccucaggccucugu

SEQ ID NO: 2156402 - RNA, 16 nt, Human
cugccucaggccucug

SEQ ID NO: 2156403 - RNA, 15 nt, Human
cugccucaggccucu

SEQ ID NO: 2156404 - RNA, 24 nt, Human
cugcucucuuuuucuccaggguca

SEQ ID NO: 2156405 - RNA, 20 nt, Human
cugcucucuuuuucuccagg

SEQ ID NO: 2156406 - RNA, 21 nt, Human
cugcuccccucugcacggacc

SEQ ID NO: 2156407 - RNA, 18 nt, Human
cugcaccauuuaaaaaca

SEQ ID NO: 2156408 - RNA, 22 nt, Human
cugaguggcuucacuccugcug

SEQ ID NO: 2156409 - RNA, 21 nt, Human
cugaguggcuucacuccugcu

SEQ ID NO: 2156410 - RNA, 19 nt, Human
cugaguggcuucacuccug

SEQ ID NO: 2156411 - RNA, 16 nt, Human
cugaguggcuucacuc

SEQ ID NO: 2156412 - RNA, 23 nt, Human
cugaguggcuucacuccugcugu

SEQ ID NO: 2156413 - RNA, 15 nt, Human
cugaguggcuucacu

SEQ ID NO: 2156414 - RNA, 13 nt, Human
cugaguggcuuca

SEQ ID NO: 2156415 - RNA, 22 nt, Human
cugauguuccuuuggaagaaaa

SEQ ID NO: 2156416 - RNA, 21 nt, Human
cuccucuuguaaauaaagccc

SEQ ID NO: 2156417 - RNA, 20 nt, Human
cuccucuuguaaauaaagcc

SEQ ID NO: 2156418 - RNA, 14 nt, Human
cuccucuuguaaau

SEQ ID NO: 2156419 - RNA, 13 nt, Human
cuccucuuguaaa

SEQ ID NO: 2156420 - RNA, 12 nt, Human
cuccucuuguaa

SEQ ID NO: 2156421 - RNA, 17 nt, Human
cuccucacucaccuuca

SEQ ID NO: 2156422 - RNA, 23 nt, Human
cucccaggugcagccagaggcac

SEQ ID NO: 2156423 - RNA, 12 nt, Human
cucgaauuuugu

SEQ ID NO: 2156424 - RNA, 23 nt, Human
cucgacguuuacaagcccccccu

SEQ ID NO: 2156425 - RNA, 14 nt, Human
cucgcauugacaca

SEQ ID NO: 2156426 - RNA, 22 nt, Human
cucgcuuggacggcugggcaca

SEQ ID NO: 2156427 - RNA, 21 nt, Human
cucuaacaauguauuuucuuc

SEQ ID NO: 2156428 - RNA, 12 nt, Human
cuaaaagcacac

SEQ ID NO: 2156429 - RNA, 13 nt, Human
cucauccugcagg

SEQ ID NO: 2156430 - RNA, 14 nt, Human
cucauccugcaggc

SEQ ID NO: 2156431 - RNA, 17 nt, Human
cucaucgccagacaacu

SEQ ID NO: 2156432 - RNA, 17 nt, Human
cucauugaauuauaaaa

SEQ ID NO: 2156433 - RNA, 11 nt, Human
cucauuuacug

SEQ ID NO: 2156434 - RNA, 20 nt, Human
cucauuuaaaguauuuuauu

SEQ ID NO: 2156435 - RNA, 19 nt, Human
cucauuuaaaguauuuuau

SEQ ID NO: 2156436 - RNA, 14 nt, Human
cucauuuaaaguau

SEQ ID NO: 2156437 - RNA, 11 nt, Human
cucucccaggg

SEQ ID NO: 2156438 - RNA, 18 nt, Human
cucucaucgccagacaac

SEQ ID NO: 2156439 - RNA, 18 nt, Human
cucucugcaccguacugu

SEQ ID NO: 2156440 - RNA, 12 nt, Human
cucuggacugug

SEQ ID NO: 2156441 - RNA, 14 nt, Human
cucuggaccugccc

SEQ ID NO: 2156442 - RNA, 21 nt, Human
cucuggaccugcccccgcauc

SEQ ID NO: 2156443 - RNA, 13 nt, Human
cucuggaccugcc

SEQ ID NO: 2156444 - RNA, 12 nt, Human
cucuggaccugc

SEQ ID NO: 2156445 - RNA, 13 nt, Human
cucuggaaagcaa

SEQ ID NO: 2156446 - RNA, 14 nt, Human
cucuuggcuccacu

SEQ ID NO: 2156447 - RNA, 19 nt, Human
cucuuggaggugucuguau

SEQ ID NO: 2156448 - RNA, 14 nt, Human
cucuuguaaauaaa

SEQ ID NO: 2156449 - RNA, 12 nt, Human
cucuuguaaaua

SEQ ID NO: 2156450 - RNA, 20 nt, Human
cucuugaagacacugaaaua

SEQ ID NO: 2156451 - RNA, 21 nt, Human
cucuugaagacacugaaauau

SEQ ID NO: 2156452 - RNA, 24 nt, Human
cucuuguaaauaaagcccugggau

SEQ ID NO: 2156453 - RNA, 23 nt, Human
cucuuguaaauaaagcccuggga

SEQ ID NO: 2156454 - RNA, 20 nt, Human
cucuuguaaauaaagcccug

SEQ ID NO: 2156455 - RNA, 19 nt, Human
cucuuguaaauaaagcccu

SEQ ID NO: 2156456 - RNA, 18 nt, Human
cucuuguaaauaaagccc

SEQ ID NO: 2156457 - RNA, 17 nt, Human
cucuuguaaauaaagcc

SEQ ID NO: 2156458 - RNA, 19 nt, Human
cucuucagguuguaaaaaa

SEQ ID NO: 2156459 - RNA, 22 nt, Human
cugaaugaaccuucuggccucc

SEQ ID NO: 2156460 - RNA, 14 nt, Human
cuuacuccaggaga

SEQ ID NO: 2156461 - RNA, 17 nt, Human
cuuacggcccuggccuu

SEQ ID NO: 2156462 - RNA, 16 nt, Human
cuuacggcccuggccu

SEQ ID NO: 2156463 - RNA, 15 nt, Human
cuuacggcccuggcc

SEQ ID NO: 2156464 - RNA, 20 nt, Human
cuuauuuaaguaacuuuaaa

SEQ ID NO: 2156465 - RNA, 16 nt, Human
cuuaucuccaagacca

SEQ ID NO: 2156466 - RNA, 13 nt, Human
cuuaucuccaaga

SEQ ID NO: 2156467 - RNA, 14 nt, Human
cuuaucuccaagac

SEQ ID NO: 2156468 - RNA, 19 nt, Human
cuuaucaagaguugugaca

SEQ ID NO: 2156469 - RNA, 22 nt, Human
cuuaggugugauuauaaaauca

SEQ ID NO: 2156470 - RNA, 19 nt, Human
cuuaauauucuggagucau

SEQ ID NO: 2156471 - RNA, 14 nt, Human
cuuaauauucugga

SEQ ID NO: 2156472 - RNA, 14 nt, Human
cuguuuuguaaagu

SEQ ID NO: 2156473 - RNA, 17 nt, Human
cuguuuuguaaaguccc

SEQ ID NO: 2156474 - RNA, 16 nt, Human
cuguuuuguaaagucc

SEQ ID NO: 2156475 - RNA, 21 nt, Human
cuguuuuguaaaguccccaga

SEQ ID NO: 2156476 - RNA, 15 nt, Human
cuguuuaugcuuuug

SEQ ID NO: 2156477 - RNA, 13 nt, Human
cuuccagcccaga

SEQ ID NO: 2156478 - RNA, 17 nt, Human
cuucgacagcauuuucc

SEQ ID NO: 2156479 - RNA, 15 nt, Human
cuucgacagcauuuu

SEQ ID NO: 2156480 - RNA, 14 nt, Human
cuucgacagcauuu

SEQ ID NO: 2156481 - RNA, 15 nt, Human
cuuccuuuugaggga

SEQ ID NO: 2156482 - RNA, 17 nt, Human
cuuccuugcuuaaggua

SEQ ID NO: 2156483 - RNA, 21 nt, Human
cuucgacagcauuuuccucug

SEQ ID NO: 2156484 - RNA, 12 nt, Human
cuucucagccac

SEQ ID NO: 2156485 - RNA, 19 nt, Human
cuucgggcuggccaucugg

SEQ ID NO: 2156486 - RNA, 20 nt, Human
cuuugaaagccccagaaauc

SEQ ID NO: 2156487 - RNA, 19 nt, Human
cuuugaaagccccagaaau

SEQ ID NO: 2156488 - RNA, 14 nt, Human
cuuuggcagaguuc

SEQ ID NO: 2156489 - RNA, 16 nt, Human
cuuugccaagaccuuu

SEQ ID NO: 2156490 - RNA, 20 nt, Human
cuuugccaagaccuuucaaa

SEQ ID NO: 2156491 - RNA, 17 nt, Human
cuuugccaagaccuuuc

SEQ ID NO: 2156492 - RNA, 22 nt, Human
gaaaacgcucucuacucugcuu

SEQ ID NO: 2156493 - RNA, 13 nt, Human
gaaaaccucuccu

SEQ ID NO: 2156494 - RNA, 13 nt, Human
cuuuuuaaaaaua

SEQ ID NO: 2156495 - RNA, 18 nt, Human
cuuuugaacccaggaguu

SEQ ID NO: 2156496 - RNA, 20 nt, Human
cuuuugaacccaggaguuca

SEQ ID NO: 2156497 - RNA, 22 nt, Human
cuuuuugauuacaguguagcuu

SEQ ID NO: 2156498 - RNA, 13 nt, Human
cuuuugaacccag

SEQ ID NO: 2156499 - RNA, 14 nt, Human
cuuuugaacccagg

SEQ ID NO: 2156500 - RNA, 15 nt, Human
cuugagaaaaaaaga

SEQ ID NO: 2156501 - RNA, 22 nt, Human
cuugagaaaaaaagaauaguug

SEQ ID NO: 2156502 - RNA, 16 nt, Human
cuugagaaaaaaagaa

SEQ ID NO: 2156503 - RNA, 19 nt, Human
cuugagaacuuuauuucca

SEQ ID NO: 2156504 - RNA, 21 nt, Human
cuugagaagauucuucccauu

SEQ ID NO: 2156505 - RNA, 17 nt, Human
cuugagaagauucuucc

SEQ ID NO: 2156506 - RNA, 16 nt, Human
cuucuggccucccaca

SEQ ID NO: 2156507 - RNA, 19 nt, Human
cuucuggccucccacagac

SEQ ID NO: 2156508 - RNA, 15 nt, Human
cuucuggccucccac

SEQ ID NO: 2156509 - RNA, 14 nt, Human
cuucuggccuccca

SEQ ID NO: 2156510 - RNA, 18 nt, Human
cuugcucuggaccugccc

SEQ ID NO: 2156511 - RNA, 17 nt, Human
cuugcucuggaccugcc

SEQ ID NO: 2156512 - RNA, 16 nt, Human
cuugcucuggaccugc

SEQ ID NO: 2156513 - RNA, 15 nt, Human
cuugcucuggaccug

SEQ ID NO: 2156514 - RNA, 14 nt, Human
cuugcucuggaccu

SEQ ID NO: 2156515 - RNA, 13 nt, Human
cuugcucuggacc

SEQ ID NO: 2156516 - RNA, 12 nt, Human
cuuguagccuuu

SEQ ID NO: 2156517 - RNA, 16 nt, Human
cuuguagccuuuugac

SEQ ID NO: 2156518 - RNA, 14 nt, Human
cuuguagccuuuug

SEQ ID NO: 2156519 - RNA, 17 nt, Human
cuuguagccuuuugacu

SEQ ID NO: 2156520 - RNA, 22 nt, Human
cuuguguuuuuaacucaauauu

SEQ ID NO: 2156521 - RNA, 17 nt, Human
cuuguuaaugcuuucug

SEQ ID NO: 2156522 - RNA, 18 nt, Human
cuuguuaaugcuuucuga

SEQ ID NO: 2156523 - RNA, 14 nt, Human
cuugggcccucugg

SEQ ID NO: 2156524 - RNA, 15 nt, Human
cuugggcccucuggu

SEQ ID NO: 2156525 - RNA, 13 nt, Human
gacaucagcuggu

SEQ ID NO: 2156526 - RNA, 16 nt, Human
gaccaaggagaugaag

SEQ ID NO: 2156527 - RNA, 13 nt, Human
gaccagcaaauac

SEQ ID NO: 2156528 - RNA, 17 nt, Human
gacccagacacaucgca

SEQ ID NO: 2156529 - RNA, 18 nt, Human
gacccccgcccccugccc

SEQ ID NO: 2156530 - RNA, 16 nt, Human
gacccccgcccccugc

SEQ ID NO: 2156531 - RNA, 15 nt, Human
gacccccgcccccug

SEQ ID NO: 2156532 - RNA, 11 nt, Human
gacccccgccc

SEQ ID NO: 2156533 - RNA, 19 nt, Human
gacccccgcccccugcccu

SEQ ID NO: 2156534 - RNA, 23 nt, Human
gacagacucacaaccugaaccua

SEQ ID NO: 2156535 - RNA, 15 nt, Human
gacugaccuggucca

SEQ ID NO: 2156536 - RNA, 23 nt, Human
gacugaccugguccacagggcac

SEQ ID NO: 2156537 - RNA, 22 nt, Human
gacugaccugguccacagggca

SEQ ID NO: 2156538 - RNA, 20 nt, Human
gacugaccugguccacaggg

SEQ ID NO: 2156539 - RNA, 19 nt, Human
gacugaccugguccacagg

SEQ ID NO: 2156540 - RNA, 19 nt, Human
gacugaccuugaugagcug

SEQ ID NO: 2156541 - RNA, 15 nt, Human
gacugaucaggaccu

SEQ ID NO: 2156542 - RNA, 16 nt, Human
gaccugucuccuggcg

SEQ ID NO: 2156543 - RNA, 15 nt, Human
gaccugucuccuggc

SEQ ID NO: 2156544 - RNA, 19 nt, Human
gaccugguccacagggcac

SEQ ID NO: 2156545 - RNA, 18 nt, Human
gaccugguccacagggca

SEQ ID NO: 2156546 - RNA, 17 nt, Human
gaccugguccacagggc

SEQ ID NO: 2156547 - RNA, 15 nt, Human
gaccuucuaggaagc

SEQ ID NO: 2156548 - RNA, 12 nt, Human
gacggcuccacu

SEQ ID NO: 2156549 - RNA, 18 nt, Human
gacggcugggcacacgcc

SEQ ID NO: 2156550 - RNA, 13 nt, Human
gacggcugggcac

SEQ ID NO: 2156551 - RNA, 12 nt, Human
gacggcugggca

SEQ ID NO: 2156552 - RNA, 18 nt, Human
gacggcuccacuaggacu

SEQ ID NO: 2156553 - RNA, 12 nt, Human
gacuaaaugaaa

SEQ ID NO: 2156554 - RNA, 18 nt, Human
gacuaacuaucaaauaga

SEQ ID NO: 2156555 - RNA, 18 nt, Human
gacguuuacaagcccccc

SEQ ID NO: 2156556 - RNA, 20 nt, Human
gacgugggcugggcccacaa

SEQ ID NO: 2156557 - RNA, 13 nt, Human
gacgugggcuggg

SEQ ID NO: 2156558 - RNA, 21 nt, Human
gaacgauauguagcagaaagg

SEQ ID NO: 2156559 - RNA, 18 nt, Human
gaacgauauguagcagaa

SEQ ID NO: 2156560 - RNA, 18 nt, Human
gaaccuauuucucuuucu

SEQ ID NO: 2156561 - RNA, 21 nt, Human
gaaccuauuucucuuucuuua

SEQ ID NO: 2156562 - RNA, 17 nt, Human
gaaccuauuucucuuuc

SEQ ID NO: 2156563 - RNA, 16 nt, Human
gaaccuauuucucuuu

SEQ ID NO: 2156564 - RNA, 22 nt, Human
gaacauaaagcaaauagacaca

SEQ ID NO: 2156565 - RNA, 15 nt, Human
gaacauaaagcaaau

SEQ ID NO: 2156566 - RNA, 19 nt, Human
gaagaaaaaaggccuugaa

SEQ ID NO: 2156567 - RNA, 21 nt, Human
gaagagaguccauauuucaau

SEQ ID NO: 2156568 - RNA, 13 nt, Human
gaagagccacagu

SEQ ID NO: 2156569 - RNA, 12 nt, Human
gaagagccacag

SEQ ID NO: 2156570 - RNA, 12 nt, Human
gaaguaugggaa

SEQ ID NO: 2156571 - RNA, 16 nt, Human
gaauaauaaauauuua

SEQ ID NO: 2156572 - RNA, 11 nt, Human
gaauaauaaau

SEQ ID NO: 2156573 - RNA, 21 nt, Human
gaauauuuucauuaaaagcua

SEQ ID NO: 2156574 - RNA, 20 nt, Human
gaauauuuucauuaaaagcu

SEQ ID NO: 2156575 - RNA, 19 nt, Human
gaauauuugguuuuccugu

SEQ ID NO: 2156576 - RNA, 13 nt, Human
gaauaccuguggu

SEQ ID NO: 2156577 - RNA, 14 nt, Human
gaauugagcugcag

SEQ ID NO: 2156578 - RNA, 16 nt, Human
gaauugagcugcagaa

SEQ ID NO: 2156579 - RNA, 15 nt, Human
gaaugaaccuucugg

SEQ ID NO: 2156580 - RNA, 17 nt, Human
gaaugaaccuucuggcc

SEQ ID NO: 2156581 - RNA, 13 nt, Human
gauauaaauaaaa

SEQ ID NO: 2156582 - RNA, 23 nt, Human
gauaguggggagacuucuuggcu

SEQ ID NO: 2156583 - RNA, 15 nt, Human
gauauaaauaaaaca

SEQ ID NO: 2156584 - RNA, 18 nt, Human
gaguucgagaccagccug

SEQ ID NO: 2156585 - RNA, 21 nt, Human
gaguucugcucauucuaauga

SEQ ID NO: 2156586 - RNA, 20 nt, Human
gaguucugcucauucuaaug

SEQ ID NO: 2156587 - RNA, 16 nt, Human
gaguucugcucauucu

SEQ ID NO: 2156588 - RNA, 18 nt, Human
gaugacaacuacagaaaa

SEQ ID NO: 2156589 - RNA, 13 nt, Human
gaugaacagacug

SEQ ID NO: 2156590 - RNA, 15 nt, Human
gauuaauuccuuucc

SEQ ID NO: 2156591 - RNA, 18 nt, Human
gauuaauauggggaugca

SEQ ID NO: 2156592 - RNA, 23 nt, Human
gauguucuacuuuguucugcugu

SEQ ID NO: 2156593 - RNA, 21 nt, Human
gauguucuacuuuguucugcu

SEQ ID NO: 2156594 - RNA, 16 nt, Human
gauuuaaacaaacaaa

SEQ ID NO: 2156595 - RNA, 23 nt, Human
gcaaaugcuaaugucaaacuuga

SEQ ID NO: 2156596 - RNA, 21 nt, Human
gcaaagacuauucccuucuaa

SEQ ID NO: 2156597 - RNA, 22 nt, Human
gcaaagacuauucccuucuaac

SEQ ID NO: 2156598 - RNA, 22 nt, Human
gcaaagugaaguugcuucuucu

SEQ ID NO: 2156599 - RNA, 15 nt, Human
gcaaacccagacggc

SEQ ID NO: 2156600 - RNA, 13 nt, Human
gcagaugcaauga

SEQ ID NO: 2156601 - RNA, 19 nt, Human
gcagaugcaaugacucagg

SEQ ID NO: 2156602 - RNA, 20 nt, Human
gcagaugcuagcacaugccc

SEQ ID NO: 2156603 - RNA, 17 nt, Human
gcagauggaaaggagcc

SEQ ID NO: 2156604 - RNA, 20 nt, Human
gcaggagcacacccagcccc

SEQ ID NO: 2156605 - RNA, 17 nt, Human
gcaggagcacacccagc

SEQ ID NO: 2156606 - RNA, 16 nt, Human
gcaggagcacacccag

SEQ ID NO: 2156607 - RNA, 20 nt, Human
gcagcagguggcagaauggg

SEQ ID NO: 2156608 - RNA, 15 nt, Human
gcacuaagauauuuc

SEQ ID NO: 2156609 - RNA, 17 nt, Human
gcacccacccugggacc

SEQ ID NO: 2156610 - RNA, 14 nt, Human
gcacccacccuggg

SEQ ID NO: 2156611 - RNA, 13 nt, Human
gcacccacccugg

SEQ ID NO: 2156612 - RNA, 23 nt, Human
gcauauauuggguuccauucuca

SEQ ID NO: 2156613 - RNA, 14 nt, Human
gccaaaagcugcuc

SEQ ID NO: 2156614 - RNA, 15 nt, Human
gccaaaagcugcuca

SEQ ID NO: 2156615 - RNA, 23 nt, Human
gcauuuuguauuugucuaacugg

SEQ ID NO: 2156616 - RNA, 14 nt, Human
gcauuuuguauuug

SEQ ID NO: 2156617 - RNA, 16 nt, Human
gcauuuucuaaacaga

SEQ ID NO: 2156618 - RNA, 21 nt, Human
gcauuuuccucugcuuugaaa

SEQ ID NO: 2156619 - RNA, 18 nt, Human
gcauuuuccucugcuuug

SEQ ID NO: 2156620 - RNA, 15 nt, Human
gcauuuuccucugcu

SEQ ID NO: 2156621 - RNA, 13 nt, Human
gcauuuuccucug

SEQ ID NO: 2156622 - RNA, 20 nt, Human
gcauuuuccuccaucgcagu

SEQ ID NO: 2156623 - RNA, 23 nt, Human
gcccacaaaggcaaaggguccag

SEQ ID NO: 2156624 - RNA, 23 nt, Human
gccauggauggaaaacgcucucu

SEQ ID NO: 2156625 - RNA, 13 nt, Human
gccagggccugcg

SEQ ID NO: 2156626 - RNA, 14 nt, Human
gccagggccugcga

SEQ ID NO: 2156627 - RNA, 16 nt, Human
gccagggccugcgagg

SEQ ID NO: 2156628 - RNA, 18 nt, Human
gccaggugcaaccaggga

SEQ ID NO: 2156629 - RNA, 20 nt, Human
gccagucuugacgaguguga

SEQ ID NO: 2156630 - RNA, 13 nt, Human
gccagcugccucc

SEQ ID NO: 2156631 - RNA, 19 nt, Human
gccagcgggaauggcagcu

SEQ ID NO: 2156632 - RNA, 22 nt, Human
gccagagcuacccgcagaguuc

SEQ ID NO: 2156633 - RNA, 18 nt, Human
gcccgcggggacauuggg

SEQ ID NO: 2156634 - RNA, 24 nt, Human
gcccuccuacccugcgcccagucc

SEQ ID NO: 2156635 - RNA, 19 nt, Human
gcccuccuacccugcgccc

SEQ ID NO: 2156636 - RNA, 19 nt, Human
gcccuccccucucugcacc

SEQ ID NO: 2156637 - RNA, 18 nt, Human
gcccuccccucucugcac

SEQ ID NO: 2156638 - RNA, 15 nt, Human
gcccuccccucucug

SEQ ID NO: 2156639 - RNA, 13 nt, Human
gccccgccgccug

SEQ ID NO: 2156640 - RNA, 20 nt, Human
gccccauucuuuuguaauuu

SEQ ID NO: 2156641 - RNA, 21 nt, Human
gccccaggcagggccaacccu

SEQ ID NO: 2156642 - RNA, 21 nt, Human
gcccaggugaguccuagagcu

SEQ ID NO: 2156643 - RNA, 13 nt, Human
gccgggcagaggg

SEQ ID NO: 2156644 - RNA, 22 nt, Human
gccgcaaaccacacuggacucc

SEQ ID NO: 2156645 - RNA, 21 nt, Human
gccgcaaaccacacuggacuc

SEQ ID NO: 2156646 - RNA, 19 nt, Human
gccgcaaaccacacuggac

SEQ ID NO: 2156647 - RNA, 17 nt, Human
gccgcaaaccacacugg

SEQ ID NO: 2156648 - RNA, 16 nt, Human
gccgcaaaccacacug

SEQ ID NO: 2156649 - RNA, 19 nt, Human
gccguugauucacuucacg

SEQ ID NO: 2156650 - RNA, 16 nt, Human
gccucccugccucagg

SEQ ID NO: 2156651 - RNA, 14 nt, Human
gccucccugccuca

SEQ ID NO: 2156652 - RNA, 17 nt, Human
gccucccugccucaggc

SEQ ID NO: 2156653 - RNA, 21 nt, Human
gccucccccuagccauuuuua

SEQ ID NO: 2156654 - RNA, 18 nt, Human
gccucccccuagccauuu

SEQ ID NO: 2156655 - RNA, 22 nt, Human
gccucagcccugacccugugga

SEQ ID NO: 2156656 - RNA, 17 nt, Human
gccucagcccugacccu

SEQ ID NO: 2156657 - RNA, 18 nt, Human
gccugaagaguccucuga

SEQ ID NO: 2156658 - RNA, 20 nt, Human
gccugaagaguccucugaau

SEQ ID NO: 2156659 - RNA, 15 nt, Human
gcggacaguggcagg

SEQ ID NO: 2156660 - RNA, 14 nt, Human
gcggacaguggcag

SEQ ID NO: 2156661 - RNA, 16 nt, Human
gcggacaucagcuggu

SEQ ID NO: 2156662 - RNA, 19 nt, Human
gcggacaguggcaggacag

SEQ ID NO: 2156663 - RNA, 16 nt, Human
gcggacaguggcagga

SEQ ID NO: 2156664 - RNA, 19 nt, Human
gcgcccaguccuuccaccu

SEQ ID NO: 2156665 - RNA, 17 nt, Human
gcgcccaguccuuccac

SEQ ID NO: 2156666 - RNA, 21 nt, Human
gcuaacuagcuuggaaacugg

SEQ ID NO: 2156667 - RNA, 20 nt, Human
gcuacaccuuucuccuuugu

SEQ ID NO: 2156668 - RNA, 15 nt, Human
gcuacaccuuucucc

SEQ ID NO: 2156669 - RNA, 13 nt, Human
gcuacaccuuucu

SEQ ID NO: 2156670 - RNA, 16 nt, Human
gcgucgcccucccagg

SEQ ID NO: 2156671 - RNA, 14 nt, Human
gccuguaaucccag

SEQ ID NO: 2156672 - RNA, 14 nt, Human
gccugguuuagccu

SEQ ID NO: 2156673 - RNA, 16 nt, Human
gccuuuuauuucuuaa

SEQ ID NO: 2156674 - RNA, 12 nt, Human
gccuuuucuauu

SEQ ID NO: 2156675 - RNA, 16 nt, Human
gccuuuugacuuucau

SEQ ID NO: 2156676 - RNA, 17 nt, Human
gccuugggcccucuggu

SEQ ID NO: 2156677 - RNA, 12 nt, Human
ggugacaguggc

SEQ ID NO: 2156678 - RNA, 10 nt, Human
gguggccaug

SEQ ID NO: 2156679 - RNA, 20 nt, Human
gguggccaugccucagcccu

SEQ ID NO: 2156680 - RNA, 17 nt, Human
gguggccaugccucagc

SEQ ID NO: 2156681 - RNA, 21 nt, Human
ggugagagggccgggcagagg

SEQ ID NO: 2156682 - RNA, 20 nt, Human
ggugagagggccgggcagag

SEQ ID NO: 2156683 - RNA, 21 nt, Human
gguggugcagguagaccuguc

SEQ ID NO: 2156684 - RNA, 15 nt, Human
ggucagaaacaggac

SEQ ID NO: 2156685 - RNA, 17 nt, Human
ggucagaaacaggaccg

SEQ ID NO: 2156686 - RNA, 16 nt, Human
ggucagaaacaggacc

SEQ ID NO: 2156687 - RNA, 18 nt, Human
ggucagaaacaggaccgg

SEQ ID NO: 2156688 - RNA, 11 nt, Human
gguagaacaca

SEQ ID NO: 2156689 - RNA, 20 nt, Human
gguaccaguugaaauuuuug

SEQ ID NO: 2156690 - RNA, 15 nt, Human
gggugaaggcuggca

SEQ ID NO: 2156691 - RNA, 14 nt, Human
gggugaaggcuggc

SEQ ID NO: 2156692 - RNA, 13 nt, Human
gggugaaggcugg

SEQ ID NO: 2156693 - RNA, 12 nt, Human
gggugaaggcug

SEQ ID NO: 2156694 - RNA, 20 nt, Human
ggguucaccugggcugaggc

SEQ ID NO: 2156695 - RNA, 21 nt, Human
ggguuggagcaguagcuggag

SEQ ID NO: 2156696 - RNA, 14 nt, Human
ggggagggugacag

SEQ ID NO: 2156697 - RNA, 16 nt, Human
gggcacaaagggccca

SEQ ID NO: 2156698 - RNA, 17 nt, Human
gggcacaaagggcccag

SEQ ID NO: 2156699 - RNA, 15 nt, Human
gggcacaaagggccc

SEQ ID NO: 2156700 - RNA, 20 nt, Human
gggaugacaugcacucagcu

SEQ ID NO: 2156701 - RNA, 18 nt, Human
gggacugaaaaccucucc

SEQ ID NO: 2156702 - RNA, 19 nt, Human
gggacugaaaaccucuccu

SEQ ID NO: 2156703 - RNA, 19 nt, Human
gggaguggggaagugaucu

SEQ ID NO: 2156704 - RNA, 18 nt, Human
gggaguguacucccaggg

SEQ ID NO: 2156705 - RNA, 17 nt, Human
gggaguguacucccagg

SEQ ID NO: 2156706 - RNA, 16 nt, Human
gggcacaggccaugga

SEQ ID NO: 2156707 - RNA, 14 nt, Human
gggcacaggccaug

SEQ ID NO: 2156708 - RNA, 15 nt, Human
gggcacacgccuccc

SEQ ID NO: 2156709 - RNA, 19 nt, Human
gggcacacgccucccacug

SEQ ID NO: 2156710 - RNA, 12 nt, Human
gggcaccugcca

SEQ ID NO: 2156711 - RNA, 12 nt, Human
gggcacccaccc

SEQ ID NO: 2156712 - RNA, 23 nt, Human
gggcaggggagggucagccaggg

SEQ ID NO: 2156713 - RNA, 13 nt, Human
ggcuuacacccac

SEQ ID NO: 2156714 - RNA, 17 nt, Human
ggcuuacggcccuggcc

SEQ ID NO: 2156715 - RNA, 16 nt, Human
ggcuuacggcccuggc

SEQ ID NO: 2156716 - RNA, 23 nt, Human
ggcuuaaacccauauuguaaaac

SEQ ID NO: 2156717 - RNA, 22 nt, Human
gggaauggcacagcccaaagaa

SEQ ID NO: 2156718 - RNA, 16 nt, Human
gggaauggcacagccc

SEQ ID NO: 2156719 - RNA, 18 nt, Human
gggaaggggacccccgcc

SEQ ID NO: 2156720 - RNA, 15 nt, Human
gggaauggcagcugc

SEQ ID NO: 2156721 - RNA, 16 nt, Human
gggacaaagaggccuu

SEQ ID NO: 2156722 - RNA, 15 nt, Human
gggacaaagaggccu

SEQ ID NO: 2156723 - RNA, 22 nt, Human
gggacaaagaggccuuuaacca

SEQ ID NO: 2156724 - RNA, 17 nt, Human
gggaccuauaacugccc

SEQ ID NO: 2156725 - RNA, 12 nt, Human
gggaccucuccc

SEQ ID NO: 2156726 - RNA, 19 nt, Human
gggaccuauaacugcccag

SEQ ID NO: 2156727 - RNA, 16 nt, Human
gggaccucucccaggg

SEQ ID NO: 2156728 - RNA, 23 nt, Human
gggaccucucccagggucccugg

SEQ ID NO: 2156729 - RNA, 15 nt, Human
ggcugauggaguaaa

SEQ ID NO: 2156730 - RNA, 14 nt, Human
ggaaaacgcucucu

SEQ ID NO: 2156731 - RNA, 21 nt, Human
gcuuuuacugaagccuuucuu

SEQ ID NO: 2156732 - RNA, 13 nt, Human
gcuuuaauaaugu

SEQ ID NO: 2156733 - RNA, 15 nt, Human
gcuuuggagaagagu

SEQ ID NO: 2156734 - RNA, 15 nt, Human
gcuuugggagaaugu

SEQ ID NO: 2156735 - RNA, 14 nt, Human
ggaaaauauuuuga

SEQ ID NO: 2156736 - RNA, 12 nt, Human
ggaaaauauuuu

SEQ ID NO: 2156737 - RNA, 21 nt, Human
ggaaccguaggacccaagcag

SEQ ID NO: 2156738 - RNA, 16 nt, Human
ggaaccguaggaccca

SEQ ID NO: 2156739 - RNA, 20 nt, Human
ggaagaucucugcagggccg

SEQ ID NO: 2156740 - RNA, 19 nt, Human
ggaagaucucugcagggcc

SEQ ID NO: 2156741 - RNA, 24 nt, Human
gcuggccccgccgccugguacuca

SEQ ID NO: 2156742 - RNA, 23 nt, Human
gcuggccccgccgccugguacuc

SEQ ID NO: 2156743 - RNA, 22 nt, Human
gcuggccccgccgccugguacu

SEQ ID NO: 2156744 - RNA, 13 nt, Human
gcuggccccgccg

SEQ ID NO: 2156745 - RNA, 20 nt, Human
gcugcucagggaaaagcagc

SEQ ID NO: 2156746 - RNA, 21 nt, Human
gcugcucagggaaaagcagcu

SEQ ID NO: 2156747 - RNA, 16 nt, Human
gcuagcacaugcccua

SEQ ID NO: 2156748 - RNA, 13 nt, Human
gcuguauuuugaa

SEQ ID NO: 2156749 - RNA, 15 nt, Human
ggccaggccagcugc

SEQ ID NO: 2156750 - RNA, 17 nt, Human
ggccaggccagcugccu

SEQ ID NO: 2156751 - RNA, 18 nt, Human
ggccccgccgccugguac

SEQ ID NO: 2156752 - RNA, 15 nt, Human
ggccccgccgccugg

SEQ ID NO: 2156753 - RNA, 14 nt, Human
ggccccgccgccug

SEQ ID NO: 2156754 - RNA, 22 nt, Human
ggcaccugccacccugggccug

SEQ ID NO: 2156755 - RNA, 19 nt, Human
ggagugagaggucucucuu

SEQ ID NO: 2156756 - RNA, 20 nt, Human
ggaggaucuuuugaacccag

SEQ ID NO: 2156757 - RNA, 12 nt, Human
ggaccucuccca

SEQ ID NO: 2156758 - RNA, 14 nt, Human
ggaccucucccagg

SEQ ID NO: 2156759 - RNA, 15 nt, Human
ggaccucucccaggg

SEQ ID NO: 2156760 - RNA, 23 nt, Human
ggaccugcccccgcauccccugc

SEQ ID NO: 2156761 - RNA, 11 nt, Human
ggaccugcccc

SEQ ID NO: 2156762 - RNA, 10 nt, Human
ggaccugccc

SEQ ID NO: 2156763 - RNA, 22 nt, Human
ggaccugcccccgcauccccug

SEQ ID NO: 2156764 - RNA, 21 nt, Human
ggagaccuggacacaggccug

SEQ ID NO: 2156765 - RNA, 21 nt, Human
uauauuuuauacauuaacuuc

SEQ ID NO: 2156766 - RNA, 23 nt, Human
uauauaauacugacugagaauau

SEQ ID NO: 2156767 - RNA, 23 nt, Human
uauacuugcuuuguguucuuugu

SEQ ID NO: 2156768 - RNA, 15 nt, Human
uauauacauauauau

SEQ ID NO: 2156769 - RNA, 17 nt, Human
uauaugauuuuuaucca

SEQ ID NO: 2156770 - RNA, 14 nt, Human
uauauuuuaauuug

SEQ ID NO: 2156771 - RNA, 20 nt, Human
uauauuuguguauuuaacag

SEQ ID NO: 2156772 - RNA, 16 nt, Human
uauauuuguguauuua

SEQ ID NO: 2156773 - RNA, 22 nt, Human
uagaguuucaaccaugaagucu

SEQ ID NO: 2156774 - RNA, 12 nt, Human
uagauguuuccu

SEQ ID NO: 2156775 - RNA, 15 nt, Human
uagauguucuacuuu

SEQ ID NO: 2156776 - RNA, 16 nt, Human
uaggaacuugagaacu

SEQ ID NO: 2156777 - RNA, 22 nt, Human
uaggccaggugcaaccagggag

SEQ ID NO: 2156778 - RNA, 20 nt, Human
uagccuauguggauuuuuuc

SEQ ID NO: 2156779 - RNA, 13 nt, Human
uagcaguaaaaua

SEQ ID NO: 2156780 - RNA, 16 nt, Human
uagccauuuuuacugu

SEQ ID NO: 2156781 - RNA, 17 nt, Human
uagccauuuuuacuguu

SEQ ID NO: 2156782 - RNA, 18 nt, Human
uacacaccuuauauuuac

SEQ ID NO: 2156783 - RNA, 18 nt, Human
uaccaaauagcuucuguu

SEQ ID NO: 2156784 - RNA, 22 nt, Human
uaccaaucauauuaauacaaug

SEQ ID NO: 2156785 - RNA, 13 nt, Human
uaccaaucauauu

SEQ ID NO: 2156786 - RNA, 18 nt, Human
uacugauguuccuuugga

SEQ ID NO: 2156787 - RNA, 17 nt, Human
uacugauguuccuuugg

SEQ ID NO: 2156788 - RNA, 17 nt, Human
uagaaagacagagcugg

SEQ ID NO: 2156789 - RNA, 23 nt, Human
uagaaagaauauuugguuuuccu

SEQ ID NO: 2156790 - RNA, 22 nt, Human
uagaaaggggcaguuuaaagca

SEQ ID NO: 2156791 - RNA, 18 nt, Human
uagaaagugccagaaagu

SEQ ID NO: 2156792 - RNA, 17 nt, Human
uagaaagugccagaaag

SEQ ID NO: 2156793 - RNA, 22 nt, Human
uagaacauaaagcaaauagaca

SEQ ID NO: 2156794 - RNA, 16 nt, Human
uagaacauaaagcaaa

SEQ ID NO: 2156795 - RNA, 18 nt, Human
uagaacauaaagcaaaua

SEQ ID NO: 2156796 - RNA, 17 nt, Human
uagaacauaaagcaaau

SEQ ID NO: 2156797 - RNA, 12 nt, Human
uacuguauuuga

SEQ ID NO: 2156798 - RNA, 16 nt, Human
uacugugguguuuugu

SEQ ID NO: 2156799 - RNA, 13 nt, Human
uacugugucuuug

SEQ ID NO: 2156800 - RNA, 23 nt, Human
uacugugucuuugguuugugcua

SEQ ID NO: 2156801 - RNA, 15 nt, Human
uacuugcucuggacc

SEQ ID NO: 2156802 - RNA, 14 nt, Human
uacuugcucuggac

SEQ ID NO: 2156803 - RNA, 12 nt, Human
uacuugcucugg

SEQ ID NO: 2156804 - RNA, 13 nt, Human
uacuuuaauaaau

SEQ ID NO: 2156805 - RNA, 20 nt, Human
uacuugcucuggaccugccc

SEQ ID NO: 2156806 - RNA, 18 nt, Human
uacuugcucuggaccugc

SEQ ID NO: 2156807 - RNA, 17 nt, Human
uacuugcucuggaccug

SEQ ID NO: 2156808 - RNA, 16 nt, Human
uacuugcucuggaccu

SEQ ID NO: 2156809 - RNA, 14 nt, Human
uacuugcuuugugu

SEQ ID NO: 2156810 - RNA, 22 nt, Human
uacuugcucuggaccugccccc

SEQ ID NO: 2156811 - RNA, 19 nt, Human
uaauauaaaguuggaugcg

SEQ ID NO: 2156812 - RNA, 14 nt, Human
uaauauaaaguugg

SEQ ID NO: 2156813 - RNA, 20 nt, Human
uaauacaaugaugcuauuug

SEQ ID NO: 2156814 - RNA, 14 nt, Human
uaaucugagaaaca

SEQ ID NO: 2156815 - RNA, 18 nt, Human
uaaucuuaucaagaguug

SEQ ID NO: 2156816 - RNA, 22 nt, Human
uaaugauggcccauucuacuug

SEQ ID NO: 2156817 - RNA, 18 nt, Human
uaaugauggcccauucua

SEQ ID NO: 2156818 - RNA, 14 nt, Human
uaaugauggcccau

SEQ ID NO: 2156819 - RNA, 16 nt, Human
uaauauggggaugcag

SEQ ID NO: 2156820 - RNA, 19 nt, Human
uaauauauuuguguauuua

SEQ ID NO: 2156821 - RNA, 20 nt, Human
uaauauauuuguguauuuaa

SEQ ID NO: 2156822 - RNA, 12 nt, Human
uaauucugggaa

SEQ ID NO: 2156823 - RNA, 19 nt, Human
uaauucuugcauauuuugu

SEQ ID NO: 2156824 - RNA, 15 nt, Human
uaauucuugcauauu

SEQ ID NO: 2156825 - RNA, 14 nt, Human
uaauucuuauucuu

SEQ ID NO: 2156826 - RNA, 20 nt, Human
uaauucuucaccuuaggaau

SEQ ID NO: 2156827 - RNA, 15 nt, Human
uaauuaaauagcuuu

SEQ ID NO: 2156828 - RNA, 21 nt, Human
uaauuaaauaaaaaucugugg

SEQ ID NO: 2156829 - RNA, 12 nt, Human
uaauuuggcagg

SEQ ID NO: 2156830 - RNA, 16 nt, Human
uaacaauguauuuucu

SEQ ID NO: 2156831 - RNA, 14 nt, Human
uaacaauguauuuu

SEQ ID NO: 2156832 - RNA, 23 nt, Human
uaacugcccagcggacaguggca

SEQ ID NO: 2156833 - RNA, 17 nt, Human
uaacugcccagcggaca

SEQ ID NO: 2156834 - RNA, 19 nt, Human
uaacugcaaagugaaguug

SEQ ID NO: 2156835 - RNA, 22 nt, Human
uaaccaaucuacaaucucccuu

SEQ ID NO: 2156836 - RNA, 15 nt, Human
uaaccaaucuacaau

SEQ ID NO: 2156837 - RNA, 14 nt, Human
uaaccaaucuacaa

SEQ ID NO: 2156838 - RNA, 21 nt, Human
uaaauaaaacauuuucacaca

SEQ ID NO: 2156839 - RNA, 22 nt, Human
uaaauaaaacauuuucacacaa

SEQ ID NO: 2156840 - RNA, 10 nt, Human
uaaauauuua

SEQ ID NO: 2156841 - RNA, 23 nt, Human
uaaauauugucuuuuuguauguc

SEQ ID NO: 2156842 - RNA, 20 nt, Human
uaaauauugucuuuuuguau

SEQ ID NO: 2156843 - RNA, 17 nt, Human
uaaauauugucuuuuug

SEQ ID NO: 2156844 - RNA, 16 nt, Human
uaaauauugucuuuuu

SEQ ID NO: 2156845 - RNA, 15 nt, Human
uaaauauugucuuuu

SEQ ID NO: 2156846 - RNA, 13 nt, Human
uaaauauugucuu

SEQ ID NO: 2156847 - RNA, 18 nt, Human
uaaacaauaucagacuuu

SEQ ID NO: 2156848 - RNA, 12 nt, Human
uaaacaaaugua

SEQ ID NO: 2156849 - RNA, 19 nt, Human
uaaacaaauguaugauuac

SEQ ID NO: 2156850 - RNA, 21 nt, Human
uaaaaucugauauguauuguu

SEQ ID NO: 2156851 - RNA, 20 nt, Human
uaaaaucugauauguauugu

SEQ ID NO: 2156852 - RNA, 23 nt, Human
uaaaaucugauauguauuguuug

SEQ ID NO: 2156853 - RNA, 22 nt, Human
uaaaaucugauauguauuguuu

SEQ ID NO: 2156854 - RNA, 16 nt, Human
uaaaaaaaagaaauga

SEQ ID NO: 2156855 - RNA, 12 nt, Human
uaaaaaaaagaa

SEQ ID NO: 2156856 - RNA, 17 nt, Human
uaaaaaaagaagagaaa

SEQ ID NO: 2156857 - RNA, 15 nt, Human
uaaaaacaggcagcu

SEQ ID NO: 2156858 - RNA, 23 nt, Human
uaaaaaacaugugguuacacagu

SEQ ID NO: 2156859 - RNA, 18 nt, Human
guuuuccuguauaggaau

SEQ ID NO: 2156860 - RNA, 20 nt, Human
guuuuccuuuuauuucuuca

SEQ ID NO: 2156861 - RNA, 19 nt, Human
guuuuuaacucaauauuuu

SEQ ID NO: 2156862 - RNA, 15 nt, Human
guuuuuaacucaaua

SEQ ID NO: 2156863 - RNA, 19 nt, Human
guuuuguggaggagcucag

SEQ ID NO: 2156864 - RNA, 14 nt, Human
guuuccugcaggcc

SEQ ID NO: 2156865 - RNA, 16 nt, Human
guuuccugcaggccag

SEQ ID NO: 2156866 - RNA, 23 nt, Human
guuuccaguacaccuuucagcca

SEQ ID NO: 2156867 - RNA, 12 nt, Human
guuuagccugga

SEQ ID NO: 2156868 - RNA, 21 nt, Human
guuugaaucuauuuaucuuca

SEQ ID NO: 2156869 - RNA, 17 nt, Human
guuugaauauaaacacu

SEQ ID NO: 2156870 - RNA, 19 nt, Human
guuugaauauaaacacuau

SEQ ID NO: 2156871 - RNA, 13 nt, Human
guuugaauauaaa

SEQ ID NO: 2156872 - RNA, 17 nt, Human
guuuccuuccagcccag

SEQ ID NO: 2156873 - RNA, 21 nt, Human
ucaaacuaggggacaaagcaa

SEQ ID NO: 2156874 - RNA, 16 nt, Human
uauuuuauacauuaac

SEQ ID NO: 2156875 - RNA, 12 nt, Human
uauuuuuuaaag

SEQ ID NO: 2156876 - RNA, 14 nt, Human
uauuugagaauaua

SEQ ID NO: 2156877 - RNA, 20 nt, Human
uauuucuuaaacaaauguau

SEQ ID NO: 2156878 - RNA, 15 nt, Human
uauuucucuuucuuu

SEQ ID NO: 2156879 - RNA, 16 nt, Human
uauuucucuuucuuua

SEQ ID NO: 2156880 - RNA, 13 nt, Human
uauuucucuuucu

SEQ ID NO: 2156881 - RNA, 20 nt, Human
uaucugagcucuuugcacua

SEQ ID NO: 2156882 - RNA, 19 nt, Human
uaucugagcucuuugcacu

SEQ ID NO: 2156883 - RNA, 13 nt, Human
ucaauuaacaaua

SEQ ID NO: 2156884 - RNA, 17 nt, Human
ucaaugguuugcaagga

SEQ ID NO: 2156885 - RNA, 13 nt, Human
ucacaauacuguu

SEQ ID NO: 2156886 - RNA, 17 nt, Human
ucacaaguuuuuuuacu

SEQ ID NO: 2156887 - RNA, 19 nt, Human
ucacacaauacaauaaguu

SEQ ID NO: 2156888 - RNA, 23 nt, Human
ucacacacagacucauauuacug

SEQ ID NO: 2156889 - RNA, 14 nt, Human
ucacacacagacug

SEQ ID NO: 2156890 - RNA, 14 nt, Human
ucaaagaaauaucu

SEQ ID NO: 2156891 - RNA, 15 nt, Human
ucaacguuaauaauu

SEQ ID NO: 2156892 - RNA, 16 nt, Human
ucaagcccgcggggac

SEQ ID NO: 2156893 - RNA, 23 nt, Human
ucacagggacugaaaaccucucc

SEQ ID NO: 2156894 - RNA, 19 nt, Human
ucacuccugcuguaaauuu

SEQ ID NO: 2156895 - RNA, 16 nt, Human
ucacuccugcuguaaa

SEQ ID NO: 2156896 - RNA, 15 nt, Human
ucacuccugcuguaa

SEQ ID NO: 2156897 - RNA, 14 nt, Human
ucacuccugcugua

SEQ ID NO: 2156898 - RNA, 13 nt, Human
ucacuccugcugu

SEQ ID NO: 2156899 - RNA, 12 nt, Human
ucacuccugcug

SEQ ID NO: 2156900 - RNA, 14 nt, Human
ucagaccagcucuu

SEQ ID NO: 2156901 - RNA, 23 nt, Human
ucagagugcaagccccugcucca

SEQ ID NO: 2156902 - RNA, 23 nt, Human
uccccagagaaagcgcagaugcu

SEQ ID NO: 2156903 - RNA, 17 nt, Human
uccccagagaaagcgca

SEQ ID NO: 2156904 - RNA, 16 nt, Human
ucccccuagccauuuu

SEQ ID NO: 2156905 - RNA, 14 nt, Human
ucccccuagccauu

SEQ ID NO: 2156906 - RNA, 15 nt, Human
ucccccuagccauuu

SEQ ID NO: 2156907 - RNA, 22 nt, Human
uccccugccccuuuacggacac

SEQ ID NO: 2156908 - RNA, 17 nt, Human
uccccugccuccauccu

SEQ ID NO: 2156909 - RNA, 15 nt, Human
uccccugccuccauc

SEQ ID NO: 2156910 - RNA, 13 nt, Human
uccccugccucca

SEQ ID NO: 2156911 - RNA, 12 nt, Human
uccccugccucc

SEQ ID NO: 2156912 - RNA, 22 nt, Human
uccauggccguguagaagcaug

SEQ ID NO: 2156913 - RNA, 19 nt, Human
ucccaacaaacauugaugc

SEQ ID NO: 2156914 - RNA, 19 nt, Human
ucccaggaguucugcucau

SEQ ID NO: 2156915 - RNA, 18 nt, Human
ucccaggaguucugcuca

SEQ ID NO: 2156916 - RNA, 15 nt, Human
ucccaggaguucugc

SEQ ID NO: 2156917 - RNA, 21 nt, Human
ucccaggcucucaacagggga

SEQ ID NO: 2156918 - RNA, 19 nt, Human
ucccauucuccauuuguua

SEQ ID NO: 2156919 - RNA, 16 nt, Human
ucccauucuccauuug

SEQ ID NO: 2156920 - RNA, 18 nt, Human
uccaccucgacguuuaca

SEQ ID NO: 2156921 - RNA, 14 nt, Human
uccagaaggagaca

SEQ ID NO: 2156922 - RNA, 19 nt, Human
uccagaaggagacaggcag

SEQ ID NO: 2156923 - RNA, 20 nt, Human
uccacuucuuucagcagacu

SEQ ID NO: 2156924 - RNA, 16 nt, Human
ucaucucucuuuaaua

SEQ ID NO: 2156925 - RNA, 20 nt, Human
ucaguucuugccacuuuuuu

SEQ ID NO: 2156926 - RNA, 20 nt, Human
ucagucuucucucacuuuga

SEQ ID NO: 2156927 - RNA, 13 nt, Human
ucagcagacugau

SEQ ID NO: 2156928 - RNA, 15 nt, Human
ucugaacuggagcca

SEQ ID NO: 2156929 - RNA, 14 nt, Human
ucugaacuggagcc

SEQ ID NO: 2156930 - RNA, 19 nt, Human
ucugaaaauuaacacugcu

SEQ ID NO: 2156931 - RNA, 18 nt, Human
ucugaaaauuaacacugc

SEQ ID NO: 2156932 - RNA, 17 nt, Human
ucugaaaauuaacacug

SEQ ID NO: 2156933 - RNA, 18 nt, Human
ucucugcaccguacugug

SEQ ID NO: 2156934 - RNA, 13 nt, Human
ucucuuucuuuac

SEQ ID NO: 2156935 - RNA, 18 nt, Human
ucucuuucuuuacaagau

SEQ ID NO: 2156936 - RNA, 20 nt, Human
ucugaacuggagccaugggc

SEQ ID NO: 2156937 - RNA, 18 nt, Human
ucugagcucuuugcacua

SEQ ID NO: 2156938 - RNA, 13 nt, Human
ucucuacucugcu

SEQ ID NO: 2156939 - RNA, 18 nt, Human
ucucuacagguuugggua

SEQ ID NO: 2156940 - RNA, 18 nt, Human
ucucugaggaagcugggg

SEQ ID NO: 2156941 - RNA, 22 nt, Human
ucucagguuaagugugaguaau

SEQ ID NO: 2156942 - RNA, 21 nt, Human
ucuccucuuguaaauaaagcc

SEQ ID NO: 2156943 - RNA, 23 nt, Human
ucuccucuuguaaauaaagcccu

SEQ ID NO: 2156944 - RNA, 17 nt, Human
ucuccugaaguucagcc

SEQ ID NO: 2156945 - RNA, 15 nt, Human
ucucccugacccugu

SEQ ID NO: 2156946 - RNA, 13 nt, Human
ucuccucuuguaa

SEQ ID NO: 2156947 - RNA, 15 nt, Human
ucuccucuuguaaau

SEQ ID NO: 2156948 - RNA, 14 nt, Human
ucuccucuuguaaa

SEQ ID NO: 2156949 - RNA, 22 nt, Human
uccuuuuuuguuccuuuuuccu

SEQ ID NO: 2156950 - RNA, 14 nt, Human
uccuuuuuuaaaag

SEQ ID NO: 2156951 - RNA, 18 nt, Human
ugaacagacugaccuuga

SEQ ID NO: 2156952 - RNA, 17 nt, Human
ugaacagacugaccuug

SEQ ID NO: 2156953 - RNA, 17 nt, Human
ugaacaccauugaaggc

SEQ ID NO: 2156954 - RNA, 20 nt, Human
ugaacaccauugaaggcuua

SEQ ID NO: 2156955 - RNA, 22 nt, Human
ugaacugaacaccauugaaggc

SEQ ID NO: 2156956 - RNA, 12 nt, Human
ugaacugaacac

SEQ ID NO: 2156957 - RNA, 13 nt, Human
ugaacugaacacc

SEQ ID NO: 2156958 - RNA, 14 nt, Human
ugaacugaacacca

SEQ ID NO: 2156959 - RNA, 16 nt, Human
ugaagaggaugcugug

SEQ ID NO: 2156960 - RNA, 16 nt, Human
ugaaggcuggcaugau

SEQ ID NO: 2156961 - RNA, 13 nt, Human
ugaaggcuggcau

SEQ ID NO: 2156962 - RNA, 12 nt, Human
ugaaggcuggca

SEQ ID NO: 2156963 - RNA, 11 nt, Human
ugaaggcuggc

SEQ ID NO: 2156964 - RNA, 15 nt, Human
ucuuucacaaaaaag

SEQ ID NO: 2156965 - RNA, 15 nt, Human
ucuuuuuauugaauc

SEQ ID NO: 2156966 - RNA, 14 nt, Human
ucuuuuuauugaau

SEQ ID NO: 2156967 - RNA, 13 nt, Human
ucuuuuuauugaa

SEQ ID NO: 2156968 - RNA, 15 nt, Human
ucuuuuguaauuuaa

SEQ ID NO: 2156969 - RNA, 19 nt, Human
ugaaaugcagagucaauga

SEQ ID NO: 2156970 - RNA, 20 nt, Human
ucuugacgagugugaagcuu

SEQ ID NO: 2156971 - RNA, 16 nt, Human
ucugugucugaguggc

SEQ ID NO: 2156972 - RNA, 17 nt, Human
uggaaaaaaaaaagaca

SEQ ID NO: 2156973 - RNA, 16 nt, Human
uggaaaaaaaaaagac

SEQ ID NO: 2156974 - RNA, 15 nt, Human
uggaaccaggcuugg

SEQ ID NO: 2156975 - RNA, 20 nt, Human
ugcuuguuaaugcuuucuga

SEQ ID NO: 2156976 - RNA, 22 nt, Human
ugggcgggcaggggagggucag

SEQ ID NO: 2156977 - RNA, 17 nt, Human
ugggcgggcaggggagg

SEQ ID NO: 2156978 - RNA, 15 nt, Human
uggguuccauucuca

SEQ ID NO: 2156979 - RNA, 21 nt, Human
uggguucauccuauucuuucg

SEQ ID NO: 2156980 - RNA, 20 nt, Human
uggguccaggauuccucuuu

SEQ ID NO: 2156981 - RNA, 18 nt, Human
uggccuugggcccucugg

SEQ ID NO: 2156982 - RNA, 23 nt, Human
ugccauggacagaagaaggcagc

SEQ ID NO: 2156983 - RNA, 20 nt, Human
ugccauggacagaagaaggc

SEQ ID NO: 2156984 - RNA, 18 nt, Human
ugccauggacagaagaag

SEQ ID NO: 2156985 - RNA, 22 nt, Human
ugccaguaaaaaaaaaaaaugg

SEQ ID NO: 2156986 - RNA, 14 nt, Human
ugccaguaaaaaaa

SEQ ID NO: 2156987 - RNA, 17 nt, Human
ugccaaccuauuuugaa

SEQ ID NO: 2156988 - RNA, 20 nt, Human
ugccaaaaaaagacagggcu

SEQ ID NO: 2156989 - RNA, 20 nt, Human
ugaaggcuggcaugauccaa

SEQ ID NO: 2156990 - RNA, 14 nt, Human
ugcagccagaggca

SEQ ID NO: 2156991 - RNA, 13 nt, Human
ugcagccagaggc

SEQ ID NO: 2156992 - RNA, 11 nt, Human
ugcagccagag

SEQ ID NO: 2156993 - RNA, 15 nt, Human
ugccuagaggcccca

SEQ ID NO: 2156994 - RNA, 18 nt, Human
ugcgcccaguccuuccac

SEQ ID NO: 2156995 - RNA, 17 nt, Human
ugcgcccaguccuucca

SEQ ID NO: 2156996 - RNA, 15 nt, Human
ugcugaguugguguu

SEQ ID NO: 2156997 - RNA, 20 nt, Human
ugcucaggagaccuggagga

SEQ ID NO: 2156998 - RNA, 16 nt, Human
ugcuagcacaugcccu

SEQ ID NO: 2156999 - RNA, 12 nt, Human
ugcuagcacaug

SEQ ID NO: 2157000 - RNA, 20 nt, Human
ugcuagccggccacuuugga

SEQ ID NO: 2157001 - RNA, 20 nt, Human
ugcgucauuacagggcacag

SEQ ID NO: 2157002 - RNA, 22 nt, Human
uuaauauggggaugcagcauua

SEQ ID NO: 2157003 - RNA, 16 nt, Human
uuaauauggggaugca

SEQ ID NO: 2157004 - RNA, 18 nt, Human
uuacggcccuggccuugg

SEQ ID NO: 2157005 - RNA, 16 nt, Human
uuacggacacccccuc

SEQ ID NO: 2157006 - RNA, 23 nt, Human
uuaccuuuuugaaaaagaaaaca

SEQ ID NO: 2157007 - RNA, 14 nt, Human
uuaaagcaaaggag

SEQ ID NO: 2157008 - RNA, 15 nt, Human
uuaaauagcuuuugu

SEQ ID NO: 2157009 - RNA, 19 nt, Human
uuaaauggaaacugaaacu

SEQ ID NO: 2157010 - RNA, 12 nt, Human
uguuuuguaaag

SEQ ID NO: 2157011 - RNA, 23 nt, Human
uguucugcccaaugccuuuuuga

SEQ ID NO: 2157012 - RNA, 10 nt, Human
uguguuuguu

SEQ ID NO: 2157013 - RNA, 20 nt, Human
uguguuuguucuuuuuauug

SEQ ID NO: 2157014 - RNA, 17 nt, Human
uguguuuaugugagcug

SEQ ID NO: 2157015 - RNA, 22 nt, Human
uguguauuuaacagggagggga

SEQ ID NO: 2157016 - RNA, 20 nt, Human
uguguauuuaacagggaggg

SEQ ID NO: 2157017 - RNA, 18 nt, Human
uguguauuuaacagggag

SEQ ID NO: 2157018 - RNA, 13 nt, Human
uguguauuuaaca

SEQ ID NO: 2157019 - RNA, 19 nt, Human
uguauugcauauauacaua

SEQ ID NO: 2157020 - RNA, 18 nt, Human
uguauuuaacagggaggg

SEQ ID NO: 2157021 - RNA, 12 nt, Human
uguagcagaaag

SEQ ID NO: 2157022 - RNA, 15 nt, Human
uguauaauauuuuua

SEQ ID NO: 2157023 - RNA, 18 nt, Human
ugucauauagcugguuau

SEQ ID NO: 2157024 - RNA, 20 nt, Human
ugucacguuuuguuuugugc

SEQ ID NO: 2157025 - RNA, 20 nt, Human
uguauuuguuaaugguuuga

SEQ ID NO: 2157026 - RNA, 18 nt, Human
uguauuuguuaaugguuu

SEQ ID NO: 2157027 - RNA, 22 nt, Human
ugucauagaaagugccagaaag

SEQ ID NO: 2157028 - RNA, 17 nt, Human
ugucauagaaagugcca

SEQ ID NO: 2157029 - RNA, 19 nt, Human
uguaccaugugcuacaggg

SEQ ID NO: 2157030 - RNA, 19 nt, Human
uguacaggaugcuuugguu

SEQ ID NO: 2157031 - RNA, 12 nt, Human
uguacuacaauu

SEQ ID NO: 2157032 - RNA, 18 nt, Human
uguacuaggauacugcug

SEQ ID NO: 2157033 - RNA, 12 nt, Human
uguacucccagg

SEQ ID NO: 2157034 - RNA, 16 nt, Human
uguaaaucugcucagg

SEQ ID NO: 2157035 - RNA, 13 nt, Human
uguaaaucugcuc

SEQ ID NO: 2157036 - RNA, 15 nt, Human
uguaaucccagcacu

SEQ ID NO: 2157037 - RNA, 16 nt, Human
ugugaguaaucugaga

SEQ ID NO: 2157038 - RNA, 19 nt, Human
ugugaguaaucugagaaac

SEQ ID NO: 2157039 - RNA, 17 nt, Human
ugugcaauaauuuacau

SEQ ID NO: 2157040 - RNA, 14 nt, Human
ugucucacauggga

SEQ ID NO: 2157041 - RNA, 13 nt, Human
ugucugccagggc

SEQ ID NO: 2157042 - RNA, 20 nt, Human
ugugcuacaggggccagaag

SEQ ID NO: 2157043 - RNA, 18 nt, Human
ugugcuacaggggccaga

SEQ ID NO: 2157044 - RNA, 17 nt, Human
ugugcuacaggggccag

SEQ ID NO: 2157045 - RNA, 15 nt, Human
ugugcuacaggggcc

SEQ ID NO: 2157046 - RNA, 13 nt, Human
ugugcagacuuca

SEQ ID NO: 2157047 - RNA, 17 nt, Human
ugugcacaaaguggcau

SEQ ID NO: 2157048 - RNA, 14 nt, Human
ugugcacaaagugg

SEQ ID NO: 2157049 - RNA, 19 nt, Human
ugugcauagagccacguau

SEQ ID NO: 2157050 - RNA, 20 nt, Human
uguggaaaagaaacacgcac

SEQ ID NO: 2157051 - RNA, 15 nt, Human
uguggaaaagaaaca

SEQ ID NO: 2157052 - RNA, 15 nt, Human
uguggguaccuguau

SEQ ID NO: 2157053 - RNA, 15 nt, Human
ugugggucaaggaau

SEQ ID NO: 2157054 - RNA, 23 nt, Human
uguggggaaccaauugcuuuguc

SEQ ID NO: 2157055 - RNA, 19 nt, Human
uuguacacaccuuauauuu

SEQ ID NO: 2157056 - RNA, 22 nt, Human
uuguaaaguccccagagaaagc

SEQ ID NO: 2157057 - RNA, 16 nt, Human
uuguaaaguccccaga

SEQ ID NO: 2157058 - RNA, 15 nt, Human
uuggccaaacaagug

SEQ ID NO: 2157059 - RNA, 16 nt, Human
uuggguuccauucuca

SEQ ID NO: 2157060 - RNA, 16 nt, Human
uuggaagaaaaaaucu

SEQ ID NO: 2157061 - RNA, 21 nt, Human
uugcguggaauugugcugagu

SEQ ID NO: 2157062 - RNA, 12 nt, Human
uugccugcaggc

SEQ ID NO: 2157063 - RNA, 23 nt, Human
uugacgagugugaagcuuccuug

SEQ ID NO: 2157064 - RNA, 18 nt, Human
uugaggaaacaacagcuu

SEQ ID NO: 2157065 - RNA, 19 nt, Human
uugaggggagagggaacgg

SEQ ID NO: 2157066 - RNA, 17 nt, Human
uugaucuucaacaaauu

SEQ ID NO: 2157067 - RNA, 16 nt, Human
uugaucuucaacaaau

SEQ ID NO: 2157068 - RNA, 15 nt, Human
uugaucuucaacaaa

SEQ ID NO: 2157069 - RNA, 13 nt, Human
uugaucuucaaca

SEQ ID NO: 2157070 - RNA, 11 nt, Human
uugaucuucaa

SEQ ID NO: 2157071 - RNA, 20 nt, Human
uugauuuuuacguuugaaga

SEQ ID NO: 2157072 - RNA, 13 nt, Human
uugaagacacuga

SEQ ID NO: 2157073 - RNA, 15 nt, Human
uugaagacacugaaa

SEQ ID NO: 2157074 - RNA, 22 nt, Human
uugaagacacugaaauauacac

SEQ ID NO: 2157075 - RNA, 20 nt, Human
uugaaucuauuuaucuucau

SEQ ID NO: 2157076 - RNA, 17 nt, Human
uugaaucuauuuaucuu

SEQ ID NO: 2157077 - RNA, 22 nt, Human
uucuucacuguccuccaagcca

SEQ ID NO: 2157078 - RNA, 15 nt, Human
uucucauccugcagg

SEQ ID NO: 2157079 - RNA, 20 nt, Human
uucucaugauuuacagagaa

SEQ ID NO: 2157080 - RNA, 17 nt, Human
uucucaugauuuacaga

SEQ ID NO: 2157081 - RNA, 23 nt, Human
uucuaaugauggcccauucuacu

SEQ ID NO: 2157082 - RNA, 16 nt, Human
uucuaaugauggccca

SEQ ID NO: 2157083 - RNA, 14 nt, Human
uucuccagggucag

SEQ ID NO: 2157084 - RNA, 14 nt, Human
uucuaaacagagau

SEQ ID NO: 2157085 - RNA, 18 nt, Human
uuccuuuccagguauuuu

SEQ ID NO: 2157086 - RNA, 14 nt, Human
uuccuuccagccca

SEQ ID NO: 2157087 - RNA, 14 nt, Human
uucauaaucuuugc

SEQ ID NO: 2157088 - RNA, 16 nt, Human
uucaugaguuuuuccc

SEQ ID NO: 2157089 - RNA, 24 nt, Human
uuccaugaaaaugcaacaacaugu

SEQ ID NO: 2157090 - RNA, 15 nt, Human
uuccaugaaaaugca

SEQ ID NO: 2157091 - RNA, 20 nt, Human
uuccacuuuuuuuuguaugu

SEQ ID NO: 2157092 - RNA, 15 nt, Human
uucauuuuaugaaga

SEQ ID NO: 2157093 - RNA, 17 nt, Human
uucaccccaaucccagc

SEQ ID NO: 2157094 - RNA, 14 nt, Human
uucaaauugugugu

SEQ ID NO: 2157095 - RNA, 21 nt, Human
uucaaauugugugugcucugc

SEQ ID NO: 2157096 - RNA, 22 nt, Human
uucaaugguuugcaaggaagcc

SEQ ID NO: 2157097 - RNA, 20 nt, Human
uucaaugguuugcaaggaag

SEQ ID NO: 2157098 - RNA, 23 nt, Human
uucaaugguuugcaaggaagcca

SEQ ID NO: 2157099 - RNA, 20 nt, Human
uucaauguuuuuaaaaaucu

SEQ ID NO: 2157100 - RNA, 21 nt, Human
uuuacaagcccccccuuccac

SEQ ID NO: 2157101 - RNA, 15 nt, Human
uuuacaagccccccc

SEQ ID NO: 2157102 - RNA, 21 nt, Human
uuuaaucuccaccagucauuu

SEQ ID NO: 2157103 - RNA, 14 nt, Human
uuucucuuucuuua

SEQ ID NO: 2157104 - RNA, 12 nt, Human
uuucucuuucuu

SEQ ID NO: 2157105 - RNA, 17 nt, Human
uuuccucuuccugccua

SEQ ID NO: 2157106 - RNA, 20 nt, Human
uuucagcauugauauuugug

SEQ ID NO: 2157107 - RNA, 15 nt, Human
uuucagcauugauau

SEQ ID NO: 2157108 - RNA, 14 nt, Human
uuucagcauugaua

SEQ ID NO: 2157109 - RNA, 22 nt, Human
uuucauuggaaauuaggaugua

SEQ ID NO: 2157110 - RNA, 20 nt, Human
uuuauuuguuugugcauuug

SEQ ID NO: 2157111 - RNA, 13 nt, Human
uuuauuucuuaaa

SEQ ID NO: 2157112 - RNA, 16 nt, Human
uuugguuaagcuuuga

SEQ ID NO: 2157113 - RNA, 13 nt, Human
uuuguguucuuug

SEQ ID NO: 2157114 - RNA, 14 nt, Human
uuuguucccauccu

SEQ ID NO: 2157115 - RNA, 23 nt, Human
uuuguucccauccucuucuuuua

SEQ ID NO: 2157116 - RNA, 16 nt, Human
uuugagcauggguuca

SEQ ID NO: 2157117 - RNA, 18 nt, Human
uuugauaguauugugcau

SEQ ID NO: 2157118 - RNA, 19 nt, Human
uuugcauaauaaaugcuuc

SEQ ID NO: 2157119 - RNA, 13 nt, Human
uuuuaauuugaua

SEQ ID NO: 2157120 - RNA, 19 nt, Human
uuuuacugaagccuuucuu

SEQ ID NO: 2157121 - RNA, 15 nt, Human
uuuuacugaagccuu

SEQ ID NO: 2157122 - RNA, 23 nt, Human
uuuucacacaauacaauaaguua

SEQ ID NO: 2157123 - RNA, 12 nt, Human
caaaccuucaca

SEQ ID NO: 2157124 - RNA, 14 nt, Human
caaacucucugaac

SEQ ID NO: 2157125 - RNA, 16 nt, Human
caaacagaaaacaugu

SEQ ID NO: 2157126 - RNA, 12 nt, Human
caagagcugagg

SEQ ID NO: 2157127 - RNA, 18 nt, Human
caaaguuccaaaaugcca

SEQ ID NO: 2157128 - RNA, 16 nt, Human
caaaguuccaaaaugc

SEQ ID NO: 2157129 - RNA, 17 nt, Human
caaagagaaaaagaaau

SEQ ID NO: 2157130 - RNA, 21 nt, Human
caaagagaaaaagaaaugcaa

SEQ ID NO: 2157131 - RNA, 20 nt, Human
caaagagaaaaagaaaugca

SEQ ID NO: 2157132 - RNA, 19 nt, Human
caaagagaaaaagaaaugc

SEQ ID NO: 2157133 - RNA, 19 nt, Human
caaagaaggaaaaggcagg

SEQ ID NO: 2157134 - RNA, 22 nt, Human
caaagaacauguagaaaacaaa

SEQ ID NO: 2157135 - RNA, 21 nt, Human
caaagaacauguagaaaacaa

SEQ ID NO: 2157136 - RNA, 10 nt, Human
caacagaaaa

SEQ ID NO: 2157137 - RNA, 14 nt, Human
caacagaaaaaugg

SEQ ID NO: 2157138 - RNA, 19 nt, Human
caaauuacucuuucuccau

SEQ ID NO: 2157139 - RNA, 16 nt, Human
caaauuacucuuucuc

SEQ ID NO: 2157140 - RNA, 15 nt, Human
caaauuuuauuugua

SEQ ID NO: 2157141 - RNA, 13 nt, Human
caaggagaugaag

SEQ ID NO: 2157142 - RNA, 23 nt, Human
caaggagaugaagcaaacacauu

SEQ ID NO: 2157143 - RNA, 12 nt, Human
caauauccuuug

SEQ ID NO: 2157144 - RNA, 20 nt, Human
caauauccuuugccucaagg

SEQ ID NO: 2157145 - RNA, 15 nt, Human
caauauccuuugccu

SEQ ID NO: 2157146 - RNA, 13 nt, Human
caauauccuuugc

SEQ ID NO: 2157147 - RNA, 20 nt, Human
caaugugucuuucuuuuugg

SEQ ID NO: 2157148 - RNA, 17 nt, Human
caauguuuuuaaaaauc

SEQ ID NO: 2157149 - RNA, 21 nt, Human
caauguuuauuucauaaagaa

SEQ ID NO: 2157150 - RNA, 17 nt, Human
caauguuguuuuaagac

SEQ ID NO: 2157151 - RNA, 16 nt, Human
caauuuuuuuuuccuu

SEQ ID NO: 2157152 - RNA, 18 nt, Human
caauguuuuuaaaaaucu

SEQ ID NO: 2157153 - RNA, 21 nt, Human
cacaauaccuuauuuaaguaa

SEQ ID NO: 2157154 - RNA, 13 nt, Human
cacaauacaauaa

SEQ ID NO: 2157155 - RNA, 15 nt, Human
cacaaagggcccaga

SEQ ID NO: 2157156 - RNA, 16 nt, Human
cacaaagggcccagau

SEQ ID NO: 2157157 - RNA, 13 nt, Human
cacaaagggccca

SEQ ID NO: 2157158 - RNA, 20 nt, Human
cacaaaggcaaaggguccag

SEQ ID NO: 2157159 - RNA, 22 nt, Human
cacaguggaaagacagcuucuc

SEQ ID NO: 2157160 - RNA, 14 nt, Human
aacuguacugggcc

SEQ ID NO: 2157161 - RNA, 22 nt, Human
aacuguaccaugugcuacaggg

SEQ ID NO: 2157162 - RNA, 16 nt, Human
aacuguaccaugugcu

SEQ ID NO: 2157163 - RNA, 22 nt, Human
aacuucuuauaggaaagcuuga

SEQ ID NO: 2157164 - RNA, 22 nt, Human
gugaugcuaaagguuguauugc

SEQ ID NO: 2157165 - RNA, 16 nt, Human
gugaugcccugcccuu

SEQ ID NO: 2157166 - RNA, 23 nt, Human
gugcacaaaguggcauaaaaaac

SEQ ID NO: 2157167 - RNA, 21 nt, Human
gugcacaaaguggcauaaaaa

SEQ ID NO: 2157168 - RNA, 14 nt, Human
gugcacaaaguggc

SEQ ID NO: 2157169 - RNA, 15 nt, Human
gugcaagccccugcu

SEQ ID NO: 2157170 - RNA, 13 nt, Human
gugcaaccaggga

SEQ ID NO: 2157171 - RNA, 12 nt, Human
gugccucccugg

SEQ ID NO: 2157172 - RNA, 15 nt, Human
gugccucccugguga

SEQ ID NO: 2157173 - RNA, 13 nt, Human
gugccucccuggu

SEQ ID NO: 2157174 - RNA, 15 nt, Human
aacugcaaagugaag

SEQ ID NO: 2157175 - RNA, 18 nt, Human
aacugcaaagugaaguug

SEQ ID NO: 2157176 - RNA, 13 nt, Human
aacugaaagugaa

SEQ ID NO: 2157177 - RNA, 18 nt, Human
gugaacuucuugaaucua

SEQ ID NO: 2157178 - RNA, 15 nt, Human
aaccugaaccuagga

SEQ ID NO: 2157179 - RNA, 21 nt, Human
aacccagacggcuccacuagg

SEQ ID NO: 2157180 - RNA, 17 nt, Human
aacccagcaacagaaaa

SEQ ID NO: 2157181 - RNA, 16 nt, Human
aacccagcaacagaaa

SEQ ID NO: 2157182 - RNA, 23 nt, Human
aacccagcaacagaaaaauggag

SEQ ID NO: 2157183 - RNA, 12 nt, Human
aacccccacugg

SEQ ID NO: 2157184 - RNA, 16 nt, Human
aacccccacuggacug

SEQ ID NO: 2157185 - RNA, 18 nt, Human
aaccccgucaacaaaucu

SEQ ID NO: 2157186 - RNA, 17 nt, Human
aaccccgucaacaaauc

SEQ ID NO: 2157187 - RNA, 16 nt, Human
aaccccgucaacaaau

SEQ ID NO: 2157188 - RNA, 15 nt, Human
aaccccgucaacaaa

SEQ ID NO: 2157189 - RNA, 14 nt, Human
aaccccgucaacaa

SEQ ID NO: 2157190 - RNA, 22 nt, Human
aacccaaauuacguguacuaca

SEQ ID NO: 2157191 - RNA, 15 nt, Human
aaccauuuucauuug

SEQ ID NO: 2157192 - RNA, 21 nt, Human
aacaguuaauuaguuaacagu

SEQ ID NO: 2157193 - RNA, 15 nt, Human
gucuuuuuaaaaaua

SEQ ID NO: 2157194 - RNA, 23 nt, Human
gucuguaucaguggauuucccau

SEQ ID NO: 2157195 - RNA, 22 nt, Human
gucuguaucaguggauuuccca

SEQ ID NO: 2157196 - RNA, 15 nt, Human
gucuguaucagugga

SEQ ID NO: 2157197 - RNA, 16 nt, Human
gucuguaucacucugu

SEQ ID NO: 2157198 - RNA, 17 nt, Human
aacuacugcaccauuua

SEQ ID NO: 2157199 - RNA, 16 nt, Human
aacuacugcaccauuu

SEQ ID NO: 2157200 - RNA, 20 nt, Human
aacuacugcaccauuuaaaa

SEQ ID NO: 2157201 - RNA, 15 nt, Human
guauaauauuuuuaa

SEQ ID NO: 2157202 - RNA, 12 nt, Human
guauaauauuuu

SEQ ID NO: 2157203 - RNA, 21 nt, Human
guaucaguggauuucccaucc

SEQ ID NO: 2157204 - RNA, 20 nt, Human
gucaaacaaacucucugaac

SEQ ID NO: 2157205 - RNA, 13 nt, Human
aaauugugugugc

SEQ ID NO: 2157206 - RNA, 21 nt, Human
aaauugugugugcucugcuuc

SEQ ID NO: 2157207 - RNA, 22 nt, Human
aaauugugugugcucugcuuca

SEQ ID NO: 2157208 - RNA, 21 nt, Human
aaaugucacguuuuguuuugu

SEQ ID NO: 2157209 - RNA, 22 nt, Human
aaauuaguaggcucauuuacug

SEQ ID NO: 2157210 - RNA, 18 nt, Human
aaauuuggccaaacaagu

SEQ ID NO: 2157211 - RNA, 23 nt, Human
gucaggaguucgagaccagccug

SEQ ID NO: 2157212 - RNA, 19 nt, Human
gucagaauuagcugcuucu

SEQ ID NO: 2157213 - RNA, 22 nt, Human
gucaacaaaucuaggaaaauau

SEQ ID NO: 2157214 - RNA, 12 nt, Human
gucaacaaaucu

SEQ ID NO: 2157215 - RNA, 16 nt, Human
aacaauguauuuucuu

SEQ ID NO: 2157216 - RNA, 20 nt, Human
aacaauguuguuuuaagacu

SEQ ID NO: 2157217 - RNA, 20 nt, Human
gucauuuuucagaccuuuua

SEQ ID NO: 2157218 - RNA, 11 nt, Human
aacagggaggg

SEQ ID NO: 2157219 - RNA, 20 nt, Human
guuucugaaaauuaacacug

SEQ ID NO: 2157220 - RNA, 21 nt, Human
guuucugaaaauuaacacugc

SEQ ID NO: 2157221 - RNA, 21 nt, Human
guuuacagucuauuugagacu

SEQ ID NO: 2157222 - RNA, 16 nt, Human
guuuacagucuauuug

SEQ ID NO: 2157223 - RNA, 14 nt, Human
guuuacagucuauu

SEQ ID NO: 2157224 - RNA, 13 nt, Human
guuuauuuuaaga

SEQ ID NO: 2157225 - RNA, 22 nt, Human
aaggaagccacagcugguggua

SEQ ID NO: 2157226 - RNA, 12 nt, Human
aaggagggugag

SEQ ID NO: 2157227 - RNA, 19 nt, Human
aaggagccuaggccaggug

SEQ ID NO: 2157228 - RNA, 18 nt, Human
aaggagccuaggccaggu

SEQ ID NO: 2157229 - RNA, 21 nt, Human
aaggagccuaggccaggugca

SEQ ID NO: 2157230 - RNA, 16 nt, Human
aaggagccuaggccag

SEQ ID NO: 2157231 - RNA, 15 nt, Human
aaggagaugaagcaa

SEQ ID NO: 2157232 - RNA, 21 nt, Human
aaggcccacgagcuuguucuu

SEQ ID NO: 2157233 - RNA, 22 nt, Human
aaggccauccuucccugucugc

SEQ ID NO: 2157234 - RNA, 23 nt, Human
guugcuucuucuacuucagucuu

SEQ ID NO: 2157235 - RNA, 14 nt, Human
aaguauuuuauucu

SEQ ID NO: 2157236 - RNA, 18 nt, Human
uaaaauacgguaccuggc

SEQ ID NO: 2157237 - RNA, 18 nt, Human
aagaucucugcagggccg

SEQ ID NO: 2157238 - RNA, 17 nt, Human
aagaugaacagacugac

SEQ ID NO: 2157239 - RNA, 15 nt, Human
aagaugaacagacug

SEQ ID NO: 2157240 - RNA, 16 nt, Human
guguggguaccuguau

SEQ ID NO: 2157241 - RNA, 17 nt, Human
guguggguaccuguauu

SEQ ID NO: 2157242 - RNA, 23 nt, Human
gugucaggaugguaauucuuauu

SEQ ID NO: 2157243 - RNA, 22 nt, Human
aagauggguccaggauuccucu

SEQ ID NO: 2157244 - RNA, 18 nt, Human
aagaugggugaaggcugg

SEQ ID NO: 2157245 - RNA, 16 nt, Human
aagacguguuuguguu

SEQ ID NO: 2157246 - RNA, 15 nt, Human
aagacguguuugugu

SEQ ID NO: 2157247 - RNA, 23 nt, Human
aagacguguuuguguuugugugu

SEQ ID NO: 2157248 - RNA, 20 nt, Human
aagacuauccaacuuaacau

SEQ ID NO: 2157249 - RNA, 20 nt, Human
aagacuugcauuuaaaugug

SEQ ID NO: 2157250 - RNA, 11 nt, Human
aagagccacag

SEQ ID NO: 2157251 - RNA, 13 nt, Human
aagaccuuucaaa

SEQ ID NO: 2157252 - RNA, 17 nt, Human
aagaggaugcugugaaa

SEQ ID NO: 2157253 - RNA, 17 nt, Human
guggccgcccaaggccc

SEQ ID NO: 2157254 - RNA, 14 nt, Human
aagaggaugcugug

SEQ ID NO: 2157255 - RNA, 22 nt, Human
aagagccacaggucuuuauguu

SEQ ID NO: 2157256 - RNA, 15 nt, Human
aagagccacaggucu

SEQ ID NO: 2157257 - RNA, 16 nt, Human
aagcccccccuuccac

SEQ ID NO: 2157258 - RNA, 19 nt, Human
aagcccugggaucacugug

SEQ ID NO: 2157259 - RNA, 17 nt, Human
gugugugcucugcuuca

SEQ ID NO: 2157260 - RNA, 13 nt, Human
guuagggaauggc

SEQ ID NO: 2157261 - RNA, 15 nt, Human
guucaaacauuuacc

SEQ ID NO: 2157262 - RNA, 20 nt, Human
guuagaauaauaaauauuua

SEQ ID NO: 2157263 - RNA, 22 nt, Human
guuacuuuucauauuugcacua

SEQ ID NO: 2157264 - RNA, 21 nt, Human
guuacuuuucauauuugcacu

SEQ ID NO: 2157265 - RNA, 18 nt, Human
guuacuuuucauauuugc

SEQ ID NO: 2157266 - RNA, 15 nt, Human
guuaggauggcagga

SEQ ID NO: 2157267 - RNA, 16 nt, Human
aauagacuaaaugaaa

SEQ ID NO: 2157268 - RNA, 15 nt, Human
aauagacuaaaugaa

SEQ ID NO: 2157269 - RNA, 21 nt, Human
aauacaccagguagaacacaa

SEQ ID NO: 2157270 - RNA, 16 nt, Human
uaaauguuaagaaaaa

SEQ ID NO: 2157271 - RNA, 15 nt, Human
uaacuagcuuggaaa

SEQ ID NO: 2157272 - RNA, 17 nt, Human
uaacuuccaugugaggg

SEQ ID NO: 2157273 - RNA, 15 nt, Human
uaagacguguuugug

SEQ ID NO: 2157274 - RNA, 19 nt, Human
uaaguuuccuuccagccca

SEQ ID NO: 2157275 - RNA, 21 nt, Human
uaaguuuccuuccagcccaga

SEQ ID NO: 2157276 - RNA, 11 nt, Human
aaucuauuuaa

SEQ ID NO: 2157277 - RNA, 17 nt, Human
aaucuauuuaucuucau

SEQ ID NO: 2157278 - RNA, 12 nt, Human
aaucuauuuaag

SEQ ID NO: 2157279 - RNA, 14 nt, Human
aaucccagcaauuu

SEQ ID NO: 2157280 - RNA, 18 nt, Human
aaugacuaauucuugcau

SEQ ID NO: 2157281 - RNA, 17 nt, Human
aaugacuaauucuugca

SEQ ID NO: 2157282 - RNA, 20 nt, Human
aaugacuaauucuugcauau

SEQ ID NO: 2157283 - RNA, 17 nt, Human
aaugagaggcauuuccc

SEQ ID NO: 2157284 - RNA, 17 nt, Human
aaugagauuaauuccuu

SEQ ID NO: 2157285 - RNA, 18 nt, Human
aaugagauuaauuccuuu

SEQ ID NO: 2157286 - RNA, 22 nt, Human
aaugagaagaaaauggaaccag

SEQ ID NO: 2157287 - RNA, 19 nt, Human
aaugaguuaccuacauuuu

SEQ ID NO: 2157288 - RNA, 19 nt, Human
uaauuuaaagccacaacca

SEQ ID NO: 2157289 - RNA, 12 nt, Human
uaauuuaaagcc

SEQ ID NO: 2157290 - RNA, 13 nt, Human
uaauuuauaaaaa

SEQ ID NO: 2157291 - RNA, 16 nt, Human
uaauuuauaaaaaggu

SEQ ID NO: 2157292 - RNA, 13 nt, Human
aaugcaaaaaucu

SEQ ID NO: 2157293 - RNA, 18 nt, Human
aauggauaaaaucugaua

SEQ ID NO: 2157294 - RNA, 19 nt, Human
aaugguuugcaaggaagcc

SEQ ID NO: 2157295 - RNA, 18 nt, Human
aaugguuugcaaggaagc

SEQ ID NO: 2157296 - RNA, 17 nt, Human
aaugguuugcaaggaag

SEQ ID NO: 2157297 - RNA, 15 nt, Human
uacagagaagugaau

SEQ ID NO: 2157298 - RNA, 23 nt, Human
uacagagaagugaauaacugcaa

SEQ ID NO: 2157299 - RNA, 18 nt, Human
uacaaugaugcuauuugc

SEQ ID NO: 2157300 - RNA, 14 nt, Human
aauggaaccaggcu

SEQ ID NO: 2157301 - RNA, 18 nt, Human
aaugcuuuagaaagguuu

SEQ ID NO: 2157302 - RNA, 17 nt, Human
aauggaaccaggcuugg

SEQ ID NO: 2157303 - RNA, 16 nt, Human
aauggaaccaggcuug

SEQ ID NO: 2157304 - RNA, 22 nt, Human
uaccuguguauuuuuuaaagcu

SEQ ID NO: 2157305 - RNA, 15 nt, Human
aauguuagauaguua

SEQ ID NO: 2157306 - RNA, 13 nt, Human
uacaggggccaga

SEQ ID NO: 2157307 - RNA, 20 nt, Human
uacagggcacaggccaugga

SEQ ID NO: 2157308 - RNA, 15 nt, Human
uacaggggccagaag

SEQ ID NO: 2157309 - RNA, 17 nt, Human
uacagggguucuggaaa

SEQ ID NO: 2157310 - RNA, 17 nt, Human
uaccaugugcuacaggg

SEQ ID NO: 2157311 - RNA, 22 nt, Human
aauuaaguuagggaauggcaca

SEQ ID NO: 2157312 - RNA, 18 nt, Human
acaggacuuaaaaugaca

SEQ ID NO: 2157313 - RNA, 21 nt, Human
acagcuucucauccugcaggc

SEQ ID NO: 2157314 - RNA, 20 nt, Human
acagcuucucauccugcagg

SEQ ID NO: 2157315 - RNA, 15 nt, Human
acagcuauauuucug

SEQ ID NO: 2157316 - RNA, 16 nt, Human
acagcaagucaggguu

SEQ ID NO: 2157317 - RNA, 12 nt, Human
acagcaagucag

SEQ ID NO: 2157318 - RNA, 13 nt, Human
acagcgcuaugca

SEQ ID NO: 2157319 - RNA, 16 nt, Human
uauggcagugucuuuc

SEQ ID NO: 2157320 - RNA, 13 nt, Human
uauggcagugucu

SEQ ID NO: 2157321 - RNA, 23 nt, Human
uaugggaaaugagaggcauuucc

SEQ ID NO: 2157322 - RNA, 11 nt, Human
acagaaaaacc

SEQ ID NO: 2157323 - RNA, 22 nt, Human
uaucaauuggaaaggaagaaaa

SEQ ID NO: 2157324 - RNA, 15 nt, Human
uauccccucuacucu

SEQ ID NO: 2157325 - RNA, 14 nt, Human
uauaacugcccagc

SEQ ID NO: 2157326 - RNA, 14 nt, Human
uauauauuuuaauu

SEQ ID NO: 2157327 - RNA, 22 nt, Human
uauagcccagccaggccccagg

SEQ ID NO: 2157328 - RNA, 14 nt, Human
uaggauguaaaucu

SEQ ID NO: 2157329 - RNA, 14 nt, Human
uaggauacugcugc

SEQ ID NO: 2157330 - RNA, 13 nt, Human
uaggaaaauauuu

SEQ ID NO: 2157331 - RNA, 22 nt, Human
uagggcaggagugagaggucuc

SEQ ID NO: 2157332 - RNA, 21 nt, Human
uagcuucaccccaaucccagc

SEQ ID NO: 2157333 - RNA, 20 nt, Human
uagcuuggaaacuggaugag

SEQ ID NO: 2157334 - RNA, 15 nt, Human
uagcuuggaaacugg

SEQ ID NO: 2157335 - RNA, 19 nt, Human
uagcuuuugugucuuacau

SEQ ID NO: 2157336 - RNA, 16 nt, Human
uagcuuuugugucuua

SEQ ID NO: 2157337 - RNA, 18 nt, Human
acaaaucuaggaaaauau

SEQ ID NO: 2157338 - RNA, 22 nt, Human
acaaaucuaggaaaauauuuug

SEQ ID NO: 2157339 - RNA, 12 nt, Human
acacaauacaau

SEQ ID NO: 2157340 - RNA, 14 nt, Human
acacaauacaauaa

SEQ ID NO: 2157341 - RNA, 18 nt, Human
acaaugaugcuauuugca

SEQ ID NO: 2157342 - RNA, 20 nt, Human
acaaugaugcuauuugcaau

SEQ ID NO: 2157343 - RNA, 15 nt, Human
uaguaaaaauacaaa

SEQ ID NO: 2157344 - RNA, 17 nt, Human
acacacagacucauauu

SEQ ID NO: 2157345 - RNA, 16 nt, Human
acacaggccugcucuc

SEQ ID NO: 2157346 - RNA, 12 nt, Human
acaaaacaaaaa

SEQ ID NO: 2157347 - RNA, 22 nt, Human
acaaaaagguaaaacuuuuuau

SEQ ID NO: 2157348 - RNA, 12 nt, Human
acaaaacaaaac

SEQ ID NO: 2157349 - RNA, 11 nt, Human
acaaaaaagug

SEQ ID NO: 2157350 - RNA, 12 nt, Human
acaaaaaagaag

SEQ ID NO: 2157351 - RNA, 22 nt, Human
acaaaggugaaaauuguuugua

SEQ ID NO: 2157352 - RNA, 15 nt, Human
uagagggaccucucc

SEQ ID NO: 2157353 - RNA, 19 nt, Human
uagagggaccucucccagg

SEQ ID NO: 2157354 - RNA, 20 nt, Human
uagagggaccucucccaggg

SEQ ID NO: 2157355 - RNA, 21 nt, Human
uagcacaacgugguacuauuu

SEQ ID NO: 2157356 - RNA, 12 nt, Human
aauuuggcuucu

SEQ ID NO: 2157357 - RNA, 18 nt, Human
aauuuggcuucuguuguc

SEQ ID NO: 2157358 - RNA, 20 nt, Human
uacuuuucauauuugcacua

SEQ ID NO: 2157359 - RNA, 19 nt, Human
uacuuuucauauuugcacu

SEQ ID NO: 2157360 - RNA, 20 nt, Human
acuacgggggggagaaggaa

SEQ ID NO: 2157361 - RNA, 20 nt, Human
acuagagggaccucucccag

SEQ ID NO: 2157362 - RNA, 21 nt, Human
acuagagggaccucucccagg

SEQ ID NO: 2157363 - RNA, 22 nt, Human
acuagagggaccucucccaggg

SEQ ID NO: 2157364 - RNA, 19 nt, Human
uccccaucgccagcugaug

SEQ ID NO: 2157365 - RNA, 20 nt, Human
uccccaucgccagcugauga

SEQ ID NO: 2157366 - RNA, 19 nt, Human
ucccccaccccauuucucu

SEQ ID NO: 2157367 - RNA, 14 nt, Human
uccccucucugcac

SEQ ID NO: 2157368 - RNA, 23 nt, Human
uccccguaugaguuagaauaaua

SEQ ID NO: 2157369 - RNA, 22 nt, Human
acucaauauuuuccaugaaaau

SEQ ID NO: 2157370 - RNA, 21 nt, Human
acucaauauuuuccaugaaaa

SEQ ID NO: 2157371 - RNA, 18 nt, Human
acucaauauuuuccauga

SEQ ID NO: 2157372 - RNA, 15 nt, Human
acucaauauuuucca

SEQ ID NO: 2157373 - RNA, 12 nt, Human
acucaauauuuu

SEQ ID NO: 2157374 - RNA, 19 nt, Human
acucacauggcuauguuuu

SEQ ID NO: 2157375 - RNA, 16 nt, Human
acucacauggcuaugu

SEQ ID NO: 2157376 - RNA, 23 nt, Human
acucaauauuuuccaugaaaaug

SEQ ID NO: 2157377 - RNA, 20 nt, Human
acucacauggcuauguuuua

SEQ ID NO: 2157378 - RNA, 16 nt, Human
acucaccucuaaaaca

SEQ ID NO: 2157379 - RNA, 22 nt, Human
ucccugacccuguauauagccc

SEQ ID NO: 2157380 - RNA, 17 nt, Human
ucccugacccuguauau

SEQ ID NO: 2157381 - RNA, 16 nt, Human
ucccugacccuguaua

SEQ ID NO: 2157382 - RNA, 17 nt, Human
acucagaagggagcuag

SEQ ID NO: 2157383 - RNA, 17 nt, Human
acugaaaaccucuccuc

SEQ ID NO: 2157384 - RNA, 15 nt, Human
acugaaaaccucucc

SEQ ID NO: 2157385 - RNA, 16 nt, Human
acugaaaaccucuccu

SEQ ID NO: 2157386 - RNA, 12 nt, Human
uccucuuguaaa

SEQ ID NO: 2157387 - RNA, 15 nt, Human
uccucuuuucucugc

SEQ ID NO: 2157388 - RNA, 21 nt, Human
uccucuuguaaauaaagcccu

SEQ ID NO: 2157389 - RNA, 19 nt, Human
uccucuuguaaauaaagcc

SEQ ID NO: 2157390 - RNA, 18 nt, Human
uccucuuguaaauaaagc

SEQ ID NO: 2157391 - RNA, 20 nt, Human
uccucuuguaaauaaagccc

SEQ ID NO: 2157392 - RNA, 12 nt, Human
acucuucucagc

SEQ ID NO: 2157393 - RNA, 19 nt, Human
acucgauucauauugaaua

SEQ ID NO: 2157394 - RNA, 23 nt, Human
uccggcccuccuacccugcgccc

SEQ ID NO: 2157395 - RNA, 21 nt, Human
uccggcccuccuacccugcgc

SEQ ID NO: 2157396 - RNA, 20 nt, Human
uccuacccugcgcccagucc

SEQ ID NO: 2157397 - RNA, 19 nt, Human
uccauuuguuaucugggaa

SEQ ID NO: 2157398 - RNA, 17 nt, Human
uccauuuguuaucuggg

SEQ ID NO: 2157399 - RNA, 23 nt, Human
acggcccuggccuugggcccucu

SEQ ID NO: 2157400 - RNA, 14 nt, Human
acggcccuggccuu

SEQ ID NO: 2157401 - RNA, 12 nt, Human
acggcccuggcc

SEQ ID NO: 2157402 - RNA, 12 nt, Human
uccaugaaaaug

SEQ ID NO: 2157403 - RNA, 20 nt, Human
acgccgcccuaaaagcacac

SEQ ID NO: 2157404 - RNA, 19 nt, Human
uccagggagcauuuuccuc

SEQ ID NO: 2157405 - RNA, 21 nt, Human
uccagggacgaagaagagcca

SEQ ID NO: 2157406 - RNA, 17 nt, Human
acgaagccaucuuucuu

SEQ ID NO: 2157407 - RNA, 15 nt, Human
acgaagaagagccac

SEQ ID NO: 2157408 - RNA, 18 nt, Human
acgaagaagagccacagu

SEQ ID NO: 2157409 - RNA, 17 nt, Human
acgaagaagagccacag

SEQ ID NO: 2157410 - RNA, 14 nt, Human
accugaaccuagga

SEQ ID NO: 2157411 - RNA, 16 nt, Human
accugaacugaacacc

SEQ ID NO: 2157412 - RNA, 14 nt, Human
ucauaaucuuugcu

SEQ ID NO: 2157413 - RNA, 15 nt, Human
ucauaaucuuugcuu

SEQ ID NO: 2157414 - RNA, 22 nt, Human
accugauuaacugaggcaucca

SEQ ID NO: 2157415 - RNA, 17 nt, Human
accugauuaacugaggc

SEQ ID NO: 2157416 - RNA, 18 nt, Human
ucauuuuucagaccuuuu

SEQ ID NO: 2157417 - RNA, 17 nt, Human
ucauuuuguaacaaaug

SEQ ID NO: 2157418 - RNA, 20 nt, Human
ucauuuuguaacaaaugaac

SEQ ID NO: 2157419 - RNA, 14 nt, Human
accuggacacaggc

SEQ ID NO: 2157420 - RNA, 17 nt, Human
accuggacacaggccug

SEQ ID NO: 2157421 - RNA, 21 nt, Human
accuggcuuuuuauuguauuu

SEQ ID NO: 2157422 - RNA, 17 nt, Human
accuugaugagcugugc

SEQ ID NO: 2157423 - RNA, 22 nt, Human
accuucuggccucccacagacu

SEQ ID NO: 2157424 - RNA, 18 nt, Human
accuucuggccucccaca

SEQ ID NO: 2157425 - RNA, 14 nt, Human
accuucagaauaag

SEQ ID NO: 2157426 - RNA, 22 nt, Human
accuucacugugaccuugagaa

SEQ ID NO: 2157427 - RNA, 17 nt, Human
accuucacacacagacu

SEQ ID NO: 2157428 - RNA, 23 nt, Human
accuucacacacagacuguuguc

SEQ ID NO: 2157429 - RNA, 22 nt, Human
accuucaguaacccccacugga

SEQ ID NO: 2157430 - RNA, 15 nt, Human
ucacaugggacaaag

SEQ ID NO: 2157431 - RNA, 21 nt, Human
accaaugccaaaaaaagacag

SEQ ID NO: 2157432 - RNA, 19 nt, Human
accaaaaacugaaagugaa

SEQ ID NO: 2157433 - RNA, 17 nt, Human
ucaagauucccaggagu

SEQ ID NO: 2157434 - RNA, 16 nt, Human
ucaagauucccaggag

SEQ ID NO: 2157435 - RNA, 15 nt, Human
ucaagauucccagga

SEQ ID NO: 2157436 - RNA, 20 nt, Human
ucaagauucccaggaguucu

SEQ ID NO: 2157437 - RNA, 19 nt, Human
ucaagauucccaggaguuc

SEQ ID NO: 2157438 - RNA, 22 nt, Human
ucaagauucccaggaguucugc

SEQ ID NO: 2157439 - RNA, 18 nt, Human
ucaauauuuuccaugaaa

SEQ ID NO: 2157440 - RNA, 17 nt, Human
ucaauauuuuccaugaa

SEQ ID NO: 2157441 - RNA, 16 nt, Human
ucaauauuuuccauga

SEQ ID NO: 2157442 - RNA, 15 nt, Human
ucaauauuuuccaug

SEQ ID NO: 2157443 - RNA, 24 nt, Human
ucaaguacauaaaguacauaacaa

SEQ ID NO: 2157444 - RNA, 21 nt, Human
accaaaaaagcuguauuuuga

SEQ ID NO: 2157445 - RNA, 15 nt, Human
acauuuuaaugcacc

SEQ ID NO: 2157446 - RNA, 19 nt, Human
acauuuuaaugcaccugaa

SEQ ID NO: 2157447 - RNA, 23 nt, Human
acauugggaaggggacccccgcc

SEQ ID NO: 2157448 - RNA, 19 nt, Human
acauugggaaggggacccc

SEQ ID NO: 2157449 - RNA, 15 nt, Human
acauugggaagggga

SEQ ID NO: 2157450 - RNA, 22 nt, Human
acauugguauucgcuugagaaa

SEQ ID NO: 2157451 - RNA, 14 nt, Human
uauuuugaucuuca

SEQ ID NO: 2157452 - RNA, 12 nt, Human
uauuuugaucuu

SEQ ID NO: 2157453 - RNA, 18 nt, Human
uauuuugaucuucaacaa

SEQ ID NO: 2157454 - RNA, 16 nt, Human
uauuuugaucuucaac

SEQ ID NO: 2157455 - RNA, 15 nt, Human
uauuuugaucuucaa

SEQ ID NO: 2157456 - RNA, 13 nt, Human
uauuuuuauuugu

SEQ ID NO: 2157457 - RNA, 17 nt, Human
uauuuuuauuuguuugu

SEQ ID NO: 2157458 - RNA, 16 nt, Human
uauuuuguaacuucca

SEQ ID NO: 2157459 - RNA, 22 nt, Human
uauuuguuaaugguuugaauau

SEQ ID NO: 2157460 - RNA, 20 nt, Human
uauuuguuaaugguuugaau

SEQ ID NO: 2157461 - RNA, 22 nt, Human
uauuuguaggggaacucauuug

SEQ ID NO: 2157462 - RNA, 20 nt, Human
acauguauaauauuuuuaau

SEQ ID NO: 2157463 - RNA, 19 nt, Human
acauguauaauauuuuuaa

SEQ ID NO: 2157464 - RNA, 14 nt, Human
acauguauaauauu

SEQ ID NO: 2157465 - RNA, 17 nt, Human
acauuaagccuuccaca

SEQ ID NO: 2157466 - RNA, 22 nt, Human
ucauaagagccacaggucuuua

SEQ ID NO: 2157467 - RNA, 14 nt, Human
ucauaaagaauugu

SEQ ID NO: 2157468 - RNA, 17 nt, Human
acccuggaaaaugaauc

SEQ ID NO: 2157469 - RNA, 17 nt, Human
acccccacuggacugac

SEQ ID NO: 2157470 - RNA, 22 nt, Human
acccugcgcccaguccuuccac

SEQ ID NO: 2157471 - RNA, 18 nt, Human
acccugaggccucuggaa

SEQ ID NO: 2157472 - RNA, 17 nt, Human
ucacuucacgcuuucag

SEQ ID NO: 2157473 - RNA, 22 nt, Human
accaugugcuacaggggccaga

SEQ ID NO: 2157474 - RNA, 23 nt, Human
accaugcgacacugggaggccag

SEQ ID NO: 2157475 - RNA, 22 nt, Human
accaugcgacacugggaggcca

SEQ ID NO: 2157476 - RNA, 17 nt, Human
acccagcaacagaaaaa

SEQ ID NO: 2157477 - RNA, 18 nt, Human
ucagaauuagcugcuucu

SEQ ID NO: 2157478 - RNA, 13 nt, Human
ucguucucccugg

SEQ ID NO: 2157479 - RNA, 22 nt, Human
acuguggggaaccaauugcuuu

SEQ ID NO: 2157480 - RNA, 20 nt, Human
ucuaaagaguuuauuuuaag

SEQ ID NO: 2157481 - RNA, 21 nt, Human
ucuaaagaguuuauuuuaaga

SEQ ID NO: 2157482 - RNA, 20 nt, Human
acugggccauguugugccuc

SEQ ID NO: 2157483 - RNA, 14 nt, Human
ucgcccucccaggc

SEQ ID NO: 2157484 - RNA, 13 nt, Human
ucgcccucccagg

SEQ ID NO: 2157485 - RNA, 17 nt, Human
ucgcccucccaggcucu

SEQ ID NO: 2157486 - RNA, 17 nt, Human
acugaaauauacacaca

SEQ ID NO: 2157487 - RNA, 15 nt, Human
acugaaauauacaca

SEQ ID NO: 2157488 - RNA, 16 nt, Human
acugaaauauacacac

SEQ ID NO: 2157489 - RNA, 15 nt, Human
acuguacugggccau

SEQ ID NO: 2157490 - RNA, 16 nt, Human
acuguccuccaagcca

SEQ ID NO: 2157491 - RNA, 18 nt, Human
acuguccuccaagccagc

SEQ ID NO: 2157492 - RNA, 22 nt, Human
acuguaucucuaauacagugug

SEQ ID NO: 2157493 - RNA, 22 nt, Human
acuuccaugugaggguuuucag

SEQ ID NO: 2157494 - RNA, 20 nt, Human
acuuccagugcaacacugaa

SEQ ID NO: 2157495 - RNA, 20 nt, Human
acuucaggcuugauaauacu

SEQ ID NO: 2157496 - RNA, 18 nt, Human
acuucaggcuugauaaua

SEQ ID NO: 2157497 - RNA, 16 nt, Human
acuucaugcaggugaa

SEQ ID NO: 2157498 - RNA, 23 nt, Human
acuucauggccuuugauaaaugu

SEQ ID NO: 2157499 - RNA, 22 nt, Human
acuucauggccuuugauaaaug

SEQ ID NO: 2157500 - RNA, 16 nt, Human
acuucccccaaauuua

SEQ ID NO: 2157501 - RNA, 11 nt, Human
acuucccccaa

SEQ ID NO: 2157502 - RNA, 16 nt, Human
ucuaggaaaauauuuu

SEQ ID NO: 2157503 - RNA, 22 nt, Human
ucuaggaaaauauuuugaucuu

SEQ ID NO: 2157504 - RNA, 21 nt, Human
ucuaggaaaauauuuugaucu

SEQ ID NO: 2157505 - RNA, 20 nt, Human
acuuccugagggaucuauac

SEQ ID NO: 2157506 - RNA, 22 nt, Human
acuucggcagauacugucucuu

SEQ ID NO: 2157507 - RNA, 14 nt, Human
acuucucuuccuug

SEQ ID NO: 2157508 - RNA, 20 nt, Human
acuugacagaacacugucuu

SEQ ID NO: 2157509 - RNA, 18 nt, Human
acuugacagaacacuguc

SEQ ID NO: 2157510 - RNA, 17 nt, Human
acuugacagaacacugu

SEQ ID NO: 2157511 - RNA, 18 nt, Human
acuugaguuacaccagac

SEQ ID NO: 2157512 - RNA, 21 nt, Human
acuugaguuacaccagaccug

SEQ ID NO: 2157513 - RNA, 22 nt, Human
acuugccgcgucgcccucccag

SEQ ID NO: 2157514 - RNA, 23 nt, Human
acuugccgcgucgcccucccagg

SEQ ID NO: 2157515 - RNA, 10 nt, Human
acuuugugcu

SEQ ID NO: 2157516 - RNA, 18 nt, Human
agaaagacagagcuggga

SEQ ID NO: 2157517 - RNA, 22 nt, Human
agaaacuguucccaccugcugg

SEQ ID NO: 2157518 - RNA, 15 nt, Human
agaaacuguucccac

SEQ ID NO: 2157519 - RNA, 21 nt, Human
agaaacuguucccaccugcug

SEQ ID NO: 2157520 - RNA, 15 nt, Human
agaagcauacaacuu

SEQ ID NO: 2157521 - RNA, 15 nt, Human
agaacuuuauuucca

SEQ ID NO: 2157522 - RNA, 13 nt, Human
ucuggccucccac

SEQ ID NO: 2157523 - RNA, 14 nt, Human
ucuggccucccaca

SEQ ID NO: 2157524 - RNA, 13 nt, Human
agaauauaauacu

SEQ ID NO: 2157525 - RNA, 23 nt, Human
agaauaguugaaccuauuucucu

SEQ ID NO: 2157526 - RNA, 21 nt, Human
agaauaguugaaccuauuucu

SEQ ID NO: 2157527 - RNA, 16 nt, Human
agaauauaaaaaacuu

SEQ ID NO: 2157528 - RNA, 20 nt, Human
agaauaguugaaccuauuuc

SEQ ID NO: 2157529 - RNA, 16 nt, Human
agaaggagacaggcag

SEQ ID NO: 2157530 - RNA, 19 nt, Human
agaagcucucgggcuagga

SEQ ID NO: 2157531 - RNA, 16 nt, Human
ugaaaaggcaaaaagc

SEQ ID NO: 2157532 - RNA, 19 nt, Human
ucuuugguuuaauuuaaag

SEQ ID NO: 2157533 - RNA, 17 nt, Human
ucuuugugucaacauga

SEQ ID NO: 2157534 - RNA, 9 nt, Human
ugaaaaaga

SEQ ID NO: 2157535 - RNA, 11 nt, Human
agagcugaggc

SEQ ID NO: 2157536 - RNA, 15 nt, Human
ucuuuauguugaguc

SEQ ID NO: 2157537 - RNA, 17 nt, Human
ucuuggcuuggugagga

SEQ ID NO: 2157538 - RNA, 14 nt, Human
agaccugucuccug

SEQ ID NO: 2157539 - RNA, 16 nt, Human
agaccugucuccuggc

SEQ ID NO: 2157540 - RNA, 15 nt, Human
agaccugucuccugg

SEQ ID NO: 2157541 - RNA, 19 nt, Human
ucuucccauucuccauuug

SEQ ID NO: 2157542 - RNA, 15 nt, Human
ucuucccauucucca

SEQ ID NO: 2157543 - RNA, 14 nt, Human
ucuucccauucucc

SEQ ID NO: 2157544 - RNA, 13 nt, Human
ucuucccauucuc

SEQ ID NO: 2157545 - RNA, 20 nt, Human
ucuucaaccagggauuguuu

SEQ ID NO: 2157546 - RNA, 12 nt, Human
agacauugcacc

SEQ ID NO: 2157547 - RNA, 16 nt, Human
agaguuucaaccauga

SEQ ID NO: 2157548 - RNA, 18 nt, Human
ugaaaguccagaaacugu

SEQ ID NO: 2157549 - RNA, 16 nt, Human
ugaaaguccagaaacu

SEQ ID NO: 2157550 - RNA, 18 nt, Human
ugaagccuuucuuuugga

SEQ ID NO: 2157551 - RNA, 22 nt, Human
ugaaggggccaaggagggugag

SEQ ID NO: 2157552 - RNA, 13 nt, Human
ugaauaaagugcu

SEQ ID NO: 2157553 - RNA, 17 nt, Human
ugagaacuuuauuucca

SEQ ID NO: 2157554 - RNA, 20 nt, Human
ugagaagaaaauggaaccag

SEQ ID NO: 2157555 - RNA, 22 nt, Human
ugagaagaaaauggaaccaggc

SEQ ID NO: 2157556 - RNA, 22 nt, Human
ugagaagauucuucccauucuc

SEQ ID NO: 2157557 - RNA, 23 nt, Human
ugagaagauucuucccauucucc

SEQ ID NO: 2157558 - RNA, 12 nt, Human
agcaagaggagg

SEQ ID NO: 2157559 - RNA, 17 nt, Human
agcaagacuguuagccc

SEQ ID NO: 2157560 - RNA, 22 nt, Human
agauucccaggaguucugcuca

SEQ ID NO: 2157561 - RNA, 17 nt, Human
agauucccaggaguucu

SEQ ID NO: 2157562 - RNA, 19 nt, Human
agauucccaggaguucugc

SEQ ID NO: 2157563 - RNA, 10 nt, Human
agauggaaag

SEQ ID NO: 2157564 - RNA, 14 nt, Human
ugacucacaccuga

SEQ ID NO: 2157565 - RNA, 19 nt, Human
ugacucacaccugaacuga

SEQ ID NO: 2157566 - RNA, 16 nt, Human
ugacucaagauuccca

SEQ ID NO: 2157567 - RNA, 15 nt, Human
ugacucaagauuccc

SEQ ID NO: 2157568 - RNA, 14 nt, Human
ugacucaagauucc

SEQ ID NO: 2157569 - RNA, 22 nt, Human
ugacucaagauucccaggaguu

SEQ ID NO: 2157570 - RNA, 21 nt, Human
ugacucaagauucccaggagu

SEQ ID NO: 2157571 - RNA, 20 nt, Human
ugacucaagauucccaggag

SEQ ID NO: 2157572 - RNA, 19 nt, Human
ugacucaagauucccagga

SEQ ID NO: 2157573 - RNA, 18 nt, Human
ugacucaagauucccagg

SEQ ID NO: 2157574 - RNA, 17 nt, Human
ugacucaagauucccag

SEQ ID NO: 2157575 - RNA, 17 nt, Human
ugaccuucuaggaagcu

SEQ ID NO: 2157576 - RNA, 15 nt, Human
ugauauguauuguuu

SEQ ID NO: 2157577 - RNA, 16 nt, Human
ugauauuugugcauuu

SEQ ID NO: 2157578 - RNA, 19 nt, Human
ugauauuugugcauuuucu

SEQ ID NO: 2157579 - RNA, 17 nt, Human
ugauauuugugcauuuu

SEQ ID NO: 2157580 - RNA, 18 nt, Human
ugaucaaagccacacucu

SEQ ID NO: 2157581 - RNA, 19 nt, Human
agcauugauauuugugcau

SEQ ID NO: 2157582 - RNA, 21 nt, Human
agcauugauauuugugcauuu

SEQ ID NO: 2157583 - RNA, 18 nt, Human
agcauugauauuugugca

SEQ ID NO: 2157584 - RNA, 15 nt, Human
agcauugauauuugu

SEQ ID NO: 2157585 - RNA, 23 nt, Human
agcauugugugugcagacuucag

SEQ ID NO: 2157586 - RNA, 20 nt, Human
agcauuucgcgauggacaga

SEQ ID NO: 2157587 - RNA, 21 nt, Human
agcauugggugagguaauaaa

SEQ ID NO: 2157588 - RNA, 22 nt, Human
ugaguaaaauaaauauugucuu

SEQ ID NO: 2157589 - RNA, 16 nt, Human
ugagacacaggaugaa

SEQ ID NO: 2157590 - RNA, 19 nt, Human
ugagacacaggaugaagca

SEQ ID NO: 2157591 - RNA, 14 nt, Human
ugagucaauuggaa

SEQ ID NO: 2157592 - RNA, 23 nt, Human
ugagucacaaagaacauguagaa

SEQ ID NO: 2157593 - RNA, 23 nt, Human
agccaugggcacaaagggcccag

SEQ ID NO: 2157594 - RNA, 22 nt, Human
agccaugggcacaaagggccca

SEQ ID NO: 2157595 - RNA, 15 nt, Human
agccaggccccaggc

SEQ ID NO: 2157596 - RNA, 14 nt, Human
agccaggccccagg

SEQ ID NO: 2157597 - RNA, 13 nt, Human
agccacugaagua

SEQ ID NO: 2157598 - RNA, 19 nt, Human
ugauuaauuaaauagcuuu

SEQ ID NO: 2157599 - RNA, 15 nt, Human
agccacugagcaaug

SEQ ID NO: 2157600 - RNA, 20 nt, Human
ugaugacaacuacagaaaaa

SEQ ID NO: 2157601 - RNA, 19 nt, Human
ugaugagcugugcacaaag

SEQ ID NO: 2157602 - RNA, 24 nt, Human
ugaugagcugugcacaaaguggca

SEQ ID NO: 2157603 - RNA, 12 nt, Human
agcuagccagag

SEQ ID NO: 2157604 - RNA, 19 nt, Human
agcuagccagaggacugug

SEQ ID NO: 2157605 - RNA, 17 nt, Human
agcuagccagaggacug

SEQ ID NO: 2157606 - RNA, 22 nt, Human
agcggugcuguccucagguggc

SEQ ID NO: 2157607 - RNA, 18 nt, Human
agcguacucaucaucaac

SEQ ID NO: 2157608 - RNA, 14 nt, Human
agcuaccucaacca

SEQ ID NO: 2157609 - RNA, 23 nt, Human
agcuaccucaaccaaugccaaaa

SEQ ID NO: 2157610 - RNA, 18 nt, Human
agcucauaagagccacag

SEQ ID NO: 2157611 - RNA, 18 nt, Human
ugcccagcggacaguggc

SEQ ID NO: 2157612 - RNA, 18 nt, Human
ugcauaagguuuuuaugc

SEQ ID NO: 2157613 - RNA, 12 nt, Human
ugcauaccaacc

SEQ ID NO: 2157614 - RNA, 14 nt, Human
ugcauaccaaccug

SEQ ID NO: 2157615 - RNA, 18 nt, Human
ugcauaccaaccugggca

SEQ ID NO: 2157616 - RNA, 13 nt, Human
ugccaaguuuguu

SEQ ID NO: 2157617 - RNA, 16 nt, Human
agccuuccacacucac

SEQ ID NO: 2157618 - RNA, 19 nt, Human
ugcaccauuuaaaaacagg

SEQ ID NO: 2157619 - RNA, 18 nt, Human
aggccaaggcggguggau

SEQ ID NO: 2157620 - RNA, 20 nt, Human
uggccaugccucagcccuga

SEQ ID NO: 2157621 - RNA, 18 nt, Human
uggccaugccucagcccu

SEQ ID NO: 2157622 - RNA, 17 nt, Human
uggccaugccucagccc

SEQ ID NO: 2157623 - RNA, 15 nt, Human
uggccaugccucagc

SEQ ID NO: 2157624 - RNA, 14 nt, Human
uggccaugccucag

SEQ ID NO: 2157625 - RNA, 17 nt, Human
uggccaugaugacaacu

SEQ ID NO: 2157626 - RNA, 21 nt, Human
uggccugaagaguccucugaa

SEQ ID NO: 2157627 - RNA, 16 nt, Human
uggccaaacaaguguu

SEQ ID NO: 2157628 - RNA, 22 nt, Human
uggccaugaagaggaugcugug

SEQ ID NO: 2157629 - RNA, 20 nt, Human
aggcaaaggguccagaagga

SEQ ID NO: 2157630 - RNA, 19 nt, Human
aggcaaaggguccagaagg

SEQ ID NO: 2157631 - RNA, 16 nt, Human
aggcaaaggguccaga

SEQ ID NO: 2157632 - RNA, 11 nt, Human
uggaccugccc

SEQ ID NO: 2157633 - RNA, 13 nt, Human
uggacacaggccu

SEQ ID NO: 2157634 - RNA, 15 nt, Human
uggacacaggccugc

SEQ ID NO: 2157635 - RNA, 17 nt, Human
aggcaagguuauaugca

SEQ ID NO: 2157636 - RNA, 18 nt, Human
aggcaccucaagaagaag

SEQ ID NO: 2157637 - RNA, 12 nt, Human
aggcaccucaag

SEQ ID NO: 2157638 - RNA, 15 nt, Human
ugcuuguauagguuu

SEQ ID NO: 2157639 - RNA, 21 nt, Human
ugcuuuuggggggcauauauu

SEQ ID NO: 2157640 - RNA, 19 nt, Human
uggaagggauggggugcca

SEQ ID NO: 2157641 - RNA, 13 nt, Human
aggauacugcugc

SEQ ID NO: 2157642 - RNA, 22 nt, Human
aggagcugacucacaccugaac

SEQ ID NO: 2157643 - RNA, 16 nt, Human
aggagcuuccuguccu

SEQ ID NO: 2157644 - RNA, 11 nt, Human
aggagcuuccu

SEQ ID NO: 2157645 - RNA, 20 nt, Human
aggagcuuccuguccuccca

SEQ ID NO: 2157646 - RNA, 15 nt, Human
aggaaauagaauuga

SEQ ID NO: 2157647 - RNA, 14 nt, Human
agcuuuaccagcug

SEQ ID NO: 2157648 - RNA, 13 nt, Human
agcuuuaaaagaa

SEQ ID NO: 2157649 - RNA, 15 nt, Human
agcuuuaaaagaaaa

SEQ ID NO: 2157650 - RNA, 23 nt, Human
ugcucauucuaaugauggcccau

SEQ ID NO: 2157651 - RNA, 21 nt, Human
ugcucauucuaaugauggccc

SEQ ID NO: 2157652 - RNA, 19 nt, Human
ugcucauucuaaugauggc

SEQ ID NO: 2157653 - RNA, 17 nt, Human
ugccuuuggcagaguuc

SEQ ID NO: 2157654 - RNA, 14 nt, Human
agcuucuuugccaa

SEQ ID NO: 2157655 - RNA, 19 nt, Human
agcuggccccgccgccugg

SEQ ID NO: 2157656 - RNA, 18 nt, Human
agcuggccccgccgccug

SEQ ID NO: 2157657 - RNA, 15 nt, Human
agcuggccccgccgc

SEQ ID NO: 2157658 - RNA, 14 nt, Human
agcuggccccgccg

SEQ ID NO: 2157659 - RNA, 22 nt, Human
ugcccagcggacaguggcagga

SEQ ID NO: 2157660 - RNA, 21 nt, Human
ugcccagcggacaguggcagg

SEQ ID NO: 2157661 - RNA, 20 nt, Human
ugcccagcggacaguggcag

SEQ ID NO: 2157662 - RNA, 19 nt, Human
ugcccagcggacaguggca

SEQ ID NO: 2157663 - RNA, 13 nt, Human
agcuggccccgcc

SEQ ID NO: 2157664 - RNA, 21 nt, Human
uggucagguauuucaguucuu

SEQ ID NO: 2157665 - RNA, 20 nt, Human
agguauucaauauccuuugc

SEQ ID NO: 2157666 - RNA, 20 nt, Human
uggguggggaggaaauagaa

SEQ ID NO: 2157667 - RNA, 20 nt, Human
aggggcgugggaguggccug

SEQ ID NO: 2157668 - RNA, 23 nt, Human
aggggcgccgcaaaccacacugg

SEQ ID NO: 2157669 - RNA, 18 nt, Human
ugggccauguugugccuc

SEQ ID NO: 2157670 - RNA, 16 nt, Human
ugggcacccacccugg

SEQ ID NO: 2157671 - RNA, 14 nt, Human
ugggcacccacccu

SEQ ID NO: 2157672 - RNA, 20 nt, Human
ugggcacccacccugggacc

SEQ ID NO: 2157673 - RNA, 22 nt, Human
ugggcacacgccucccacuggg

SEQ ID NO: 2157674 - RNA, 17 nt, Human
aggccuuaucuccaaga

SEQ ID NO: 2157675 - RNA, 19 nt, Human
aggccuuaucuccaagacc

SEQ ID NO: 2157676 - RNA, 20 nt, Human
ugggagguggagguugcagu

SEQ ID NO: 2157677 - RNA, 20 nt, Human
agggccgggcagaggggcag

SEQ ID NO: 2157678 - RNA, 23 nt, Human
agggccgccagggagaccuggac

SEQ ID NO: 2157679 - RNA, 20 nt, Human
agggccgccagggagaccug

SEQ ID NO: 2157680 - RNA, 16 nt, Human
agggccgggcagaggg

SEQ ID NO: 2157681 - RNA, 18 nt, Human
agggccgggcagaggggc

SEQ ID NO: 2157682 - RNA, 18 nt, Human
ugggcccacaaaggcaaa

SEQ ID NO: 2157683 - RNA, 16 nt, Human
ugggcugggcccacaa

SEQ ID NO: 2157684 - RNA, 15 nt, Human
aguacaauucuuacu

SEQ ID NO: 2157685 - RNA, 19 nt, Human
aguacaccacaagggucac

SEQ ID NO: 2157686 - RNA, 21 nt, Human
aguagaaagacagagcuggga

SEQ ID NO: 2157687 - RNA, 20 nt, Human
aguagaaagacagagcuggg

SEQ ID NO: 2157688 - RNA, 12 nt, Human
aguaaaaauaca

SEQ ID NO: 2157689 - RNA, 13 nt, Human
aguaaaaauacaa

SEQ ID NO: 2157690 - RNA, 18 nt, Human
aguaaggaguucauuuua

SEQ ID NO: 2157691 - RNA, 19 nt, Human
aguaaaaauacaaaaauua

SEQ ID NO: 2157692 - RNA, 13 nt, Human
uguacuuugugcu

SEQ ID NO: 2157693 - RNA, 11 nt, Human
uguagaaaaca

SEQ ID NO: 2157694 - RNA, 19 nt, Human
uguaacuuccaugugaggg

SEQ ID NO: 2157695 - RNA, 13 nt, Human
aggugcagccaga

SEQ ID NO: 2157696 - RNA, 12 nt, Human
agguggccaugc

SEQ ID NO: 2157697 - RNA, 18 nt, Human
aggugcagccagaggcac

SEQ ID NO: 2157698 - RNA, 17 nt, Human
aggugcagccagaggca

SEQ ID NO: 2157699 - RNA, 16 nt, Human
aggugcagccagaggc

SEQ ID NO: 2157700 - RNA, 15 nt, Human
aggugcagccagagg

SEQ ID NO: 2157701 - RNA, 14 nt, Human
aggugcagccagag

SEQ ID NO: 2157702 - RNA, 19 nt, Human
agguggccaugccucagcc

SEQ ID NO: 2157703 - RNA, 18 nt, Human
agguggccaugccucagc

SEQ ID NO: 2157704 - RNA, 15 nt, Human
aggugcaaccaggga

SEQ ID NO: 2157705 - RNA, 13 nt, Human
aggugcaaccagg

SEQ ID NO: 2157706 - RNA, 22 nt, Human
ugucaggggcggggagggugac

SEQ ID NO: 2157707 - RNA, 18 nt, Human
aguagugccuuuacuuca

SEQ ID NO: 2157708 - RNA, 18 nt, Human
aguaggggaagacaugca

SEQ ID NO: 2157709 - RNA, 17 nt, Human
aguaggcucauuuacug

SEQ ID NO: 2157710 - RNA, 17 nt, Human
uguauuuuuuaaagcua

SEQ ID NO: 2157711 - RNA, 16 nt, Human
uguauuuuuuaaagcu

SEQ ID NO: 2157712 - RNA, 14 nt, Human
uguauuuuuuaaag

SEQ ID NO: 2157713 - RNA, 19 nt, Human
agucagaauuagcugcuuc

SEQ ID NO: 2157714 - RNA, 14 nt, Human
ugucuaaaaaacaa

SEQ ID NO: 2157715 - RNA, 13 nt, Human
ugucuaaaaaaca

SEQ ID NO: 2157716 - RNA, 18 nt, Human
ugucuaaaaaacaaaaca

SEQ ID NO: 2157717 - RNA, 20 nt, Human
aguccagaaacuguucccac

SEQ ID NO: 2157718 - RNA, 14 nt, Human
ugugguuaaugcca

SEQ ID NO: 2157719 - RNA, 15 nt, Human
ugugguuaaugccau

SEQ ID NO: 2157720 - RNA, 20 nt, Human
ugugguuaaugccauggaca

SEQ ID NO: 2157721 - RNA, 17 nt, Human
uguuaaugguuugaaua

SEQ ID NO: 2157722 - RNA, 15 nt, Human
uguuaaugcuuucug

SEQ ID NO: 2157723 - RNA, 20 nt, Human
uguuaacauuuuugguaguc

SEQ ID NO: 2157724 - RNA, 17 nt, Human
uguuaacauuuuuggua

SEQ ID NO: 2157725 - RNA, 15 nt, Human
agugccaaguuuguu

SEQ ID NO: 2157726 - RNA, 19 nt, Human
agugccccauucuuuugua

SEQ ID NO: 2157727 - RNA, 20 nt, Human
agugccccauucuuuuguaa

SEQ ID NO: 2157728 - RNA, 16 nt, Human
uguggauuuuuuccua

SEQ ID NO: 2157729 - RNA, 14 nt, Human
ugugcucugcuuca

SEQ ID NO: 2157730 - RNA, 14 nt, Human
ugugccucccuggu

SEQ ID NO: 2157731 - RNA, 16 nt, Human
ugugccucccugguga

SEQ ID NO: 2157732 - RNA, 15 nt, Human
aguuagaauaauaaa

SEQ ID NO: 2157733 - RNA, 19 nt, Human
aguuagaauaauaaauauu

SEQ ID NO: 2157734 - RNA, 18 nt, Human
aguuagaauaauaaauau

SEQ ID NO: 2157735 - RNA, 22 nt, Human
aguggaaagacagcuucucauc

SEQ ID NO: 2157736 - RNA, 19 nt, Human
aguggagaacugggcuugc

SEQ ID NO: 2157737 - RNA, 19 nt, Human
uguuauccuuuuuuaaaag

SEQ ID NO: 2157738 - RNA, 13 nt, Human
uguuauccuauuu

SEQ ID NO: 2157739 - RNA, 15 nt, Human
uguucuacuuuguuc

SEQ ID NO: 2157740 - RNA, 21 nt, Human
aguucgaugggcccaauucuu

SEQ ID NO: 2157741 - RNA, 14 nt, Human
uguuuaugcuuuug

SEQ ID NO: 2157742 - RNA, 19 nt, Human
uguuuauuaguuuugcaua

SEQ ID NO: 2157743 - RNA, 22 nt, Human
uguugguuacccuccuagcuuu

SEQ ID NO: 2157744 - RNA, 16 nt, Human
uguugugccucccugg

SEQ ID NO: 2157745 - RNA, 18 nt, Human
uguuguuccuuuugaaag

SEQ ID NO: 2157746 - RNA, 14 nt, Human
uguuguuccuuuug

SEQ ID NO: 2157747 - RNA, 15 nt, Human
uguuguuccuuuuga

SEQ ID NO: 2157748 - RNA, 22 nt, Human
uuaaucuccaccagucauuuuu

SEQ ID NO: 2157749 - RNA, 22 nt, Human
uuaagggaguguacucccaggg

SEQ ID NO: 2157750 - RNA, 18 nt, Human
uuaaaaaaaucaaaacaa

SEQ ID NO: 2157751 - RNA, 12 nt, Human
uuaaaaaaauca

SEQ ID NO: 2157752 - RNA, 18 nt, Human
uuaaaaaaagaagagaaa

SEQ ID NO: 2157753 - RNA, 12 nt, Human
uuaaaaaaagaa

SEQ ID NO: 2157754 - RNA, 12 nt, Human
uuaaaguauuuu

SEQ ID NO: 2157755 - RNA, 22 nt, Human
uuaaacaaauguaugauuacau

SEQ ID NO: 2157756 - RNA, 15 nt, Human
auaaucuauaugcug

SEQ ID NO: 2157757 - RNA, 22 nt, Human
auaauacuauauuuauacugua

SEQ ID NO: 2157758 - RNA, 16 nt, Human
uuacugaagccuuucu

SEQ ID NO: 2157759 - RNA, 20 nt, Human
uuagaacacugguuuaaagg

SEQ ID NO: 2157760 - RNA, 18 nt, Human
uuacccuccuagcuuucc

SEQ ID NO: 2157761 - RNA, 20 nt, Human
auaaccaugugaaaaggcaa

SEQ ID NO: 2157762 - RNA, 11 nt, Human
auaaauauuua

SEQ ID NO: 2157763 - RNA, 23 nt, Human
auaaauauugucuuuuuguaugu

SEQ ID NO: 2157764 - RNA, 21 nt, Human
auaaauauugucuuuuuguau

SEQ ID NO: 2157765 - RNA, 20 nt, Human
auaaauauugucuuuuugua

SEQ ID NO: 2157766 - RNA, 22 nt, Human
uuugggaaaaaaacauacacaa

SEQ ID NO: 2157767 - RNA, 23 nt, Human
augucaggggcggggagggugac

SEQ ID NO: 2157768 - RNA, 21 nt, Human
auguagucagaauuagcugcu

SEQ ID NO: 2157769 - RNA, 20 nt, Human
uuuguaggggaacucauuug

SEQ ID NO: 2157770 - RNA, 18 nt, Human
uuuguaggggaacucauu

SEQ ID NO: 2157771 - RNA, 19 nt, Human
augucuguaucacucugug

SEQ ID NO: 2157772 - RNA, 13 nt, Human
uuuuaacucaaua

SEQ ID NO: 2157773 - RNA, 21 nt, Human
uuuuaaccccgucaacaaauc

SEQ ID NO: 2157774 - RNA, 20 nt, Human
uuuuaaccccgucaacaaau

SEQ ID NO: 2157775 - RNA, 18 nt, Human
uuuuaaccccgucaacaa

SEQ ID NO: 2157776 - RNA, 16 nt, Human
uuuuaaccccgucaac

SEQ ID NO: 2157777 - RNA, 19 nt, Human
uuuuaagacguguuugugu

SEQ ID NO: 2157778 - RNA, 13 nt, Human
uuuguuugugcau

SEQ ID NO: 2157779 - RNA, 13 nt, Human
auguugaggugga

SEQ ID NO: 2157780 - RNA, 18 nt, Human
uuuuagauacuuugcuag

SEQ ID NO: 2157781 - RNA, 13 nt, Human
uuuucagcauuga

SEQ ID NO: 2157782 - RNA, 19 nt, Human
uuuuccaugaaaaugcaac

SEQ ID NO: 2157783 - RNA, 18 nt, Human
uuuuccaugaaaaugcaa

SEQ ID NO: 2157784 - RNA, 13 nt, Human
uuuuaugcauguu

SEQ ID NO: 2157785 - RNA, 19 nt, Human
uuuuaugccuuuuauuucu

SEQ ID NO: 2157786 - RNA, 17 nt, Human
auguuuuuguguauuug

SEQ ID NO: 2157787 - RNA, 18 nt, Human
auguugugccucccuggu

SEQ ID NO: 2157788 - RNA, 23 nt, Human
auguuuauuucauaaagaauugu

SEQ ID NO: 2157789 - RNA, 13 nt, Human
auuacucuuucuc

SEQ ID NO: 2157790 - RNA, 20 nt, Human
auuaauauggggaugcagca

SEQ ID NO: 2157791 - RNA, 12 nt, Human
uuuuuuaaaaaa

SEQ ID NO: 2157792 - RNA, 23 nt, Human
auucccuucgacagcauuuuccu

SEQ ID NO: 2157793 - RNA, 20 nt, Human
auucccuucgacagcauuuu

SEQ ID NO: 2157794 - RNA, 17 nt, Human
auuuaacagggagggga

SEQ ID NO: 2157795 - RNA, 15 nt, Human
auuuaaacaaacaaa

SEQ ID NO: 2157796 - RNA, 21 nt, Human
auuguuugggauccuauugaa

SEQ ID NO: 2157797 - RNA, 12 nt, Human
auuguuugaacc

SEQ ID NO: 2157798 - RNA, 15 nt, Human
auugucuuuuuguau

SEQ ID NO: 2157799 - RNA, 15 nt, Human
auucuacuugcucug

SEQ ID NO: 2157800 - RNA, 13 nt, Human
auucuacuugcuc

SEQ ID NO: 2157801 - RNA, 12 nt, Human
auucuacuugcu

SEQ ID NO: 2157802 - RNA, 23 nt, Human
auucuacuugcucuggaccugcc

SEQ ID NO: 2157803 - RNA, 21 nt, Human
auucuacuugcucuggaccug

SEQ ID NO: 2157804 - RNA, 20 nt, Human
auucuacuugcucuggaccu

SEQ ID NO: 2157805 - RNA, 19 nt, Human
auucuacuugcucuggacc

SEQ ID NO: 2157806 - RNA, 18 nt, Human
auucuacuugcucuggac

SEQ ID NO: 2157807 - RNA, 17 nt, Human
auucuacuugcucugga

SEQ ID NO: 2157808 - RNA, 16 nt, Human
auucuacuugcucugg

SEQ ID NO: 2157809 - RNA, 22 nt, Human
auucuacuugcucuggaccugc

SEQ ID NO: 2157810 - RNA, 22 nt, Human
auuuguaggggaacucauuugg

SEQ ID NO: 2157811 - RNA, 19 nt, Human
auuuguaggggaacucauu

SEQ ID NO: 2157812 - RNA, 22 nt, Human
auuuuauuuguaggggaacuca

SEQ ID NO: 2157813 - RNA, 16 nt, Human
auuuaccuuuuugaaa

SEQ ID NO: 2157814 - RNA, 21 nt, Human
auuuagcuccaaaccuucaca

SEQ ID NO: 2157815 - RNA, 14 nt, Human
auuugguuuuccug

SEQ ID NO: 2157816 - RNA, 16 nt, Human
auuugguuuuccugua

SEQ ID NO: 2157817 - RNA, 15 nt, Human
auauaaauaaaacau

SEQ ID NO: 2157818 - RNA, 18 nt, Human
auauaaauaaaacauuuu

SEQ ID NO: 2157819 - RNA, 13 nt, Human
auauauauuuuaa

SEQ ID NO: 2157820 - RNA, 13 nt, Human
uucacuucacgcu

SEQ ID NO: 2157821 - RNA, 22 nt, Human
uucacuguccuccaagccagcg

SEQ ID NO: 2157822 - RNA, 22 nt, Human
uucacugugaccuugagaagau

SEQ ID NO: 2157823 - RNA, 21 nt, Human
auaguugaaccuauuucucuu

SEQ ID NO: 2157824 - RNA, 14 nt, Human
auauaaaaaacuuu

SEQ ID NO: 2157825 - RNA, 16 nt, Human
auaguggggagacuuc

SEQ ID NO: 2157826 - RNA, 20 nt, Human
uucacacacagacuguuguc

SEQ ID NO: 2157827 - RNA, 17 nt, Human
auagcuuuugugucuua

SEQ ID NO: 2157828 - RNA, 15 nt, Human
uuccagugcaacacu

SEQ ID NO: 2157829 - RNA, 19 nt, Human
uuccagugcaacacugaag

SEQ ID NO: 2157830 - RNA, 21 nt, Human
uuccagugcaacacugaagcu

SEQ ID NO: 2157831 - RNA, 18 nt, Human
uuccacacucaccucuaa

SEQ ID NO: 2157832 - RNA, 13 nt, Human
uuccaagagcuga

SEQ ID NO: 2157833 - RNA, 12 nt, Human
uuccaagagcug

SEQ ID NO: 2157834 - RNA, 21 nt, Human
auauauuuguguauuuaacag

SEQ ID NO: 2157835 - RNA, 17 nt, Human
auauauuuguguauuua

SEQ ID NO: 2157836 - RNA, 22 nt, Human
auauauuuguguauuuaacagg

SEQ ID NO: 2157837 - RNA, 21 nt, Human
auauauuggguuccauucuca

SEQ ID NO: 2157838 - RNA, 17 nt, Human
auauauuggguuccauu

SEQ ID NO: 2157839 - RNA, 13 nt, Human
auauauuugugua

SEQ ID NO: 2157840 - RNA, 19 nt, Human
auauauguauauauaugca

SEQ ID NO: 2157841 - RNA, 14 nt, Human
uucauauugaauau

SEQ ID NO: 2157842 - RNA, 13 nt, Human
uucuuuuguaauu

SEQ ID NO: 2157843 - RNA, 15 nt, Human
uucuuuuuauugaau

SEQ ID NO: 2157844 - RNA, 17 nt, Human
uugaacccaggaguuca

SEQ ID NO: 2157845 - RNA, 19 nt, Human
uucuuugugucaacaugaa

SEQ ID NO: 2157846 - RNA, 17 nt, Human
uucuuaaacaaauguau

SEQ ID NO: 2157847 - RNA, 15 nt, Human
uucuuacaaacaugu

SEQ ID NO: 2157848 - RNA, 14 nt, Human
uucuccucuuguaa

SEQ ID NO: 2157849 - RNA, 13 nt, Human
uucuccucuugua

SEQ ID NO: 2157850 - RNA, 19 nt, Human
uucuccucuuguaaauaaa

SEQ ID NO: 2157851 - RNA, 17 nt, Human
uucuccucuuguaaaua

SEQ ID NO: 2157852 - RNA, 22 nt, Human
uucuccucuuguaaauaaagcc

SEQ ID NO: 2157853 - RNA, 22 nt, Human
uucucuuucuuuacaagauggg

SEQ ID NO: 2157854 - RNA, 16 nt, Human
uucucuuucuuuacaa

SEQ ID NO: 2157855 - RNA, 11 nt, Human
uucucuuucuu

SEQ ID NO: 2157856 - RNA, 20 nt, Human
uucgaugggcccaauucuua

SEQ ID NO: 2157857 - RNA, 21 nt, Human
uucgaugggcccaauucuuac

SEQ ID NO: 2157858 - RNA, 16 nt, Human
uucgacagcauuuucc

SEQ ID NO: 2157859 - RNA, 23 nt, Human
uucgacagcauuuuccucugcuu

SEQ ID NO: 2157860 - RNA, 15 nt, Human
uucgagaccagccug

SEQ ID NO: 2157861 - RNA, 16 nt, Human
uucgagaccagccugg

SEQ ID NO: 2157862 - RNA, 19 nt, Human
uucgagaccagccuggcca

SEQ ID NO: 2157863 - RNA, 14 nt, Human
uucgagaccagccu

SEQ ID NO: 2157864 - RNA, 22 nt, Human
uucgcgauggacagacucacaa

SEQ ID NO: 2157865 - RNA, 16 nt, Human
auauuuuccaugaaaa

SEQ ID NO: 2157866 - RNA, 18 nt, Human
auauuuuccaugaaaaug

SEQ ID NO: 2157867 - RNA, 15 nt, Human
auauuuuuaauuaaa

SEQ ID NO: 2157868 - RNA, 11 nt, Human
auauuuuaauu

SEQ ID NO: 2157869 - RNA, 21 nt, Human
augcaacaacauguauaauau

SEQ ID NO: 2157870 - RNA, 16 nt, Human
augcaacaacauguau

SEQ ID NO: 2157871 - RNA, 14 nt, Human
augcaacaacaugu

SEQ ID NO: 2157872 - RNA, 19 nt, Human
uuguucugcuguucucuag

SEQ ID NO: 2157873 - RNA, 17 nt, Human
uuguggcuauuaaaacu

SEQ ID NO: 2157874 - RNA, 21 nt, Human
augcagccuaaggcuguauga

SEQ ID NO: 2157875 - RNA, 17 nt, Human
augcaggugaaacccag

SEQ ID NO: 2157876 - RNA, 20 nt, Human
augcagucuguccaggcucg

SEQ ID NO: 2157877 - RNA, 19 nt, Human
augcagucuguccaggcuc

SEQ ID NO: 2157878 - RNA, 18 nt, Human
augcaggugaaacccagu

SEQ ID NO: 2157879 - RNA, 18 nt, Human
augcagucuguccaggcu

SEQ ID NO: 2157880 - RNA, 19 nt, Human
uuuagcaguaaaauagcug

SEQ ID NO: 2157881 - RNA, 22 nt, Human
uuucccccaccccauuucucuc

SEQ ID NO: 2157882 - RNA, 20 nt, Human
auggacagaagaaggcagca

SEQ ID NO: 2157883 - RNA, 19 nt, Human
auggacagaagaaggcagc

SEQ ID NO: 2157884 - RNA, 13 nt, Human
uuucagaccuuuu

SEQ ID NO: 2157885 - RNA, 12 nt, Human
uuucagaccuuu

SEQ ID NO: 2157886 - RNA, 16 nt, Human
uuucauauuugcacua

SEQ ID NO: 2157887 - RNA, 23 nt, Human
auggcacagcccaaagaaggaaa

SEQ ID NO: 2157888 - RNA, 21 nt, Human
auggccguguagaagcauggu

SEQ ID NO: 2157889 - RNA, 18 nt, Human
auggccguguagaagcau

SEQ ID NO: 2157890 - RNA, 18 nt, Human
auggccuuugauaaaugu

SEQ ID NO: 2157891 - RNA, 18 nt, Human
auggcuaccuaaaaagau

SEQ ID NO: 2157892 - RNA, 19 nt, Human
augacauuguuaaaauaaa

SEQ ID NO: 2157893 - RNA, 21 nt, Human
augagaagaaaauggaaccag

SEQ ID NO: 2157894 - RNA, 14 nt, Human
augagaacucugag

SEQ ID NO: 2157895 - RNA, 13 nt, Human
augagacacagga

SEQ ID NO: 2157896 - RNA, 14 nt, Human
augagacacaggau

SEQ ID NO: 2157897 - RNA, 23 nt, Human
augagaagaaaauggaaccaggc

SEQ ID NO: 2157898 - RNA, 16 nt, Human
uugguuuaauuuaaag

SEQ ID NO: 2157899 - RNA, 12 nt, Human
aucuuugugaag

SEQ ID NO: 2157900 - RNA, 22 nt, Human
aucuuuuguucccauccucuuc

SEQ ID NO: 2157901 - RNA, 16 nt, Human
aucuuuuguucccauc

SEQ ID NO: 2157902 - RNA, 22 nt, Human
uuggaugggacuagagcuuucu

SEQ ID NO: 2157903 - RNA, 22 nt, Human
augaagauauuugcuuuaauaa

SEQ ID NO: 2157904 - RNA, 21 nt, Human
augaaccuucuggccucccac

SEQ ID NO: 2157905 - RNA, 24 nt, Human
augaaccuucuggccucccacaga

SEQ ID NO: 2157906 - RNA, 16 nt, Human
uuggggggcauauauu

SEQ ID NO: 2157907 - RNA, 15 nt, Human
uugcaauuccugcuc

SEQ ID NO: 2157908 - RNA, 13 nt, Human
uugauucacuuca

SEQ ID NO: 2157909 - RNA, 17 nt, Human
uugaugcugacagucau

SEQ ID NO: 2157910 - RNA, 21 nt, Human
aucuugauaccaccuauauag

SEQ ID NO: 2157911 - RNA, 22 nt, Human
aucugguaccaguugaaauuuu

SEQ ID NO: 2157912 - RNA, 16 nt, Human
uugccgguggugcagg

SEQ ID NO: 2157913 - RNA, 22 nt, Human
uugccgcgucgcccucccaggc

SEQ ID NO: 2157914 - RNA, 18 nt, Human
uugccgcgucgcccuccc

SEQ ID NO: 2157915 - RNA, 21 nt, Human
uugccgcgucgcccucccagg

SEQ ID NO: 2157916 - RNA, 18 nt, Human
aucugagcucuuugcacu

SEQ ID NO: 2157917 - RNA, 19 nt, Human
aucugagcucuuugcacua

SEQ ID NO: 2157918 - RNA, 18 nt, Human
aucugauauguauuguuu

SEQ ID NO: 2157919 - RNA, 14 nt, Human
aucugauauguauu

SEQ ID NO: 2157920 - RNA, 12 nt, Human
gcggagcuggcc

SEQ ID NO: 2157921 - RNA, 18 nt, Human
gcggagcaagaggaggcc

SEQ ID NO: 2157922 - RNA, 17 nt, Human
gcggagcaagaggaggc

SEQ ID NO: 2157923 - RNA, 17 nt, Human
gcggagcuggccccgcc

SEQ ID NO: 2157924 - RNA, 14 nt, Human
gcggagcuggcccc

SEQ ID NO: 2157925 - RNA, 16 nt, Human
gcggaggagagagagg

SEQ ID NO: 2157926 - RNA, 20 nt, Human
gcgugaucaaagccacacuc

SEQ ID NO: 2157927 - RNA, 14 nt, Human
gccucgcaggaaga

SEQ ID NO: 2157928 - RNA, 13 nt, Human
gcccauucuacuu

SEQ ID NO: 2157929 - RNA, 15 nt, Human
gcccauucuacuugc

SEQ ID NO: 2157930 - RNA, 14 nt, Human
gcccauucuacuug

SEQ ID NO: 2157931 - RNA, 20 nt, Human
gcccauucuacuugcucugg

SEQ ID NO: 2157932 - RNA, 19 nt, Human
gcccauucuacuugcucug

SEQ ID NO: 2157933 - RNA, 18 nt, Human
gcccauucuacuugcucu

SEQ ID NO: 2157934 - RNA, 17 nt, Human
gcccauucuacuugcuc

SEQ ID NO: 2157935 - RNA, 22 nt, Human
gcccauucuacuugcucuggac

SEQ ID NO: 2157936 - RNA, 21 nt, Human
gcccauucuacuugcucugga

SEQ ID NO: 2157937 - RNA, 20 nt, Human
gcccccgcauccccugccuc

SEQ ID NO: 2157938 - RNA, 18 nt, Human
gcccccgcauccccugcc

SEQ ID NO: 2157939 - RNA, 16 nt, Human
gcccccgcauccccug

SEQ ID NO: 2157940 - RNA, 14 nt, Human
gccaggccccaggc

SEQ ID NO: 2157941 - RNA, 13 nt, Human
gccaggccagcug

SEQ ID NO: 2157942 - RNA, 13 nt, Human
gccaggccccagg

SEQ ID NO: 2157943 - RNA, 12 nt, Human
gccaggccagcu

SEQ ID NO: 2157944 - RNA, 17 nt, Human
gcugcaggggcauggga

SEQ ID NO: 2157945 - RNA, 23 nt, Human
gcucucuuuuucuccagggucag

SEQ ID NO: 2157946 - RNA, 22 nt, Human
gcucucuuuuucuccaggguca

SEQ ID NO: 2157947 - RNA, 14 nt, Human
gcugaaaaaaaauu

SEQ ID NO: 2157948 - RNA, 22 nt, Human
gcucccaggugcagccagaggc

SEQ ID NO: 2157949 - RNA, 20 nt, Human
gcucccaggugcagccagag

SEQ ID NO: 2157950 - RNA, 19 nt, Human
gcucccaggugcagccaga

SEQ ID NO: 2157951 - RNA, 14 nt, Human
gcucccaggugcag

SEQ ID NO: 2157952 - RNA, 17 nt, Human
gcuccucuccagucuga

SEQ ID NO: 2157953 - RNA, 18 nt, Human
ggaagacccaacacaugg

SEQ ID NO: 2157954 - RNA, 20 nt, Human
ggaagacccaacacauggga

SEQ ID NO: 2157955 - RNA, 16 nt, Human
ggaaacaacagcuuua

SEQ ID NO: 2157956 - RNA, 13 nt, Human
ggaaacaacagcu

SEQ ID NO: 2157957 - RNA, 13 nt, Human
ggaaacagacucg

SEQ ID NO: 2157958 - RNA, 22 nt, Human
ggaaacagacucgauucauauu

SEQ ID NO: 2157959 - RNA, 21 nt, Human
gcuuccuguccucccagcucc

SEQ ID NO: 2157960 - RNA, 16 nt, Human
gcuuccuguccuccca

SEQ ID NO: 2157961 - RNA, 19 nt, Human
gcuuucugaagcuuuacca

SEQ ID NO: 2157962 - RNA, 12 nt, Human
gcuuaaugaaaa

SEQ ID NO: 2157963 - RNA, 22 nt, Human
gcuucaacauucuuugcaagau

SEQ ID NO: 2157964 - RNA, 19 nt, Human
gcugugcacaaaguggcau

SEQ ID NO: 2157965 - RNA, 21 nt, Human
gcugugcacaaaguggcauaa

SEQ ID NO: 2157966 - RNA, 13 nt, Human
gguuucugaaaau

SEQ ID NO: 2157967 - RNA, 19 nt, Human
gguuccucguucucccugg

SEQ ID NO: 2157968 - RNA, 18 nt, Human
ggugggcacccacccugg

SEQ ID NO: 2157969 - RNA, 17 nt, Human
ggugggcacccacccug

SEQ ID NO: 2157970 - RNA, 20 nt, Human
guaaaauaaauauugucuuu

SEQ ID NO: 2157971 - RNA, 19 nt, Human
guaaaauaaauauugucuu

SEQ ID NO: 2157972 - RNA, 15 nt, Human
aaaguuuucccuuga

SEQ ID NO: 2157973 - RNA, 19 nt, Human
aaaguuauugugauauccu

SEQ ID NO: 2157974 - RNA, 18 nt, Human
gguuugaauauaaacacu

SEQ ID NO: 2157975 - RNA, 15 nt, Human
gguuugaauauaaac

SEQ ID NO: 2157976 - RNA, 14 nt, Human
gguuugcaaggaag

SEQ ID NO: 2157977 - RNA, 21 nt, Human
gguuugccgguggugcaggua

SEQ ID NO: 2157978 - RNA, 17 nt, Human
gguuugccgguggugca

SEQ ID NO: 2157979 - RNA, 23 nt, Human
ggugcuguccucagguggccaug

SEQ ID NO: 2157980 - RNA, 20 nt, Human
ggugcuguccucagguggcc

SEQ ID NO: 2157981 - RNA, 19 nt, Human
ggugcuguccucagguggc

SEQ ID NO: 2157982 - RNA, 15 nt, Human
ggugcuguccucagg

SEQ ID NO: 2157983 - RNA, 16 nt, Human
aaagcaucacuuggga

SEQ ID NO: 2157984 - RNA, 18 nt, Human
aaagcagcucuccccuca

SEQ ID NO: 2157985 - RNA, 15 nt, Human
aaagcagcucucccc

SEQ ID NO: 2157986 - RNA, 23 nt, Human
aaagaaguaggggaagacaugca

SEQ ID NO: 2157987 - RNA, 16 nt, Human
gguccagggagcaggc

SEQ ID NO: 2157988 - RNA, 12 nt, Human
gguccagggagc

SEQ ID NO: 2157989 - RNA, 15 nt, Human
gguccacagggcacc

SEQ ID NO: 2157990 - RNA, 21 nt, Human
gguaugaccuucuaggaagcu

SEQ ID NO: 2157991 - RNA, 14 nt, Human
gguccacagggcac

SEQ ID NO: 2157992 - RNA, 18 nt, Human
aaaaugugccauuuugca

SEQ ID NO: 2157993 - RNA, 16 nt, Human
aaacaaaacaaaacaa

SEQ ID NO: 2157994 - RNA, 14 nt, Human
gggccgccagggag

SEQ ID NO: 2157995 - RNA, 16 nt, Human
aaaaucuguggugguc

SEQ ID NO: 2157996 - RNA, 21 nt, Human
aaaaugaguuaccuacauuuu

SEQ ID NO: 2157997 - RNA, 14 nt, Human
gggaagagggggcg

SEQ ID NO: 2157998 - RNA, 21 nt, Human
aaaacccagcaacagaaaaau

SEQ ID NO: 2157999 - RNA, 19 nt, Human
aaaaccaauguuuugcagu

SEQ ID NO: 2158000 - RNA, 20 nt, Human
aaaacaguccuucaaacuuc

SEQ ID NO: 2158001 - RNA, 22 nt, Human
aaaacagguagaauuaucuaau

SEQ ID NO: 2158002 - RNA, 14 nt, Human
aaaaaucuauauuu

SEQ ID NO: 2158003 - RNA, 16 nt, Human
aaaagcagcucucccc

SEQ ID NO: 2158004 - RNA, 17 nt, Human
aaaagcagcucuccccu

SEQ ID NO: 2158005 - RNA, 21 nt, Human
aaaagcacacucauccccuca

SEQ ID NO: 2158006 - RNA, 21 nt, Human
gggagcaggcggugggcaccc

SEQ ID NO: 2158007 - RNA, 17 nt, Human
gggaggccagugagcca

SEQ ID NO: 2158008 - RNA, 15 nt, Human
gggagcaggcggugg

SEQ ID NO: 2158009 - RNA, 15 nt, Human
gggcaggccagagcu

SEQ ID NO: 2158010 - RNA, 14 nt, Human
aaaagguaaaacuu

SEQ ID NO: 2158011 - RNA, 23 nt, Human
aaaagguaaaacuuuuuauauuu

SEQ ID NO: 2158012 - RNA, 21 nt, Human
gggcagcgggagccucccugc

SEQ ID NO: 2158013 - RNA, 19 nt, Human
ggccuugggcccucugguu

SEQ ID NO: 2158014 - RNA, 22 nt, Human
ggcggugggcacccacccuggg

SEQ ID NO: 2158015 - RNA, 21 nt, Human
ggcggugggcacccacccugg

SEQ ID NO: 2158016 - RNA, 15 nt, Human
ggcccaggugagucc

SEQ ID NO: 2158017 - RNA, 22 nt, Human
ggcauauauuggguuccauucu

SEQ ID NO: 2158018 - RNA, 20 nt, Human
ggcauccuuccucacaccag

SEQ ID NO: 2158019 - RNA, 14 nt, Human
ggccaugccucagc

SEQ ID NO: 2158020 - RNA, 22 nt, Human
ggccaucugguuaggauggcag

SEQ ID NO: 2158021 - RNA, 21 nt, Human
ggccaucugguuaggauggca

SEQ ID NO: 2158022 - RNA, 20 nt, Human
ggccauccuucccugucugc

SEQ ID NO: 2158023 - RNA, 22 nt, Human
ggccagagcuacccgcagaguu

SEQ ID NO: 2158024 - RNA, 14 nt, Human
ggccaaacaagugu

SEQ ID NO: 2158025 - RNA, 14 nt, Human
ggaguucugcucau

SEQ ID NO: 2158026 - RNA, 22 nt, Human
ggagugcuuaucccuucuuuuu

SEQ ID NO: 2158027 - RNA, 14 nt, Human
ggauaauuagcauc

SEQ ID NO: 2158028 - RNA, 19 nt, Human
ggauaauuagcaucucagg

SEQ ID NO: 2158029 - RNA, 22 nt, Human
ggauggcaggacgugggcuggg

SEQ ID NO: 2158030 - RNA, 21 nt, Human
ggauggcaggacgugggcugg

SEQ ID NO: 2158031 - RNA, 17 nt, Human
ggcacaaagggcccaga

SEQ ID NO: 2158032 - RNA, 17 nt, Human
ggcacaggccauggaug

SEQ ID NO: 2158033 - RNA, 23 nt, Human
ggcacaggccauggauggaaaac

SEQ ID NO: 2158034 - RNA, 20 nt, Human
ggagguggagguugcaguga

SEQ ID NO: 2158035 - RNA, 19 nt, Human
ggagguggagguugcagug

SEQ ID NO: 2158036 - RNA, 23 nt, Human
ggaggugaacaagcaaacccaga

SEQ ID NO: 2158037 - RNA, 17 nt, Human
ggaggccuuccagggac

SEQ ID NO: 2158038 - RNA, 21 nt, Human
ggaggaaggcuuacacccaca

SEQ ID NO: 2158039 - RNA, 12 nt, Human
ggagcugcaggg

SEQ ID NO: 2158040 - RNA, 20 nt, Human
ggagcugcaggggcauggga

SEQ ID NO: 2158041 - RNA, 14 nt, Human
ggagcugcaggggc

SEQ ID NO: 2158042 - RNA, 20 nt, Human
ggagcuggccccgccgccug

SEQ ID NO: 2158043 - RNA, 15 nt, Human
ggagcauugggaccu

SEQ ID NO: 2158044 - RNA, 23 nt, Human
gacacugaaauauacacacagca

SEQ ID NO: 2158045 - RNA, 23 nt, Human
gacagacaacacugggaaacaga

SEQ ID NO: 2158046 - RNA, 19 nt, Human
gaauuuuguuuucuugauu

SEQ ID NO: 2158047 - RNA, 18 nt, Human
gacaaaaucaucuuugug

SEQ ID NO: 2158048 - RNA, 16 nt, Human
gaauuauaaaagccag

SEQ ID NO: 2158049 - RNA, 14 nt, Human
gaauuaucuaauuu

SEQ ID NO: 2158050 - RNA, 14 nt, Human
gaagcuaagcugca

SEQ ID NO: 2158051 - RNA, 17 nt, Human
gaagugaauaacugcaa

SEQ ID NO: 2158052 - RNA, 21 nt, Human
gaagcugucauaaaaagacaa

SEQ ID NO: 2158053 - RNA, 17 nt, Human
gaagcugggguucauga

SEQ ID NO: 2158054 - RNA, 17 nt, Human
gaagggagcuagccaga

SEQ ID NO: 2158055 - RNA, 18 nt, Human
gaagggauaugugaaaca

SEQ ID NO: 2158056 - RNA, 12 nt, Human
gaaugacuccuu

SEQ ID NO: 2158057 - RNA, 20 nt, Human
gaaugagauuaauuccuuuc

SEQ ID NO: 2158058 - RNA, 20 nt, Human
gagaggcagaagaacccugg

SEQ ID NO: 2158059 - RNA, 17 nt, Human
gagcauggguucauccu

SEQ ID NO: 2158060 - RNA, 16 nt, Human
gacugaaaaccucucc

SEQ ID NO: 2158061 - RNA, 17 nt, Human
gacugaaaaccucuccu

SEQ ID NO: 2158062 - RNA, 18 nt, Human
gacugaaaaccucuccuc

SEQ ID NO: 2158063 - RNA, 20 nt, Human
gacugaaaaccucuccucau

SEQ ID NO: 2158064 - RNA, 19 nt, Human
gagaagugaauaacugcaa

SEQ ID NO: 2158065 - RNA, 15 nt, Human
gauaugcaaaagcug

SEQ ID NO: 2158066 - RNA, 14 nt, Human
gauaugcaaaagcu

SEQ ID NO: 2158067 - RNA, 17 nt, Human
gauaugugaaacaaugu

SEQ ID NO: 2158068 - RNA, 15 nt, Human
gauaugugaaacaau

SEQ ID NO: 2158069 - RNA, 18 nt, Human
gagucaauuggaaagacu

SEQ ID NO: 2158070 - RNA, 20 nt, Human
gaggugggaggaucuuuuga

SEQ ID NO: 2158071 - RNA, 22 nt, Human
gagucacaaagaacauguagaa

SEQ ID NO: 2158072 - RNA, 21 nt, Human
gauuauuuucuacacauacau

SEQ ID NO: 2158073 - RNA, 14 nt, Human
gcaccguacugugg

SEQ ID NO: 2158074 - RNA, 14 nt, Human
gcagccagaggcac

SEQ ID NO: 2158075 - RNA, 12 nt, Human
gcagccagaggc

SEQ ID NO: 2158076 - RNA, 20 nt, Human
gcauaauaaaugcuucagug

SEQ ID NO: 2158077 - RNA, 14 nt, Human
gcauaauaaaugcu

SEQ ID NO: 2158078 - RNA, 11 nt, Human
gcauaauaaau

SEQ ID NO: 2158079 - RNA, 15 nt, Human
gcaggcuucaaacua

SEQ ID NO: 2158080 - RNA, 21 nt, Human
cuuggcacccaagaccucagg

SEQ ID NO: 2158081 - RNA, 12 nt, Human
cuugccugcagg

SEQ ID NO: 2158082 - RNA, 13 nt, Human
cuugccugcaggc

SEQ ID NO: 2158083 - RNA, 21 nt, Human
cuugaugagcugugcacaaag

SEQ ID NO: 2158084 - RNA, 13 nt, Human
cuucuaggaagcu

SEQ ID NO: 2158085 - RNA, 20 nt, Human
cuucuguugucaccuucacc

SEQ ID NO: 2158086 - RNA, 19 nt, Human
cuucuguugucaccuucac

SEQ ID NO: 2158087 - RNA, 21 nt, Human
cuucuguugucaccuucaccu

SEQ ID NO: 2158088 - RNA, 15 nt, Human
cuucuguugucaccu

SEQ ID NO: 2158089 - RNA, 14 nt, Human
cuucacuccugcug

SEQ ID NO: 2158090 - RNA, 13 nt, Human
cuucacuccugcu

SEQ ID NO: 2158091 - RNA, 15 nt, Human
cuucacuccugcugu

SEQ ID NO: 2158092 - RNA, 21 nt, Human
cuucacguagaacauugguau

SEQ ID NO: 2158093 - RNA, 17 nt, Human
cuucacuguccuccaag

SEQ ID NO: 2158094 - RNA, 22 nt, Human
cuucaugcaggugaaacccagu

SEQ ID NO: 2158095 - RNA, 19 nt, Human
gaaaaaaaucguccaggga

SEQ ID NO: 2158096 - RNA, 18 nt, Human
gaaaaaccagaggcagcu

SEQ ID NO: 2158097 - RNA, 15 nt, Human
cuuuuuuucuacugu

SEQ ID NO: 2158098 - RNA, 20 nt, Human
cuuuuuuguguuuuuaaaag

SEQ ID NO: 2158099 - RNA, 15 nt, Human
cuuuugcauucuccc

SEQ ID NO: 2158100 - RNA, 14 nt, Human
cuuuugcauucucc

SEQ ID NO: 2158101 - RNA, 13 nt, Human
cuuuugcauucuc

SEQ ID NO: 2158102 - RNA, 12 nt, Human
cuuuuguaauuu

SEQ ID NO: 2158103 - RNA, 15 nt, Human
gaaaauggaaccagg

SEQ ID NO: 2158104 - RNA, 18 nt, Human
gaaaauggaaccaggcuu

SEQ ID NO: 2158105 - RNA, 14 nt, Human
cuuuguacuuugug

SEQ ID NO: 2158106 - RNA, 14 nt, Human
cuuugauguauuuu

SEQ ID NO: 2158107 - RNA, 17 nt, Human
cuuugauguauuuuccc

SEQ ID NO: 2158108 - RNA, 20 nt, Human
cuuucaaugguuugcaagga

SEQ ID NO: 2158109 - RNA, 22 nt, Human
cuuucaaugguuugcaaggaag

SEQ ID NO: 2158110 - RNA, 21 nt, Human
cuuucaaugguuugcaaggaa

SEQ ID NO: 2158111 - RNA, 14 nt, Human
cuuucacaaaaaag

SEQ ID NO: 2158112 - RNA, 16 nt, Human
cuuucacaaaaaagaa

SEQ ID NO: 2158113 - RNA, 15 nt, Human
cuuucacaaaaaaga

SEQ ID NO: 2158114 - RNA, 23 nt, Human
cuggugagagggccgggcagagg

SEQ ID NO: 2158115 - RNA, 22 nt, Human
cuggugagagggccgggcagag

SEQ ID NO: 2158116 - RNA, 21 nt, Human
cuggugagagggccgggcaga

SEQ ID NO: 2158117 - RNA, 22 nt, Human
cuggccccgccgccugguacuc

SEQ ID NO: 2158118 - RNA, 16 nt, Human
cuggccccgccgccug

SEQ ID NO: 2158119 - RNA, 14 nt, Human
cuggccccgccgcc

SEQ ID NO: 2158120 - RNA, 12 nt, Human
cuggccccgccg

SEQ ID NO: 2158121 - RNA, 23 nt, Human
cuggccccgccgccugguacuca

SEQ ID NO: 2158122 - RNA, 12 nt, Human
cuggcagcucag

SEQ ID NO: 2158123 - RNA, 19 nt, Human
cugguuugccgguggugca

SEQ ID NO: 2158124 - RNA, 24 nt, Human
cugucacugcucuggacugugugg

SEQ ID NO: 2158125 - RNA, 13 nt, Human
cugucacuguggg

SEQ ID NO: 2158126 - RNA, 17 nt, Human
cugucacugcucuggac

SEQ ID NO: 2158127 - RNA, 17 nt, Human
cugaccuugaugagcug

SEQ ID NO: 2158128 - RNA, 16 nt, Human
cugaccuugaugagcu

SEQ ID NO: 2158129 - RNA, 16 nt, Human
cugcauuuguauauuu

SEQ ID NO: 2158130 - RNA, 12 nt, Human
auuagcugcuuc

SEQ ID NO: 2158131 - RNA, 21 nt, Human
auuaugaugugggucaaggaa

SEQ ID NO: 2158132 - RNA, 23 nt, Human
auuaugagacacaggaugaagca

SEQ ID NO: 2158133 - RNA, 13 nt, Human
auuagcugcuucu

SEQ ID NO: 2158134 - RNA, 21 nt, Human
auuagcugcuucuauguuuca

SEQ ID NO: 2158135 - RNA, 22 nt, Human
auugugugugcagacuucagga

SEQ ID NO: 2158136 - RNA, 19 nt, Human
auugugugugcagacuuca

SEQ ID NO: 2158137 - RNA, 14 nt, Human
auucuugaagucag

SEQ ID NO: 2158138 - RNA, 18 nt, Human
auugauauaaauaaaaca

SEQ ID NO: 2158139 - RNA, 19 nt, Human
auugauauaaauaaaacau

SEQ ID NO: 2158140 - RNA, 24 nt, Human
caaacccagacggcuccacuagga

SEQ ID NO: 2158141 - RNA, 20 nt, Human
caaacccagacggcuccacu

SEQ ID NO: 2158142 - RNA, 16 nt, Human
caacacgcaggagcac

SEQ ID NO: 2158143 - RNA, 15 nt, Human
caacacgcaggagca

SEQ ID NO: 2158144 - RNA, 22 nt, Human
caaagaugggugaaggcuggca

SEQ ID NO: 2158145 - RNA, 21 nt, Human
caaagaugggugaaggcuggc

SEQ ID NO: 2158146 - RNA, 20 nt, Human
caaagaugggugaaggcugg

SEQ ID NO: 2158147 - RNA, 21 nt, Human
auuuuaugccuuuuauuucuu

SEQ ID NO: 2158148 - RNA, 20 nt, Human
auuuuaugccuuuuauuucu

SEQ ID NO: 2158149 - RNA, 16 nt, Human
auuugugcauuuucua

SEQ ID NO: 2158150 - RNA, 22 nt, Human
auuuguguauuuaacagggagg

SEQ ID NO: 2158151 - RNA, 14 nt, Human
auuuguguauuuaa

SEQ ID NO: 2158152 - RNA, 17 nt, Human
auuuguuuguuuuccuu

SEQ ID NO: 2158153 - RNA, 13 nt, Human
cacugggaaacag

SEQ ID NO: 2158154 - RNA, 18 nt, Human
cacugggaaacagaggcu

SEQ ID NO: 2158155 - RNA, 16 nt, Human
cacugcauaccaaccu

SEQ ID NO: 2158156 - RNA, 19 nt, Human
cacugggguccagggagca

SEQ ID NO: 2158157 - RNA, 14 nt, Human
caauggcagaugua

SEQ ID NO: 2158158 - RNA, 13 nt, Human
caauuuaaagcaa

SEQ ID NO: 2158159 - RNA, 13 nt, Human
ccaaugccaaaaa

SEQ ID NO: 2158160 - RNA, 12 nt, Human
ccacccugggac

SEQ ID NO: 2158161 - RNA, 13 nt, Human
ccacccugggacc

SEQ ID NO: 2158162 - RNA, 23 nt, Human
cauuaugaugugggucaaggaau

SEQ ID NO: 2158163 - RNA, 22 nt, Human
cauuaugaugugggucaaggaa

SEQ ID NO: 2158164 - RNA, 13 nt, Human
cauucucauugaa

SEQ ID NO: 2158165 - RNA, 17 nt, Human
cauucuccauuuguuau

SEQ ID NO: 2158166 - RNA, 12 nt, Human
cauucuccauuu

SEQ ID NO: 2158167 - RNA, 23 nt, Human
cauugggaaggggacccccgccc

SEQ ID NO: 2158168 - RNA, 15 nt, Human
caugaccagcaaaua

SEQ ID NO: 2158169 - RNA, 12 nt, Human
caugaccagcaa

SEQ ID NO: 2158170 - RNA, 19 nt, Human
cauccugugccuccaucag

SEQ ID NO: 2158171 - RNA, 12 nt, Human
caguuuaaagca

SEQ ID NO: 2158172 - RNA, 15 nt, Human
cauacaacacaaaga

SEQ ID NO: 2158173 - RNA, 17 nt, Human
cauacaacacaaagaga

SEQ ID NO: 2158174 - RNA, 16 nt, Human
cauacaacacaaagag

SEQ ID NO: 2158175 - RNA, 9 nt, Human
cagagcugg

SEQ ID NO: 2158176 - RNA, 20 nt, Human
cagagcuacccgcagaguuc

SEQ ID NO: 2158177 - RNA, 22 nt, Human
cagcgggaauggcagcugccac

SEQ ID NO: 2158178 - RNA, 23 nt, Human
cagcgggaauggcagcugccacg

SEQ ID NO: 2158179 - RNA, 18 nt, Human
cagcgggagccucccugc

SEQ ID NO: 2158180 - RNA, 20 nt, Human
cagcgggagccucccugccu

SEQ ID NO: 2158181 - RNA, 16 nt, Human
cagcgggaauggcagc

SEQ ID NO: 2158182 - RNA, 19 nt, Human
cagcgggagccucccugcc

SEQ ID NO: 2158183 - RNA, 17 nt, Human
cagcccccacauccugu

SEQ ID NO: 2158184 - RNA, 13 nt, Human
cagccagaggcac

SEQ ID NO: 2158185 - RNA, 15 nt, Human
caggccagcugccuc

SEQ ID NO: 2158186 - RNA, 14 nt, Human
caggacaggaaaaa

SEQ ID NO: 2158187 - RNA, 20 nt, Human
caguaaaauagcugagggaa

SEQ ID NO: 2158188 - RNA, 14 nt, Human
caguaaaauagcug

SEQ ID NO: 2158189 - RNA, 19 nt, Human
caguaaaaaaaaaaaaugg

SEQ ID NO: 2158190 - RNA, 16 nt, Human
cagggaggggaagagg

SEQ ID NO: 2158191 - RNA, 19 nt, Human
ccugacccuguauauagcc

SEQ ID NO: 2158192 - RNA, 17 nt, Human
ccugacccuguauauag

SEQ ID NO: 2158193 - RNA, 20 nt, Human
ccucuuguaaauaaagcccu

SEQ ID NO: 2158194 - RNA, 18 nt, Human
ccucuuguaaauaaagcc

SEQ ID NO: 2158195 - RNA, 17 nt, Human
ccucuuguaaauaaagc

SEQ ID NO: 2158196 - RNA, 14 nt, Human
ccucuuguaaauaa

SEQ ID NO: 2158197 - RNA, 13 nt, Human
ccucuuguaaaua

SEQ ID NO: 2158198 - RNA, 12 nt, Human
ccucuuguaaau

SEQ ID NO: 2158199 - RNA, 13 nt, Human
ccugacugucucc

SEQ ID NO: 2158200 - RNA, 12 nt, Human
ccucucugcacc

SEQ ID NO: 2158201 - RNA, 15 nt, Human
ccuggaggagcagag

SEQ ID NO: 2158202 - RNA, 16 nt, Human
ccugcccauuggagag

SEQ ID NO: 2158203 - RNA, 16 nt, Human
ccuauuucucuuucuu

SEQ ID NO: 2158204 - RNA, 15 nt, Human
ccuauuucucuuucu

SEQ ID NO: 2158205 - RNA, 13 nt, Human
ccuauuucucuuu

SEQ ID NO: 2158206 - RNA, 12 nt, Human
ccuauuucucuu

SEQ ID NO: 2158207 - RNA, 21 nt, Human
ccucagcccugacccugugga

SEQ ID NO: 2158208 - RNA, 20 nt, Human
ccuaggagugccccauucuu

SEQ ID NO: 2158209 - RNA, 23 nt, Human
ccuaagcaaacccagugucagga

SEQ ID NO: 2158210 - RNA, 22 nt, Human
ccguaguagauguucuacuuug

SEQ ID NO: 2158211 - RNA, 17 nt, Human
ccguaggacccaagcag

SEQ ID NO: 2158212 - RNA, 11 nt, Human
ccgucaacaaa

SEQ ID NO: 2158213 - RNA, 22 nt, Human
cccuggccuugggcccucuggu

SEQ ID NO: 2158214 - RNA, 21 nt, Human
cccuggccuugggcccucugg

SEQ ID NO: 2158215 - RNA, 11 nt, Human
cccuggccuga

SEQ ID NO: 2158216 - RNA, 11 nt, Human
ccgcccccugc

SEQ ID NO: 2158217 - RNA, 17 nt, Human
ccgcccccugcccuccc

SEQ ID NO: 2158218 - RNA, 16 nt, Human
ccgcccccugcccucc

SEQ ID NO: 2158219 - RNA, 20 nt, Human
ccgaauguugagguggacuc

SEQ ID NO: 2158220 - RNA, 20 nt, Human
ccgccagggagaccuggaca

SEQ ID NO: 2158221 - RNA, 21 nt, Human
ccgccaaaagcugcucaggga

SEQ ID NO: 2158222 - RNA, 21 nt, Human
ccccuuuauguacaggaugcu

SEQ ID NO: 2158223 - RNA, 12 nt, Human
ccccuuuugcau

SEQ ID NO: 2158224 - RNA, 22 nt, Human
ccccaucgccagcugaugacuc

SEQ ID NO: 2158225 - RNA, 19 nt, Human
ccccaucgccagcugauga

SEQ ID NO: 2158226 - RNA, 23 nt, Human
ccccaucgccagcugaugacuca

SEQ ID NO: 2158227 - RNA, 22 nt, Human
ccccagagaaagcgcagaugcu

SEQ ID NO: 2158228 - RNA, 15 nt, Human
cccauauuguaaaac

SEQ ID NO: 2158229 - RNA, 18 nt, Human
cccauauuguaaaacagg

SEQ ID NO: 2158230 - RNA, 19 nt, Human
cccauauuguaaaacaggu

SEQ ID NO: 2158231 - RNA, 22 nt, Human
ccaguuccuuucaaugguuugc

SEQ ID NO: 2158232 - RNA, 21 nt, Human
ccaguuccuuucaaugguuug

SEQ ID NO: 2158233 - RNA, 14 nt, Human
ccauggugcuuguu

SEQ ID NO: 2158234 - RNA, 22 nt, Human
ccagggcuuacggcccuggccu

SEQ ID NO: 2158235 - RNA, 21 nt, Human
ccagggcuuacggcccuggcc

SEQ ID NO: 2158236 - RNA, 13 nt, Human
ccagggucccugg

SEQ ID NO: 2158237 - RNA, 19 nt, Human
ccagggucagaaacaggac

SEQ ID NO: 2158238 - RNA, 18 nt, Human
ccagggucagaaacagga

SEQ ID NO: 2158239 - RNA, 17 nt, Human
ccagggucagaaacagg

SEQ ID NO: 2158240 - RNA, 10 nt, Human
ccagggucag

SEQ ID NO: 2158241 - RNA, 21 nt, Human
ccagaguggggaugacaugca

SEQ ID NO: 2158242 - RNA, 20 nt, Human
ccagcuacaccuuucuccuu

SEQ ID NO: 2158243 - RNA, 19 nt, Human
ccagcuacaccuuucuccu

SEQ ID NO: 2158244 - RNA, 18 nt, Human
ccagcuacaccuuucucc

SEQ ID NO: 2158245 - RNA, 17 nt, Human
ccuucuggccucccaca

SEQ ID NO: 2158246 - RNA, 20 nt, Human
ccuucuggccucccacagac

SEQ ID NO: 2158247 - RNA, 18 nt, Human
ccuucuggccucccacag

SEQ ID NO: 2158248 - RNA, 12 nt, Human
ccuuuucuauuc

SEQ ID NO: 2158249 - RNA, 13 nt, Human
ccuuuugcauucu

SEQ ID NO: 2158250 - RNA, 15 nt, Human
cgccucccacugggg

SEQ ID NO: 2158251 - RNA, 19 nt, Human
cgccucccacuggggucca

SEQ ID NO: 2158252 - RNA, 16 nt, Human
cgccucccacuggggu

SEQ ID NO: 2158253 - RNA, 20 nt, Human
cgccgccugguacucaagcc

SEQ ID NO: 2158254 - RNA, 23 nt, Human
cgccgcaaaccacacuggacucc

SEQ ID NO: 2158255 - RNA, 22 nt, Human
cgccgcaaaccacacuggacuc

SEQ ID NO: 2158256 - RNA, 21 nt, Human
cgccgcaaaccacacuggacu

SEQ ID NO: 2158257 - RNA, 15 nt, Human
cgccgccugguacuc

SEQ ID NO: 2158258 - RNA, 14 nt, Human
cgccgccugguacu

SEQ ID NO: 2158259 - RNA, 20 nt, Human
cgccgcaaaccacacuggac

SEQ ID NO: 2158260 - RNA, 19 nt, Human
cgccgcaaaccacacugga

SEQ ID NO: 2158261 - RNA, 22 nt, Human
cgagugugaagcuuccuuggcu

SEQ ID NO: 2158262 - RNA, 14 nt, Human
cggagcaagaggag

SEQ ID NO: 2158263 - RNA, 13 nt, Human
cggcggagcuggc

SEQ ID NO: 2158264 - RNA, 21 nt, Human
cggcggagcuggccccgccgc

SEQ ID NO: 2158265 - RNA, 19 nt, Human
cggcggagcuggccccgcc

SEQ ID NO: 2158266 - RNA, 16 nt, Human
cuagccuauguggauu

SEQ ID NO: 2158267 - RNA, 18 nt, Human
cuagccggccacuuugga

SEQ ID NO: 2158268 - RNA, 15 nt, Human
cuaguuguuaucaau

SEQ ID NO: 2158269 - RNA, 12 nt, Human
cuaauuuauaaa

SEQ ID NO: 2158270 - RNA, 18 nt, Human
cuaaagaguuuauuuuaa

SEQ ID NO: 2158271 - RNA, 19 nt, Human
cuaaagaguuuauuuuaag

SEQ ID NO: 2158272 - RNA, 22 nt, Human
cuauccaucaugaccagcaaau

SEQ ID NO: 2158273 - RNA, 19 nt, Human
cuccagucugaucugugaa

SEQ ID NO: 2158274 - RNA, 13 nt, Human
cuccccucagagu

SEQ ID NO: 2158275 - RNA, 16 nt, Human
cuccccucagagugca

SEQ ID NO: 2158276 - RNA, 12 nt, Human
cucccugacccu

SEQ ID NO: 2158277 - RNA, 23 nt, Human
cucccugacccuguauauagccc

SEQ ID NO: 2158278 - RNA, 17 nt, Human
cucccugacccuguaua

SEQ ID NO: 2158279 - RNA, 16 nt, Human
cucccugacccuguau

SEQ ID NO: 2158280 - RNA, 14 nt, Human
cucccugacccugu

SEQ ID NO: 2158281 - RNA, 23 nt, Human
cuccagaagauagcuucacccca

SEQ ID NO: 2158282 - RNA, 14 nt, Human
cuccagaagauagc

SEQ ID NO: 2158283 - RNA, 15 nt, Human
cuccagaagauagcu

SEQ ID NO: 2158284 - RNA, 21 nt, Human
cuccagggucagaaacaggac

SEQ ID NO: 2158285 - RNA, 20 nt, Human
cuccagggucagaaacagga

SEQ ID NO: 2158286 - RNA, 20 nt, Human
cucuccucauguucugcuuu

SEQ ID NO: 2158287 - RNA, 16 nt, Human
cucuccucacacacag

SEQ ID NO: 2158288 - RNA, 23 nt, Human
cucugcgugcagggacaaagagg

SEQ ID NO: 2158289 - RNA, 22 nt, Human
cucugcgugcagggacaaagag

SEQ ID NO: 2158290 - RNA, 18 nt, Human
cucugcaccguacugugg

SEQ ID NO: 2158291 - RNA, 14 nt, Human
cugaaaaccucucc

SEQ ID NO: 2158292 - RNA, 15 nt, Human
cugaaaaccucuccu

SEQ ID NO: 2158293 - RNA, 17 nt, Human
cugaaaaccucuccuca

SEQ ID NO: 2158294 - RNA, 20 nt, Human
cugaaaaccucuccucaugu

SEQ ID NO: 2158295 - RNA, 17 nt, Human
cugaaaauuaacacugc

SEQ ID NO: 2158296 - RNA, 16 nt, Human
cugaaaauuaacacug

SEQ ID NO: 2158297 - RNA, 18 nt, Human
cugaagcuuuaccagcug

SEQ ID NO: 2158298 - RNA, 14 nt, Human
cugaagcuuuacca

SEQ ID NO: 2158299 - RNA, 21 nt, Human
cugaagggauaugugaaacaa

SEQ ID NO: 2158300 - RNA, 19 nt, Human
cugaagggauaugugaaac

SEQ ID NO: 2158301 - RNA, 12 nt, Human
cugacccuguau

SEQ ID NO: 2158302 - RNA, 13 nt, Human
cugacccugugga

SEQ ID NO: 2158303 - RNA, 22 nt, Human
cugacccuguauauagcccagc

SEQ ID NO: 2158304 - RNA, 21 nt, Human
cugacccuguauauagcccag

SEQ ID NO: 2158305 - RNA, 20 nt, Human
cugacccuguauauagccca

SEQ ID NO: 2158306 - RNA, 19 nt, Human
cugacccuguauauagccc

SEQ ID NO: 2158307 - RNA, 18 nt, Human
cugacccuguauauagcc

SEQ ID NO: 2158308 - RNA, 15 nt, Human
cugacccuguauaua

SEQ ID NO: 2158309 - RNA, 13 nt, Human
cugacccuguaua

SEQ ID NO: 2158310 - RNA, 20 nt, Human
auaugcaguaaaagaaagaa

SEQ ID NO: 2158311 - RNA, 22 nt, Human
auauuuccaggcugcauuugua

SEQ ID NO: 2158312 - RNA, 23 nt, Human
auauuuccaggcugcauuuguau

SEQ ID NO: 2158313 - RNA, 12 nt, Human
auacuugcuuug

SEQ ID NO: 2158314 - RNA, 16 nt, Human
auagaaagugccagaa

SEQ ID NO: 2158315 - RNA, 19 nt, Human
auagaaagugccagaaagu

SEQ ID NO: 2158316 - RNA, 13 nt, Human
auauacacacagc

SEQ ID NO: 2158317 - RNA, 20 nt, Human
auauaauauauuuguguauu

SEQ ID NO: 2158318 - RNA, 17 nt, Human
auauaauauauuugugu

SEQ ID NO: 2158319 - RNA, 19 nt, Human
auaauguaaacaauaucag

SEQ ID NO: 2158320 - RNA, 16 nt, Human
auacaaugaugcuauu

SEQ ID NO: 2158321 - RNA, 22 nt, Human
auacaaugaugcuauuugcaau

SEQ ID NO: 2158322 - RNA, 21 nt, Human
auacaaugaugcuauuugcaa

SEQ ID NO: 2158323 - RNA, 22 nt, Human
aguuugaaucuauuuaucuuca

SEQ ID NO: 2158324 - RNA, 18 nt, Human
auaaaacauuuucacaca

SEQ ID NO: 2158325 - RNA, 20 nt, Human
auaaaacauuuucacacaau

SEQ ID NO: 2158326 - RNA, 12 nt, Human
auaaagcaaaua

SEQ ID NO: 2158327 - RNA, 18 nt, Human
auaaagcaaauagacaca

SEQ ID NO: 2158328 - RNA, 14 nt, Human
auaaagcaaauaga

SEQ ID NO: 2158329 - RNA, 17 nt, Human
aguccaacaauguuguu

SEQ ID NO: 2158330 - RNA, 11 nt, Human
aguccuuccac

SEQ ID NO: 2158331 - RNA, 14 nt, Human
agucaauuaacaau

SEQ ID NO: 2158332 - RNA, 18 nt, Human
agucacaaagaacaugua

SEQ ID NO: 2158333 - RNA, 20 nt, Human
aguacuggcugauggaguaa

SEQ ID NO: 2158334 - RNA, 18 nt, Human
aguaacccccacuggacu

SEQ ID NO: 2158335 - RNA, 22 nt, Human
aguugacuugacagaacacugu

SEQ ID NO: 2158336 - RNA, 20 nt, Human
aguugugacaacuuccugag

SEQ ID NO: 2158337 - RNA, 18 nt, Human
aguugugacaacuuccug

SEQ ID NO: 2158338 - RNA, 16 nt, Human
aguucagccacccuga

SEQ ID NO: 2158339 - RNA, 15 nt, Human
aguucagccacccug

SEQ ID NO: 2158340 - RNA, 20 nt, Human
agugaucuuuuguucccauc

SEQ ID NO: 2158341 - RNA, 17 nt, Human
aguggcuuuaaugaaua

SEQ ID NO: 2158342 - RNA, 14 nt, Human
agugucaggaggaa

SEQ ID NO: 2158343 - RNA, 18 nt, Human
augcuuuagaaagguuuu

SEQ ID NO: 2158344 - RNA, 21 nt, Human
augauggcccauucuacuugc

SEQ ID NO: 2158345 - RNA, 20 nt, Human
augauggcccauucuacuug

SEQ ID NO: 2158346 - RNA, 19 nt, Human
augauggcccauucuacuu

SEQ ID NO: 2158347 - RNA, 15 nt, Human
augauggcccauucu

SEQ ID NO: 2158348 - RNA, 12 nt, Human
augauggcccau

SEQ ID NO: 2158349 - RNA, 20 nt, Human
augaugacaacuacagaaaa

SEQ ID NO: 2158350 - RNA, 15 nt, Human
augaucuuuucaagu

SEQ ID NO: 2158351 - RNA, 20 nt, Human
augguaauucuuauucuuuc

SEQ ID NO: 2158352 - RNA, 18 nt, Human
augugaaaaggcaaaaag

SEQ ID NO: 2158353 - RNA, 23 nt, Human
auguauuguuugggauccuauug

SEQ ID NO: 2158354 - RNA, 14 nt, Human
augaccagcaaaua

SEQ ID NO: 2158355 - RNA, 15 nt, Human
augaaguuguaggua

SEQ ID NO: 2158356 - RNA, 20 nt, Human
augaaaaugcaacaacaugu

SEQ ID NO: 2158357 - RNA, 15 nt, Human
aucuauacuugcuuu

SEQ ID NO: 2158358 - RNA, 16 nt, Human
aucuauuuaucuucau

SEQ ID NO: 2158359 - RNA, 13 nt, Human
aucuauuuaagua

SEQ ID NO: 2158360 - RNA, 17 nt, Human
aucucucuuuaauauaa

SEQ ID NO: 2158361 - RNA, 14 nt, Human
aucuucaacaaauu

SEQ ID NO: 2158362 - RNA, 13 nt, Human
aucuucaacaaau

SEQ ID NO: 2158363 - RNA, 12 nt, Human
aucuucaacaaa

SEQ ID NO: 2158364 - RNA, 16 nt, Human
aucaaagccacacucu

SEQ ID NO: 2158365 - RNA, 14 nt, Human
aucaaagccacacu

SEQ ID NO: 2158366 - RNA, 15 nt, Human
aucaucuuugugaag

SEQ ID NO: 2158367 - RNA, 22 nt, Human
aucgcggcggagcuggccccgc

SEQ ID NO: 2158368 - RNA, 20 nt, Human
aucgcggcggagcuggcccc

SEQ ID NO: 2158369 - RNA, 19 nt, Human
aucgccagcugaugacuca

SEQ ID NO: 2158370 - RNA, 23 nt, Human
aucgccagcugaugacucaagau

SEQ ID NO: 2158371 - RNA, 21 nt, Human
aucgccagcugaugacucaag

SEQ ID NO: 2158372 - RNA, 22 nt, Human
auccuucccugucugccagggc

SEQ ID NO: 2158373 - RNA, 19 nt, Human
auccuucccugucugccag

SEQ ID NO: 2158374 - RNA, 20 nt, Human
agacugaccuugaugagcug

SEQ ID NO: 2158375 - RNA, 15 nt, Human
agacugaggggucga

SEQ ID NO: 2158376 - RNA, 14 nt, Human
agagagaggcagaa

SEQ ID NO: 2158377 - RNA, 15 nt, Human
agagagaggcaaugg

SEQ ID NO: 2158378 - RNA, 12 nt, Human
agacagagcugg

SEQ ID NO: 2158379 - RNA, 22 nt, Human
agacccaacacaugggaccuau

SEQ ID NO: 2158380 - RNA, 13 nt, Human
agaccagccuggc

SEQ ID NO: 2158381 - RNA, 15 nt, Human
agaccagccuggcca

SEQ ID NO: 2158382 - RNA, 12 nt, Human
agaccagcucuu

SEQ ID NO: 2158383 - RNA, 13 nt, Human
agaccagcucuuc

SEQ ID NO: 2158384 - RNA, 18 nt, Human
agaagugaauaacugcaa

SEQ ID NO: 2158385 - RNA, 19 nt, Human
agaaguaggggaagacaug

SEQ ID NO: 2158386 - RNA, 18 nt, Human
agaaguaggggaagacau

SEQ ID NO: 2158387 - RNA, 22 nt, Human
agaagguuugguccagccuggu

SEQ ID NO: 2158388 - RNA, 22 nt, Human
agaagagaguccauauuucaau

SEQ ID NO: 2158389 - RNA, 18 nt, Human
acuuuccucuuccugccu

SEQ ID NO: 2158390 - RNA, 15 nt, Human
agcaaugccugccca

SEQ ID NO: 2158391 - RNA, 23 nt, Human
agcacaaugucucacaugggaca

SEQ ID NO: 2158392 - RNA, 18 nt, Human
agaugaacagacugaccu

SEQ ID NO: 2158393 - RNA, 17 nt, Human
agaugaagcaaacacau

SEQ ID NO: 2158394 - RNA, 18 nt, Human
agaugaagcaaacacauu

SEQ ID NO: 2158395 - RNA, 19 nt, Human
agaugaagcaaacacauua

SEQ ID NO: 2158396 - RNA, 21 nt, Human
agagugcaagccccugcucca

SEQ ID NO: 2158397 - RNA, 19 nt, Human
agauguaaaguuauucuug

SEQ ID NO: 2158398 - RNA, 22 nt, Human
agauucuucccauucuccauuu

SEQ ID NO: 2158399 - RNA, 19 nt, Human
agauucuucccauucucca

SEQ ID NO: 2158400 - RNA, 23 nt, Human
agcaaaggaguagaaagacagag

SEQ ID NO: 2158401 - RNA, 23 nt, Human
agauucuucccauucuccauuug

SEQ ID NO: 2158402 - RNA, 13 nt, Human
agcaaacacauua

SEQ ID NO: 2158403 - RNA, 13 nt, Human
agcaaacccagac

SEQ ID NO: 2158404 - RNA, 15 nt, Human
agcaaacccagacgg

SEQ ID NO: 2158405 - RNA, 18 nt, Human
aggcuaaagcccagagac

SEQ ID NO: 2158406 - RNA, 21 nt, Human
aggcuaaagcccagagacagc

SEQ ID NO: 2158407 - RNA, 21 nt, Human
aggcggugggcacccacccug

SEQ ID NO: 2158408 - RNA, 14 nt, Human
aggcggugggcacc

SEQ ID NO: 2158409 - RNA, 18 nt, Human
aggccaggugcaaccagg

SEQ ID NO: 2158410 - RNA, 14 nt, Human
aggccagugagcca

SEQ ID NO: 2158411 - RNA, 21 nt, Human
aggccauccuucccugucugc

SEQ ID NO: 2158412 - RNA, 13 nt, Human
aggccaggccagc

SEQ ID NO: 2158413 - RNA, 15 nt, Human
aggccaggccagcug

SEQ ID NO: 2158414 - RNA, 12 nt, Human
aggccaggugca

SEQ ID NO: 2158415 - RNA, 11 nt, Human
aggucuagccu

SEQ ID NO: 2158416 - RNA, 17 nt, Human
agggccugcgagggcag

SEQ ID NO: 2158417 - RNA, 15 nt, Human
agggucagaaacagg

SEQ ID NO: 2158418 - RNA, 19 nt, Human
agggucagaaacaggaccg

SEQ ID NO: 2158419 - RNA, 21 nt, Human
agcuucaccccaaucccagcu

SEQ ID NO: 2158420 - RNA, 12 nt, Human
agcuucaaagcu

SEQ ID NO: 2158421 - RNA, 18 nt, Human
agcuucaccccaauccca

SEQ ID NO: 2158422 - RNA, 20 nt, Human
agcuucaccccaaucccagc

SEQ ID NO: 2158423 - RNA, 17 nt, Human
agcugaggcaauucuaa

SEQ ID NO: 2158424 - RNA, 15 nt, Human
aaagcccagagacag

SEQ ID NO: 2158425 - RNA, 14 nt, Human
aaagccccagaaau

SEQ ID NO: 2158426 - RNA, 22 nt, Human
aaauaaaacauuuucacacaau

SEQ ID NO: 2158427 - RNA, 18 nt, Human
aaauaaaacauuuucaca

SEQ ID NO: 2158428 - RNA, 12 nt, Human
aaauaaaacauu

SEQ ID NO: 2158429 - RNA, 19 nt, Human
aaaguauuuuauucuuauu

SEQ ID NO: 2158430 - RNA, 16 nt, Human
aaagugccagaaagug

SEQ ID NO: 2158431 - RNA, 22 nt, Human
aaacccauauuguaaaacaggu

SEQ ID NO: 2158432 - RNA, 21 nt, Human
aaaauauuuugaucuucaaca

SEQ ID NO: 2158433 - RNA, 15 nt, Human
aaaaucaaaacaaaa

SEQ ID NO: 2158434 - RNA, 18 nt, Human
aaaaucaaaacaaaaaaa

SEQ ID NO: 2158435 - RNA, 19 nt, Human
aaaauauuuugaucuucaa

SEQ ID NO: 2158436 - RNA, 14 nt, Human
aaaauuaacacugc

SEQ ID NO: 2158437 - RNA, 12 nt, Human
aaacaggcagcu

SEQ ID NO: 2158438 - RNA, 21 nt, Human
aaacaggacuuaaaaugacau

SEQ ID NO: 2158439 - RNA, 13 nt, Human
aacuguucccacc

SEQ ID NO: 2158440 - RNA, 15 nt, Human
aacuguucccaccug

SEQ ID NO: 2158441 - RNA, 18 nt, Human
aacuguucccaccugcug

SEQ ID NO: 2158442 - RNA, 12 nt, Human
aacaggaccggg

SEQ ID NO: 2158443 - RNA, 19 nt, Human
aacaggacuuaaaaugaca

SEQ ID NO: 2158444 - RNA, 17 nt, Human
aacaggaccggguggaa

SEQ ID NO: 2158445 - RNA, 21 nt, Human
aacacuauauggcagugucuu

SEQ ID NO: 2158446 - RNA, 20 nt, Human
aacacuauauggcagugucu

SEQ ID NO: 2158447 - RNA, 18 nt, Human
aacacuauauggcagugu

SEQ ID NO: 2158448 - RNA, 14 nt, Human
aacacuauauggca

SEQ ID NO: 2158449 - RNA, 21 nt, Human
aacccuucuccucuuguaaau

SEQ ID NO: 2158450 - RNA, 20 nt, Human
aacccuucuccucuuguaaa

SEQ ID NO: 2158451 - RNA, 18 nt, Human
aacccuucuccucuugua

SEQ ID NO: 2158452 - RNA, 11 nt, Human
aacccuucucc

SEQ ID NO: 2158453 - RNA, 19 nt, Human
aaccagggauuguuucugu

SEQ ID NO: 2158454 - RNA, 16 nt, Human
aaccagggauuguuuc

SEQ ID NO: 2158455 - RNA, 15 nt, Human
aaccagggauuguuu

SEQ ID NO: 2158456 - RNA, 15 nt, Human
aaccagggagcugca

SEQ ID NO: 2158457 - RNA, 19 nt, Human
aaaugcuaaugucaaacuu

SEQ ID NO: 2158458 - RNA, 21 nt, Human
aaaugcuaaugucaaacuuga

SEQ ID NO: 2158459 - RNA, 16 nt, Human
aaauugguucuuuauu

SEQ ID NO: 2158460 - RNA, 14 nt, Human
aacaaacaaacaaa

SEQ ID NO: 2158461 - RNA, 18 nt, Human
aacaaacauugaugcuga

SEQ ID NO: 2158462 - RNA, 19 nt, Human
aacaaaugaacgauaugua

SEQ ID NO: 2158463 - RNA, 23 nt, Human
aacaaaucuaggaaaauauuuug

SEQ ID NO: 2158464 - RNA, 21 nt, Human
aacaaaucuaggaaaauauuu

SEQ ID NO: 2158465 - RNA, 20 nt, Human
aacaaaucuaggaaaauauu

SEQ ID NO: 2158466 - RNA, 19 nt, Human
aacaaaucuaggaaaauau

SEQ ID NO: 2158467 - RNA, 16 nt, Human
aacaaacucucugaac

SEQ ID NO: 2158468 - RNA, 14 nt, Human
aauaauaaauauuu

SEQ ID NO: 2158469 - RNA, 18 nt, Human
aauaaagccuucaaacuc

SEQ ID NO: 2158470 - RNA, 15 nt, Human
aauaauaaauauuua

SEQ ID NO: 2158471 - RNA, 19 nt, Human
aauauaaauguuaagaaaa

SEQ ID NO: 2158472 - RNA, 12 nt, Human
aauauaaauguu

SEQ ID NO: 2158473 - RNA, 14 nt, Human
aauauaaacacuau

SEQ ID NO: 2158474 - RNA, 13 nt, Human
aauauaaacacua

SEQ ID NO: 2158475 - RNA, 16 nt, Human
aauaugcuggcuggag

SEQ ID NO: 2158476 - RNA, 14 nt, Human
aauaugcuggcugg

SEQ ID NO: 2158477 - RNA, 22 nt, Human
aaucuccaccagucauuuuuca

SEQ ID NO: 2158478 - RNA, 21 nt, Human
aaucuccaccagucauuuuuc

SEQ ID NO: 2158479 - RNA, 18 nt, Human
aaucucccuucacaaguu

SEQ ID NO: 2158480 - RNA, 22 nt, Human
aaugguauuugaauuaaauguu

SEQ ID NO: 2158481 - RNA, 15 nt, Human
aaugcucagaccagc

SEQ ID NO: 2158482 - RNA, 22 nt, Human
aagacagcuucucauccugcag

SEQ ID NO: 2158483 - RNA, 21 nt, Human
aagacagggcugauaagcuaa

SEQ ID NO: 2158484 - RNA, 14 nt, Human
aagacaugcagccu

SEQ ID NO: 2158485 - RNA, 13 nt, Human
aagagagaaacaa

SEQ ID NO: 2158486 - RNA, 17 nt, Human
aagauuacuuuuucuuu

SEQ ID NO: 2158487 - RNA, 23 nt, Human
aagauucuucccauucuccauuu

SEQ ID NO: 2158488 - RNA, 21 nt, Human
aagauucuucccauucuccau

SEQ ID NO: 2158489 - RNA, 20 nt, Human
aagauucuucccauucucca

SEQ ID NO: 2158490 - RNA, 19 nt, Human
aagauucuucccauucucc

SEQ ID NO: 2158491 - RNA, 15 nt, Human
aagauucuucccauu

SEQ ID NO: 2158492 - RNA, 22 nt, Human
aagauucuucccauucuccauu

SEQ ID NO: 2158493 - RNA, 17 nt, Human
aaguagcauuuacugug

SEQ ID NO: 2158494 - RNA, 16 nt, Human
aaguagcauuuacugu

SEQ ID NO: 2158495 - RNA, 11 nt, Human
aaguagcauuu

SEQ ID NO: 2158496 - RNA, 15 nt, Human
aagggauaugugaaa

SEQ ID NO: 2158497 - RNA, 19 nt, Human
aagggaguguacucccagg

SEQ ID NO: 2158498 - RNA, 14 nt, Human
aagcugcuuuauuc

SEQ ID NO: 2158499 - RNA, 21 nt, Human
aaggcaaaggguccagaagga

SEQ ID NO: 2158500 - RNA, 16 nt, Human
acaguguagcuugccc

SEQ ID NO: 2158501 - RNA, 17 nt, Human
acagcugaguuguugag

SEQ ID NO: 2158502 - RNA, 18 nt, Human
acagugagggagauccca

SEQ ID NO: 2158503 - RNA, 21 nt, Human
acagggcugauaagcuaacac

SEQ ID NO: 2158504 - RNA, 22 nt, Human
acaucagcuggucaaacaaacu

SEQ ID NO: 2158505 - RNA, 18 nt, Human
acauacaacacaaagaga

SEQ ID NO: 2158506 - RNA, 17 nt, Human
acauacaacacaaagag

SEQ ID NO: 2158507 - RNA, 17 nt, Human
accaaggagaugaagca

SEQ ID NO: 2158508 - RNA, 16 nt, Human
acauuuaccuuuuuga

SEQ ID NO: 2158509 - RNA, 18 nt, Human
acauuuaccaaucauauu

SEQ ID NO: 2158510 - RNA, 15 nt, Human
acauuuaccaaucau

SEQ ID NO: 2158511 - RNA, 20 nt, Human
acccauauuguaaaacaggu

SEQ ID NO: 2158512 - RNA, 16 nt, Human
acccauauuguaaaac

SEQ ID NO: 2158513 - RNA, 23 nt, Human
acccaugccucccccuagccauu

SEQ ID NO: 2158514 - RNA, 23 nt, Human
aauuuauuuuuaccuucacugug

SEQ ID NO: 2158515 - RNA, 21 nt, Human
aauuucagcuucuauauauug

SEQ ID NO: 2158516 - RNA, 16 nt, Human
aauuguauuuuaguaa

SEQ ID NO: 2158517 - RNA, 15 nt, Human
aauugguucuuuauu

SEQ ID NO: 2158518 - RNA, 18 nt, Human
acaaccugaaccuaggag

SEQ ID NO: 2158519 - RNA, 14 nt, Human
acaaccugaaccua

SEQ ID NO: 2158520 - RNA, 13 nt, Human
acaaccugaaccu

SEQ ID NO: 2158521 - RNA, 13 nt, Human
acaauuuaaagca

SEQ ID NO: 2158522 - RNA, 20 nt, Human
acaauuuaaagcaaaggagu

SEQ ID NO: 2158523 - RNA, 14 nt, Human
acaauuuaaagcaa

SEQ ID NO: 2158524 - RNA, 14 nt, Human
acacugggaaacag

SEQ ID NO: 2158525 - RNA, 20 nt, Human
acacugggaggccagugagc

SEQ ID NO: 2158526 - RNA, 15 nt, Human
acacugggaggccag

SEQ ID NO: 2158527 - RNA, 14 nt, Human
acacugggaggcca

SEQ ID NO: 2158528 - RNA, 11 nt, Human
acuauuuuauu

SEQ ID NO: 2158529 - RNA, 17 nt, Human
acuauuuuauuuucuaa

SEQ ID NO: 2158530 - RNA, 22 nt, Human
acucugugucugaguggcuuca

SEQ ID NO: 2158531 - RNA, 16 nt, Human
acucugugucugagug

SEQ ID NO: 2158532 - RNA, 15 nt, Human
acucugugucugagu

SEQ ID NO: 2158533 - RNA, 21 nt, Human
acucugucuaaaaaacaaaac

SEQ ID NO: 2158534 - RNA, 16 nt, Human
acuugggaggcugagg

SEQ ID NO: 2158535 - RNA, 15 nt, Human
acuauugcauuuuac

SEQ ID NO: 2158536 - RNA, 18 nt, Human
accuguguauuuuuuaaa

SEQ ID NO: 2158537 - RNA, 23 nt, Human
acgcugucccuaguaaaaauaca

SEQ ID NO: 2158538 - RNA, 17 nt, Human
acuaacuaucaaauaga

SEQ ID NO: 2158539 - RNA, 14 nt, Human
accccaaucccagc

SEQ ID NO: 2158540 - RNA, 12 nt, Human
accucagggcac

SEQ ID NO: 2158541 - RNA, 23 nt, Human
cauaagagccacaggucuuuaug

SEQ ID NO: 2158542 - RNA, 11 nt, Human
cauaagguuuu

SEQ ID NO: 2158543 - RNA, 16 nt, Human
cauaagguuuuuaugc

SEQ ID NO: 2158544 - RNA, 17 nt, Human
cauaagguuuuuaugca

SEQ ID NO: 2158545 - RNA, 17 nt, Human
cauaauaaaugcuucag

SEQ ID NO: 2158546 - RNA, 20 nt, Human
cauaaagcaaauagacacag

SEQ ID NO: 2158547 - RNA, 13 nt, Human
cauaaagcaaaua

SEQ ID NO: 2158548 - RNA, 22 nt, Human
cauaaccaugugaaaaggcaaa

SEQ ID NO: 2158549 - RNA, 20 nt, Human
cauaacagauuuuuuuugga

SEQ ID NO: 2158550 - RNA, 22 nt, Human
caguugguguucaaauagcacu

SEQ ID NO: 2158551 - RNA, 18 nt, Human
cagugugaauaaagugcu

SEQ ID NO: 2158552 - RNA, 17 nt, Human
caguggcaggacaggaa

SEQ ID NO: 2158553 - RNA, 19 nt, Human
caguucuugccacuuuuuu

SEQ ID NO: 2158554 - RNA, 15 nt, Human
caguuccuuucaaug

SEQ ID NO: 2158555 - RNA, 15 nt, Human
caguuaaguuuuucc

SEQ ID NO: 2158556 - RNA, 21 nt, Human
cagugugucgagucaaaaugu

SEQ ID NO: 2158557 - RNA, 24 nt, Human
caguguuggccaugaugacaacua

SEQ ID NO: 2158558 - RNA, 22 nt, Human
caucucagguuaagugugagua

SEQ ID NO: 2158559 - RNA, 15 nt, Human
cauacuuaagcaaaa

SEQ ID NO: 2158560 - RNA, 22 nt, Human
cauaguuggggucauagauguu

SEQ ID NO: 2158561 - RNA, 17 nt, Human
cauauccguauauaucc

SEQ ID NO: 2158562 - RNA, 15 nt, Human
cauaucauguacagu

SEQ ID NO: 2158563 - RNA, 14 nt, Human
cauauuuuguaacu

SEQ ID NO: 2158564 - RNA, 14 nt, Human
cauauuucuuuggc

SEQ ID NO: 2158565 - RNA, 12 nt, Human
cauauuucaauu

SEQ ID NO: 2158566 - RNA, 15 nt, Human
cauuuaaaguauuuu

SEQ ID NO: 2158567 - RNA, 17 nt, Human
cauuuacugugucuuug

SEQ ID NO: 2158568 - RNA, 21 nt, Human
cauuucccccaccccauuucu

SEQ ID NO: 2158569 - RNA, 20 nt, Human
cauuucccccaccccauuuc

SEQ ID NO: 2158570 - RNA, 10 nt, Human
cauuucucuc

SEQ ID NO: 2158571 - RNA, 15 nt, Human
cauuucucuccucac

SEQ ID NO: 2158572 - RNA, 21 nt, Human
ccaaaccuucacacacagacu

SEQ ID NO: 2158573 - RNA, 18 nt, Human
ccaaaccuucacacacag

SEQ ID NO: 2158574 - RNA, 18 nt, Human
cauuuuguaacaaaugaa

SEQ ID NO: 2158575 - RNA, 19 nt, Human
ccaauucuuacaaacaugu

SEQ ID NO: 2158576 - RNA, 18 nt, Human
ccaauucuuacaaacaug

SEQ ID NO: 2158577 - RNA, 17 nt, Human
ccaauuuuuuuuuccuu

SEQ ID NO: 2158578 - RNA, 16 nt, Human
ccaauuuuuuuuuccu

SEQ ID NO: 2158579 - RNA, 20 nt, Human
ccacaaaggcaaagggucca

SEQ ID NO: 2158580 - RNA, 16 nt, Human
ccacaaaggcaaaggg

SEQ ID NO: 2158581 - RNA, 13 nt, Human
ccaaggcucuguu

SEQ ID NO: 2158582 - RNA, 22 nt, Human
ccaagagcugaggcaauucuaa

SEQ ID NO: 2158583 - RNA, 21 nt, Human
ccaaccuauuuugaaguacca

SEQ ID NO: 2158584 - RNA, 14 nt, Human
ccaaccuauuuuga

SEQ ID NO: 2158585 - RNA, 21 nt, Human
ccaacccuucuccucuuguaa

SEQ ID NO: 2158586 - RNA, 13 nt, Human
ccaacccuucucc

SEQ ID NO: 2158587 - RNA, 11 nt, Human
ccaacccuucu

SEQ ID NO: 2158588 - RNA, 17 nt, Human
ccaagaccucagggcac

SEQ ID NO: 2158589 - RNA, 22 nt, Human
caugugguuaaugccauggaca

SEQ ID NO: 2158590 - RNA, 23 nt, Human
caugugguuacacagugugaaua

SEQ ID NO: 2158591 - RNA, 16 nt, Human
caugugguuacacagu

SEQ ID NO: 2158592 - RNA, 17 nt, Human
caugugguuaaugccau

SEQ ID NO: 2158593 - RNA, 16 nt, Human
cauggugcccuggcuu

SEQ ID NO: 2158594 - RNA, 22 nt, Human
caugugaaaaggcaaaaagcau

SEQ ID NO: 2158595 - RNA, 22 nt, Human
caugcagucugggaguggggaa

SEQ ID NO: 2158596 - RNA, 22 nt, Human
caugcagccuaaggcuguauga

SEQ ID NO: 2158597 - RNA, 16 nt, Human
caugccucagcccuga

SEQ ID NO: 2158598 - RNA, 14 nt, Human
caugccucagcccu

SEQ ID NO: 2158599 - RNA, 11 nt, Human
caugccucagc

SEQ ID NO: 2158600 - RNA, 20 nt, Human
caugccucagcccugacccu

SEQ ID NO: 2158601 - RNA, 19 nt, Human
caugccucagcccugaccc

SEQ ID NO: 2158602 - RNA, 21 nt, Human
caugccucccccuagccauuu

SEQ ID NO: 2158603 - RNA, 14 nt, Human
cauggauggaaaac

SEQ ID NO: 2158604 - RNA, 19 nt, Human
caugcugugauugugccua

SEQ ID NO: 2158605 - RNA, 21 nt, Human
cauggacagaagaaggcagca

SEQ ID NO: 2158606 - RNA, 15 nt, Human
cauggacagaagaag

SEQ ID NO: 2158607 - RNA, 22 nt, Human
caugcgacacugggaggccagu

SEQ ID NO: 2158608 - RNA, 23 nt, Human
ccaucgccagcugaugacucaag

SEQ ID NO: 2158609 - RNA, 21 nt, Human
ccaucgccagcugaugacuca

SEQ ID NO: 2158610 - RNA, 19 nt, Human
ccaucgccagcugaugacu

SEQ ID NO: 2158611 - RNA, 22 nt, Human
ccaucgccagcugaugacucaa

SEQ ID NO: 2158612 - RNA, 17 nt, Human
ccaucgccagcugauga

SEQ ID NO: 2158613 - RNA, 20 nt, Human
ccauccuucccugucugcca

SEQ ID NO: 2158614 - RNA, 14 nt, Human
ccaucuuucuuugg

SEQ ID NO: 2158615 - RNA, 16 nt, Human
ccauccucuucuuuua

SEQ ID NO: 2158616 - RNA, 18 nt, Human
ccaggccuuaucuccaag

SEQ ID NO: 2158617 - RNA, 17 nt, Human
ccagggagaccuggaca

SEQ ID NO: 2158618 - RNA, 16 nt, Human
ccagggagaccuggac

SEQ ID NO: 2158619 - RNA, 18 nt, Human
ccagggacgaagaagagc

SEQ ID NO: 2158620 - RNA, 23 nt, Human
ccagggacgaagaagagccacag

SEQ ID NO: 2158621 - RNA, 21 nt, Human
ccagggacgaagaagagccac

SEQ ID NO: 2158622 - RNA, 20 nt, Human
ccagggacgaagaagagcca

SEQ ID NO: 2158623 - RNA, 19 nt, Human
ccagggacgaagaagagcc

SEQ ID NO: 2158624 - RNA, 23 nt, Human
ccagcugaugacucaagauuccc

SEQ ID NO: 2158625 - RNA, 22 nt, Human
ccagcugaugacucaagauucc

SEQ ID NO: 2158626 - RNA, 17 nt, Human
ccagcugaugacucaag

SEQ ID NO: 2158627 - RNA, 16 nt, Human
ccagcugaugacucaa

SEQ ID NO: 2158628 - RNA, 15 nt, Human
ccagcugaugacuca

SEQ ID NO: 2158629 - RNA, 11 nt, Human
ccagccuggcc

SEQ ID NO: 2158630 - RNA, 18 nt, Human
ccaugugcuacaggggcc

SEQ ID NO: 2158631 - RNA, 23 nt, Human
ccaugugcuacaggggccagaag

SEQ ID NO: 2158632 - RNA, 21 nt, Human
ccaugugaggguuuucagcau

SEQ ID NO: 2158633 - RNA, 16 nt, Human
ccauggauggaaaacg

SEQ ID NO: 2158634 - RNA, 22 nt, Human
ccaugaaaaugcaacaacaugu

SEQ ID NO: 2158635 - RNA, 16 nt, Human
ccaugcgacacuggga

SEQ ID NO: 2158636 - RNA, 22 nt, Human
ccaugcgacacugggaggccag

SEQ ID NO: 2158637 - RNA, 21 nt, Human
ccaugcgacacugggaggcca

SEQ ID NO: 2158638 - RNA, 11 nt, Human
cccagacacau

SEQ ID NO: 2158639 - RNA, 23 nt, Human
cccagacacaucgcacuguggau

SEQ ID NO: 2158640 - RNA, 20 nt, Human
cccagacacaucgcacugug

SEQ ID NO: 2158641 - RNA, 21 nt, Human
cccagacggcuccacuaggac

SEQ ID NO: 2158642 - RNA, 19 nt, Human
cccagcuacucgggaagcu

SEQ ID NO: 2158643 - RNA, 17 nt, Human
cccaguccuuccaccuc

SEQ ID NO: 2158644 - RNA, 16 nt, Human
cccaguccuuccaccu

SEQ ID NO: 2158645 - RNA, 14 nt, Human
cccaguccuuccac

SEQ ID NO: 2158646 - RNA, 23 nt, Human
cccaucgccagcugaugacucaa

SEQ ID NO: 2158647 - RNA, 13 nt, Human
ccuccauccuagu

SEQ ID NO: 2158648 - RNA, 19 nt, Human
ccucaguucuugccacuuu

SEQ ID NO: 2158649 - RNA, 18 nt, Human
ccucuccucauguucugc

SEQ ID NO: 2158650 - RNA, 20 nt, Human
ccucugaaugaaccuucugg

SEQ ID NO: 2158651 - RNA, 15 nt, Human
ccucucccugacccu

SEQ ID NO: 2158652 - RNA, 12 nt, Human
ccucucccugac

SEQ ID NO: 2158653 - RNA, 21 nt, Human
ccucucccugacccuguauau

SEQ ID NO: 2158654 - RNA, 11 nt, Human
ccucucccagg

SEQ ID NO: 2158655 - RNA, 21 nt, Human
cccuuuauugaaaaaauaaaa

SEQ ID NO: 2158656 - RNA, 19 nt, Human
ccuaacauaccuaagcaaa

SEQ ID NO: 2158657 - RNA, 16 nt, Human
ccuaaaccaaaaacug

SEQ ID NO: 2158658 - RNA, 15 nt, Human
ccuauucuuucgaaa

SEQ ID NO: 2158659 - RNA, 11 nt, Human
ccucacacagc

SEQ ID NO: 2158660 - RNA, 18 nt, Human
ccucagcccugacccugu

SEQ ID NO: 2158661 - RNA, 17 nt, Human
ccucagcccugacccug

SEQ ID NO: 2158662 - RNA, 16 nt, Human
ccucagcccugacccu

SEQ ID NO: 2158663 - RNA, 15 nt, Human
ccucagcccugaccc

SEQ ID NO: 2158664 - RNA, 13 nt, Human
ccucagcccugac

SEQ ID NO: 2158665 - RNA, 14 nt, Human
ccucagagugcaag

SEQ ID NO: 2158666 - RNA, 21 nt, Human
ccucagagugcaagccccugc

SEQ ID NO: 2158667 - RNA, 21 nt, Human
cccgcggggacauugggaagg

SEQ ID NO: 2158668 - RNA, 21 nt, Human
cccuaaggucauuaccacagg

SEQ ID NO: 2158669 - RNA, 14 nt, Human
cccuaaaagcacac

SEQ ID NO: 2158670 - RNA, 19 nt, Human
cuaaggucauuaccacagg

SEQ ID NO: 2158671 - RNA, 15 nt, Human
cuacccgcagaguuc

SEQ ID NO: 2158672 - RNA, 16 nt, Human
cuacaauuuaaagcaa

SEQ ID NO: 2158673 - RNA, 23 nt, Human
cuacagaaaaaccagaggcagcu

SEQ ID NO: 2158674 - RNA, 13 nt, Human
cuacagaaaaacc

SEQ ID NO: 2158675 - RNA, 13 nt, Human
cuaaugauggccc

SEQ ID NO: 2158676 - RNA, 23 nt, Human
cuaaugauggcccauucuacuug

SEQ ID NO: 2158677 - RNA, 22 nt, Human
cuaaugauggcccauucuacuu

SEQ ID NO: 2158678 - RNA, 19 nt, Human
cuaaugugccuaguucuuu

SEQ ID NO: 2158679 - RNA, 18 nt, Human
cuaaugucuguaucacuc

SEQ ID NO: 2158680 - RNA, 19 nt, Human
cuacuugcucuggaccugc

SEQ ID NO: 2158681 - RNA, 18 nt, Human
cuacuugcucuggaccug

SEQ ID NO: 2158682 - RNA, 17 nt, Human
cuacuugcucuggaccu

SEQ ID NO: 2158683 - RNA, 16 nt, Human
cuacuugcucuggacc

SEQ ID NO: 2158684 - RNA, 15 nt, Human
cuacuugcucuggac

SEQ ID NO: 2158685 - RNA, 14 nt, Human
cuacuugcucugga

SEQ ID NO: 2158686 - RNA, 13 nt, Human
cuacuugcucugg

SEQ ID NO: 2158687 - RNA, 21 nt, Human
cuacuugcucuggaccugccc

SEQ ID NO: 2158688 - RNA, 21 nt, Human
cuacuuuaauaaaugguuauu

SEQ ID NO: 2158689 - RNA, 21 nt, Human
cuacugugguguuuuguuuau

SEQ ID NO: 2158690 - RNA, 13 nt, Human
cuagcacaugccc

SEQ ID NO: 2158691 - RNA, 18 nt, Human
cuagagggaccucuccca

SEQ ID NO: 2158692 - RNA, 19 nt, Human
cuagagggaccucucccag

SEQ ID NO: 2158693 - RNA, 20 nt, Human
cuagagggaccucucccagg

SEQ ID NO: 2158694 - RNA, 21 nt, Human
cuagagggaccucucccaggg

SEQ ID NO: 2158695 - RNA, 22 nt, Human
cuagagcuuucuuucacaaaaa

SEQ ID NO: 2158696 - RNA, 14 nt, Human
cuagagcuuucuuu

SEQ ID NO: 2158697 - RNA, 14 nt, Human
cuaggccaggugca

SEQ ID NO: 2158698 - RNA, 11 nt, Human
cuaggccaggu

SEQ ID NO: 2158699 - RNA, 22 nt, Human
cuaggccaggugcaaccaggga

SEQ ID NO: 2158700 - RNA, 20 nt, Human
cuaggccaggugcaaccagg

SEQ ID NO: 2158701 - RNA, 23 nt, Human
cuaggaagaucucugcagggccg

SEQ ID NO: 2158702 - RNA, 17 nt, Human
cuaggacuucaaauugg

SEQ ID NO: 2158703 - RNA, 15 nt, Human
cuaggauacugcugc

SEQ ID NO: 2158704 - RNA, 14 nt, Human
cuaggauacugcug

SEQ ID NO: 2158705 - RNA, 16 nt, Human
cucacauuacacacac

SEQ ID NO: 2158706 - RNA, 23 nt, Human
cucaccccagacuccugacuguc

SEQ ID NO: 2158707 - RNA, 22 nt, Human
cucaaaugcucagaccagcucu

SEQ ID NO: 2158708 - RNA, 12 nt, Human
cuauuuugaagu

SEQ ID NO: 2158709 - RNA, 18 nt, Human
cucaacuagcagauacag

SEQ ID NO: 2158710 - RNA, 22 nt, Human
cgugggcugggcccacaaaggc

SEQ ID NO: 2158711 - RNA, 17 nt, Human
cgugcagggacaaagag

SEQ ID NO: 2158712 - RNA, 19 nt, Human
cuaaaacuacaaaaauuaa

SEQ ID NO: 2158713 - RNA, 23 nt, Human
cguuuacaagcccccccuuccac

SEQ ID NO: 2158714 - RNA, 15 nt, Human
cuaacaccagacaga

SEQ ID NO: 2158715 - RNA, 17 nt, Human
cgggagccucccugccu

SEQ ID NO: 2158716 - RNA, 15 nt, Human
cgggagccucccugc

SEQ ID NO: 2158717 - RNA, 22 nt, Human
cgggagccucccugccucaggc

SEQ ID NO: 2158718 - RNA, 19 nt, Human
cgggagccucccugccuca

SEQ ID NO: 2158719 - RNA, 23 nt, Human
cgcugucccuaguaaaaauacaa

SEQ ID NO: 2158720 - RNA, 13 nt, Human
cgcuugagaaaaa

SEQ ID NO: 2158721 - RNA, 23 nt, Human
cgcggcggagcuggccccgccgc

SEQ ID NO: 2158722 - RNA, 22 nt, Human
cgcggcggagcuggccccgccg

SEQ ID NO: 2158723 - RNA, 21 nt, Human
cgcggcggagcuggccccgcc

SEQ ID NO: 2158724 - RNA, 18 nt, Human
cgcggcggagcuggcccc

SEQ ID NO: 2158725 - RNA, 17 nt, Human
cgcggcggagcuggccc

SEQ ID NO: 2158726 - RNA, 15 nt, Human
cgcggcggagcuggc

SEQ ID NO: 2158727 - RNA, 13 nt, Human
cgccagcugauga

SEQ ID NO: 2158728 - RNA, 20 nt, Human
cgccagcugaugacucaaga

SEQ ID NO: 2158729 - RNA, 18 nt, Human
cgccagcugaugacucaa

SEQ ID NO: 2158730 - RNA, 17 nt, Human
cgccagcugaugacuca

SEQ ID NO: 2158731 - RNA, 16 nt, Human
cgccagcugaugacuc

SEQ ID NO: 2158732 - RNA, 15 nt, Human
cgccagcugaugacu

SEQ ID NO: 2158733 - RNA, 14 nt, Human
cgcccccugcccuc

SEQ ID NO: 2158734 - RNA, 16 nt, Human
cgcccaguccuuccac

SEQ ID NO: 2158735 - RNA, 19 nt, Human
cgcccccugcccuccccuc

SEQ ID NO: 2158736 - RNA, 15 nt, Human
cgcccccugcccucc

SEQ ID NO: 2158737 - RNA, 15 nt, Human
cgcccaguccuucca

SEQ ID NO: 2158738 - RNA, 14 nt, Human
cgcccaguccuucc

SEQ ID NO: 2158739 - RNA, 21 nt, Human
cgcccagauuaugagacacag

SEQ ID NO: 2158740 - RNA, 18 nt, Human
cucccaggugcagccaga

SEQ ID NO: 2158741 - RNA, 17 nt, Human
cucccaggugcagccag

SEQ ID NO: 2158742 - RNA, 13 nt, Human
cucuacucugcuu

SEQ ID NO: 2158743 - RNA, 12 nt, Human
cucuacucugcu

SEQ ID NO: 2158744 - RNA, 16 nt, Human
cucuacucuuacuucc

SEQ ID NO: 2158745 - RNA, 14 nt, Human
cucuacucugcuuu

SEQ ID NO: 2158746 - RNA, 22 nt, Human
cucucuacuaaaacuacaaaaa

SEQ ID NO: 2158747 - RNA, 23 nt, Human
cucucuacuaaaacuacaaaaau

SEQ ID NO: 2158748 - RNA, 18 nt, Human
cugaagaguccucugaau

SEQ ID NO: 2158749 - RNA, 15 nt, Human
cugaagaguccucug

SEQ ID NO: 2158750 - RNA, 16 nt, Human
cugaagaguccucuga

SEQ ID NO: 2158751 - RNA, 14 nt, Human
cugaagaguccucu

SEQ ID NO: 2158752 - RNA, 17 nt, Human
cugacagucaugcaguc

SEQ ID NO: 2158753 - RNA, 22 nt, Human
cugacucacaccugaacugaac

SEQ ID NO: 2158754 - RNA, 20 nt, Human
cugacugucucccgggacua

SEQ ID NO: 2158755 - RNA, 23 nt, Human
cugagaauauaauacuguauuug

SEQ ID NO: 2158756 - RNA, 20 nt, Human
cugagaauauaauacuguau

SEQ ID NO: 2158757 - RNA, 23 nt, Human
cugagaagguuugguccagccug

SEQ ID NO: 2158758 - RNA, 17 nt, Human
cugagcucuuugcacua

SEQ ID NO: 2158759 - RNA, 22 nt, Human
cugagccagugucaggaggaag

SEQ ID NO: 2158760 - RNA, 16 nt, Human
cugagccagugucagg

SEQ ID NO: 2158761 - RNA, 22 nt, Human
cugagcgccuggguccagggga

SEQ ID NO: 2158762 - RNA, 15 nt, Human
cugagcgccuggguc

SEQ ID NO: 2158763 - RNA, 22 nt, Human
cucuucuuuuagcaguaaaaua

SEQ ID NO: 2158764 - RNA, 18 nt, Human
cugaaauauacacacagc

SEQ ID NO: 2158765 - RNA, 19 nt, Human
cugaaauauacacacagca

SEQ ID NO: 2158766 - RNA, 12 nt, Human
cucuuugcacua

SEQ ID NO: 2158767 - RNA, 20 nt, Human
cugaacaccauugaaggcuu

SEQ ID NO: 2158768 - RNA, 11 nt, Human
cugaacaccau

SEQ ID NO: 2158769 - RNA, 18 nt, Human
cugaacaccauugaaggc

SEQ ID NO: 2158770 - RNA, 19 nt, Human
cugaacaccauugaaggcu

SEQ ID NO: 2158771 - RNA, 19 nt, Human
cugaacugauggguuucuc

SEQ ID NO: 2158772 - RNA, 13 nt, Human
cugaacugaacac

SEQ ID NO: 2158773 - RNA, 16 nt, Human
cucucugaaccccucc

SEQ ID NO: 2158774 - RNA, 13 nt, Human
cucugcuuugaaa

SEQ ID NO: 2158775 - RNA, 14 nt, Human
cucugcuuuaaagu

SEQ ID NO: 2158776 - RNA, 16 nt, Human
cuguauuugagaauau

SEQ ID NO: 2158777 - RNA, 19 nt, Human
cugucccuaguaaaaauac

SEQ ID NO: 2158778 - RNA, 21 nt, Human
cugucccuaguaaaaauacaa

SEQ ID NO: 2158779 - RNA, 12 nt, Human
cugucuccuggc

SEQ ID NO: 2158780 - RNA, 17 nt, Human
cuggucagguauuucag

SEQ ID NO: 2158781 - RNA, 22 nt, Human
cugguccacagggcaccugcca

SEQ ID NO: 2158782 - RNA, 16 nt, Human
cugguccacagggcac

SEQ ID NO: 2158783 - RNA, 13 nt, Human
cugguccacaggg

SEQ ID NO: 2158784 - RNA, 23 nt, Human
cuguaccaugugcuacaggggcc

SEQ ID NO: 2158785 - RNA, 19 nt, Human
cuggcuuuuuauuguauuu

SEQ ID NO: 2158786 - RNA, 11 nt, Human
cugggaaacag

SEQ ID NO: 2158787 - RNA, 15 nt, Human
cugggaaacagaggc

SEQ ID NO: 2158788 - RNA, 16 nt, Human
cugggaaacagaggcu

SEQ ID NO: 2158789 - RNA, 13 nt, Human
cuggcuggaguga

SEQ ID NO: 2158790 - RNA, 20 nt, Human
cugggaugggaggagaggac

SEQ ID NO: 2158791 - RNA, 13 nt, Human
cuggccucccaca

SEQ ID NO: 2158792 - RNA, 14 nt, Human
cuggccucccacag

SEQ ID NO: 2158793 - RNA, 18 nt, Human
cuggcaugauccaagcaa

SEQ ID NO: 2158794 - RNA, 17 nt, Human
cuggcaugauccaagca

SEQ ID NO: 2158795 - RNA, 18 nt, Human
cuggcaugcuaaagccuu

SEQ ID NO: 2158796 - RNA, 15 nt, Human
cugcauaccaaccug

SEQ ID NO: 2158797 - RNA, 16 nt, Human
cugcauaccaaccugg

SEQ ID NO: 2158798 - RNA, 17 nt, Human
cugccacccugggccug

SEQ ID NO: 2158799 - RNA, 16 nt, Human
cugccacccugggccu

SEQ ID NO: 2158800 - RNA, 23 nt, Human
cugccacccugggccuggcagcu

SEQ ID NO: 2158801 - RNA, 15 nt, Human
cugcagacgcccaga

SEQ ID NO: 2158802 - RNA, 16 nt, Human
cugcagugaggcugug

SEQ ID NO: 2158803 - RNA, 22 nt, Human
cugcuguaaauuuggcuucugu

SEQ ID NO: 2158804 - RNA, 23 nt, Human
cugcgcccaguccuuccaccucg

SEQ ID NO: 2158805 - RNA, 19 nt, Human
cugcgcccaguccuuccac

SEQ ID NO: 2158806 - RNA, 18 nt, Human
cugcgcccaguccuucca

SEQ ID NO: 2158807 - RNA, 16 nt, Human
cuugagucacaaagaa

SEQ ID NO: 2158808 - RNA, 13 nt, Human
cuugcauauuuug

SEQ ID NO: 2158809 - RNA, 14 nt, Human
cuugaguaaaauaa

SEQ ID NO: 2158810 - RNA, 13 nt, Human
cuugaguaaaaua

SEQ ID NO: 2158811 - RNA, 12 nt, Human
cuugaguaaaau

SEQ ID NO: 2158812 - RNA, 12 nt, Human
cuucuuuuagca

SEQ ID NO: 2158813 - RNA, 23 nt, Human
cuucuuuuagcaguaaaauagcu

SEQ ID NO: 2158814 - RNA, 17 nt, Human
cuugcuuuguguucuuu

SEQ ID NO: 2158815 - RNA, 19 nt, Human
cuugcuuuguguucuuugu

SEQ ID NO: 2158816 - RNA, 18 nt, Human
cuugcuuuguguucuuug

SEQ ID NO: 2158817 - RNA, 14 nt, Human
cuugcauugcagag

SEQ ID NO: 2158818 - RNA, 16 nt, Human
cuuucuuucacaaaaa

SEQ ID NO: 2158819 - RNA, 15 nt, Human
cuuucaaagccauuu

SEQ ID NO: 2158820 - RNA, 17 nt, Human
cuuucaaagccauuuua

SEQ ID NO: 2158821 - RNA, 22 nt, Human
cuuucaugaguuuuucccagcu

SEQ ID NO: 2158822 - RNA, 18 nt, Human
cuuucaugaguuuuuccc

SEQ ID NO: 2158823 - RNA, 14 nt, Human
cuuuguuuuuauuu

SEQ ID NO: 2158824 - RNA, 22 nt, Human
cuuuggagaagaguguggaguc

SEQ ID NO: 2158825 - RNA, 17 nt, Human
cuuuggaagaaaaaauc

SEQ ID NO: 2158826 - RNA, 15 nt, Human
cuuuggaagaaaaaa

SEQ ID NO: 2158827 - RNA, 21 nt, Human
cuuuuaacuccucaauuccaa

SEQ ID NO: 2158828 - RNA, 20 nt, Human
cuuuuaacuccucaauucca

SEQ ID NO: 2158829 - RNA, 19 nt, Human
gaaauucaacguuaauaau

SEQ ID NO: 2158830 - RNA, 23 nt, Human
gaaauucaacguuaauaauucug

SEQ ID NO: 2158831 - RNA, 14 nt, Human
gaaauuaggaugua

SEQ ID NO: 2158832 - RNA, 20 nt, Human
gaacauguagaaaacaaaau

SEQ ID NO: 2158833 - RNA, 17 nt, Human
gaaaugcaaaaaucucu

SEQ ID NO: 2158834 - RNA, 14 nt, Human
gaaaugcaaaaauc

SEQ ID NO: 2158835 - RNA, 20 nt, Human
gaaaugagaggcauuucccc

SEQ ID NO: 2158836 - RNA, 14 nt, Human
gaaagcaaagggcu

SEQ ID NO: 2158837 - RNA, 11 nt, Human
gaaaaauggag

SEQ ID NO: 2158838 - RNA, 22 nt, Human
gaaaaagaaaugcaaaaaucuc

SEQ ID NO: 2158839 - RNA, 14 nt, Human
gaaaaagaaaugca

SEQ ID NO: 2158840 - RNA, 13 nt, Human
gaaaaagaaaugc

SEQ ID NO: 2158841 - RNA, 20 nt, Human
gaaacgaagccaucuuucuu

SEQ ID NO: 2158842 - RNA, 14 nt, Human
gaaacgcagacacu

SEQ ID NO: 2158843 - RNA, 22 nt, Human
gaaaggagccuaggccaggugc

SEQ ID NO: 2158844 - RNA, 19 nt, Human
gaaaggagccuaggccagg

SEQ ID NO: 2158845 - RNA, 16 nt, Human
gaaagugccagaaagu

SEQ ID NO: 2158846 - RNA, 16 nt, Human
gaaagugaaaguccag

SEQ ID NO: 2158847 - RNA, 14 nt, Human
gaagaguccucuga

SEQ ID NO: 2158848 - RNA, 16 nt, Human
gaagaguccucugaau

SEQ ID NO: 2158849 - RNA, 22 nt, Human
gaagauucuucccauucuccau

SEQ ID NO: 2158850 - RNA, 21 nt, Human
gaagauucuucccauucucca

SEQ ID NO: 2158851 - RNA, 21 nt, Human
gaagaguguggagucauucuc

SEQ ID NO: 2158852 - RNA, 22 nt, Human
gaagaucucugcagggccgcca

SEQ ID NO: 2158853 - RNA, 19 nt, Human
gaagaucucugcagggccg

SEQ ID NO: 2158854 - RNA, 24 nt, Human
gaacuuuccacauucagagcuuac

SEQ ID NO: 2158855 - RNA, 14 nt, Human
gaacuuuauuucca

SEQ ID NO: 2158856 - RNA, 18 nt, Human
gagacacaggaugaagca

SEQ ID NO: 2158857 - RNA, 17 nt, Human
gagacacaggaugaagc

SEQ ID NO: 2158858 - RNA, 11 nt, Human
gagacacagga

SEQ ID NO: 2158859 - RNA, 23 nt, Human
gagaagauucuucccauucucca

SEQ ID NO: 2158860 - RNA, 14 nt, Human
gacuccggcccucc

SEQ ID NO: 2158861 - RNA, 13 nt, Human
gagaccagccugg

SEQ ID NO: 2158862 - RNA, 14 nt, Human
gagaccagccuggc

SEQ ID NO: 2158863 - RNA, 18 nt, Human
gagagaggcaauggcucc

SEQ ID NO: 2158864 - RNA, 23 nt, Human
gagagggccgggcagaggggcag

SEQ ID NO: 2158865 - RNA, 22 nt, Human
gaggaaaaaaaucguccaggga

SEQ ID NO: 2158866 - RNA, 18 nt, Human
gaggaaacaacagcuuua

SEQ ID NO: 2158867 - RNA, 14 nt, Human
gagcucuuugcacu

SEQ ID NO: 2158868 - RNA, 17 nt, Human
gagcugaggcaauucua

SEQ ID NO: 2158869 - RNA, 21 nt, Human
gagcucuuggaggugucugua

SEQ ID NO: 2158870 - RNA, 21 nt, Human
gagcucccaggugcagccaga

SEQ ID NO: 2158871 - RNA, 20 nt, Human
gagcucccaggugcagccag

SEQ ID NO: 2158872 - RNA, 16 nt, Human
gagcucccaggugcag

SEQ ID NO: 2158873 - RNA, 18 nt, Human
gagcuagccagaggacug

SEQ ID NO: 2158874 - RNA, 15 nt, Human
gagcuagccagagga

SEQ ID NO: 2158875 - RNA, 14 nt, Human
gagcuagccagagg

SEQ ID NO: 2158876 - RNA, 13 nt, Human
gagcuagccagag

SEQ ID NO: 2158877 - RNA, 12 nt, Human
gagcuagccaga

SEQ ID NO: 2158878 - RNA, 22 nt, Human
gagcagagaucacaccacugca

SEQ ID NO: 2158879 - RNA, 20 nt, Human
gagcagagaucacaccacug

SEQ ID NO: 2158880 - RNA, 14 nt, Human
gagccucccugccu

SEQ ID NO: 2158881 - RNA, 13 nt, Human
gagccucccugcc

SEQ ID NO: 2158882 - RNA, 12 nt, Human
gagccucccugc

SEQ ID NO: 2158883 - RNA, 19 nt, Human
gagccucccugccucaggc

SEQ ID NO: 2158884 - RNA, 15 nt, Human
gagccucccugccuc

SEQ ID NO: 2158885 - RNA, 16 nt, Human
gagccuaggccaggug

SEQ ID NO: 2158886 - RNA, 17 nt, Human
gagccuaggccaggugc

SEQ ID NO: 2158887 - RNA, 15 nt, Human
gagccuaggccaggu

SEQ ID NO: 2158888 - RNA, 14 nt, Human
gagccuaggccagg

SEQ ID NO: 2158889 - RNA, 18 nt, Human
gacgaagaagagccacag

SEQ ID NO: 2158890 - RNA, 22 nt, Human
gacggcugggcacacgccuccc

SEQ ID NO: 2158891 - RNA, 16 nt, Human
gacgaagaagagccac

SEQ ID NO: 2158892 - RNA, 14 nt, Human
gaccuugaugagcu

SEQ ID NO: 2158893 - RNA, 15 nt, Human
gaccuugaugagcug

SEQ ID NO: 2158894 - RNA, 13 nt, Human
gaccuugaugagc

SEQ ID NO: 2158895 - RNA, 18 nt, Human
gaccuggacacaggccug

SEQ ID NO: 2158896 - RNA, 14 nt, Human
gacguguuuguguu

SEQ ID NO: 2158897 - RNA, 18 nt, Human
gacuaauucuugcauauu

SEQ ID NO: 2158898 - RNA, 12 nt, Human
gacuaauucuug

SEQ ID NO: 2158899 - RNA, 14 nt, Human
gacccuguggaagc

SEQ ID NO: 2158900 - RNA, 17 nt, Human
gaccugcagacgcccag

SEQ ID NO: 2158901 - RNA, 23 nt, Human
gaccugcccccgcauccccugcc

SEQ ID NO: 2158902 - RNA, 21 nt, Human
gacauagcaucuuguggcuuu

SEQ ID NO: 2158903 - RNA, 14 nt, Human
gacaggcagagcug

SEQ ID NO: 2158904 - RNA, 16 nt, Human
gacagcauuuuccucu

SEQ ID NO: 2158905 - RNA, 23 nt, Human
gacagcauuuuccucugcuuuga

SEQ ID NO: 2158906 - RNA, 20 nt, Human
gacagcauuuuccucugcuu

SEQ ID NO: 2158907 - RNA, 21 nt, Human
gacagcuucucauccugcagg

SEQ ID NO: 2158908 - RNA, 22 nt, Human
gacagcuucucauccugcaggc

SEQ ID NO: 2158909 - RNA, 12 nt, Human
gacaccuuucau

SEQ ID NO: 2158910 - RNA, 12 nt, Human
gacacaggccug

SEQ ID NO: 2158911 - RNA, 13 nt, Human
gacacccccucgc

SEQ ID NO: 2158912 - RNA, 19 nt, Human
gcacugccucucacagcug

SEQ ID NO: 2158913 - RNA, 21 nt, Human
gcacugccucucacagcugag

SEQ ID NO: 2158914 - RNA, 16 nt, Human
gcacugccucucacag

SEQ ID NO: 2158915 - RNA, 14 nt, Human
gcacugccucucac

SEQ ID NO: 2158916 - RNA, 13 nt, Human
gcacugccucuca

SEQ ID NO: 2158917 - RNA, 21 nt, Human
gcacggaccaugcgacacugg

SEQ ID NO: 2158918 - RNA, 20 nt, Human
gcacgguggacccagacaca

SEQ ID NO: 2158919 - RNA, 20 nt, Human
gcaccauuuaaaaacaggca

SEQ ID NO: 2158920 - RNA, 21 nt, Human
gcacccaagaccucagggcac

SEQ ID NO: 2158921 - RNA, 17 nt, Human
gcacccaagaccucagg

SEQ ID NO: 2158922 - RNA, 15 nt, Human
gcagauacugucucu

SEQ ID NO: 2158923 - RNA, 22 nt, Human
gcagcgggagccucccugccuc

SEQ ID NO: 2158924 - RNA, 13 nt, Human
gcaggacaggaaa

SEQ ID NO: 2158925 - RNA, 16 nt, Human
gccaaaaaaagacagg

SEQ ID NO: 2158926 - RNA, 14 nt, Human
gccaaaaaaagaca

SEQ ID NO: 2158927 - RNA, 18 nt, Human
gcaugaucugaaaaauac

SEQ ID NO: 2158928 - RNA, 16 nt, Human
gcaugaucugaaaaau

SEQ ID NO: 2158929 - RNA, 23 nt, Human
gcaugauccaagcaagacugagg

SEQ ID NO: 2158930 - RNA, 22 nt, Human
gcaugauccaagcaagacugag

SEQ ID NO: 2158931 - RNA, 19 nt, Human
gcaugauccaagcaagacu

SEQ ID NO: 2158932 - RNA, 18 nt, Human
gcaugauccaagcaagac

SEQ ID NO: 2158933 - RNA, 13 nt, Human
gcaugaagguuuc

SEQ ID NO: 2158934 - RNA, 20 nt, Human
gcaucuuguggcuuugcaac

SEQ ID NO: 2158935 - RNA, 14 nt, Human
gcauauuuuguaac

SEQ ID NO: 2158936 - RNA, 21 nt, Human
gcaggggagggucagccaggg

SEQ ID NO: 2158937 - RNA, 19 nt, Human
gcaggggagggucagccag

SEQ ID NO: 2158938 - RNA, 20 nt, Human
gcaggggagggucagccagg

SEQ ID NO: 2158939 - RNA, 19 nt, Human
gcagggccaacccuucucc

SEQ ID NO: 2158940 - RNA, 23 nt, Human
gcagggccgccagggagaccugg

SEQ ID NO: 2158941 - RNA, 15 nt, Human
gcagggccgccaggg

SEQ ID NO: 2158942 - RNA, 15 nt, Human
gcagugccugauaag

SEQ ID NO: 2158943 - RNA, 20 nt, Human
gcaguggagguagaaugacu

SEQ ID NO: 2158944 - RNA, 18 nt, Human
gcaguggagguagaauga

SEQ ID NO: 2158945 - RNA, 17 nt, Human
gcagguagaccugucuc

SEQ ID NO: 2158946 - RNA, 19 nt, Human
gcagguagaccugucuccu

SEQ ID NO: 2158947 - RNA, 15 nt, Human
gcaggugaauuguuu

SEQ ID NO: 2158948 - RNA, 20 nt, Human
gcaggugaaacccagucacu

SEQ ID NO: 2158949 - RNA, 17 nt, Human
gcaggugaaacccaguc

SEQ ID NO: 2158950 - RNA, 16 nt, Human
gcaggugaaacccagu

SEQ ID NO: 2158951 - RNA, 16 nt, Human
gauaaauacaaggccc

SEQ ID NO: 2158952 - RNA, 16 nt, Human
gauaagcuucaaagcu

SEQ ID NO: 2158953 - RNA, 16 nt, Human
gauaguauugugcaua

SEQ ID NO: 2158954 - RNA, 23 nt, Human
gaucuauacuugcuuuguguucu

SEQ ID NO: 2158955 - RNA, 16 nt, Human
gaucuauacuugcuuu

SEQ ID NO: 2158956 - RNA, 21 nt, Human
gaucgcggcggagcuggcccc

SEQ ID NO: 2158957 - RNA, 15 nt, Human
gaugaagcauuuaca

SEQ ID NO: 2158958 - RNA, 15 nt, Human
gaugaagcaaacaca

SEQ ID NO: 2158959 - RNA, 16 nt, Human
gaugaagcaaacacau

SEQ ID NO: 2158960 - RNA, 19 nt, Human
gaugaagcaaacacauuaa

SEQ ID NO: 2158961 - RNA, 15 nt, Human
gauggauuuguauca

SEQ ID NO: 2158962 - RNA, 16 nt, Human
gaugcagcauuaugau

SEQ ID NO: 2158963 - RNA, 21 nt, Human
gaugcagcauuuuguauuugu

SEQ ID NO: 2158964 - RNA, 19 nt, Human
gaugacaacuacagaaaaa

SEQ ID NO: 2158965 - RNA, 20 nt, Human
gaugacaugcacucagcucu

SEQ ID NO: 2158966 - RNA, 22 nt, Human
gauuuuuacguuugaagacauu

SEQ ID NO: 2158967 - RNA, 22 nt, Human
gauuuccccuuuugcauucucc

SEQ ID NO: 2158968 - RNA, 23 nt, Human
gauuuccccuuuugcauucuccc

SEQ ID NO: 2158969 - RNA, 19 nt, Human
gauuuccccuuuugcauuc

SEQ ID NO: 2158970 - RNA, 17 nt, Human
gauuuccccuuuugcau

SEQ ID NO: 2158971 - RNA, 22 nt, Human
gauuucccauccccugugggaa

SEQ ID NO: 2158972 - RNA, 20 nt, Human
gauuucccauccccuguggg

SEQ ID NO: 2158973 - RNA, 16 nt, Human
gauuuccccuuuugca

SEQ ID NO: 2158974 - RNA, 18 nt, Human
gcaaaggguccagaagga

SEQ ID NO: 2158975 - RNA, 22 nt, Human
gcaaaggguccagaaggagaca

SEQ ID NO: 2158976 - RNA, 15 nt, Human
gcaacagaaaaaugg

SEQ ID NO: 2158977 - RNA, 17 nt, Human
gcaacagaaaaauggag

SEQ ID NO: 2158978 - RNA, 16 nt, Human
gcaaggguucccucaa

SEQ ID NO: 2158979 - RNA, 18 nt, Human
gcaaggguucccucaaga

SEQ ID NO: 2158980 - RNA, 15 nt, Human
gcaagccccugcucc

SEQ ID NO: 2158981 - RNA, 22 nt, Human
gccccaggcagggccaacccuu

SEQ ID NO: 2158982 - RNA, 23 nt, Human
gccccauucuuuuguaauuuaaa

SEQ ID NO: 2158983 - RNA, 22 nt, Human
gccccauucuuuuguaauuuaa

SEQ ID NO: 2158984 - RNA, 19 nt, Human
gcccccugcccuccccucu

SEQ ID NO: 2158985 - RNA, 14 nt, Human
gcccccugcccucc

SEQ ID NO: 2158986 - RNA, 12 nt, Human
gcccccugcccu

SEQ ID NO: 2158987 - RNA, 22 nt, Human
gccccuuuacggacacccccuc

SEQ ID NO: 2158988 - RNA, 20 nt, Human
gccccuuuacggacaccccc

SEQ ID NO: 2158989 - RNA, 15 nt, Human
gccccuuuacggaca

SEQ ID NO: 2158990 - RNA, 18 nt, Human
gcccuccuacccugcgcc

SEQ ID NO: 2158991 - RNA, 14 nt, Human
gcccugacccugug

SEQ ID NO: 2158992 - RNA, 17 nt, Human
gcccugacccuguggaa

SEQ ID NO: 2158993 - RNA, 17 nt, Human
gcccuccuacccugcgc

SEQ ID NO: 2158994 - RNA, 12 nt, Human
gcccucccaggc

SEQ ID NO: 2158995 - RNA, 21 nt, Human
gcccucccaggcucucaacag

SEQ ID NO: 2158996 - RNA, 20 nt, Human
gcccaagguuaaaaaguuca

SEQ ID NO: 2158997 - RNA, 23 nt, Human
gccaugaagaggaugcugugaaa

SEQ ID NO: 2158998 - RNA, 14 nt, Human
gccaugccucagcc

SEQ ID NO: 2158999 - RNA, 13 nt, Human
gccaugccucagc

SEQ ID NO: 2159000 - RNA, 21 nt, Human
gccaugccucagcccugaccc

SEQ ID NO: 2159001 - RNA, 17 nt, Human
gccaugccucagcccug

SEQ ID NO: 2159002 - RNA, 23 nt, Human
gccaucugguuaggauggcagga

SEQ ID NO: 2159003 - RNA, 17 nt, Human
gccaaggcucuguuuau

SEQ ID NO: 2159004 - RNA, 13 nt, Human
gccagaggcaccu

SEQ ID NO: 2159005 - RNA, 19 nt, Human
gccagcugaugacucaaga

SEQ ID NO: 2159006 - RNA, 18 nt, Human
gccagcugaugacucaag

SEQ ID NO: 2159007 - RNA, 14 nt, Human
gccagcugaugacu

SEQ ID NO: 2159008 - RNA, 17 nt, Human
gccagcugaugacucaa

SEQ ID NO: 2159009 - RNA, 16 nt, Human
gccagcugaugacuca

SEQ ID NO: 2159010 - RNA, 23 nt, Human
gccuuaucuccaagaccagagau

SEQ ID NO: 2159011 - RNA, 16 nt, Human
gccuggguccagggga

SEQ ID NO: 2159012 - RNA, 16 nt, Human
gccuuuggcagaguuc

SEQ ID NO: 2159013 - RNA, 20 nt, Human
gcuacaguuuugugaaucuu

SEQ ID NO: 2159014 - RNA, 15 nt, Human
gcuacaggggccaga

SEQ ID NO: 2159015 - RNA, 15 nt, Human
gcuaaagcccagaga

SEQ ID NO: 2159016 - RNA, 18 nt, Human
gcgggcaggggaggguca

SEQ ID NO: 2159017 - RNA, 23 nt, Human
gcgggcgcacugccucucacagc

SEQ ID NO: 2159018 - RNA, 17 nt, Human
gcgggcgcacugccucu

SEQ ID NO: 2159019 - RNA, 22 nt, Human
gcgggcgcacugccucucacag

SEQ ID NO: 2159020 - RNA, 18 nt, Human
gcggugggcacccacccu

SEQ ID NO: 2159021 - RNA, 19 nt, Human
gcgguuccucguucucccu

SEQ ID NO: 2159022 - RNA, 17 nt, Human
gcgucgcccucccaggc

SEQ ID NO: 2159023 - RNA, 19 nt, Human
gcgccgcaaaccacacugg

SEQ ID NO: 2159024 - RNA, 21 nt, Human
gcgccgcaaaccacacuggac

SEQ ID NO: 2159025 - RNA, 18 nt, Human
gcgacacugggaggccag

SEQ ID NO: 2159026 - RNA, 19 nt, Human
gccgcaccauugaacugua

SEQ ID NO: 2159027 - RNA, 15 nt, Human
gccguaguagauguu

SEQ ID NO: 2159028 - RNA, 22 nt, Human
gccguaguagauguucuacuuu

SEQ ID NO: 2159029 - RNA, 15 nt, Human
gccgguggugcaggu

SEQ ID NO: 2159030 - RNA, 14 nt, Human
gccucccacugggg

SEQ ID NO: 2159031 - RNA, 13 nt, Human
gccucccacuggg

SEQ ID NO: 2159032 - RNA, 15 nt, Human
gccucccuggugaga

SEQ ID NO: 2159033 - RNA, 13 nt, Human
gccucccugguga

SEQ ID NO: 2159034 - RNA, 18 nt, Human
uuuuuaaaaacuaaaaaa

SEQ ID NO: 2159035 - RNA, 11 nt, Human
uuuuuaaaagu

SEQ ID NO: 2159036 - RNA, 15 nt, Human
uuuuuaaagcuacaa

SEQ ID NO: 2159037 - RNA, 22 nt, Human
uuuugguuaagcuuugacacug

SEQ ID NO: 2159038 - RNA, 21 nt, Human
uuuugguuaagcuuugacacu

SEQ ID NO: 2159039 - RNA, 19 nt, Human
uuuugguuaagcuuugaca

SEQ ID NO: 2159040 - RNA, 18 nt, Human
uuuuguaacuuccaugug

SEQ ID NO: 2159041 - RNA, 15 nt, Human
uuuuguaacaaauga

SEQ ID NO: 2159042 - RNA, 14 nt, Human
uuuuguaauuuaaa

SEQ ID NO: 2159043 - RNA, 21 nt, Human
uuuuugaaaaagaaaacacuu

SEQ ID NO: 2159044 - RNA, 15 nt, Human
uuuuuccuucucugg

SEQ ID NO: 2159045 - RNA, 20 nt, Human
uuugaaucuauuuaucuuca

SEQ ID NO: 2159046 - RNA, 22 nt, Human
uuuuaaaaguuacuccuuuuag

SEQ ID NO: 2159047 - RNA, 18 nt, Human
uuuuaaaaguaaauguac

SEQ ID NO: 2159048 - RNA, 14 nt, Human
uuuguucuuuuuau

SEQ ID NO: 2159049 - RNA, 13 nt, Human
uuuuaauuaaaua

SEQ ID NO: 2159050 - RNA, 21 nt, Human
uuuuaaagaccugacaccuuu

SEQ ID NO: 2159051 - RNA, 15 nt, Human
uuucugaagcuuuac

SEQ ID NO: 2159052 - RNA, 18 nt, Human
uuucugaagcuuuaccag

SEQ ID NO: 2159053 - RNA, 19 nt, Human
uuucuacuuguuauaaacu

SEQ ID NO: 2159054 - RNA, 14 nt, Human
uuaccaaucauauu

SEQ ID NO: 2159055 - RNA, 16 nt, Human
uuucuuaaacaaaugu

SEQ ID NO: 2159056 - RNA, 23 nt, Human
uuucuuaucacaaaaaagaaaau

SEQ ID NO: 2159057 - RNA, 23 nt, Human
uuucuucaccucugcuacucaag

SEQ ID NO: 2159058 - RNA, 13 nt, Human
guauacuuccuua

SEQ ID NO: 2159059 - RNA, 19 nt, Human
guauacuuccuuaugcuuc

SEQ ID NO: 2159060 - RNA, 15 nt, Human
guauauagcccagcc

SEQ ID NO: 2159061 - RNA, 21 nt, Human
guauauauuuuuuaaaaaucu

SEQ ID NO: 2159062 - RNA, 18 nt, Human
guaucuacuuuaauaaau

SEQ ID NO: 2159063 - RNA, 19 nt, Human
guauguuuuuguguauuug

SEQ ID NO: 2159064 - RNA, 23 nt, Human
guauguuuuuguguauuuguuaa

SEQ ID NO: 2159065 - RNA, 22 nt, Human
guagucagaauuagcugcuucu

SEQ ID NO: 2159066 - RNA, 21 nt, Human
guagucagaauuagcugcuuc

SEQ ID NO: 2159067 - RNA, 14 nt, Human
guagcauuuacugu

SEQ ID NO: 2159068 - RNA, 20 nt, Human
guagcauuuacugugucuuu

SEQ ID NO: 2159069 - RNA, 15 nt, Human
guagcaguagaugca

SEQ ID NO: 2159070 - RNA, 16 nt, Human
guagcacauguaugcu

SEQ ID NO: 2159071 - RNA, 16 nt, Human
guagauguucuacuuu

SEQ ID NO: 2159072 - RNA, 18 nt, Human
guccaggggaggccuucc

SEQ ID NO: 2159073 - RNA, 13 nt, Human
guccacagggcac

SEQ ID NO: 2159074 - RNA, 19 nt, Human
guauuuuauaauucuggga

SEQ ID NO: 2159075 - RNA, 21 nt, Human
guauuuuaguaagagauuccu

SEQ ID NO: 2159076 - RNA, 13 nt, Human
guauuuugaaaau

SEQ ID NO: 2159077 - RNA, 20 nt, Human
guauuuucuucaccucugcu

SEQ ID NO: 2159078 - RNA, 13 nt, Human
gucugccagggcc

SEQ ID NO: 2159079 - RNA, 12 nt, Human
gucugccagggc

SEQ ID NO: 2159080 - RNA, 11 nt, Human
gucugccaggg

SEQ ID NO: 2159081 - RNA, 20 nt, Human
gucuguguuuuuuuggcagu

SEQ ID NO: 2159082 - RNA, 23 nt, Human
gucuguuuuguaaaguccccaga

SEQ ID NO: 2159083 - RNA, 15 nt, Human
gucuguuuuguaaag

SEQ ID NO: 2159084 - RNA, 14 nt, Human
gucuguuuuguaaa

SEQ ID NO: 2159085 - RNA, 12 nt, Human
gugcagccagag

SEQ ID NO: 2159086 - RNA, 14 nt, Human
gugcagccagaggc

SEQ ID NO: 2159087 - RNA, 13 nt, Human
gugcagccagagg

SEQ ID NO: 2159088 - RNA, 17 nt, Human
gugccauuuugcauuuu

SEQ ID NO: 2159089 - RNA, 13 nt, Human
gugaucaaagcca

SEQ ID NO: 2159090 - RNA, 22 nt, Human
gugacagagcaagacucugucu

SEQ ID NO: 2159091 - RNA, 19 nt, Human
gugaacaagcaaacccaga

SEQ ID NO: 2159092 - RNA, 14 nt, Human
gugaauuguuugaa

SEQ ID NO: 2159093 - RNA, 17 nt, Human
gugaauuguuugaaccu

SEQ ID NO: 2159094 - RNA, 17 nt, Human
gugucgagucaaaaugu

SEQ ID NO: 2159095 - RNA, 17 nt, Human
gugucugaguggcuuca

SEQ ID NO: 2159096 - RNA, 15 nt, Human
gugugcucugcuuca

SEQ ID NO: 2159097 - RNA, 21 nt, Human
guuaacuauuuuauuuucuaa

SEQ ID NO: 2159098 - RNA, 23 nt, Human
guguucaaggccauccuucccug

SEQ ID NO: 2159099 - RNA, 15 nt, Human
guguuuuuaacucaa

SEQ ID NO: 2159100 - RNA, 13 nt, Human
guguacucccagg

SEQ ID NO: 2159101 - RNA, 21 nt, Human
guguacucccagggcuuacgg

SEQ ID NO: 2159102 - RNA, 23 nt, Human
gugggcgggcaggggagggucag

SEQ ID NO: 2159103 - RNA, 17 nt, Human
guggggaagugaucuuu

SEQ ID NO: 2159104 - RNA, 16 nt, Human
guggggaggaaauaga

SEQ ID NO: 2159105 - RNA, 17 nt, Human
guggcuucacuccugcu

SEQ ID NO: 2159106 - RNA, 16 nt, Human
guggcuucacuccugc

SEQ ID NO: 2159107 - RNA, 20 nt, Human
gugggcacccacccugggac

SEQ ID NO: 2159108 - RNA, 16 nt, Human
gugggcacccacccug

SEQ ID NO: 2159109 - RNA, 23 nt, Human
guggcuucacuccugcuguaaau

SEQ ID NO: 2159110 - RNA, 20 nt, Human
guggcuauuaaaacucuuuu

SEQ ID NO: 2159111 - RNA, 19 nt, Human
guggcuauuaaaacucuuu

SEQ ID NO: 2159112 - RNA, 17 nt, Human
guggcuauuaaaacucu

SEQ ID NO: 2159113 - RNA, 20 nt, Human
guucgagaccagccuggcca

SEQ ID NO: 2159114 - RNA, 16 nt, Human
guucgagaccagccug

SEQ ID NO: 2159115 - RNA, 18 nt, Human
guucgacagugaauauuc

SEQ ID NO: 2159116 - RNA, 16 nt, Human
guucucuuaaaaggua

SEQ ID NO: 2159117 - RNA, 17 nt, Human
guucugagagaaaaaga

SEQ ID NO: 2159118 - RNA, 18 nt, Human
guugaaccuauuucucuu

SEQ ID NO: 2159119 - RNA, 16 nt, Human
guugaaccuauuucuc

SEQ ID NO: 2159120 - RNA, 15 nt, Human
guugaaccuauuucu

SEQ ID NO: 2159121 - RNA, 13 nt, Human
guuacuauaugcc

SEQ ID NO: 2159122 - RNA, 19 nt, Human
guuauccauuuaaaaaugg

SEQ ID NO: 2159123 - RNA, 18 nt, Human
guucaaggccauccuucc

SEQ ID NO: 2159124 - RNA, 19 nt, Human
guucaaggccauccuuccc

SEQ ID NO: 2159125 - RNA, 14 nt, Human
guucagaagaaauu

SEQ ID NO: 2159126 - RNA, 13 nt, Human
guucacucuucuc

SEQ ID NO: 2159127 - RNA, 20 nt, Human
guucacucuucucagccacu

SEQ ID NO: 2159128 - RNA, 12 nt, Human
guucaugacaau

SEQ ID NO: 2159129 - RNA, 20 nt, Human
guucauccuauucuuucgaa

SEQ ID NO: 2159130 - RNA, 23 nt, Human
guucagccacccugaggccucug

SEQ ID NO: 2159131 - RNA, 18 nt, Human
guuccucguucucccugg

SEQ ID NO: 2159132 - RNA, 20 nt, Human
guuccucguucucccuggga

SEQ ID NO: 2159133 - RNA, 17 nt, Human
guuccucguucucccug

SEQ ID NO: 2159134 - RNA, 14 nt, Human
guuccucguucucc

SEQ ID NO: 2159135 - RNA, 19 nt, Human
guuucuguuuaacuucuua

SEQ ID NO: 2159136 - RNA, 14 nt, Human
guuucuguuuaacu

SEQ ID NO: 2159137 - RNA, 16 nt, Human
guuugguccagccugg

SEQ ID NO: 2159138 - RNA, 18 nt, Human
guuuguggcuauuaaaac

SEQ ID NO: 2159139 - RNA, 15 nt, Human
guuuguggcuauuaa

SEQ ID NO: 2159140 - RNA, 18 nt, Human
guuuguuuuccuuuuauu

SEQ ID NO: 2159141 - RNA, 13 nt, Human
guuuguuuuccuu

SEQ ID NO: 2159142 - RNA, 17 nt, Human
guuuuguaaagucccca

SEQ ID NO: 2159143 - RNA, 13 nt, Human
guuuuguaaaguc

SEQ ID NO: 2159144 - RNA, 19 nt, Human
guuuucagcauugauauuu

SEQ ID NO: 2159145 - RNA, 20 nt, Human
guuuucccuugaggaaacaa

SEQ ID NO: 2159146 - RNA, 23 nt, Human
guugugacaacuuccugagggau

SEQ ID NO: 2159147 - RNA, 18 nt, Human
guugugccucccugguga

SEQ ID NO: 2159148 - RNA, 16 nt, Human
guugugccucccuggu

SEQ ID NO: 2159149 - RNA, 12 nt, Human
guugucccugca

SEQ ID NO: 2159150 - RNA, 14 nt, Human
guugucaccuucac

SEQ ID NO: 2159151 - RNA, 21 nt, Human
uaaaacagguagaauuaucua

SEQ ID NO: 2159152 - RNA, 23 nt, Human
uaaaacaccuaaauaaccaaucu

SEQ ID NO: 2159153 - RNA, 11 nt, Human
uaaaagcacac

SEQ ID NO: 2159154 - RNA, 18 nt, Human
uaaaacauuuucacacaa

SEQ ID NO: 2159155 - RNA, 15 nt, Human
uaaaacauuuucaca

SEQ ID NO: 2159156 - RNA, 17 nt, Human
uaaaacauuuucacaca

SEQ ID NO: 2159157 - RNA, 22 nt, Human
uaaaacagguagaauuaucuaa

SEQ ID NO: 2159158 - RNA, 18 nt, Human
uaaagaaaaucucuguga

SEQ ID NO: 2159159 - RNA, 14 nt, Human
uaaaguuauucuug

SEQ ID NO: 2159160 - RNA, 13 nt, Human
uaaaguuauucuu

SEQ ID NO: 2159161 - RNA, 19 nt, Human
uaaaguuauucuugaaguc

SEQ ID NO: 2159162 - RNA, 16 nt, Human
uaaaccaaaaacugaa

SEQ ID NO: 2159163 - RNA, 21 nt, Human
uaaauguaccuucagaauaag

SEQ ID NO: 2159164 - RNA, 22 nt, Human
uaaauggaaacugaaacuacug

SEQ ID NO: 2159165 - RNA, 11 nt, Human
uaaauggcugc

SEQ ID NO: 2159166 - RNA, 18 nt, Human
uaaauggaaacugaaacu

SEQ ID NO: 2159167 - RNA, 16 nt, Human
uaaauggaaacugaaa

SEQ ID NO: 2159168 - RNA, 17 nt, Human
uaaauuuggcuucuguu

SEQ ID NO: 2159169 - RNA, 14 nt, Human
uaaauuuggcuucu

SEQ ID NO: 2159170 - RNA, 14 nt, Human
uaacaccagcauug

SEQ ID NO: 2159171 - RNA, 19 nt, Human
uaacaccugauuaacugag

SEQ ID NO: 2159172 - RNA, 18 nt, Human
uaacaccugauuaacuga

SEQ ID NO: 2159173 - RNA, 22 nt, Human
uaaccaugugaaaaggcaaaaa

SEQ ID NO: 2159174 - RNA, 17 nt, Human
uaaccauggugcuuguu

SEQ ID NO: 2159175 - RNA, 22 nt, Human
uaacucaauauuuuccaugaaa

SEQ ID NO: 2159176 - RNA, 14 nt, Human
uaacucaauauuuu

SEQ ID NO: 2159177 - RNA, 19 nt, Human
uaacuauuuuauuuucuaa

SEQ ID NO: 2159178 - RNA, 17 nt, Human
uaacuccucaauuccaa

SEQ ID NO: 2159179 - RNA, 18 nt, Human
uaacccccacuggacuga

SEQ ID NO: 2159180 - RNA, 18 nt, Human
uaaccccgucaacaaauc

SEQ ID NO: 2159181 - RNA, 17 nt, Human
uaaccccgucaacaaau

SEQ ID NO: 2159182 - RNA, 16 nt, Human
uaaccccgucaacaaa

SEQ ID NO: 2159183 - RNA, 23 nt, Human
uaauguuguuccuuuugaaagaa

SEQ ID NO: 2159184 - RNA, 16 nt, Human
uaauuagcaucucagg

SEQ ID NO: 2159185 - RNA, 18 nt, Human
uaaggucauuaccacagg

SEQ ID NO: 2159186 - RNA, 12 nt, Human
uaauaaauauuu

SEQ ID NO: 2159187 - RNA, 14 nt, Human
uauaaacacuauau

SEQ ID NO: 2159188 - RNA, 17 nt, Human
uaguugaaccuauuucu

SEQ ID NO: 2159189 - RNA, 19 nt, Human
uaguugaaacgcagacacu

SEQ ID NO: 2159190 - RNA, 23 nt, Human
uaguagauguucuacuuuguucu

SEQ ID NO: 2159191 - RNA, 18 nt, Human
uagcauauaauucuauau

SEQ ID NO: 2159192 - RNA, 20 nt, Human
uagauacuuugcuagccggc

SEQ ID NO: 2159193 - RNA, 16 nt, Human
uagccggccacuuugg

SEQ ID NO: 2159194 - RNA, 15 nt, Human
uagaauuaucuaauu

SEQ ID NO: 2159195 - RNA, 16 nt, Human
uagaauuaucuaauuu

SEQ ID NO: 2159196 - RNA, 19 nt, Human
uagaauuaucuaauuuaua

SEQ ID NO: 2159197 - RNA, 21 nt, Human
uagaauuaucuaauuuauaaa

SEQ ID NO: 2159198 - RNA, 22 nt, Human
uagaauuaucuaauuuauaaaa

SEQ ID NO: 2159199 - RNA, 23 nt, Human
uagaauuaucuaauuuauaaaaa

SEQ ID NO: 2159200 - RNA, 17 nt, Human
uagaauaauaaauauuu

SEQ ID NO: 2159201 - RNA, 16 nt, Human
uagaauaauaaauauu

SEQ ID NO: 2159202 - RNA, 14 nt, Human
uacuuguuauaaac

SEQ ID NO: 2159203 - RNA, 14 nt, Human
uagacuaaaugaaa

SEQ ID NO: 2159204 - RNA, 16 nt, Human
uagaccugucuccugg

SEQ ID NO: 2159205 - RNA, 14 nt, Human
uagaccugucuccu

SEQ ID NO: 2159206 - RNA, 13 nt, Human
uagacuaaaugaa

SEQ ID NO: 2159207 - RNA, 16 nt, Human
uaccuucauaugcagu

SEQ ID NO: 2159208 - RNA, 18 nt, Human
uacuguggaaaagaaaca

SEQ ID NO: 2159209 - RNA, 17 nt, Human
uacucauuuaaaguauu

SEQ ID NO: 2159210 - RNA, 23 nt, Human
uacucccagggcuuacggcccug

SEQ ID NO: 2159211 - RNA, 20 nt, Human
uacugcaccauuuaaaaaca

SEQ ID NO: 2159212 - RNA, 17 nt, Human
uacaaacaugugguuaa

SEQ ID NO: 2159213 - RNA, 19 nt, Human
uaauuccuuuccagguauu

SEQ ID NO: 2159214 - RNA, 17 nt, Human
uacaacacaaagagaaa

SEQ ID NO: 2159215 - RNA, 15 nt, Human
uacaacacaaagaga

SEQ ID NO: 2159216 - RNA, 23 nt, Human
uacaacccgguucacucuucuca

SEQ ID NO: 2159217 - RNA, 13 nt, Human
uacacaauguguc

SEQ ID NO: 2159218 - RNA, 16 nt, Human
uacacaaugugucuuu

SEQ ID NO: 2159219 - RNA, 22 nt, Human
uacacagugugaauaaagugcu

SEQ ID NO: 2159220 - RNA, 11 nt, Human
uacacagugug

SEQ ID NO: 2159221 - RNA, 18 nt, Human
ugaaucuauuuaucuuca

SEQ ID NO: 2159222 - RNA, 16 nt, Human
ugaaucuauuuaagua

SEQ ID NO: 2159223 - RNA, 14 nt, Human
ugaaucuauuuaag

SEQ ID NO: 2159224 - RNA, 15 nt, Human
ugaaugaaccuucug

SEQ ID NO: 2159225 - RNA, 16 nt, Human
ugaaugaaccuucugg

SEQ ID NO: 2159226 - RNA, 23 nt, Human
ugaaugcagucuguccaggcucg

SEQ ID NO: 2159227 - RNA, 22 nt, Human
ugaaugcagucuguccaggcuc

SEQ ID NO: 2159228 - RNA, 17 nt, Human
ugaagaguccucugaau

SEQ ID NO: 2159229 - RNA, 23 nt, Human
ugaagaguccucugaaugaaccu

SEQ ID NO: 2159230 - RNA, 18 nt, Human
ugaaggccucgcaggaag

SEQ ID NO: 2159231 - RNA, 16 nt, Human
ugaaggccucgcagga

SEQ ID NO: 2159232 - RNA, 22 nt, Human
ugacagagcaagacucugucua

SEQ ID NO: 2159233 - RNA, 18 nt, Human
ugacaugcacucagcucu

SEQ ID NO: 2159234 - RNA, 15 nt, Human
ugaauuguuugaacc

SEQ ID NO: 2159235 - RNA, 15 nt, Human
ugacaacuacagaaa

SEQ ID NO: 2159236 - RNA, 22 nt, Human
ugacaacuacagaaaaaccaga

SEQ ID NO: 2159237 - RNA, 16 nt, Human
ugacaacuacagaaaa

SEQ ID NO: 2159238 - RNA, 17 nt, Human
ugacuuucauuggaaau

SEQ ID NO: 2159239 - RNA, 15 nt, Human
ugacuuucauuggaa

SEQ ID NO: 2159240 - RNA, 23 nt, Human
ugacuaauucuugcauauuuugu

SEQ ID NO: 2159241 - RNA, 22 nt, Human
ugacuaauucuugcauauuuug

SEQ ID NO: 2159242 - RNA, 17 nt, Human
ugacuaauucuugcaua

SEQ ID NO: 2159243 - RNA, 15 nt, Human
ugacuaauucuugca

SEQ ID NO: 2159244 - RNA, 14 nt, Human
ugagaaaaaaagaa

SEQ ID NO: 2159245 - RNA, 11 nt, Human
ugacuuugucu

SEQ ID NO: 2159246 - RNA, 17 nt, Human
ugagagggccgggcaga

SEQ ID NO: 2159247 - RNA, 14 nt, Human
ugagagggccgggc

SEQ ID NO: 2159248 - RNA, 18 nt, Human
ugaggucauagcagugcu

SEQ ID NO: 2159249 - RNA, 20 nt, Human
ugagcugugcacaaaguggc

SEQ ID NO: 2159250 - RNA, 12 nt, Human
ugagcugucacu

SEQ ID NO: 2159251 - RNA, 17 nt, Human
ugagcugcagaaacgaa

SEQ ID NO: 2159252 - RNA, 15 nt, Human
ugagcugcagaaacg

SEQ ID NO: 2159253 - RNA, 14 nt, Human
ugagcugcagaaac

SEQ ID NO: 2159254 - RNA, 16 nt, Human
ugagcucuuugcacua

SEQ ID NO: 2159255 - RNA, 15 nt, Human
ugagcucuuugcacu

SEQ ID NO: 2159256 - RNA, 18 nt, Human
ucugcaccguacugugga

SEQ ID NO: 2159257 - RNA, 14 nt, Human
ucugucuaaaaaac

SEQ ID NO: 2159258 - RNA, 15 nt, Human
ucugucuaaaaaaca

SEQ ID NO: 2159259 - RNA, 13 nt, Human
ucuggaccugccc

SEQ ID NO: 2159260 - RNA, 12 nt, Human
ucuggaccugcc

SEQ ID NO: 2159261 - RNA, 16 nt, Human
ucuuuucauugaacag

SEQ ID NO: 2159262 - RNA, 22 nt, Human
ucuuguggcuuugcaaccauuu

SEQ ID NO: 2159263 - RNA, 21 nt, Human
ucuuaucacaaaaaagaaaau

SEQ ID NO: 2159264 - RNA, 23 nt, Human
ucuuaucaagaguugugacaacu

SEQ ID NO: 2159265 - RNA, 20 nt, Human
ucuucauuugaaugucuucu

SEQ ID NO: 2159266 - RNA, 21 nt, Human
ucuucuuuuagcaguaaaaua

SEQ ID NO: 2159267 - RNA, 23 nt, Human
ucaggaggaaggcuuacacccac

SEQ ID NO: 2159268 - RNA, 16 nt, Human
ucaggaggaaggcuua

SEQ ID NO: 2159269 - RNA, 18 nt, Human
ucaggaccuccaagccac

SEQ ID NO: 2159270 - RNA, 20 nt, Human
ucaggaccuccaagccacug

SEQ ID NO: 2159271 - RNA, 13 nt, Human
ucaggacacuaau

SEQ ID NO: 2159272 - RNA, 17 nt, Human
ucaguuaaguuuuuccc

SEQ ID NO: 2159273 - RNA, 18 nt, Human
ucaguuaaguuuuucccu

SEQ ID NO: 2159274 - RNA, 11 nt, Human
ucagguggcca

SEQ ID NO: 2159275 - RNA, 13 nt, Human
ucagguggccaug

SEQ ID NO: 2159276 - RNA, 16 nt, Human
ucauacuuaagcaaaa

SEQ ID NO: 2159277 - RNA, 19 nt, Human
ucauagaaagugccagaaa

SEQ ID NO: 2159278 - RNA, 17 nt, Human
ucaucaacccuaaaaag

SEQ ID NO: 2159279 - RNA, 14 nt, Human
ucaucauuuuuccu

SEQ ID NO: 2159280 - RNA, 14 nt, Human
ucaucuuugugaag

SEQ ID NO: 2159281 - RNA, 22 nt, Human
ucccacugggguccagggagca

SEQ ID NO: 2159282 - RNA, 14 nt, Human
ucccagggcuuacg

SEQ ID NO: 2159283 - RNA, 21 nt, Human
uccaugugaggguuuucagca

SEQ ID NO: 2159284 - RNA, 22 nt, Human
ucauguauguucagaagaaauu

SEQ ID NO: 2159285 - RNA, 19 nt, Human
ucauguauguucagaagaa

SEQ ID NO: 2159286 - RNA, 21 nt, Human
ucauguauguucagaagaaau

SEQ ID NO: 2159287 - RNA, 12 nt, Human
uccaagagcuga

SEQ ID NO: 2159288 - RNA, 23 nt, Human
uccacacucaccucuaaaacagu

SEQ ID NO: 2159289 - RNA, 17 nt, Human
uccaagccacugagcaa

SEQ ID NO: 2159290 - RNA, 15 nt, Human
uccaagccagcggga

SEQ ID NO: 2159291 - RNA, 18 nt, Human
uccacuuucagugaaagc

SEQ ID NO: 2159292 - RNA, 14 nt, Human
uccuauuuagaugg

SEQ ID NO: 2159293 - RNA, 19 nt, Human
uccuauuuugcauaauaaa

SEQ ID NO: 2159294 - RNA, 21 nt, Human
ucgccagcugaugacucaaga

SEQ ID NO: 2159295 - RNA, 20 nt, Human
ucgccagcugaugacucaag

SEQ ID NO: 2159296 - RNA, 19 nt, Human
ucgccagcugaugacucaa

SEQ ID NO: 2159297 - RNA, 18 nt, Human
ucgccagcugaugacuca

SEQ ID NO: 2159298 - RNA, 16 nt, Human
ucgccagcugaugacu

SEQ ID NO: 2159299 - RNA, 15 nt, Human
ucgauucauauugaa

SEQ ID NO: 2159300 - RNA, 17 nt, Human
ucgauucauauugaaua

SEQ ID NO: 2159301 - RNA, 20 nt, Human
ucgcaggaagacccaacaca

SEQ ID NO: 2159302 - RNA, 18 nt, Human
uccuuuguacuuugugcu

SEQ ID NO: 2159303 - RNA, 13 nt, Human
uccuuuguacuuu

SEQ ID NO: 2159304 - RNA, 12 nt, Human
ucucacaaacau

SEQ ID NO: 2159305 - RNA, 12 nt, Human
ucguccagggag

SEQ ID NO: 2159306 - RNA, 23 nt, Human
ucuaaugauggcccauucuacuu

SEQ ID NO: 2159307 - RNA, 22 nt, Human
ucuaaugauggcccauucuacu

SEQ ID NO: 2159308 - RNA, 16 nt, Human
ucuaaugauggcccau

SEQ ID NO: 2159309 - RNA, 13 nt, Human
ucuaauuuauaaa

SEQ ID NO: 2159310 - RNA, 14 nt, Human
ucuaauuuauaaaa

SEQ ID NO: 2159311 - RNA, 22 nt, Human
ucuacucauuuaaaguauuuua

SEQ ID NO: 2159312 - RNA, 20 nt, Human
ucuaggccuccuggcccagg

SEQ ID NO: 2159313 - RNA, 13 nt, Human
uggaaccaggcuu

SEQ ID NO: 2159314 - RNA, 12 nt, Human
uggacagaagaa

SEQ ID NO: 2159315 - RNA, 21 nt, Human
uggacuagagggaccucuccc

SEQ ID NO: 2159316 - RNA, 22 nt, Human
ugcuuugaaagccccagaaauc

SEQ ID NO: 2159317 - RNA, 23 nt, Human
ugcuuugaaagccccagaaauca

SEQ ID NO: 2159318 - RNA, 23 nt, Human
uggaaagacagcuucucauccug

SEQ ID NO: 2159319 - RNA, 15 nt, Human
uggaaagcaaagggc

SEQ ID NO: 2159320 - RNA, 12 nt, Human
uggaaagcaaag

SEQ ID NO: 2159321 - RNA, 19 nt, Human
uggaaagacagcuucucau

SEQ ID NO: 2159322 - RNA, 23 nt, Human
uggauuucccauccccuguggga

SEQ ID NO: 2159323 - RNA, 19 nt, Human
uggaggagcucaggacacu

SEQ ID NO: 2159324 - RNA, 20 nt, Human
uggcaggacgugggcugggc

SEQ ID NO: 2159325 - RNA, 13 nt, Human
uggcaggacagga

SEQ ID NO: 2159326 - RNA, 19 nt, Human
ugguauucgcuugagaaaa

SEQ ID NO: 2159327 - RNA, 21 nt, Human
ugggggcggggugggaaagau

SEQ ID NO: 2159328 - RNA, 23 nt, Human
ugggaccuauaacugcccagcgg

SEQ ID NO: 2159329 - RNA, 19 nt, Human
ugggaccuaggggcgccgc

SEQ ID NO: 2159330 - RNA, 24 nt, Human
ugggaccuccaccguugguguuca

SEQ ID NO: 2159331 - RNA, 16 nt, Human
uggcccauucuacuug

SEQ ID NO: 2159332 - RNA, 15 nt, Human
uggcccauucuacuu

SEQ ID NO: 2159333 - RNA, 22 nt, Human
uggcccauucuacuugcucugg

SEQ ID NO: 2159334 - RNA, 21 nt, Human
uggcccauucuacuugcucug

SEQ ID NO: 2159335 - RNA, 20 nt, Human
uggcccauucuacuugcucu

SEQ ID NO: 2159336 - RNA, 17 nt, Human
uggcccauucuacuugc

SEQ ID NO: 2159337 - RNA, 23 nt, Human
uggcccauucuacuugcucugga

SEQ ID NO: 2159338 - RNA, 18 nt, Human
uggcuucucugaggaagc

SEQ ID NO: 2159339 - RNA, 16 nt, Human
uggcuucucugaggaa

SEQ ID NO: 2159340 - RNA, 15 nt, Human
uggcuucucugagga

SEQ ID NO: 2159341 - RNA, 19 nt, Human
uggcuucuguugucaccuu

SEQ ID NO: 2159342 - RNA, 14 nt, Human
uggcuuuaaugaau

SEQ ID NO: 2159343 - RNA, 24 nt, Human
ugcauauuuuguaacuuccaugug

SEQ ID NO: 2159344 - RNA, 22 nt, Human
ugcacuuucucaugauuuacag

SEQ ID NO: 2159345 - RNA, 15 nt, Human
ugcaggccaggccag

SEQ ID NO: 2159346 - RNA, 17 nt, Human
ugcauauauacauauau

SEQ ID NO: 2159347 - RNA, 16 nt, Human
ugcucagaccagcucu

SEQ ID NO: 2159348 - RNA, 17 nt, Human
ugcucagaccagcucuu

SEQ ID NO: 2159349 - RNA, 21 nt, Human
ugcucagggaaaagcagcucu

SEQ ID NO: 2159350 - RNA, 22 nt, Human
ugcucagggaaaagcagcucuc

SEQ ID NO: 2159351 - RNA, 23 nt, Human
ugcugcgucauuacagggcacag

SEQ ID NO: 2159352 - RNA, 20 nt, Human
ugcugcggagcaagaggagg

SEQ ID NO: 2159353 - RNA, 16 nt, Human
ugcugcggagcaagag

SEQ ID NO: 2159354 - RNA, 15 nt, Human
ugcugcggagcaaga

SEQ ID NO: 2159355 - RNA, 14 nt, Human
ugcugcauacauuc

SEQ ID NO: 2159356 - RNA, 21 nt, Human
ugccucucacagcugaguugu

SEQ ID NO: 2159357 - RNA, 18 nt, Human
ugccucucacagcugagu

SEQ ID NO: 2159358 - RNA, 17 nt, Human
ugccucucacagcugag

SEQ ID NO: 2159359 - RNA, 14 nt, Human
ugccucucacagcu

SEQ ID NO: 2159360 - RNA, 17 nt, Human
ugcuaaagccuuccuau

SEQ ID NO: 2159361 - RNA, 19 nt, Human
uguaaucccagcuacucgg

SEQ ID NO: 2159362 - RNA, 20 nt, Human
uguaaucccagcuacucggg

SEQ ID NO: 2159363 - RNA, 13 nt, Human
uguagcagaaagg

SEQ ID NO: 2159364 - RNA, 15 nt, Human
uguacugggccaugu

SEQ ID NO: 2159365 - RNA, 18 nt, Human
uguagccuuuugacuuuc

SEQ ID NO: 2159366 - RNA, 14 nt, Human
ugucaccuucaccu

SEQ ID NO: 2159367 - RNA, 13 nt, Human
ugucaccuucacc

SEQ ID NO: 2159368 - RNA, 16 nt, Human
uguauuuaaaaaaauc

SEQ ID NO: 2159369 - RNA, 22 nt, Human
uguauuuucuucaccucugcua

SEQ ID NO: 2159370 - RNA, 14 nt, Human
uguccucagguggc

SEQ ID NO: 2159371 - RNA, 19 nt, Human
uguccucagguggccaugc

SEQ ID NO: 2159372 - RNA, 18 nt, Human
uguccucagguggccaug

SEQ ID NO: 2159373 - RNA, 18 nt, Human
ugugaauugagcugcaga

SEQ ID NO: 2159374 - RNA, 22 nt, Human
uguggcuauuaaaacucuuuua

SEQ ID NO: 2159375 - RNA, 22 nt, Human
uuaacuugucaaaaaacaaaaa

SEQ ID NO: 2159376 - RNA, 16 nt, Human
uuaacuugucaaaaaa

SEQ ID NO: 2159377 - RNA, 21 nt, Human
uuaauacaaugaugcuauuug

SEQ ID NO: 2159378 - RNA, 17 nt, Human
uuacacagugugaauaa

SEQ ID NO: 2159379 - RNA, 19 nt, Human
uuacaacccgguucacucu

SEQ ID NO: 2159380 - RNA, 20 nt, Human
uuaauuaaauagcuuuugug

SEQ ID NO: 2159381 - RNA, 19 nt, Human
uuaauuaaauagcuuuugu

SEQ ID NO: 2159382 - RNA, 15 nt, Human
uuaauuaaauagcuu

SEQ ID NO: 2159383 - RNA, 22 nt, Human
uuaaagccacaaccacauacaa

SEQ ID NO: 2159384 - RNA, 20 nt, Human
uuaaacuaaggcccucuuga

SEQ ID NO: 2159385 - RNA, 12 nt, Human
uguuuuuaaaag

SEQ ID NO: 2159386 - RNA, 12 nt, Human
uguuuuuaacuc

SEQ ID NO: 2159387 - RNA, 11 nt, Human
uguuugugugu

SEQ ID NO: 2159388 - RNA, 22 nt, Human
uguuuagaacacugguuuaaag

SEQ ID NO: 2159389 - RNA, 21 nt, Human
uguuuccaguacaccuuucag

SEQ ID NO: 2159390 - RNA, 16 nt, Human
uguuuccugcaggcca

SEQ ID NO: 2159391 - RNA, 18 nt, Human
ugugugugcagacuucag

SEQ ID NO: 2159392 - RNA, 14 nt, Human
uguguuuuuaaaag

SEQ ID NO: 2159393 - RNA, 22 nt, Human
uguguggagcucgcuaaaguca

SEQ ID NO: 2159394 - RNA, 21 nt, Human
uguuagcccaagguuaaaaag

SEQ ID NO: 2159395 - RNA, 15 nt, Human
uguucagaagaaauu

SEQ ID NO: 2159396 - RNA, 22 nt, Human
uguucagaagaaauucugucau

SEQ ID NO: 2159397 - RNA, 14 nt, Human
uguugacaugugcu

SEQ ID NO: 2159398 - RNA, 17 nt, Human
uguucuuuuuauugaau

SEQ ID NO: 2159399 - RNA, 14 nt, Human
uguucuuuuuauug

SEQ ID NO: 2159400 - RNA, 18 nt, Human
uguucugcuguucucuag

SEQ ID NO: 2159401 - RNA, 14 nt, Human
uguucugcuguucu

SEQ ID NO: 2159402 - RNA, 16 nt, Human
uguuuaacuucuuaua

SEQ ID NO: 2159403 - RNA, 19 nt, Human
caaugaugcuauuugcaau

SEQ ID NO: 2159404 - RNA, 18 nt, Human
caaugaugcuauuugcaa

SEQ ID NO: 2159405 - RNA, 17 nt, Human
caaugaugcuauuugca

SEQ ID NO: 2159406 - RNA, 13 nt, Human
caaugaugcuauu

SEQ ID NO: 2159407 - RNA, 22 nt, Human
caaugccaaaaaaagacagggc

SEQ ID NO: 2159408 - RNA, 20 nt, Human
cacaaagagaaaaagaaaug

SEQ ID NO: 2159409 - RNA, 22 nt, Human
cacaaagaugggugaaggcugg

SEQ ID NO: 2159410 - RNA, 18 nt, Human
cacaaagagaaaaagaaa

SEQ ID NO: 2159411 - RNA, 13 nt, Human
cacaaaaaagaag

SEQ ID NO: 2159412 - RNA, 12 nt, Human
cacaaaaaagaa

SEQ ID NO: 2159413 - RNA, 18 nt, Human
cacagacucaaaugcuca

SEQ ID NO: 2159414 - RNA, 14 nt, Human
cacagacucauauu

SEQ ID NO: 2159415 - RNA, 23 nt, Human
cacagacuguugucccugcacuc

SEQ ID NO: 2159416 - RNA, 22 nt, Human
cacagacuguugucccugcacu

SEQ ID NO: 2159417 - RNA, 20 nt, Human
cacacuggacuccggcccuc

SEQ ID NO: 2159418 - RNA, 19 nt, Human
cacacuggacuccggcccu

SEQ ID NO: 2159419 - RNA, 13 nt, Human
cacacuggacucc

SEQ ID NO: 2159420 - RNA, 14 nt, Human
cacacucauccccu

SEQ ID NO: 2159421 - RNA, 22 nt, Human
cacacagacuguugucccugca

SEQ ID NO: 2159422 - RNA, 15 nt, Human
cacacagacuguugu

SEQ ID NO: 2159423 - RNA, 20 nt, Human
cacacagacucauauuacug

SEQ ID NO: 2159424 - RNA, 14 nt, Human
cacaaccugaaccu

SEQ ID NO: 2159425 - RNA, 22 nt, Human
cacaccaggcuugccugcaggc

SEQ ID NO: 2159426 - RNA, 21 nt, Human
cacaccaggcuugccugcagg

SEQ ID NO: 2159427 - RNA, 22 nt, Human
cacaccuguaaucccagcacuu

SEQ ID NO: 2159428 - RNA, 22 nt, Human
cacauacaacacaaagagaaaa

SEQ ID NO: 2159429 - RNA, 13 nt, Human
cacauacaacaca

SEQ ID NO: 2159430 - RNA, 15 nt, Human
caccacgucacuuca

SEQ ID NO: 2159431 - RNA, 22 nt, Human
caccacucaaaggccagaccug

SEQ ID NO: 2159432 - RNA, 18 nt, Human
caccacucaaaggccaga

SEQ ID NO: 2159433 - RNA, 18 nt, Human
cacauggcuauguuuuag

SEQ ID NO: 2159434 - RNA, 17 nt, Human
cacauuagacuauccau

SEQ ID NO: 2159435 - RNA, 23 nt, Human
cacauuaagccuuccacacucac

SEQ ID NO: 2159436 - RNA, 16 nt, Human
caaggaagccacagcu

SEQ ID NO: 2159437 - RNA, 21 nt, Human
caagccccugcuccagaagau

SEQ ID NO: 2159438 - RNA, 18 nt, Human
caagcccccccuuccacu

SEQ ID NO: 2159439 - RNA, 16 nt, Human
caaccugaaccuagga

SEQ ID NO: 2159440 - RNA, 13 nt, Human
caaccugaaccua

SEQ ID NO: 2159441 - RNA, 12 nt, Human
caaccugaaccu

SEQ ID NO: 2159442 - RNA, 23 nt, Human
caacccuucuccucuuguaaaua

SEQ ID NO: 2159443 - RNA, 21 nt, Human
caacccuucuccucuuguaaa

SEQ ID NO: 2159444 - RNA, 20 nt, Human
caacccuucuccucuuguaa

SEQ ID NO: 2159445 - RNA, 10 nt, Human
caacccuucu

SEQ ID NO: 2159446 - RNA, 15 nt, Human
caacuuaacaugaaa

SEQ ID NO: 2159447 - RNA, 23 nt, Human
caacauguauaauauuuuuaauu

SEQ ID NO: 2159448 - RNA, 19 nt, Human
caacauguauaauauuuuu

SEQ ID NO: 2159449 - RNA, 18 nt, Human
caacauguauaauauuuu

SEQ ID NO: 2159450 - RNA, 17 nt, Human
caacauguauaauauuu

SEQ ID NO: 2159451 - RNA, 14 nt, Human
caacauucuuugca

SEQ ID NO: 2159452 - RNA, 13 nt, Human
caacauguauaau

SEQ ID NO: 2159453 - RNA, 22 nt, Human
caaccacauacaacacaaagag

SEQ ID NO: 2159454 - RNA, 23 nt, Human
caaauugugugugcucugcuuca

SEQ ID NO: 2159455 - RNA, 16 nt, Human
caaaggaguagaaaga

SEQ ID NO: 2159456 - RNA, 19 nt, Human
caaagaggccuuuaaccau

SEQ ID NO: 2159457 - RNA, 23 nt, Human
caaacuuccagugcaacacugaa

SEQ ID NO: 2159458 - RNA, 15 nt, Human
caaauagcacuugac

SEQ ID NO: 2159459 - RNA, 14 nt, Human
cacccacccuggga

SEQ ID NO: 2159460 - RNA, 13 nt, Human
cacccacccuggg

SEQ ID NO: 2159461 - RNA, 21 nt, Human
aacugaacaccauugaaggcu

SEQ ID NO: 2159462 - RNA, 22 nt, Human
aacugaacaccauugaaggcuu

SEQ ID NO: 2159463 - RNA, 23 nt, Human
aacugaacaccauugaaggcuua

SEQ ID NO: 2159464 - RNA, 19 nt, Human
gugaguccuagagcuacag

SEQ ID NO: 2159465 - RNA, 20 nt, Human
gugaaggccucgcaggaaga

SEQ ID NO: 2159466 - RNA, 12 nt, Human
gugaaggccucg

SEQ ID NO: 2159467 - RNA, 13 nt, Human
gugaaggcuggca

SEQ ID NO: 2159468 - RNA, 12 nt, Human
gugaaggcuggc

SEQ ID NO: 2159469 - RNA, 14 nt, Human
gugaaggcuggcau

SEQ ID NO: 2159470 - RNA, 19 nt, Human
gucuuuguuaaguucuauu

SEQ ID NO: 2159471 - RNA, 20 nt, Human
aaccaugaagucucuaacaa

SEQ ID NO: 2159472 - RNA, 22 nt, Human
aaccacauacaacacaaagaga

SEQ ID NO: 2159473 - RNA, 13 nt, Human
aacauuuucacac

SEQ ID NO: 2159474 - RNA, 15 nt, Human
aacauuuuacccaca

SEQ ID NO: 2159475 - RNA, 17 nt, Human
aacauuuuacccacaca

SEQ ID NO: 2159476 - RNA, 18 nt, Human
gucgacuucgggcuggcc

SEQ ID NO: 2159477 - RNA, 15 nt, Human
gucgcccucccaggc

SEQ ID NO: 2159478 - RNA, 16 nt, Human
guagccuuuugacuuu

SEQ ID NO: 2159479 - RNA, 12 nt, Human
aagcaaacacau

SEQ ID NO: 2159480 - RNA, 13 nt, Human
aagcaaacacauu

SEQ ID NO: 2159481 - RNA, 14 nt, Human
aagcaaacacauua

SEQ ID NO: 2159482 - RNA, 13 nt, Human
aagcaaacccaga

SEQ ID NO: 2159483 - RNA, 19 nt, Human
aagcaaacccagacggcuc

SEQ ID NO: 2159484 - RNA, 16 nt, Human
aagcaaacccagacgg

SEQ ID NO: 2159485 - RNA, 23 nt, Human
gugguuaaugccauggacagaag

SEQ ID NO: 2159486 - RNA, 14 nt, Human
gugguuacacagug

SEQ ID NO: 2159487 - RNA, 13 nt, Human
gugguuacacagu

SEQ ID NO: 2159488 - RNA, 13 nt, Human
guguucuuugugu

SEQ ID NO: 2159489 - RNA, 19 nt, Human
aagacccaacacaugggac

SEQ ID NO: 2159490 - RNA, 15 nt, Human
aagagauuccugagc

SEQ ID NO: 2159491 - RNA, 18 nt, Human
aagagcugaggcaauucu

SEQ ID NO: 2159492 - RNA, 11 nt, Human
aagagcugagg

SEQ ID NO: 2159493 - RNA, 23 nt, Human
gugggaaagauuacuuuuucuuu

SEQ ID NO: 2159494 - RNA, 20 nt, Human
gugguguuuccugcaggcca

SEQ ID NO: 2159495 - RNA, 14 nt, Human
gugggucaaggaau

SEQ ID NO: 2159496 - RNA, 19 nt, Human
aagaaggcagcagguggca

SEQ ID NO: 2159497 - RNA, 18 nt, Human
gugcuguccucagguggc

SEQ ID NO: 2159498 - RNA, 20 nt, Human
aagaaguaggggaagacaug

SEQ ID NO: 2159499 - RNA, 23 nt, Human
aagaccagagauaguggggagac

SEQ ID NO: 2159500 - RNA, 14 nt, Human
guggcaaccugcuu

SEQ ID NO: 2159501 - RNA, 12 nt, Human
uaacaaaugaac

SEQ ID NO: 2159502 - RNA, 17 nt, Human
uaaauagcuuuuguguc

SEQ ID NO: 2159503 - RNA, 14 nt, Human
aauacaauaaguua

SEQ ID NO: 2159504 - RNA, 22 nt, Human
uaaauaacuggaggaauuuucu

SEQ ID NO: 2159505 - RNA, 23 nt, Human
uaaagucauggucauugcaggaa

SEQ ID NO: 2159506 - RNA, 18 nt, Human
aauaaaaaaaagaaauga

SEQ ID NO: 2159507 - RNA, 20 nt, Human
aauaaaaaaaagaaaugaaa

SEQ ID NO: 2159508 - RNA, 18 nt, Human
aauaaagguuguuuugaa

SEQ ID NO: 2159509 - RNA, 23 nt, Human
uaaacccauauuguaaaacaggu

SEQ ID NO: 2159510 - RNA, 17 nt, Human
uaaagauaaagccagaa

SEQ ID NO: 2159511 - RNA, 23 nt, Human
aaguguuuaacuugucaaaaaac

SEQ ID NO: 2159512 - RNA, 21 nt, Human
aaguucuauuggaaaaaccac

SEQ ID NO: 2159513 - RNA, 16 nt, Human
aaguucagccacccug

SEQ ID NO: 2159514 - RNA, 21 nt, Human
aaguuuucccuugaggaaaca

SEQ ID NO: 2159515 - RNA, 22 nt, Human
aaguuuucccuugaggaaacaa

SEQ ID NO: 2159516 - RNA, 16 nt, Human
guucucccugggaggc

SEQ ID NO: 2159517 - RNA, 14 nt, Human
aagcuuugacacug

SEQ ID NO: 2159518 - RNA, 19 nt, Human
aaggagacaggcagagcug

SEQ ID NO: 2159519 - RNA, 16 nt, Human
aaggagacaggcagag

SEQ ID NO: 2159520 - RNA, 14 nt, Human
aaggagacaggcag

SEQ ID NO: 2159521 - RNA, 15 nt, Human
aaggccucgcaggaa

SEQ ID NO: 2159522 - RNA, 17 nt, Human
aaggccucgcaggaaga

SEQ ID NO: 2159523 - RNA, 18 nt, Human
aaggccucgcaggaagac

SEQ ID NO: 2159524 - RNA, 23 nt, Human
guuuuuuucauugccaaaaacua

SEQ ID NO: 2159525 - RNA, 16 nt, Human
aaggguucccucaaga

SEQ ID NO: 2159526 - RNA, 13 nt, Human
uacagucuauuug

SEQ ID NO: 2159527 - RNA, 22 nt, Human
aauguagugaagggauguauca

SEQ ID NO: 2159528 - RNA, 23 nt, Human
aaugguuugaauauaaacacuau

SEQ ID NO: 2159529 - RNA, 17 nt, Human
aaugguuugaauauaaa

SEQ ID NO: 2159530 - RNA, 22 nt, Human
uacaaucucccuucacaaguuu

SEQ ID NO: 2159531 - RNA, 14 nt, Human
aaugguuugaauau

SEQ ID NO: 2159532 - RNA, 20 nt, Human
uacaccuuucuccuuuguac

SEQ ID NO: 2159533 - RNA, 19 nt, Human
uacaccuuucuccuuugua

SEQ ID NO: 2159534 - RNA, 18 nt, Human
uacaccuuucuccuuugu

SEQ ID NO: 2159535 - RNA, 12 nt, Human
aauuaacacugc

SEQ ID NO: 2159536 - RNA, 14 nt, Human
aauuaacagaaaaa

SEQ ID NO: 2159537 - RNA, 14 nt, Human
uacccgcagaguuc

SEQ ID NO: 2159538 - RNA, 15 nt, Human
uacaagcccccccuu

SEQ ID NO: 2159539 - RNA, 14 nt, Human
uacaagcccccccu

SEQ ID NO: 2159540 - RNA, 19 nt, Human
uacaagcccccccuuccac

SEQ ID NO: 2159541 - RNA, 22 nt, Human
uaauuugauaguauugugcaua

SEQ ID NO: 2159542 - RNA, 18 nt, Human
aaugcaacaacauguaua

SEQ ID NO: 2159543 - RNA, 15 nt, Human
aaugcaacaacaugu

SEQ ID NO: 2159544 - RNA, 17 nt, Human
uaaugugccuaguucuu

SEQ ID NO: 2159545 - RNA, 18 nt, Human
uaaugucaaacuugaguc

SEQ ID NO: 2159546 - RNA, 13 nt, Human
uaaugucaaacuu

SEQ ID NO: 2159547 - RNA, 16 nt, Human
acaagcaaacccagac

SEQ ID NO: 2159548 - RNA, 19 nt, Human
acaagcaaacccagacggc

SEQ ID NO: 2159549 - RNA, 14 nt, Human
acaacacaaagaga

SEQ ID NO: 2159550 - RNA, 23 nt, Human
uagagcuuucuuucacaaaaaag

SEQ ID NO: 2159551 - RNA, 12 nt, Human
uagagcuuucuu

SEQ ID NO: 2159552 - RNA, 22 nt, Human
uagacaaguccagccuggcaag

SEQ ID NO: 2159553 - RNA, 23 nt, Human
acaaaaaaaccucuuaauauucu

SEQ ID NO: 2159554 - RNA, 17 nt, Human
aauuugagauacaaaca

SEQ ID NO: 2159555 - RNA, 21 nt, Human
aauuugauaguauugugcaua

SEQ ID NO: 2159556 - RNA, 15 nt, Human
aauuuaaagccacaa

SEQ ID NO: 2159557 - RNA, 20 nt, Human
aauuuaaagaaguaugggaa

SEQ ID NO: 2159558 - RNA, 12 nt, Human
aauuuaaagcaa

SEQ ID NO: 2159559 - RNA, 20 nt, Human
aauuguuuguaagugaagug

SEQ ID NO: 2159560 - RNA, 21 nt, Human
aauugugugugcucugcuuca

SEQ ID NO: 2159561 - RNA, 12 nt, Human
aauuguuucaca

SEQ ID NO: 2159562 - RNA, 17 nt, Human
aauucuugcauauuuug

SEQ ID NO: 2159563 - RNA, 13 nt, Human
aauucuugcauau

SEQ ID NO: 2159564 - RNA, 23 nt, Human
uacccugcgcccaguccuuccac

SEQ ID NO: 2159565 - RNA, 21 nt, Human
uacccugcgcccaguccuucc

SEQ ID NO: 2159566 - RNA, 23 nt, Human
aauucuuauuuuuuaaaaagcua

SEQ ID NO: 2159567 - RNA, 19 nt, Human
aauucuuauuuuuuaaaaa

SEQ ID NO: 2159568 - RNA, 15 nt, Human
aauucuuauucuuuc

SEQ ID NO: 2159569 - RNA, 17 nt, Human
aauucuuacaaacaugu

SEQ ID NO: 2159570 - RNA, 21 nt, Human
uacucaaguagcauuuacugu

SEQ ID NO: 2159571 - RNA, 19 nt, Human
uacucaaguagcauuuacu

SEQ ID NO: 2159572 - RNA, 15 nt, Human
uacucaagcccgcgg

SEQ ID NO: 2159573 - RNA, 13 nt, Human
uacguaugagacg

SEQ ID NO: 2159574 - RNA, 23 nt, Human
acagucuauuugagacuccucag

SEQ ID NO: 2159575 - RNA, 19 nt, Human
acagugugaauaaagugcu

SEQ ID NO: 2159576 - RNA, 17 nt, Human
acagggcaccugccacc

SEQ ID NO: 2159577 - RNA, 13 nt, Human
acagggcacaggc

SEQ ID NO: 2159578 - RNA, 15 nt, Human
acagggcaccugcca

SEQ ID NO: 2159579 - RNA, 16 nt, Human
acagggcacaggccau

SEQ ID NO: 2159580 - RNA, 15 nt, Human
uauuaguuuugcaua

SEQ ID NO: 2159581 - RNA, 20 nt, Human
uauucaauaaaaaaaagaaa

SEQ ID NO: 2159582 - RNA, 23 nt, Human
uauucaauaaaaaaaagaaauga

SEQ ID NO: 2159583 - RNA, 22 nt, Human
uauucaauaaaaaaaagaaaug

SEQ ID NO: 2159584 - RNA, 14 nt, Human
uauugucuuuuugu

SEQ ID NO: 2159585 - RNA, 20 nt, Human
uauuuaaguaacuuuaaauu

SEQ ID NO: 2159586 - RNA, 22 nt, Human
uauuucaauuuccaagagcuga

SEQ ID NO: 2159587 - RNA, 22 nt, Human
uauuuagcuccaaaccuucaca

SEQ ID NO: 2159588 - RNA, 21 nt, Human
uauugaauauaauauauuugu

SEQ ID NO: 2159589 - RNA, 20 nt, Human
uauugaauauaauauauuug

SEQ ID NO: 2159590 - RNA, 22 nt, Human
uauugaauauaauauauuugug

SEQ ID NO: 2159591 - RNA, 11 nt, Human
uauugaaucua

SEQ ID NO: 2159592 - RNA, 17 nt, Human
uauugaaucuauuuaag

SEQ ID NO: 2159593 - RNA, 16 nt, Human
uauugaaucuauuuaa

SEQ ID NO: 2159594 - RNA, 22 nt, Human
uauucuuucgaaagaagaaaau

SEQ ID NO: 2159595 - RNA, 14 nt, Human
uauugacuuugucu

SEQ ID NO: 2159596 - RNA, 17 nt, Human
uauuggguuccauucuc

SEQ ID NO: 2159597 - RNA, 15 nt, Human
uauuguaaaacaggu

SEQ ID NO: 2159598 - RNA, 17 nt, Human
uauucuuauucaaagaa

SEQ ID NO: 2159599 - RNA, 14 nt, Human
uauucuuauucaaa

SEQ ID NO: 2159600 - RNA, 20 nt, Human
acagacuguugucccugcac

SEQ ID NO: 2159601 - RNA, 19 nt, Human
acagacuguugucccugca

SEQ ID NO: 2159602 - RNA, 19 nt, Human
acagacugaccuugaugag

SEQ ID NO: 2159603 - RNA, 20 nt, Human
acagacucaaaugcucagac

SEQ ID NO: 2159604 - RNA, 22 nt, Human
acagacucacaaccugaaccua

SEQ ID NO: 2159605 - RNA, 20 nt, Human
acagacucacaaccugaacc

SEQ ID NO: 2159606 - RNA, 22 nt, Human
acagacucgauucauauugaau

SEQ ID NO: 2159607 - RNA, 18 nt, Human
uaugaugugggucaagga

SEQ ID NO: 2159608 - RNA, 19 nt, Human
acagcccaaagaaggaaaa

SEQ ID NO: 2159609 - RNA, 12 nt, Human
uauacacacagc

SEQ ID NO: 2159610 - RNA, 18 nt, Human
uauagguuuuaaagaccu

SEQ ID NO: 2159611 - RNA, 19 nt, Human
uagucagaauuagcugcuu

SEQ ID NO: 2159612 - RNA, 16 nt, Human
acacaucgcacugugg

SEQ ID NO: 2159613 - RNA, 21 nt, Human
acaccaggcuugccugcaggc

SEQ ID NO: 2159614 - RNA, 12 nt, Human
acacccagcccc

SEQ ID NO: 2159615 - RNA, 19 nt, Human
acaccuaaauaaccaaucu

SEQ ID NO: 2159616 - RNA, 17 nt, Human
acacccagcccccacau

SEQ ID NO: 2159617 - RNA, 20 nt, Human
acucauuuaaaguauuuuau

SEQ ID NO: 2159618 - RNA, 16 nt, Human
ucccuguaggauuuuu

SEQ ID NO: 2159619 - RNA, 23 nt, Human
uccucagguggccaugccucagc

SEQ ID NO: 2159620 - RNA, 15 nt, Human
uccucacacacagac

SEQ ID NO: 2159621 - RNA, 20 nt, Human
uccucaauuccaacacugau

SEQ ID NO: 2159622 - RNA, 18 nt, Human
uccccuuuugcauucucc

SEQ ID NO: 2159623 - RNA, 15 nt, Human
acuauauuguacaca

SEQ ID NO: 2159624 - RNA, 16 nt, Human
acuaaaacuacaaaaa

SEQ ID NO: 2159625 - RNA, 20 nt, Human
uccagccugguuuagccugg

SEQ ID NO: 2159626 - RNA, 21 nt, Human
uccagcuauuuuuauuuguuu

SEQ ID NO: 2159627 - RNA, 18 nt, Human
acguuuacaagccccccc

SEQ ID NO: 2159628 - RNA, 17 nt, Human
ucccaggugcagccaga

SEQ ID NO: 2159629 - RNA, 21 nt, Human
acuguaccaugugcuacaggg

SEQ ID NO: 2159630 - RNA, 12 nt, Human
acuguacaugug

SEQ ID NO: 2159631 - RNA, 22 nt, Human
acugggaugggaggagaggaca

SEQ ID NO: 2159632 - RNA, 17 nt, Human
ucgacagugaauauuca

SEQ ID NO: 2159633 - RNA, 22 nt, Human
ucgacagcauuuuccucugcuu

SEQ ID NO: 2159634 - RNA, 18 nt, Human
uccuuucaagguaacugu

SEQ ID NO: 2159635 - RNA, 19 nt, Human
uccuuucaaugguuugcaa

SEQ ID NO: 2159636 - RNA, 14 nt, Human
uccuuuccagguau

SEQ ID NO: 2159637 - RNA, 22 nt, Human
ucgaauuuuguuuucuugauuu

SEQ ID NO: 2159638 - RNA, 16 nt, Human
acugccuuuggcagag

SEQ ID NO: 2159639 - RNA, 19 nt, Human
acugccuuuggcagaguuc

SEQ ID NO: 2159640 - RNA, 16 nt, Human
acugcauaccaaccug

SEQ ID NO: 2159641 - RNA, 20 nt, Human
acugcauaccaaccugggca

SEQ ID NO: 2159642 - RNA, 22 nt, Human
acugcugcgucauuacagggca

SEQ ID NO: 2159643 - RNA, 16 nt, Human
uccuuccucacaccag

SEQ ID NO: 2159644 - RNA, 21 nt, Human
uccuuccucacaccaggcuug

SEQ ID NO: 2159645 - RNA, 10 nt, Human
acuggcaugc

SEQ ID NO: 2159646 - RNA, 19 nt, Human
uccugugccuccaucagcu

SEQ ID NO: 2159647 - RNA, 14 nt, Human
uccugcaggccagg

SEQ ID NO: 2159648 - RNA, 19 nt, Human
uccugcaggccaggccagc

SEQ ID NO: 2159649 - RNA, 20 nt, Human
uccugcaggccaggccagcu

SEQ ID NO: 2159650 - RNA, 12 nt, Human
uccacagggcac

SEQ ID NO: 2159651 - RNA, 20 nt, Human
uccaacacugauuuccccuu

SEQ ID NO: 2159652 - RNA, 20 nt, Human
ucauuugcuaacuagcuugg

SEQ ID NO: 2159653 - RNA, 19 nt, Human
ucauuuguuuguuuuccuu

SEQ ID NO: 2159654 - RNA, 18 nt, Human
accugguccacagggcac

SEQ ID NO: 2159655 - RNA, 17 nt, Human
accugguccacagggca

SEQ ID NO: 2159656 - RNA, 16 nt, Human
accugguccacagggc

SEQ ID NO: 2159657 - RNA, 15 nt, Human
accugguccacaggg

SEQ ID NO: 2159658 - RNA, 15 nt, Human
uccaccagucauuuu

SEQ ID NO: 2159659 - RNA, 14 nt, Human
uccaccagucauuu

SEQ ID NO: 2159660 - RNA, 18 nt, Human
uccaccagucauuuuuca

SEQ ID NO: 2159661 - RNA, 16 nt, Human
uccaccagucauuuuu

SEQ ID NO: 2159662 - RNA, 23 nt, Human
accuuaggaauaaucuccuguua

SEQ ID NO: 2159663 - RNA, 12 nt, Human
accuauccacac

SEQ ID NO: 2159664 - RNA, 12 nt, Human
ucauauugaaua

SEQ ID NO: 2159665 - RNA, 16 nt, Human
ucaugaccagcaaaua

SEQ ID NO: 2159666 - RNA, 15 nt, Human
ucaugaccagcaaau

SEQ ID NO: 2159667 - RNA, 18 nt, Human
ucauucuaaugauggccc

SEQ ID NO: 2159668 - RNA, 22 nt, Human
accuccuuucaagguaacugua

SEQ ID NO: 2159669 - RNA, 14 nt, Human
accucuccucaugu

SEQ ID NO: 2159670 - RNA, 23 nt, Human
accucucccugacccuguauaua

SEQ ID NO: 2159671 - RNA, 22 nt, Human
accucucccugacccuguauau

SEQ ID NO: 2159672 - RNA, 17 nt, Human
accucucccugacccug

SEQ ID NO: 2159673 - RNA, 14 nt, Human
accucucccugacc

SEQ ID NO: 2159674 - RNA, 15 nt, Human
accagccugaccaaa

SEQ ID NO: 2159675 - RNA, 11 nt, Human
accagccuggc

SEQ ID NO: 2159676 - RNA, 12 nt, Human
accagccuggcc

SEQ ID NO: 2159677 - RNA, 15 nt, Human
accagccuggccaac

SEQ ID NO: 2159678 - RNA, 20 nt, Human
accagccuggccaacauggu

SEQ ID NO: 2159679 - RNA, 15 nt, Human
accacucaaaggcca

SEQ ID NO: 2159680 - RNA, 22 nt, Human
accacacuggacuccggcccuc

SEQ ID NO: 2159681 - RNA, 21 nt, Human
accacacuggacuccggcccu

SEQ ID NO: 2159682 - RNA, 20 nt, Human
uauuucaguuuuaaauguac

SEQ ID NO: 2159683 - RNA, 15 nt, Human
ucacuguccuccaag

SEQ ID NO: 2159684 - RNA, 16 nt, Human
ucacuguccuccaagc

SEQ ID NO: 2159685 - RNA, 19 nt, Human
ucacuguccuccaagccag

SEQ ID NO: 2159686 - RNA, 19 nt, Human
accagggauuguuucuguu

SEQ ID NO: 2159687 - RNA, 18 nt, Human
accagggauuguuucugu

SEQ ID NO: 2159688 - RNA, 16 nt, Human
accagggauuguuucu

SEQ ID NO: 2159689 - RNA, 19 nt, Human
accagggagcugcaggggc

SEQ ID NO: 2159690 - RNA, 23 nt, Human
accaugaagucucuaacaaugua

SEQ ID NO: 2159691 - RNA, 16 nt, Human
accauuuaaaaacagg

SEQ ID NO: 2159692 - RNA, 14 nt, Human
accauuuaaaaaca

SEQ ID NO: 2159693 - RNA, 23 nt, Human
accauuuaaaaacaggcagcuca

SEQ ID NO: 2159694 - RNA, 21 nt, Human
accauuuaaaaacaggcagcu

SEQ ID NO: 2159695 - RNA, 19 nt, Human
acccaagaccucagggcac

SEQ ID NO: 2159696 - RNA, 18 nt, Human
acccaagaccucagggca

SEQ ID NO: 2159697 - RNA, 14 nt, Human
acccccgcccccug

SEQ ID NO: 2159698 - RNA, 21 nt, Human
acccccgcccccugcccuccc

SEQ ID NO: 2159699 - RNA, 20 nt, Human
acccccgcccccugcccucc

SEQ ID NO: 2159700 - RNA, 19 nt, Human
acccccgcccccugcccuc

SEQ ID NO: 2159701 - RNA, 18 nt, Human
acccccgcccccugcccu

SEQ ID NO: 2159702 - RNA, 15 nt, Human
acccccgcccccugc

SEQ ID NO: 2159703 - RNA, 15 nt, Human
accccauuucucucc

SEQ ID NO: 2159704 - RNA, 14 nt, Human
accccauuucucuc

SEQ ID NO: 2159705 - RNA, 19 nt, Human
accccauuucucuccucac

SEQ ID NO: 2159706 - RNA, 16 nt, Human
ucagcccugacccugu

SEQ ID NO: 2159707 - RNA, 13 nt, Human
ucagcccugaccc

SEQ ID NO: 2159708 - RNA, 12 nt, Human
ucagaagaaauu

SEQ ID NO: 2159709 - RNA, 15 nt, Human
ucagggucauagcau

SEQ ID NO: 2159710 - RNA, 21 nt, Human
acccuucuccucuuguaaaua

SEQ ID NO: 2159711 - RNA, 19 nt, Human
acccuucuccucuuguaaa

SEQ ID NO: 2159712 - RNA, 17 nt, Human
acccuucuccucuugua

SEQ ID NO: 2159713 - RNA, 15 nt, Human
acccuucuccucuug

SEQ ID NO: 2159714 - RNA, 19 nt, Human
agauuaugagacacaggau

SEQ ID NO: 2159715 - RNA, 19 nt, Human
ugacuugacagaacacugu

SEQ ID NO: 2159716 - RNA, 17 nt, Human
ugacuugacagaacacu

SEQ ID NO: 2159717 - RNA, 22 nt, Human
agcaacauuuuacccacacaca

SEQ ID NO: 2159718 - RNA, 16 nt, Human
agcaacagaaaaaugg

SEQ ID NO: 2159719 - RNA, 20 nt, Human
agcaacauuuuacccacaca

SEQ ID NO: 2159720 - RNA, 13 nt, Human
agcaacagaaaaa

SEQ ID NO: 2159721 - RNA, 19 nt, Human
agaugcuagcacaugcccu

SEQ ID NO: 2159722 - RNA, 22 nt, Human
agaugugguugcauaagguuuu

SEQ ID NO: 2159723 - RNA, 21 nt, Human
agaugugguugcauaagguuu

SEQ ID NO: 2159724 - RNA, 16 nt, Human
ugacagucaugcaguc

SEQ ID NO: 2159725 - RNA, 20 nt, Human
ugaccaaaauggugaaaccu

SEQ ID NO: 2159726 - RNA, 15 nt, Human
agauccuuccuuuug

SEQ ID NO: 2159727 - RNA, 16 nt, Human
ugaauauaaacacuau

SEQ ID NO: 2159728 - RNA, 22 nt, Human
ugaauauaauauauuuguguau

SEQ ID NO: 2159729 - RNA, 21 nt, Human
ugaauauaauauauuugugua

SEQ ID NO: 2159730 - RNA, 14 nt, Human
ugaauauaaacacu

SEQ ID NO: 2159731 - RNA, 15 nt, Human
ugaauauaaacacua

SEQ ID NO: 2159732 - RNA, 16 nt, Human
ugaagguuucugaaaa

SEQ ID NO: 2159733 - RNA, 13 nt, Human
ugaagguuucuga

SEQ ID NO: 2159734 - RNA, 13 nt, Human
ugaagcuuuacca

SEQ ID NO: 2159735 - RNA, 12 nt, Human
ugaagcuuccuu

SEQ ID NO: 2159736 - RNA, 14 nt, Human
agaguccucugaau

SEQ ID NO: 2159737 - RNA, 12 nt, Human
agaguccucuga

SEQ ID NO: 2159738 - RNA, 13 nt, Human
agaguccucugaa

SEQ ID NO: 2159739 - RNA, 11 nt, Human
ugaagaagaga

SEQ ID NO: 2159740 - RNA, 21 nt, Human
agaggccuuuaaccauggugc

SEQ ID NO: 2159741 - RNA, 18 nt, Human
agaggcaauggcuccuuc

SEQ ID NO: 2159742 - RNA, 13 nt, Human
agaggcagaagaa

SEQ ID NO: 2159743 - RNA, 17 nt, Human
agaggcagaagaacccu

SEQ ID NO: 2159744 - RNA, 15 nt, Human
agagggaccucuccc

SEQ ID NO: 2159745 - RNA, 16 nt, Human
agagggaccucuccca

SEQ ID NO: 2159746 - RNA, 19 nt, Human
agagggaccucucccaggg

SEQ ID NO: 2159747 - RNA, 13 nt, Human
ugaagccuuucuu

SEQ ID NO: 2159748 - RNA, 20 nt, Human
agcagaggauaauuagcauc

SEQ ID NO: 2159749 - RNA, 19 nt, Human
agcagaugcaaugacucag

SEQ ID NO: 2159750 - RNA, 23 nt, Human
ugagggaucuauacuugcuuugu

SEQ ID NO: 2159751 - RNA, 23 nt, Human
ugaggggucgacuucgggcuggc

SEQ ID NO: 2159752 - RNA, 23 nt, Human
ugaggaaaaaaaucguccaggga

SEQ ID NO: 2159753 - RNA, 16 nt, Human
ugaggaaacaacagcu

SEQ ID NO: 2159754 - RNA, 20 nt, Human
ugagcggugcuguccucagg

SEQ ID NO: 2159755 - RNA, 21 nt, Human
ugagcggugcuguccucaggu

SEQ ID NO: 2159756 - RNA, 23 nt, Human
agcacaugcccuaaugucuguau

SEQ ID NO: 2159757 - RNA, 18 nt, Human
ugagcaauguauaacccc

SEQ ID NO: 2159758 - RNA, 17 nt, Human
ugagcaauguauaaccc

SEQ ID NO: 2159759 - RNA, 18 nt, Human
agcagaaaggcacgucca

SEQ ID NO: 2159760 - RNA, 19 nt, Human
agcagacugaucaggaccu

SEQ ID NO: 2159761 - RNA, 18 nt, Human
agcagacugaucaggacc

SEQ ID NO: 2159762 - RNA, 17 nt, Human
agcagacugaucaggac

SEQ ID NO: 2159763 - RNA, 16 nt, Human
agcagacugaucagga

SEQ ID NO: 2159764 - RNA, 19 nt, Human
agaccugacaccuuucaua

SEQ ID NO: 2159765 - RNA, 19 nt, Human
agaccugcagacgcccaga

SEQ ID NO: 2159766 - RNA, 17 nt, Human
agacuguugucccugca

SEQ ID NO: 2159767 - RNA, 23 nt, Human
agacagcuucucauccugcaggc

SEQ ID NO: 2159768 - RNA, 22 nt, Human
agacagcuucucauccugcagg

SEQ ID NO: 2159769 - RNA, 13 nt, Human
agacacugaaaua

SEQ ID NO: 2159770 - RNA, 22 nt, Human
agacacugaaauauacacacag

SEQ ID NO: 2159771 - RNA, 20 nt, Human
agacacugaaauauacacac

SEQ ID NO: 2159772 - RNA, 21 nt, Human
agacacugaaauauacacaca

SEQ ID NO: 2159773 - RNA, 12 nt, Human
ucuucaacaaau

SEQ ID NO: 2159774 - RNA, 17 nt, Human
ucuuauuuuuuaaaaag

SEQ ID NO: 2159775 - RNA, 18 nt, Human
ucuuaauauucuggaguc

SEQ ID NO: 2159776 - RNA, 14 nt, Human
ucuuaauauucugg

SEQ ID NO: 2159777 - RNA, 16 nt, Human
agaaggaaaaggcagg

SEQ ID NO: 2159778 - RNA, 19 nt, Human
agaacucauguuauuuuuu

SEQ ID NO: 2159779 - RNA, 22 nt, Human
agaacucauguuauuuuuuaac

SEQ ID NO: 2159780 - RNA, 20 nt, Human
agaagaaaauggaaccaggc

SEQ ID NO: 2159781 - RNA, 19 nt, Human
agaagaaaauggaaccagg

SEQ ID NO: 2159782 - RNA, 15 nt, Human
ucugagaaacaauga

SEQ ID NO: 2159783 - RNA, 15 nt, Human
agaaagacagagcug

SEQ ID NO: 2159784 - RNA, 13 nt, Human
agaagcuaagcug

SEQ ID NO: 2159785 - RNA, 14 nt, Human
ucuggaaagcaaag

SEQ ID NO: 2159786 - RNA, 17 nt, Human
ucugcugguuuuaacaa

SEQ ID NO: 2159787 - RNA, 21 nt, Human
ucugcuguucucuagaaagaa

SEQ ID NO: 2159788 - RNA, 22 nt, Human
ucugcucaggagaccuggagga

SEQ ID NO: 2159789 - RNA, 21 nt, Human
agaagaaggcagcagguggca

SEQ ID NO: 2159790 - RNA, 14 nt, Human
agaagaaggcagca

SEQ ID NO: 2159791 - RNA, 13 nt, Human
agaagaaggcagc

SEQ ID NO: 2159792 - RNA, 23 nt, Human
agaagaaaauggaaccaggcuug

SEQ ID NO: 2159793 - RNA, 22 nt, Human
agaagaaaauggaaccaggcuu

SEQ ID NO: 2159794 - RNA, 23 nt, Human
agaaaacacuuaaaaugaucauu

SEQ ID NO: 2159795 - RNA, 12 nt, Human
ucucuuucuuua

SEQ ID NO: 2159796 - RNA, 15 nt, Human
ucucuuucaugaguu

SEQ ID NO: 2159797 - RNA, 18 nt, Human
ucucugccauaaaugauu

SEQ ID NO: 2159798 - RNA, 17 nt, Human
acuuuuuuuuguauguu

SEQ ID NO: 2159799 - RNA, 21 nt, Human
ucucugcgugcagggacaaag

SEQ ID NO: 2159800 - RNA, 23 nt, Human
acuuuuuugcuauccagcuauuu

SEQ ID NO: 2159801 - RNA, 15 nt, Human
acuuuuucuuuaugu

SEQ ID NO: 2159802 - RNA, 17 nt, Human
acuuugggaggccaagg

SEQ ID NO: 2159803 - RNA, 19 nt, Human
ugcauaauaaaugcuucag

SEQ ID NO: 2159804 - RNA, 11 nt, Human
ugcauaauaaa

SEQ ID NO: 2159805 - RNA, 19 nt, Human
ugcagucuguccaggcucg

SEQ ID NO: 2159806 - RNA, 13 nt, Human
ugcauaauuucag

SEQ ID NO: 2159807 - RNA, 12 nt, Human
agccuaggccag

SEQ ID NO: 2159808 - RNA, 14 nt, Human
agccuaggccaggu

SEQ ID NO: 2159809 - RNA, 13 nt, Human
agccuaggccagg

SEQ ID NO: 2159810 - RNA, 22 nt, Human
agccuauguggauuuuuuccua

SEQ ID NO: 2159811 - RNA, 22 nt, Human
agcuauuuuuauuuguuugugc

SEQ ID NO: 2159812 - RNA, 19 nt, Human
agcuacucgggaagcugag

SEQ ID NO: 2159813 - RNA, 17 nt, Human
agcuauugauauaaaua

SEQ ID NO: 2159814 - RNA, 23 nt, Human
agcuauugauauaaauaaaacau

SEQ ID NO: 2159815 - RNA, 17 nt, Human
agcugggauguuucugu

SEQ ID NO: 2159816 - RNA, 20 nt, Human
agcugugcacaaaguggcau

SEQ ID NO: 2159817 - RNA, 15 nt, Human
agcugugcacaaagu

SEQ ID NO: 2159818 - RNA, 14 nt, Human
ugccuuuacuucag

SEQ ID NO: 2159819 - RNA, 19 nt, Human
ugcgacacugggaggccag

SEQ ID NO: 2159820 - RNA, 15 nt, Human
agcucuccccucaga

SEQ ID NO: 2159821 - RNA, 22 nt, Human
agcugaugacucaagauuccca

SEQ ID NO: 2159822 - RNA, 19 nt, Human
agcucuugaagacacugaa

SEQ ID NO: 2159823 - RNA, 15 nt, Human
agcugaugacucaag

SEQ ID NO: 2159824 - RNA, 11 nt, Human
agcugaugacu

SEQ ID NO: 2159825 - RNA, 12 nt, Human
ugccuccauccu

SEQ ID NO: 2159826 - RNA, 15 nt, Human
ugccuccauccuagu

SEQ ID NO: 2159827 - RNA, 20 nt, Human
ugccgcgucgcccucccagg

SEQ ID NO: 2159828 - RNA, 16 nt, Human
ugccgcgucgcccucc

SEQ ID NO: 2159829 - RNA, 21 nt, Human
ugccgcgucgcccucccaggc

SEQ ID NO: 2159830 - RNA, 18 nt, Human
ugcccuuggcacccaaga

SEQ ID NO: 2159831 - RNA, 19 nt, Human
aggaauuuucuccaauuuu

SEQ ID NO: 2159832 - RNA, 16 nt, Human
aggaauuuucuccaau

SEQ ID NO: 2159833 - RNA, 21 nt, Human
aggaaagcuugaguaaaauaa

SEQ ID NO: 2159834 - RNA, 19 nt, Human
ugcuauccagcuauuuuua

SEQ ID NO: 2159835 - RNA, 12 nt, Human
ugcucuggaccu

SEQ ID NO: 2159836 - RNA, 16 nt, Human
ugcucuggaccugccc

SEQ ID NO: 2159837 - RNA, 15 nt, Human
ugcucuggaccugcc

SEQ ID NO: 2159838 - RNA, 14 nt, Human
ugcucuggaccugc

SEQ ID NO: 2159839 - RNA, 13 nt, Human
ugcucuggaccug

SEQ ID NO: 2159840 - RNA, 20 nt, Human
ugcucuggaccugcccccgc

SEQ ID NO: 2159841 - RNA, 23 nt, Human
agcuuggaaacuggaugagguca

SEQ ID NO: 2159842 - RNA, 14 nt, Human
agcuuucuuucaca

SEQ ID NO: 2159843 - RNA, 20 nt, Human
agcuuucuuucacaaaaaag

SEQ ID NO: 2159844 - RNA, 22 nt, Human
agcuuugacacuggaaugaguu

SEQ ID NO: 2159845 - RNA, 17 nt, Human
agcuuugacacuggaau

SEQ ID NO: 2159846 - RNA, 22 nt, Human
aggaaaauauuuugaucuucaa

SEQ ID NO: 2159847 - RNA, 15 nt, Human
aggaaaauauuuuga

SEQ ID NO: 2159848 - RNA, 13 nt, Human
aggaaaauauuuu

SEQ ID NO: 2159849 - RNA, 21 nt, Human
aggccccugucucagggugag

SEQ ID NO: 2159850 - RNA, 18 nt, Human
aggcauccuuccucacac

SEQ ID NO: 2159851 - RNA, 20 nt, Human
aggcauccuuccucacacca

SEQ ID NO: 2159852 - RNA, 18 nt, Human
uggcacagcccaaagaag

SEQ ID NO: 2159853 - RNA, 20 nt, Human
uggcacagcccaaagaagga

SEQ ID NO: 2159854 - RNA, 22 nt, Human
uggcagauguaaaguuauucuu

SEQ ID NO: 2159855 - RNA, 21 nt, Human
aggcuauuguccccuaaacca

SEQ ID NO: 2159856 - RNA, 14 nt, Human
aggccuuuaaccau

SEQ ID NO: 2159857 - RNA, 15 nt, Human
aggcucauuuacugu

SEQ ID NO: 2159858 - RNA, 14 nt, Human
aggcucauuuacug

SEQ ID NO: 2159859 - RNA, 19 nt, Human
uggcucacaccuguaaucc

SEQ ID NO: 2159860 - RNA, 16 nt, Human
uggcucacaccuguaa

SEQ ID NO: 2159861 - RNA, 15 nt, Human
ugggaaacagaggcu

SEQ ID NO: 2159862 - RNA, 16 nt, Human
aggcuugccugcaggc

SEQ ID NO: 2159863 - RNA, 15 nt, Human
aggcuugccugcagg

SEQ ID NO: 2159864 - RNA, 17 nt, Human
aggcuugccugcaggca

SEQ ID NO: 2159865 - RNA, 16 nt, Human
agggaaaagcagcucu

SEQ ID NO: 2159866 - RNA, 18 nt, Human
aggcugggcguaguggcu

SEQ ID NO: 2159867 - RNA, 16 nt, Human
agggccaacccuucuc

SEQ ID NO: 2159868 - RNA, 15 nt, Human
agggccaacccuucu

SEQ ID NO: 2159869 - RNA, 21 nt, Human
agggccaacccuucuccucuu

SEQ ID NO: 2159870 - RNA, 17 nt, Human
agggccaacccuucucc

SEQ ID NO: 2159871 - RNA, 17 nt, Human
agggaguguacucccag

SEQ ID NO: 2159872 - RNA, 16 nt, Human
agggaguguacuccca

SEQ ID NO: 2159873 - RNA, 18 nt, Human
agggaguguacucccagg

SEQ ID NO: 2159874 - RNA, 19 nt, Human
agggcuccucuccagucug

SEQ ID NO: 2159875 - RNA, 19 nt, Human
agggcuuacggcccuggcc

SEQ ID NO: 2159876 - RNA, 20 nt, Human
agggcuuacggcccuggccu

SEQ ID NO: 2159877 - RNA, 18 nt, Human
agggcuuacggcccuggc

SEQ ID NO: 2159878 - RNA, 15 nt, Human
agggcuuacggcccu

SEQ ID NO: 2159879 - RNA, 16 nt, Human
agggagaccuggacac

SEQ ID NO: 2159880 - RNA, 21 nt, Human
agggagaagacuauauuguac

SEQ ID NO: 2159881 - RNA, 19 nt, Human
agggagcaggcggugggca

SEQ ID NO: 2159882 - RNA, 22 nt, Human
agggagaccuggacacaggccu

SEQ ID NO: 2159883 - RNA, 21 nt, Human
agggagaccuggacacaggcc

SEQ ID NO: 2159884 - RNA, 18 nt, Human
ugggacuagagcuuucuu

SEQ ID NO: 2159885 - RNA, 23 nt, Human
agggagcuagccagaggacugug

SEQ ID NO: 2159886 - RNA, 17 nt, Human
agggagcuagccagagg

SEQ ID NO: 2159887 - RNA, 17 nt, Human
agggagcauuuuccucc

SEQ ID NO: 2159888 - RNA, 15 nt, Human
agggagcauuuuccu

SEQ ID NO: 2159889 - RNA, 16 nt, Human
agggagcgagggagaa

SEQ ID NO: 2159890 - RNA, 16 nt, Human
agggagcuagccagag

SEQ ID NO: 2159891 - RNA, 15 nt, Human
agggagcuagccaga

SEQ ID NO: 2159892 - RNA, 12 nt, Human
ugggaggcgggc

SEQ ID NO: 2159893 - RNA, 15 nt, Human
ugggcaauauagcaa

SEQ ID NO: 2159894 - RNA, 16 nt, Human
ugggcaauauagcaag

SEQ ID NO: 2159895 - RNA, 19 nt, Human
ugggcacaaagggcccaga

SEQ ID NO: 2159896 - RNA, 21 nt, Human
ugggcacacgccucccacugg

SEQ ID NO: 2159897 - RNA, 16 nt, Human
ugggcacacgccuccc

SEQ ID NO: 2159898 - RNA, 20 nt, Human
ugggcacaaagggcccagau

SEQ ID NO: 2159899 - RNA, 14 nt, Human
agguuucugaaaau

SEQ ID NO: 2159900 - RNA, 23 nt, Human
agguuucugaaaauuaacacugc

SEQ ID NO: 2159901 - RNA, 15 nt, Human
agguuucugaaaauu

SEQ ID NO: 2159902 - RNA, 16 nt, Human
aggugggcgggcaggg

SEQ ID NO: 2159903 - RNA, 15 nt, Human
aggugugauuauaaa

SEQ ID NO: 2159904 - RNA, 18 nt, Human
agguugcagugagcagag

SEQ ID NO: 2159905 - RNA, 22 nt, Human
uguagucagaauuagcugcuuc

SEQ ID NO: 2159906 - RNA, 20 nt, Human
aguagcaguagaugcaugua

SEQ ID NO: 2159907 - RNA, 17 nt, Human
aguagauguucuacuuu

SEQ ID NO: 2159908 - RNA, 17 nt, Human
aguaccaccaaaaaagc

SEQ ID NO: 2159909 - RNA, 22 nt, Human
aguaccaccaaaaaagcuguau

SEQ ID NO: 2159910 - RNA, 20 nt, Human
aguaaucugagaaacaauga

SEQ ID NO: 2159911 - RNA, 15 nt, Human
aguauuaaaauuugg

SEQ ID NO: 2159912 - RNA, 20 nt, Human
agucauaaaauguaucuucc

SEQ ID NO: 2159913 - RNA, 24 nt, Human
agucacugugagcucccaggugca

SEQ ID NO: 2159914 - RNA, 23 nt, Human
agucacugugagcucccaggugc

SEQ ID NO: 2159915 - RNA, 15 nt, Human
aguggauuucccauc

SEQ ID NO: 2159916 - RNA, 12 nt, Human
ugugucugagug

SEQ ID NO: 2159917 - RNA, 20 nt, Human
aguguggagucauucucauu

SEQ ID NO: 2159918 - RNA, 18 nt, Human
aguguggagucauucuca

SEQ ID NO: 2159919 - RNA, 23 nt, Human
aguguggagucauucucauugaa

SEQ ID NO: 2159920 - RNA, 20 nt, Human
uguucgacagugaauauuca

SEQ ID NO: 2159921 - RNA, 23 nt, Human
ugugagcucccaggugcagccag

SEQ ID NO: 2159922 - RNA, 19 nt, Human
ugugagcucccaggugcag

SEQ ID NO: 2159923 - RNA, 13 nt, Human
ugugacuggucag

SEQ ID NO: 2159924 - RNA, 23 nt, Human
agugagcggugcuguccucaggu

SEQ ID NO: 2159925 - RNA, 22 nt, Human
agugagcggugcuguccucagg

SEQ ID NO: 2159926 - RNA, 17 nt, Human
agugcaacacugaagcu

SEQ ID NO: 2159927 - RNA, 18 nt, Human
agugcaagccccugcucc

SEQ ID NO: 2159928 - RNA, 15 nt, Human
agugcaagccccugc

SEQ ID NO: 2159929 - RNA, 17 nt, Human
agugcaagccccugcuc

SEQ ID NO: 2159930 - RNA, 21 nt, Human
auagacagaauagauagcacu

SEQ ID NO: 2159931 - RNA, 15 nt, Human
auagacuaaaugaaa

SEQ ID NO: 2159932 - RNA, 13 nt, Human
auagauguuuccu

SEQ ID NO: 2159933 - RNA, 16 nt, Human
auacuggcaugcuaaa

SEQ ID NO: 2159934 - RNA, 12 nt, Human
auacuggcaugc

SEQ ID NO: 2159935 - RNA, 19 nt, Human
auacugacugagaauauaa

SEQ ID NO: 2159936 - RNA, 15 nt, Human
uuauucaaagaaaua

SEQ ID NO: 2159937 - RNA, 23 nt, Human
uuauucaauaaaaaaaagaaaug

SEQ ID NO: 2159938 - RNA, 13 nt, Human
uuauuaguuuugc

SEQ ID NO: 2159939 - RNA, 12 nt, Human
uuauuaguuuug

SEQ ID NO: 2159940 - RNA, 20 nt, Human
uuaucacaaaaaagaaaaug

SEQ ID NO: 2159941 - RNA, 23 nt, Human
auacauauauguauauauaugca

SEQ ID NO: 2159942 - RNA, 21 nt, Human
uuaugaugugggucaaggaau

SEQ ID NO: 2159943 - RNA, 20 nt, Human
uuaugaugugggucaaggaa

SEQ ID NO: 2159944 - RNA, 23 nt, Human
aguuuuucccagcuacaccuuuc

SEQ ID NO: 2159945 - RNA, 22 nt, Human
aguuuuucccagcuacaccuuu

SEQ ID NO: 2159946 - RNA, 13 nt, Human
auaaaaaaaagaa

SEQ ID NO: 2159947 - RNA, 21 nt, Human
uuaaguuuccuuccagcccag

SEQ ID NO: 2159948 - RNA, 20 nt, Human
uuaaguuuccuuccagccca

SEQ ID NO: 2159949 - RNA, 17 nt, Human
uuaagacguguuugugu

SEQ ID NO: 2159950 - RNA, 16 nt, Human
uuaagacguguuugug

SEQ ID NO: 2159951 - RNA, 13 nt, Human
uuaagacguguuu

SEQ ID NO: 2159952 - RNA, 15 nt, Human
uuaaucuuaucaaga

SEQ ID NO: 2159953 - RNA, 19 nt, Human
uuaacacugcuuguguuuu

SEQ ID NO: 2159954 - RNA, 14 nt, Human
uuaacagaaaaaca

SEQ ID NO: 2159955 - RNA, 23 nt, Human
aguuuaucgaccaguuugaaucu

SEQ ID NO: 2159956 - RNA, 20 nt, Human
uuacagggcacaggccaugg

SEQ ID NO: 2159957 - RNA, 17 nt, Human
uuacaguguagcuugcc

SEQ ID NO: 2159958 - RNA, 12 nt, Human
uuacaaacaugu

SEQ ID NO: 2159959 - RNA, 15 nt, Human
uuacaaacauguggu

SEQ ID NO: 2159960 - RNA, 19 nt, Human
uuagaauaauaaauauuua

SEQ ID NO: 2159961 - RNA, 19 nt, Human
uuauaaaaagguguuuuga

SEQ ID NO: 2159962 - RNA, 14 nt, Human
auaauauuuuuaau

SEQ ID NO: 2159963 - RNA, 20 nt, Human
auaauauuuuuaauuaaaua

SEQ ID NO: 2159964 - RNA, 14 nt, Human
auaauauauuugug

SEQ ID NO: 2159965 - RNA, 20 nt, Human
aucuuucuuuggaugggacu

SEQ ID NO: 2159966 - RNA, 11 nt, Human
aucuuuugaac

SEQ ID NO: 2159967 - RNA, 22 nt, Human
aucuuuucauugaacagcaaag

SEQ ID NO: 2159968 - RNA, 21 nt, Human
uuggccccccgaccuuguaga

SEQ ID NO: 2159969 - RNA, 17 nt, Human
aucuguaucuuuucucu

SEQ ID NO: 2159970 - RNA, 17 nt, Human
aucugguuaggauggca

SEQ ID NO: 2159971 - RNA, 13 nt, Human
uugcucuggaccu

SEQ ID NO: 2159972 - RNA, 14 nt, Human
uugcucuggaccug

SEQ ID NO: 2159973 - RNA, 17 nt, Human
uugacagaacacugucu

SEQ ID NO: 2159974 - RNA, 16 nt, Human
uugacagaacacuguc

SEQ ID NO: 2159975 - RNA, 15 nt, Human
uugacagaacacugu

SEQ ID NO: 2159976 - RNA, 14 nt, Human
uugacagaacacug

SEQ ID NO: 2159977 - RNA, 20 nt, Human
uugaaucuauuuaaguaaaa

SEQ ID NO: 2159978 - RNA, 17 nt, Human
uugaaucuauuuaagua

SEQ ID NO: 2159979 - RNA, 15 nt, Human
uugaaucuauuuaag

SEQ ID NO: 2159980 - RNA, 11 nt, Human
uugaaggcuua

SEQ ID NO: 2159981 - RNA, 12 nt, Human
uugaaggcuuaa

SEQ ID NO: 2159982 - RNA, 21 nt, Human
uugacuugacagaacacuguc

SEQ ID NO: 2159983 - RNA, 20 nt, Human
uugacuugacagaacacugu

SEQ ID NO: 2159984 - RNA, 19 nt, Human
uugacuugacagaacacug

SEQ ID NO: 2159985 - RNA, 11 nt, Human
uugacuuuguc

SEQ ID NO: 2159986 - RNA, 12 nt, Human
uugacuuugucu

SEQ ID NO: 2159987 - RNA, 22 nt, Human
uugagacuccucaguucuugcc

SEQ ID NO: 2159988 - RNA, 18 nt, Human
uugagucuguuuuguaaa

SEQ ID NO: 2159989 - RNA, 15 nt, Human
uugagucuguuuugu

SEQ ID NO: 2159990 - RNA, 17 nt, Human
aucuccaccagucauuu

SEQ ID NO: 2159991 - RNA, 22 nt, Human
aucuccaccagucauuuuucag

SEQ ID NO: 2159992 - RNA, 18 nt, Human
aucuccaagaccagagau

SEQ ID NO: 2159993 - RNA, 21 nt, Human
aucucagguuaagugugagua

SEQ ID NO: 2159994 - RNA, 16 nt, Human
aucuacuuuaauaaau

SEQ ID NO: 2159995 - RNA, 13 nt, Human
uugcaaggaagcc

SEQ ID NO: 2159996 - RNA, 12 nt, Human
uugcaaggaagc

SEQ ID NO: 2159997 - RNA, 12 nt, Human
uugcauucuccc

SEQ ID NO: 2159998 - RNA, 18 nt, Human
uugcauauuuuguaacuu

SEQ ID NO: 2159999 - RNA, 14 nt, Human
uugcauauauacau

SEQ ID NO: 2160000 - RNA, 14 nt, Human
uuccuguccuccca

SEQ ID NO: 2160001 - RNA, 20 nt, Human
uuccuguccucccagcuccu

SEQ ID NO: 2160002 - RNA, 14 nt, Human
uucgcuugagaaaa

SEQ ID NO: 2160003 - RNA, 16 nt, Human
uucgcuugagaaaaaa

SEQ ID NO: 2160004 - RNA, 20 nt, Human
uucggcagauacugucucuu

SEQ ID NO: 2160005 - RNA, 19 nt, Human
uugaaagccccagaaauca

SEQ ID NO: 2160006 - RNA, 13 nt, Human
uugaaccuauuuc

SEQ ID NO: 2160007 - RNA, 16 nt, Human
uugaaccuauuucucu

SEQ ID NO: 2160008 - RNA, 15 nt, Human
uugaaccuauuucuc

SEQ ID NO: 2160009 - RNA, 19 nt, Human
uugaaccuauuucucuuuc

SEQ ID NO: 2160010 - RNA, 16 nt, Human
auccguauauaucccc

SEQ ID NO: 2160011 - RNA, 16 nt, Human
auccaagcaagacuga

SEQ ID NO: 2160012 - RNA, 13 nt, Human
uuuggcagaguuc

SEQ ID NO: 2160013 - RNA, 14 nt, Human
auguaugauuacau

SEQ ID NO: 2160014 - RNA, 19 nt, Human
auguauguucagaagaaau

SEQ ID NO: 2160015 - RNA, 20 nt, Human
auguauguucagaagaaauu

SEQ ID NO: 2160016 - RNA, 16 nt, Human
uuugugaaucuuugug

SEQ ID NO: 2160017 - RNA, 24 nt, Human
uuugugaaggccucgcaggaagac

SEQ ID NO: 2160018 - RNA, 15 nt, Human
augugauuuaaacaa

SEQ ID NO: 2160019 - RNA, 20 nt, Human
auguacgaugagaaauucaa

SEQ ID NO: 2160020 - RNA, 20 nt, Human
auguacuaggauacugcugc

SEQ ID NO: 2160021 - RNA, 21 nt, Human
uuugcaaggaagccacagcug

SEQ ID NO: 2160022 - RNA, 14 nt, Human
uuugcaaggaagcc

SEQ ID NO: 2160023 - RNA, 12 nt, Human
uuugcaaggaag

SEQ ID NO: 2160024 - RNA, 19 nt, Human
uuugacgggaaacaaaacu

SEQ ID NO: 2160025 - RNA, 18 nt, Human
augguuugcaaggaagcc

SEQ ID NO: 2160026 - RNA, 17 nt, Human
augguuugcaaggaagc

SEQ ID NO: 2160027 - RNA, 16 nt, Human
augguuugcaaggaag

SEQ ID NO: 2160028 - RNA, 22 nt, Human
augguuugaauauaaacacuau

SEQ ID NO: 2160029 - RNA, 21 nt, Human
augguuugaauauaaacacua

SEQ ID NO: 2160030 - RNA, 23 nt, Human
auggugcuuguuaaugcuuucug

SEQ ID NO: 2160031 - RNA, 16 nt, Human
uuucuuucacaaaaaa

SEQ ID NO: 2160032 - RNA, 12 nt, Human
auggggaugcag

SEQ ID NO: 2160033 - RNA, 20 nt, Human
uuugaaaaagaaaacacuua

SEQ ID NO: 2160034 - RNA, 18 nt, Human
augggugaaggcuggcau

SEQ ID NO: 2160035 - RNA, 17 nt, Human
augggugaaggcuggca

SEQ ID NO: 2160036 - RNA, 16 nt, Human
augggugaaggcuggc

SEQ ID NO: 2160037 - RNA, 15 nt, Human
augggugaaggcugg

SEQ ID NO: 2160038 - RNA, 21 nt, Human
auggguccaggauuccucuuu

SEQ ID NO: 2160039 - RNA, 19 nt, Human
auggguccaggauuccucu

SEQ ID NO: 2160040 - RNA, 14 nt, Human
augggugaaggcug

SEQ ID NO: 2160041 - RNA, 23 nt, Human
augcuaaagguuguauugcauau

SEQ ID NO: 2160042 - RNA, 20 nt, Human
augccucccccuagccauuu

SEQ ID NO: 2160043 - RNA, 24 nt, Human
augccucagcccugacccugugga

SEQ ID NO: 2160044 - RNA, 20 nt, Human
augccucagcccugacccug

SEQ ID NO: 2160045 - RNA, 18 nt, Human
augccaaaaaaagacagg

SEQ ID NO: 2160046 - RNA, 17 nt, Human
augccauggacagaaga

SEQ ID NO: 2160047 - RNA, 19 nt, Human
augccauggacagaagaag

SEQ ID NO: 2160048 - RNA, 18 nt, Human
augccauggacagaagaa

SEQ ID NO: 2160049 - RNA, 13 nt, Human
uuuaauuuaaagc

SEQ ID NO: 2160050 - RNA, 15 nt, Human
uuuaaguaacuuuaa

SEQ ID NO: 2160051 - RNA, 13 nt, Human
uuuaauuaaauaa

SEQ ID NO: 2160052 - RNA, 15 nt, Human
uuguucuuuguucuu

SEQ ID NO: 2160053 - RNA, 13 nt, Human
uuguucuuuuuau

SEQ ID NO: 2160054 - RNA, 21 nt, Human
uuguucccauccucuucuuuu

SEQ ID NO: 2160055 - RNA, 19 nt, Human
augauuaauuaaauagcuu

SEQ ID NO: 2160056 - RNA, 17 nt, Human
augauccaagcaagacu

SEQ ID NO: 2160057 - RNA, 15 nt, Human
augauccaagcaaga

SEQ ID NO: 2160058 - RNA, 24 nt, Human
augcaccugaauguuagauaguua

SEQ ID NO: 2160059 - RNA, 14 nt, Human
augcuauuugcaau

SEQ ID NO: 2160060 - RNA, 21 nt, Human
augcuauuugcaauuccugcu

SEQ ID NO: 2160061 - RNA, 17 nt, Human
uuuccaugaaaaugcaa

SEQ ID NO: 2160062 - RNA, 14 nt, Human
uuuccccuuuugca

SEQ ID NO: 2160063 - RNA, 15 nt, Human
auggcagugucuuuc

SEQ ID NO: 2160064 - RNA, 24 nt, Human
auggcccauucuacuugcucugga

SEQ ID NO: 2160065 - RNA, 23 nt, Human
auggcccauucuacuugcucugg

SEQ ID NO: 2160066 - RNA, 19 nt, Human
auggcccauucuacuugcu

SEQ ID NO: 2160067 - RNA, 17 nt, Human
auggcccauucuacuug

SEQ ID NO: 2160068 - RNA, 15 nt, Human
auggcccauucuacu

SEQ ID NO: 2160069 - RNA, 14 nt, Human
auggcagcugccac

SEQ ID NO: 2160070 - RNA, 21 nt, Human
auggcaggacgugggcugggc

SEQ ID NO: 2160071 - RNA, 20 nt, Human
auggcaggacgugggcuggg

SEQ ID NO: 2160072 - RNA, 13 nt, Human
auuaucuaauuua

SEQ ID NO: 2160073 - RNA, 14 nt, Human
auuaucuaauuuau

SEQ ID NO: 2160074 - RNA, 20 nt, Human
auucccaggaguucugcuca

SEQ ID NO: 2160075 - RNA, 18 nt, Human
auucccaggaguucugcu

SEQ ID NO: 2160076 - RNA, 12 nt, Human
auucccaggagu

SEQ ID NO: 2160077 - RNA, 11 nt, Human
auucccaggag

SEQ ID NO: 2160078 - RNA, 21 nt, Human
auucccaggaguucugcucau

SEQ ID NO: 2160079 - RNA, 19 nt, Human
auucuaacuuuuuugcuau

SEQ ID NO: 2160080 - RNA, 18 nt, Human
auucuaaugauggcccau

SEQ ID NO: 2160081 - RNA, 17 nt, Human
auucuaaugauggccca

SEQ ID NO: 2160082 - RNA, 21 nt, Human
auucuaaugauggcccauucu

SEQ ID NO: 2160083 - RNA, 23 nt, Human
auucuaaugauggcccauucuac

SEQ ID NO: 2160084 - RNA, 21 nt, Human
auucuuacaaacaugugguua

SEQ ID NO: 2160085 - RNA, 16 nt, Human
auucuuacaaacaugu

SEQ ID NO: 2160086 - RNA, 21 nt, Human
auucuuaagacuugcauuuaa

SEQ ID NO: 2160087 - RNA, 17 nt, Human
auucuuacaaacaugug

SEQ ID NO: 2160088 - RNA, 16 nt, Human
auucuucccauucucc

SEQ ID NO: 2160089 - RNA, 18 nt, Human
auucuucccauucuccau

SEQ ID NO: 2160090 - RNA, 17 nt, Human
auucuucccauucucca

SEQ ID NO: 2160091 - RNA, 22 nt, Human
auucuucccauucuccauuugu

SEQ ID NO: 2160092 - RNA, 13 nt, Human
auugacuuugucu

SEQ ID NO: 2160093 - RNA, 19 nt, Human
auucuaggccuccuggccc

SEQ ID NO: 2160094 - RNA, 18 nt, Human
auucuaggccuccuggcc

SEQ ID NO: 2160095 - RNA, 20 nt, Human
auucuaggccuccuggccca

SEQ ID NO: 2160096 - RNA, 12 nt, Human
auuuuuuaaagc

SEQ ID NO: 2160097 - RNA, 23 nt, Human
auuuuuuaaaaaucuauauuuug

SEQ ID NO: 2160098 - RNA, 15 nt, Human
auuuuuuaaaaacua

SEQ ID NO: 2160099 - RNA, 22 nt, Human
auuuuuuaaccccgucaacaaa

SEQ ID NO: 2160100 - RNA, 23 nt, Human
auuuuuuaaccccgucaacaaau

SEQ ID NO: 2160101 - RNA, 21 nt, Human
auuuuuuaaccccgucaacaa

SEQ ID NO: 2160102 - RNA, 21 nt, Human
auuuuuugguuaagcuuugac

SEQ ID NO: 2160103 - RNA, 20 nt, Human
auuuuucagaccuuuuaacu

SEQ ID NO: 2160104 - RNA, 17 nt, Human
auuuuguaacaaaugaa

SEQ ID NO: 2160105 - RNA, 19 nt, Human
auuuuguaacuuccaugug

SEQ ID NO: 2160106 - RNA, 19 nt, Human
auuuugcauaauaaaugcu

SEQ ID NO: 2160107 - RNA, 15 nt, Human
auuuugcauaauaaa

SEQ ID NO: 2160108 - RNA, 19 nt, Human
auuuugaucuucaacaaau

SEQ ID NO: 2160109 - RNA, 17 nt, Human
auuuugaucuucaacaa

SEQ ID NO: 2160110 - RNA, 20 nt, Human
auuuugaucuucaacaaauu

SEQ ID NO: 2160111 - RNA, 16 nt, Human
auuuugaucuucaaca

SEQ ID NO: 2160112 - RNA, 13 nt, Human
auuuugaucuuca

SEQ ID NO: 2160113 - RNA, 15 nt, Human
auuuuccaugaaaau

SEQ ID NO: 2160114 - RNA, 19 nt, Human
auuuuaagacguguuugug

SEQ ID NO: 2160115 - RNA, 20 nt, Human
auugggaaggggacccccgc

SEQ ID NO: 2160116 - RNA, 18 nt, Human
auuggguuccauucucac

SEQ ID NO: 2160117 - RNA, 16 nt, Human
auuuccaagagcugag

SEQ ID NO: 2160118 - RNA, 15 nt, Human
auuuccaagagcuga

SEQ ID NO: 2160119 - RNA, 16 nt, Human
auuuccccuuuugcau

SEQ ID NO: 2160120 - RNA, 22 nt, Human
auuuccccuuuugcauucuccc

SEQ ID NO: 2160121 - RNA, 21 nt, Human
auuuccccuuuugcauucucc

SEQ ID NO: 2160122 - RNA, 17 nt, Human
auuuggcuucuguuguc

SEQ ID NO: 2160123 - RNA, 20 nt, Human
auuuguccucuuuacaugaa

SEQ ID NO: 2160124 - RNA, 20 nt, Human
auuuuaagacguguuugugu

SEQ ID NO: 2160125 - RNA, 21 nt, Human
ggaaguuuuguggaggagcuc

SEQ ID NO: 2160126 - RNA, 13 nt, Human
ggaacuugagaac

SEQ ID NO: 2160127 - RNA, 20 nt, Human
ggaacuuauuaaauggaaac

SEQ ID NO: 2160128 - RNA, 16 nt, Human
ggacuccggcccuccu

SEQ ID NO: 2160129 - RNA, 13 nt, Human
ggacgugggcugg

SEQ ID NO: 2160130 - RNA, 15 nt, Human
ggacccccgcccccu

SEQ ID NO: 2160131 - RNA, 14 nt, Human
ggacccccgccccc

SEQ ID NO: 2160132 - RNA, 22 nt, Human
ggacccccgcccccugcccucc

SEQ ID NO: 2160133 - RNA, 20 nt, Human
ggacccccgcccccugcccu

SEQ ID NO: 2160134 - RNA, 19 nt, Human
ggacccccgcccccugccc

SEQ ID NO: 2160135 - RNA, 16 nt, Human
ggacccccgcccccug

SEQ ID NO: 2160136 - RNA, 23 nt, Human
ggacccccgcccccugcccuccc

SEQ ID NO: 2160137 - RNA, 15 nt, Human
ggacggcugggcaca

SEQ ID NO: 2160138 - RNA, 21 nt, Human
gcuuucuuucacaaaaaagaa

SEQ ID NO: 2160139 - RNA, 21 nt, Human
gcuuugaaagccccagaaauc

SEQ ID NO: 2160140 - RNA, 12 nt, Human
gcuggagugagg

SEQ ID NO: 2160141 - RNA, 19 nt, Human
gcccucaaacuugacucua

SEQ ID NO: 2160142 - RNA, 14 nt, Human
gcccccccuuccac

SEQ ID NO: 2160143 - RNA, 13 nt, Human
gcccccccuucca

SEQ ID NO: 2160144 - RNA, 15 nt, Human
gcccccccuuccacu

SEQ ID NO: 2160145 - RNA, 16 nt, Human
gccuaggccaggugca

SEQ ID NO: 2160146 - RNA, 14 nt, Human
gccuaggccaggug

SEQ ID NO: 2160147 - RNA, 13 nt, Human
gccuaggccaggu

SEQ ID NO: 2160148 - RNA, 13 nt, Human
gcgcacugccucu

SEQ ID NO: 2160149 - RNA, 15 nt, Human
gcgcaccgaaaaacu

SEQ ID NO: 2160150 - RNA, 15 nt, Human
gccuccaucagcuaa

SEQ ID NO: 2160151 - RNA, 14 nt, Human
gccuccauccuagu

SEQ ID NO: 2160152 - RNA, 19 nt, Human
gcgugcagggacaaagagg

SEQ ID NO: 2160153 - RNA, 18 nt, Human
gcgugcagggacaaagag

SEQ ID NO: 2160154 - RNA, 16 nt, Human
gcucagaccagcucuu

SEQ ID NO: 2160155 - RNA, 15 nt, Human
gcucagggaaaagca

SEQ ID NO: 2160156 - RNA, 17 nt, Human
gcucagggaaaagcagc

SEQ ID NO: 2160157 - RNA, 22 nt, Human
gcuauuuuuauuuguuugugca

SEQ ID NO: 2160158 - RNA, 22 nt, Human
gcuauugauauaaauaaaacau

SEQ ID NO: 2160159 - RNA, 19 nt, Human
gcuauuugcaauuccugcu

SEQ ID NO: 2160160 - RNA, 17 nt, Human
gcuauuugcaauuccug

SEQ ID NO: 2160161 - RNA, 19 nt, Human
gcuccugagggagcuccaa

SEQ ID NO: 2160162 - RNA, 17 nt, Human
gcuccugagggagcucc

SEQ ID NO: 2160163 - RNA, 20 nt, Human
gcuccccucugcacggacca

SEQ ID NO: 2160164 - RNA, 14 nt, Human
aaagacagagcugg

SEQ ID NO: 2160165 - RNA, 22 nt, Human
aaagacagggcugauaagcuaa

SEQ ID NO: 2160166 - RNA, 19 nt, Human
aaacuuccagugcaacacu

SEQ ID NO: 2160167 - RNA, 21 nt, Human
aaacuuccagugcaacacuga

SEQ ID NO: 2160168 - RNA, 22 nt, Human
aaacuuccagugcaacacugaa

SEQ ID NO: 2160169 - RNA, 20 nt, Human
aaacuuuccucuuccugccu

SEQ ID NO: 2160170 - RNA, 13 nt, Human
aaaggaagaaaaa

SEQ ID NO: 2160171 - RNA, 20 nt, Human
aaaggagccuaggccaggug

SEQ ID NO: 2160172 - RNA, 21 nt, Human
aaagcugcucagggaaaagca

SEQ ID NO: 2160173 - RNA, 12 nt, Human
ggugcaaccagg

SEQ ID NO: 2160174 - RNA, 17 nt, Human
ggucgacuucgggcugg

SEQ ID NO: 2160175 - RNA, 15 nt, Human
gguggaguuaaucuu

SEQ ID NO: 2160176 - RNA, 12 nt, Human
ggugcagguaga

SEQ ID NO: 2160177 - RNA, 17 nt, Human
ggugcagccagaggcac

SEQ ID NO: 2160178 - RNA, 13 nt, Human
ggugcagccagag

SEQ ID NO: 2160179 - RNA, 20 nt, Human
aaacuaggggacaaagcaaa

SEQ ID NO: 2160180 - RNA, 11 nt, Human
aaaccucuccu

SEQ ID NO: 2160181 - RNA, 22 nt, Human
aaaccucuccucauguucugcu

SEQ ID NO: 2160182 - RNA, 17 nt, Human
ggguccagggagcaggc

SEQ ID NO: 2160183 - RNA, 20 nt, Human
ggguccaggauuccucuuuu

SEQ ID NO: 2160184 - RNA, 16 nt, Human
ggguccagggagcagg

SEQ ID NO: 2160185 - RNA, 18 nt, Human
ggguccaggauuccucuu

SEQ ID NO: 2160186 - RNA, 17 nt, Human
ggguccagaaggagaca

SEQ ID NO: 2160187 - RNA, 17 nt, Human
gggucgacuucgggcug

SEQ ID NO: 2160188 - RNA, 15 nt, Human
ggggacccccgcccc

SEQ ID NO: 2160189 - RNA, 13 nt, Human
ggggacccccgcc

SEQ ID NO: 2160190 - RNA, 18 nt, Human
ggggacccccgcccccug

SEQ ID NO: 2160191 - RNA, 20 nt, Human
aaacaugugguuacacagug

SEQ ID NO: 2160192 - RNA, 15 nt, Human
ggggaauucaucucu

SEQ ID NO: 2160193 - RNA, 22 nt, Human
aaacaauguuaacauuuuuggu

SEQ ID NO: 2160194 - RNA, 15 nt, Human
aaauauacacacagc

SEQ ID NO: 2160195 - RNA, 14 nt, Human
aaaguuauucuuga

SEQ ID NO: 2160196 - RNA, 18 nt, Human
aaauaaccaaucuacaau

SEQ ID NO: 2160197 - RNA, 21 nt, Human
aaauaacuggaggaauuuucu

SEQ ID NO: 2160198 - RNA, 20 nt, Human
guacucaucaucaacccuaa

SEQ ID NO: 2160199 - RNA, 18 nt, Human
guacuaggauacugcugc

SEQ ID NO: 2160200 - RNA, 22 nt, Human
guacuaggauacugcugcguca

SEQ ID NO: 2160201 - RNA, 19 nt, Human
guacuggcugauggaguaa

SEQ ID NO: 2160202 - RNA, 17 nt, Human
guagaauuaucuaauuu

SEQ ID NO: 2160203 - RNA, 22 nt, Human
guagaauuaucuaauuuauaaa

SEQ ID NO: 2160204 - RNA, 22 nt, Human
guagaacacaaggucauuugcu

SEQ ID NO: 2160205 - RNA, 19 nt, Human
guagaccugucuccuggcg

SEQ ID NO: 2160206 - RNA, 21 nt, Human
guagaccugucuccuggcggu

SEQ ID NO: 2160207 - RNA, 21 nt, Human
guaccaugugcuacaggggcc

SEQ ID NO: 2160208 - RNA, 15 nt, Human
guaccaccaaaaaag

SEQ ID NO: 2160209 - RNA, 12 nt, Human
aaaacucuuuua

SEQ ID NO: 2160210 - RNA, 23 nt, Human
aaaacugaaagugaaaguccaga

SEQ ID NO: 2160211 - RNA, 15 nt, Human
gggacauugggaagg

SEQ ID NO: 2160212 - RNA, 11 nt, Human
aaaaccaggcc

SEQ ID NO: 2160213 - RNA, 22 nt, Human
aaaagccagcaggcuucaaacu

SEQ ID NO: 2160214 - RNA, 24 nt, Human
gggagcaggcggugggcacccacc

SEQ ID NO: 2160215 - RNA, 17 nt, Human
gggagggucagccaggg

SEQ ID NO: 2160216 - RNA, 16 nt, Human
ggcuucucugaggaag

SEQ ID NO: 2160217 - RNA, 15 nt, Human
ggcuucucugaggaa

SEQ ID NO: 2160218 - RNA, 18 nt, Human
ggcaguuuaaagcacaau

SEQ ID NO: 2160219 - RNA, 23 nt, Human
ggcacugaagggauaugugaaac

SEQ ID NO: 2160220 - RNA, 16 nt, Human
ggcccuccuacccugc

SEQ ID NO: 2160221 - RNA, 21 nt, Human
ggcccuccuacccugcgccca

SEQ ID NO: 2160222 - RNA, 19 nt, Human
ggcccuccuacccugcgcc

SEQ ID NO: 2160223 - RNA, 17 nt, Human
ggcccuccuacccugcg

SEQ ID NO: 2160224 - RNA, 20 nt, Human
ggcccuccuacccugcgccc

SEQ ID NO: 2160225 - RNA, 23 nt, Human
gagugccccauucuuuuguaauu

SEQ ID NO: 2160226 - RNA, 19 nt, Human
gagguggagguugcaguga

SEQ ID NO: 2160227 - RNA, 21 nt, Human
gagaagcucucgggcuaggaa

SEQ ID NO: 2160228 - RNA, 22 nt, Human
gaagcauggugcccuggcuucu

SEQ ID NO: 2160229 - RNA, 20 nt, Human
gacucaagauucccaggagu

SEQ ID NO: 2160230 - RNA, 19 nt, Human
gacucaagauucccaggag

SEQ ID NO: 2160231 - RNA, 18 nt, Human
gacucaagauucccagga

SEQ ID NO: 2160232 - RNA, 17 nt, Human
gacucaagauucccagg

SEQ ID NO: 2160233 - RNA, 16 nt, Human
gacucaagauucccag

SEQ ID NO: 2160234 - RNA, 12 nt, Human
gacucaagauuc

SEQ ID NO: 2160235 - RNA, 22 nt, Human
gacucaaaugcucagaccagcu

SEQ ID NO: 2160236 - RNA, 18 nt, Human
gacuauauuguacacacc

SEQ ID NO: 2160237 - RNA, 22 nt, Human
gacucaagauucccaggaguuc

SEQ ID NO: 2160238 - RNA, 19 nt, Human
gacucacaaccugaaccua

SEQ ID NO: 2160239 - RNA, 18 nt, Human
gacucacaaccugaaccu

SEQ ID NO: 2160240 - RNA, 23 nt, Human
gacucacaccugaacugaacacc

SEQ ID NO: 2160241 - RNA, 14 nt, Human
gacucacaccugaa

SEQ ID NO: 2160242 - RNA, 22 nt, Human
gcacugaagggauaugugaaac

SEQ ID NO: 2160243 - RNA, 20 nt, Human
gcacucuuuaagggagugua

SEQ ID NO: 2160244 - RNA, 17 nt, Human
gcacugaaaaaaaaucu

SEQ ID NO: 2160245 - RNA, 14 nt, Human
gcagggacaaagag

SEQ ID NO: 2160246 - RNA, 21 nt, Human
gcagggacaaagaggccuuua

SEQ ID NO: 2160247 - RNA, 15 nt, Human
gcagggacaaagagg

SEQ ID NO: 2160248 - RNA, 22 nt, Human
gcauguacccuaaggucauuac

SEQ ID NO: 2160249 - RNA, 16 nt, Human
gccaaccuauuuugaa

SEQ ID NO: 2160250 - RNA, 22 nt, Human
gcauugugugugcagacuucag

SEQ ID NO: 2160251 - RNA, 22 nt, Human
gccaacccuucuccucuuguaa

SEQ ID NO: 2160252 - RNA, 13 nt, Human
gccaacccuucuc

SEQ ID NO: 2160253 - RNA, 23 nt, Human
gccaacccuucuccucuuguaaa

SEQ ID NO: 2160254 - RNA, 15 nt, Human
gccaaccuauuuuga

SEQ ID NO: 2160255 - RNA, 21 nt, Human
gccaaggagggugagugcaag

SEQ ID NO: 2160256 - RNA, 20 nt, Human
gccaaggagggugagugcaa

SEQ ID NO: 2160257 - RNA, 13 nt, Human
gaugcugugaaau

SEQ ID NO: 2160258 - RNA, 19 nt, Human
gaugcugugaaauucccaa

SEQ ID NO: 2160259 - RNA, 17 nt, Human
cuugggucccagggaag

SEQ ID NO: 2160260 - RNA, 17 nt, Human
cuuucagcagacugauc

SEQ ID NO: 2160261 - RNA, 20 nt, Human
cuuugguuuaauuuaaagcc

SEQ ID NO: 2160262 - RNA, 19 nt, Human
cuuugguuauauuuagcuc

SEQ ID NO: 2160263 - RNA, 21 nt, Human
gaagacacugaaauauacaca

SEQ ID NO: 2160264 - RNA, 19 nt, Human
gaagacccaacacauggga

SEQ ID NO: 2160265 - RNA, 14 nt, Human
gaagacauugcacc

SEQ ID NO: 2160266 - RNA, 15 nt, Human
gaaccaggcuuggaa

SEQ ID NO: 2160267 - RNA, 16 nt, Human
gaaccauguuuguggc

SEQ ID NO: 2160268 - RNA, 19 nt, Human
gaacaccauugaaggcuua

SEQ ID NO: 2160269 - RNA, 20 nt, Human
gaacaccauugaaggcuuaa

SEQ ID NO: 2160270 - RNA, 20 nt, Human
gaacaauauugacuuugucu

SEQ ID NO: 2160271 - RNA, 19 nt, Human
gaacaauauugacuuuguc

SEQ ID NO: 2160272 - RNA, 16 nt, Human
gaacaccauugaaggc

SEQ ID NO: 2160273 - RNA, 20 nt, Human
gaaaggggcaguuuaaagca

SEQ ID NO: 2160274 - RNA, 15 nt, Human
gaaacaacagcuuua

SEQ ID NO: 2160275 - RNA, 21 nt, Human
gaaacaacagcuuuaaaagaa

SEQ ID NO: 2160276 - RNA, 21 nt, Human
cuguugucaccuucaccuccu

SEQ ID NO: 2160277 - RNA, 23 nt, Human
cuguugucaccuucaccuccuuu

SEQ ID NO: 2160278 - RNA, 18 nt, Human
cuguugucaccuucaccu

SEQ ID NO: 2160279 - RNA, 17 nt, Human
cuguugucaccuucacc

SEQ ID NO: 2160280 - RNA, 23 nt, Human
cuguucaauguuuuuaaaaaucu

SEQ ID NO: 2160281 - RNA, 22 nt, Human
cuguucaauguuuuuaaaaauc

SEQ ID NO: 2160282 - RNA, 16 nt, Human
cuguacugggccaugu

SEQ ID NO: 2160283 - RNA, 15 nt, Human
cuguccuccaagcca

SEQ ID NO: 2160284 - RNA, 17 nt, Human
cuguccuccaagccagc

SEQ ID NO: 2160285 - RNA, 14 nt, Human
cugucauagaaagu

SEQ ID NO: 2160286 - RNA, 23 nt, Human
cuguguauuuuuuaaagcuacaa

SEQ ID NO: 2160287 - RNA, 19 nt, Human
cuguguauuuuuuaaagcu

SEQ ID NO: 2160288 - RNA, 23 nt, Human
cugccuccgcgugaucaaagcca

SEQ ID NO: 2160289 - RNA, 23 nt, Human
cugcucagggaaaagcagcucuc

SEQ ID NO: 2160290 - RNA, 22 nt, Human
cugcucagggaaaagcagcucu

SEQ ID NO: 2160291 - RNA, 14 nt, Human
cuggacugaccugg

SEQ ID NO: 2160292 - RNA, 21 nt, Human
cuggacugaccugguccacag

SEQ ID NO: 2160293 - RNA, 13 nt, Human
cauaauuucagcu

SEQ ID NO: 2160294 - RNA, 22 nt, Human
cauccuucccugucugccaggg

SEQ ID NO: 2160295 - RNA, 18 nt, Human
cauccuuccucacaccag

SEQ ID NO: 2160296 - RNA, 21 nt, Human
cauccuucccugucugccagg

SEQ ID NO: 2160297 - RNA, 15 nt, Human
cauccuucccugucu

SEQ ID NO: 2160298 - RNA, 16 nt, Human
cauccccugccuccau

SEQ ID NO: 2160299 - RNA, 13 nt, Human
cauccccugccuc

SEQ ID NO: 2160300 - RNA, 22 nt, Human
cauccccugccuccauccuagu

SEQ ID NO: 2160301 - RNA, 15 nt, Human
cauccccugccucca

SEQ ID NO: 2160302 - RNA, 14 nt, Human
cauccccugccucc

SEQ ID NO: 2160303 - RNA, 18 nt, Human
caugaagguuucugaaaa

SEQ ID NO: 2160304 - RNA, 15 nt, Human
caugaagguuucuga

SEQ ID NO: 2160305 - RNA, 20 nt, Human
cauguauaauauuuuuaauu

SEQ ID NO: 2160306 - RNA, 18 nt, Human
cauguauaauauuuuuaa

SEQ ID NO: 2160307 - RNA, 15 nt, Human
cauguauaauauuuu

SEQ ID NO: 2160308 - RNA, 18 nt, Human
cauguugcuguuuccagu

SEQ ID NO: 2160309 - RNA, 21 nt, Human
cauuaugaugugggucaagga

SEQ ID NO: 2160310 - RNA, 24 nt, Human
ccaacggcaagggaacaaguacuu

SEQ ID NO: 2160311 - RNA, 18 nt, Human
ccaaucccagcuaccuca

SEQ ID NO: 2160312 - RNA, 12 nt, Human
cauuggaaauua

SEQ ID NO: 2160313 - RNA, 22 nt, Human
ccacacuggacuccggcccucc

SEQ ID NO: 2160314 - RNA, 21 nt, Human
ccacacuggacuccggcccuc

SEQ ID NO: 2160315 - RNA, 14 nt, Human
ccaccagucauuuu

SEQ ID NO: 2160316 - RNA, 20 nt, Human
cagagcugggauguuucugu

SEQ ID NO: 2160317 - RNA, 17 nt, Human
cagaggggcagauggaa

SEQ ID NO: 2160318 - RNA, 14 nt, Human
cagaggggcagaug

SEQ ID NO: 2160319 - RNA, 15 nt, Human
cagcguacucaucau

SEQ ID NO: 2160320 - RNA, 23 nt, Human
caggugaguccuagagcuacagg

SEQ ID NO: 2160321 - RNA, 22 nt, Human
caggugaguccuagagcuacag

SEQ ID NO: 2160322 - RNA, 16 nt, Human
caggugcagccagagg

SEQ ID NO: 2160323 - RNA, 15 nt, Human
caggugcagccagag

SEQ ID NO: 2160324 - RNA, 14 nt, Human
caggugcagccaga

SEQ ID NO: 2160325 - RNA, 19 nt, Human
caggugcagccagaggcac

SEQ ID NO: 2160326 - RNA, 17 nt, Human
caggugcagccagaggc

SEQ ID NO: 2160327 - RNA, 20 nt, Human
caggugaguccuagagcuac

SEQ ID NO: 2160328 - RNA, 22 nt, Human
cagucugaugagaacucugagc

SEQ ID NO: 2160329 - RNA, 15 nt, Human
caguccuuccaccuc

SEQ ID NO: 2160330 - RNA, 15 nt, Human
cagucugaucuguga

SEQ ID NO: 2160331 - RNA, 17 nt, Human
caggcggugggcaccca

SEQ ID NO: 2160332 - RNA, 15 nt, Human
caggcggugggcacc

SEQ ID NO: 2160333 - RNA, 21 nt, Human
caggcggugggcacccacccu

SEQ ID NO: 2160334 - RNA, 12 nt, Human
caggagcuuccu

SEQ ID NO: 2160335 - RNA, 23 nt, Human
caggagcuuccuguccucccagc

SEQ ID NO: 2160336 - RNA, 20 nt, Human
auugugugugcucugcuuca

SEQ ID NO: 2160337 - RNA, 19 nt, Human
auugugugugcucugcuuc

SEQ ID NO: 2160338 - RNA, 12 nt, Human
auuucauaaaga

SEQ ID NO: 2160339 - RNA, 12 nt, Human
auuccuuuccag

SEQ ID NO: 2160340 - RNA, 13 nt, Human
auucuugcauauu

SEQ ID NO: 2160341 - RNA, 12 nt, Human
auucuugcauau

SEQ ID NO: 2160342 - RNA, 16 nt, Human
auucaauauccuuugc

SEQ ID NO: 2160343 - RNA, 19 nt, Human
auucaauauccuuugccuc

SEQ ID NO: 2160344 - RNA, 21 nt, Human
caaaugcuaaugucaaacuug

SEQ ID NO: 2160345 - RNA, 15 nt, Human
caaaugcuaauguca

SEQ ID NO: 2160346 - RNA, 22 nt, Human
caacaaaucuaggaaaauauuu

SEQ ID NO: 2160347 - RNA, 16 nt, Human
caaaggguccagaagg

SEQ ID NO: 2160348 - RNA, 21 nt, Human
caaaggguccagaaggagaca

SEQ ID NO: 2160349 - RNA, 17 nt, Human
caaaggguccagaagga

SEQ ID NO: 2160350 - RNA, 22 nt, Human
caacaacauguauaauauuuuu

SEQ ID NO: 2160351 - RNA, 21 nt, Human
caacaacauguauaauauuuu

SEQ ID NO: 2160352 - RNA, 17 nt, Human
caacuacagaaaaacca

SEQ ID NO: 2160353 - RNA, 19 nt, Human
caaccagggagcugcaggg

SEQ ID NO: 2160354 - RNA, 22 nt, Human
caaccagggauuguuucuguuu

SEQ ID NO: 2160355 - RNA, 17 nt, Human
caaccagggagcugcag

SEQ ID NO: 2160356 - RNA, 18 nt, Human
auuuucuucaccucugcu

SEQ ID NO: 2160357 - RNA, 20 nt, Human
caaacaugugguuaaugcca

SEQ ID NO: 2160358 - RNA, 21 nt, Human
cacugggaggccagugagcca

SEQ ID NO: 2160359 - RNA, 14 nt, Human
cacugggaggccag

SEQ ID NO: 2160360 - RNA, 23 nt, Human
cacucugugucugaguggcuuca

SEQ ID NO: 2160361 - RNA, 17 nt, Human
cacucugugucugagug

SEQ ID NO: 2160362 - RNA, 22 nt, Human
caccuuucauaaucuuugcuuu

SEQ ID NO: 2160363 - RNA, 16 nt, Human
caccuuucuccuuugu

SEQ ID NO: 2160364 - RNA, 21 nt, Human
caccuuuguuuagaacacugg

SEQ ID NO: 2160365 - RNA, 17 nt, Human
caauuuccaagagcuga

SEQ ID NO: 2160366 - RNA, 18 nt, Human
caauggcuuacuccagga

SEQ ID NO: 2160367 - RNA, 19 nt, Human
caauggcuaccuaaaaaga

SEQ ID NO: 2160368 - RNA, 12 nt, Human
caaucccagcua

SEQ ID NO: 2160369 - RNA, 17 nt, Human
caaucccagcuaccuca

SEQ ID NO: 2160370 - RNA, 20 nt, Human
caaucauauuaauacaauga

SEQ ID NO: 2160371 - RNA, 20 nt, Human
caccaggcuugccugcaggc

SEQ ID NO: 2160372 - RNA, 22 nt, Human
cacagggacugaaaaccucucc

SEQ ID NO: 2160373 - RNA, 15 nt, Human
cccagggaaguuuug

SEQ ID NO: 2160374 - RNA, 21 nt, Human
cccagccaggccccaggcagg

SEQ ID NO: 2160375 - RNA, 21 nt, Human
cccacugggguccagggagca

SEQ ID NO: 2160376 - RNA, 16 nt, Human
cccauccccuguggga

SEQ ID NO: 2160377 - RNA, 22 nt, Human
cccaucgccagcugaugacuca

SEQ ID NO: 2160378 - RNA, 21 nt, Human
cccaucgccagcugaugacuc

SEQ ID NO: 2160379 - RNA, 20 nt, Human
cccauccucuucuuuuagca

SEQ ID NO: 2160380 - RNA, 19 nt, Human
cccauccucuucuuuuagc

SEQ ID NO: 2160381 - RNA, 15 nt, Human
cccucacucucuaca

SEQ ID NO: 2160382 - RNA, 22 nt, Human
ccagcuauugauauaaauaaaa

SEQ ID NO: 2160383 - RNA, 23 nt, Human
ccaguuccuuucaaugguuugca

SEQ ID NO: 2160384 - RNA, 22 nt, Human
ccaugaugacaacuacagaaaa

SEQ ID NO: 2160385 - RNA, 18 nt, Human
cccaagaccucagggcac

SEQ ID NO: 2160386 - RNA, 15 nt, Human
ccucgcaggaagacc

SEQ ID NO: 2160387 - RNA, 12 nt, Human
ccucgcuuggac

SEQ ID NO: 2160388 - RNA, 20 nt, Human
ccuccgcgugaucaaagcca

SEQ ID NO: 2160389 - RNA, 15 nt, Human
ccucccaggcucuca

SEQ ID NO: 2160390 - RNA, 22 nt, Human
ccgguucacucuucucagccac

SEQ ID NO: 2160391 - RNA, 17 nt, Human
cccuucuccucuuguaa

SEQ ID NO: 2160392 - RNA, 20 nt, Human
cccuucuccucuuguaaaua

SEQ ID NO: 2160393 - RNA, 18 nt, Human
cccuucuccucuuguaaa

SEQ ID NO: 2160394 - RNA, 14 nt, Human
ccuggauguugcug

SEQ ID NO: 2160395 - RNA, 13 nt, Human
ccugucuccuggc

SEQ ID NO: 2160396 - RNA, 16 nt, Human
ccugucuccuggcggu

SEQ ID NO: 2160397 - RNA, 19 nt, Human
ccugccucaggccucugug

SEQ ID NO: 2160398 - RNA, 19 nt, Human
ccugauaagcuucaaagcu

SEQ ID NO: 2160399 - RNA, 15 nt, Human
ccugagggagcucca

SEQ ID NO: 2160400 - RNA, 22 nt, Human
ccugagggaucuauacuugcuu

SEQ ID NO: 2160401 - RNA, 13 nt, Human
ccugagggagcuc

SEQ ID NO: 2160402 - RNA, 22 nt, Human
cucaaaggccagaccugcagac

SEQ ID NO: 2160403 - RNA, 13 nt, Human
cucaaaggccaga

SEQ ID NO: 2160404 - RNA, 19 nt, Human
cuauguggauuuuuuccua

SEQ ID NO: 2160405 - RNA, 18 nt, Human
cuauguggauuuuuuccu

SEQ ID NO: 2160406 - RNA, 17 nt, Human
cucacaaccugaaccua

SEQ ID NO: 2160407 - RNA, 16 nt, Human
cucacaaccugaaccu

SEQ ID NO: 2160408 - RNA, 20 nt, Human
cucacaaccugaaccuagga

SEQ ID NO: 2160409 - RNA, 19 nt, Human
cucaccuauccacacaaca

SEQ ID NO: 2160410 - RNA, 16 nt, Human
cucaccucuaaaacag

SEQ ID NO: 2160411 - RNA, 22 nt, Human
cucagaagggagcuagccagag

SEQ ID NO: 2160412 - RNA, 21 nt, Human
cucagaagggagcuagccaga

SEQ ID NO: 2160413 - RNA, 18 nt, Human
cuacucaaguagcauuua

SEQ ID NO: 2160414 - RNA, 17 nt, Human
cuacucaaguagcauuu

SEQ ID NO: 2160415 - RNA, 20 nt, Human
cuacucaaguagcauuuacu

SEQ ID NO: 2160416 - RNA, 13 nt, Human
cuacuaaaacuac

SEQ ID NO: 2160417 - RNA, 18 nt, Human
cuaggccuccuggcccag

SEQ ID NO: 2160418 - RNA, 17 nt, Human
cuaggccuccuggccca

SEQ ID NO: 2160419 - RNA, 19 nt, Human
cuaggccuccuggcccagg

SEQ ID NO: 2160420 - RNA, 16 nt, Human
cgcauccccugccucc

SEQ ID NO: 2160421 - RNA, 15 nt, Human
cgcauccccugccuc

SEQ ID NO: 2160422 - RNA, 14 nt, Human
cgcauccccugccu

SEQ ID NO: 2160423 - RNA, 13 nt, Human
cgcauccccugcc

SEQ ID NO: 2160424 - RNA, 18 nt, Human
cgcauccccugccuccau

SEQ ID NO: 2160425 - RNA, 22 nt, Human
cgguucacucuucucagccacu

SEQ ID NO: 2160426 - RNA, 19 nt, Human
cgguuccucguucucccug

SEQ ID NO: 2160427 - RNA, 21 nt, Human
cgguuccucguucucccuggg

SEQ ID NO: 2160428 - RNA, 12 nt, Human
cguguuuguguu

SEQ ID NO: 2160429 - RNA, 21 nt, Human
cuccccaucgccagcugauga

SEQ ID NO: 2160430 - RNA, 23 nt, Human
cuccccaucgccagcugaugacu

SEQ ID NO: 2160431 - RNA, 19 nt, Human
cugaggaagcugggguuca

SEQ ID NO: 2160432 - RNA, 14 nt, Human
cugacaccuuucau

SEQ ID NO: 2160433 - RNA, 18 nt, Human
acucaaaugcucagacca

SEQ ID NO: 2160434 - RNA, 21 nt, Human
acucaaaugcucagaccagcu

SEQ ID NO: 2160435 - RNA, 23 nt, Human
acucaaaugcucagaccagcucu

SEQ ID NO: 2160436 - RNA, 22 nt, Human
acucauauuacugguaggaacu

SEQ ID NO: 2160437 - RNA, 15 nt, Human
acucauauuacuggu

SEQ ID NO: 2160438 - RNA, 13 nt, Human
acucauauuacug

SEQ ID NO: 2160439 - RNA, 17 nt, Human
accugucuccuggcggu

SEQ ID NO: 2160440 - RNA, 19 nt, Human
accuuucauaaucuuugcu

SEQ ID NO: 2160441 - RNA, 21 nt, Human
accuuucauaaucuuugcuuu

SEQ ID NO: 2160442 - RNA, 20 nt, Human
accuuucauaaucuuugcuu

SEQ ID NO: 2160443 - RNA, 22 nt, Human
acuaauucuugcauauuuugua

SEQ ID NO: 2160444 - RNA, 14 nt, Human
acuaauucuugcau

SEQ ID NO: 2160445 - RNA, 17 nt, Human
acgcuuugggagaaugu

SEQ ID NO: 2160446 - RNA, 19 nt, Human
acgcuuucagcgaaugaca

SEQ ID NO: 2160447 - RNA, 19 nt, Human
acuucacgcuuucagcgaa

SEQ ID NO: 2160448 - RNA, 15 nt, Human
acuggagccaugggc

SEQ ID NO: 2160449 - RNA, 20 nt, Human
acugguaggaacuugagaac

SEQ ID NO: 2160450 - RNA, 15 nt, Human
acucugucuaaaaaa

SEQ ID NO: 2160451 - RNA, 19 nt, Human
agaaagguuuugagcaugg

SEQ ID NO: 2160452 - RNA, 21 nt, Human
agaaagguuuugagcaugggu

SEQ ID NO: 2160453 - RNA, 20 nt, Human
agaaaggggcaguuuaaagc

SEQ ID NO: 2160454 - RNA, 20 nt, Human
agaaaauggaaccaggcuug

SEQ ID NO: 2160455 - RNA, 19 nt, Human
agaaaauggaaccaggcuu

SEQ ID NO: 2160456 - RNA, 19 nt, Human
acuuuucauauuugcacua

SEQ ID NO: 2160457 - RNA, 12 nt, Human
acuuuauuucca

SEQ ID NO: 2160458 - RNA, 21 nt, Human
acuuuauuuccaaguuguuca

SEQ ID NO: 2160459 - RNA, 21 nt, Human
acacagacuguugucccugca

SEQ ID NO: 2160460 - RNA, 15 nt, Human
acaacuacagaaaaa

SEQ ID NO: 2160461 - RNA, 20 nt, Human
acaacuacagaaaaaccaga

SEQ ID NO: 2160462 - RNA, 19 nt, Human
acaacuacagaaaaaccag

SEQ ID NO: 2160463 - RNA, 15 nt, Human
acaggaugcuuuggu

SEQ ID NO: 2160464 - RNA, 23 nt, Human
acacugcuuguguuuuuaacuca

SEQ ID NO: 2160465 - RNA, 16 nt, Human
acacuggacuccggcc

SEQ ID NO: 2160466 - RNA, 19 nt, Human
acacugcuuguguuuuuaa

SEQ ID NO: 2160467 - RNA, 17 nt, Human
acagaggcuauuguccc

SEQ ID NO: 2160468 - RNA, 13 nt, Human
accagaggcagcu

SEQ ID NO: 2160469 - RNA, 22 nt, Human
accccucccucacucccaccug

SEQ ID NO: 2160470 - RNA, 13 nt, Human
aacaacauguaua

SEQ ID NO: 2160471 - RNA, 21 nt, Human
aacacauuaagccuuccacac

SEQ ID NO: 2160472 - RNA, 19 nt, Human
aacaccauugaaggcuuaa

SEQ ID NO: 2160473 - RNA, 15 nt, Human
aacaccauugaaggc

SEQ ID NO: 2160474 - RNA, 17 nt, Human
aacaccauugaaggcuu

SEQ ID NO: 2160475 - RNA, 14 nt, Human
aacacgcaggagca

SEQ ID NO: 2160476 - RNA, 13 nt, Human
aacacgcaggagc

SEQ ID NO: 2160477 - RNA, 21 nt, Human
aaauuaacacugcuuguguuu

SEQ ID NO: 2160478 - RNA, 18 nt, Human
aaauuaacagaaaaacag

SEQ ID NO: 2160479 - RNA, 13 nt, Human
aaauuaacacugc

SEQ ID NO: 2160480 - RNA, 12 nt, Human
aaauuaacacug

SEQ ID NO: 2160481 - RNA, 19 nt, Human
aaccuaggagugccccauu

SEQ ID NO: 2160482 - RNA, 21 nt, Human
aacccuaaaaagcagagcuuu

SEQ ID NO: 2160483 - RNA, 14 nt, Human
aaccagaggcagcu

SEQ ID NO: 2160484 - RNA, 23 nt, Human
aacccuucuccucuuguaaauaa

SEQ ID NO: 2160485 - RNA, 13 nt, Human
aacuuaacaugaa

SEQ ID NO: 2160486 - RNA, 18 nt, Human
aacugagauccuuccuuu

SEQ ID NO: 2160487 - RNA, 19 nt, Human
aacgcucucuacucugcuu

SEQ ID NO: 2160488 - RNA, 15 nt, Human
aacgcagacacugag

SEQ ID NO: 2160489 - RNA, 12 nt, Human
aacucagaaggg

SEQ ID NO: 2160490 - RNA, 19 nt, Human
aaagccacaaccacauaca

SEQ ID NO: 2160491 - RNA, 17 nt, Human
aaaggccagaccugcag

SEQ ID NO: 2160492 - RNA, 20 nt, Human
aaaggccagaccugcagacg

SEQ ID NO: 2160493 - RNA, 12 nt, Human
aaaguccccaga

SEQ ID NO: 2160494 - RNA, 19 nt, Human
aaauaaaguuggucuuuug

SEQ ID NO: 2160495 - RNA, 15 nt, Human
aaauagcuucuguuu

SEQ ID NO: 2160496 - RNA, 12 nt, Human
aaaaagaaauga

SEQ ID NO: 2160497 - RNA, 21 nt, Human
aaacacgcacuuagucucuaa

SEQ ID NO: 2160498 - RNA, 14 nt, Human
aaagaaaugcaaaa

SEQ ID NO: 2160499 - RNA, 13 nt, Human
aaagaaaugcaaa

SEQ ID NO: 2160500 - RNA, 22 nt, Human
aaacugagauccuuccuuuuga

SEQ ID NO: 2160501 - RNA, 13 nt, Human
aaagaaauaucug

SEQ ID NO: 2160502 - RNA, 12 nt, Human
aaacucucugaa

SEQ ID NO: 2160503 - RNA, 13 nt, Human
aaacucucugaac

SEQ ID NO: 2160504 - RNA, 20 nt, Human
aaaccauuaugaagaagaga

SEQ ID NO: 2160505 - RNA, 19 nt, Human
aaaccccuacccucacaau

SEQ ID NO: 2160506 - RNA, 17 nt, Human
aagggagcuagccagag

SEQ ID NO: 2160507 - RNA, 17 nt, Human
aagcuacaaucuguuca

SEQ ID NO: 2160508 - RNA, 20 nt, Human
aaggcagggagcgagggaga

SEQ ID NO: 2160509 - RNA, 14 nt, Human
aagcuguauuuuga

SEQ ID NO: 2160510 - RNA, 22 nt, Human
aagcugggguucaugacaaugg

SEQ ID NO: 2160511 - RNA, 16 nt, Human
aagcugggguucauga

SEQ ID NO: 2160512 - RNA, 16 nt, Human
aagauucccaggaguu

SEQ ID NO: 2160513 - RNA, 15 nt, Human
aagauucccaggagu

SEQ ID NO: 2160514 - RNA, 14 nt, Human
aagauucccaggag

SEQ ID NO: 2160515 - RNA, 13 nt, Human
aagauucccagga

SEQ ID NO: 2160516 - RNA, 19 nt, Human
aagauucccaggaguucug

SEQ ID NO: 2160517 - RNA, 17 nt, Human
aagauucccaggaguuc

SEQ ID NO: 2160518 - RNA, 21 nt, Human
aagauucccaggaguucugcu

SEQ ID NO: 2160519 - RNA, 17 nt, Human
aagauaaagccagaagc

SEQ ID NO: 2160520 - RNA, 13 nt, Human
aacuuuauuucca

SEQ ID NO: 2160521 - RNA, 19 nt, Human
aacuuuccucuuccugccu

SEQ ID NO: 2160522 - RNA, 14 nt, Human
aagccacagcuggu

SEQ ID NO: 2160523 - RNA, 22 nt, Human
aagcagcggucagcagacaagg

SEQ ID NO: 2160524 - RNA, 23 nt, Human
aaugucacguuuuguuuugugcc

SEQ ID NO: 2160525 - RNA, 22 nt, Human
aaugucacguuuuguuuugugc

SEQ ID NO: 2160526 - RNA, 17 nt, Human
aaugaaguuguagguaa

SEQ ID NO: 2160527 - RNA, 21 nt, Human
aauacuauauuuauacuguau

SEQ ID NO: 2160528 - RNA, 21 nt, Human
agagaaaaagaaaugcaaaaa

SEQ ID NO: 2160529 - RNA, 20 nt, Human
agagaaaaagaaaugcaaaa

SEQ ID NO: 2160530 - RNA, 16 nt, Human
agagaaaaagaaaugc

SEQ ID NO: 2160531 - RNA, 14 nt, Human
agagaaaaagaaau

SEQ ID NO: 2160532 - RNA, 12 nt, Human
agagaaaaagag

SEQ ID NO: 2160533 - RNA, 16 nt, Human
agaggacaagggaaau

SEQ ID NO: 2160534 - RNA, 18 nt, Human
agagggccgggcagaggg

SEQ ID NO: 2160535 - RNA, 17 nt, Human
agagggccgggcagagg

SEQ ID NO: 2160536 - RNA, 15 nt, Human
agagggccgggcaga

SEQ ID NO: 2160537 - RNA, 20 nt, Human
agaguguggagucauucuca

SEQ ID NO: 2160538 - RNA, 20 nt, Human
agcacacucauccccucacu

SEQ ID NO: 2160539 - RNA, 14 nt, Human
agcacacucauccc

SEQ ID NO: 2160540 - RNA, 23 nt, Human
agcagcugaaauaugcuggcugg

SEQ ID NO: 2160541 - RNA, 22 nt, Human
agcagcugaaauaugcuggcug

SEQ ID NO: 2160542 - RNA, 12 nt, Human
agcagcucuccc

SEQ ID NO: 2160543 - RNA, 14 nt, Human
agcagcucuccccu

SEQ ID NO: 2160544 - RNA, 21 nt, Human
agcaugcugugauugugccua

SEQ ID NO: 2160545 - RNA, 23 nt, Human
agccucccugccucaggccucug

SEQ ID NO: 2160546 - RNA, 14 nt, Human
agccucccugccuc

SEQ ID NO: 2160547 - RNA, 13 nt, Human
agccucccugccu

SEQ ID NO: 2160548 - RNA, 12 nt, Human
agccucccugcc

SEQ ID NO: 2160549 - RNA, 17 nt, Human
aggaguuauuuguaaug

SEQ ID NO: 2160550 - RNA, 14 nt, Human
aggaugcuuugguu

SEQ ID NO: 2160551 - RNA, 18 nt, Human
aggacccaagcagagaag

SEQ ID NO: 2160552 - RNA, 15 nt, Human
aggacccaagcagag

SEQ ID NO: 2160553 - RNA, 13 nt, Human
aggacccaagcag

SEQ ID NO: 2160554 - RNA, 12 nt, Human
aggacccaagca

SEQ ID NO: 2160555 - RNA, 20 nt, Human
agcugaaauaugcuggcugg

SEQ ID NO: 2160556 - RNA, 18 nt, Human
agcugaaauaugcuggcu

SEQ ID NO: 2160557 - RNA, 17 nt, Human
agcugaaaguugggacu

SEQ ID NO: 2160558 - RNA, 14 nt, Human
agcugaaaguuggg

SEQ ID NO: 2160559 - RNA, 16 nt, Human
agcugcucagggaaaa

SEQ ID NO: 2160560 - RNA, 21 nt, Human
agcugcucagggaaaagcagc

SEQ ID NO: 2160561 - RNA, 22 nt, Human
agcuuccccaacacgcaggagc

SEQ ID NO: 2160562 - RNA, 20 nt, Human
agguggagguugcagugagc

SEQ ID NO: 2160563 - RNA, 12 nt, Human
agggucccuggg

SEQ ID NO: 2160564 - RNA, 21 nt, Human
aggguccagaaggagacaggc

SEQ ID NO: 2160565 - RNA, 19 nt, Human
aggguccagaaggagacag

SEQ ID NO: 2160566 - RNA, 18 nt, Human
aggguccagaaggagaca

SEQ ID NO: 2160567 - RNA, 23 nt, Human
agggucagccagggccugcgagg

SEQ ID NO: 2160568 - RNA, 19 nt, Human
agggucagccagggccugc

SEQ ID NO: 2160569 - RNA, 18 nt, Human
agggucagccagggccug

SEQ ID NO: 2160570 - RNA, 17 nt, Human
agggucagccagggccu

SEQ ID NO: 2160571 - RNA, 15 nt, Human
agggucagccagggc

SEQ ID NO: 2160572 - RNA, 16 nt, Human
agggaccucucccagg

SEQ ID NO: 2160573 - RNA, 13 nt, Human
agggaccucuccc

SEQ ID NO: 2160574 - RNA, 15 nt, Human
agggaccucucccag

SEQ ID NO: 2160575 - RNA, 22 nt, Human
agggacgaagaagagccacagu

SEQ ID NO: 2160576 - RNA, 21 nt, Human
agggacgaagaagagccacag

SEQ ID NO: 2160577 - RNA, 17 nt, Human
agggacgaagaagagcc

SEQ ID NO: 2160578 - RNA, 12 nt, Human
auaaaaaggugu

SEQ ID NO: 2160579 - RNA, 20 nt, Human
auaaagcccugggaucacug

SEQ ID NO: 2160580 - RNA, 14 nt, Human
auaaagcccuggga

SEQ ID NO: 2160581 - RNA, 22 nt, Human
auagcaucuuguggcuuugcaa

SEQ ID NO: 2160582 - RNA, 14 nt, Human
auauuuacguauga

SEQ ID NO: 2160583 - RNA, 17 nt, Human
aguugaaccuauuucuc

SEQ ID NO: 2160584 - RNA, 19 nt, Human
aguugaaccuauuucucuu

SEQ ID NO: 2160585 - RNA, 18 nt, Human
aguuccaaaaugccaaau

SEQ ID NO: 2160586 - RNA, 22 nt, Human
aguucauguauguucagaagaa

SEQ ID NO: 2160587 - RNA, 20 nt, Human
aguggcuucacuccugcugu

SEQ ID NO: 2160588 - RNA, 21 nt, Human
aguggcuucacuccugcugua

SEQ ID NO: 2160589 - RNA, 19 nt, Human
aguggcuucacuccugcug

SEQ ID NO: 2160590 - RNA, 18 nt, Human
aguggcuucacuccugcu

SEQ ID NO: 2160591 - RNA, 19 nt, Human
agugaaguugcuucuucua

SEQ ID NO: 2160592 - RNA, 17 nt, Human
agugaagugagaaguuc

SEQ ID NO: 2160593 - RNA, 23 nt, Human
agucugcgucucugcuuuaaagu

SEQ ID NO: 2160594 - RNA, 23 nt, Human
auggaaaggagccuaggccaggu

SEQ ID NO: 2160595 - RNA, 16 nt, Human
auggaaacugaaacua

SEQ ID NO: 2160596 - RNA, 17 nt, Human
augaugcuauuugcaau

SEQ ID NO: 2160597 - RNA, 16 nt, Human
augaugcuauuugcaa

SEQ ID NO: 2160598 - RNA, 11 nt, Human
auuaaauagcu

SEQ ID NO: 2160599 - RNA, 13 nt, Human
auguucugcuuuc

SEQ ID NO: 2160600 - RNA, 22 nt, Human
auguuccuuuggaagaaaaaau

SEQ ID NO: 2160601 - RNA, 23 nt, Human
auguauuuucuucaccucugcua

SEQ ID NO: 2160602 - RNA, 17 nt, Human
augaagguuucugaaaa

SEQ ID NO: 2160603 - RNA, 19 nt, Human
augaagguuucugaaaauu

SEQ ID NO: 2160604 - RNA, 13 nt, Human
aucuauauuuugg

SEQ ID NO: 2160605 - RNA, 15 nt, Human
aucuauuaaaaccac

SEQ ID NO: 2160606 - RNA, 18 nt, Human
aucucccuucacaaguuu

SEQ ID NO: 2160607 - RNA, 21 nt, Human
auccuauugaaccauguuugu

SEQ ID NO: 2160608 - RNA, 13 nt, Human
auccuauucuuuc

SEQ ID NO: 2160609 - RNA, 13 nt, Human
auccccugccucc

SEQ ID NO: 2160610 - RNA, 12 nt, Human
auccccugccuc

SEQ ID NO: 2160611 - RNA, 18 nt, Human
aucagcuccacuuucagu

SEQ ID NO: 2160612 - RNA, 22 nt, Human
aucagcuggucaaacaaacucu

SEQ ID NO: 2160613 - RNA, 19 nt, Human
aaaaacccagcaacagaaa

SEQ ID NO: 2160614 - RNA, 13 nt, Human
ccagggccugcga

SEQ ID NO: 2160615 - RNA, 14 nt, Human
ccagggccugcgag

SEQ ID NO: 2160616 - RNA, 19 nt, Human
ccagggagcugcaggggca

SEQ ID NO: 2160617 - RNA, 15 nt, Human
ccagggagcugcagg

SEQ ID NO: 2160618 - RNA, 13 nt, Human
ccagggagcugca

SEQ ID NO: 2160619 - RNA, 15 nt, Human
ccaggugcagccaga

SEQ ID NO: 2160620 - RNA, 14 nt, Human
ccaggugcagccag

SEQ ID NO: 2160621 - RNA, 14 nt, Human
ccagguagaacaca

SEQ ID NO: 2160622 - RNA, 16 nt, Human
ccaggugcagccagag

SEQ ID NO: 2160623 - RNA, 21 nt, Human
ccagugaugcuaaagguugua

SEQ ID NO: 2160624 - RNA, 14 nt, Human
ccagugcaacacug

SEQ ID NO: 2160625 - RNA, 20 nt, Human
ccauucuacuugcucuggac

SEQ ID NO: 2160626 - RNA, 19 nt, Human
ccauucucaccuauccaca

SEQ ID NO: 2160627 - RNA, 17 nt, Human
ccauuaugaagaagaga

SEQ ID NO: 2160628 - RNA, 15 nt, Human
ccauuauguccuagu

SEQ ID NO: 2160629 - RNA, 12 nt, Human
ccauucuacuug

SEQ ID NO: 2160630 - RNA, 17 nt, Human
ccauucuacuugcucug

SEQ ID NO: 2160631 - RNA, 13 nt, Human
ccauucuacuugc

SEQ ID NO: 2160632 - RNA, 22 nt, Human
ccauucuacuugcucuggaccu

SEQ ID NO: 2160633 - RNA, 19 nt, Human
ccauucuacuugcucugga

SEQ ID NO: 2160634 - RNA, 18 nt, Human
ccauucuacuugcucugg

SEQ ID NO: 2160635 - RNA, 15 nt, Human
ccauuucucuccuca

SEQ ID NO: 2160636 - RNA, 23 nt, Human
ccaucugguuaggauggcaggac

SEQ ID NO: 2160637 - RNA, 15 nt, Human
ccauuuuuacuguua

SEQ ID NO: 2160638 - RNA, 13 nt, Human
cccacagacucaa

SEQ ID NO: 2160639 - RNA, 23 nt, Human
cccacagacucaaaugcucagac

SEQ ID NO: 2160640 - RNA, 14 nt, Human
ccagauuuaaauaa

SEQ ID NO: 2160641 - RNA, 18 nt, Human
ccagcuccucacucaccu

SEQ ID NO: 2160642 - RNA, 18 nt, Human
ccaccucucccugacccu

SEQ ID NO: 2160643 - RNA, 17 nt, Human
ccaccucucccugaccc

SEQ ID NO: 2160644 - RNA, 16 nt, Human
ccaccucucccugacc

SEQ ID NO: 2160645 - RNA, 18 nt, Human
ccagaaggagacaggcag

SEQ ID NO: 2160646 - RNA, 17 nt, Human
ccagaaggagacaggca

SEQ ID NO: 2160647 - RNA, 14 nt, Human
ccagaaggagacag

SEQ ID NO: 2160648 - RNA, 18 nt, Human
ccacugcauaccaaccug

SEQ ID NO: 2160649 - RNA, 19 nt, Human
ccacugcauaccaaccugg

SEQ ID NO: 2160650 - RNA, 22 nt, Human
ccacugggguccagggagcagg

SEQ ID NO: 2160651 - RNA, 19 nt, Human
ccacugggguccagggagc

SEQ ID NO: 2160652 - RNA, 18 nt, Human
ccacugggguccagggag

SEQ ID NO: 2160653 - RNA, 13 nt, Human
ccacuggacugac

SEQ ID NO: 2160654 - RNA, 12 nt, Human
ccuaggccaggu

SEQ ID NO: 2160655 - RNA, 11 nt, Human
ccuaggccagg

SEQ ID NO: 2160656 - RNA, 15 nt, Human
ccuaggccaggugca

SEQ ID NO: 2160657 - RNA, 14 nt, Human
ccgccugguacuca

SEQ ID NO: 2160658 - RNA, 15 nt, Human
ccgggcagaggggca

SEQ ID NO: 2160659 - RNA, 12 nt, Human
ccgggcagaggg

SEQ ID NO: 2160660 - RNA, 16 nt, Human
cccugccucaggccuc

SEQ ID NO: 2160661 - RNA, 21 nt, Human
cccugccucaggccucugugc

SEQ ID NO: 2160662 - RNA, 18 nt, Human
cccugccuccauccuagu

SEQ ID NO: 2160663 - RNA, 13 nt, Human
cccugccuccauc

SEQ ID NO: 2160664 - RNA, 12 nt, Human
cccugccuccau

SEQ ID NO: 2160665 - RNA, 19 nt, Human
cccugcuccagaagauagc

SEQ ID NO: 2160666 - RNA, 22 nt, Human
cccuugaggaaacaacagcuuu

SEQ ID NO: 2160667 - RNA, 13 nt, Human
cccuuccaggggu

SEQ ID NO: 2160668 - RNA, 22 nt, Human
cccuggugagagggccgggcag

SEQ ID NO: 2160669 - RNA, 15 nt, Human
cccuguauauagccc

SEQ ID NO: 2160670 - RNA, 18 nt, Human
cccuguauauagcccagc

SEQ ID NO: 2160671 - RNA, 17 nt, Human
cccuguauauagcccag

SEQ ID NO: 2160672 - RNA, 13 nt, Human
ccccaaucccagc

SEQ ID NO: 2160673 - RNA, 13 nt, Human
ccccaccccauuu

SEQ ID NO: 2160674 - RNA, 17 nt, Human
ccccaccucucccugac

SEQ ID NO: 2160675 - RNA, 12 nt, Human
ccccaccucucc

SEQ ID NO: 2160676 - RNA, 21 nt, Human
cccagagaaagcgcagaugcu

SEQ ID NO: 2160677 - RNA, 22 nt, Human
cccccaccucucccugacccug

SEQ ID NO: 2160678 - RNA, 21 nt, Human
ccccucgcuuggacggcuggg

SEQ ID NO: 2160679 - RNA, 16 nt, Human
ccccugccuccauccu

SEQ ID NO: 2160680 - RNA, 15 nt, Human
ccccugccuccaucc

SEQ ID NO: 2160681 - RNA, 23 nt, Human
ccccugcccuccccucucugcac

SEQ ID NO: 2160682 - RNA, 15 nt, Human
cccgcauccccugcc

SEQ ID NO: 2160683 - RNA, 14 nt, Human
cccgcauccccugc

SEQ ID NO: 2160684 - RNA, 19 nt, Human
cccgcauccccugccucca

SEQ ID NO: 2160685 - RNA, 18 nt, Human
cccgcauccccugccucc

SEQ ID NO: 2160686 - RNA, 17 nt, Human
cccgcauccccugccuc

SEQ ID NO: 2160687 - RNA, 16 nt, Human
cccgcauccccugccu

SEQ ID NO: 2160688 - RNA, 20 nt, Human
cccgcauccccugccuccau

SEQ ID NO: 2160689 - RNA, 15 nt, Human
cccgccaaaagcugc

SEQ ID NO: 2160690 - RNA, 16 nt, Human
cuccaccagucauuuu

SEQ ID NO: 2160691 - RNA, 20 nt, Human
cuccagaguggggaugacau

SEQ ID NO: 2160692 - RNA, 15 nt, Human
cuccaaaccuucaca

SEQ ID NO: 2160693 - RNA, 14 nt, Human
cuccaaaccuucac

SEQ ID NO: 2160694 - RNA, 21 nt, Human
cuccaaaccuucacacacaga

SEQ ID NO: 2160695 - RNA, 16 nt, Human
cuccaaaccuucacac

SEQ ID NO: 2160696 - RNA, 21 nt, Human
cucauucuaaugauggcccau

SEQ ID NO: 2160697 - RNA, 17 nt, Human
cucaguucuugccacuu

SEQ ID NO: 2160698 - RNA, 20 nt, Human
cucauucuaaugauggccca

SEQ ID NO: 2160699 - RNA, 18 nt, Human
cucauucuaaugauggcc

SEQ ID NO: 2160700 - RNA, 14 nt, Human
cucauucuaaugau

SEQ ID NO: 2160701 - RNA, 12 nt, Human
cucccaggcucu

SEQ ID NO: 2160702 - RNA, 13 nt, Human
cucccaggcucuc

SEQ ID NO: 2160703 - RNA, 13 nt, Human
cucagcccugacc

SEQ ID NO: 2160704 - RNA, 15 nt, Human
cucagcccugacccu

SEQ ID NO: 2160705 - RNA, 14 nt, Human
cucagcccugaccc

SEQ ID NO: 2160706 - RNA, 17 nt, Human
cucagcccugacccugu

SEQ ID NO: 2160707 - RNA, 21 nt, Human
cucagguggccaugccucagc

SEQ ID NO: 2160708 - RNA, 20 nt, Human
cucagguggccaugccucag

SEQ ID NO: 2160709 - RNA, 19 nt, Human
cucagguggccaugccuca

SEQ ID NO: 2160710 - RNA, 18 nt, Human
cucagguggccaugccuc

SEQ ID NO: 2160711 - RNA, 15 nt, Human
cucagguggccaugc

SEQ ID NO: 2160712 - RNA, 13 nt, Human
cucagguggccau

SEQ ID NO: 2160713 - RNA, 12 nt, Human
cucagguggcca

SEQ ID NO: 2160714 - RNA, 17 nt, Human
cucagcucuuggcucca

SEQ ID NO: 2160715 - RNA, 18 nt, Human
cucagcucuuggcuccac

SEQ ID NO: 2160716 - RNA, 20 nt, Human
cucagcucuuggcuccacug

SEQ ID NO: 2160717 - RNA, 22 nt, Human
cucagcuuccccaacacgcagg

SEQ ID NO: 2160718 - RNA, 17 nt, Human
cucagcuuccccaacac

SEQ ID NO: 2160719 - RNA, 16 nt, Human
cuauuggaaaaaccac

SEQ ID NO: 2160720 - RNA, 9 nt, Human
cuauuuaag

SEQ ID NO: 2160721 - RNA, 15 nt, Human
cucacaccugaacug

SEQ ID NO: 2160722 - RNA, 14 nt, Human
cucaaguagcauuu

SEQ ID NO: 2160723 - RNA, 20 nt, Human
cucaaguagcauuuacugug

SEQ ID NO: 2160724 - RNA, 18 nt, Human
cucaaguagcauuuacug

SEQ ID NO: 2160725 - RNA, 15 nt, Human
cucaaguagcauuua

SEQ ID NO: 2160726 - RNA, 17 nt, Human
cucaagcccgcggggac

SEQ ID NO: 2160727 - RNA, 14 nt, Human
cucaagauucccag

SEQ ID NO: 2160728 - RNA, 13 nt, Human
cucaagauuccca

SEQ ID NO: 2160729 - RNA, 21 nt, Human
cucaagauucccaggaguucu

SEQ ID NO: 2160730 - RNA, 17 nt, Human
cucaagauucccaggag

SEQ ID NO: 2160731 - RNA, 16 nt, Human
cucaagauucccagga

SEQ ID NO: 2160732 - RNA, 15 nt, Human
cucaagauucccagg

SEQ ID NO: 2160733 - RNA, 17 nt, Human
cuauuucucuuucuuua

SEQ ID NO: 2160734 - RNA, 14 nt, Human
cuauuucucuuucu

SEQ ID NO: 2160735 - RNA, 12 nt, Human
cuauuucucuuu

SEQ ID NO: 2160736 - RNA, 18 nt, Human
cuauuugcaauuccugcu

SEQ ID NO: 2160737 - RNA, 11 nt, Human
cuauuugcaau

SEQ ID NO: 2160738 - RNA, 16 nt, Human
cuauuugagacuccuc

SEQ ID NO: 2160739 - RNA, 21 nt, Human
cuauuugcaauuccugcuccu

SEQ ID NO: 2160740 - RNA, 15 nt, Human
cuaggaaaauauuuu

SEQ ID NO: 2160741 - RNA, 17 nt, Human
cuaggaaaauauuuuga

SEQ ID NO: 2160742 - RNA, 19 nt, Human
cuauacuugcuuuguguuc

SEQ ID NO: 2160743 - RNA, 21 nt, Human
cuauucuuucgaaagaagaaa

SEQ ID NO: 2160744 - RNA, 21 nt, Human
cuauugauauaaauaaaacau

SEQ ID NO: 2160745 - RNA, 16 nt, Human
cuacucgggaagcuga

SEQ ID NO: 2160746 - RNA, 14 nt, Human
cuacugcaccauuu

SEQ ID NO: 2160747 - RNA, 18 nt, Human
cuacugcaccauuuaaaa

SEQ ID NO: 2160748 - RNA, 17 nt, Human
cuagagggaccucuccc

SEQ ID NO: 2160749 - RNA, 14 nt, Human
cuagagggaccucu

SEQ ID NO: 2160750 - RNA, 15 nt, Human
cuagagggaccucuc

SEQ ID NO: 2160751 - RNA, 16 nt, Human
cuagagggaccucucc

SEQ ID NO: 2160752 - RNA, 18 nt, Human
cuagaaagaauauuuggu

SEQ ID NO: 2160753 - RNA, 23 nt, Human
cuacuguuuuaauuuauacuggc

SEQ ID NO: 2160754 - RNA, 15 nt, Human
cuacaccuuucuccu

SEQ ID NO: 2160755 - RNA, 20 nt, Human
cuacaccuuucuccuuugua

SEQ ID NO: 2160756 - RNA, 18 nt, Human
cuacaccuuucuccuuug

SEQ ID NO: 2160757 - RNA, 22 nt, Human
cuaagcuggagugcuuaucccu

SEQ ID NO: 2160758 - RNA, 12 nt, Human
cuaauacaccag

SEQ ID NO: 2160759 - RNA, 18 nt, Human
cuaauagacuaaaugaaa

SEQ ID NO: 2160760 - RNA, 17 nt, Human
cuaauagacuaaaugaa

SEQ ID NO: 2160761 - RNA, 20 nt, Human
cuaauagacuaaaugaaauc

SEQ ID NO: 2160762 - RNA, 16 nt, Human
cuaaaaaacaaaacaa

SEQ ID NO: 2160763 - RNA, 11 nt, Human
cuaaaaauaau

SEQ ID NO: 2160764 - RNA, 13 nt, Human
cuacccucacaau

SEQ ID NO: 2160765 - RNA, 16 nt, Human
cuacaggggccagaag

SEQ ID NO: 2160766 - RNA, 14 nt, Human
cuacaggggccaga

SEQ ID NO: 2160767 - RNA, 13 nt, Human
cuacaggggccag

SEQ ID NO: 2160768 - RNA, 17 nt, Human
cuacagguuuggguaca

SEQ ID NO: 2160769 - RNA, 13 nt, Human
ccugcccuuggca

SEQ ID NO: 2160770 - RNA, 13 nt, Human
ccugcccuccccu

SEQ ID NO: 2160771 - RNA, 19 nt, Human
ccugcccccgcauccccug

SEQ ID NO: 2160772 - RNA, 22 nt, Human
ccugcccccgcauccccugccu

SEQ ID NO: 2160773 - RNA, 20 nt, Human
ccugcccccgcauccccugc

SEQ ID NO: 2160774 - RNA, 23 nt, Human
ccugcccccgcauccccugccuc

SEQ ID NO: 2160775 - RNA, 15 nt, Human
ccucuuccugccuag

SEQ ID NO: 2160776 - RNA, 21 nt, Human
ccugaagaguccucugaauga

SEQ ID NO: 2160777 - RNA, 17 nt, Human
ccugagcgccugggucc

SEQ ID NO: 2160778 - RNA, 21 nt, Human
ccugaggccucuggaaagcaa

SEQ ID NO: 2160779 - RNA, 21 nt, Human
ccugccacccugggccuggca

SEQ ID NO: 2160780 - RNA, 15 nt, Human
ccugccacccugggc

SEQ ID NO: 2160781 - RNA, 24 nt, Human
ccugccacccugggccuggcagcu

SEQ ID NO: 2160782 - RNA, 23 nt, Human
ccuggguccaggggaggccuucc

SEQ ID NO: 2160783 - RNA, 21 nt, Human
ccuguauauagcccagccagg

SEQ ID NO: 2160784 - RNA, 16 nt, Human
ccuguauauagcccag

SEQ ID NO: 2160785 - RNA, 13 nt, Human
ccuguauauagcc

SEQ ID NO: 2160786 - RNA, 23 nt, Human
ccuguauauagcccagccaggcc

SEQ ID NO: 2160787 - RNA, 21 nt, Human
ccugggguggggauagggagc

SEQ ID NO: 2160788 - RNA, 23 nt, Human
cgcaccgaaaaacuaaaaauaau

SEQ ID NO: 2160789 - RNA, 21 nt, Human
cgaugggcccaauucuuacaa

SEQ ID NO: 2160790 - RNA, 12 nt, Human
cgcacugccucu

SEQ ID NO: 2160791 - RNA, 17 nt, Human
cgaggagguaaugaauu

SEQ ID NO: 2160792 - RNA, 13 nt, Human
cggacaguggcag

SEQ ID NO: 2160793 - RNA, 15 nt, Human
cggacaguggcagga

SEQ ID NO: 2160794 - RNA, 24 nt, Human
cgcaggaagacccaacacauggga

SEQ ID NO: 2160795 - RNA, 12 nt, Human
cgcacuguggau

SEQ ID NO: 2160796 - RNA, 12 nt, Human
cgcccaaggccc

SEQ ID NO: 2160797 - RNA, 15 nt, Human
cgcggggacauuggg

SEQ ID NO: 2160798 - RNA, 22 nt, Human
cggcccuccuacccugcgccca

SEQ ID NO: 2160799 - RNA, 23 nt, Human
cggcccuccuacccugcgcccag

SEQ ID NO: 2160800 - RNA, 20 nt, Human
cggcccuccuacccugcgcc

SEQ ID NO: 2160801 - RNA, 17 nt, Human
ccuugucugaacuggag

SEQ ID NO: 2160802 - RNA, 20 nt, Human
cgaagccaucuuucuuugga

SEQ ID NO: 2160803 - RNA, 22 nt, Human
cgaaugacaaaaucaucuuugu

SEQ ID NO: 2160804 - RNA, 18 nt, Human
cgaaugacaaaaucaucu

SEQ ID NO: 2160805 - RNA, 16 nt, Human
ccuucuccucuuguaa

SEQ ID NO: 2160806 - RNA, 15 nt, Human
ccuucuccucuugua

SEQ ID NO: 2160807 - RNA, 17 nt, Human
ccuucuccucuuguaaa

SEQ ID NO: 2160808 - RNA, 14 nt, Human
ccuuccagcccaga

SEQ ID NO: 2160809 - RNA, 13 nt, Human
ccuuccagcccag

SEQ ID NO: 2160810 - RNA, 18 nt, Human
ccuugagaagauucuucc

SEQ ID NO: 2160811 - RNA, 18 nt, Human
ccuugaggaaacaacagc

SEQ ID NO: 2160812 - RNA, 21 nt, Human
ccuugaggaaacaacagcuuu

SEQ ID NO: 2160813 - RNA, 17 nt, Human
gaaaauauuuugaucuu

SEQ ID NO: 2160814 - RNA, 23 nt, Human
gaaaauauuuugaucuucaacaa

SEQ ID NO: 2160815 - RNA, 20 nt, Human
gaaaauauuuugaucuucaa

SEQ ID NO: 2160816 - RNA, 19 nt, Human
gaaaauauuuugaucuuca

SEQ ID NO: 2160817 - RNA, 22 nt, Human
gaaaacaggacuuaaaaugaca

SEQ ID NO: 2160818 - RNA, 20 nt, Human
gaaaacaggacuuaaaauga

SEQ ID NO: 2160819 - RNA, 11 nt, Human
gaaaaggcagg

SEQ ID NO: 2160820 - RNA, 12 nt, Human
gaaaaggcaaaa

SEQ ID NO: 2160821 - RNA, 17 nt, Human
cuuuguuaaguucuauu

SEQ ID NO: 2160822 - RNA, 19 nt, Human
cuuuguguucuuuguguca

SEQ ID NO: 2160823 - RNA, 19 nt, Human
cuuuuuauugaaucuauuu

SEQ ID NO: 2160824 - RNA, 14 nt, Human
cuuuuguucccauc

SEQ ID NO: 2160825 - RNA, 14 nt, Human
cuuuuuauugaauc

SEQ ID NO: 2160826 - RNA, 13 nt, Human
cuuuuuauugaau

SEQ ID NO: 2160827 - RNA, 17 nt, Human
cuuuuguucccauccuc

SEQ ID NO: 2160828 - RNA, 17 nt, Human
cuuuuuauugaaucuau

SEQ ID NO: 2160829 - RNA, 15 nt, Human
cuuuuuauugaaucu

SEQ ID NO: 2160830 - RNA, 21 nt, Human
cuuuuucuuuuuuucuuuggu

SEQ ID NO: 2160831 - RNA, 15 nt, Human
gaaagccccagaaau

SEQ ID NO: 2160832 - RNA, 14 nt, Human
gaaagcgcagaugc

SEQ ID NO: 2160833 - RNA, 16 nt, Human
gaaaaugaaucccucu

SEQ ID NO: 2160834 - RNA, 20 nt, Human
gaaaaugcaacaacauguau

SEQ ID NO: 2160835 - RNA, 18 nt, Human
gaaaaugcaacaacaugu

SEQ ID NO: 2160836 - RNA, 21 nt, Human
gaaaccauuaugaagaagaga

SEQ ID NO: 2160837 - RNA, 19 nt, Human
cuuucccugcuuaaugaaa

SEQ ID NO: 2160838 - RNA, 22 nt, Human
cuuuccauuugguuuagaacau

SEQ ID NO: 2160839 - RNA, 21 nt, Human
cuuuauguacaggaugcuuug

SEQ ID NO: 2160840 - RNA, 23 nt, Human
cuuuauguacaggaugcuuuggu

SEQ ID NO: 2160841 - RNA, 22 nt, Human
cuuguauagguuuuaaagaccu

SEQ ID NO: 2160842 - RNA, 18 nt, Human
cuuuacggacacccccuc

SEQ ID NO: 2160843 - RNA, 23 nt, Human
cuucuccucuuguaaauaaagcc

SEQ ID NO: 2160844 - RNA, 18 nt, Human
cuucuccucuuguaaaua

SEQ ID NO: 2160845 - RNA, 17 nt, Human
cuucuccucuuguaaau

SEQ ID NO: 2160846 - RNA, 15 nt, Human
cuucuccucuuguaa

SEQ ID NO: 2160847 - RNA, 14 nt, Human
cuucuccucuugua

SEQ ID NO: 2160848 - RNA, 18 nt, Human
cuucucucucuaaaauga

SEQ ID NO: 2160849 - RNA, 20 nt, Human
cuucuccugaaguucagcca

SEQ ID NO: 2160850 - RNA, 19 nt, Human
cuugacucuacugaucuga

SEQ ID NO: 2160851 - RNA, 13 nt, Human
cuugaggaaacaa

SEQ ID NO: 2160852 - RNA, 18 nt, Human
cuugaggaaacaacagcu

SEQ ID NO: 2160853 - RNA, 20 nt, Human
cuugaggaaacaacagcuuu

SEQ ID NO: 2160854 - RNA, 21 nt, Human
cuugaggaaacaacagcuuua

SEQ ID NO: 2160855 - RNA, 21 nt, Human
cuuauaggaaagcuugaguaa

SEQ ID NO: 2160856 - RNA, 17 nt, Human
cuuauaggaaagcuuga

SEQ ID NO: 2160857 - RNA, 16 nt, Human
cuuaucccuucuuuuu

SEQ ID NO: 2160858 - RNA, 17 nt, Human
cuuaucccuucuuuuuc

SEQ ID NO: 2160859 - RNA, 23 nt, Human
cuuaucacaaaaaagaaaaugaa

SEQ ID NO: 2160860 - RNA, 21 nt, Human
cuucaaacuaggggacaaagc

SEQ ID NO: 2160861 - RNA, 14 nt, Human
cuucaaccagggau

SEQ ID NO: 2160862 - RNA, 22 nt, Human
cuucaaccagggauuguuucug

SEQ ID NO: 2160863 - RNA, 19 nt, Human
cuuccagggacgaagaaga

SEQ ID NO: 2160864 - RNA, 22 nt, Human
cuuccagggacgaagaagagcc

SEQ ID NO: 2160865 - RNA, 18 nt, Human
cuucaccccaaucccagc

SEQ ID NO: 2160866 - RNA, 22 nt, Human
cuguggaaaagaaacacgcacu

SEQ ID NO: 2160867 - RNA, 19 nt, Human
cuguggaaaagaaacacgc

SEQ ID NO: 2160868 - RNA, 13 nt, Human
cugucucagggug

SEQ ID NO: 2160869 - RNA, 18 nt, Human
cugugcacaaaguggcau

SEQ ID NO: 2160870 - RNA, 19 nt, Human
cugugcacaaaguggcaua

SEQ ID NO: 2160871 - RNA, 16 nt, Human
cugugccuccaucagc

SEQ ID NO: 2160872 - RNA, 15 nt, Human
cugugccuccaucag

SEQ ID NO: 2160873 - RNA, 17 nt, Human
cuguucccaccugcugg

SEQ ID NO: 2160874 - RNA, 21 nt, Human
cuguggggaaccaauugcuuu

SEQ ID NO: 2160875 - RNA, 12 nt, Human
cuguccucaggu

SEQ ID NO: 2160876 - RNA, 18 nt, Human
cuguccucagguggccau

SEQ ID NO: 2160877 - RNA, 17 nt, Human
cuguccucagguggcca

SEQ ID NO: 2160878 - RNA, 16 nt, Human
cuguccucagguggcc

SEQ ID NO: 2160879 - RNA, 15 nt, Human
cuguccucagguggc

SEQ ID NO: 2160880 - RNA, 12 nt, Human
cuguccuccaag

SEQ ID NO: 2160881 - RNA, 13 nt, Human
cuguccaggcucg

SEQ ID NO: 2160882 - RNA, 12 nt, Human
cuguccaggcuc

SEQ ID NO: 2160883 - RNA, 20 nt, Human
cuguaucaguggauuuccca

SEQ ID NO: 2160884 - RNA, 14 nt, Human
cuguaucacucugu

SEQ ID NO: 2160885 - RNA, 15 nt, Human
cuguaucaguggauu

SEQ ID NO: 2160886 - RNA, 16 nt, Human
cuguaucacucugugu

SEQ ID NO: 2160887 - RNA, 16 nt, Human
cuguauauagcccagc

SEQ ID NO: 2160888 - RNA, 18 nt, Human
cuggucaaacaaacucuc

SEQ ID NO: 2160889 - RNA, 23 nt, Human
cuggucaaacaaacucucugaac

SEQ ID NO: 2160890 - RNA, 17 nt, Human
cuggucaaacaaacucu

SEQ ID NO: 2160891 - RNA, 16 nt, Human
cugggguccagggagc

SEQ ID NO: 2160892 - RNA, 15 nt, Human
cugggguccagggag

SEQ ID NO: 2160893 - RNA, 17 nt, Human
cugguaccaguugaaau

SEQ ID NO: 2160894 - RNA, 16 nt, Human
cugguaccaguugaaa

SEQ ID NO: 2160895 - RNA, 14 nt, Human
cugguacucaagcc

SEQ ID NO: 2160896 - RNA, 22 nt, Human
cuggccaucugguuaggauggc

SEQ ID NO: 2160897 - RNA, 16 nt, Human
cuggccuugggcccuc

SEQ ID NO: 2160898 - RNA, 20 nt, Human
cuggccuugggcccucuggu

SEQ ID NO: 2160899 - RNA, 15 nt, Human
cuggagugaggaaaa

SEQ ID NO: 2160900 - RNA, 18 nt, Human
cuggagucaucauucccu

SEQ ID NO: 2160901 - RNA, 19 nt, Human
cuggaccugcccccgcauc

SEQ ID NO: 2160902 - RNA, 17 nt, Human
cuggaccugcccccgca

SEQ ID NO: 2160903 - RNA, 12 nt, Human
cuggaccugccc

SEQ ID NO: 2160904 - RNA, 18 nt, Human
cuggacuccggcccuccu

SEQ ID NO: 2160905 - RNA, 15 nt, Human
cuggacuccggcccu

SEQ ID NO: 2160906 - RNA, 13 nt, Human
cuggacuccggcc

SEQ ID NO: 2160907 - RNA, 15 nt, Human
cuggacacaggccug

SEQ ID NO: 2160908 - RNA, 14 nt, Human
cuggacacaggccu

SEQ ID NO: 2160909 - RNA, 13 nt, Human
cuggacacaggcc

SEQ ID NO: 2160910 - RNA, 15 nt, Human
cugcuggaaacagac

SEQ ID NO: 2160911 - RNA, 19 nt, Human
cugcuguaaauuuggcuuc

SEQ ID NO: 2160912 - RNA, 17 nt, Human
cugcuguaaauuuggcu

SEQ ID NO: 2160913 - RNA, 21 nt, Human
cugcugguuuuaacaacugug

SEQ ID NO: 2160914 - RNA, 15 nt, Human
cugcgagggcagcgg

SEQ ID NO: 2160915 - RNA, 13 nt, Human
cugccuccauccu

SEQ ID NO: 2160916 - RNA, 14 nt, Human
cugccuccauccua

SEQ ID NO: 2160917 - RNA, 19 nt, Human
gagaucccauccccuuguc

SEQ ID NO: 2160918 - RNA, 15 nt, Human
gagaugaagcaaaca

SEQ ID NO: 2160919 - RNA, 18 nt, Human
gagaugaagcaaacacau

SEQ ID NO: 2160920 - RNA, 20 nt, Human
gagaugaagcaaacacauua

SEQ ID NO: 2160921 - RNA, 13 nt, Human
gagcaacauuuua

SEQ ID NO: 2160922 - RNA, 15 nt, Human
gagcaagaggaggcc

SEQ ID NO: 2160923 - RNA, 20 nt, Human
gagcaaggguucccucaaga

SEQ ID NO: 2160924 - RNA, 15 nt, Human
gagagagaggcagaa

SEQ ID NO: 2160925 - RNA, 13 nt, Human
gagagagcuggag

SEQ ID NO: 2160926 - RNA, 15 nt, Human
gagagcaacauuuua

SEQ ID NO: 2160927 - RNA, 18 nt, Human
gagagccccucacacagc

SEQ ID NO: 2160928 - RNA, 19 nt, Human
gagacagcuugaucaaagg

SEQ ID NO: 2160929 - RNA, 19 nt, Human
gagacaggcagagcugcuc

SEQ ID NO: 2160930 - RNA, 16 nt, Human
gagacaggcagagcug

SEQ ID NO: 2160931 - RNA, 14 nt, Human
gagacaggcagagc

SEQ ID NO: 2160932 - RNA, 12 nt, Human
gagacaggcaga

SEQ ID NO: 2160933 - RNA, 16 nt, Human
gagaacuuuauuucca

SEQ ID NO: 2160934 - RNA, 19 nt, Human
gagaaagcgcagaugcuag

SEQ ID NO: 2160935 - RNA, 18 nt, Human
gacuugacagaacacugu

SEQ ID NO: 2160936 - RNA, 16 nt, Human
gacuugacagaacacu

SEQ ID NO: 2160937 - RNA, 17 nt, Human
gacuagagggaccucuc

SEQ ID NO: 2160938 - RNA, 19 nt, Human
gacuagagggaccucuccc

SEQ ID NO: 2160939 - RNA, 20 nt, Human
gacuagagggaccucuccca

SEQ ID NO: 2160940 - RNA, 23 nt, Human
gacuagagggaccucucccaggg

SEQ ID NO: 2160941 - RNA, 15 nt, Human
gacuagagcuuucuu

SEQ ID NO: 2160942 - RNA, 18 nt, Human
gacuagagcuuucuuuca

SEQ ID NO: 2160943 - RNA, 17 nt, Human
gaccuauaacugcccag

SEQ ID NO: 2160944 - RNA, 22 nt, Human
gacuccggcccuccuacccugc

SEQ ID NO: 2160945 - RNA, 15 nt, Human
gacuccggcccuccu

SEQ ID NO: 2160946 - RNA, 11 nt, Human
gacccuguaua

SEQ ID NO: 2160947 - RNA, 19 nt, Human
gacccuguauauagcccag

SEQ ID NO: 2160948 - RNA, 17 nt, Human
gacccuguauauagccc

SEQ ID NO: 2160949 - RNA, 12 nt, Human
gaccagccuggc

SEQ ID NO: 2160950 - RNA, 22 nt, Human
gaccagccuggccaacauggua

SEQ ID NO: 2160951 - RNA, 14 nt, Human
gacaugcacucagc

SEQ ID NO: 2160952 - RNA, 23 nt, Human
gacauccccccgccaaaagcugc

SEQ ID NO: 2160953 - RNA, 18 nt, Human
gacaguggcaggacagga

SEQ ID NO: 2160954 - RNA, 13 nt, Human
gacaguggcagga

SEQ ID NO: 2160955 - RNA, 15 nt, Human
gacaguggcaggaca

SEQ ID NO: 2160956 - RNA, 19 nt, Human
gacaacacugggaaacaga

SEQ ID NO: 2160957 - RNA, 15 nt, Human
gacaacuacagaaaa

SEQ ID NO: 2160958 - RNA, 16 nt, Human
gacaauggcagaugua

SEQ ID NO: 2160959 - RNA, 19 nt, Human
gacaaggagaagagcaagg

SEQ ID NO: 2160960 - RNA, 17 nt, Human
gaauggcacagcccaaa

SEQ ID NO: 2160961 - RNA, 22 nt, Human
gaauggcacagcccaaagaagg

SEQ ID NO: 2160962 - RNA, 13 nt, Human
gaauggcagcugc

SEQ ID NO: 2160963 - RNA, 16 nt, Human
gaauggcagcugccac

SEQ ID NO: 2160964 - RNA, 22 nt, Human
gaaugcagucuguccaggcucg

SEQ ID NO: 2160965 - RNA, 20 nt, Human
gaaugcagucuguccaggcu

SEQ ID NO: 2160966 - RNA, 18 nt, Human
gaaucucugaauuugaga

SEQ ID NO: 2160967 - RNA, 18 nt, Human
gaaucuagggagggggaa

SEQ ID NO: 2160968 - RNA, 14 nt, Human
gaauugcagaguac

SEQ ID NO: 2160969 - RNA, 22 nt, Human
gauugcguggaauugugcugag

SEQ ID NO: 2160970 - RNA, 20 nt, Human
gcaaaccacacuggacuccg

SEQ ID NO: 2160971 - RNA, 18 nt, Human
gcaaaccacacuggacuc

SEQ ID NO: 2160972 - RNA, 17 nt, Human
gcaaaccacacuggacu

SEQ ID NO: 2160973 - RNA, 15 nt, Human
gcaaaccacacugga

SEQ ID NO: 2160974 - RNA, 17 nt, Human
gcaaaggaguagaaaga

SEQ ID NO: 2160975 - RNA, 22 nt, Human
gcaaaccacacuggacuccggc

SEQ ID NO: 2160976 - RNA, 13 nt, Human
gaugguaauucuu

SEQ ID NO: 2160977 - RNA, 17 nt, Human
gaugugggucaaggaau

SEQ ID NO: 2160978 - RNA, 15 nt, Human
gaugccauuacauuu

SEQ ID NO: 2160979 - RNA, 20 nt, Human
gauggcccauucuacuugcu

SEQ ID NO: 2160980 - RNA, 19 nt, Human
gauggcccauucuacuugc

SEQ ID NO: 2160981 - RNA, 18 nt, Human
gauggcccauucuacuug

SEQ ID NO: 2160982 - RNA, 22 nt, Human
gauggcccauucuacuugcucu

SEQ ID NO: 2160983 - RNA, 21 nt, Human
gaugggugaaggcuggcauga

SEQ ID NO: 2160984 - RNA, 16 nt, Human
gaugggugaaggcugg

SEQ ID NO: 2160985 - RNA, 20 nt, Human
gcacacucauccccucacuu

SEQ ID NO: 2160986 - RNA, 19 nt, Human
gcacacgccucccacuggg

SEQ ID NO: 2160987 - RNA, 17 nt, Human
gcacacgccucccacug

SEQ ID NO: 2160988 - RNA, 14 nt, Human
gcacacgccuccca

SEQ ID NO: 2160989 - RNA, 14 nt, Human
gcacaaaguggcau

SEQ ID NO: 2160990 - RNA, 15 nt, Human
gcaauguuuauuuca

SEQ ID NO: 2160991 - RNA, 16 nt, Human
gcaauuccugcuccua

SEQ ID NO: 2160992 - RNA, 23 nt, Human
gcaauuucaaauuacucuuucuc

SEQ ID NO: 2160993 - RNA, 13 nt, Human
gcacaaaguggca

SEQ ID NO: 2160994 - RNA, 16 nt, Human
gcacaaagggcccaga

SEQ ID NO: 2160995 - RNA, 23 nt, Human
gcacaaagaugggugaaggcugg

SEQ ID NO: 2160996 - RNA, 18 nt, Human
gcacuguggauuauuuca

SEQ ID NO: 2160997 - RNA, 15 nt, Human
gaguaaucugagaaa

SEQ ID NO: 2160998 - RNA, 20 nt, Human
gaguagaaagacagagcugg

SEQ ID NO: 2160999 - RNA, 17 nt, Human
gaguagaaagacagagc

SEQ ID NO: 2161000 - RNA, 22 nt, Human
gaguagaaagacagagcuggga

SEQ ID NO: 2161001 - RNA, 17 nt, Human
gagucuguuuuguaaag

SEQ ID NO: 2161002 - RNA, 16 nt, Human
gagucuguuuuguaaa

SEQ ID NO: 2161003 - RNA, 13 nt, Human
gaguccucugaau

SEQ ID NO: 2161004 - RNA, 17 nt, Human
gaguccuagagcuacag

SEQ ID NO: 2161005 - RNA, 15 nt, Human
gaguguacucccagg

SEQ ID NO: 2161006 - RNA, 23 nt, Human
gaguugacuugacagaacacugu

SEQ ID NO: 2161007 - RNA, 23 nt, Human
gauagcuucaccccaaucccagc

SEQ ID NO: 2161008 - RNA, 21 nt, Human
gaggggucgacuucgggcugg

SEQ ID NO: 2161009 - RNA, 23 nt, Human
gagggcagcgggagccucccugc

SEQ ID NO: 2161010 - RNA, 18 nt, Human
gagggcagcgggagccuc

SEQ ID NO: 2161011 - RNA, 16 nt, Human
gagggcagcgggagcc

SEQ ID NO: 2161012 - RNA, 22 nt, Human
gagggagcaaguccuucccuuu

SEQ ID NO: 2161013 - RNA, 23 nt, Human
gagggagcuccaacucagaaggg

SEQ ID NO: 2161014 - RNA, 15 nt, Human
gagguagaaugacuc

SEQ ID NO: 2161015 - RNA, 19 nt, Human
gagguagaaugacuccuug

SEQ ID NO: 2161016 - RNA, 22 nt, Human
gagguauucaauauccuuugcc

SEQ ID NO: 2161017 - RNA, 15 nt, Human
gagggugagugcaag

SEQ ID NO: 2161018 - RNA, 15 nt, Human
gagggucagccaggg

SEQ ID NO: 2161019 - RNA, 14 nt, Human
gagggucagccagg

SEQ ID NO: 2161020 - RNA, 18 nt, Human
gagggucagccagggccu

SEQ ID NO: 2161021 - RNA, 16 nt, Human
gagggucagccagggc

SEQ ID NO: 2161022 - RNA, 18 nt, Human
gaggcaagguuauaugca

SEQ ID NO: 2161023 - RNA, 16 nt, Human
gaggccagugagccac

SEQ ID NO: 2161024 - RNA, 18 nt, Human
gaggccguugauucacuu

SEQ ID NO: 2161025 - RNA, 14 nt, Human
gaggccuuuaacca

SEQ ID NO: 2161026 - RNA, 18 nt, Human
gaggccucuggaaagcaa

SEQ ID NO: 2161027 - RNA, 13 nt, Human
ggaugcagcauua

SEQ ID NO: 2161028 - RNA, 21 nt, Human
ggcaauauagcaagaucccau

SEQ ID NO: 2161029 - RNA, 14 nt, Human
ggcacccacccugg

SEQ ID NO: 2161030 - RNA, 13 nt, Human
ggcacccacccug

SEQ ID NO: 2161031 - RNA, 11 nt, Human
ggcaugcuaaa

SEQ ID NO: 2161032 - RNA, 17 nt, Human
ggcaugcuaaagccuuc

SEQ ID NO: 2161033 - RNA, 13 nt, Human
ggcagcuucuuug

SEQ ID NO: 2161034 - RNA, 21 nt, Human
ggcagcguacucaucaucaac

SEQ ID NO: 2161035 - RNA, 22 nt, Human
ggccauguugugccucccuggu

SEQ ID NO: 2161036 - RNA, 16 nt, Human
ggccauguugugccuc

SEQ ID NO: 2161037 - RNA, 21 nt, Human
ggccauguugugccucccugg

SEQ ID NO: 2161038 - RNA, 18 nt, Human
ggcaugggaaggugggcg

SEQ ID NO: 2161039 - RNA, 13 nt, Human
ggcccuggccuug

SEQ ID NO: 2161040 - RNA, 21 nt, Human
ggccucuggaaagcaaagggc

SEQ ID NO: 2161041 - RNA, 23 nt, Human
ggcggagcuggccccgccgccug

SEQ ID NO: 2161042 - RNA, 20 nt, Human
ggcggagcuggccccgccgc

SEQ ID NO: 2161043 - RNA, 17 nt, Human
ggcggagcuggccccgc

SEQ ID NO: 2161044 - RNA, 15 nt, Human
ggcggagcuggcccc

SEQ ID NO: 2161045 - RNA, 14 nt, Human
ggcggagcuggccc

SEQ ID NO: 2161046 - RNA, 13 nt, Human
ggcggagcuggcc

SEQ ID NO: 2161047 - RNA, 22 nt, Human
ggcgccgcaaaccacacuggac

SEQ ID NO: 2161048 - RNA, 20 nt, Human
ggcgccgcaaaccacacugg

SEQ ID NO: 2161049 - RNA, 13 nt, Human
ggccugaagaguc

SEQ ID NO: 2161050 - RNA, 19 nt, Human
ggccugaagaguccucuga

SEQ ID NO: 2161051 - RNA, 23 nt, Human
ggccugaagaguccucugaauga

SEQ ID NO: 2161052 - RNA, 16 nt, Human
ggcucacaccuguaau

SEQ ID NO: 2161053 - RNA, 15 nt, Human
ggaauggcacagccc

SEQ ID NO: 2161054 - RNA, 20 nt, Human
ggaauucaucucucuuuaau

SEQ ID NO: 2161055 - RNA, 20 nt, Human
ggaauuuucuccaauuuuuu

SEQ ID NO: 2161056 - RNA, 16 nt, Human
ggaaggggacccccgc

SEQ ID NO: 2161057 - RNA, 19 nt, Human
ggaaggugggcgggcaggg

SEQ ID NO: 2161058 - RNA, 22 nt, Human
ggaaggggacccccgcccccug

SEQ ID NO: 2161059 - RNA, 17 nt, Human
ggaaggggacccccgcc

SEQ ID NO: 2161060 - RNA, 17 nt, Human
ggaccaaggagaugaag

SEQ ID NO: 2161061 - RNA, 19 nt, Human
ggagaugaagcaaacacau

SEQ ID NO: 2161062 - RNA, 14 nt, Human
ggaaaagcagcucu

SEQ ID NO: 2161063 - RNA, 18 nt, Human
ggaaaagcagcucucccc

SEQ ID NO: 2161064 - RNA, 19 nt, Human
ggaaaagcggacaucagcu

SEQ ID NO: 2161065 - RNA, 20 nt, Human
ggaaaaggcagggagcgagg

SEQ ID NO: 2161066 - RNA, 20 nt, Human
gcuuuagaaagguuuugagc

SEQ ID NO: 2161067 - RNA, 21 nt, Human
ggaaaggggcaggccagagcu

SEQ ID NO: 2161068 - RNA, 14 nt, Human
ggaaccaggcuugg

SEQ ID NO: 2161069 - RNA, 21 nt, Human
gcuguccucagguggccaugc

SEQ ID NO: 2161070 - RNA, 22 nt, Human
gcuucucauccugcaggcagcu

SEQ ID NO: 2161071 - RNA, 15 nt, Human
gccucaggccucugu

SEQ ID NO: 2161072 - RNA, 13 nt, Human
gccucccacagac

SEQ ID NO: 2161073 - RNA, 12 nt, Human
gccucccacugg

SEQ ID NO: 2161074 - RNA, 15 nt, Human
gccugauaagcuuca

SEQ ID NO: 2161075 - RNA, 20 nt, Human
gccugauaagcuucaaagcu

SEQ ID NO: 2161076 - RNA, 20 nt, Human
gccugggugacagagcaaga

SEQ ID NO: 2161077 - RNA, 22 nt, Human
gccugggugacagagcaagacu

SEQ ID NO: 2161078 - RNA, 20 nt, Human
gccuggcagcucagcuuccc

SEQ ID NO: 2161079 - RNA, 13 nt, Human
gccuggcagcuca

SEQ ID NO: 2161080 - RNA, 13 nt, Human
gcagacgcccaga

SEQ ID NO: 2161081 - RNA, 17 nt, Human
gcccugggaucacugug

SEQ ID NO: 2161082 - RNA, 20 nt, Human
gcccuggccuugggcccucu

SEQ ID NO: 2161083 - RNA, 16 nt, Human
gcgucauuacagggca

SEQ ID NO: 2161084 - RNA, 23 nt, Human
gcgucauuacagggcacaggcca

SEQ ID NO: 2161085 - RNA, 22 nt, Human
gcgucauuacagggcacaggcc

SEQ ID NO: 2161086 - RNA, 15 nt, Human
gcgugaucaaagcca

SEQ ID NO: 2161087 - RNA, 19 nt, Human
gcgugaucaaagccacacu

SEQ ID NO: 2161088 - RNA, 16 nt, Human
gcuaaagcccagagac

SEQ ID NO: 2161089 - RNA, 14 nt, Human
gcuaaagccuuccu

SEQ ID NO: 2161090 - RNA, 16 nt, Human
gcuaacaccagacaga

SEQ ID NO: 2161091 - RNA, 22 nt, Human
gcuacccgcagaguucucagaa

SEQ ID NO: 2161092 - RNA, 16 nt, Human
gcuacccgcagaguuc

SEQ ID NO: 2161093 - RNA, 18 nt, Human
gcuagccagaggacugug

SEQ ID NO: 2161094 - RNA, 15 nt, Human
gcuagccagaggacu

SEQ ID NO: 2161095 - RNA, 13 nt, Human
gcuagccagagga

SEQ ID NO: 2161096 - RNA, 12 nt, Human
gcuagccagagg

SEQ ID NO: 2161097 - RNA, 22 nt, Human
gcuccaaaccuucacacacaga

SEQ ID NO: 2161098 - RNA, 21 nt, Human
gcuccaaaccuucacacacag

SEQ ID NO: 2161099 - RNA, 15 nt, Human
gcuccaaaccuucac

SEQ ID NO: 2161100 - RNA, 14 nt, Human
gcuccaaaccuuca

SEQ ID NO: 2161101 - RNA, 17 nt, Human
gcugacucacaccugaa

SEQ ID NO: 2161102 - RNA, 22 nt, Human
gcucuggaccugcccccgcauc

SEQ ID NO: 2161103 - RNA, 17 nt, Human
gcucuggaccugccccc

SEQ ID NO: 2161104 - RNA, 15 nt, Human
gcucuggaccugccc

SEQ ID NO: 2161105 - RNA, 14 nt, Human
gcucuggaccugcc

SEQ ID NO: 2161106 - RNA, 13 nt, Human
gcucuggaccugc

SEQ ID NO: 2161107 - RNA, 12 nt, Human
gcucuggaccug

SEQ ID NO: 2161108 - RNA, 11 nt, Human
gcucuggaccu

SEQ ID NO: 2161109 - RNA, 20 nt, Human
gcucuuccgaaaaccaggcc

SEQ ID NO: 2161110 - RNA, 22 nt, Human
gcugagugaaaaaucuguggaa

SEQ ID NO: 2161111 - RNA, 13 nt, Human
gcugaguuggugu

SEQ ID NO: 2161112 - RNA, 21 nt, Human
gcugaguuguugagucuguuu

SEQ ID NO: 2161113 - RNA, 18 nt, Human
gcugaguuguugagucug

SEQ ID NO: 2161114 - RNA, 13 nt, Human
gcugaugacucaa

SEQ ID NO: 2161115 - RNA, 22 nt, Human
gcugaugacucaagauucccag

SEQ ID NO: 2161116 - RNA, 23 nt, Human
gcugaugacucaagauucccagg

SEQ ID NO: 2161117 - RNA, 22 nt, Human
gcugcaucccccccaccucucc

SEQ ID NO: 2161118 - RNA, 21 nt, Human
guagaaagacagagcugggau

SEQ ID NO: 2161119 - RNA, 18 nt, Human
guagaaagacagagcugg

SEQ ID NO: 2161120 - RNA, 10 nt, Human
guacuuugug

SEQ ID NO: 2161121 - RNA, 12 nt, Human
guacuacaauuu

SEQ ID NO: 2161122 - RNA, 15 nt, Human
guacuacaauuuaaa

SEQ ID NO: 2161123 - RNA, 21 nt, Human
guaccuucagaauaagcuucc

SEQ ID NO: 2161124 - RNA, 14 nt, Human
guacaguuuuauuu

SEQ ID NO: 2161125 - RNA, 18 nt, Human
guacaggaugcuuugguu

SEQ ID NO: 2161126 - RNA, 19 nt, Human
guaaucugagaaacaauga

SEQ ID NO: 2161127 - RNA, 17 nt, Human
guaaucugagaaacaau

SEQ ID NO: 2161128 - RNA, 14 nt, Human
guaaucugagaaac

SEQ ID NO: 2161129 - RNA, 17 nt, Human
guaauucuuauucuuuc

SEQ ID NO: 2161130 - RNA, 15 nt, Human
guaauucuuauucuu

SEQ ID NO: 2161131 - RNA, 19 nt, Human
guaaaagaaagaaagaaaa

SEQ ID NO: 2161132 - RNA, 12 nt, Human
guaaaaauacaa

SEQ ID NO: 2161133 - RNA, 17 nt, Human
gguuuacagucuauuug

SEQ ID NO: 2161134 - RNA, 10 nt, Human
gguuuuccug

SEQ ID NO: 2161135 - RNA, 15 nt, Human
gguuuucuguuacuu

SEQ ID NO: 2161136 - RNA, 15 nt, Human
guaaauaaagcccug

SEQ ID NO: 2161137 - RNA, 14 nt, Human
guaaauaaagcccu

SEQ ID NO: 2161138 - RNA, 13 nt, Human
guaaauaaagccc

SEQ ID NO: 2161139 - RNA, 18 nt, Human
guaaaguccccagagaaa

SEQ ID NO: 2161140 - RNA, 16 nt, Human
guaaaguccccagaga

SEQ ID NO: 2161141 - RNA, 23 nt, Human
guaaaguccccagagaaagcgca

SEQ ID NO: 2161142 - RNA, 13 nt, Human
ggugaaggcuggc

SEQ ID NO: 2161143 - RNA, 19 nt, Human
ggucagccagggccugcga

SEQ ID NO: 2161144 - RNA, 13 nt, Human
ggucagccagggc

SEQ ID NO: 2161145 - RNA, 22 nt, Human
gguagaccugucuccuggcggu

SEQ ID NO: 2161146 - RNA, 19 nt, Human
gguagaccugucuccuggc

SEQ ID NO: 2161147 - RNA, 14 nt, Human
gguagaccugucuc

SEQ ID NO: 2161148 - RNA, 20 nt, Human
ggggagggugacaguggccg

SEQ ID NO: 2161149 - RNA, 18 nt, Human
gggcuuacggcccuggcc

SEQ ID NO: 2161150 - RNA, 16 nt, Human
gggcuuacggcccugg

SEQ ID NO: 2161151 - RNA, 18 nt, Human
gggcgaucgcggcggagc

SEQ ID NO: 2161152 - RNA, 22 nt, Human
gggcgaucgcggcggagcuggc

SEQ ID NO: 2161153 - RNA, 22 nt, Human
gggcgccgcaaaccacacugga

SEQ ID NO: 2161154 - RNA, 16 nt, Human
gggccuggcagcucag

SEQ ID NO: 2161155 - RNA, 13 nt, Human
gucagccagggcc

SEQ ID NO: 2161156 - RNA, 10 nt, Human
gucagccagg

SEQ ID NO: 2161157 - RNA, 16 nt, Human
gucagccagggccugc

SEQ ID NO: 2161158 - RNA, 14 nt, Human
gucagccagggccu

SEQ ID NO: 2161159 - RNA, 19 nt, Human
gucauagauguuuccuugc

SEQ ID NO: 2161160 - RNA, 21 nt, Human
guccagggagcauuuuccucc

SEQ ID NO: 2161161 - RNA, 17 nt, Human
guccaggauuccucuuu

SEQ ID NO: 2161162 - RNA, 20 nt, Human
guccagaaggagacaggcag

SEQ ID NO: 2161163 - RNA, 19 nt, Human
guccagaaggagacaggca

SEQ ID NO: 2161164 - RNA, 17 nt, Human
guccagaaggagacagg

SEQ ID NO: 2161165 - RNA, 16 nt, Human
guccagaaggagacag

SEQ ID NO: 2161166 - RNA, 14 nt, Human
guccagaaggagac

SEQ ID NO: 2161167 - RNA, 11 nt, Human
guccagaagga

SEQ ID NO: 2161168 - RNA, 14 nt, Human
guauuuguuaaugg

SEQ ID NO: 2161169 - RNA, 15 nt, Human
gucaauguacuagga

SEQ ID NO: 2161170 - RNA, 21 nt, Human
guauuagaguuucaaccauga

SEQ ID NO: 2161171 - RNA, 18 nt, Human
guauucaauauccuuugc

SEQ ID NO: 2161172 - RNA, 23 nt, Human
gucugaguggcuucacuccugcu

SEQ ID NO: 2161173 - RNA, 15 nt, Human
gucugaguggcuuca

SEQ ID NO: 2161174 - RNA, 15 nt, Human
guccucagguggcca

SEQ ID NO: 2161175 - RNA, 14 nt, Human
guccucagguggcc

SEQ ID NO: 2161176 - RNA, 14 nt, Human
guccuccaagccag

SEQ ID NO: 2161177 - RNA, 23 nt, Human
guccucagguggccaugccucag

SEQ ID NO: 2161178 - RNA, 17 nt, Human
guccucagguggccaug

SEQ ID NO: 2161179 - RNA, 16 nt, Human
guccucagguggccau

SEQ ID NO: 2161180 - RNA, 15 nt, Human
guccucccagcuccu

SEQ ID NO: 2161181 - RNA, 22 nt, Human
gugcaugaagguuucugaaaau

SEQ ID NO: 2161182 - RNA, 22 nt, Human
gugcagguagaccugucuccug

SEQ ID NO: 2161183 - RNA, 17 nt, Human
gugcagggacaaagagg

SEQ ID NO: 2161184 - RNA, 15 nt, Human
gugcagguagaccug

SEQ ID NO: 2161185 - RNA, 21 nt, Human
gugcagguagaccugucuccu

SEQ ID NO: 2161186 - RNA, 23 nt, Human
gugaaauucccaacaaacauuga

SEQ ID NO: 2161187 - RNA, 12 nt, Human
gugaaauuccca

SEQ ID NO: 2161188 - RNA, 20 nt, Human
gugaaagcaucacuugggau

SEQ ID NO: 2161189 - RNA, 24 nt, Human
gugaaacccagucacugugagcuc

SEQ ID NO: 2161190 - RNA, 22 nt, Human
gugagcucccaggugcagccag

SEQ ID NO: 2161191 - RNA, 23 nt, Human
guggaggagcucaggacacuaau

SEQ ID NO: 2161192 - RNA, 20 nt, Human
guggaggagcucaggacacu

SEQ ID NO: 2161193 - RNA, 16 nt, Human
guggaggagcucagga

SEQ ID NO: 2161194 - RNA, 15 nt, Human
guggagucauucuca

SEQ ID NO: 2161195 - RNA, 13 nt, Human
gugcuuuauauuu

SEQ ID NO: 2161196 - RNA, 18 nt, Human
guggaaaugcgcaugagu

SEQ ID NO: 2161197 - RNA, 16 nt, Human
gugcuucaacauucuu

SEQ ID NO: 2161198 - RNA, 23 nt, Human
gugcugaguugguguugacaugu

SEQ ID NO: 2161199 - RNA, 13 nt, Human
uaucuaauuuaua

SEQ ID NO: 2161200 - RNA, 15 nt, Human
uaugagacacaggau

SEQ ID NO: 2161201 - RNA, 16 nt, Human
uaugaccuucuaggaa

SEQ ID NO: 2161202 - RNA, 18 nt, Human
uaugaccuucuaggaagc

SEQ ID NO: 2161203 - RNA, 13 nt, Human
uaugcuucuuuca

SEQ ID NO: 2161204 - RNA, 20 nt, Human
uauauguauuuaaaaaaauc

SEQ ID NO: 2161205 - RNA, 13 nt, Human
uauacuggcaugc

SEQ ID NO: 2161206 - RNA, 23 nt, Human
uauacuggcaugcuaaagccuuc

SEQ ID NO: 2161207 - RNA, 15 nt, Human
uauaauauauuugug

SEQ ID NO: 2161208 - RNA, 22 nt, Human
uauaauauuuuuaauuaaauaa

SEQ ID NO: 2161209 - RNA, 22 nt, Human
uauaauauauuuguguauuuaa

SEQ ID NO: 2161210 - RNA, 16 nt, Human
uauaauauauuugugu

SEQ ID NO: 2161211 - RNA, 15 nt, Human
uauaauacuguauuu

SEQ ID NO: 2161212 - RNA, 16 nt, Human
uaggacccaagcagag

SEQ ID NO: 2161213 - RNA, 14 nt, Human
uaggacccaagcag

SEQ ID NO: 2161214 - RNA, 20 nt, Human
uaggcucauuuacuguuuua

SEQ ID NO: 2161215 - RNA, 17 nt, Human
uaggcucauuuacuguu

SEQ ID NO: 2161216 - RNA, 16 nt, Human
uaggcucauuuacugu

SEQ ID NO: 2161217 - RNA, 20 nt, Human
uaggucuagccuauguggau

SEQ ID NO: 2161218 - RNA, 20 nt, Human
uaguaggugaguuuucaccu

SEQ ID NO: 2161219 - RNA, 16 nt, Human
uauguucagaagaaau

SEQ ID NO: 2161220 - RNA, 16 nt, Human
uauucauuuuuguuau

SEQ ID NO: 2161221 - RNA, 13 nt, Human
uauuuaucuucau

SEQ ID NO: 2161222 - RNA, 23 nt, Human
ucaccacucaaaggccagaccug

SEQ ID NO: 2161223 - RNA, 22 nt, Human
ucaccacucaaaggccagaccu

SEQ ID NO: 2161224 - RNA, 20 nt, Human
ucaccacucaaaggccagac

SEQ ID NO: 2161225 - RNA, 22 nt, Human
ucacaccaggcuugccugcagg

SEQ ID NO: 2161226 - RNA, 21 nt, Human
ucacaccaggcuugccugcag

SEQ ID NO: 2161227 - RNA, 23 nt, Human
ucacaccaggcuugccugcaggc

SEQ ID NO: 2161228 - RNA, 20 nt, Human
ucacaagggacgcuuuggga

SEQ ID NO: 2161229 - RNA, 18 nt, Human
ucacaagggacgcuuugg

SEQ ID NO: 2161230 - RNA, 22 nt, Human
ucacacacagacuguugucccu

SEQ ID NO: 2161231 - RNA, 19 nt, Human
ucacacacagacuguuguc

SEQ ID NO: 2161232 - RNA, 23 nt, Human
ucaauuccaacacugauuucccc

SEQ ID NO: 2161233 - RNA, 19 nt, Human
ucaauaaaaaaaagaaaug

SEQ ID NO: 2161234 - RNA, 22 nt, Human
ucaauaaaaaaaagaaaugaaa

SEQ ID NO: 2161235 - RNA, 14 nt, Human
ucaauguuuuuaaa

SEQ ID NO: 2161236 - RNA, 18 nt, Human
ucaauguuuuuaaaaauc

SEQ ID NO: 2161237 - RNA, 22 nt, Human
ucaaacuuccagugcaacacug

SEQ ID NO: 2161238 - RNA, 18 nt, Human
uauuugcacuaagauauu

SEQ ID NO: 2161239 - RNA, 14 nt, Human
uauuugcaauuccu

SEQ ID NO: 2161240 - RNA, 16 nt, Human
ucggcagauacugucu

SEQ ID NO: 2161241 - RNA, 13 nt, Human
ucuacuugcucug

SEQ ID NO: 2161242 - RNA, 16 nt, Human
ucuacuugcucuggac

SEQ ID NO: 2161243 - RNA, 15 nt, Human
ucuacuugcucugga

SEQ ID NO: 2161244 - RNA, 14 nt, Human
ucuacuugcucugg

SEQ ID NO: 2161245 - RNA, 23 nt, Human
ucuacaaucucccuucacaaguu

SEQ ID NO: 2161246 - RNA, 16 nt, Human
ucuacacauacaugua

SEQ ID NO: 2161247 - RNA, 17 nt, Human
ucuacuugcucuggacc

SEQ ID NO: 2161248 - RNA, 18 nt, Human
ucuacuugcucuggaccu

SEQ ID NO: 2161249 - RNA, 18 nt, Human
ucuccccucagagugcaa

SEQ ID NO: 2161250 - RNA, 13 nt, Human
ucuccccucagag

SEQ ID NO: 2161251 - RNA, 15 nt, Human
ucucaugauuuacag

SEQ ID NO: 2161252 - RNA, 19 nt, Human
ucucaucgccagacaacug

SEQ ID NO: 2161253 - RNA, 15 nt, Human
ucucauccugcaggc

SEQ ID NO: 2161254 - RNA, 13 nt, Human
ucucauccugcag

SEQ ID NO: 2161255 - RNA, 17 nt, Human
uccuccaucgcaguguu

SEQ ID NO: 2161256 - RNA, 12 nt, Human
uccuccaagcca

SEQ ID NO: 2161257 - RNA, 14 nt, Human
uccuccaagccagc

SEQ ID NO: 2161258 - RNA, 21 nt, Human
uccuaguuaaucaucauuuuu

SEQ ID NO: 2161259 - RNA, 15 nt, Human
uccuacccugcgccc

SEQ ID NO: 2161260 - RNA, 23 nt, Human
uccugacugucucccgggacuac

SEQ ID NO: 2161261 - RNA, 23 nt, Human
uccugagccagugucaggaggaa

SEQ ID NO: 2161262 - RNA, 20 nt, Human
uccacuuuuuuuuguauguu

SEQ ID NO: 2161263 - RNA, 16 nt, Human
ucaggucaggaguucg

SEQ ID NO: 2161264 - RNA, 19 nt, Human
ucagcucuuggcuccacug

SEQ ID NO: 2161265 - RNA, 12 nt, Human
ucaggacacuaa

SEQ ID NO: 2161266 - RNA, 11 nt, Human
ucaggccucug

SEQ ID NO: 2161267 - RNA, 15 nt, Human
ucauagauguuuccu

SEQ ID NO: 2161268 - RNA, 23 nt, Human
uccaaaccuucacacacagacug

SEQ ID NO: 2161269 - RNA, 22 nt, Human
uccaaaccuucacacacagacu

SEQ ID NO: 2161270 - RNA, 18 nt, Human
uccaaaccuucacacaca

SEQ ID NO: 2161271 - RNA, 14 nt, Human
uccaaaccuucaca

SEQ ID NO: 2161272 - RNA, 13 nt, Human
uccaaaccuucac

SEQ ID NO: 2161273 - RNA, 11 nt, Human
ucauuuacugu

SEQ ID NO: 2161274 - RNA, 15 nt, Human
ucauuuacuguuuua

SEQ ID NO: 2161275 - RNA, 17 nt, Human
ucuugcauauuuuguaa

SEQ ID NO: 2161276 - RNA, 14 nt, Human
ucuuucaugaguuu

SEQ ID NO: 2161277 - RNA, 12 nt, Human
ucuuucaugagu

SEQ ID NO: 2161278 - RNA, 21 nt, Human
ucuuugccaagaccuuucaaa

SEQ ID NO: 2161279 - RNA, 15 nt, Human
ucuuugauccuucuc

SEQ ID NO: 2161280 - RNA, 12 nt, Human
ucuuucuuugga

SEQ ID NO: 2161281 - RNA, 22 nt, Human
ugaacaguuuaucgaccaguuu

SEQ ID NO: 2161282 - RNA, 23 nt, Human
ugaacaagcaaacccagacggcu

SEQ ID NO: 2161283 - RNA, 16 nt, Human
ugaaauauuuuacagu

SEQ ID NO: 2161284 - RNA, 17 nt, Human
ugaaagccccagaaauc

SEQ ID NO: 2161285 - RNA, 16 nt, Human
ugaaagccccagaaau

SEQ ID NO: 2161286 - RNA, 15 nt, Human
ugaaagccccagaaa

SEQ ID NO: 2161287 - RNA, 11 nt, Human
ugaaacccagu

SEQ ID NO: 2161288 - RNA, 20 nt, Human
ugaaacccagucacugugag

SEQ ID NO: 2161289 - RNA, 21 nt, Human
ugacagaacacugucuugaag

SEQ ID NO: 2161290 - RNA, 17 nt, Human
ugacagaacacugucuu

SEQ ID NO: 2161291 - RNA, 16 nt, Human
ugacagaacacugucu

SEQ ID NO: 2161292 - RNA, 15 nt, Human
ugacagaacacuguc

SEQ ID NO: 2161293 - RNA, 14 nt, Human
ugacagaacacugu

SEQ ID NO: 2161294 - RNA, 13 nt, Human
ugacagaacacug

SEQ ID NO: 2161295 - RNA, 20 nt, Human
ugacccuguauauagcccag

SEQ ID NO: 2161296 - RNA, 19 nt, Human
ugacccuguauauagccca

SEQ ID NO: 2161297 - RNA, 18 nt, Human
ugacccuguauauagccc

SEQ ID NO: 2161298 - RNA, 17 nt, Human
ugacccuguauauagcc

SEQ ID NO: 2161299 - RNA, 18 nt, Human
ugaauugagcugcagaaa

SEQ ID NO: 2161300 - RNA, 13 nt, Human
ugaaucuuugugc

SEQ ID NO: 2161301 - RNA, 20 nt, Human
ugauucacuucacgcuuuca

SEQ ID NO: 2161302 - RNA, 18 nt, Human
ugaugugggucaaggaau

SEQ ID NO: 2161303 - RNA, 14 nt, Human
ugaugcccugcccu

SEQ ID NO: 2161304 - RNA, 14 nt, Human
ugaucuucaacaaa

SEQ ID NO: 2161305 - RNA, 21 nt, Human
ugaucuucaacaaauugcccu

SEQ ID NO: 2161306 - RNA, 15 nt, Human
ugaucuucaacaaau

SEQ ID NO: 2161307 - RNA, 22 nt, Human
ugaucuucaacaaauugcccuu

SEQ ID NO: 2161308 - RNA, 19 nt, Human
ugaucugugaauugagcug

SEQ ID NO: 2161309 - RNA, 12 nt, Human
ugaucaggaccu

SEQ ID NO: 2161310 - RNA, 20 nt, Human
ugaucaggaccuccaagcca

SEQ ID NO: 2161311 - RNA, 18 nt, Human
ugauccaagcaagacuga

SEQ ID NO: 2161312 - RNA, 17 nt, Human
ugagucgcgcaccgaaa

SEQ ID NO: 2161313 - RNA, 17 nt, Human
ugagucuguuuuguaaa

SEQ ID NO: 2161314 - RNA, 16 nt, Human
ugagucuguuuuguaa

SEQ ID NO: 2161315 - RNA, 18 nt, Human
ugagucuguuuuguaaag

SEQ ID NO: 2161316 - RNA, 23 nt, Human
ugaguuuucaccucgaauuuugu

SEQ ID NO: 2161317 - RNA, 23 nt, Human
ugaguugacuugacagaacacug

SEQ ID NO: 2161318 - RNA, 14 nt, Human
ugagggagauccca

SEQ ID NO: 2161319 - RNA, 18 nt, Human
ugcuguaaauuuggcuuc

SEQ ID NO: 2161320 - RNA, 20 nt, Human
ugcuguaaauuuggcuucug

SEQ ID NO: 2161321 - RNA, 19 nt, Human
ugcuguaaauuuggcuucu

SEQ ID NO: 2161322 - RNA, 15 nt, Human
ugcugguuuuaacaa

SEQ ID NO: 2161323 - RNA, 16 nt, Human
ugcugguuuuaacaac

SEQ ID NO: 2161324 - RNA, 20 nt, Human
ugcuaacuagcuuggaaacu

SEQ ID NO: 2161325 - RNA, 22 nt, Human
ugcuaacuagcuuggaaacugg

SEQ ID NO: 2161326 - RNA, 19 nt, Human
ugcuacucaaguagcauuu

SEQ ID NO: 2161327 - RNA, 14 nt, Human
ugcucagaccagcu

SEQ ID NO: 2161328 - RNA, 19 nt, Human
ugcucagggaaaagcagcu

SEQ ID NO: 2161329 - RNA, 20 nt, Human
ugcuaggcccccggguguga

SEQ ID NO: 2161330 - RNA, 20 nt, Human
ugccguuacuuuucauauuu

SEQ ID NO: 2161331 - RNA, 22 nt, Human
ugccguuacuuuucauauuugc

SEQ ID NO: 2161332 - RNA, 15 nt, Human
ugcauuuguauauuu

SEQ ID NO: 2161333 - RNA, 15 nt, Human
ugcagggacaaagag

SEQ ID NO: 2161334 - RNA, 16 nt, Human
ugcagggacaaagagg

SEQ ID NO: 2161335 - RNA, 17 nt, Human
uggcccaggugaguccu

SEQ ID NO: 2161336 - RNA, 20 nt, Human
uggccccgccgccugguacu

SEQ ID NO: 2161337 - RNA, 15 nt, Human
uggccccgccgccug

SEQ ID NO: 2161338 - RNA, 13 nt, Human
uggccccgccgcc

SEQ ID NO: 2161339 - RNA, 21 nt, Human
uggccccgccgccugguacuc

SEQ ID NO: 2161340 - RNA, 18 nt, Human
uggccucccacagacuca

SEQ ID NO: 2161341 - RNA, 17 nt, Human
uggcaaggguucaccug

SEQ ID NO: 2161342 - RNA, 22 nt, Human
uggcagaauggggugcaugaag

SEQ ID NO: 2161343 - RNA, 22 nt, Human
uggaggagcucaggacacuaau

SEQ ID NO: 2161344 - RNA, 20 nt, Human
uggaggagcucaggacacua

SEQ ID NO: 2161345 - RNA, 17 nt, Human
uggacuccggcccuccu

SEQ ID NO: 2161346 - RNA, 19 nt, Human
uggacugaccugguccaca

SEQ ID NO: 2161347 - RNA, 17 nt, Human
uggacugaccuggucca

SEQ ID NO: 2161348 - RNA, 14 nt, Human
uggacuccggcccu

SEQ ID NO: 2161349 - RNA, 13 nt, Human
ugggucaaggaau

SEQ ID NO: 2161350 - RNA, 16 nt, Human
uggucaaacaaacucu

SEQ ID NO: 2161351 - RNA, 21 nt, Human
uggucaaacaaacucucugaa

SEQ ID NO: 2161352 - RNA, 22 nt, Human
uggucaaacaaacucucugaac

SEQ ID NO: 2161353 - RNA, 23 nt, Human
uggugcagguagaccugucuccu

SEQ ID NO: 2161354 - RNA, 21 nt, Human
uggugcagguagaccugucuc

SEQ ID NO: 2161355 - RNA, 15 nt, Human
uggggauauaauacu

SEQ ID NO: 2161356 - RNA, 13 nt, Human
ugggcccucuggu

SEQ ID NO: 2161357 - RNA, 14 nt, Human
ugggcccucugguu

SEQ ID NO: 2161358 - RNA, 16 nt, Human
ugggcccucugguuug

SEQ ID NO: 2161359 - RNA, 14 nt, Human
ugggauguuucugu

SEQ ID NO: 2161360 - RNA, 19 nt, Human
uuaaccccgucaacaaauc

SEQ ID NO: 2161361 - RNA, 18 nt, Human
uuaaccccgucaacaaau

SEQ ID NO: 2161362 - RNA, 17 nt, Human
uuaaccccgucaacaaa

SEQ ID NO: 2161363 - RNA, 19 nt, Human
uuaacuauuuuauuuucua

SEQ ID NO: 2161364 - RNA, 12 nt, Human
uuaacucaauau

SEQ ID NO: 2161365 - RNA, 20 nt, Human
uuacaagcccccccuuccac

SEQ ID NO: 2161366 - RNA, 19 nt, Human
uuacaagcccccccuucca

SEQ ID NO: 2161367 - RNA, 17 nt, Human
uuacaagcccccccuuc

SEQ ID NO: 2161368 - RNA, 17 nt, Human
uguuuguaagugaagug

SEQ ID NO: 2161369 - RNA, 14 nt, Human
uuaaaaguaaaugu

SEQ ID NO: 2161370 - RNA, 19 nt, Human
uuaaagaaguaugggaaau

SEQ ID NO: 2161371 - RNA, 10 nt, Human
uguuuuuaaa

SEQ ID NO: 2161372 - RNA, 19 nt, Human
uguuuuguaaaguccccag

SEQ ID NO: 2161373 - RNA, 17 nt, Human
uguuuugucuuacaaag

SEQ ID NO: 2161374 - RNA, 15 nt, Human
uuaggauggcaggac

SEQ ID NO: 2161375 - RNA, 18 nt, Human
uuagucucuaaagaguuu

SEQ ID NO: 2161376 - RNA, 20 nt, Human
uuagcugcuucuauguuuca

SEQ ID NO: 2161377 - RNA, 12 nt, Human
uuagcugcuucu

SEQ ID NO: 2161378 - RNA, 14 nt, Human
uuacugugucuuug

SEQ ID NO: 2161379 - RNA, 13 nt, Human
uuacugugucuuu

SEQ ID NO: 2161380 - RNA, 21 nt, Human
uuacuuuucauauuugcacua

SEQ ID NO: 2161381 - RNA, 16 nt, Human
uuacuuuucauauuug

SEQ ID NO: 2161382 - RNA, 16 nt, Human
uuccuuguagccuuuu

SEQ ID NO: 2161383 - RNA, 19 nt, Human
uuccuuguagccuuuugac

SEQ ID NO: 2161384 - RNA, 18 nt, Human
uuccuuguagccuuuuga

SEQ ID NO: 2161385 - RNA, 14 nt, Human
uucgggcuggccau

SEQ ID NO: 2161386 - RNA, 17 nt, Human
uucccugcuuaaugaaa

SEQ ID NO: 2161387 - RNA, 19 nt, Human
uucccuucgacagcauuuu

SEQ ID NO: 2161388 - RNA, 21 nt, Human
uuccucacaccaggcuugccu

SEQ ID NO: 2161389 - RNA, 21 nt, Human
uucccccaccccauuucucuc

SEQ ID NO: 2161390 - RNA, 23 nt, Human
uucccccaaauuuaaagaaguau

SEQ ID NO: 2161391 - RNA, 19 nt, Human
uucccauccucuucuuuua

SEQ ID NO: 2161392 - RNA, 13 nt, Human
uuccauucucacc

SEQ ID NO: 2161393 - RNA, 23 nt, Human
uuccaugugaggguuuucagcau

SEQ ID NO: 2161394 - RNA, 20 nt, Human
uuauugaaucuauuuaagua

SEQ ID NO: 2161395 - RNA, 18 nt, Human
uuauugaaucuauuuaag

SEQ ID NO: 2161396 - RNA, 12 nt, Human
uuaugcuuuugg

SEQ ID NO: 2161397 - RNA, 17 nt, Human
uuaugcauguuuguugu

SEQ ID NO: 2161398 - RNA, 15 nt, Human
uuaugccuuuuauuu

SEQ ID NO: 2161399 - RNA, 14 nt, Human
uucaaagccauuuu

SEQ ID NO: 2161400 - RNA, 13 nt, Human
uucaaagccauuu

SEQ ID NO: 2161401 - RNA, 12 nt, Human
uuauuuuaagac

SEQ ID NO: 2161402 - RNA, 14 nt, Human
uucacuccugcugu

SEQ ID NO: 2161403 - RNA, 19 nt, Human
uucaauuuccaagagcuga

SEQ ID NO: 2161404 - RNA, 17 nt, Human
uucaauuuccaagagcu

SEQ ID NO: 2161405 - RNA, 17 nt, Human
uucacaaacagaaaaca

SEQ ID NO: 2161406 - RNA, 14 nt, Human
uucacguagaacau

SEQ ID NO: 2161407 - RNA, 19 nt, Human
uuugaauauaaacacuaua

SEQ ID NO: 2161408 - RNA, 18 nt, Human
uuugaauauaaacacuau

SEQ ID NO: 2161409 - RNA, 17 nt, Human
uuugaauauaaacacua

SEQ ID NO: 2161410 - RNA, 15 nt, Human
uuugccaagaccuuu

SEQ ID NO: 2161411 - RNA, 16 nt, Human
uuuggacuguuuuguu

SEQ ID NO: 2161412 - RNA, 16 nt, Human
uuugcuucucucucua

SEQ ID NO: 2161413 - RNA, 17 nt, Human
uuuguaaaguccccaga

SEQ ID NO: 2161414 - RNA, 12 nt, Human
uuuguauguuuu

SEQ ID NO: 2161415 - RNA, 10 nt, Human
uuuguauguu

SEQ ID NO: 2161416 - RNA, 18 nt, Human
uuuguauguuuuuuuucu

SEQ ID NO: 2161417 - RNA, 22 nt, Human
uuucauuuuguaacaaaugaac

SEQ ID NO: 2161418 - RNA, 17 nt, Human
uuucagugaaagcauca

SEQ ID NO: 2161419 - RNA, 21 nt, Human
uuucauuuguuuguuuuccuu

SEQ ID NO: 2161420 - RNA, 21 nt, Human
uuucaaugguuugcaaggaag

SEQ ID NO: 2161421 - RNA, 20 nt, Human
uuuaugccuuuuauuucuua

SEQ ID NO: 2161422 - RNA, 14 nt, Human
uuucaauuuccaag

SEQ ID NO: 2161423 - RNA, 17 nt, Human
uuuccucugcuuugaaa

SEQ ID NO: 2161424 - RNA, 13 nt, Human
uuuccucugcuuu

SEQ ID NO: 2161425 - RNA, 16 nt, Human
uuucucuccucacaca

SEQ ID NO: 2161426 - RNA, 20 nt, Human
uuucugaaaauuaacacugc

SEQ ID NO: 2161427 - RNA, 19 nt, Human
uuucugaaaauuaacacug

SEQ ID NO: 2161428 - RNA, 16 nt, Human
uuucuccuuuguacuu

SEQ ID NO: 2161429 - RNA, 13 nt, Human
uuguucaaacauu

SEQ ID NO: 2161430 - RNA, 19 nt, Human
uuguuuauuaguuuugcau

SEQ ID NO: 2161431 - RNA, 12 nt, Human
uuguuucuguuu

SEQ ID NO: 2161432 - RNA, 13 nt, Human
uuguuuguuuucc

SEQ ID NO: 2161433 - RNA, 20 nt, Human
uuuaaaaguuacuccuuuua

SEQ ID NO: 2161434 - RNA, 13 nt, Human
uuuauacuguaua

SEQ ID NO: 2161435 - RNA, 17 nt, Human
uuuauacuggcaugcua

SEQ ID NO: 2161436 - RNA, 21 nt, Human
uuuaaccccgucaacaaaucu

SEQ ID NO: 2161437 - RNA, 18 nt, Human
uuuaaccccgucaacaaa

SEQ ID NO: 2161438 - RNA, 17 nt, Human
uuuaaccccgucaacaa

SEQ ID NO: 2161439 - RNA, 16 nt, Human
uuuaaccccgucaaca

SEQ ID NO: 2161440 - RNA, 21 nt, Human
uuuaaccauggugcuuguuaa

SEQ ID NO: 2161441 - RNA, 19 nt, Human
uuuacccacacacagauaa

SEQ ID NO: 2161442 - RNA, 12 nt, Human
uugcauaauaaa

SEQ ID NO: 2161443 - RNA, 13 nt, Human
uugcauaagguuu

SEQ ID NO: 2161444 - RNA, 18 nt, Human
uugauauuugugcauuuu

SEQ ID NO: 2161445 - RNA, 21 nt, Human
uugauauuugugcauuuucua

SEQ ID NO: 2161446 - RNA, 20 nt, Human
uugauauuugugcauuuucu

SEQ ID NO: 2161447 - RNA, 19 nt, Human
uugaauuaaauguucaucu

SEQ ID NO: 2161448 - RNA, 21 nt, Human
uucuguaucuacuuuaauaaa

SEQ ID NO: 2161449 - RNA, 17 nt, Human
uucuguaucuacuuuaa

SEQ ID NO: 2161450 - RNA, 15 nt, Human
uucuggccucccaca

SEQ ID NO: 2161451 - RNA, 14 nt, Human
uucuggccucccac

SEQ ID NO: 2161452 - RNA, 22 nt, Human
uucuuauaggaaagcuugagua

SEQ ID NO: 2161453 - RNA, 21 nt, Human
uucuuucccugcuuaaugaaa

SEQ ID NO: 2161454 - RNA, 17 nt, Human
uuguagcauccucuuua

SEQ ID NO: 2161455 - RNA, 21 nt, Human
uugggaaggggacccccgccc

SEQ ID NO: 2161456 - RNA, 13 nt, Human
uugggauuaauau

SEQ ID NO: 2161457 - RNA, 17 nt, Human
caauauugacuuugucu

SEQ ID NO: 2161458 - RNA, 16 nt, Human
caauauugacuuuguc

SEQ ID NO: 2161459 - RNA, 14 nt, Human
caauauugacuuug

SEQ ID NO: 2161460 - RNA, 13 nt, Human
caauauagcaaga

SEQ ID NO: 2161461 - RNA, 12 nt, Human
caauauagcaag

SEQ ID NO: 2161462 - RNA, 14 nt, Human
caaugacuaauucu

SEQ ID NO: 2161463 - RNA, 22 nt, Human
caauguacuaggauacugcugc

SEQ ID NO: 2161464 - RNA, 23 nt, Human
caauguagucagaauuagcugcu

SEQ ID NO: 2161465 - RNA, 21 nt, Human
caauguacuaggauacugcug

SEQ ID NO: 2161466 - RNA, 21 nt, Human
caaugacuaauucuugcauau

SEQ ID NO: 2161467 - RNA, 14 nt, Human
caauguuaacauuu

SEQ ID NO: 2161468 - RNA, 20 nt, Human
caacacugggaaacagaggc

SEQ ID NO: 2161469 - RNA, 23 nt, Human
caacacugauuuccccuuuugca

SEQ ID NO: 2161470 - RNA, 21 nt, Human
caacacugauuuccccuuuug

SEQ ID NO: 2161471 - RNA, 22 nt, Human
caagacucugucuaaaaaacaa

SEQ ID NO: 2161472 - RNA, 23 nt, Human
caagacucugucuaaaaaacaaa

SEQ ID NO: 2161473 - RNA, 20 nt, Human
caaggagggugagugcaagg

SEQ ID NO: 2161474 - RNA, 19 nt, Human
caaggagggugagugcaag

SEQ ID NO: 2161475 - RNA, 22 nt, Human
caagccagcgggaauggcagcu

SEQ ID NO: 2161476 - RNA, 22 nt, Human
caaagggggaggcuaaagccca

SEQ ID NO: 2161477 - RNA, 23 nt, Human
caaauacucauuuuaggaaaaaa

SEQ ID NO: 2161478 - RNA, 22 nt, Human
caaacuaggggacaaagcaaaa

SEQ ID NO: 2161479 - RNA, 20 nt, Human
caaacuaggggacaaagcaa

SEQ ID NO: 2161480 - RNA, 21 nt, Human
caaaggccagaccugcagacg

SEQ ID NO: 2161481 - RNA, 20 nt, Human
caaaggccagaccugcagac

SEQ ID NO: 2161482 - RNA, 19 nt, Human
caaaggccagaccugcaga

SEQ ID NO: 2161483 - RNA, 18 nt, Human
caaaggccagaccugcag

SEQ ID NO: 2161484 - RNA, 22 nt, Human
caaaggccagaccugcagacgc

SEQ ID NO: 2161485 - RNA, 13 nt, Human
caaacacauuaag

SEQ ID NO: 2161486 - RNA, 23 nt, Human
caaacacauuaagccuuccacac

SEQ ID NO: 2161487 - RNA, 15 nt, Human
caaaauggauaaaau

SEQ ID NO: 2161488 - RNA, 23 nt, Human
caaaauggauaaaaucugauaug

SEQ ID NO: 2161489 - RNA, 18 nt, Human
caaaauggauaaaaucug

SEQ ID NO: 2161490 - RNA, 13 nt, Human
caaaacaaaacaa

SEQ ID NO: 2161491 - RNA, 18 nt, Human
caaaacagaggcacuuaa

SEQ ID NO: 2161492 - RNA, 21 nt, Human
caaaaacccagcaacagaaaa

SEQ ID NO: 2161493 - RNA, 22 nt, Human
cacagugugaauaaagugcugc

SEQ ID NO: 2161494 - RNA, 13 nt, Human
cacagugugaaua

SEQ ID NO: 2161495 - RNA, 14 nt, Human
aagcaaaaagugau

SEQ ID NO: 2161496 - RNA, 17 nt, Human
guguauuuaacagggag

SEQ ID NO: 2161497 - RNA, 18 nt, Human
guguauuuaacagggagg

SEQ ID NO: 2161498 - RNA, 17 nt, Human
aagauagcuucacccca

SEQ ID NO: 2161499 - RNA, 13 nt, Human
gugguugugaucc

SEQ ID NO: 2161500 - RNA, 19 nt, Human
gugcugcggagcaagagga

SEQ ID NO: 2161501 - RNA, 16 nt, Human
gugugaauaaagugcu

SEQ ID NO: 2161502 - RNA, 19 nt, Human
aagcacacucauccccuca

SEQ ID NO: 2161503 - RNA, 21 nt, Human
aagcacaaugucucacauggg

SEQ ID NO: 2161504 - RNA, 15 nt, Human
aagcauguguuugca

SEQ ID NO: 2161505 - RNA, 20 nt, Human
guuauuggccuuuucuauuc

SEQ ID NO: 2161506 - RNA, 16 nt, Human
aagccuuccacacuca

SEQ ID NO: 2161507 - RNA, 20 nt, Human
guugacuugacagaacacug

SEQ ID NO: 2161508 - RNA, 19 nt, Human
guugacuugacagaacacu

SEQ ID NO: 2161509 - RNA, 17 nt, Human
guucuugccacuuuuuu

SEQ ID NO: 2161510 - RNA, 13 nt, Human
aagcuuccuuggc

SEQ ID NO: 2161511 - RNA, 21 nt, Human
aagcucuugaagacacugaaa

SEQ ID NO: 2161512 - RNA, 19 nt, Human
aagcucuugaagacacuga

SEQ ID NO: 2161513 - RNA, 20 nt, Human
aagcucuugaagacacugaa

SEQ ID NO: 2161514 - RNA, 17 nt, Human
aagcucuugaagacacu

SEQ ID NO: 2161515 - RNA, 14 nt, Human
aaguuaaauuuuau

SEQ ID NO: 2161516 - RNA, 20 nt, Human
aaguuaugggaauaccugug

SEQ ID NO: 2161517 - RNA, 12 nt, Human
aagugccagaaa

SEQ ID NO: 2161518 - RNA, 16 nt, Human
uaaaauguaucuucca

SEQ ID NO: 2161519 - RNA, 21 nt, Human
aaguuuccuuccagcccagaa

SEQ ID NO: 2161520 - RNA, 20 nt, Human
aaguuuccuuccagcccaga

SEQ ID NO: 2161521 - RNA, 19 nt, Human
aaguuuccuuccagcccag

SEQ ID NO: 2161522 - RNA, 18 nt, Human
aaguuuccuuccagccca

SEQ ID NO: 2161523 - RNA, 18 nt, Human
uaaaauaaauauugucuu

SEQ ID NO: 2161524 - RNA, 14 nt, Human
uaaaauaaauauug

SEQ ID NO: 2161525 - RNA, 17 nt, Human
uaaaauaaauauugucu

SEQ ID NO: 2161526 - RNA, 13 nt, Human
uaaaacuuuuuau

SEQ ID NO: 2161527 - RNA, 23 nt, Human
uaaaacuuuuuauauuuuauaca

SEQ ID NO: 2161528 - RNA, 19 nt, Human
uaaaagaaagaaagaaaaa

SEQ ID NO: 2161529 - RNA, 14 nt, Human
uaaaacucuuuuaa

SEQ ID NO: 2161530 - RNA, 15 nt, Human
uaaaacuacaaaaau

SEQ ID NO: 2161531 - RNA, 18 nt, Human
aaguaacuuuaaauuaug

SEQ ID NO: 2161532 - RNA, 16 nt, Human
aagguuucugaaaauu

SEQ ID NO: 2161533 - RNA, 18 nt, Human
aagguuugguccagccug

SEQ ID NO: 2161534 - RNA, 20 nt, Human
aaggggacccccgcccccug

SEQ ID NO: 2161535 - RNA, 16 nt, Human
aaggggacccccgccc

SEQ ID NO: 2161536 - RNA, 15 nt, Human
aaggcuuaaacccau

SEQ ID NO: 2161537 - RNA, 22 nt, Human
guuuuaaagaccugacaccuuu

SEQ ID NO: 2161538 - RNA, 13 nt, Human
aaguaacuuuaaa

SEQ ID NO: 2161539 - RNA, 19 nt, Human
guuuuaauuuauacuggca

SEQ ID NO: 2161540 - RNA, 21 nt, Human
aaguauugcugaguccaacaa

SEQ ID NO: 2161541 - RNA, 23 nt, Human
gucuagccuauguggauuuuuuc

SEQ ID NO: 2161542 - RNA, 18 nt, Human
gucgcgcaccgaaaaacu

SEQ ID NO: 2161543 - RNA, 15 nt, Human
gucgagucaaaaugu

SEQ ID NO: 2161544 - RNA, 20 nt, Human
guccucuuuacaugaaacua

SEQ ID NO: 2161545 - RNA, 19 nt, Human
aacauaaagcaaauagaca

SEQ ID NO: 2161546 - RNA, 14 nt, Human
aacauaaagcaaau

SEQ ID NO: 2161547 - RNA, 17 nt, Human
aacauguauaauauuuu

SEQ ID NO: 2161548 - RNA, 14 nt, Human
aacauucaggagcu

SEQ ID NO: 2161549 - RNA, 13 nt, Human
aacauucaggagc

SEQ ID NO: 2161550 - RNA, 20 nt, Human
aacacaaagagaaaaagaaa

SEQ ID NO: 2161551 - RNA, 23 nt, Human
guccccagagaaagcgcagaugc

SEQ ID NO: 2161552 - RNA, 12 nt, Human
guccccagagaa

SEQ ID NO: 2161553 - RNA, 23 nt, Human
gucacaaagaacauguagaaaac

SEQ ID NO: 2161554 - RNA, 15 nt, Human
gucacugcucuggac

SEQ ID NO: 2161555 - RNA, 15 nt, Human
gucagaaacaggacc

SEQ ID NO: 2161556 - RNA, 21 nt, Human
aaauucaacguuaauaauucu

SEQ ID NO: 2161557 - RNA, 21 nt, Human
aaauuaggauguaaaucugcu

SEQ ID NO: 2161558 - RNA, 20 nt, Human
aaauucccaacaaacauuga

SEQ ID NO: 2161559 - RNA, 18 nt, Human
aaauguaugauuacauca

SEQ ID NO: 2161560 - RNA, 14 nt, Human
aaauguaucuucca

SEQ ID NO: 2161561 - RNA, 17 nt, Human
aaauguauauauguaua

SEQ ID NO: 2161562 - RNA, 23 nt, Human
guauuguuugggauccuauugaa

SEQ ID NO: 2161563 - RNA, 9 nt, Human
guauuuaac

SEQ ID NO: 2161564 - RNA, 20 nt, Human
guauuguuugggauccuauu

SEQ ID NO: 2161565 - RNA, 22 nt, Human
gucuucaaccagggauuguuuc

SEQ ID NO: 2161566 - RNA, 12 nt, Human
gucuauuugaga

SEQ ID NO: 2161567 - RNA, 22 nt, Human
gucucuuucaugaguuuuuccc

SEQ ID NO: 2161568 - RNA, 12 nt, Human
aaccuucuggcc

SEQ ID NO: 2161569 - RNA, 19 nt, Human
aaccuucacacacagacug

SEQ ID NO: 2161570 - RNA, 17 nt, Human
aaccuucuggccuccca

SEQ ID NO: 2161571 - RNA, 13 nt, Human
gugaauaaagugc

SEQ ID NO: 2161572 - RNA, 15 nt, Human
gugaaguugcuucuu

SEQ ID NO: 2161573 - RNA, 14 nt, Human
gugaauaaagugcu

SEQ ID NO: 2161574 - RNA, 12 nt, Human
aacucucugaac

SEQ ID NO: 2161575 - RNA, 14 nt, Human
aacucuuuuaacag

SEQ ID NO: 2161576 - RNA, 13 nt, Human
aacucuuuuaaca

SEQ ID NO: 2161577 - RNA, 14 nt, Human
aagaagagaaagaa

SEQ ID NO: 2161578 - RNA, 15 nt, Human
aagaagagccacagu

SEQ ID NO: 2161579 - RNA, 14 nt, Human
aagaagagccacag

SEQ ID NO: 2161580 - RNA, 20 nt, Human
gugcuacaggggccagaaga

SEQ ID NO: 2161581 - RNA, 19 nt, Human
gugcuacaggggccagaag

SEQ ID NO: 2161582 - RNA, 16 nt, Human
gugcuacaggggccag

SEQ ID NO: 2161583 - RNA, 21 nt, Human
aacuugagaacuuuauuucca

SEQ ID NO: 2161584 - RNA, 22 nt, Human
aacuugagaacuuuauuuccaa

SEQ ID NO: 2161585 - RNA, 18 nt, Human
aacuugagaacuuuauuu

SEQ ID NO: 2161586 - RNA, 20 nt, Human
gugaucuuuuguucccaucc

SEQ ID NO: 2161587 - RNA, 21 nt, Human
uagggaauggcacagcccaaa

SEQ ID NO: 2161588 - RNA, 20 nt, Human
acaaugacuaauucuugcau

SEQ ID NO: 2161589 - RNA, 21 nt, Human
acaauaaguuaacuauuuuau

SEQ ID NO: 2161590 - RNA, 21 nt, Human
acaaauuuuuauuucuaaaau

SEQ ID NO: 2161591 - RNA, 15 nt, Human
uagccagaggacugu

SEQ ID NO: 2161592 - RNA, 18 nt, Human
acaaauuuuuauuucuaa

SEQ ID NO: 2161593 - RNA, 16 nt, Human
acaaauuuuuauuucu

SEQ ID NO: 2161594 - RNA, 14 nt, Human
acaaagggcccaga

SEQ ID NO: 2161595 - RNA, 18 nt, Human
acaaaggcaaagggucca

SEQ ID NO: 2161596 - RNA, 22 nt, Human
acaaagaugggugaaggcuggc

SEQ ID NO: 2161597 - RNA, 21 nt, Human
acaaagaugggugaaggcugg

SEQ ID NO: 2161598 - RNA, 20 nt, Human
acacagugugaauaaagugc

SEQ ID NO: 2161599 - RNA, 23 nt, Human
acacaaugugucuuucuuuuugg

SEQ ID NO: 2161600 - RNA, 17 nt, Human
acacaaugugucuuucu

SEQ ID NO: 2161601 - RNA, 15 nt, Human
acaauguauuuucuu

SEQ ID NO: 2161602 - RNA, 15 nt, Human
acaccuuauauuuac

SEQ ID NO: 2161603 - RNA, 22 nt, Human
acaccuuucuccuuuguacuuu

SEQ ID NO: 2161604 - RNA, 17 nt, Human
acaccuuucuccuuugu

SEQ ID NO: 2161605 - RNA, 14 nt, Human
acaccuuucuccuu

SEQ ID NO: 2161606 - RNA, 17 nt, Human
acaccauugaaggcuua

SEQ ID NO: 2161607 - RNA, 15 nt, Human
uaguuacuauaugcc

SEQ ID NO: 2161608 - RNA, 12 nt, Human
acagggagggga

SEQ ID NO: 2161609 - RNA, 10 nt, Human
acagggaggg

SEQ ID NO: 2161610 - RNA, 22 nt, Human
acagggacugaaaaccucuccu

SEQ ID NO: 2161611 - RNA, 16 nt, Human
uauucaauauccuuug

SEQ ID NO: 2161612 - RNA, 22 nt, Human
uauguuuuuuuucugcuggaaa

SEQ ID NO: 2161613 - RNA, 15 nt, Human
uauguuuuuuuucug

SEQ ID NO: 2161614 - RNA, 18 nt, Human
uauguuuuuguguauuug

SEQ ID NO: 2161615 - RNA, 14 nt, Human
uauguuuuugugua

SEQ ID NO: 2161616 - RNA, 15 nt, Human
uauuaaaacucuuuu

SEQ ID NO: 2161617 - RNA, 15 nt, Human
uaugugaaacaaugu

SEQ ID NO: 2161618 - RNA, 23 nt, Human
uauauuuagcuccaaaccuucac

SEQ ID NO: 2161619 - RNA, 15 nt, Human
uaucuccaagaccag

SEQ ID NO: 2161620 - RNA, 17 nt, Human
uaugcuaaaauacauuu

SEQ ID NO: 2161621 - RNA, 20 nt, Human
uaugccuuugauguauuuuc

SEQ ID NO: 2161622 - RNA, 22 nt, Human
uaugccguuacuuuucauauuu

SEQ ID NO: 2161623 - RNA, 21 nt, Human
uacucugcuuuuuuucuacug

SEQ ID NO: 2161624 - RNA, 22 nt, Human
uacguuugaagacauugcacca

SEQ ID NO: 2161625 - RNA, 16 nt, Human
uacguuugaagacauu

SEQ ID NO: 2161626 - RNA, 15 nt, Human
aauuagcugcuucua

SEQ ID NO: 2161627 - RNA, 14 nt, Human
aauuagcugcuucu

SEQ ID NO: 2161628 - RNA, 15 nt, Human
uaccuguauucccag

SEQ ID NO: 2161629 - RNA, 17 nt, Human
aauucccaacaaacauu

SEQ ID NO: 2161630 - RNA, 18 nt, Human
aauucaacguuaauaauu

SEQ ID NO: 2161631 - RNA, 21 nt, Human
aauucaacguuaauaauucug

SEQ ID NO: 2161632 - RNA, 22 nt, Human
aauuaguaggcucauuuacugu

SEQ ID NO: 2161633 - RNA, 21 nt, Human
aauuaguaggcucauuuacug

SEQ ID NO: 2161634 - RNA, 16 nt, Human
aauguuaacauuuuug

SEQ ID NO: 2161635 - RNA, 17 nt, Human
aaugugccuaguucuuu

SEQ ID NO: 2161636 - RNA, 14 nt, Human
aauggaaacugaaa

SEQ ID NO: 2161637 - RNA, 21 nt, Human
aaugccauggacagaagaagg

SEQ ID NO: 2161638 - RNA, 13 nt, Human
aauggcuccuuca

SEQ ID NO: 2161639 - RNA, 19 nt, Human
aauggcacagcccaaagaa

SEQ ID NO: 2161640 - RNA, 20 nt, Human
aauggcacagcccaaagaag

SEQ ID NO: 2161641 - RNA, 17 nt, Human
aauggcacagcccaaag

SEQ ID NO: 2161642 - RNA, 17 nt, Human
uaauagacuaaaugaaa

SEQ ID NO: 2161643 - RNA, 22 nt, Human
aaucuuaucaagaguugugaca

SEQ ID NO: 2161644 - RNA, 14 nt, Human
uaaucccagcuacu

SEQ ID NO: 2161645 - RNA, 14 nt, Human
uaaucccagcaauu

SEQ ID NO: 2161646 - RNA, 14 nt, Human
uaauauuuuuaauu

SEQ ID NO: 2161647 - RNA, 15 nt, Human
uaauauuuuuaauua

SEQ ID NO: 2161648 - RNA, 22 nt, Human
uaaugucuguaucacucugugu

SEQ ID NO: 2161649 - RNA, 15 nt, Human
uaagcuuugacacug

SEQ ID NO: 2161650 - RNA, 16 nt, Human
uaaguuguuauuucag

SEQ ID NO: 2161651 - RNA, 15 nt, Human
aaucaucuuugugaa

SEQ ID NO: 2161652 - RNA, 19 nt, Human
aaucauauuaauacaauga

SEQ ID NO: 2161653 - RNA, 14 nt, Human
aauauauuugugua

SEQ ID NO: 2161654 - RNA, 13 nt, Human
aauauauuugugu

SEQ ID NO: 2161655 - RNA, 21 nt, Human
uaaaauuuggccaaacaagug

SEQ ID NO: 2161656 - RNA, 22 nt, Human
aauaguugaaccuauuucucuu

SEQ ID NO: 2161657 - RNA, 24 nt, Human
aauauauuuguguauuuaacaggg

SEQ ID NO: 2161658 - RNA, 13 nt, Human
aauaucagacuuu

SEQ ID NO: 2161659 - RNA, 21 nt, Human
aauauauuuguguauuuaaca

SEQ ID NO: 2161660 - RNA, 19 nt, Human
aauauauuuguguauuuaa

SEQ ID NO: 2161661 - RNA, 10 nt, Human
aauauucugg

SEQ ID NO: 2161662 - RNA, 16 nt, Human
aauauugacuuugucu

SEQ ID NO: 2161663 - RNA, 15 nt, Human
aauauugacuuuguc

SEQ ID NO: 2161664 - RNA, 14 nt, Human
aauauugacuuugu

SEQ ID NO: 2161665 - RNA, 13 nt, Human
aauauugucuuuu

SEQ ID NO: 2161666 - RNA, 21 nt, Human
aauauugucuuuuuguauguc

SEQ ID NO: 2161667 - RNA, 18 nt, Human
aauauuugguuuuccugu

SEQ ID NO: 2161668 - RNA, 21 nt, Human
aauauuuugaucuucaacaaa

SEQ ID NO: 2161669 - RNA, 20 nt, Human
aauauuuugaucuucaacaa

SEQ ID NO: 2161670 - RNA, 13 nt, Human
aauauuuugaucu

SEQ ID NO: 2161671 - RNA, 23 nt, Human
aauauuuugaucuucaacaaauu

SEQ ID NO: 2161672 - RNA, 14 nt, Human
ucacaaccugaacc

SEQ ID NO: 2161673 - RNA, 19 nt, Human
ucacaaccugaaccuagga

SEQ ID NO: 2161674 - RNA, 16 nt, Human
ucacaaccugaaccua

SEQ ID NO: 2161675 - RNA, 20 nt, Human
ucaauuuccaagagcugagg

SEQ ID NO: 2161676 - RNA, 18 nt, Human
ucaauuuccaagagcuga

SEQ ID NO: 2161677 - RNA, 13 nt, Human
ucaauuuccaaga

SEQ ID NO: 2161678 - RNA, 14 nt, Human
ucacaaaaaagaag

SEQ ID NO: 2161679 - RNA, 23 nt, Human
ucacguuuuguuuugugccaacc

SEQ ID NO: 2161680 - RNA, 23 nt, Human
ucacuacccuaauagacuaaaug

SEQ ID NO: 2161681 - RNA, 12 nt, Human
accagcugaaag

SEQ ID NO: 2161682 - RNA, 20 nt, Human
accagcugaaaguugggacu

SEQ ID NO: 2161683 - RNA, 12 nt, Human
ucacuugagacc

SEQ ID NO: 2161684 - RNA, 15 nt, Human
accagucauuuuuca

SEQ ID NO: 2161685 - RNA, 14 nt, Human
accagucauuuuuc

SEQ ID NO: 2161686 - RNA, 16 nt, Human
accagucauuuuucag

SEQ ID NO: 2161687 - RNA, 16 nt, Human
ucacugugagcuccca

SEQ ID NO: 2161688 - RNA, 16 nt, Human
acauuguuaaaauaaa

SEQ ID NO: 2161689 - RNA, 13 nt, Human
acauuuucacaca

SEQ ID NO: 2161690 - RNA, 15 nt, Human
acauuuucacacaau

SEQ ID NO: 2161691 - RNA, 20 nt, Human
acauuuucacacaauacaau

SEQ ID NO: 2161692 - RNA, 16 nt, Human
ucaauauccuuugccu

SEQ ID NO: 2161693 - RNA, 14 nt, Human
ucaauauccuuugc

SEQ ID NO: 2161694 - RNA, 18 nt, Human
acauguagaaaacaaaau

SEQ ID NO: 2161695 - RNA, 22 nt, Human
ucaaccagggauuguuucuguu

SEQ ID NO: 2161696 - RNA, 20 nt, Human
ucaaccagggauuguuucug

SEQ ID NO: 2161697 - RNA, 17 nt, Human
ucaaccagggauuguuu

SEQ ID NO: 2161698 - RNA, 14 nt, Human
ucaacauucuuugc

SEQ ID NO: 2161699 - RNA, 16 nt, Human
ucaacaaauugcccuu

SEQ ID NO: 2161700 - RNA, 17 nt, Human
ucaaccaaugccaaaaa

SEQ ID NO: 2161701 - RNA, 21 nt, Human
acaugguaaacgcugucccua

SEQ ID NO: 2161702 - RNA, 23 nt, Human
acccuucuccucuuguaaauaaa

SEQ ID NO: 2161703 - RNA, 19 nt, Human
accgaaaaacuaaaaauaa

SEQ ID NO: 2161704 - RNA, 20 nt, Human
ucagccacccugaggccucu

SEQ ID NO: 2161705 - RNA, 19 nt, Human
ucagccacccugaggccuc

SEQ ID NO: 2161706 - RNA, 18 nt, Human
ucagcuccacuuucagug

SEQ ID NO: 2161707 - RNA, 16 nt, Human
acccccucgcuuggac

SEQ ID NO: 2161708 - RNA, 15 nt, Human
accccaguuuuuguu

SEQ ID NO: 2161709 - RNA, 15 nt, Human
ucaguggauuuccca

SEQ ID NO: 2161710 - RNA, 14 nt, Human
ucauauuugcacua

SEQ ID NO: 2161711 - RNA, 13 nt, Human
ucauauuugcacu

SEQ ID NO: 2161712 - RNA, 20 nt, Human
ucauaugcaaagcauauuaa

SEQ ID NO: 2161713 - RNA, 14 nt, Human
ucauauugaauaua

SEQ ID NO: 2161714 - RNA, 15 nt, Human
accuaggggcgccgc

SEQ ID NO: 2161715 - RNA, 22 nt, Human
accuauuucucuuucuuuacaa

SEQ ID NO: 2161716 - RNA, 19 nt, Human
accuauuucucuuucuuua

SEQ ID NO: 2161717 - RNA, 14 nt, Human
accuauuucucuuu

SEQ ID NO: 2161718 - RNA, 11 nt, Human
accuauuucuc

SEQ ID NO: 2161719 - RNA, 17 nt, Human
ucaucgccagacaacug

SEQ ID NO: 2161720 - RNA, 20 nt, Human
ucaucuacucauuuaaagua

SEQ ID NO: 2161721 - RNA, 16 nt, Human
acucaagauucccagg

SEQ ID NO: 2161722 - RNA, 15 nt, Human
acucaagauucccag

SEQ ID NO: 2161723 - RNA, 14 nt, Human
acucaagcccgcgg

SEQ ID NO: 2161724 - RNA, 19 nt, Human
acucaagauucccaggagu

SEQ ID NO: 2161725 - RNA, 23 nt, Human
acucaagauucccaggaguucug

SEQ ID NO: 2161726 - RNA, 18 nt, Human
acucaagauucccaggag

SEQ ID NO: 2161727 - RNA, 17 nt, Human
acucaagauucccagga

SEQ ID NO: 2161728 - RNA, 15 nt, Human
acucaaguagcauuu

SEQ ID NO: 2161729 - RNA, 21 nt, Human
acucacaaccugaaccuagga

SEQ ID NO: 2161730 - RNA, 16 nt, Human
acucaaguagcauuua

SEQ ID NO: 2161731 - RNA, 15 nt, Human
acuagagcuuucuuu

SEQ ID NO: 2161732 - RNA, 18 nt, Human
acuagagggaccucuccc

SEQ ID NO: 2161733 - RNA, 19 nt, Human
acuagagggaccucuccca

SEQ ID NO: 2161734 - RNA, 15 nt, Human
acuacugcaccauuu

SEQ ID NO: 2161735 - RNA, 16 nt, Human
ucccagcuaccucaac

SEQ ID NO: 2161736 - RNA, 16 nt, Human
ucccagcuacaccuuu

SEQ ID NO: 2161737 - RNA, 18 nt, Human
acuacagaaaaaccagag

SEQ ID NO: 2161738 - RNA, 22 nt, Human
acguuugaagacauugcaccag

SEQ ID NO: 2161739 - RNA, 18 nt, Human
uccagugcaacacugaag

SEQ ID NO: 2161740 - RNA, 22 nt, Human
acggcugggcacacgccuccca

SEQ ID NO: 2161741 - RNA, 11 nt, Human
acggcugggca

SEQ ID NO: 2161742 - RNA, 22 nt, Human
acggcuccacuaggacuucaaa

SEQ ID NO: 2161743 - RNA, 18 nt, Human
acgcucucuacucugcuu

SEQ ID NO: 2161744 - RNA, 15 nt, Human
acgcucucuacucug

SEQ ID NO: 2161745 - RNA, 14 nt, Human
acgccucccacugg

SEQ ID NO: 2161746 - RNA, 15 nt, Human
acgccucccacuggg

SEQ ID NO: 2161747 - RNA, 20 nt, Human
accuuucuccuuuguacuuu

SEQ ID NO: 2161748 - RNA, 19 nt, Human
accuuucuccuuuguacuu

SEQ ID NO: 2161749 - RNA, 23 nt, Human
accuuucuccuuuguacuuugug

SEQ ID NO: 2161750 - RNA, 22 nt, Human
ucauucccuucgacagcauuuu

SEQ ID NO: 2161751 - RNA, 23 nt, Human
ucauucccuucgacagcauuuuc

SEQ ID NO: 2161752 - RNA, 21 nt, Human
ucauucccuucgacagcauuu

SEQ ID NO: 2161753 - RNA, 20 nt, Human
ucauucccuucgacagcauu

SEQ ID NO: 2161754 - RNA, 16 nt, Human
accuuucuccuuugua

SEQ ID NO: 2161755 - RNA, 15 nt, Human
accuuucuccuuugu

SEQ ID NO: 2161756 - RNA, 22 nt, Human
uccaggauuccucuuuucucug

SEQ ID NO: 2161757 - RNA, 18 nt, Human
uccaggauuccucuuuuc

SEQ ID NO: 2161758 - RNA, 15 nt, Human
uccaggauuccucuu

SEQ ID NO: 2161759 - RNA, 18 nt, Human
acugcaccauuuaaaaac

SEQ ID NO: 2161760 - RNA, 22 nt, Human
uccugcuguaaauuuggcuucu

SEQ ID NO: 2161761 - RNA, 20 nt, Human
acugaacaccauugaaggcu

SEQ ID NO: 2161762 - RNA, 21 nt, Human
acugaacaccauugaaggcuu

SEQ ID NO: 2161763 - RNA, 22 nt, Human
acugaacaccauugaaggcuua

SEQ ID NO: 2161764 - RNA, 19 nt, Human
acugaacaccauugaaggc

SEQ ID NO: 2161765 - RNA, 20 nt, Human
acugagauccuuccuuuuga

SEQ ID NO: 2161766 - RNA, 17 nt, Human
acugaccugguccacag

SEQ ID NO: 2161767 - RNA, 13 nt, Human
acugaccuugaug

SEQ ID NO: 2161768 - RNA, 19 nt, Human
acugaccuugaugagcugu

SEQ ID NO: 2161769 - RNA, 22 nt, Human
acugaccugguccacagggcac

SEQ ID NO: 2161770 - RNA, 21 nt, Human
acugaccugguccacagggca

SEQ ID NO: 2161771 - RNA, 14 nt, Human
acuccugcuguaaa

SEQ ID NO: 2161772 - RNA, 22 nt, Human
acuccucaguucuugccacuuu

SEQ ID NO: 2161773 - RNA, 17 nt, Human
acuccucaguucuugcc

SEQ ID NO: 2161774 - RNA, 21 nt, Human
acucacaccugaacugaacac

SEQ ID NO: 2161775 - RNA, 19 nt, Human
acucucugaaccccucccu

SEQ ID NO: 2161776 - RNA, 21 nt, Human
acucucugaaccccucccucc

SEQ ID NO: 2161777 - RNA, 18 nt, Human
acucucugaaccccuccc

SEQ ID NO: 2161778 - RNA, 16 nt, Human
uccucagguggccaug

SEQ ID NO: 2161779 - RNA, 13 nt, Human
uccucagguggcc

SEQ ID NO: 2161780 - RNA, 18 nt, Human
uccucagguggccaugcc

SEQ ID NO: 2161781 - RNA, 22 nt, Human
uccucagguggccaugccucag

SEQ ID NO: 2161782 - RNA, 16 nt, Human
agaaaugcaaaaaucu

SEQ ID NO: 2161783 - RNA, 14 nt, Human
agaaaugcaaaaau

SEQ ID NO: 2161784 - RNA, 19 nt, Human
ucuccuuuguacuuugugc

SEQ ID NO: 2161785 - RNA, 20 nt, Human
ucuccuuuguacuuugugcu

SEQ ID NO: 2161786 - RNA, 21 nt, Human
ucugaagcuuuaccagcugaa

SEQ ID NO: 2161787 - RNA, 17 nt, Human
ucugaguggcuucacuc

SEQ ID NO: 2161788 - RNA, 21 nt, Human
ucugaguggcuucacuccugc

SEQ ID NO: 2161789 - RNA, 22 nt, Human
ucugaguggcuucacuccugcu

SEQ ID NO: 2161790 - RNA, 20 nt, Human
ucugcagggccgccagggag

SEQ ID NO: 2161791 - RNA, 22 nt, Human
agaagauucuucccauucucca

SEQ ID NO: 2161792 - RNA, 22 nt, Human
agaagaaauucugucauagaaa

SEQ ID NO: 2161793 - RNA, 18 nt, Human
agaagaaauucugucaua

SEQ ID NO: 2161794 - RNA, 22 nt, Human
agaacugccuuuggcagaguuc

SEQ ID NO: 2161795 - RNA, 21 nt, Human
agaaauucugucauagaaagu

SEQ ID NO: 2161796 - RNA, 23 nt, Human
agaaauucugucauagaaagugc

SEQ ID NO: 2161797 - RNA, 16 nt, Human
ucugcgugcagggaca

SEQ ID NO: 2161798 - RNA, 19 nt, Human
ucugcgucucugcuuuaaa

SEQ ID NO: 2161799 - RNA, 20 nt, Human
ucugcgucucugcuuuaaag

SEQ ID NO: 2161800 - RNA, 15 nt, Human
ucugcucauucuaau

SEQ ID NO: 2161801 - RNA, 18 nt, Human
ucuguugucaccuucacc

SEQ ID NO: 2161802 - RNA, 17 nt, Human
ucuguugucaccuucac

SEQ ID NO: 2161803 - RNA, 16 nt, Human
ucuguugucaccuuca

SEQ ID NO: 2161804 - RNA, 19 nt, Human
agacacaucgcacugugga

SEQ ID NO: 2161805 - RNA, 21 nt, Human
agacacagucauacugucacu

SEQ ID NO: 2161806 - RNA, 13 nt, Human
agacacaggauga

SEQ ID NO: 2161807 - RNA, 16 nt, Human
agaauaauaaauauuu

SEQ ID NO: 2161808 - RNA, 12 nt, Human
agaauaauaaau

SEQ ID NO: 2161809 - RNA, 15 nt, Human
agaauggggugcaug

SEQ ID NO: 2161810 - RNA, 19 nt, Human
agaauauuugguuuuccug

SEQ ID NO: 2161811 - RNA, 19 nt, Human
agaaucagucuugcagcug

SEQ ID NO: 2161812 - RNA, 14 nt, Human
agaauuaucuaauu

SEQ ID NO: 2161813 - RNA, 15 nt, Human
agaauuaucuaauuu

SEQ ID NO: 2161814 - RNA, 17 nt, Human
agaauuaucuaauuuau

SEQ ID NO: 2161815 - RNA, 19 nt, Human
ucugggaguggggaaguga

SEQ ID NO: 2161816 - RNA, 18 nt, Human
agaauuaucuaauuuaua

SEQ ID NO: 2161817 - RNA, 20 nt, Human
agaauuaucuaauuuauaaa

SEQ ID NO: 2161818 - RNA, 21 nt, Human
agaauuaucuaauuuauaaaa

SEQ ID NO: 2161819 - RNA, 22 nt, Human
ucuccaccagucauuuuucaga

SEQ ID NO: 2161820 - RNA, 20 nt, Human
ucuccaauuuuuuuuuccuu

SEQ ID NO: 2161821 - RNA, 16 nt, Human
ucuccucauguucugc

SEQ ID NO: 2161822 - RNA, 17 nt, Human
acuuuuuauauuuuaua

SEQ ID NO: 2161823 - RNA, 21 nt, Human
acuuuuuauauuuuauacauu

SEQ ID NO: 2161824 - RNA, 13 nt, Human
acuuuguucugcu

SEQ ID NO: 2161825 - RNA, 13 nt, Human
acuuaagcaaaag

SEQ ID NO: 2161826 - RNA, 11 nt, Human
acuuauuaaau

SEQ ID NO: 2161827 - RNA, 23 nt, Human
ucuacagguuuggguacaagugg

SEQ ID NO: 2161828 - RNA, 18 nt, Human
acuguucccaccugcugg

SEQ ID NO: 2161829 - RNA, 21 nt, Human
acuucccccaaauuuaaagaa

SEQ ID NO: 2161830 - RNA, 15 nt, Human
ucuauuuaaguaaaa

SEQ ID NO: 2161831 - RNA, 19 nt, Human
ucuauuuaucuucauuuga

SEQ ID NO: 2161832 - RNA, 15 nt, Human
ucuauuuaucuucau

SEQ ID NO: 2161833 - RNA, 15 nt, Human
ucuauacuugcuuug

SEQ ID NO: 2161834 - RNA, 17 nt, Human
ugaccuugaugagcugu

SEQ ID NO: 2161835 - RNA, 20 nt, Human
ugaccugguccacagggcac

SEQ ID NO: 2161836 - RNA, 15 nt, Human
ugaccugguccacag

SEQ ID NO: 2161837 - RNA, 22 nt, Human
ugaccuugaugagcugugcaca

SEQ ID NO: 2161838 - RNA, 19 nt, Human
ugaccuugaugagcugugc

SEQ ID NO: 2161839 - RNA, 18 nt, Human
ugaccuugaugagcugug

SEQ ID NO: 2161840 - RNA, 12 nt, Human
agauucccagga

SEQ ID NO: 2161841 - RNA, 14 nt, Human
agauucccaggagu

SEQ ID NO: 2161842 - RNA, 13 nt, Human
agauucccaggag

SEQ ID NO: 2161843 - RNA, 15 nt, Human
agauucccaggaguu

SEQ ID NO: 2161844 - RNA, 16 nt, Human
agauucccaggaguuc

SEQ ID NO: 2161845 - RNA, 15 nt, Human
agauuaauuccuuuc

SEQ ID NO: 2161846 - RNA, 20 nt, Human
agaugcaaugacucaggaca

SEQ ID NO: 2161847 - RNA, 23 nt, Human
ugacaccuuucauaaucuuugcu

SEQ ID NO: 2161848 - RNA, 20 nt, Human
ugacaccuuucauaaucuuu

SEQ ID NO: 2161849 - RNA, 20 nt, Human
agcaaggguucccucaagag

SEQ ID NO: 2161850 - RNA, 14 nt, Human
agcaagucaggguu

SEQ ID NO: 2161851 - RNA, 16 nt, Human
ugagauuaauuccuuu

SEQ ID NO: 2161852 - RNA, 14 nt, Human
ugagauuaauuccu

SEQ ID NO: 2161853 - RNA, 18 nt, Human
ugaaaaugcaacaacaug

SEQ ID NO: 2161854 - RNA, 21 nt, Human
ugaaaaugcaacaacauguau

SEQ ID NO: 2161855 - RNA, 20 nt, Human
ugaaaaugcaacaacaugua

SEQ ID NO: 2161856 - RNA, 23 nt, Human
ugaaaaugcaacaacauguauaa

SEQ ID NO: 2161857 - RNA, 16 nt, Human
ugaaaauuaacacugc

SEQ ID NO: 2161858 - RNA, 15 nt, Human
ugaaaauuaacacug

SEQ ID NO: 2161859 - RNA, 14 nt, Human
ugaaaauuaacacu

SEQ ID NO: 2161860 - RNA, 18 nt, Human
ugaaaauuaacacugcuu

SEQ ID NO: 2161861 - RNA, 11 nt, Human
ucuuugugaag

SEQ ID NO: 2161862 - RNA, 16 nt, Human
ucuuugugaaggccuc

SEQ ID NO: 2161863 - RNA, 15 nt, Human
ucuuuuuuucuuugg

SEQ ID NO: 2161864 - RNA, 20 nt, Human
ucuuucccugcuuaaugaaa

SEQ ID NO: 2161865 - RNA, 21 nt, Human
agacucugucuaaaaaacaaa

SEQ ID NO: 2161866 - RNA, 20 nt, Human
agacucugucuaaaaaacaa

SEQ ID NO: 2161867 - RNA, 18 nt, Human
agacucugucuaaaaaac

SEQ ID NO: 2161868 - RNA, 13 nt, Human
agacucugucuaa

SEQ ID NO: 2161869 - RNA, 17 nt, Human
agacuccucaguucuug

SEQ ID NO: 2161870 - RNA, 23 nt, Human
agacuccugacugucucccggga

SEQ ID NO: 2161871 - RNA, 11 nt, Human
agacuccucag

SEQ ID NO: 2161872 - RNA, 14 nt, Human
agaggcauuucccc

SEQ ID NO: 2161873 - RNA, 13 nt, Human
agaggcauuuccc

SEQ ID NO: 2161874 - RNA, 16 nt, Human
ugaagggauaugugaa

SEQ ID NO: 2161875 - RNA, 18 nt, Human
ugaagguuucugaaaauu

SEQ ID NO: 2161876 - RNA, 14 nt, Human
ugaagcaaacacau

SEQ ID NO: 2161877 - RNA, 15 nt, Human
ugaagcaaacacauu

SEQ ID NO: 2161878 - RNA, 13 nt, Human
ugaagcaaacaca

SEQ ID NO: 2161879 - RNA, 21 nt, Human
ugaauauuuucauuaaaagcu

SEQ ID NO: 2161880 - RNA, 19 nt, Human
ugaauauuuucauuaaaag

SEQ ID NO: 2161881 - RNA, 12 nt, Human
ugaaguaccacc

SEQ ID NO: 2161882 - RNA, 20 nt, Human
ugaaauuuuugguuauaaau

SEQ ID NO: 2161883 - RNA, 17 nt, Human
ugucaacaugaacaaau

SEQ ID NO: 2161884 - RNA, 17 nt, Human
agguuugguccagccug

SEQ ID NO: 2161885 - RNA, 21 nt, Human
ugucccuaguaaaaauacaaa

SEQ ID NO: 2161886 - RNA, 15 nt, Human
agucaucauucccuu

SEQ ID NO: 2161887 - RNA, 23 nt, Human
aguccauauuucaauuuccaaga

SEQ ID NO: 2161888 - RNA, 13 nt, Human
aguccccagagaa

SEQ ID NO: 2161889 - RNA, 21 nt, Human
aguccauauuucaauuuccaa

SEQ ID NO: 2161890 - RNA, 11 nt, Human
ugucuccuggc

SEQ ID NO: 2161891 - RNA, 21 nt, Human
ugucuccuggcgguuccucgu

SEQ ID NO: 2161892 - RNA, 13 nt, Human
ugucucuuucaug

SEQ ID NO: 2161893 - RNA, 15 nt, Human
agucuguuuuguaaa

SEQ ID NO: 2161894 - RNA, 16 nt, Human
agucuguuuuguaaag

SEQ ID NO: 2161895 - RNA, 22 nt, Human
ugugaagcacagaccccuucca

SEQ ID NO: 2161896 - RNA, 14 nt, Human
agugaaagcaucac

SEQ ID NO: 2161897 - RNA, 15 nt, Human
agugagccacuccgg

SEQ ID NO: 2161898 - RNA, 16 nt, Human
ugugaugcccugcccu

SEQ ID NO: 2161899 - RNA, 14 nt, Human
uggugaaaccuccu

SEQ ID NO: 2161900 - RNA, 20 nt, Human
agguagaccugucuccuggc

SEQ ID NO: 2161901 - RNA, 22 nt, Human
agguagaauuaucuaauuuaua

SEQ ID NO: 2161902 - RNA, 14 nt, Human
aggguuggagcagu

SEQ ID NO: 2161903 - RNA, 23 nt, Human
agguaugaccuucuaggaagcuc

SEQ ID NO: 2161904 - RNA, 22 nt, Human
agguaugaccuucuaggaagcu

SEQ ID NO: 2161905 - RNA, 20 nt, Human
agguaugaccuucuaggaag

SEQ ID NO: 2161906 - RNA, 15 nt, Human
aggucaggaguucga

SEQ ID NO: 2161907 - RNA, 14 nt, Human
ugggugaaggcugg

SEQ ID NO: 2161908 - RNA, 16 nt, Human
ugggugaaggcuggca

SEQ ID NO: 2161909 - RNA, 15 nt, Human
ugggugaaggcuggc

SEQ ID NO: 2161910 - RNA, 19 nt, Human
ugguaaacgcugucccuag

SEQ ID NO: 2161911 - RNA, 17 nt, Human
ugguaauucuuauucuu

SEQ ID NO: 2161912 - RNA, 14 nt, Human
ugguccagccuggu

SEQ ID NO: 2161913 - RNA, 21 nt, Human
ugguccacagggcaccugcca

SEQ ID NO: 2161914 - RNA, 15 nt, Human
ugguccacagggcac

SEQ ID NO: 2161915 - RNA, 14 nt, Human
ugguccacagggca

SEQ ID NO: 2161916 - RNA, 13 nt, Human
ugguccacagggc

SEQ ID NO: 2161917 - RNA, 21 nt, Human
aggggucgacuucgggcuggc

SEQ ID NO: 2161918 - RNA, 19 nt, Human
aggggucgacuucgggcug

SEQ ID NO: 2161919 - RNA, 19 nt, Human
aggggagggucagccaggg

SEQ ID NO: 2161920 - RNA, 18 nt, Human
aggggagggucagccagg

SEQ ID NO: 2161921 - RNA, 15 nt, Human
aggggaggccuucca

SEQ ID NO: 2161922 - RNA, 22 nt, Human
aggggacccccgcccccugccc

SEQ ID NO: 2161923 - RNA, 14 nt, Human
aggggacccccgcc

SEQ ID NO: 2161924 - RNA, 19 nt, Human
aggggacccccgcccccug

SEQ ID NO: 2161925 - RNA, 18 nt, Human
aggggacccccgcccccu

SEQ ID NO: 2161926 - RNA, 15 nt, Human
aggggacccccgccc

SEQ ID NO: 2161927 - RNA, 15 nt, Human
ugggaauaccugugg

SEQ ID NO: 2161928 - RNA, 15 nt, Human
ugguuuaauuuaaag

SEQ ID NO: 2161929 - RNA, 16 nt, Human
ugguuaagcuuugaca

SEQ ID NO: 2161930 - RNA, 17 nt, Human
ugguuugcaaggaagcc

SEQ ID NO: 2161931 - RNA, 15 nt, Human
ugguuugcaaggaag

SEQ ID NO: 2161932 - RNA, 20 nt, Human
ugguuuuaacaacugugcuu

SEQ ID NO: 2161933 - RNA, 13 nt, Human
ugguuuuccugua

SEQ ID NO: 2161934 - RNA, 15 nt, Human
uguagaagcauggug

SEQ ID NO: 2161935 - RNA, 16 nt, Human
auaaccaaucuacaau

SEQ ID NO: 2161936 - RNA, 23 nt, Human
auaacugcccagcggacaguggc

SEQ ID NO: 2161937 - RNA, 13 nt, Human
auaacugcccagc

SEQ ID NO: 2161938 - RNA, 20 nt, Human
auaacugcaaagugaaguug

SEQ ID NO: 2161939 - RNA, 16 nt, Human
auaaauguuaagaaaa

SEQ ID NO: 2161940 - RNA, 15 nt, Human
auaaauguuaagaaa

SEQ ID NO: 2161941 - RNA, 19 nt, Human
auaacuggaggaauuuucu

SEQ ID NO: 2161942 - RNA, 16 nt, Human
uuacccacacacagau

SEQ ID NO: 2161943 - RNA, 22 nt, Human
auaaacauuuguagcauccucu

SEQ ID NO: 2161944 - RNA, 13 nt, Human
auaaauaaaacau

SEQ ID NO: 2161945 - RNA, 23 nt, Human
auaaagugcugcggagcaagagg

SEQ ID NO: 2161946 - RNA, 22 nt, Human
auaaagugcugcggagcaagag

SEQ ID NO: 2161947 - RNA, 22 nt, Human
auaaguuaacuauuuuauuuuc

SEQ ID NO: 2161948 - RNA, 19 nt, Human
auaauucugggaagcaaaa

SEQ ID NO: 2161949 - RNA, 15 nt, Human
auaauuguauauaug

SEQ ID NO: 2161950 - RNA, 18 nt, Human
auaaucaucucugucaca

SEQ ID NO: 2161951 - RNA, 23 nt, Human
uuaucaagaguugugacaacuuc

SEQ ID NO: 2161952 - RNA, 22 nt, Human
uuaucaagaguugugacaacuu

SEQ ID NO: 2161953 - RNA, 24 nt, Human
auaccaaauagcuucuguuuuguu

SEQ ID NO: 2161954 - RNA, 17 nt, Human
auacauucuguaauaca

SEQ ID NO: 2161955 - RNA, 16 nt, Human
auacaacacaaagaga

SEQ ID NO: 2161956 - RNA, 15 nt, Human
auacaacacaaagag

SEQ ID NO: 2161957 - RNA, 16 nt, Human
uuauagccgaaaugau

SEQ ID NO: 2161958 - RNA, 14 nt, Human
uuauacuggcaugc

SEQ ID NO: 2161959 - RNA, 21 nt, Human
uuauaccuguguauuuuuuaa

SEQ ID NO: 2161960 - RNA, 18 nt, Human
uuauacuuuguaaagaca

SEQ ID NO: 2161961 - RNA, 10 nt, Human
uuagccugga

SEQ ID NO: 2161962 - RNA, 19 nt, Human
uuagcaguaaaauagcuga

SEQ ID NO: 2161963 - RNA, 16 nt, Human
uuagcaguaaaauagc

SEQ ID NO: 2161964 - RNA, 14 nt, Human
uuagcaguaaaaua

SEQ ID NO: 2161965 - RNA, 19 nt, Human
aguguagcauccuaaagau

SEQ ID NO: 2161966 - RNA, 20 nt, Human
uguuauguagugugcuuuuu

SEQ ID NO: 2161967 - RNA, 19 nt, Human
uguucccauccucuucuuu

SEQ ID NO: 2161968 - RNA, 14 nt, Human
uguucaaacauuua

SEQ ID NO: 2161969 - RNA, 13 nt, Human
aguggcauaaaaa

SEQ ID NO: 2161970 - RNA, 16 nt, Human
aguggcaggacaggaa

SEQ ID NO: 2161971 - RNA, 13 nt, Human
aguggcaggacag

SEQ ID NO: 2161972 - RNA, 17 nt, Human
aguggcaggacaggaaa

SEQ ID NO: 2161973 - RNA, 17 nt, Human
aguuagggaauggcaca

SEQ ID NO: 2161974 - RNA, 17 nt, Human
aguguuuaacuugucaa

SEQ ID NO: 2161975 - RNA, 17 nt, Human
aguucgagaccagccug

SEQ ID NO: 2161976 - RNA, 19 nt, Human
aguucgagaccagccuggc

SEQ ID NO: 2161977 - RNA, 13 nt, Human
uguugucaccuuc

SEQ ID NO: 2161978 - RNA, 18 nt, Human
aguuuucccuugaggaaa

SEQ ID NO: 2161979 - RNA, 20 nt, Human
aguuuucccuugaggaaaca

SEQ ID NO: 2161980 - RNA, 17 nt, Human
aguuuucaccucgaauu

SEQ ID NO: 2161981 - RNA, 15 nt, Human
aguuucaaccaugaa

SEQ ID NO: 2161982 - RNA, 15 nt, Human
aguuuauuuuaagac

SEQ ID NO: 2161983 - RNA, 19 nt, Human
aguuuccuuccagcccaga

SEQ ID NO: 2161984 - RNA, 22 nt, Human
uguuuuaauuuauacuggcaug

SEQ ID NO: 2161985 - RNA, 22 nt, Human
agccagcgggaauggcagcugc

SEQ ID NO: 2161986 - RNA, 15 nt, Human
agccagggccugcga

SEQ ID NO: 2161987 - RNA, 23 nt, Human
ugaugacucaagauucccaggag

SEQ ID NO: 2161988 - RNA, 16 nt, Human
agcaccugaacaguuu

SEQ ID NO: 2161989 - RNA, 22 nt, Human
ugaugacucaagauucccagga

SEQ ID NO: 2161990 - RNA, 15 nt, Human
ugaugacucaagauu

SEQ ID NO: 2161991 - RNA, 14 nt, Human
ugaugacucaagau

SEQ ID NO: 2161992 - RNA, 14 nt, Human
agccagaggacugu

SEQ ID NO: 2161993 - RNA, 13 nt, Human
agccagaggacug

SEQ ID NO: 2161994 - RNA, 17 nt, Human
agccagaggacugugau

SEQ ID NO: 2161995 - RNA, 20 nt, Human
agcccgcggggacauuggga

SEQ ID NO: 2161996 - RNA, 15 nt, Human
agcccgcggggacau

SEQ ID NO: 2161997 - RNA, 15 nt, Human
agcccccccuuccac

SEQ ID NO: 2161998 - RNA, 13 nt, Human
agcccccccuucc

SEQ ID NO: 2161999 - RNA, 17 nt, Human
agcccuugcauugcaga

SEQ ID NO: 2162000 - RNA, 16 nt, Human
ugcacucuagccuggg

SEQ ID NO: 2162001 - RNA, 14 nt, Human
ugcagacgcccaga

SEQ ID NO: 2162002 - RNA, 16 nt, Human
ugccucaggccucugu

SEQ ID NO: 2162003 - RNA, 18 nt, Human
ugccucaggccucugugc

SEQ ID NO: 2162004 - RNA, 21 nt, Human
ugcccuccccucucugcaccg

SEQ ID NO: 2162005 - RNA, 17 nt, Human
ugcccuccccucucugc

SEQ ID NO: 2162006 - RNA, 14 nt, Human
ugcccuccccucuc

SEQ ID NO: 2162007 - RNA, 16 nt, Human
ugcccuaaugucugua

SEQ ID NO: 2162008 - RNA, 17 nt, Human
agcuacccgcagaguuc

SEQ ID NO: 2162009 - RNA, 14 nt, Human
ugccauuuugcauu

SEQ ID NO: 2162010 - RNA, 19 nt, Human
ugcccaaaguuuuauuuuu

SEQ ID NO: 2162011 - RNA, 18 nt, Human
ugcccccgcauccccugc

SEQ ID NO: 2162012 - RNA, 21 nt, Human
ugcccccgcauccccugccuc

SEQ ID NO: 2162013 - RNA, 20 nt, Human
ugcccccgcauccccugccu

SEQ ID NO: 2162014 - RNA, 22 nt, Human
ugcccccgcauccccugccucc

SEQ ID NO: 2162015 - RNA, 18 nt, Human
ugccccauucuuuuguaa

SEQ ID NO: 2162016 - RNA, 12 nt, Human
ugccccauucuu

SEQ ID NO: 2162017 - RNA, 17 nt, Human
agcgggagccucccugc

SEQ ID NO: 2162018 - RNA, 20 nt, Human
agcgggaauggcagcugcca

SEQ ID NO: 2162019 - RNA, 19 nt, Human
agcggacaucagcugguca

SEQ ID NO: 2162020 - RNA, 20 nt, Human
agcggacaguggcaggacag

SEQ ID NO: 2162021 - RNA, 17 nt, Human
agcggacaguggcagga

SEQ ID NO: 2162022 - RNA, 16 nt, Human
agcggacaguggcagg

SEQ ID NO: 2162023 - RNA, 15 nt, Human
agcggacaguggcag

SEQ ID NO: 2162024 - RNA, 14 nt, Human
agcggacaguggca

SEQ ID NO: 2162025 - RNA, 21 nt, Human
ugcauucucccuccuucccuu

SEQ ID NO: 2162026 - RNA, 11 nt, Human
ugcauucuccc

SEQ ID NO: 2162027 - RNA, 16 nt, Human
uggcaugauccaagca

SEQ ID NO: 2162028 - RNA, 19 nt, Human
aggccucuggaaagcaaag

SEQ ID NO: 2162029 - RNA, 17 nt, Human
aggccucgcaggaagac

SEQ ID NO: 2162030 - RNA, 14 nt, Human
aggccucgcaggaa

SEQ ID NO: 2162031 - RNA, 13 nt, Human
aggccucgcagga

SEQ ID NO: 2162032 - RNA, 15 nt, Human
aggccucugugccgc

SEQ ID NO: 2162033 - RNA, 14 nt, Human
aggccuccuggccc

SEQ ID NO: 2162034 - RNA, 14 nt, Human
aggccagaccugca

SEQ ID NO: 2162035 - RNA, 14 nt, Human
uggagucauucuca

SEQ ID NO: 2162036 - RNA, 15 nt, Human
uggagucauucucau

SEQ ID NO: 2162037 - RNA, 12 nt, Human
aggccagaccug

SEQ ID NO: 2162038 - RNA, 23 nt, Human
uggcacccaagaccucagggcac

SEQ ID NO: 2162039 - RNA, 14 nt, Human
uggcacccaagacc

SEQ ID NO: 2162040 - RNA, 20 nt, Human
uggcugcaucccccccaccu

SEQ ID NO: 2162041 - RNA, 19 nt, Human
uggcuucacuccugcugua

SEQ ID NO: 2162042 - RNA, 18 nt, Human
uggcuucacuccugcugu

SEQ ID NO: 2162043 - RNA, 23 nt, Human
uggcuucacuccugcuguaaauu

SEQ ID NO: 2162044 - RNA, 16 nt, Human
uggcuucacuccugcu

SEQ ID NO: 2162045 - RNA, 14 nt, Human
uggcuucacuccug

SEQ ID NO: 2162046 - RNA, 19 nt, Human
ugggaaggggacccccgcc

SEQ ID NO: 2162047 - RNA, 22 nt, Human
ugggaaggggacccccgccccc

SEQ ID NO: 2162048 - RNA, 22 nt, Human
ugggaacuuauuaaauggaaac

SEQ ID NO: 2162049 - RNA, 20 nt, Human
aggcucucaacaggggagag

SEQ ID NO: 2162050 - RNA, 12 nt, Human
aggcuggcauga

SEQ ID NO: 2162051 - RNA, 12 nt, Human
ugcuguccucag

SEQ ID NO: 2162052 - RNA, 18 nt, Human
ugcuguccucagguggcc

SEQ ID NO: 2162053 - RNA, 14 nt, Human
ugcuguccucaggu

SEQ ID NO: 2162054 - RNA, 19 nt, Human
ugcuguccucagguggcca

SEQ ID NO: 2162055 - RNA, 21 nt, Human
ugcuguccucagguggccaug

SEQ ID NO: 2162056 - RNA, 20 nt, Human
aggacauccccccgccaaaa

SEQ ID NO: 2162057 - RNA, 17 nt, Human
ugcugugaaauucccaa

SEQ ID NO: 2162058 - RNA, 12 nt, Human
ugcucugcuuca

SEQ ID NO: 2162059 - RNA, 22 nt, Human
uggaaauuaggauguaaaucug

SEQ ID NO: 2162060 - RNA, 18 nt, Human
aggauaauuagcaucuca

SEQ ID NO: 2162061 - RNA, 14 nt, Human
uggacccagacaca

SEQ ID NO: 2162062 - RNA, 22 nt, Human
uggaaaggagccuaggccaggu

SEQ ID NO: 2162063 - RNA, 21 nt, Human
uggaaaggagccuaggccagg

SEQ ID NO: 2162064 - RNA, 18 nt, Human
aggagcauuuuuuaaaaa

SEQ ID NO: 2162065 - RNA, 21 nt, Human
aggacugugaugcccugcccu

SEQ ID NO: 2162066 - RNA, 20 nt, Human
aggacugugaugcccugccc

SEQ ID NO: 2162067 - RNA, 14 nt, Human
aggacugugaugcc

SEQ ID NO: 2162068 - RNA, 12 nt, Human
uucuguuuaacu

SEQ ID NO: 2162069 - RNA, 17 nt, Human
uucuugcauauuuugua

SEQ ID NO: 2162070 - RNA, 14 nt, Human
uucuugcauauuuu

SEQ ID NO: 2162071 - RNA, 20 nt, Human
uucuugcauauuuuguaacu

SEQ ID NO: 2162072 - RNA, 18 nt, Human
uucugaagcuuuaccagc

SEQ ID NO: 2162073 - RNA, 17 nt, Human
uucuccuuuguacuuug

SEQ ID NO: 2162074 - RNA, 14 nt, Human
uucuccuuuguacu

SEQ ID NO: 2162075 - RNA, 12 nt, Human
uucuccuuugua

SEQ ID NO: 2162076 - RNA, 20 nt, Human
uucucccuccuucccuuccu

SEQ ID NO: 2162077 - RNA, 21 nt, Human
aucacucugugucugaguggc

SEQ ID NO: 2162078 - RNA, 15 nt, Human
aucaguguuggccau

SEQ ID NO: 2162079 - RNA, 20 nt, Human
auccucuucuuuuagcagua

SEQ ID NO: 2162080 - RNA, 18 nt, Human
auccucuucuuuuagcag

SEQ ID NO: 2162081 - RNA, 13 nt, Human
auccucuucuuuu

SEQ ID NO: 2162082 - RNA, 23 nt, Human
aucguccagggagcauuuuccuc

SEQ ID NO: 2162083 - RNA, 13 nt, Human
aucguccagggag

SEQ ID NO: 2162084 - RNA, 12 nt, Human
aucguccaggga

SEQ ID NO: 2162085 - RNA, 18 nt, Human
uugaauauaaacacuaua

SEQ ID NO: 2162086 - RNA, 16 nt, Human
uugaauauaaacacua

SEQ ID NO: 2162087 - RNA, 15 nt, Human
uugaauauaaacacu

SEQ ID NO: 2162088 - RNA, 21 nt, Human
uugaauauaauauauuugugu

SEQ ID NO: 2162089 - RNA, 20 nt, Human
uugaauauaauauauuugug

SEQ ID NO: 2162090 - RNA, 22 nt, Human
uugaauauaauauauuugugua

SEQ ID NO: 2162091 - RNA, 14 nt, Human
uugaguaaaauaaa

SEQ ID NO: 2162092 - RNA, 12 nt, Human
uugaguaaaaua

SEQ ID NO: 2162093 - RNA, 18 nt, Human
uugaguaaaauaaauauu

SEQ ID NO: 2162094 - RNA, 18 nt, Human
uugacacuggaaugaguu

SEQ ID NO: 2162095 - RNA, 18 nt, Human
uugagaacuuuauuucca

SEQ ID NO: 2162096 - RNA, 17 nt, Human
auauugucuuuuuguau

SEQ ID NO: 2162097 - RNA, 14 nt, Human
auauugucuuuuug

SEQ ID NO: 2162098 - RNA, 17 nt, Human
auauuguaaaacaggua

SEQ ID NO: 2162099 - RNA, 16 nt, Human
auauuguaaaacaggu

SEQ ID NO: 2162100 - RNA, 19 nt, Human
auauuggguuccauucuca

SEQ ID NO: 2162101 - RNA, 22 nt, Human
auauuaaagagaaagcccgcuu

SEQ ID NO: 2162102 - RNA, 21 nt, Human
uucccagcuacaccuuucucc

SEQ ID NO: 2162103 - RNA, 20 nt, Human
uucccaggaguucugcucau

SEQ ID NO: 2162104 - RNA, 19 nt, Human
uucccaggaguucugcuca

SEQ ID NO: 2162105 - RNA, 23 nt, Human
aucaauguaccuuuuuugguagu

SEQ ID NO: 2162106 - RNA, 20 nt, Human
aucacucugugucugagugg

SEQ ID NO: 2162107 - RNA, 16 nt, Human
aucacucugugucuga

SEQ ID NO: 2162108 - RNA, 17 nt, Human
auauuuuuuaaaaaucu

SEQ ID NO: 2162109 - RNA, 23 nt, Human
auauuuuuuaaaaaucuauauuu

SEQ ID NO: 2162110 - RNA, 16 nt, Human
uuccucuuuucucugc

SEQ ID NO: 2162111 - RNA, 12 nt, Human
auauuugcacua

SEQ ID NO: 2162112 - RNA, 13 nt, Human
uuccccuuuugca

SEQ ID NO: 2162113 - RNA, 16 nt, Human
uucagugaaagcauca

SEQ ID NO: 2162114 - RNA, 21 nt, Human
uucaguaacccccacuggacu

SEQ ID NO: 2162115 - RNA, 13 nt, Human
auauauuuuaauu

SEQ ID NO: 2162116 - RNA, 13 nt, Human
uucagaagaaauu

SEQ ID NO: 2162117 - RNA, 19 nt, Human
uuccaguacaccuuucagc

SEQ ID NO: 2162118 - RNA, 15 nt, Human
uucauuaaaagcuac

SEQ ID NO: 2162119 - RNA, 20 nt, Human
auauggggaugcagcauuau

SEQ ID NO: 2162120 - RNA, 16 nt, Human
auauggggaugcagca

SEQ ID NO: 2162121 - RNA, 17 nt, Human
auauguagcagaaaggc

SEQ ID NO: 2162122 - RNA, 20 nt, Human
uuucccagcuacaccuuucu

SEQ ID NO: 2162123 - RNA, 14 nt, Human
uuucauaaucuuug

SEQ ID NO: 2162124 - RNA, 12 nt, Human
uuucauaaucuu

SEQ ID NO: 2162125 - RNA, 20 nt, Human
uuucauaguuggggucauag

SEQ ID NO: 2162126 - RNA, 13 nt, Human
augcugugaaauu

SEQ ID NO: 2162127 - RNA, 17 nt, Human
auggaaccaggcuugga

SEQ ID NO: 2162128 - RNA, 16 nt, Human
auggaaccaggcuugg

SEQ ID NO: 2162129 - RNA, 14 nt, Human
uuuauguacaggau

SEQ ID NO: 2162130 - RNA, 22 nt, Human
augccguuacuuuucauauuug

SEQ ID NO: 2162131 - RNA, 20 nt, Human
augccguuacuuuucauauu

SEQ ID NO: 2162132 - RNA, 14 nt, Human
augccguuacuuuu

SEQ ID NO: 2162133 - RNA, 13 nt, Human
augccucagcccu

SEQ ID NO: 2162134 - RNA, 17 nt, Human
uuuacggacacccccuc

SEQ ID NO: 2162135 - RNA, 13 nt, Human
uuuacggacaccc

SEQ ID NO: 2162136 - RNA, 16 nt, Human
uuuccuuccagcccag

SEQ ID NO: 2162137 - RNA, 15 nt, Human
uuuccuuccagccca

SEQ ID NO: 2162138 - RNA, 15 nt, Human
uuucuaaacagagau

SEQ ID NO: 2162139 - RNA, 13 nt, Human
uuucguucaguua

SEQ ID NO: 2162140 - RNA, 22 nt, Human
uuucgauucguuaagagagcaa

SEQ ID NO: 2162141 - RNA, 15 nt, Human
augggaccuauaacu

SEQ ID NO: 2162142 - RNA, 22 nt, Human
augggaccuauaacugcccagc

SEQ ID NO: 2162143 - RNA, 20 nt, Human
augggcacaaagggcccaga

SEQ ID NO: 2162144 - RNA, 18 nt, Human
augggcacaaagggccca

SEQ ID NO: 2162145 - RNA, 15 nt, Human
uuucuuucacaaaaa

SEQ ID NO: 2162146 - RNA, 19 nt, Human
uuucugcuggaaacagacu

SEQ ID NO: 2162147 - RNA, 20 nt, Human
uuugaaagccccagaaauca

SEQ ID NO: 2162148 - RNA, 23 nt, Human
uuucuccauauuagauuuaccca

SEQ ID NO: 2162149 - RNA, 15 nt, Human
uuucuccagggucag

SEQ ID NO: 2162150 - RNA, 16 nt, Human
uuucuaaacagagaug

SEQ ID NO: 2162151 - RNA, 17 nt, Human
augagauuaauuccuuu

SEQ ID NO: 2162152 - RNA, 17 nt, Human
augaguggcuuuaauga

SEQ ID NO: 2162153 - RNA, 13 nt, Human
augaguuuuuccc

SEQ ID NO: 2162154 - RNA, 17 nt, Human
uugucaccuucaccucc

SEQ ID NO: 2162155 - RNA, 19 nt, Human
uugucccggauuuuuguua

SEQ ID NO: 2162156 - RNA, 19 nt, Human
uugugugugcucugcuuca

SEQ ID NO: 2162157 - RNA, 22 nt, Human
uugugaaggccucgcaggaaga

SEQ ID NO: 2162158 - RNA, 14 nt, Human
augaucugaaaaau

SEQ ID NO: 2162159 - RNA, 18 nt, Human
uuguaaaaaaaaaaaaca

SEQ ID NO: 2162160 - RNA, 17 nt, Human
augacaacuacagaaaa

SEQ ID NO: 2162161 - RNA, 23 nt, Human
augacaaaaucaucuuugugaag

SEQ ID NO: 2162162 - RNA, 13 nt, Human
uugcuuguucucu

SEQ ID NO: 2162163 - RNA, 23 nt, Human
uugcugaaggcuaaauucacagc

SEQ ID NO: 2162164 - RNA, 17 nt, Human
uuggacggcugggcaca

SEQ ID NO: 2162165 - RNA, 17 nt, Human
aucuuugugaaggccuc

SEQ ID NO: 2162166 - RNA, 13 nt, Human
aucuuugugaagg

SEQ ID NO: 2162167 - RNA, 20 nt, Human
auuuucacacaauacaauaa

SEQ ID NO: 2162168 - RNA, 15 nt, Human
auuuuccucugcuuu

SEQ ID NO: 2162169 - RNA, 19 nt, Human
auuuuccucugcuuugaaa

SEQ ID NO: 2162170 - RNA, 15 nt, Human
auuuucauuaaaagc

SEQ ID NO: 2162171 - RNA, 13 nt, Human
auuuucauuuguu

SEQ ID NO: 2162172 - RNA, 23 nt, Human
auuucauuuuguaacaaaugaac

SEQ ID NO: 2162173 - RNA, 21 nt, Human
auuucauuuuguaacaaauga

SEQ ID NO: 2162174 - RNA, 21 nt, Human
auuucccccaccccauuucuc

SEQ ID NO: 2162175 - RNA, 23 nt, Human
auuucccccaccccauuucucuc

SEQ ID NO: 2162176 - RNA, 21 nt, Human
auuucccauccccugugggaa

SEQ ID NO: 2162177 - RNA, 15 nt, Human
auuuccccuuuugca

SEQ ID NO: 2162178 - RNA, 15 nt, Human
auuuacugugucuuu

SEQ ID NO: 2162179 - RNA, 12 nt, Human
auuuacuguuuu

SEQ ID NO: 2162180 - RNA, 22 nt, Human
auuuaaaaacaggcagcucaua

SEQ ID NO: 2162181 - RNA, 14 nt, Human
auuuaaaaaaauca

SEQ ID NO: 2162182 - RNA, 21 nt, Human
auuuaguaggugaguuuucac

SEQ ID NO: 2162183 - RNA, 13 nt, Human
auuuagauaugca

SEQ ID NO: 2162184 - RNA, 16 nt, Human
auuuauaaaaaggugu

SEQ ID NO: 2162185 - RNA, 16 nt, Human
auucuuauuuuuuaaa

SEQ ID NO: 2162186 - RNA, 18 nt, Human
auucuuauucaaagaaau

SEQ ID NO: 2162187 - RNA, 17 nt, Human
auucuuuuguaauuuaa

SEQ ID NO: 2162188 - RNA, 16 nt, Human
auucuuuuguaauuua

SEQ ID NO: 2162189 - RNA, 13 nt, Human
auucuuuuguaau

SEQ ID NO: 2162190 - RNA, 15 nt, Human
auucuuaaaaaaaga

SEQ ID NO: 2162191 - RNA, 17 nt, Human
auucugucauagaaagu

SEQ ID NO: 2162192 - RNA, 18 nt, Human
auucugucauagaaagug

SEQ ID NO: 2162193 - RNA, 12 nt, Human
auucuggaguca

SEQ ID NO: 2162194 - RNA, 15 nt, Human
auuguauuuguuucu

SEQ ID NO: 2162195 - RNA, 14 nt, Human
auucuccauuuguu

SEQ ID NO: 2162196 - RNA, 18 nt, Human
auucuccauuuguuaucu

SEQ ID NO: 2162197 - RNA, 16 nt, Human
auucuccauuuguuau

SEQ ID NO: 2162198 - RNA, 19 nt, Human
auucuccauuuguuaucug

SEQ ID NO: 2162199 - RNA, 16 nt, Human
auuccaacacugauuu

SEQ ID NO: 2162200 - RNA, 17 nt, Human
uuuuagggagcuggucu

SEQ ID NO: 2162201 - RNA, 18 nt, Human
uuuucauugaacagcaaa

SEQ ID NO: 2162202 - RNA, 22 nt, Human
uuuucuccaauuuuuuuuuccu

SEQ ID NO: 2162203 - RNA, 16 nt, Human
uuuucauauuugcacu

SEQ ID NO: 2162204 - RNA, 11 nt, Human
auuaaaaccac

SEQ ID NO: 2162205 - RNA, 21 nt, Human
augugcuacaggggccagaag

SEQ ID NO: 2162206 - RNA, 19 nt, Human
augugcuacaggggccaga

SEQ ID NO: 2162207 - RNA, 15 nt, Human
augugcuacaggggc

SEQ ID NO: 2162208 - RNA, 13 nt, Human
augugcuacaggg

SEQ ID NO: 2162209 - RNA, 23 nt, Human
augugcuacaggggccagaagau

SEQ ID NO: 2162210 - RNA, 17 nt, Human
auguggauuuuuuccua

SEQ ID NO: 2162211 - RNA, 16 nt, Human
auguucagaagaaauu

SEQ ID NO: 2162212 - RNA, 17 nt, Human
auguucagaagaaauuc

SEQ ID NO: 2162213 - RNA, 20 nt, Human
auuaauacaaugaugcuauu

SEQ ID NO: 2162214 - RNA, 23 nt, Human
uuuuuauugaaucuauuuaagua

SEQ ID NO: 2162215 - RNA, 15 nt, Human
uuuuuguguauuugu

SEQ ID NO: 2162216 - RNA, 22 nt, Human
uuuuuacguuugaagacauugc

SEQ ID NO: 2162217 - RNA, 14 nt, Human
uuuugagcaugggu

SEQ ID NO: 2162218 - RNA, 19 nt, Human
uuuugaucuucaacaaauu

SEQ ID NO: 2162219 - RNA, 18 nt, Human
uuuugaucuucaacaaau

SEQ ID NO: 2162220 - RNA, 13 nt, Human
uuuugaucuucaa

SEQ ID NO: 2162221 - RNA, 15 nt, Human
uuuugcauaauuuca

SEQ ID NO: 2162222 - RNA, 20 nt, Human
uuuugcaucucacaaacaua

SEQ ID NO: 2162223 - RNA, 18 nt, Human
cugucuaaaaaacaaaac

SEQ ID NO: 2162224 - RNA, 14 nt, Human
cugucuaaaaaaca

SEQ ID NO: 2162225 - RNA, 18 nt, Human
cuguaaauuuggcuucug

SEQ ID NO: 2162226 - RNA, 17 nt, Human
cuguaaauuuggcuucu

SEQ ID NO: 2162227 - RNA, 20 nt, Human
cuggucugaugacuugcuua

SEQ ID NO: 2162228 - RNA, 21 nt, Human
cugugaauugagcugcagaaa

SEQ ID NO: 2162229 - RNA, 19 nt, Human
cugugaauugagcugcaga

SEQ ID NO: 2162230 - RNA, 15 nt, Human
cugugaauugagcug

SEQ ID NO: 2162231 - RNA, 23 nt, Human
cugugaauugagcugcagaaacg

SEQ ID NO: 2162232 - RNA, 17 nt, Human
cuguuauccuauuuaga

SEQ ID NO: 2162233 - RNA, 20 nt, Human
cuuaaaauacgguaccuggc

SEQ ID NO: 2162234 - RNA, 14 nt, Human
cuuaaacaaaugua

SEQ ID NO: 2162235 - RNA, 16 nt, Human
cugccucucacagcug

SEQ ID NO: 2162236 - RNA, 14 nt, Human
cugccucucacagc

SEQ ID NO: 2162237 - RNA, 22 nt, Human
cugccucucacagcugaguugu

SEQ ID NO: 2162238 - RNA, 21 nt, Human
cugccucucacagcugaguug

SEQ ID NO: 2162239 - RNA, 20 nt, Human
cugcuacucaaguagcauuu

SEQ ID NO: 2162240 - RNA, 23 nt, Human
cugcuacucaaguagcauuuacu

SEQ ID NO: 2162241 - RNA, 19 nt, Human
cuggaaacauucaggagcu

SEQ ID NO: 2162242 - RNA, 17 nt, Human
cuggcagcucagcuucc

SEQ ID NO: 2162243 - RNA, 13 nt, Human
cuggcagcucagc

SEQ ID NO: 2162244 - RNA, 15 nt, Human
cuuuuuuucuuuggu

SEQ ID NO: 2162245 - RNA, 13 nt, Human
cuuuugugucuua

SEQ ID NO: 2162246 - RNA, 15 nt, Human
cuuuuuuuuguaugu

SEQ ID NO: 2162247 - RNA, 14 nt, Human
gaaaagcagcucuc

SEQ ID NO: 2162248 - RNA, 17 nt, Human
gaaaagcagcucucccc

SEQ ID NO: 2162249 - RNA, 18 nt, Human
gaaaagcggacaucagcu

SEQ ID NO: 2162250 - RNA, 13 nt, Human
gaaaauuaacacu

SEQ ID NO: 2162251 - RNA, 15 nt, Human
gaaaauuaacacugc

SEQ ID NO: 2162252 - RNA, 20 nt, Human
gaaaagcggacaucagcugg

SEQ ID NO: 2162253 - RNA, 20 nt, Human
gaaacuguucccaccugcug

SEQ ID NO: 2162254 - RNA, 21 nt, Human
gaaacuguucccaccugcugg

SEQ ID NO: 2162255 - RNA, 22 nt, Human
gaaacuguucccaccugcugga

SEQ ID NO: 2162256 - RNA, 16 nt, Human
gaaagacagagcuggg

SEQ ID NO: 2162257 - RNA, 14 nt, Human
gaaagacagagcug

SEQ ID NO: 2162258 - RNA, 17 nt, Human
gaaagaauuucauaugc

SEQ ID NO: 2162259 - RNA, 17 nt, Human
gaaagacagcuucucau

SEQ ID NO: 2162260 - RNA, 16 nt, Human
gaaagacagcuucuca

SEQ ID NO: 2162261 - RNA, 13 nt, Human
gaaagguuuugag

SEQ ID NO: 2162262 - RNA, 21 nt, Human
gaacaagcaaacccagacggc

SEQ ID NO: 2162263 - RNA, 16 nt, Human
gaacaagcaaacccag

SEQ ID NO: 2162264 - RNA, 18 nt, Human
cuugccgcgucgcccucc

SEQ ID NO: 2162265 - RNA, 21 nt, Human
cuugccgcgucgcccucccag

SEQ ID NO: 2162266 - RNA, 23 nt, Human
cuugccgcgucgcccucccaggc

SEQ ID NO: 2162267 - RNA, 20 nt, Human
cuugucucccagcucagggc

SEQ ID NO: 2162268 - RNA, 21 nt, Human
cuuuaagggaguguacuccca

SEQ ID NO: 2162269 - RNA, 23 nt, Human
cuuuaagggaguguacucccagg

SEQ ID NO: 2162270 - RNA, 21 nt, Human
cuucuucuacuucagucuucu

SEQ ID NO: 2162271 - RNA, 15 nt, Human
cuucuauaauuguau

SEQ ID NO: 2162272 - RNA, 16 nt, Human
cuucuauauauuguau

SEQ ID NO: 2162273 - RNA, 23 nt, Human
gaggggcagauggaaaggagccu

SEQ ID NO: 2162274 - RNA, 17 nt, Human
gagcuggccccgccgcc

SEQ ID NO: 2162275 - RNA, 16 nt, Human
gagcuggccccgccgc

SEQ ID NO: 2162276 - RNA, 14 nt, Human
gagcuggccccgcc

SEQ ID NO: 2162277 - RNA, 13 nt, Human
gagcuggccccgc

SEQ ID NO: 2162278 - RNA, 20 nt, Human
gagaggcaauggcuccuuca

SEQ ID NO: 2162279 - RNA, 20 nt, Human
gagacuccucaguucuugcc

SEQ ID NO: 2162280 - RNA, 18 nt, Human
gagaaguucauauuucuu

SEQ ID NO: 2162281 - RNA, 20 nt, Human
gagaccuggacacaggccug

SEQ ID NO: 2162282 - RNA, 19 nt, Human
gagaccuggacacaggccu

SEQ ID NO: 2162283 - RNA, 10 nt, Human
gagaaaaaga

SEQ ID NO: 2162284 - RNA, 19 nt, Human
gacuuuuuuuuuuuauaau

SEQ ID NO: 2162285 - RNA, 12 nt, Human
gagaaaaagacc

SEQ ID NO: 2162286 - RNA, 16 nt, Human
gagaaaaagaaaugca

SEQ ID NO: 2162287 - RNA, 15 nt, Human
gagaaaaagaaaugc

SEQ ID NO: 2162288 - RNA, 14 nt, Human
gagaaaaagaaaug

SEQ ID NO: 2162289 - RNA, 16 nt, Human
gaccuccaagccacug

SEQ ID NO: 2162290 - RNA, 13 nt, Human
gaccucagggcac

SEQ ID NO: 2162291 - RNA, 17 nt, Human
gacacugggaggccagu

SEQ ID NO: 2162292 - RNA, 16 nt, Human
gacacugggaggccag

SEQ ID NO: 2162293 - RNA, 23 nt, Human
gacacugggaggccagugagcca

SEQ ID NO: 2162294 - RNA, 20 nt, Human
gacaaaguuccaaaaugcca

SEQ ID NO: 2162295 - RNA, 18 nt, Human
gacaaaguuccaaaaugc

SEQ ID NO: 2162296 - RNA, 15 nt, Human
gaauuagcugcuucu

SEQ ID NO: 2162297 - RNA, 20 nt, Human
gacaaagaggccuuuaacca

SEQ ID NO: 2162298 - RNA, 21 nt, Human
gaauuaaguuagggaauggca

SEQ ID NO: 2162299 - RNA, 18 nt, Human
gaauuaaguuagggaaug

SEQ ID NO: 2162300 - RNA, 16 nt, Human
gaucucugcagggccg

SEQ ID NO: 2162301 - RNA, 15 nt, Human
gaucucugcagggcc

SEQ ID NO: 2162302 - RNA, 20 nt, Human
gaucucugcagggccgccag

SEQ ID NO: 2162303 - RNA, 17 nt, Human
gauacugucucuuucau

SEQ ID NO: 2162304 - RNA, 17 nt, Human
gaucaaaggcacacagc

SEQ ID NO: 2162305 - RNA, 13 nt, Human
gauauuugugcau

SEQ ID NO: 2162306 - RNA, 14 nt, Human
gcaaccugcuucca

SEQ ID NO: 2162307 - RNA, 23 nt, Human
gcaaccagggagcugcaggggca

SEQ ID NO: 2162308 - RNA, 17 nt, Human
gcaaccagggagcugca

SEQ ID NO: 2162309 - RNA, 16 nt, Human
gcauccccugccucca

SEQ ID NO: 2162310 - RNA, 17 nt, Human
gcauccccugccuccau

SEQ ID NO: 2162311 - RNA, 15 nt, Human
gcauccccugccucc

SEQ ID NO: 2162312 - RNA, 14 nt, Human
gcauccccugccuc

SEQ ID NO: 2162313 - RNA, 13 nt, Human
gcauccccugccu

SEQ ID NO: 2162314 - RNA, 19 nt, Human
gcauccuaaagauaaagcc

SEQ ID NO: 2162315 - RNA, 20 nt, Human
gcauccuaaagauaaagcca

SEQ ID NO: 2162316 - RNA, 23 nt, Human
gcauccacuucuuucagcagacu

SEQ ID NO: 2162317 - RNA, 13 nt, Human
gcaguuuaaagca

SEQ ID NO: 2162318 - RNA, 13 nt, Human
gcagugagcagag

SEQ ID NO: 2162319 - RNA, 17 nt, Human
gcagucuguccaggcuc

SEQ ID NO: 2162320 - RNA, 22 nt, Human
gcagcugaaauaugcuggcugg

SEQ ID NO: 2162321 - RNA, 19 nt, Human
gcagcugaaauaugcuggc

SEQ ID NO: 2162322 - RNA, 18 nt, Human
gcagcugaaauaugcugg

SEQ ID NO: 2162323 - RNA, 12 nt, Human
gcagcucucccc

SEQ ID NO: 2162324 - RNA, 20 nt, Human
gcagcucauaagagccacag

SEQ ID NO: 2162325 - RNA, 16 nt, Human
gcagaaaauugccuaa

SEQ ID NO: 2162326 - RNA, 23 nt, Human
gcagaaacgaagccaucuuucuu

SEQ ID NO: 2162327 - RNA, 17 nt, Human
gcagaaacgaagccauc

SEQ ID NO: 2162328 - RNA, 11 nt, Human
gcccccugccc

SEQ ID NO: 2162329 - RNA, 14 nt, Human
gcccaggaugcugc

SEQ ID NO: 2162330 - RNA, 18 nt, Human
gcauuuacugugucuuug

SEQ ID NO: 2162331 - RNA, 17 nt, Human
gcauuuacugugucuuu

SEQ ID NO: 2162332 - RNA, 17 nt, Human
gccgcgucgcccuccca

SEQ ID NO: 2162333 - RNA, 16 nt, Human
gcggcggagcuggccc

SEQ ID NO: 2162334 - RNA, 20 nt, Human
gcggcggagcuggccccgcc

SEQ ID NO: 2162335 - RNA, 18 nt, Human
gcggcggagcuggccccg

SEQ ID NO: 2162336 - RNA, 19 nt, Human
gcgggaauggcagcugcca

SEQ ID NO: 2162337 - RNA, 14 nt, Human
gcgggagccucccu

SEQ ID NO: 2162338 - RNA, 19 nt, Human
gcuauuaaaacucuuuuaa

SEQ ID NO: 2162339 - RNA, 18 nt, Human
gcuauuaaaacucuuuua

SEQ ID NO: 2162340 - RNA, 21 nt, Human
ggaaaggagccuaggccaggu

SEQ ID NO: 2162341 - RNA, 19 nt, Human
ggaaaggagccuaggccag

SEQ ID NO: 2162342 - RNA, 17 nt, Human
ggaaacuggaugagguc

SEQ ID NO: 2162343 - RNA, 19 nt, Human
ggaaaaaaaucguccaggg

SEQ ID NO: 2162344 - RNA, 13 nt, Human
ggaaacagaggcu

SEQ ID NO: 2162345 - RNA, 17 nt, Human
gcuuuugugucuuacau

SEQ ID NO: 2162346 - RNA, 19 nt, Human
gcuuugcaaccauuuucau

SEQ ID NO: 2162347 - RNA, 14 nt, Human
ggacaucagcuggu

SEQ ID NO: 2162348 - RNA, 20 nt, Human
ggacauccccccgccaaaag

SEQ ID NO: 2162349 - RNA, 18 nt, Human
ggacauagcgaauacaaa

SEQ ID NO: 2162350 - RNA, 17 nt, Human
ggacaguggcaggacag

SEQ ID NO: 2162351 - RNA, 16 nt, Human
ggacaguggcaggaca

SEQ ID NO: 2162352 - RNA, 12 nt, Human
ggacaguggcag

SEQ ID NO: 2162353 - RNA, 14 nt, Human
ggacaguggcagga

SEQ ID NO: 2162354 - RNA, 13 nt, Human
ggacaguggcagg

SEQ ID NO: 2162355 - RNA, 15 nt, Human
ggacacccccucgcu

SEQ ID NO: 2162356 - RNA, 20 nt, Human
ggaaugagauuaauuccuuu

SEQ ID NO: 2162357 - RNA, 18 nt, Human
ggacacaggccugcucuc

SEQ ID NO: 2162358 - RNA, 13 nt, Human
ggacacaggccug

SEQ ID NO: 2162359 - RNA, 15 nt, Human
gcugagcaaacaugu

SEQ ID NO: 2162360 - RNA, 15 nt, Human
gcugaggcaauucua

SEQ ID NO: 2162361 - RNA, 14 nt, Human
gcugaggcaauucu

SEQ ID NO: 2162362 - RNA, 18 nt, Human
gcugugcacaaaguggca

SEQ ID NO: 2162363 - RNA, 17 nt, Human
aaaauauuuugaucuuc

SEQ ID NO: 2162364 - RNA, 15 nt, Human
aaaauauuuugaucu

SEQ ID NO: 2162365 - RNA, 18 nt, Human
aaaaugcaacaacaugua

SEQ ID NO: 2162366 - RNA, 16 nt, Human
aaaauggaaccaggcu

SEQ ID NO: 2162367 - RNA, 23 nt, Human
aaaauggcuucagaauuaaaacu

SEQ ID NO: 2162368 - RNA, 16 nt, Human
gggccugcgagggcag

SEQ ID NO: 2162369 - RNA, 20 nt, Human
gggccgccagggagaccugg

SEQ ID NO: 2162370 - RNA, 17 nt, Human
gggccauguugugccuc

SEQ ID NO: 2162371 - RNA, 23 nt, Human
gggccgccagggagaccuggaca

SEQ ID NO: 2162372 - RNA, 17 nt, Human
gggccgggcagaggggc

SEQ ID NO: 2162373 - RNA, 23 nt, Human
aaacuuccagugcaacacugaag

SEQ ID NO: 2162374 - RNA, 19 nt, Human
gguccaggauuccucuuuu

SEQ ID NO: 2162375 - RNA, 16 nt, Human
ggucauagcagugcuu

SEQ ID NO: 2162376 - RNA, 21 nt, Human
gguccagaaggagacaggcag

SEQ ID NO: 2162377 - RNA, 20 nt, Human
aaacuguucccaccugcugg

SEQ ID NO: 2162378 - RNA, 21 nt, Human
aaacuguucccaccugcugga

SEQ ID NO: 2162379 - RNA, 14 nt, Human
aaacuaaaaauaau

SEQ ID NO: 2162380 - RNA, 13 nt, Human
aaacgcagacacu

SEQ ID NO: 2162381 - RNA, 17 nt, Human
gggguccagggagcagg

SEQ ID NO: 2162382 - RNA, 17 nt, Human
ggggcccaugaaagagg

SEQ ID NO: 2162383 - RNA, 15 nt, Human
aaaccaaaaacugaa

SEQ ID NO: 2162384 - RNA, 15 nt, Human
aaaccagaggcagcu

SEQ ID NO: 2162385 - RNA, 19 nt, Human
aaacgaagccaucuuucuu

SEQ ID NO: 2162386 - RNA, 18 nt, Human
aaacgaagccaucuuucu

SEQ ID NO: 2162387 - RNA, 11 nt, Human
aaaccuucaca

SEQ ID NO: 2162388 - RNA, 20 nt, Human
aaaccuucacacacagacug

SEQ ID NO: 2162389 - RNA, 12 nt, Human
gggucaaggaau

SEQ ID NO: 2162390 - RNA, 18 nt, Human
gggucauagauguuuccu

SEQ ID NO: 2162391 - RNA, 13 nt, Human
ggguccagaagga

SEQ ID NO: 2162392 - RNA, 13 nt, Human
aaacauuuucaca

SEQ ID NO: 2162393 - RNA, 14 nt, Human
aaacauuuucacac

SEQ ID NO: 2162394 - RNA, 16 nt, Human
aaacauuuucacacaa

SEQ ID NO: 2162395 - RNA, 22 nt, Human
aaacauuuucacacaauacaau

SEQ ID NO: 2162396 - RNA, 13 nt, Human
guaacaaaugaac

SEQ ID NO: 2162397 - RNA, 15 nt, Human
guaaauuuggcuucu

SEQ ID NO: 2162398 - RNA, 13 nt, Human
guaaauuuggcuu

SEQ ID NO: 2162399 - RNA, 16 nt, Human
guaaauuuggcuucug

SEQ ID NO: 2162400 - RNA, 14 nt, Human
guaaaguccccaga

SEQ ID NO: 2162401 - RNA, 20 nt, Human
guaaacgcugucccuaguaa

SEQ ID NO: 2162402 - RNA, 16 nt, Human
guaaacgcugucccua

SEQ ID NO: 2162403 - RNA, 23 nt, Human
aaauaucugagcucuuugcacua

SEQ ID NO: 2162404 - RNA, 12 nt, Human
aaauauugucuu

SEQ ID NO: 2162405 - RNA, 20 nt, Human
aaauauugucuuuuuguaug

SEQ ID NO: 2162406 - RNA, 17 nt, Human
aaauauugucuuuuugu

SEQ ID NO: 2162407 - RNA, 15 nt, Human
aaagcuguauuuuga

SEQ ID NO: 2162408 - RNA, 17 nt, Human
aaagcuguauuuugaaa

SEQ ID NO: 2162409 - RNA, 13 nt, Human
aaagguuuugagc

SEQ ID NO: 2162410 - RNA, 19 nt, Human
aaagguuguuuugaaacug

SEQ ID NO: 2162411 - RNA, 17 nt, Human
gguguugacaugugcuu

SEQ ID NO: 2162412 - RNA, 19 nt, Human
ggcacacgccucccacugg

SEQ ID NO: 2162413 - RNA, 18 nt, Human
ggcacacgccucccacug

SEQ ID NO: 2162414 - RNA, 17 nt, Human
ggcacacgccucccacu

SEQ ID NO: 2162415 - RNA, 15 nt, Human
ggcacacgccuccca

SEQ ID NO: 2162416 - RNA, 12 nt, Human
ggcacacgccuc

SEQ ID NO: 2162417 - RNA, 18 nt, Human
ggcagggccaacccuucu

SEQ ID NO: 2162418 - RNA, 22 nt, Human
ggcaggggagggucagccaggg

SEQ ID NO: 2162419 - RNA, 20 nt, Human
ggcaggggagggucagccag

SEQ ID NO: 2162420 - RNA, 23 nt, Human
ggccaacccuucuccucuuguaa

SEQ ID NO: 2162421 - RNA, 22 nt, Human
ggccagaccugcagacgcccag

SEQ ID NO: 2162422 - RNA, 18 nt, Human
ggccagaccugcagacgc

SEQ ID NO: 2162423 - RNA, 15 nt, Human
ggccagaccugcaga

SEQ ID NO: 2162424 - RNA, 22 nt, Human
ggaguggggaagugaucuuuug

SEQ ID NO: 2162425 - RNA, 19 nt, Human
ggaguguacucccagggcu

SEQ ID NO: 2162426 - RNA, 18 nt, Human
ggaguguacucccagggc

SEQ ID NO: 2162427 - RNA, 15 nt, Human
ggaguguacucccag

SEQ ID NO: 2162428 - RNA, 18 nt, Human
ggaucuauacuugcuuug

SEQ ID NO: 2162429 - RNA, 20 nt, Human
ggaggcuaaagcccagagac

SEQ ID NO: 2162430 - RNA, 18 nt, Human
ggagggggaauguaguga

SEQ ID NO: 2162431 - RNA, 16 nt, Human
ggccuggcagcucagc

SEQ ID NO: 2162432 - RNA, 14 nt, Human
ggccuggcagcuca

SEQ ID NO: 2162433 - RNA, 21 nt, Human
ggcgaucgcggcggagcuggc

SEQ ID NO: 2162434 - RNA, 17 nt, Human
ggccucccacagacuca

SEQ ID NO: 2162435 - RNA, 14 nt, Human
ggccucccacagac

SEQ ID NO: 2162436 - RNA, 16 nt, Human
ggccucccacagacuc

SEQ ID NO: 2162437 - RNA, 11 nt, Human
aaaaaaagaca

SEQ ID NO: 2162438 - RNA, 11 nt, Human
aaaaaaagaaa

SEQ ID NO: 2162439 - RNA, 11 nt, Human
aaaaaaaccaa

SEQ ID NO: 2162440 - RNA, 12 nt, Human
aaaaaagaaaau

SEQ ID NO: 2162441 - RNA, 22 nt, Human
ggcuggcaugauccaagcaaga

SEQ ID NO: 2162442 - RNA, 12 nt, Human
ggcuggcaugau

SEQ ID NO: 2162443 - RNA, 17 nt, Human
auuuauacuguauauau

SEQ ID NO: 2162444 - RNA, 16 nt, Human
auuuauacuggcaugc

SEQ ID NO: 2162445 - RNA, 15 nt, Human
auuuauacuggcaug

SEQ ID NO: 2162446 - RNA, 19 nt, Human
auuguacacaccuuauauu

SEQ ID NO: 2162447 - RNA, 14 nt, Human
auuguaaaacaggu

SEQ ID NO: 2162448 - RNA, 22 nt, Human
auucaucucucuuuaauauaaa

SEQ ID NO: 2162449 - RNA, 17 nt, Human
auucaucucucuuuaau

SEQ ID NO: 2162450 - RNA, 19 nt, Human
auugauauuugugcauuuu

SEQ ID NO: 2162451 - RNA, 22 nt, Human
auugauauuugugcauuuucua

SEQ ID NO: 2162452 - RNA, 18 nt, Human
auugauauuugugcauuu

SEQ ID NO: 2162453 - RNA, 16 nt, Human
auugauauuugugcau

SEQ ID NO: 2162454 - RNA, 13 nt, Human
auugauauuugug

SEQ ID NO: 2162455 - RNA, 17 nt, Human
auucuuucgaaagaaga

SEQ ID NO: 2162456 - RNA, 17 nt, Human
auuccucuuuucucugc

SEQ ID NO: 2162457 - RNA, 15 nt, Human
auuccucuuuucucu

SEQ ID NO: 2162458 - RNA, 12 nt, Human
auuccucuuuuc

SEQ ID NO: 2162459 - RNA, 15 nt, Human
auuuuauacauuaac

SEQ ID NO: 2162460 - RNA, 14 nt, Human
auuuuauaauucug

SEQ ID NO: 2162461 - RNA, 14 nt, Human
caaaccacacugga

SEQ ID NO: 2162462 - RNA, 14 nt, Human
caaaagcugcucag

SEQ ID NO: 2162463 - RNA, 15 nt, Human
caaaccacacuggac

SEQ ID NO: 2162464 - RNA, 12 nt, Human
caaaagcugcuc

SEQ ID NO: 2162465 - RNA, 23 nt, Human
caaaaaaaccucuuaauauucug

SEQ ID NO: 2162466 - RNA, 21 nt, Human
auuuuuacguuugaagacauu

SEQ ID NO: 2162467 - RNA, 17 nt, Human
caaauuuuauuuguagg

SEQ ID NO: 2162468 - RNA, 20 nt, Human
caaaucuaggaaaauauuuu

SEQ ID NO: 2162469 - RNA, 23 nt, Human
caaaucuaggaaaauauuuugau

SEQ ID NO: 2162470 - RNA, 12 nt, Human
caacacaaagag

SEQ ID NO: 2162471 - RNA, 15 nt, Human
caacacaaagagaaa

SEQ ID NO: 2162472 - RNA, 13 nt, Human
caacacaaagaga

SEQ ID NO: 2162473 - RNA, 23 nt, Human
caacacaaagagaaaaagaaaug

SEQ ID NO: 2162474 - RNA, 22 nt, Human
caacacaaagagaaaaagaaau

SEQ ID NO: 2162475 - RNA, 20 nt, Human
caacacaaagagaaaaagaa

SEQ ID NO: 2162476 - RNA, 16 nt, Human
caacacaaagagaaaa

SEQ ID NO: 2162477 - RNA, 19 nt, Human
caagauucccaggaguucu

SEQ ID NO: 2162478 - RNA, 16 nt, Human
caagauucccaggagu

SEQ ID NO: 2162479 - RNA, 15 nt, Human
caagauucccaggag

SEQ ID NO: 2162480 - RNA, 14 nt, Human
caagauucccagga

SEQ ID NO: 2162481 - RNA, 21 nt, Human
caagauucccaggaguucugc

SEQ ID NO: 2162482 - RNA, 20 nt, Human
caagauucccaggaguucug

SEQ ID NO: 2162483 - RNA, 13 nt, Human
caagauucccagg

SEQ ID NO: 2162484 - RNA, 17 nt, Human
caaguagcauuuacugu

SEQ ID NO: 2162485 - RNA, 16 nt, Human
caaguagcauuuacug

SEQ ID NO: 2162486 - RNA, 17 nt, Human
caaguuguucaaacauu

SEQ ID NO: 2162487 - RNA, 21 nt, Human
caauaaaaaaaagaaaugaaa

SEQ ID NO: 2162488 - RNA, 20 nt, Human
caauaaaaaaaagaaaugaa

SEQ ID NO: 2162489 - RNA, 19 nt, Human
caauaaaaaaaagaaauga

SEQ ID NO: 2162490 - RNA, 16 nt, Human
caauaaaaaaaagaaa

SEQ ID NO: 2162491 - RNA, 13 nt, Human
caauaaaaaaaag

SEQ ID NO: 2162492 - RNA, 19 nt, Human
caauucuuacaaacaugug

SEQ ID NO: 2162493 - RNA, 18 nt, Human
caauucuuacaaacaugu

SEQ ID NO: 2162494 - RNA, 17 nt, Human
caauucuuacaaacaug

SEQ ID NO: 2162495 - RNA, 12 nt, Human
caauuuaaagca

SEQ ID NO: 2162496 - RNA, 24 nt, Human
cacaucagcuccacuuucagugaa

SEQ ID NO: 2162497 - RNA, 23 nt, Human
cacagguaugaccuucuaggaag

SEQ ID NO: 2162498 - RNA, 23 nt, Human
caccuaaauaaccaaucuacaau

SEQ ID NO: 2162499 - RNA, 22 nt, Human
caccuaaauaaccaaucuacaa

SEQ ID NO: 2162500 - RNA, 23 nt, Human
caccucaagaagaagaggggcau

SEQ ID NO: 2162501 - RNA, 16 nt, Human
cacugaaauauacaca

SEQ ID NO: 2162502 - RNA, 20 nt, Human
cacugaaauauacacacagc

SEQ ID NO: 2162503 - RNA, 17 nt, Human
cacucuucucagccacu

SEQ ID NO: 2162504 - RNA, 14 nt, Human
cacucuucucagcc

SEQ ID NO: 2162505 - RNA, 13 nt, Human
cacucuucucagc

SEQ ID NO: 2162506 - RNA, 15 nt, Human
cacuaauacaccagg

SEQ ID NO: 2162507 - RNA, 11 nt, Human
cagaacacugu

SEQ ID NO: 2162508 - RNA, 19 nt, Human
cagaauagauagcacugaa

SEQ ID NO: 2162509 - RNA, 14 nt, Human
cagaauacacuuaa

SEQ ID NO: 2162510 - RNA, 19 nt, Human
cacuuucagugaaagcauc

SEQ ID NO: 2162511 - RNA, 18 nt, Human
cacuuucagugaaagcau

SEQ ID NO: 2162512 - RNA, 17 nt, Human
cacuuucagugaaagca

SEQ ID NO: 2162513 - RNA, 23 nt, Human
cagcugaugacucaagauuccca

SEQ ID NO: 2162514 - RNA, 22 nt, Human
cagcugaugacucaagauuccc

SEQ ID NO: 2162515 - RNA, 21 nt, Human
cagcugaugacucaagauucc

SEQ ID NO: 2162516 - RNA, 16 nt, Human
cagcugaugacucaag

SEQ ID NO: 2162517 - RNA, 15 nt, Human
cagcugaugacucaa

SEQ ID NO: 2162518 - RNA, 13 nt, Human
cagcugaugacuc

SEQ ID NO: 2162519 - RNA, 18 nt, Human
cagcugagugaaaaaucu

SEQ ID NO: 2162520 - RNA, 12 nt, Human
cagcugaguugu

SEQ ID NO: 2162521 - RNA, 23 nt, Human
cagcugagugaaaaaucugugga

SEQ ID NO: 2162522 - RNA, 22 nt, Human
cagccagggccugcgagggcag

SEQ ID NO: 2162523 - RNA, 21 nt, Human
cagccagggccugcgagggca

SEQ ID NO: 2162524 - RNA, 16 nt, Human
cagccagggccugcga

SEQ ID NO: 2162525 - RNA, 23 nt, Human
cagccagggccugcgagggcagc

SEQ ID NO: 2162526 - RNA, 20 nt, Human
cagggagcauuuuccuccau

SEQ ID NO: 2162527 - RNA, 14 nt, Human
cagggagcugcagg

SEQ ID NO: 2162528 - RNA, 17 nt, Human
cagggagcugcaggggc

SEQ ID NO: 2162529 - RNA, 15 nt, Human
cagggagcugcaggg

SEQ ID NO: 2162530 - RNA, 18 nt, Human
cagggagcugcaggggca

SEQ ID NO: 2162531 - RNA, 15 nt, Human
cagucaauuaacaau

SEQ ID NO: 2162532 - RNA, 14 nt, Human
cagucaauuaacaa

SEQ ID NO: 2162533 - RNA, 24 nt, Human
caggugcaaccagggagcugcagg

SEQ ID NO: 2162534 - RNA, 18 nt, Human
caggugcaaccagggagc

SEQ ID NO: 2162535 - RNA, 15 nt, Human
caggugcaaccaggg

SEQ ID NO: 2162536 - RNA, 14 nt, Human
cauguagaaaacaa

SEQ ID NO: 2162537 - RNA, 21 nt, Human
cauguugugccucccugguga

SEQ ID NO: 2162538 - RNA, 19 nt, Human
cauguugugccucccuggu

SEQ ID NO: 2162539 - RNA, 18 nt, Human
cauguugugccucccugg

SEQ ID NO: 2162540 - RNA, 13 nt, Human
cauguugugccuc

SEQ ID NO: 2162541 - RNA, 20 nt, Human
cauguugugccucccuggug

SEQ ID NO: 2162542 - RNA, 22 nt, Human
cauucuaaugauggcccauucu

SEQ ID NO: 2162543 - RNA, 13 nt, Human
cauucuaaugaug

SEQ ID NO: 2162544 - RNA, 21 nt, Human
cauucuacuugcucuggaccu

SEQ ID NO: 2162545 - RNA, 20 nt, Human
cauucuacuugcucuggacc

SEQ ID NO: 2162546 - RNA, 18 nt, Human
cauucuacuugcucugga

SEQ ID NO: 2162547 - RNA, 17 nt, Human
cauucuacuugcucugg

SEQ ID NO: 2162548 - RNA, 16 nt, Human
cauucuacuugcucug

SEQ ID NO: 2162549 - RNA, 15 nt, Human
cauucuacuugcucu

SEQ ID NO: 2162550 - RNA, 14 nt, Human
cauucuacuugcuc

SEQ ID NO: 2162551 - RNA, 13 nt, Human
cauucuacuugcu

SEQ ID NO: 2162552 - RNA, 19 nt, Human
cauucuaaugauggcccau

SEQ ID NO: 2162553 - RNA, 12 nt, Human
cauucuacuugc

SEQ ID NO: 2162554 - RNA, 11 nt, Human
cauucuacuug

SEQ ID NO: 2162555 - RNA, 23 nt, Human
cauucuacuugcucuggaccugc

SEQ ID NO: 2162556 - RNA, 22 nt, Human
cauucuacuugcucuggaccug

SEQ ID NO: 2162557 - RNA, 23 nt, Human
cauucuaggccuccuggcccagg

SEQ ID NO: 2162558 - RNA, 20 nt, Human
caugauuuacagagaaguga

SEQ ID NO: 2162559 - RNA, 16 nt, Human
caugauuuacagagaa

SEQ ID NO: 2162560 - RNA, 21 nt, Human
caucgccagcugaugacucaa

SEQ ID NO: 2162561 - RNA, 20 nt, Human
caucgccagcugaugacuca

SEQ ID NO: 2162562 - RNA, 16 nt, Human
caucgccagcugauga

SEQ ID NO: 2162563 - RNA, 13 nt, Human
caucgccagacaa

SEQ ID NO: 2162564 - RNA, 14 nt, Human
caucgcacugugga

SEQ ID NO: 2162565 - RNA, 13 nt, Human
caucgcacugugg

SEQ ID NO: 2162566 - RNA, 15 nt, Human
cauccccugugggaa

SEQ ID NO: 2162567 - RNA, 14 nt, Human
cauauuaauacaau

SEQ ID NO: 2162568 - RNA, 23 nt, Human
cauauuaauacaaugaugcuauu

SEQ ID NO: 2162569 - RNA, 12 nt, Human
cauuuguauauu

SEQ ID NO: 2162570 - RNA, 15 nt, Human
ccaaucauauuaaua

SEQ ID NO: 2162571 - RNA, 22 nt, Human
ccgcauccccugccuccauccu

SEQ ID NO: 2162572 - RNA, 18 nt, Human
ccgcauccccugccucca

SEQ ID NO: 2162573 - RNA, 17 nt, Human
ccgcauccccugccucc

SEQ ID NO: 2162574 - RNA, 16 nt, Human
ccgcauccccugccuc

SEQ ID NO: 2162575 - RNA, 15 nt, Human
ccgcauccccugccu

SEQ ID NO: 2162576 - RNA, 14 nt, Human
ccgcauccccugcc

SEQ ID NO: 2162577 - RNA, 13 nt, Human
ccgcauccccugc

SEQ ID NO: 2162578 - RNA, 16 nt, Human
cccugucugccagggc

SEQ ID NO: 2162579 - RNA, 18 nt, Human
ccuguaaucccagcacuu

SEQ ID NO: 2162580 - RNA, 15 nt, Human
ccugguuuagccugg

SEQ ID NO: 2162581 - RNA, 15 nt, Human
ccugucugccagggc

SEQ ID NO: 2162582 - RNA, 17 nt, Human
ccugccuccauccuagu

SEQ ID NO: 2162583 - RNA, 14 nt, Human
ccugccuccauccu

SEQ ID NO: 2162584 - RNA, 11 nt, Human
ccauuucucuc

SEQ ID NO: 2162585 - RNA, 22 nt, Human
cccagggcuuacggcccuggcc

SEQ ID NO: 2162586 - RNA, 15 nt, Human
cccucagagugcaag

SEQ ID NO: 2162587 - RNA, 17 nt, Human
cccucaagaggaaguga

SEQ ID NO: 2162588 - RNA, 11 nt, Human
ccauugaaggc

SEQ ID NO: 2162589 - RNA, 12 nt, Human
ccauugaaggcu

SEQ ID NO: 2162590 - RNA, 22 nt, Human
ccauucuuuuguaauuuaaaug

SEQ ID NO: 2162591 - RNA, 18 nt, Human
ccauucuuuuguaauuua

SEQ ID NO: 2162592 - RNA, 16 nt, Human
ccauucuuuuguaauu

SEQ ID NO: 2162593 - RNA, 15 nt, Human
ccauucuuuuguaau

SEQ ID NO: 2162594 - RNA, 17 nt, Human
ccauugaaggcuuaaac

SEQ ID NO: 2162595 - RNA, 21 nt, Human
ccauugaaggcuuaaacccau

SEQ ID NO: 2162596 - RNA, 21 nt, Human
ccagucacugugagcucccag

SEQ ID NO: 2162597 - RNA, 15 nt, Human
ccaggauuccucuuu

SEQ ID NO: 2162598 - RNA, 18 nt, Human
ccaggauuccucuuuucu

SEQ ID NO: 2162599 - RNA, 17 nt, Human
ccagcuacaccuuucuc

SEQ ID NO: 2162600 - RNA, 22 nt, Human
cgugaucaaagccacacucugg

SEQ ID NO: 2162601 - RNA, 17 nt, Human
cgccuggguccagggga

SEQ ID NO: 2162602 - RNA, 21 nt, Human
cggagcuggccccgccgccug

SEQ ID NO: 2162603 - RNA, 16 nt, Human
cggagcuggccccgcc

SEQ ID NO: 2162604 - RNA, 13 nt, Human
cggagcuggcccc

SEQ ID NO: 2162605 - RNA, 15 nt, Human
cggcuccacuaggac

SEQ ID NO: 2162606 - RNA, 18 nt, Human
cgggcgcacugccucuca

SEQ ID NO: 2162607 - RNA, 15 nt, Human
cgggcgcacugccuc

SEQ ID NO: 2162608 - RNA, 22 nt, Human
cgggcgcacugccucucacagc

SEQ ID NO: 2162609 - RNA, 17 nt, Human
cgggcgcacugccucuc

SEQ ID NO: 2162610 - RNA, 16 nt, Human
cgggcgcacugccucu

SEQ ID NO: 2162611 - RNA, 20 nt, Human
ccuuuuuuaaaaguaaaugu

SEQ ID NO: 2162612 - RNA, 13 nt, Human
ccuuuuuuaaaag

SEQ ID NO: 2162613 - RNA, 16 nt, Human
cgacagcauuuuccuc

SEQ ID NO: 2162614 - RNA, 17 nt, Human
cgacacugggaggccag

SEQ ID NO: 2162615 - RNA, 19 nt, Human
ccuuuacggacacccccuc

SEQ ID NO: 2162616 - RNA, 14 nt, Human
ccuuuacggacacc

SEQ ID NO: 2162617 - RNA, 14 nt, Human
cgccucccacuggg

SEQ ID NO: 2162618 - RNA, 13 nt, Human
cgccucccacugg

SEQ ID NO: 2162619 - RNA, 23 nt, Human
cgcaggagcacacccagccccca

SEQ ID NO: 2162620 - RNA, 18 nt, Human
cgcaggagcacacccagc

SEQ ID NO: 2162621 - RNA, 17 nt, Human
cuaauuuauaaaaaggu

SEQ ID NO: 2162622 - RNA, 13 nt, Human
cuaauuuauaaaa

SEQ ID NO: 2162623 - RNA, 14 nt, Human
cuaauuuauaaaaa

SEQ ID NO: 2162624 - RNA, 17 nt, Human
cuaauucuugcauauuu

SEQ ID NO: 2162625 - RNA, 21 nt, Human
cuacucauacuuaagcaaaag

SEQ ID NO: 2162626 - RNA, 20 nt, Human
cuacucauacuuaagcaaaa

SEQ ID NO: 2162627 - RNA, 11 nt, Human
cucaauauuuu

SEQ ID NO: 2162628 - RNA, 17 nt, Human
cucucacagcugaguug

SEQ ID NO: 2162629 - RNA, 16 nt, Human
cucguucucccuggga

SEQ ID NO: 2162630 - RNA, 21 nt, Human
cucuaaagaguuuauuuuaag

SEQ ID NO: 2162631 - RNA, 14 nt, Human
cucguucucccugg

SEQ ID NO: 2162632 - RNA, 13 nt, Human
cuccaagccagcg

SEQ ID NO: 2162633 - RNA, 16 nt, Human
cuccaacucagaaggg

SEQ ID NO: 2162634 - RNA, 16 nt, Human
cucauguucugcuuuc

SEQ ID NO: 2162635 - RNA, 15 nt, Human
cucauguucugcuuu

SEQ ID NO: 2162636 - RNA, 21 nt, Human
cugaccugguccacagggcac

SEQ ID NO: 2162637 - RNA, 20 nt, Human
cugaccugguccacagggca

SEQ ID NO: 2162638 - RNA, 18 nt, Human
cugaccugguccacaggg

SEQ ID NO: 2162639 - RNA, 17 nt, Human
cugaccugguccacagg

SEQ ID NO: 2162640 - RNA, 16 nt, Human
cugaccugguccacag

SEQ ID NO: 2162641 - RNA, 12 nt, Human
cucuuuucucug

SEQ ID NO: 2162642 - RNA, 19 nt, Human
cugaagccuuucuuuugga

SEQ ID NO: 2162643 - RNA, 18 nt, Human
aaguuguucaaacauuua

SEQ ID NO: 2162644 - RNA, 22 nt, Human
aauaaguuaacuauuuuauuuu

SEQ ID NO: 2162645 - RNA, 13 nt, Human
aagguuguauugc

SEQ ID NO: 2162646 - RNA, 17 nt, Human
aagguuguauugcauau

SEQ ID NO: 2162647 - RNA, 18 nt, Human
aagguuguuuugaaacug

SEQ ID NO: 2162648 - RNA, 15 nt, Human
aaguaugggaaauga

SEQ ID NO: 2162649 - RNA, 21 nt, Human
aagucucucauucuaggccuc

SEQ ID NO: 2162650 - RNA, 17 nt, Human
aagucucuaacaaugua

SEQ ID NO: 2162651 - RNA, 15 nt, Human
aagaacaauauugac

SEQ ID NO: 2162652 - RNA, 21 nt, Human
aagaacaauauugacuuuguc

SEQ ID NO: 2162653 - RNA, 16 nt, Human
aagaaaugcaaaaauc

SEQ ID NO: 2162654 - RNA, 20 nt, Human
aagccagaagcuaagcugca

SEQ ID NO: 2162655 - RNA, 17 nt, Human
aagcagcucuccccuca

SEQ ID NO: 2162656 - RNA, 14 nt, Human
aagcagcucucccc

SEQ ID NO: 2162657 - RNA, 13 nt, Human
aagcagcucuccc

SEQ ID NO: 2162658 - RNA, 16 nt, Human
aagcagagaagcucuc

SEQ ID NO: 2162659 - RNA, 14 nt, Human
aagcagagaagcuc

SEQ ID NO: 2162660 - RNA, 15 nt, Human
aagccaucuuucuuu

SEQ ID NO: 2162661 - RNA, 13 nt, Human
aauauacacacag

SEQ ID NO: 2162662 - RNA, 14 nt, Human
aauauaauacugua

SEQ ID NO: 2162663 - RNA, 18 nt, Human
aauaugguguacauucuu

SEQ ID NO: 2162664 - RNA, 17 nt, Human
aaugaucuuuucaaguu

SEQ ID NO: 2162665 - RNA, 21 nt, Human
aaucugcugguuuuaacaacu

SEQ ID NO: 2162666 - RNA, 17 nt, Human
aaugucuucuagaauau

SEQ ID NO: 2162667 - RNA, 22 nt, Human
aaagucucucauucuaggccuc

SEQ ID NO: 2162668 - RNA, 20 nt, Human
aaagugaaaguccagaaacu

SEQ ID NO: 2162669 - RNA, 14 nt, Human
aaagugcugcggag

SEQ ID NO: 2162670 - RNA, 12 nt, Human
aaauaaagcccu

SEQ ID NO: 2162671 - RNA, 23 nt, Human
aaauggcugcaucccccccaccu

SEQ ID NO: 2162672 - RNA, 22 nt, Human
aaauggcuucagaauuaaaacu

SEQ ID NO: 2162673 - RNA, 20 nt, Human
aaacagacucgauucauauu

SEQ ID NO: 2162674 - RNA, 20 nt, Human
aaagauauaugaauaugaca

SEQ ID NO: 2162675 - RNA, 21 nt, Human
aacuuauuaaauggaaacuga

SEQ ID NO: 2162676 - RNA, 13 nt, Human
aacucaauauuuu

SEQ ID NO: 2162677 - RNA, 12 nt, Human
aacucaauauuu

SEQ ID NO: 2162678 - RNA, 21 nt, Human
aacucaauauuuuccaugaaa

SEQ ID NO: 2162679 - RNA, 20 nt, Human
aacucaauauuuuccaugaa

SEQ ID NO: 2162680 - RNA, 14 nt, Human
aacucaauauuuuc

SEQ ID NO: 2162681 - RNA, 9 nt, Human
aacaaaaca

SEQ ID NO: 2162682 - RNA, 20 nt, Human
accugcccccgcauccccug

SEQ ID NO: 2162683 - RNA, 18 nt, Human
accugcccccgcaucccc

SEQ ID NO: 2162684 - RNA, 23 nt, Human
accugcccccgcauccccugccu

SEQ ID NO: 2162685 - RNA, 16 nt, Human
accucuuaauauucug

SEQ ID NO: 2162686 - RNA, 18 nt, Human
accuuucaaagccauuuu

SEQ ID NO: 2162687 - RNA, 15 nt, Human
accuuucaaagccau

SEQ ID NO: 2162688 - RNA, 18 nt, Human
accuuucauaaucuuugc

SEQ ID NO: 2162689 - RNA, 14 nt, Human
acucugggcuccag

SEQ ID NO: 2162690 - RNA, 16 nt, Human
acucugggcuccagag

SEQ ID NO: 2162691 - RNA, 14 nt, Human
acucaaaggccaga

SEQ ID NO: 2162692 - RNA, 22 nt, Human
acucagcucuuggcuccacugg

SEQ ID NO: 2162693 - RNA, 15 nt, Human
acuaggauacugcug

SEQ ID NO: 2162694 - RNA, 21 nt, Human
acuagggugaggguuuucugu

SEQ ID NO: 2162695 - RNA, 17 nt, Human
acuaggggacaaagcaa

SEQ ID NO: 2162696 - RNA, 22 nt, Human
agaaaauggaaccaggcuugga

SEQ ID NO: 2162697 - RNA, 14 nt, Human
acuuucauuggaaa

SEQ ID NO: 2162698 - RNA, 18 nt, Human
acuuucagugaaagcauc

SEQ ID NO: 2162699 - RNA, 12 nt, Human
acugcauuuuag

SEQ ID NO: 2162700 - RNA, 18 nt, Human
acuggacuccggcccucc

SEQ ID NO: 2162701 - RNA, 19 nt, Human
acuggacuccggcccuccu

SEQ ID NO: 2162702 - RNA, 16 nt, Human
acuggacuccggcccu

SEQ ID NO: 2162703 - RNA, 14 nt, Human
acuggacuccggcc

SEQ ID NO: 2162704 - RNA, 21 nt, Human
acugugagcucccaggugcag

SEQ ID NO: 2162705 - RNA, 18 nt, Human
acugugaugcccugcccu

SEQ ID NO: 2162706 - RNA, 23 nt, Human
acugucuguguuuuuuuggcagu

SEQ ID NO: 2162707 - RNA, 15 nt, Human
acuucuuucagcaga

SEQ ID NO: 2162708 - RNA, 15 nt, Human
acuguugucccugca

SEQ ID NO: 2162709 - RNA, 24 nt, Human
acuguuuuaauuuauacuggcaug

SEQ ID NO: 2162710 - RNA, 15 nt, Human
acaucgcacugugga

SEQ ID NO: 2162711 - RNA, 16 nt, Human
acauccugugccucca

SEQ ID NO: 2162712 - RNA, 13 nt, Human
acauaaagcaaau

SEQ ID NO: 2162713 - RNA, 18 nt, Human
acauaaagcaaauagaca

SEQ ID NO: 2162714 - RNA, 15 nt, Human
acauaaagcaaauag

SEQ ID NO: 2162715 - RNA, 21 nt, Human
acauaaagcaaauagacacag

SEQ ID NO: 2162716 - RNA, 21 nt, Human
acauuuguagcauccucuuua

SEQ ID NO: 2162717 - RNA, 14 nt, Human
accccgucaacaaa

SEQ ID NO: 2162718 - RNA, 21 nt, Human
acaaagagaaaaagaaaugca

SEQ ID NO: 2162719 - RNA, 20 nt, Human
acaaagagaaaaagaaaugc

SEQ ID NO: 2162720 - RNA, 14 nt, Human
acaaagagaaaaag

SEQ ID NO: 2162721 - RNA, 15 nt, Human
aauuuuauaaacaaa

SEQ ID NO: 2162722 - RNA, 14 nt, Human
aauuauaaaagcca

SEQ ID NO: 2162723 - RNA, 22 nt, Human
acacaaagagaaaaagaaaugc

SEQ ID NO: 2162724 - RNA, 22 nt, Human
acaaugugucuuucuuuuugga

SEQ ID NO: 2162725 - RNA, 17 nt, Human
acaauguuaacauuuuu

SEQ ID NO: 2162726 - RNA, 23 nt, Human
acaaugugucuuucuuuuuggac

SEQ ID NO: 2162727 - RNA, 15 nt, Human
acacagacucauauu

SEQ ID NO: 2162728 - RNA, 16 nt, Human
acacagacucauauua

SEQ ID NO: 2162729 - RNA, 14 nt, Human
acaccagacagaca

SEQ ID NO: 2162730 - RNA, 22 nt, Human
acagguagaauuaucuaauuua

SEQ ID NO: 2162731 - RNA, 14 nt, Human
acaggggccagaag

SEQ ID NO: 2162732 - RNA, 12 nt, Human
acaggggccaga

SEQ ID NO: 2162733 - RNA, 23 nt, Human
acaggggccagaagaugaacaga

SEQ ID NO: 2162734 - RNA, 17 nt, Human
acaggggccagaagaug

SEQ ID NO: 2162735 - RNA, 18 nt, Human
acagcccaaagaaggaaa

SEQ ID NO: 2162736 - RNA, 17 nt, Human
acagcccaaagaaggaa

SEQ ID NO: 2162737 - RNA, 16 nt, Human
acagcccaaagaagga

SEQ ID NO: 2162738 - RNA, 19 nt, Human
acagcauuuuccucugcuu

SEQ ID NO: 2162739 - RNA, 14 nt, Human
acagcauuuuccuc

SEQ ID NO: 2162740 - RNA, 18 nt, Human
acagcauuuuccucugcu

SEQ ID NO: 2162741 - RNA, 15 nt, Human
acagcauuuuccucu

SEQ ID NO: 2162742 - RNA, 23 nt, Human
acagaguacuuggcuguuagccc

SEQ ID NO: 2162743 - RNA, 22 nt, Human
acacugauuuccccuuuugcau

SEQ ID NO: 2162744 - RNA, 21 nt, Human
acacugaagcucuugaagaca

SEQ ID NO: 2162745 - RNA, 20 nt, Human
acagaagaaggcagcaggug

SEQ ID NO: 2162746 - RNA, 16 nt, Human
acagaagaaggcagca

SEQ ID NO: 2162747 - RNA, 14 nt, Human
acagaacacugucu

SEQ ID NO: 2162748 - RNA, 12 nt, Human
acagaacacugu

SEQ ID NO: 2162749 - RNA, 13 nt, Human
acacugucuugaa

SEQ ID NO: 2162750 - RNA, 21 nt, Human
acacugauuuccccuuuugca

SEQ ID NO: 2162751 - RNA, 22 nt, Human
auauccuucuagaucauacaca

SEQ ID NO: 2162752 - RNA, 14 nt, Human
auauuuagcuccaa

SEQ ID NO: 2162753 - RNA, 16 nt, Human
auauagcccagccagg

SEQ ID NO: 2162754 - RNA, 21 nt, Human
auacuuccuuaugcuucuuuc

SEQ ID NO: 2162755 - RNA, 19 nt, Human
auaacagauuuuuuuugga

SEQ ID NO: 2162756 - RNA, 14 nt, Human
auacuuaagcaaaa

SEQ ID NO: 2162757 - RNA, 16 nt, Human
auacuuaagcaaaagu

SEQ ID NO: 2162758 - RNA, 17 nt, Human
auaccugggauacugug

SEQ ID NO: 2162759 - RNA, 13 nt, Human
auaccuaagcaaa

SEQ ID NO: 2162760 - RNA, 20 nt, Human
auaccugggauacugugccc

SEQ ID NO: 2162761 - RNA, 16 nt, Human
aguuaacuauuuuauu

SEQ ID NO: 2162762 - RNA, 18 nt, Human
agugugaauaaagugcug

SEQ ID NO: 2162763 - RNA, 20 nt, Human
agugugaagcuuccuuggcu

SEQ ID NO: 2162764 - RNA, 20 nt, Human
agucauucucauugaauuau

SEQ ID NO: 2162765 - RNA, 22 nt, Human
aucuuaucaagaguugugacaa

SEQ ID NO: 2162766 - RNA, 15 nt, Human
aucugggcacugaag

SEQ ID NO: 2162767 - RNA, 16 nt, Human
augacuaauucuugca

SEQ ID NO: 2162768 - RNA, 17 nt, Human
augacuaauucuugcau

SEQ ID NO: 2162769 - RNA, 19 nt, Human
augacucaggacauccccc

SEQ ID NO: 2162770 - RNA, 23 nt, Human
augacucaagauucccaggaguu

SEQ ID NO: 2162771 - RNA, 22 nt, Human
augacucaagauucccaggagu

SEQ ID NO: 2162772 - RNA, 21 nt, Human
augacucaagauucccaggag

SEQ ID NO: 2162773 - RNA, 20 nt, Human
augacucaagauucccagga

SEQ ID NO: 2162774 - RNA, 19 nt, Human
augacucaagauucccagg

SEQ ID NO: 2162775 - RNA, 16 nt, Human
augacucaagauuccc

SEQ ID NO: 2162776 - RNA, 15 nt, Human
augacucaagauucc

SEQ ID NO: 2162777 - RNA, 22 nt, Human
aucccuaggucuugggagcucu

SEQ ID NO: 2162778 - RNA, 16 nt, Human
augugggucaaggaau

SEQ ID NO: 2162779 - RNA, 21 nt, Human
augugguuacacagugugaau

SEQ ID NO: 2162780 - RNA, 17 nt, Human
auguacaggaugcuuug

SEQ ID NO: 2162781 - RNA, 14 nt, Human
auguacaggaugcu

SEQ ID NO: 2162782 - RNA, 20 nt, Human
auguacaauaagaacuucua

SEQ ID NO: 2162783 - RNA, 20 nt, Human
auguacaggaugcuuugguu

SEQ ID NO: 2162784 - RNA, 14 nt, Human
augccuuuuauuuc

SEQ ID NO: 2162785 - RNA, 19 nt, Human
augaugugggucaaggaau

SEQ ID NO: 2162786 - RNA, 14 nt, Human
augcuucuuucaaa

SEQ ID NO: 2162787 - RNA, 21 nt, Human
auggaaaacgcucucuacucu

SEQ ID NO: 2162788 - RNA, 19 nt, Human
auggaaaacgcucucuacu

SEQ ID NO: 2162789 - RNA, 21 nt, Human
auggauggaaaacgcucucua

SEQ ID NO: 2162790 - RNA, 12 nt, Human
auggauggaaaa

SEQ ID NO: 2162791 - RNA, 18 nt, Human
augggaaggugggcgggc

SEQ ID NO: 2162792 - RNA, 21 nt, Human
augggaaggugggcgggcagg

SEQ ID NO: 2162793 - RNA, 13 nt, Human
agcccugacccug

SEQ ID NO: 2162794 - RNA, 21 nt, Human
agcccugacccuguggaagca

SEQ ID NO: 2162795 - RNA, 17 nt, Human
agcccugacccugugga

SEQ ID NO: 2162796 - RNA, 15 nt, Human
agcccugacccugug

SEQ ID NO: 2162797 - RNA, 16 nt, Human
agcccaaagaaggaaa

SEQ ID NO: 2162798 - RNA, 14 nt, Human
agcccaaagaagga

SEQ ID NO: 2162799 - RNA, 16 nt, Human
agccaaggcucuguuu

SEQ ID NO: 2162800 - RNA, 21 nt, Human
agccaaggcucuguuuaugcu

SEQ ID NO: 2162801 - RNA, 17 nt, Human
agcaugaucugaaaaau

SEQ ID NO: 2162802 - RNA, 14 nt, Human
agagaaagcgcaga

SEQ ID NO: 2162803 - RNA, 19 nt, Human
agacugaucaggaccucca

SEQ ID NO: 2162804 - RNA, 17 nt, Human
agacugaucaggaccuc

SEQ ID NO: 2162805 - RNA, 16 nt, Human
agacugaucaggaccu

SEQ ID NO: 2162806 - RNA, 14 nt, Human
agacugaucaggac

SEQ ID NO: 2162807 - RNA, 14 nt, Human
agacguguuugugu

SEQ ID NO: 2162808 - RNA, 13 nt, Human
agacuaaaugaaa

SEQ ID NO: 2162809 - RNA, 12 nt, Human
agacuaaaugaa

SEQ ID NO: 2162810 - RNA, 19 nt, Human
agaucuucaaacagaauaa

SEQ ID NO: 2162811 - RNA, 15 nt, Human
agauaguuacuauau

SEQ ID NO: 2162812 - RNA, 18 nt, Human
agaggauaauuagcaucu

SEQ ID NO: 2162813 - RNA, 18 nt, Human
agaggaugcugugaaauu

SEQ ID NO: 2162814 - RNA, 18 nt, Human
agaggggcagauggaaag

SEQ ID NO: 2162815 - RNA, 17 nt, Human
agauacuuugcuagccg

SEQ ID NO: 2162816 - RNA, 21 nt, Human
agggacgcuuugggagaaugu

SEQ ID NO: 2162817 - RNA, 19 nt, Human
aggggcagauggaaaggag

SEQ ID NO: 2162818 - RNA, 15 nt, Human
aggggcagauggaaa

SEQ ID NO: 2162819 - RNA, 19 nt, Human
agggcacaggccauggaug

SEQ ID NO: 2162820 - RNA, 17 nt, Human
agggcacaggccaugga

SEQ ID NO: 2162821 - RNA, 14 nt, Human
agggcacaggccau

SEQ ID NO: 2162822 - RNA, 16 nt, Human
agggcacaaagauggg

SEQ ID NO: 2162823 - RNA, 15 nt, Human
agcuuccuuggcuuu

SEQ ID NO: 2162824 - RNA, 14 nt, Human
agcuuccuuggcuu

SEQ ID NO: 2162825 - RNA, 19 nt, Human
agcuucucauccugcaggc

SEQ ID NO: 2162826 - RNA, 15 nt, Human
agcugagugaaaaau

SEQ ID NO: 2162827 - RNA, 16 nt, Human
agcuccucacucaccu

SEQ ID NO: 2162828 - RNA, 16 nt, Human
aggauuccucuuuucu

SEQ ID NO: 2162829 - RNA, 15 nt, Human
aggauuccucuuuuc

SEQ ID NO: 2162830 - RNA, 19 nt, Human
aggauuccucuuuucucug

SEQ ID NO: 2162831 - RNA, 21 nt, Human
aggagaacucauguuauuuuu

SEQ ID NO: 2162832 - RNA, 15 nt, Human
aggaccuccaagcca

SEQ ID NO: 2162833 - RNA, 21 nt, Human
aggaccuccaagccacugagc

SEQ ID NO: 2162834 - RNA, 14 nt, Human
aaaaagaaguaggg

SEQ ID NO: 2162835 - RNA, 19 nt, Human
aaaaacuuugccagccauu

SEQ ID NO: 2162836 - RNA, 16 nt, Human
aaaaagaugacccauu

SEQ ID NO: 2162837 - RNA, 14 nt, Human
aaaaagacagggcu

SEQ ID NO: 2162838 - RNA, 18 nt, Human
aaaaauugguucuuuauu

SEQ ID NO: 2162839 - RNA, 23 nt, Human
cacugauuuccccuuuugcauuc

SEQ ID NO: 2162840 - RNA, 15 nt, Human
cacugauuuccccuu

SEQ ID NO: 2162841 - RNA, 17 nt, Human
cacugagaucuguuuga

SEQ ID NO: 2162842 - RNA, 16 nt, Human
cacucugggcuccaga

SEQ ID NO: 2162843 - RNA, 17 nt, Human
cacucugggcuccagag

SEQ ID NO: 2162844 - RNA, 14 nt, Human
cacucugggcucca

SEQ ID NO: 2162845 - RNA, 15 nt, Human
cacucugggcuccag

SEQ ID NO: 2162846 - RNA, 16 nt, Human
cacugccucucacagc

SEQ ID NO: 2162847 - RNA, 17 nt, Human
cacugccucucacagcu

SEQ ID NO: 2162848 - RNA, 15 nt, Human
cacugccucucacag

SEQ ID NO: 2162849 - RNA, 14 nt, Human
cacugccucucaca

SEQ ID NO: 2162850 - RNA, 19 nt, Human
cacuggacuccggcccucc

SEQ ID NO: 2162851 - RNA, 16 nt, Human
cacuggacugaccugg

SEQ ID NO: 2162852 - RNA, 17 nt, Human
cacuggacugaccuggu

SEQ ID NO: 2162853 - RNA, 16 nt, Human
cacuggacuccggccc

SEQ ID NO: 2162854 - RNA, 15 nt, Human
cacuggacuccggcc

SEQ ID NO: 2162855 - RNA, 22 nt, Human
cacuugccgcgucgcccuccca

SEQ ID NO: 2162856 - RNA, 13 nt, Human
cacuucucuuccu

SEQ ID NO: 2162857 - RNA, 18 nt, Human
cacuucaggucaggaguu

SEQ ID NO: 2162858 - RNA, 17 nt, Human
cacuucacgcuuucagc

SEQ ID NO: 2162859 - RNA, 22 nt, Human
cacugugagcucccaggugcag

SEQ ID NO: 2162860 - RNA, 15 nt, Human
cacugugugcuauuu

SEQ ID NO: 2162861 - RNA, 14 nt, Human
cacuguccuccaag

SEQ ID NO: 2162862 - RNA, 17 nt, Human
cacuguccuccaagcca

SEQ ID NO: 2162863 - RNA, 18 nt, Human
cacuguccuccaagccag

SEQ ID NO: 2162864 - RNA, 14 nt, Human
cacugucuugaaga

SEQ ID NO: 2162865 - RNA, 17 nt, Human
cacugugaccuugagaa

SEQ ID NO: 2162866 - RNA, 17 nt, Human
cacugugagcucccagg

SEQ ID NO: 2162867 - RNA, 16 nt, Human
cacugugagcucccag

SEQ ID NO: 2162868 - RNA, 22 nt, Human
cacucagcucuuggcuccacug

SEQ ID NO: 2162869 - RNA, 16 nt, Human
cacucauccccucacu

SEQ ID NO: 2162870 - RNA, 16 nt, Human
cacuccugcuguaaau

SEQ ID NO: 2162871 - RNA, 12 nt, Human
cacuccugcugu

SEQ ID NO: 2162872 - RNA, 11 nt, Human
cacuccugcug

SEQ ID NO: 2162873 - RNA, 16 nt, Human
cacucgcauugacaca

SEQ ID NO: 2162874 - RNA, 13 nt, Human
cacuccugcugua

SEQ ID NO: 2162875 - RNA, 12 nt, Human
cacucaaaggcc

SEQ ID NO: 2162876 - RNA, 20 nt, Human
cacucaaaggccagaccugc

SEQ ID NO: 2162877 - RNA, 15 nt, Human
cacucaaaggccaga

SEQ ID NO: 2162878 - RNA, 23 nt, Human
cacucaaaggccagaccugcaga

SEQ ID NO: 2162879 - RNA, 22 nt, Human
cacucaaaggccagaccugcag

SEQ ID NO: 2162880 - RNA, 15 nt, Human
cacguuuuguuuugu

SEQ ID NO: 2162881 - RNA, 18 nt, Human
cacguuuuguuuugugcc

SEQ ID NO: 2162882 - RNA, 16 nt, Human
cacgccucccacuggg

SEQ ID NO: 2162883 - RNA, 15 nt, Human
cacgccucccacugg

SEQ ID NO: 2162884 - RNA, 14 nt, Human
cacgccucccacug

SEQ ID NO: 2162885 - RNA, 13 nt, Human
cacgccucccacu

SEQ ID NO: 2162886 - RNA, 18 nt, Human
cacgccucccacuggggu

SEQ ID NO: 2162887 - RNA, 17 nt, Human
cacgccucccacugggg

SEQ ID NO: 2162888 - RNA, 22 nt, Human
cacgccucccacugggguccag

SEQ ID NO: 2162889 - RNA, 23 nt, Human
cacgccuguaaucccagcaauuu

SEQ ID NO: 2162890 - RNA, 15 nt, Human
caccuuauauuuacg

SEQ ID NO: 2162891 - RNA, 10 nt, Human
caccuucacc

SEQ ID NO: 2162892 - RNA, 23 nt, Human
caccuucaguaacccccacugga

SEQ ID NO: 2162893 - RNA, 20 nt, Human
cacgcaggagcacacccagc

SEQ ID NO: 2162894 - RNA, 19 nt, Human
cacgcaggagcacacccag

SEQ ID NO: 2162895 - RNA, 12 nt, Human
cacgcaggagca

SEQ ID NO: 2162896 - RNA, 16 nt, Human
caccuguaaucccagc

SEQ ID NO: 2162897 - RNA, 18 nt, Human
caccuguaaucccagcac

SEQ ID NO: 2162898 - RNA, 22 nt, Human
caccucugcuacucaaguagca

SEQ ID NO: 2162899 - RNA, 13 nt, Human
caccugaacugaa

SEQ ID NO: 2162900 - RNA, 17 nt, Human
caccugaacugaacacc

SEQ ID NO: 2162901 - RNA, 19 nt, Human
caccugaacugaacaccau

SEQ ID NO: 2162902 - RNA, 15 nt, Human
caccugcuggaguga

SEQ ID NO: 2162903 - RNA, 20 nt, Human
caccugccacccugggccug

SEQ ID NO: 2162904 - RNA, 15 nt, Human
caccugccacccugg

SEQ ID NO: 2162905 - RNA, 20 nt, Human
caccucgaauuuuguuuucu

SEQ ID NO: 2162906 - RNA, 15 nt, Human
caccucgaauuuugu

SEQ ID NO: 2162907 - RNA, 23 nt, Human
caccuccuuucaagguaacugua

SEQ ID NO: 2162908 - RNA, 19 nt, Human
caccucucccugacccugu

SEQ ID NO: 2162909 - RNA, 14 nt, Human
caccguacugugga

SEQ ID NO: 2162910 - RNA, 14 nt, Human
caccgaaaaacuaa

SEQ ID NO: 2162911 - RNA, 20 nt, Human
cagagugcaagccccugcuc

SEQ ID NO: 2162912 - RNA, 18 nt, Human
cagagugcaagccccugc

SEQ ID NO: 2162913 - RNA, 23 nt, Human
cagagugcaagccccugcuccag

SEQ ID NO: 2162914 - RNA, 14 nt, Human
cagaugcaaugacu

SEQ ID NO: 2162915 - RNA, 19 nt, Human
cagagaagcucucgggcua

SEQ ID NO: 2162916 - RNA, 22 nt, Human
cagagauaguggggagacuucu

SEQ ID NO: 2162917 - RNA, 14 nt, Human
cagaggacugugau

SEQ ID NO: 2162918 - RNA, 21 nt, Human
cagaggacugugaugcccugc

SEQ ID NO: 2162919 - RNA, 19 nt, Human
cagaaacuguucccaccug

SEQ ID NO: 2162920 - RNA, 13 nt, Human
cagaaacaggacc

SEQ ID NO: 2162921 - RNA, 23 nt, Human
cacuuuuuuuuuuaaucuccacc

SEQ ID NO: 2162922 - RNA, 13 nt, Human
cagaaaaaccaga

SEQ ID NO: 2162923 - RNA, 23 nt, Human
cacuuugggaggccaaggagggc

SEQ ID NO: 2162924 - RNA, 20 nt, Human
cacuuuggauuucaucagac

SEQ ID NO: 2162925 - RNA, 22 nt, Human
cacuuucucaugauuuacagag

SEQ ID NO: 2162926 - RNA, 15 nt, Human
cagaagaugaacaga

SEQ ID NO: 2162927 - RNA, 18 nt, Human
cagaagaugaacagacug

SEQ ID NO: 2162928 - RNA, 14 nt, Human
cagaagaaggcagc

SEQ ID NO: 2162929 - RNA, 15 nt, Human
cagaagaacccuggc

SEQ ID NO: 2162930 - RNA, 15 nt, Human
cagaagaaggcagca

SEQ ID NO: 2162931 - RNA, 20 nt, Human
cagaagauagcuucacccca

SEQ ID NO: 2162932 - RNA, 17 nt, Human
cagaagcuaagcugcag

SEQ ID NO: 2162933 - RNA, 13 nt, Human
cagaaggagacag

SEQ ID NO: 2162934 - RNA, 18 nt, Human
cagaaggagacaggcaga

SEQ ID NO: 2162935 - RNA, 17 nt, Human
cagaaggagacaggcag

SEQ ID NO: 2162936 - RNA, 22 nt, Human
cagaaggagacaggcagagcug

SEQ ID NO: 2162937 - RNA, 21 nt, Human
cagaagggagcuagccagagg

SEQ ID NO: 2162938 - RNA, 20 nt, Human
cagaagggagcuagccagag

SEQ ID NO: 2162939 - RNA, 19 nt, Human
cagaagggagcuagccaga

SEQ ID NO: 2162940 - RNA, 22 nt, Human
cagacucaaaugcucagaccag

SEQ ID NO: 2162941 - RNA, 23 nt, Human
cagacucaaaugcucagaccagc

SEQ ID NO: 2162942 - RNA, 19 nt, Human
cagacucacaaccugaacc

SEQ ID NO: 2162943 - RNA, 20 nt, Human
cagaccuuuuaacuccucaa

SEQ ID NO: 2162944 - RNA, 14 nt, Human
cagacgcccagauu

SEQ ID NO: 2162945 - RNA, 20 nt, Human
cagaccugcagacgcccaga

SEQ ID NO: 2162946 - RNA, 21 nt, Human
cagacucacaaccugaaccua

SEQ ID NO: 2162947 - RNA, 20 nt, Human
cagacucacaaccugaaccu

SEQ ID NO: 2162948 - RNA, 16 nt, Human
cagacucauauuacug

SEQ ID NO: 2162949 - RNA, 16 nt, Human
cagagaaagcgcagau

SEQ ID NO: 2162950 - RNA, 15 nt, Human
cagagaaagcgcaga

SEQ ID NO: 2162951 - RNA, 13 nt, Human
cagagaaagcgca

SEQ ID NO: 2162952 - RNA, 17 nt, Human
cagagaaagcgcagaug

SEQ ID NO: 2162953 - RNA, 13 nt, Human
cagaccagcucuu

SEQ ID NO: 2162954 - RNA, 18 nt, Human
cagaauggggugcaugaa

SEQ ID NO: 2162955 - RNA, 19 nt, Human
cagccugguuuagccugga

SEQ ID NO: 2162956 - RNA, 18 nt, Human
cagcuauugauauaaaua

SEQ ID NO: 2162957 - RNA, 13 nt, Human
cagcuauuuuuau

SEQ ID NO: 2162958 - RNA, 13 nt, Human
cagcgaaugacaa

SEQ ID NO: 2162959 - RNA, 18 nt, Human
cagcuacaccuuucuccu

SEQ ID NO: 2162960 - RNA, 21 nt, Human
cagcuaccucaaccaaugcca

SEQ ID NO: 2162961 - RNA, 16 nt, Human
cagcccugacccugug

SEQ ID NO: 2162962 - RNA, 13 nt, Human
cagcccugacccu

SEQ ID NO: 2162963 - RNA, 19 nt, Human
cagcuggugguaucugagu

SEQ ID NO: 2162964 - RNA, 19 nt, Human
cagcugaaauaugcuggcu

SEQ ID NO: 2162965 - RNA, 22 nt, Human
cagcugaaauaugcuggcugga

SEQ ID NO: 2162966 - RNA, 21 nt, Human
cagcugaaauaugcuggcugg

SEQ ID NO: 2162967 - RNA, 16 nt, Human
cagcucuuggcuccac

SEQ ID NO: 2162968 - RNA, 17 nt, Human
cagcucuuggcuccacu

SEQ ID NO: 2162969 - RNA, 18 nt, Human
cagcucuuggcuccacug

SEQ ID NO: 2162970 - RNA, 12 nt, Human
cagcucuccccu

SEQ ID NO: 2162971 - RNA, 16 nt, Human
cagcucauaagagcca

SEQ ID NO: 2162972 - RNA, 14 nt, Human
cagcucauaagagc

SEQ ID NO: 2162973 - RNA, 14 nt, Human
cagcucagcuuccc

SEQ ID NO: 2162974 - RNA, 13 nt, Human
cagcucagcuucc

SEQ ID NO: 2162975 - RNA, 22 nt, Human
caggaagacccaacacauggga

SEQ ID NO: 2162976 - RNA, 19 nt, Human
caggaagacccaacacaug

SEQ ID NO: 2162977 - RNA, 18 nt, Human
cagcuucucauccugcag

SEQ ID NO: 2162978 - RNA, 20 nt, Human
cagcuucucauccugcaggc

SEQ ID NO: 2162979 - RNA, 19 nt, Human
cagcuucucauccugcagg

SEQ ID NO: 2162980 - RNA, 21 nt, Human
cagcuucucauccugcaggca

SEQ ID NO: 2162981 - RNA, 23 nt, Human
cagcuugaucaaaggcacacagc

SEQ ID NO: 2162982 - RNA, 19 nt, Human
cagcuugaucaaaggcaca

SEQ ID NO: 2162983 - RNA, 17 nt, Human
caggaaaaacccgucaa

SEQ ID NO: 2162984 - RNA, 22 nt, Human
cagcauugauauuugugcauuu

SEQ ID NO: 2162985 - RNA, 21 nt, Human
cagcauugauauuugugcauu

SEQ ID NO: 2162986 - RNA, 15 nt, Human
cagcauuuuccucug

SEQ ID NO: 2162987 - RNA, 13 nt, Human
cagcauuuuccuc

SEQ ID NO: 2162988 - RNA, 23 nt, Human
cagcauuuuccucugcuuugaaa

SEQ ID NO: 2162989 - RNA, 20 nt, Human
cagcauugauauuugugcau

SEQ ID NO: 2162990 - RNA, 19 nt, Human
cagcauugauauuugugca

SEQ ID NO: 2162991 - RNA, 18 nt, Human
cagcauugauauuugugc

SEQ ID NO: 2162992 - RNA, 17 nt, Human
cagcauugauauuugug

SEQ ID NO: 2162993 - RNA, 21 nt, Human
cagcaucuuaccuucauaugc

SEQ ID NO: 2162994 - RNA, 17 nt, Human
cagcccaaagaaggaaa

SEQ ID NO: 2162995 - RNA, 16 nt, Human
cagauggaaaggagcc

SEQ ID NO: 2162996 - RNA, 14 nt, Human
cagauggaaaggag

SEQ ID NO: 2162997 - RNA, 21 nt, Human
cagauuaugagacacaggaug

SEQ ID NO: 2162998 - RNA, 19 nt, Human
cagauuaugagacacagga

SEQ ID NO: 2162999 - RNA, 17 nt, Human
cagcaacagaaaaaugg

SEQ ID NO: 2163000 - RNA, 14 nt, Human
cagcaacagaaaaa

SEQ ID NO: 2163001 - RNA, 13 nt, Human
cagcaacagaaaa

SEQ ID NO: 2163002 - RNA, 20 nt, Human
cagauuuuuuuuggacuguu

SEQ ID NO: 2163003 - RNA, 18 nt, Human
cagcagacugaucaggac

SEQ ID NO: 2163004 - RNA, 11 nt, Human
cagcagacuga

SEQ ID NO: 2163005 - RNA, 15 nt, Human
cagcaagucaggguu

SEQ ID NO: 2163006 - RNA, 18 nt, Human
cagucuugacgaguguga

SEQ ID NO: 2163007 - RNA, 23 nt, Human
cagucuuauagcaagacuguuag

SEQ ID NO: 2163008 - RNA, 12 nt, Human
caguccuuccac

SEQ ID NO: 2163009 - RNA, 14 nt, Human
cagugaaagcauca

SEQ ID NO: 2163010 - RNA, 13 nt, Human
cagugaaagcauc

SEQ ID NO: 2163011 - RNA, 17 nt, Human
cagugagcagagaucac

SEQ ID NO: 2163012 - RNA, 13 nt, Human
cagugagccacuc

SEQ ID NO: 2163013 - RNA, 18 nt, Human
caguagcaguagaugcau

SEQ ID NO: 2163014 - RNA, 20 nt, Human
cagucauuuuucagaccuuu

SEQ ID NO: 2163015 - RNA, 21 nt, Human
cagucauuuuucagaccuuuu

SEQ ID NO: 2163016 - RNA, 16 nt, Human
cagggucagaaacagg

SEQ ID NO: 2163017 - RNA, 10 nt, Human
cagggucaga

SEQ ID NO: 2163018 - RNA, 19 nt, Human
cagggucagaaacaggacc

SEQ ID NO: 2163019 - RNA, 18 nt, Human
cagggucagaaacaggac

SEQ ID NO: 2163020 - RNA, 12 nt, Human
cagggucccugg

SEQ ID NO: 2163021 - RNA, 19 nt, Human
cagguagaacacaagguca

SEQ ID NO: 2163022 - RNA, 20 nt, Human
cagguagaauuaucuaauuu

SEQ ID NO: 2163023 - RNA, 21 nt, Human
cagguagaccugucuccuggc

SEQ ID NO: 2163024 - RNA, 19 nt, Human
cagguagaccugucuccug

SEQ ID NO: 2163025 - RNA, 18 nt, Human
cagguagaccugucuccu

SEQ ID NO: 2163026 - RNA, 22 nt, Human
cagguagaauuaucuaauuuau

SEQ ID NO: 2163027 - RNA, 23 nt, Human
cagguagaauuaucuaauuuaua

SEQ ID NO: 2163028 - RNA, 20 nt, Human
cagguaugaccuucuaggaa

SEQ ID NO: 2163029 - RNA, 20 nt, Human
caggucaggaguucgagacc

SEQ ID NO: 2163030 - RNA, 18 nt, Human
cagguauuuuauaauucu

SEQ ID NO: 2163031 - RNA, 19 nt, Human
cagguauuuuauaauucug

SEQ ID NO: 2163032 - RNA, 23 nt, Human
cagguauuuuauaauucugggaa

SEQ ID NO: 2163033 - RNA, 15 nt, Human
cagguggccaugccu

SEQ ID NO: 2163034 - RNA, 13 nt, Human
cagguggccaugc

SEQ ID NO: 2163035 - RNA, 19 nt, Human
cagguggccaugccucagc

SEQ ID NO: 2163036 - RNA, 16 nt, Human
caggugaaacccaguc

SEQ ID NO: 2163037 - RNA, 14 nt, Human
caggugaauuguuu

SEQ ID NO: 2163038 - RNA, 21 nt, Human
caggaguucgagaccagccug

SEQ ID NO: 2163039 - RNA, 23 nt, Human
caggaguucgagaccagccuggc

SEQ ID NO: 2163040 - RNA, 15 nt, Human
caggaguucugcuca

SEQ ID NO: 2163041 - RNA, 14 nt, Human
caggaguucugcuc

SEQ ID NO: 2163042 - RNA, 22 nt, Human
caggaguucugcucauucuaau

SEQ ID NO: 2163043 - RNA, 20 nt, Human
caggaguucugcucauucua

SEQ ID NO: 2163044 - RNA, 16 nt, Human
caggaguucugcucau

SEQ ID NO: 2163045 - RNA, 16 nt, Human
caggacgugggcuggg

SEQ ID NO: 2163046 - RNA, 17 nt, Human
caggacgugggcugggc

SEQ ID NO: 2163047 - RNA, 15 nt, Human
caggacuuaaaauga

SEQ ID NO: 2163048 - RNA, 20 nt, Human
caggagaacucauguuauuu

SEQ ID NO: 2163049 - RNA, 16 nt, Human
caggagacccacaggu

SEQ ID NO: 2163050 - RNA, 19 nt, Human
caggagcacacccagcccc

SEQ ID NO: 2163051 - RNA, 16 nt, Human
caggagcacacccagc

SEQ ID NO: 2163052 - RNA, 15 nt, Human
caggagcacacccag

SEQ ID NO: 2163053 - RNA, 21 nt, Human
caggagcacacccagccccca

SEQ ID NO: 2163054 - RNA, 14 nt, Human
caggaugguaauuc

SEQ ID NO: 2163055 - RNA, 15 nt, Human
caggaugguaauucu

SEQ ID NO: 2163056 - RNA, 22 nt, Human
caggauuccucuuuucucugcc

SEQ ID NO: 2163057 - RNA, 20 nt, Human
caggauuccucuuuucucug

SEQ ID NO: 2163058 - RNA, 17 nt, Human
caggauuccucuuuucu

SEQ ID NO: 2163059 - RNA, 16 nt, Human
caggauuccucuuuuc

SEQ ID NO: 2163060 - RNA, 15 nt, Human
caggaugcuuugguu

SEQ ID NO: 2163061 - RNA, 15 nt, Human
caggaugaagcauuu

SEQ ID NO: 2163062 - RNA, 14 nt, Human
caggaugaagcauu

SEQ ID NO: 2163063 - RNA, 22 nt, Human
caggcagcuuuuucucucccac

SEQ ID NO: 2163064 - RNA, 19 nt, Human
caggcagcuuuuucucucc

SEQ ID NO: 2163065 - RNA, 23 nt, Human
caggcagcucauaagagccacag

SEQ ID NO: 2163066 - RNA, 22 nt, Human
caggcagcucauaagagccaca

SEQ ID NO: 2163067 - RNA, 21 nt, Human
caggcagcucauaagagccac

SEQ ID NO: 2163068 - RNA, 22 nt, Human
caggcagggccaacccuucucc

SEQ ID NO: 2163069 - RNA, 20 nt, Human
caggcagggccaacccuucu

SEQ ID NO: 2163070 - RNA, 18 nt, Human
caggccccaggcagggcc

SEQ ID NO: 2163071 - RNA, 18 nt, Human
caggcuugccugcaggca

SEQ ID NO: 2163072 - RNA, 17 nt, Human
caggcuugccugcaggc

SEQ ID NO: 2163073 - RNA, 16 nt, Human
caggcuugccugcagg

SEQ ID NO: 2163074 - RNA, 15 nt, Human
caggcuugccugcag

SEQ ID NO: 2163075 - RNA, 15 nt, Human
cagggaaaagcagcu

SEQ ID NO: 2163076 - RNA, 13 nt, Human
caggcucucaaca

SEQ ID NO: 2163077 - RNA, 14 nt, Human
caggcucucaacag

SEQ ID NO: 2163078 - RNA, 22 nt, Human
caggggagggucagccagggcc

SEQ ID NO: 2163079 - RNA, 20 nt, Human
caggggagggucagccaggg

SEQ ID NO: 2163080 - RNA, 19 nt, Human
caggggagggucagccagg

SEQ ID NO: 2163081 - RNA, 20 nt, Human
caggggauuucaccacucaa

SEQ ID NO: 2163082 - RNA, 18 nt, Human
caggggagggucagccag

SEQ ID NO: 2163083 - RNA, 14 nt, Human
caggggccagaaga

SEQ ID NO: 2163084 - RNA, 18 nt, Human
cagggccaacccuucucc

SEQ ID NO: 2163085 - RNA, 13 nt, Human
cagggccaacccu

SEQ ID NO: 2163086 - RNA, 13 nt, Human
cagggccugcgag

SEQ ID NO: 2163087 - RNA, 22 nt, Human
cagggccgccagggagaccugg

SEQ ID NO: 2163088 - RNA, 16 nt, Human
cagggccgccagggag

SEQ ID NO: 2163089 - RNA, 14 nt, Human
cagggccgccaggg

SEQ ID NO: 2163090 - RNA, 20 nt, Human
cagggacugaaaaccucucc

SEQ ID NO: 2163091 - RNA, 21 nt, Human
cagggacugaaaaccucuccu

SEQ ID NO: 2163092 - RNA, 23 nt, Human
cagggacugaaaaccucuccuca

SEQ ID NO: 2163093 - RNA, 23 nt, Human
cagggacgaagaagagccacagu

SEQ ID NO: 2163094 - RNA, 22 nt, Human
cagggacgaagaagagccacag

SEQ ID NO: 2163095 - RNA, 19 nt, Human
cagggacgaagaagagcca

SEQ ID NO: 2163096 - RNA, 18 nt, Human
cagggauuguuucuguuu

SEQ ID NO: 2163097 - RNA, 18 nt, Human
cagggcacaggccaugga

SEQ ID NO: 2163098 - RNA, 15 nt, Human
cagggcacaggccau

SEQ ID NO: 2163099 - RNA, 15 nt, Human
cagggcaccugccac

SEQ ID NO: 2163100 - RNA, 17 nt, Human
cagggaaaagcagcucu

SEQ ID NO: 2163101 - RNA, 19 nt, Human
cagggaaaagcagcucucc

SEQ ID NO: 2163102 - RNA, 20 nt, Human
cagggaaaagcagcucuccc

SEQ ID NO: 2163103 - RNA, 21 nt, Human
cagggaaaagcagcucucccc

SEQ ID NO: 2163104 - RNA, 23 nt, Human
cagggacaaagaggccuuuaacc

SEQ ID NO: 2163105 - RNA, 18 nt, Human
cagggacaaagaggccuu

SEQ ID NO: 2163106 - RNA, 17 nt, Human
cagggacaaagaggccu

SEQ ID NO: 2163107 - RNA, 13 nt, Human
cagggacaaagag

SEQ ID NO: 2163108 - RNA, 22 nt, Human
caugugcuacaggggccagaag

SEQ ID NO: 2163109 - RNA, 20 nt, Human
caugugcuacaggggccaga

SEQ ID NO: 2163110 - RNA, 17 nt, Human
caugugcuacaggggcc

SEQ ID NO: 2163111 - RNA, 19 nt, Human
cauggugcuuguuaaugcu

SEQ ID NO: 2163112 - RNA, 20 nt, Human
cauguaaagcaguauuaaaa

SEQ ID NO: 2163113 - RNA, 19 nt, Human
cauguacccuaaggucauu

SEQ ID NO: 2163114 - RNA, 21 nt, Human
cauguaaagcaguauuaaaau

SEQ ID NO: 2163115 - RNA, 22 nt, Human
caugggaccuauaacugcccag

SEQ ID NO: 2163116 - RNA, 18 nt, Human
caugggaccuauaacugc

SEQ ID NO: 2163117 - RNA, 21 nt, Human
caugggcacaaagggcccaga

SEQ ID NO: 2163118 - RNA, 19 nt, Human
caugggcacaaagggccca

SEQ ID NO: 2163119 - RNA, 23 nt, Human
cauuuacaacccgguucacucuu

SEQ ID NO: 2163120 - RNA, 15 nt, Human
cauuuaccuuuuuga

SEQ ID NO: 2163121 - RNA, 14 nt, Human
cauuuacaacccgg

SEQ ID NO: 2163122 - RNA, 15 nt, Human
cauugaacagcaaag

SEQ ID NO: 2163123 - RNA, 14 nt, Human
cauugaacagcaaa

SEQ ID NO: 2163124 - RNA, 17 nt, Human
cauugaauuauaaaagc

SEQ ID NO: 2163125 - RNA, 14 nt, Human
cauugaaggcuuaa

SEQ ID NO: 2163126 - RNA, 13 nt, Human
cauugaaggcuua

SEQ ID NO: 2163127 - RNA, 19 nt, Human
cauucuuuuguaauuuaaa

SEQ ID NO: 2163128 - RNA, 19 nt, Human
cauugauauuugugcauuu

SEQ ID NO: 2163129 - RNA, 16 nt, Human
cauugauauuugugca

SEQ ID NO: 2163130 - RNA, 12 nt, Human
cauugaugcuga

SEQ ID NO: 2163131 - RNA, 23 nt, Human
cauugauauuugugcauuuucua

SEQ ID NO: 2163132 - RNA, 22 nt, Human
cauugauauuugugcauuuucu

SEQ ID NO: 2163133 - RNA, 20 nt, Human
cauuuuacccacacacagau

SEQ ID NO: 2163134 - RNA, 12 nt, Human
cauuuuuacugu

SEQ ID NO: 2163135 - RNA, 20 nt, Human
cauuuuccucugcuuugaaa

SEQ ID NO: 2163136 - RNA, 17 nt, Human
cauuuuccucugcuuug

SEQ ID NO: 2163137 - RNA, 15 nt, Human
cauuuuccucugcuu

SEQ ID NO: 2163138 - RNA, 14 nt, Human
cauuuuccucugcu

SEQ ID NO: 2163139 - RNA, 11 nt, Human
cauuuucaucu

SEQ ID NO: 2163140 - RNA, 12 nt, Human
cauucuuuugua

SEQ ID NO: 2163141 - RNA, 18 nt, Human
cauucuuuuguaauuuaa

SEQ ID NO: 2163142 - RNA, 16 nt, Human
cauucuuuuguaauuu

SEQ ID NO: 2163143 - RNA, 15 nt, Human
cauucuuuuguaauu

SEQ ID NO: 2163144 - RNA, 14 nt, Human
cauucuuuuguaau

SEQ ID NO: 2163145 - RNA, 13 nt, Human
cauucuuaaaaaa

SEQ ID NO: 2163146 - RNA, 22 nt, Human
cauuacagggcacaggccaugg

SEQ ID NO: 2163147 - RNA, 21 nt, Human
cauuacagggcacaggccaug

SEQ ID NO: 2163148 - RNA, 16 nt, Human
cauuaagccuuccaca

SEQ ID NO: 2163149 - RNA, 20 nt, Human
cauucccuucgacagcauuu

SEQ ID NO: 2163150 - RNA, 18 nt, Human
cauucaguauauaaaaua

SEQ ID NO: 2163151 - RNA, 16 nt, Human
cauucaggagcuuccu

SEQ ID NO: 2163152 - RNA, 17 nt, Human
caucaugaccagcaaau

SEQ ID NO: 2163153 - RNA, 12 nt, Human
caucauucccuu

SEQ ID NO: 2163154 - RNA, 14 nt, Human
cauauuugcacuaa

SEQ ID NO: 2163155 - RNA, 13 nt, Human
cauauuugcacua

SEQ ID NO: 2163156 - RNA, 12 nt, Human
cauauuugcacu

SEQ ID NO: 2163157 - RNA, 13 nt, Human
cauauuguaaaac

SEQ ID NO: 2163158 - RNA, 16 nt, Human
cauauuguaaaacagg

SEQ ID NO: 2163159 - RNA, 17 nt, Human
cauauuguaaaacaggu

SEQ ID NO: 2163160 - RNA, 19 nt, Human
cauauuguaaaacagguag

SEQ ID NO: 2163161 - RNA, 22 nt, Human
cauauauuggguuccauucuca

SEQ ID NO: 2163162 - RNA, 18 nt, Human
cauauauuggguuccauu

SEQ ID NO: 2163163 - RNA, 19 nt, Human
cagugcuugauugcgugga

SEQ ID NO: 2163164 - RNA, 14 nt, Human
caucuuugugaagg

SEQ ID NO: 2163165 - RNA, 13 nt, Human
caucuuugugaag

SEQ ID NO: 2163166 - RNA, 14 nt, Human
caucuuucuuugga

SEQ ID NO: 2163167 - RNA, 22 nt, Human
caucuuugugaaggccucgcag

SEQ ID NO: 2163168 - RNA, 22 nt, Human
caugaaaaugcaacaacaugua

SEQ ID NO: 2163169 - RNA, 15 nt, Human
caugaaaaugcaaca

SEQ ID NO: 2163170 - RNA, 13 nt, Human
caugaaaaugcaa

SEQ ID NO: 2163171 - RNA, 21 nt, Human
caugaagaggaugcugugaaa

SEQ ID NO: 2163172 - RNA, 18 nt, Human
caugaagaggaugcugug

SEQ ID NO: 2163173 - RNA, 21 nt, Human
caugaugacaacuacagaaaa

SEQ ID NO: 2163174 - RNA, 15 nt, Human
caugcacucagcucu

SEQ ID NO: 2163175 - RNA, 16 nt, Human
caugcacucagcucuu

SEQ ID NO: 2163176 - RNA, 20 nt, Human
caugauccaagcaagacuga

SEQ ID NO: 2163177 - RNA, 14 nt, Human
caucucucuuuaau

SEQ ID NO: 2163178 - RNA, 23 nt, Human
cccaaucccagcuaccucaacca

SEQ ID NO: 2163179 - RNA, 14 nt, Human
ccauuuguuaucug

SEQ ID NO: 2163180 - RNA, 17 nt, Human
ccauucuccauuuguua

SEQ ID NO: 2163181 - RNA, 13 nt, Human
ccauucuccauuu

SEQ ID NO: 2163182 - RNA, 14 nt, Human
ccauauuguaaaac

SEQ ID NO: 2163183 - RNA, 18 nt, Human
ccauauuguaaaacaggu

SEQ ID NO: 2163184 - RNA, 17 nt, Human
ccauguugugccucccu

SEQ ID NO: 2163185 - RNA, 22 nt, Human
ccauguugugccucccugguga

SEQ ID NO: 2163186 - RNA, 20 nt, Human
ccauguugugccucccuggu

SEQ ID NO: 2163187 - RNA, 21 nt, Human
ccauguuuguggcuauuaaaa

SEQ ID NO: 2163188 - RNA, 18 nt, Human
ccaggcgcaggggcucac

SEQ ID NO: 2163189 - RNA, 15 nt, Human
ccaggccagcugccu

SEQ ID NO: 2163190 - RNA, 20 nt, Human
ccaguaaaaaaaaaaaaugg

SEQ ID NO: 2163191 - RNA, 18 nt, Human
ccagggagaccuggacac

SEQ ID NO: 2163192 - RNA, 22 nt, Human
ccagggagaccuggacacaggc

SEQ ID NO: 2163193 - RNA, 21 nt, Human
ccagggagaccuggacacagg

SEQ ID NO: 2163194 - RNA, 23 nt, Human
ccagggagaccuggacacaggcc

SEQ ID NO: 2163195 - RNA, 21 nt, Human
ccagggagcauuuuccuccau

SEQ ID NO: 2163196 - RNA, 20 nt, Human
ccagggagcauuuuccucca

SEQ ID NO: 2163197 - RNA, 19 nt, Human
ccagggagcauuuuccucc

SEQ ID NO: 2163198 - RNA, 21 nt, Human
ccagcagucaauuaacaauaa

SEQ ID NO: 2163199 - RNA, 17 nt, Human
ccagccaggccccaggc

SEQ ID NO: 2163200 - RNA, 21 nt, Human
ccagagcuacccgcagaguuc

SEQ ID NO: 2163201 - RNA, 20 nt, Human
ccagagcuacccgcagaguu

SEQ ID NO: 2163202 - RNA, 18 nt, Human
ccagaggcagcuucuuug

SEQ ID NO: 2163203 - RNA, 22 nt, Human
ccagaggcaccucaagaagaag

SEQ ID NO: 2163204 - RNA, 19 nt, Human
ccagaggcagcuucuuugc

SEQ ID NO: 2163205 - RNA, 22 nt, Human
ccagaggacugugaugcccugc

SEQ ID NO: 2163206 - RNA, 20 nt, Human
ccagaggacugugaugcccu

SEQ ID NO: 2163207 - RNA, 14 nt, Human
ccacacuggacucc

SEQ ID NO: 2163208 - RNA, 13 nt, Human
ccacacuggacuc

SEQ ID NO: 2163209 - RNA, 19 nt, Human
ccacauacaacacaaagag

SEQ ID NO: 2163210 - RNA, 20 nt, Human
ccacauacaacacaaagaga

SEQ ID NO: 2163211 - RNA, 16 nt, Human
ccacucaaaggccaga

SEQ ID NO: 2163212 - RNA, 19 nt, Human
ccacucaaaggccagaccu

SEQ ID NO: 2163213 - RNA, 18 nt, Human
ccacuggacugaccuggu

SEQ ID NO: 2163214 - RNA, 17 nt, Human
ccuguuuuuuuucuuuu

SEQ ID NO: 2163215 - RNA, 14 nt, Human
ccuguuuuuuuucu

SEQ ID NO: 2163216 - RNA, 14 nt, Human
ccuucuaggaagcu

SEQ ID NO: 2163217 - RNA, 16 nt, Human
ccuucgacagcauuuu

SEQ ID NO: 2163218 - RNA, 17 nt, Human
ccuugggcccucugguu

SEQ ID NO: 2163219 - RNA, 21 nt, Human
ccuuggcuuuuacugaagccu

SEQ ID NO: 2163220 - RNA, 18 nt, Human
ccuuccuuguagccuuuu

SEQ ID NO: 2163221 - RNA, 17 nt, Human
ccuuccuuguagccuuu

SEQ ID NO: 2163222 - RNA, 15 nt, Human
ccuucgacagcauuu

SEQ ID NO: 2163223 - RNA, 13 nt, Human
cgagaccagccug

SEQ ID NO: 2163224 - RNA, 14 nt, Human
cgagaccagccugg

SEQ ID NO: 2163225 - RNA, 15 nt, Human
cgagaccagccuggc

SEQ ID NO: 2163226 - RNA, 16 nt, Human
cgagaccagccuggcc

SEQ ID NO: 2163227 - RNA, 13 nt, Human
cgaaaaccaggcc

SEQ ID NO: 2163228 - RNA, 22 nt, Human
cgaaaaccaggccuuaucucca

SEQ ID NO: 2163229 - RNA, 18 nt, Human
ccuuuuauuucuucacca

SEQ ID NO: 2163230 - RNA, 13 nt, Human
ccuuuuauuucuu

SEQ ID NO: 2163231 - RNA, 15 nt, Human
cgaagaagagccaca

SEQ ID NO: 2163232 - RNA, 17 nt, Human
cgaagaagagccacagu

SEQ ID NO: 2163233 - RNA, 16 nt, Human
cgaagaagagccacag

SEQ ID NO: 2163234 - RNA, 18 nt, Human
cgaagaagagccacagug

SEQ ID NO: 2163235 - RNA, 14 nt, Human
cgaauacaaaauug

SEQ ID NO: 2163236 - RNA, 15 nt, Human
cgauucauauugaau

SEQ ID NO: 2163237 - RNA, 16 nt, Human
cgcaaaccacacugga

SEQ ID NO: 2163238 - RNA, 15 nt, Human
cgcaaaccacacugg

SEQ ID NO: 2163239 - RNA, 18 nt, Human
cgcaaaccacacuggacu

SEQ ID NO: 2163240 - RNA, 16 nt, Human
cgccagggagaccugg

SEQ ID NO: 2163241 - RNA, 19 nt, Human
ccugcacucuuuaagggag

SEQ ID NO: 2163242 - RNA, 12 nt, Human
ccugcaggccag

SEQ ID NO: 2163243 - RNA, 18 nt, Human
ccugcaggccaggccagc

SEQ ID NO: 2163244 - RNA, 16 nt, Human
ccugcaggccaggcca

SEQ ID NO: 2163245 - RNA, 19 nt, Human
ccugcgagggcagcgggag

SEQ ID NO: 2163246 - RNA, 20 nt, Human
ccugcgcccaguccuuccac

SEQ ID NO: 2163247 - RNA, 18 nt, Human
ccugcgcccaguccuucc

SEQ ID NO: 2163248 - RNA, 13 nt, Human
ccugcgagggcag

SEQ ID NO: 2163249 - RNA, 22 nt, Human
ccugcgcccaguccuuccaccu

SEQ ID NO: 2163250 - RNA, 19 nt, Human
ccugguacucaagcccgcg

SEQ ID NO: 2163251 - RNA, 16 nt, Human
ccugguacucaagccc

SEQ ID NO: 2163252 - RNA, 15 nt, Human
ccugguacucaagcc

SEQ ID NO: 2163253 - RNA, 21 nt, Human
ccuggugagagggccgggcag

SEQ ID NO: 2163254 - RNA, 17 nt, Human
ccugguccacagggcac

SEQ ID NO: 2163255 - RNA, 14 nt, Human
ccuggcagcucagc

SEQ ID NO: 2163256 - RNA, 20 nt, Human
ccuggacacaggccugcucu

SEQ ID NO: 2163257 - RNA, 16 nt, Human
ccuggacacaggccug

SEQ ID NO: 2163258 - RNA, 13 nt, Human
ccuggacacaggc

SEQ ID NO: 2163259 - RNA, 16 nt, Human
cccgcccccugcccuc

SEQ ID NO: 2163260 - RNA, 17 nt, Human
cccgcccccugcccucc

SEQ ID NO: 2163261 - RNA, 18 nt, Human
cccgccgccugguacuca

SEQ ID NO: 2163262 - RNA, 15 nt, Human
cccuaguaaaaauac

SEQ ID NO: 2163263 - RNA, 18 nt, Human
cccucugguuugccggug

SEQ ID NO: 2163264 - RNA, 24 nt, Human
cccugggaggcgggcgcacugccu

SEQ ID NO: 2163265 - RNA, 13 nt, Human
cccacacacagau

SEQ ID NO: 2163266 - RNA, 15 nt, Human
cccacaaaggcaaag

SEQ ID NO: 2163267 - RNA, 20 nt, Human
ccucguucucccugggaggc

SEQ ID NO: 2163268 - RNA, 18 nt, Human
ccucguucucccugggag

SEQ ID NO: 2163269 - RNA, 17 nt, Human
ccucguucucccuggga

SEQ ID NO: 2163270 - RNA, 16 nt, Human
ccucguucucccuggg

SEQ ID NO: 2163271 - RNA, 15 nt, Human
ccucguucucccugg

SEQ ID NO: 2163272 - RNA, 15 nt, Human
ccucccugccucagg

SEQ ID NO: 2163273 - RNA, 22 nt, Human
ccgccugguacucaagcccgcg

SEQ ID NO: 2163274 - RNA, 22 nt, Human
ccgcgugaucaaagccacacuc

SEQ ID NO: 2163275 - RNA, 19 nt, Human
ccgcgucgcccucccaggc

SEQ ID NO: 2163276 - RNA, 17 nt, Human
ccgcgucgcccucccag

SEQ ID NO: 2163277 - RNA, 20 nt, Human
ccgcggggacauugggaagg

SEQ ID NO: 2163278 - RNA, 16 nt, Human
ccgcaaaccacacugg

SEQ ID NO: 2163279 - RNA, 15 nt, Human
ccgcaaaccacacug

SEQ ID NO: 2163280 - RNA, 21 nt, Human
ccgcaaaccacacuggacucc

SEQ ID NO: 2163281 - RNA, 16 nt, Human
ccuauaacugcccagc

SEQ ID NO: 2163282 - RNA, 18 nt, Human
ccuaaaagcacacucauc

SEQ ID NO: 2163283 - RNA, 17 nt, Human
ccuaaaagcacacucau

SEQ ID NO: 2163284 - RNA, 23 nt, Human
cuguuuuaauuuauacuggcaug

SEQ ID NO: 2163285 - RNA, 20 nt, Human
cuuccacuuuuuuuuguaug

SEQ ID NO: 2163286 - RNA, 21 nt, Human
cuuccacuuuuuuuuguaugu

SEQ ID NO: 2163287 - RNA, 22 nt, Human
cuuccccaccccaguuuuuguu

SEQ ID NO: 2163288 - RNA, 18 nt, Human
cuuccccaacacgcagga

SEQ ID NO: 2163289 - RNA, 13 nt, Human
cuucccauucucc

SEQ ID NO: 2163290 - RNA, 14 nt, Human
cuucccauucucca

SEQ ID NO: 2163291 - RNA, 20 nt, Human
cuuccuuguagccuuuugac

SEQ ID NO: 2163292 - RNA, 17 nt, Human
cuuccuuguagccuuuu

SEQ ID NO: 2163293 - RNA, 13 nt, Human
cuuccuuggcuuu

SEQ ID NO: 2163294 - RNA, 21 nt, Human
cuuccuuguagccuuuugacu

SEQ ID NO: 2163295 - RNA, 15 nt, Human
cuuccuuaugcuucu

SEQ ID NO: 2163296 - RNA, 17 nt, Human
cuuccuuaugcuucuuu

SEQ ID NO: 2163297 - RNA, 17 nt, Human
cuucucauccugcaggc

SEQ ID NO: 2163298 - RNA, 16 nt, Human
cuucucauccugcagg

SEQ ID NO: 2163299 - RNA, 15 nt, Human
cuucucauccugcag

SEQ ID NO: 2163300 - RNA, 20 nt, Human
cuucaguaacccccacugga

SEQ ID NO: 2163301 - RNA, 22 nt, Human
cuucaguaacccccacuggacu

SEQ ID NO: 2163302 - RNA, 18 nt, Human
cuucaggucaggaguucg

SEQ ID NO: 2163303 - RNA, 13 nt, Human
cuucacacacaga

SEQ ID NO: 2163304 - RNA, 14 nt, Human
cugucuguguuuuu

SEQ ID NO: 2163305 - RNA, 14 nt, Human
cugucugccagggc

SEQ ID NO: 2163306 - RNA, 22 nt, Human
cugugauugggcguagaagugg

SEQ ID NO: 2163307 - RNA, 15 nt, Human
cugugcacgguggac

SEQ ID NO: 2163308 - RNA, 14 nt, Human
cugugaaauuccca

SEQ ID NO: 2163309 - RNA, 22 nt, Human
cugugaaauucccaacaaacau

SEQ ID NO: 2163310 - RNA, 20 nt, Human
cugugagcucccaggugcag

SEQ ID NO: 2163311 - RNA, 16 nt, Human
cugugauugugccuac

SEQ ID NO: 2163312 - RNA, 14 nt, Human
cugugaugcccugc

SEQ ID NO: 2163313 - RNA, 20 nt, Human
cugugucuuugguuugugcu

SEQ ID NO: 2163314 - RNA, 11 nt, Human
cugugggaaau

SEQ ID NO: 2163315 - RNA, 13 nt, Human
cugugggaaauua

SEQ ID NO: 2163316 - RNA, 20 nt, Human
cugggguggggauagggagc

SEQ ID NO: 2163317 - RNA, 23 nt, Human
cugcucauucuaaugauggccca

SEQ ID NO: 2163318 - RNA, 22 nt, Human
cugcucauucuaaugauggccc

SEQ ID NO: 2163319 - RNA, 14 nt, Human
cugggauguuucug

SEQ ID NO: 2163320 - RNA, 19 nt, Human
cugggauguuucugucaca

SEQ ID NO: 2163321 - RNA, 20 nt, Human
cugggccuggcagcucagcu

SEQ ID NO: 2163322 - RNA, 18 nt, Human
cugggccuggcagcucag

SEQ ID NO: 2163323 - RNA, 16 nt, Human
cugguuaggauggcag

SEQ ID NO: 2163324 - RNA, 19 nt, Human
cugguuaggauggcaggac

SEQ ID NO: 2163325 - RNA, 18 nt, Human
cugguuaggauggcagga

SEQ ID NO: 2163326 - RNA, 17 nt, Human
cuguaaucccagcacuu

SEQ ID NO: 2163327 - RNA, 18 nt, Human
cuguaaucccagcaauuu

SEQ ID NO: 2163328 - RNA, 20 nt, Human
cuguauuuugaaaaugcuuu

SEQ ID NO: 2163329 - RNA, 21 nt, Human
cuuuauucaauaaaaaaaaga

SEQ ID NO: 2163330 - RNA, 21 nt, Human
cuuuauugaaaaaauaaaaaa

SEQ ID NO: 2163331 - RNA, 12 nt, Human
cuuuauuuccaa

SEQ ID NO: 2163332 - RNA, 17 nt, Human
cuuucagugaaagcauc

SEQ ID NO: 2163333 - RNA, 15 nt, Human
cuuucagugaaagca

SEQ ID NO: 2163334 - RNA, 18 nt, Human
cuuucauaaucuuugcuu

SEQ ID NO: 2163335 - RNA, 17 nt, Human
cuuucauaaucuuugcu

SEQ ID NO: 2163336 - RNA, 12 nt, Human
cuuguaaauaaa

SEQ ID NO: 2163337 - RNA, 19 nt, Human
cuuguaaauaaagcccugg

SEQ ID NO: 2163338 - RNA, 17 nt, Human
cuuguaaauaaagcccu

SEQ ID NO: 2163339 - RNA, 16 nt, Human
cuuguaaauaaagccc

SEQ ID NO: 2163340 - RNA, 15 nt, Human
cuuguaaauaaagcc

SEQ ID NO: 2163341 - RNA, 15 nt, Human
cuuguggcuuugcaa

SEQ ID NO: 2163342 - RNA, 19 nt, Human
cuuuagaaagguuuugagc

SEQ ID NO: 2163343 - RNA, 20 nt, Human
cuuuagaaagguuuugagca

SEQ ID NO: 2163344 - RNA, 15 nt, Human
cuuggaggugucugu

SEQ ID NO: 2163345 - RNA, 20 nt, Human
cuuggcuuuuacugaagccu

SEQ ID NO: 2163346 - RNA, 21 nt, Human
cuuggaaacuggaugagguca

SEQ ID NO: 2163347 - RNA, 22 nt, Human
cuuggaaccguaggacccaagc

SEQ ID NO: 2163348 - RNA, 12 nt, Human
cuuuggcuuuuu

SEQ ID NO: 2163349 - RNA, 20 nt, Human
cuuuguucugcuguucucua

SEQ ID NO: 2163350 - RNA, 14 nt, Human
cuuuguucugcugu

SEQ ID NO: 2163351 - RNA, 17 nt, Human
cuuuucauauuugcacu

SEQ ID NO: 2163352 - RNA, 18 nt, Human
cuuuucauauuugcacua

SEQ ID NO: 2163353 - RNA, 12 nt, Human
cuuuucucugcc

SEQ ID NO: 2163354 - RNA, 16 nt, Human
cuuuuuucuuuuuccu

SEQ ID NO: 2163355 - RNA, 18 nt, Human
cuuuugacuuucauugga

SEQ ID NO: 2163356 - RNA, 12 nt, Human
gaaacagaggcu

SEQ ID NO: 2163357 - RNA, 20 nt, Human
gaaucuauuuaucuucauuu

SEQ ID NO: 2163358 - RNA, 16 nt, Human
gaaucuauuuaaguaa

SEQ ID NO: 2163359 - RNA, 15 nt, Human
gaaucuauuuaagua

SEQ ID NO: 2163360 - RNA, 13 nt, Human
gaaucuauuuaag

SEQ ID NO: 2163361 - RNA, 19 nt, Human
gaaucuauuuaucuucauu

SEQ ID NO: 2163362 - RNA, 18 nt, Human
gaaucuauuuaucuucau

SEQ ID NO: 2163363 - RNA, 18 nt, Human
gaagcuuuaccagcugaa

SEQ ID NO: 2163364 - RNA, 12 nt, Human
gaagcuuuacca

SEQ ID NO: 2163365 - RNA, 18 nt, Human
gaaggaaaaggcagggag

SEQ ID NO: 2163366 - RNA, 15 nt, Human
gaagccaucuuucuu

SEQ ID NO: 2163367 - RNA, 15 nt, Human
gaaggagacaggcag

SEQ ID NO: 2163368 - RNA, 18 nt, Human
gaaggagacaggcagagc

SEQ ID NO: 2163369 - RNA, 16 nt, Human
gaaggagacaggcaga

SEQ ID NO: 2163370 - RNA, 20 nt, Human
gaaggaaaaggcagggagcg

SEQ ID NO: 2163371 - RNA, 17 nt, Human
gaaggcagcagguggca

SEQ ID NO: 2163372 - RNA, 15 nt, Human
gaaauauacacacag

SEQ ID NO: 2163373 - RNA, 17 nt, Human
gaaauauacacacagca

SEQ ID NO: 2163374 - RNA, 15 nt, Human
gaagaagagccacag

SEQ ID NO: 2163375 - RNA, 14 nt, Human
gaagaagagccaca

SEQ ID NO: 2163376 - RNA, 23 nt, Human
gaagaaaauggaaccaggcuugg

SEQ ID NO: 2163377 - RNA, 22 nt, Human
gaacuagcauauaauucuauau

SEQ ID NO: 2163378 - RNA, 18 nt, Human
gaaccuucuggccuccca

SEQ ID NO: 2163379 - RNA, 21 nt, Human
gaaccuucuggccucccacag

SEQ ID NO: 2163380 - RNA, 14 nt, Human
gaacagaagaaaau

SEQ ID NO: 2163381 - RNA, 13 nt, Human
gaacagaagaaaa

SEQ ID NO: 2163382 - RNA, 15 nt, Human
gaaccguaggaccca

SEQ ID NO: 2163383 - RNA, 21 nt, Human
cucugugucugaguggcuuca

SEQ ID NO: 2163384 - RNA, 20 nt, Human
cucugugucugaguggcuuc

SEQ ID NO: 2163385 - RNA, 14 nt, Human
cucugugucugagu

SEQ ID NO: 2163386 - RNA, 15 nt, Human
cucuguuuaugcuuu

SEQ ID NO: 2163387 - RNA, 13 nt, Human
cucuguuuaugcu

SEQ ID NO: 2163388 - RNA, 15 nt, Human
cucuucucagccacu

SEQ ID NO: 2163389 - RNA, 14 nt, Human
cucuucucagccac

SEQ ID NO: 2163390 - RNA, 13 nt, Human
cucugaggaagcu

SEQ ID NO: 2163391 - RNA, 19 nt, Human
cucugaauuugagauacaa

SEQ ID NO: 2163392 - RNA, 23 nt, Human
cugaaagugaaaguccagaaacu

SEQ ID NO: 2163393 - RNA, 19 nt, Human
cugaaagugaaaguccaga

SEQ ID NO: 2163394 - RNA, 16 nt, Human
cugaaccccucccucc

SEQ ID NO: 2163395 - RNA, 19 nt, Human
cugaaguucagccacccug

SEQ ID NO: 2163396 - RNA, 17 nt, Human
cugcggagcaagaggag

SEQ ID NO: 2163397 - RNA, 16 nt, Human
cugcggagcaagagga

SEQ ID NO: 2163398 - RNA, 18 nt, Human
cugccuuuggcagaguuc

SEQ ID NO: 2163399 - RNA, 20 nt, Human
cugcgugcagggacaaagag

SEQ ID NO: 2163400 - RNA, 18 nt, Human
cugccuggacuagaggga

SEQ ID NO: 2163401 - RNA, 22 nt, Human
cugcccagcggacaguggcagg

SEQ ID NO: 2163402 - RNA, 18 nt, Human
cugauuuccccuuuugca

SEQ ID NO: 2163403 - RNA, 15 nt, Human
cugauuuccccuuuu

SEQ ID NO: 2163404 - RNA, 13 nt, Human
cugauuuccccuu

SEQ ID NO: 2163405 - RNA, 19 nt, Human
cugauuuccccuuuugcau

SEQ ID NO: 2163406 - RNA, 16 nt, Human
cugauuuagauaugca

SEQ ID NO: 2163407 - RNA, 20 nt, Human
cugcacucuagccuggguga

SEQ ID NO: 2163408 - RNA, 20 nt, Human
cugaguugacuugacagaac

SEQ ID NO: 2163409 - RNA, 21 nt, Human
cugaguugguguugacaugug

SEQ ID NO: 2163410 - RNA, 20 nt, Human
cugaguuguugagucuguuu

SEQ ID NO: 2163411 - RNA, 14 nt, Human
cugagugaaaaauc

SEQ ID NO: 2163412 - RNA, 13 nt, Human
cugagugaaaaau

SEQ ID NO: 2163413 - RNA, 21 nt, Human
cugagugaaaaaucuguggaa

SEQ ID NO: 2163414 - RNA, 14 nt, Human
cugauaagcuucaa

SEQ ID NO: 2163415 - RNA, 18 nt, Human
cugaucaggaccuccaag

SEQ ID NO: 2163416 - RNA, 20 nt, Human
cugagggagcuccaacucag

SEQ ID NO: 2163417 - RNA, 14 nt, Human
cuccuucccuuccu

SEQ ID NO: 2163418 - RNA, 14 nt, Human
cuccugcuguaaau

SEQ ID NO: 2163419 - RNA, 23 nt, Human
cuccugcuguaaauuuggcuucu

SEQ ID NO: 2163420 - RNA, 12 nt, Human
cucgcaggaaga

SEQ ID NO: 2163421 - RNA, 17 nt, Human
cucgauucauauugaau

SEQ ID NO: 2163422 - RNA, 13 nt, Human
cucgcaggaagac

SEQ ID NO: 2163423 - RNA, 15 nt, Human
cuccucaguucuugc

SEQ ID NO: 2163424 - RNA, 19 nt, Human
cucccuggugagagggccg

SEQ ID NO: 2163425 - RNA, 18 nt, Human
cucccugccucaggccuc

SEQ ID NO: 2163426 - RNA, 20 nt, Human
cuccacaccauucaggucuu

SEQ ID NO: 2163427 - RNA, 18 nt, Human
cuccacaccauucagguc

SEQ ID NO: 2163428 - RNA, 18 nt, Human
cuccaauuuuuuuuuccu

SEQ ID NO: 2163429 - RNA, 19 nt, Human
cuccaauuuuuuuuuccuu

SEQ ID NO: 2163430 - RNA, 20 nt, Human
cucaagaagaagaggggcau

SEQ ID NO: 2163431 - RNA, 19 nt, Human
cucaagaagaagaggggca

SEQ ID NO: 2163432 - RNA, 13 nt, Human
cucacagcugagu

SEQ ID NO: 2163433 - RNA, 15 nt, Human
cucacagcugaguug

SEQ ID NO: 2163434 - RNA, 23 nt, Human
cucacaccaggcuugccugcagg

SEQ ID NO: 2163435 - RNA, 14 nt, Human
cuauuuaucuucau

SEQ ID NO: 2163436 - RNA, 17 nt, Human
cuauuccuguaaugaaa

SEQ ID NO: 2163437 - RNA, 16 nt, Human
cucaaaugcucagacc

SEQ ID NO: 2163438 - RNA, 19 nt, Human
cucaaaugcucagaccagc

SEQ ID NO: 2163439 - RNA, 13 nt, Human
cucagagugcaag

SEQ ID NO: 2163440 - RNA, 14 nt, Human
cucacucaccuuca

SEQ ID NO: 2163441 - RNA, 18 nt, Human
cgccagggagaccuggac

SEQ ID NO: 2163442 - RNA, 16 nt, Human
cuaguaaaaauacaaa

SEQ ID NO: 2163443 - RNA, 15 nt, Human
cuauauuguacacac

SEQ ID NO: 2163444 - RNA, 14 nt, Human
cuauauuguacaca

SEQ ID NO: 2163445 - RNA, 13 nt, Human
cuauauuguacac

SEQ ID NO: 2163446 - RNA, 16 nt, Human
cuaugagcuaaauguc

SEQ ID NO: 2163447 - RNA, 11 nt, Human
gaggccuucca

SEQ ID NO: 2163448 - RNA, 20 nt, Human
gaggccccugucucagggug

SEQ ID NO: 2163449 - RNA, 15 nt, Human
gaggccagugagcca

SEQ ID NO: 2163450 - RNA, 19 nt, Human
gagggaacggaaauaaagg

SEQ ID NO: 2163451 - RNA, 13 nt, Human
gagggaccucucc

SEQ ID NO: 2163452 - RNA, 14 nt, Human
gagggaccucuccc

SEQ ID NO: 2163453 - RNA, 15 nt, Human
gagggaccucuccca

SEQ ID NO: 2163454 - RNA, 17 nt, Human
gagggaccucucccagg

SEQ ID NO: 2163455 - RNA, 18 nt, Human
gagggaccucucccaggg

SEQ ID NO: 2163456 - RNA, 19 nt, Human
gaggagguaaugaauuaaa

SEQ ID NO: 2163457 - RNA, 18 nt, Human
gaggagcucaggacacua

SEQ ID NO: 2163458 - RNA, 22 nt, Human
gagcaggcggugggcacccacc

SEQ ID NO: 2163459 - RNA, 18 nt, Human
gagcaggcggugggcacc

SEQ ID NO: 2163460 - RNA, 15 nt, Human
gagccacuccggccc

SEQ ID NO: 2163461 - RNA, 18 nt, Human
gagccaugggcacaaagg

SEQ ID NO: 2163462 - RNA, 17 nt, Human
gagccaugggcacaaag

SEQ ID NO: 2163463 - RNA, 15 nt, Human
gagcacacccagccc

SEQ ID NO: 2163464 - RNA, 13 nt, Human
gagcacacccagc

SEQ ID NO: 2163465 - RNA, 16 nt, Human
gagcacacccagcccc

SEQ ID NO: 2163466 - RNA, 14 nt, Human
gagcucaggacacu

SEQ ID NO: 2163467 - RNA, 17 nt, Human
gagcucaggacacuaau

SEQ ID NO: 2163468 - RNA, 18 nt, Human
gagcuacccgcagaguuc

SEQ ID NO: 2163469 - RNA, 19 nt, Human
gagcuccaacucagaaggg

SEQ ID NO: 2163470 - RNA, 18 nt, Human
gagcuccaacucagaagg

SEQ ID NO: 2163471 - RNA, 22 nt, Human
gagcucccaggugcagccagag

SEQ ID NO: 2163472 - RNA, 19 nt, Human
gagcugcaggggcauggga

SEQ ID NO: 2163473 - RNA, 19 nt, Human
gagcuuccuguccucccag

SEQ ID NO: 2163474 - RNA, 19 nt, Human
gagcggugcuguccucagg

SEQ ID NO: 2163475 - RNA, 23 nt, Human
gaguaaaauaaauauugucuuuu

SEQ ID NO: 2163476 - RNA, 22 nt, Human
gaguaaaauaaauauugucuuu

SEQ ID NO: 2163477 - RNA, 22 nt, Human
gaguuuuucccagcuacaccuu

SEQ ID NO: 2163478 - RNA, 20 nt, Human
gaguggcuucacuccugcug

SEQ ID NO: 2163479 - RNA, 19 nt, Human
gaguggcuucacuccugcu

SEQ ID NO: 2163480 - RNA, 15 nt, Human
gaguggcuucacucc

SEQ ID NO: 2163481 - RNA, 22 nt, Human
gaguuagaauaauaaauauuua

SEQ ID NO: 2163482 - RNA, 21 nt, Human
gaguuagaauaauaaauauuu

SEQ ID NO: 2163483 - RNA, 16 nt, Human
gaguuagaauaauaaa

SEQ ID NO: 2163484 - RNA, 20 nt, Human
gauggcaggacgugggcugg

SEQ ID NO: 2163485 - RNA, 23 nt, Human
gaugggacuagagcuuucuuuca

SEQ ID NO: 2163486 - RNA, 13 nt, Human
gaugcuauuugca

SEQ ID NO: 2163487 - RNA, 14 nt, Human
gaugcuauuugcaa

SEQ ID NO: 2163488 - RNA, 13 nt, Human
gaugcccugcccu

SEQ ID NO: 2163489 - RNA, 13 nt, Human
gaugacucaagau

SEQ ID NO: 2163490 - RNA, 16 nt, Human
gaugacucaagauucc

SEQ ID NO: 2163491 - RNA, 14 nt, Human
gaugacucaagauu

SEQ ID NO: 2163492 - RNA, 23 nt, Human
gaugacucaagauucccaggagu

SEQ ID NO: 2163493 - RNA, 22 nt, Human
gaugacucaagauucccaggag

SEQ ID NO: 2163494 - RNA, 21 nt, Human
gaugacucaagauucccagga

SEQ ID NO: 2163495 - RNA, 16 nt, Human
gaucuucaacaaauug

SEQ ID NO: 2163496 - RNA, 13 nt, Human
gaucuucaacaaa

SEQ ID NO: 2163497 - RNA, 15 nt, Human
gaucuucaacaaauu

SEQ ID NO: 2163498 - RNA, 16 nt, Human
gaucuuuucaaguuaa

SEQ ID NO: 2163499 - RNA, 24 nt, Human
gaucuuuuguucccauccucuucu

SEQ ID NO: 2163500 - RNA, 18 nt, Human
gaucuuuuguucccaucc

SEQ ID NO: 2163501 - RNA, 15 nt, Human
gaucuuuuguuccca

SEQ ID NO: 2163502 - RNA, 16 nt, Human
gaugggcccaauucuu

SEQ ID NO: 2163503 - RNA, 15 nt, Human
gauuccugagccagu

SEQ ID NO: 2163504 - RNA, 21 nt, Human
gauucccaggaguucugcuca

SEQ ID NO: 2163505 - RNA, 13 nt, Human
gauucccaggagu

SEQ ID NO: 2163506 - RNA, 12 nt, Human
gauucccaggag

SEQ ID NO: 2163507 - RNA, 19 nt, Human
gauucccaggaguucugcu

SEQ ID NO: 2163508 - RNA, 16 nt, Human
gauucacuucacgcuu

SEQ ID NO: 2163509 - RNA, 15 nt, Human
gccacaggucuuuau

SEQ ID NO: 2163510 - RNA, 22 nt, Human
gccacacucugggcuccagagu

SEQ ID NO: 2163511 - RNA, 18 nt, Human
gccauggacagaagaagg

SEQ ID NO: 2163512 - RNA, 13 nt, Human
gccauuuugcauu

SEQ ID NO: 2163513 - RNA, 20 nt, Human
gccauuuugcauuuucaucu

SEQ ID NO: 2163514 - RNA, 21 nt, Human
gccaugggcacaaagggccca

SEQ ID NO: 2163515 - RNA, 14 nt, Human
gccauuuuuacugu

SEQ ID NO: 2163516 - RNA, 20 nt, Human
gccagugaugcuaaagguug

SEQ ID NO: 2163517 - RNA, 19 nt, Human
gccagugaugcuaaagguu

SEQ ID NO: 2163518 - RNA, 15 nt, Human
gccagugagccacuc

SEQ ID NO: 2163519 - RNA, 19 nt, Human
gccagggagaccuggacac

SEQ ID NO: 2163520 - RNA, 18 nt, Human
gccagggagaccuggaca

SEQ ID NO: 2163521 - RNA, 15 nt, Human
gccagggagaccugg

SEQ ID NO: 2163522 - RNA, 21 nt, Human
gccaguaaaaaaaaaaaaugg

SEQ ID NO: 2163523 - RNA, 22 nt, Human
gccagggagaccuggacacagg

SEQ ID NO: 2163524 - RNA, 21 nt, Human
gccagggagaccuggacacag

SEQ ID NO: 2163525 - RNA, 18 nt, Human
gcccagcggacaguggca

SEQ ID NO: 2163526 - RNA, 21 nt, Human
gcccagcggacaguggcagga

SEQ ID NO: 2163527 - RNA, 20 nt, Human
gcccagcggacaguggcagg

SEQ ID NO: 2163528 - RNA, 19 nt, Human
gcccagcggacaguggcag

SEQ ID NO: 2163529 - RNA, 17 nt, Human
gcccaguccuuccaccu

SEQ ID NO: 2163530 - RNA, 15 nt, Human
gcccaguccuuccac

SEQ ID NO: 2163531 - RNA, 14 nt, Human
gcccaguccuucca

SEQ ID NO: 2163532 - RNA, 19 nt, Human
gcccaguccuuccaccucg

SEQ ID NO: 2163533 - RNA, 18 nt, Human
gcccaguccuuccaccuc

SEQ ID NO: 2163534 - RNA, 19 nt, Human
gcccagauuaugagacaca

SEQ ID NO: 2163535 - RNA, 22 nt, Human
gcccagauuaaagucuuuaucc

SEQ ID NO: 2163536 - RNA, 22 nt, Human
gcccagauuaugagacacagga

SEQ ID NO: 2163537 - RNA, 20 nt, Human
gcccagauuaugagacacag

SEQ ID NO: 2163538 - RNA, 17 nt, Human
gcccagccaggccccag

SEQ ID NO: 2163539 - RNA, 16 nt, Human
gcccagccaggcccca

SEQ ID NO: 2163540 - RNA, 15 nt, Human
gcccagccaggcccc

SEQ ID NO: 2163541 - RNA, 14 nt, Human
gcccagccaggccc

SEQ ID NO: 2163542 - RNA, 22 nt, Human
gcccaauucuuacaaacaugug

SEQ ID NO: 2163543 - RNA, 22 nt, Human
gcagauguaaaguuauucuuga

SEQ ID NO: 2163544 - RNA, 20 nt, Human
gcagauguaaaguuauucuu

SEQ ID NO: 2163545 - RNA, 17 nt, Human
gcagagaagcucucggg

SEQ ID NO: 2163546 - RNA, 18 nt, Human
gcagacugaucaggaccu

SEQ ID NO: 2163547 - RNA, 19 nt, Human
gcagaggggcagauggaaa

SEQ ID NO: 2163548 - RNA, 15 nt, Human
gcagcucagcuuccc

SEQ ID NO: 2163549 - RNA, 17 nt, Human
gcaggacgugggcuggg

SEQ ID NO: 2163550 - RNA, 17 nt, Human
gcacagcccaaagaagg

SEQ ID NO: 2163551 - RNA, 22 nt, Human
gcauccacuucuuucagcagac

SEQ ID NO: 2163552 - RNA, 23 nt, Human
gcaggcggugggcacccacccug

SEQ ID NO: 2163553 - RNA, 16 nt, Human
gcaggcggugggcacc

SEQ ID NO: 2163554 - RNA, 15 nt, Human
gcaggcggugggcac

SEQ ID NO: 2163555 - RNA, 14 nt, Human
gcaggcggugggca

SEQ ID NO: 2163556 - RNA, 17 nt, Human
gcaggccaggccagcug

SEQ ID NO: 2163557 - RNA, 15 nt, Human
gcaggccaggccagc

SEQ ID NO: 2163558 - RNA, 16 nt, Human
gcaggccaggccagcu

SEQ ID NO: 2163559 - RNA, 21 nt, Human
gcuuguuaaugcuuucugaag

SEQ ID NO: 2163560 - RNA, 23 nt, Human
gcuuguuaaugcuuucugaagcu

SEQ ID NO: 2163561 - RNA, 13 nt, Human
gcuuguuaaugcu

SEQ ID NO: 2163562 - RNA, 16 nt, Human
gcuuggacggcugggc

SEQ ID NO: 2163563 - RNA, 18 nt, Human
gcuuggaaacuggaugag

SEQ ID NO: 2163564 - RNA, 14 nt, Human
gcuugccugcaggc

SEQ ID NO: 2163565 - RNA, 13 nt, Human
gcuugccugcagg

SEQ ID NO: 2163566 - RNA, 19 nt, Human
gcuucuguugucaccuuca

SEQ ID NO: 2163567 - RNA, 20 nt, Human
gcuuugguuauauuuagcuc

SEQ ID NO: 2163568 - RNA, 19 nt, Human
gcuuacggcccuggccuug

SEQ ID NO: 2163569 - RNA, 17 nt, Human
gcuuacggcccuggccu

SEQ ID NO: 2163570 - RNA, 16 nt, Human
gcuuacggcccuggcc

SEQ ID NO: 2163571 - RNA, 15 nt, Human
gcuuacggcccuggc

SEQ ID NO: 2163572 - RNA, 12 nt, Human
gcuuacggcccu

SEQ ID NO: 2163573 - RNA, 18 nt, Human
gcuucucauccugcaggc

SEQ ID NO: 2163574 - RNA, 17 nt, Human
gcuucucauccugcagg

SEQ ID NO: 2163575 - RNA, 17 nt, Human
gcuucuguugucaccuu

SEQ ID NO: 2163576 - RNA, 16 nt, Human
gcuucuguugucaccu

SEQ ID NO: 2163577 - RNA, 16 nt, Human
gcuucucauccugcag

SEQ ID NO: 2163578 - RNA, 22 nt, Human
gcuggucaaacaaacucucuga

SEQ ID NO: 2163579 - RNA, 20 nt, Human
gcuguccucagguggccaug

SEQ ID NO: 2163580 - RNA, 19 nt, Human
gcuguccucagguggccau

SEQ ID NO: 2163581 - RNA, 18 nt, Human
gcuguccucagguggcca

SEQ ID NO: 2163582 - RNA, 13 nt, Human
gcuguccucaggu

SEQ ID NO: 2163583 - RNA, 17 nt, Human
gcugcgucauuacaggg

SEQ ID NO: 2163584 - RNA, 16 nt, Human
gcugcggagcaagagg

SEQ ID NO: 2163585 - RNA, 15 nt, Human
gcugcggagcaagag

SEQ ID NO: 2163586 - RNA, 20 nt, Human
gcuggaaacagacucgauuc

SEQ ID NO: 2163587 - RNA, 21 nt, Human
gcuggcaugauccaagcaaga

SEQ ID NO: 2163588 - RNA, 23 nt, Human
gcuggccaucugguuaggauggc

SEQ ID NO: 2163589 - RNA, 12 nt, Human
gcucuuugcacu

SEQ ID NO: 2163590 - RNA, 13 nt, Human
gcucuuugcacua

SEQ ID NO: 2163591 - RNA, 19 nt, Human
gccuuccuauuuugcauaa

SEQ ID NO: 2163592 - RNA, 15 nt, Human
gccuuguugaugugg

SEQ ID NO: 2163593 - RNA, 18 nt, Human
gcgccgcaaaccacacug

SEQ ID NO: 2163594 - RNA, 17 nt, Human
gcgccgcaaaccacacu

SEQ ID NO: 2163595 - RNA, 22 nt, Human
gcgcccaguccuuccaccucga

SEQ ID NO: 2163596 - RNA, 20 nt, Human
gccuggauguugcugugcac

SEQ ID NO: 2163597 - RNA, 12 nt, Human
gcucauuuacug

SEQ ID NO: 2163598 - RNA, 14 nt, Human
gcucauucuaauga

SEQ ID NO: 2163599 - RNA, 18 nt, Human
gcucauucuaaugauggc

SEQ ID NO: 2163600 - RNA, 17 nt, Human
gcucauuuacuguuuua

SEQ ID NO: 2163601 - RNA, 14 nt, Human
gcucacaccuguaa

SEQ ID NO: 2163602 - RNA, 19 nt, Human
gcuauccagcuauuuuuau

SEQ ID NO: 2163603 - RNA, 18 nt, Human
gcggugcuguccucaggu

SEQ ID NO: 2163604 - RNA, 16 nt, Human
gcggugcuguccucag

SEQ ID NO: 2163605 - RNA, 14 nt, Human
ggagccucccugcc

SEQ ID NO: 2163606 - RNA, 18 nt, Human
ggagccuaggccaggugc

SEQ ID NO: 2163607 - RNA, 17 nt, Human
ggagccuaggccaggug

SEQ ID NO: 2163608 - RNA, 16 nt, Human
ggagccuaggccaggu

SEQ ID NO: 2163609 - RNA, 18 nt, Human
ggagccucccugccucag

SEQ ID NO: 2163610 - RNA, 22 nt, Human
ggagccucccugccucaggccu

SEQ ID NO: 2163611 - RNA, 16 nt, Human
ggagccucccugccuc

SEQ ID NO: 2163612 - RNA, 15 nt, Human
ggagccucccugccu

SEQ ID NO: 2163613 - RNA, 17 nt, Human
ggagacaggcagagcug

SEQ ID NO: 2163614 - RNA, 13 nt, Human
ggagcaagaggag

SEQ ID NO: 2163615 - RNA, 15 nt, Human
ggagcaagaggaggc

SEQ ID NO: 2163616 - RNA, 17 nt, Human
ggagcacacccagcccc

SEQ ID NO: 2163617 - RNA, 15 nt, Human
ggagcacacccagcc

SEQ ID NO: 2163618 - RNA, 14 nt, Human
ggagcacacccagc

SEQ ID NO: 2163619 - RNA, 15 nt, Human
ggagcuagccagagg

SEQ ID NO: 2163620 - RNA, 12 nt, Human
ggagcuagccag

SEQ ID NO: 2163621 - RNA, 20 nt, Human
ggagcuccaacucagaaggg

SEQ ID NO: 2163622 - RNA, 14 nt, Human
ggacagaagaaggc

SEQ ID NO: 2163623 - RNA, 23 nt, Human
ggacagacucacaaccugaaccu

SEQ ID NO: 2163624 - RNA, 12 nt, Human
ggagacaggcag

SEQ ID NO: 2163625 - RNA, 18 nt, Human
ggacugaaaaccucuccu

SEQ ID NO: 2163626 - RNA, 16 nt, Human
ggacugaaaaccucuc

SEQ ID NO: 2163627 - RNA, 17 nt, Human
ggacugaaaaccucucc

SEQ ID NO: 2163628 - RNA, 20 nt, Human
ggacgaagaagagccacagu

SEQ ID NO: 2163629 - RNA, 19 nt, Human
ggacgaagaagagccacag

SEQ ID NO: 2163630 - RNA, 23 nt, Human
ggaccaugcgacacugggaggcc

SEQ ID NO: 2163631 - RNA, 15 nt, Human
ggauuccucuuuucu

SEQ ID NO: 2163632 - RNA, 18 nt, Human
ggauuccucuuuucucug

SEQ ID NO: 2163633 - RNA, 13 nt, Human
ggauuccucuuuu

SEQ ID NO: 2163634 - RNA, 22 nt, Human
ggcacccaagaccucagggcac

SEQ ID NO: 2163635 - RNA, 18 nt, Human
ggcacccaagaccucagg

SEQ ID NO: 2163636 - RNA, 18 nt, Human
ggcagagcugcuccccuc

SEQ ID NO: 2163637 - RNA, 21 nt, Human
ggccagaagaugaacagacug

SEQ ID NO: 2163638 - RNA, 14 nt, Human
ggccagaagaugaa

SEQ ID NO: 2163639 - RNA, 12 nt, Human
ggcagcugccac

SEQ ID NO: 2163640 - RNA, 21 nt, Human
ggcagaguucuauaauguaaa

SEQ ID NO: 2163641 - RNA, 15 nt, Human
ggcaugauccaagca

SEQ ID NO: 2163642 - RNA, 18 nt, Human
ggcaugauccaagcaaga

SEQ ID NO: 2163643 - RNA, 16 nt, Human
ggcaugauccaagcaa

SEQ ID NO: 2163644 - RNA, 14 nt, Human
ggccgggcagaggg

SEQ ID NO: 2163645 - RNA, 16 nt, Human
ggccgggcagaggggc

SEQ ID NO: 2163646 - RNA, 19 nt, Human
ggccucgcaggaagaccca

SEQ ID NO: 2163647 - RNA, 14 nt, Human
ggcgcacugccucu

SEQ ID NO: 2163648 - RNA, 16 nt, Human
ggcgcacugccucuca

SEQ ID NO: 2163649 - RNA, 19 nt, Human
ggcgccgcaaaccacacug

SEQ ID NO: 2163650 - RNA, 16 nt, Human
ggcuggagugaggaaa

SEQ ID NO: 2163651 - RNA, 14 nt, Human
ggcuggagugagga

SEQ ID NO: 2163652 - RNA, 13 nt, Human
ggcuugccugcag

SEQ ID NO: 2163653 - RNA, 17 nt, Human
ggcuucacuccugcugu

SEQ ID NO: 2163654 - RNA, 15 nt, Human
ggcuucacuccugcu

SEQ ID NO: 2163655 - RNA, 15 nt, Human
ggcuugccugcaggc

SEQ ID NO: 2163656 - RNA, 14 nt, Human
ggcuugccugcagg

SEQ ID NO: 2163657 - RNA, 21 nt, Human
gggacgaagaagagccacagu

SEQ ID NO: 2163658 - RNA, 20 nt, Human
gggacgaagaagagccacag

SEQ ID NO: 2163659 - RNA, 19 nt, Human
gggacgaagaagagccaca

SEQ ID NO: 2163660 - RNA, 17 nt, Human
gggacgaagaagagcca

SEQ ID NO: 2163661 - RNA, 13 nt, Human
gggacccccgccc

SEQ ID NO: 2163662 - RNA, 19 nt, Human
gggacccccgcccccugcc

SEQ ID NO: 2163663 - RNA, 18 nt, Human
gggacccccgcccccugc

SEQ ID NO: 2163664 - RNA, 17 nt, Human
gggacccccgcccccug

SEQ ID NO: 2163665 - RNA, 14 nt, Human
gggacccccgcccc

SEQ ID NO: 2163666 - RNA, 24 nt, Human
gggacccccgcccccugcccuccc

SEQ ID NO: 2163667 - RNA, 21 nt, Human
gggacccccgcccccugcccu

SEQ ID NO: 2163668 - RNA, 15 nt, Human
ggcuuugcaaccauu

SEQ ID NO: 2163669 - RNA, 21 nt, Human
ggcuuugcaaccauuuucauu

SEQ ID NO: 2163670 - RNA, 18 nt, Human
ggcuuuuacugaagccuu

SEQ ID NO: 2163671 - RNA, 20 nt, Human
ggcuuuuacugaagccuuuc

SEQ ID NO: 2163672 - RNA, 16 nt, Human
gggagcugcaggggca

SEQ ID NO: 2163673 - RNA, 18 nt, Human
gggagcuagccagaggac

SEQ ID NO: 2163674 - RNA, 15 nt, Human
gggagcuagccagag

SEQ ID NO: 2163675 - RNA, 21 nt, Human
gggagcuccaacucagaaggg

SEQ ID NO: 2163676 - RNA, 12 nt, Human
gggagccucccu

SEQ ID NO: 2163677 - RNA, 21 nt, Human
gggagccucccugccucaggc

SEQ ID NO: 2163678 - RNA, 15 nt, Human
ucaggcuugauaaua

SEQ ID NO: 2163679 - RNA, 16 nt, Human
ucagggaaaagcagcu

SEQ ID NO: 2163680 - RNA, 18 nt, Human
ucagggaaaagcagcucu

SEQ ID NO: 2163681 - RNA, 19 nt, Human
ucagggaaaagcagcucuc

SEQ ID NO: 2163682 - RNA, 23 nt, Human
ucagggaaaagcagcucuccccu

SEQ ID NO: 2163683 - RNA, 19 nt, Human
ucacucugugucugagugg

SEQ ID NO: 2163684 - RNA, 18 nt, Human
ucagacgcacucgcauug

SEQ ID NO: 2163685 - RNA, 18 nt, Human
ucagaccuuuuaacuccu

SEQ ID NO: 2163686 - RNA, 14 nt, Human
ucagaaacaggacc

SEQ ID NO: 2163687 - RNA, 23 nt, Human
uccacacaacauauccguauaua

SEQ ID NO: 2163688 - RNA, 22 nt, Human
uauucgcuugagaaaaaaagaa

SEQ ID NO: 2163689 - RNA, 17 nt, Human
uauucgcuugagaaaaa

SEQ ID NO: 2163690 - RNA, 14 nt, Human
uauucgcuugagaa

SEQ ID NO: 2163691 - RNA, 17 nt, Human
uauguaugguauccaag

SEQ ID NO: 2163692 - RNA, 18 nt, Human
uauguacaggaugcuuug

SEQ ID NO: 2163693 - RNA, 23 nt, Human
uauguugagucgcgcaccgaaaa

SEQ ID NO: 2163694 - RNA, 20 nt, Human
uauuaaauggaaacugaaac

SEQ ID NO: 2163695 - RNA, 19 nt, Human
uauuaaauggaaacugaaa

SEQ ID NO: 2163696 - RNA, 18 nt, Human
uauuaaauggaaacugaa

SEQ ID NO: 2163697 - RNA, 17 nt, Human
uauuaaauggaaacuga

SEQ ID NO: 2163698 - RNA, 21 nt, Human
uauuaauacaaugaugcuauu

SEQ ID NO: 2163699 - RNA, 23 nt, Human
uauuaauacaaugaugcuauuug

SEQ ID NO: 2163700 - RNA, 16 nt, Human
ucaauaaaaaaaagaa

SEQ ID NO: 2163701 - RNA, 19 nt, Human
ucaaugguuugcaaggaag

SEQ ID NO: 2163702 - RNA, 18 nt, Human
ucaaugguuugcaaggaa

SEQ ID NO: 2163703 - RNA, 23 nt, Human
ucaauguacuaggauacugcugc

SEQ ID NO: 2163704 - RNA, 22 nt, Human
ucaauguacuaggauacugcug

SEQ ID NO: 2163705 - RNA, 20 nt, Human
ucacaccugaacugaacacc

SEQ ID NO: 2163706 - RNA, 16 nt, Human
uauuuuccaugaaaau

SEQ ID NO: 2163707 - RNA, 20 nt, Human
uauuuuccaugaaaaugcaa

SEQ ID NO: 2163708 - RNA, 14 nt, Human
ucaaaugcucagac

SEQ ID NO: 2163709 - RNA, 19 nt, Human
ucaaaugcucagaccagcu

SEQ ID NO: 2163710 - RNA, 21 nt, Human
ucaaaugcucagaccagcucu

SEQ ID NO: 2163711 - RNA, 18 nt, Human
ucaacccuaaaaagcaga

SEQ ID NO: 2163712 - RNA, 22 nt, Human
ucaacccuaaaaagcagagcuu

SEQ ID NO: 2163713 - RNA, 23 nt, Human
ucaacccuaaaaagcagagcuuu

SEQ ID NO: 2163714 - RNA, 14 nt, Human
ucaaaaaacaaaaa

SEQ ID NO: 2163715 - RNA, 14 nt, Human
ucuucucagccacu

SEQ ID NO: 2163716 - RNA, 13 nt, Human
ucuguuuuguaaa

SEQ ID NO: 2163717 - RNA, 22 nt, Human
ucuguuuuguaaaguccccaga

SEQ ID NO: 2163718 - RNA, 15 nt, Human
ucuguuuuguaaagu

SEQ ID NO: 2163719 - RNA, 17 nt, Human
ucuuaaacaaauguaug

SEQ ID NO: 2163720 - RNA, 16 nt, Human
ucugcugguuuuaaca

SEQ ID NO: 2163721 - RNA, 17 nt, Human
ucugguuaggauggcag

SEQ ID NO: 2163722 - RNA, 13 nt, Human
ucucuaacaaugu

SEQ ID NO: 2163723 - RNA, 22 nt, Human
ucucuaaagaguuuauuuuaag

SEQ ID NO: 2163724 - RNA, 21 nt, Human
ucucuaaagaguuuauuuuaa

SEQ ID NO: 2163725 - RNA, 19 nt, Human
ucucuaaagaguuuauuuu

SEQ ID NO: 2163726 - RNA, 11 nt, Human
ucucugaaccc

SEQ ID NO: 2163727 - RNA, 14 nt, Human
ucgagucaaaaugu

SEQ ID NO: 2163728 - RNA, 19 nt, Human
ucuaacaauguauuuucuu

SEQ ID NO: 2163729 - RNA, 23 nt, Human
ucuauauuuugggaaaaaaacau

SEQ ID NO: 2163730 - RNA, 15 nt, Human
ucuacuuuaauaaau

SEQ ID NO: 2163731 - RNA, 14 nt, Human
ucuacuuuaauaaa

SEQ ID NO: 2163732 - RNA, 22 nt, Human
ucuacuugcucuggaccugccc

SEQ ID NO: 2163733 - RNA, 21 nt, Human
ucuacuugcucuggaccugcc

SEQ ID NO: 2163734 - RNA, 20 nt, Human
ucuacuugcucuggaccugc

SEQ ID NO: 2163735 - RNA, 19 nt, Human
ucuacuugcucuggaccug

SEQ ID NO: 2163736 - RNA, 20 nt, Human
uccuuuuaaaucuugauacc

SEQ ID NO: 2163737 - RNA, 24 nt, Human
uccuuuuauuucuucaccagauuu

SEQ ID NO: 2163738 - RNA, 16 nt, Human
ucccuaguaaaaauac

SEQ ID NO: 2163739 - RNA, 17 nt, Human
ucccuucgacagcauuu

SEQ ID NO: 2163740 - RNA, 20 nt, Human
ucccuuccuuguagccuuuu

SEQ ID NO: 2163741 - RNA, 23 nt, Human
ucccuugaggaaacaacagcuuu

SEQ ID NO: 2163742 - RNA, 18 nt, Human
ucccugccucaggccucu

SEQ ID NO: 2163743 - RNA, 17 nt, Human
ucccugccucaggccuc

SEQ ID NO: 2163744 - RNA, 16 nt, Human
ucccugccucaggccu

SEQ ID NO: 2163745 - RNA, 11 nt, Human
ucccugccuca

SEQ ID NO: 2163746 - RNA, 20 nt, Human
ucccugccucaggccucugu

SEQ ID NO: 2163747 - RNA, 19 nt, Human
uccucguucucccugggag

SEQ ID NO: 2163748 - RNA, 16 nt, Human
uccucguucucccugg

SEQ ID NO: 2163749 - RNA, 15 nt, Human
uccucguucucccug

SEQ ID NO: 2163750 - RNA, 21 nt, Human
uccucguucucccugggaggc

SEQ ID NO: 2163751 - RNA, 17 nt, Human
uccucauguucugcuuu

SEQ ID NO: 2163752 - RNA, 15 nt, Human
uccucugcuuugaaa

SEQ ID NO: 2163753 - RNA, 17 nt, Human
uccucugcuuugaaagc

SEQ ID NO: 2163754 - RNA, 21 nt, Human
uccuauucuuucgaaagaaga

SEQ ID NO: 2163755 - RNA, 13 nt, Human
uguaaaacaggua

SEQ ID NO: 2163756 - RNA, 14 nt, Human
uguaaaacagguag

SEQ ID NO: 2163757 - RNA, 22 nt, Human
uguaaaacagguagaauuaucu

SEQ ID NO: 2163758 - RNA, 12 nt, Human
uguaaaacaggu

SEQ ID NO: 2163759 - RNA, 18 nt, Human
uguaaauuuggcuucugu

SEQ ID NO: 2163760 - RNA, 16 nt, Human
uguaaauuuggcuucu

SEQ ID NO: 2163761 - RNA, 21 nt, Human
uguaaauuuggcuucuguugu

SEQ ID NO: 2163762 - RNA, 15 nt, Human
uggugguaucugagu

SEQ ID NO: 2163763 - RNA, 15 nt, Human
uggugggagggggag

SEQ ID NO: 2163764 - RNA, 16 nt, Human
ugucugaguggcuuca

SEQ ID NO: 2163765 - RNA, 18 nt, Human
uguccucccagcuccuca

SEQ ID NO: 2163766 - RNA, 17 nt, Human
uguccuccaagccagcg

SEQ ID NO: 2163767 - RNA, 17 nt, Human
ugucacagggacugaaa

SEQ ID NO: 2163768 - RNA, 16 nt, Human
uggcagcugccacgcc

SEQ ID NO: 2163769 - RNA, 21 nt, Human
uggaaacuggaugaggucaua

SEQ ID NO: 2163770 - RNA, 18 nt, Human
uggaaacauucaggagcu

SEQ ID NO: 2163771 - RNA, 23 nt, Human
ugcuuucugaagcuuuaccagcu

SEQ ID NO: 2163772 - RNA, 21 nt, Human
ugcuuucugaagcuuuaccag

SEQ ID NO: 2163773 - RNA, 20 nt, Human
ugcuuucugaagcuuuacca

SEQ ID NO: 2163774 - RNA, 15 nt, Human
ugcuuucugaagcuu

SEQ ID NO: 2163775 - RNA, 12 nt, Human
ugcuuaaugaaa

SEQ ID NO: 2163776 - RNA, 14 nt, Human
ugcuuaaugaaaag

SEQ ID NO: 2163777 - RNA, 22 nt, Human
ugcuuccauggccguguagaag

SEQ ID NO: 2163778 - RNA, 23 nt, Human
ugcuuccauggccguguagaagc

SEQ ID NO: 2163779 - RNA, 15 nt, Human
uggacggcugggcac

SEQ ID NO: 2163780 - RNA, 14 nt, Human
uggacauuuaccuu

SEQ ID NO: 2163781 - RNA, 14 nt, Human
uggcaaccugcuuc

SEQ ID NO: 2163782 - RNA, 13 nt, Human
uggcaaccugcuu

SEQ ID NO: 2163783 - RNA, 14 nt, Human
ugauauccuucuag

SEQ ID NO: 2163784 - RNA, 14 nt, Human
ugauauaaauaaaa

SEQ ID NO: 2163785 - RNA, 14 nt, Human
ugaucugaaaaaua

SEQ ID NO: 2163786 - RNA, 13 nt, Human
ugaugcuauuugc

SEQ ID NO: 2163787 - RNA, 20 nt, Human
ugaugcuauuugcaauuccu

SEQ ID NO: 2163788 - RNA, 16 nt, Human
ugauagugguggaguu

SEQ ID NO: 2163789 - RNA, 20 nt, Human
ugaguugguguugacaugug

SEQ ID NO: 2163790 - RNA, 15 nt, Human
ugagguugcuuuguu

SEQ ID NO: 2163791 - RNA, 16 nt, Human
ugaguccuagagcuac

SEQ ID NO: 2163792 - RNA, 22 nt, Human
ucuugaaucuagggagggggaa

SEQ ID NO: 2163793 - RNA, 22 nt, Human
ugagaaauucaacguuaauaau

SEQ ID NO: 2163794 - RNA, 14 nt, Human
ugagaggcauuucc

SEQ ID NO: 2163795 - RNA, 16 nt, Human
ugagaggcauuucccc

SEQ ID NO: 2163796 - RNA, 18 nt, Human
ugagauccuuccuuuuga

SEQ ID NO: 2163797 - RNA, 23 nt, Human
ugagcucccaggugcagccagag

SEQ ID NO: 2163798 - RNA, 21 nt, Human
ugagcucccaggugcagccag

SEQ ID NO: 2163799 - RNA, 16 nt, Human
ugcaaugacucaggac

SEQ ID NO: 2163800 - RNA, 17 nt, Human
ugcacucuuuaagggag

SEQ ID NO: 2163801 - RNA, 20 nt, Human
ugcacaaaguggcauaaaaa

SEQ ID NO: 2163802 - RNA, 15 nt, Human
ugcacaaaguggcau

SEQ ID NO: 2163803 - RNA, 14 nt, Human
ugcacaaaguggca

SEQ ID NO: 2163804 - RNA, 21 nt, Human
ugcaaccagggagcugcaggg

SEQ ID NO: 2163805 - RNA, 20 nt, Human
ugcaaccagggagcugcagg

SEQ ID NO: 2163806 - RNA, 17 nt, Human
ugcaaccagggagcugc

SEQ ID NO: 2163807 - RNA, 17 nt, Human
ugccacaguauauuuuu

SEQ ID NO: 2163808 - RNA, 17 nt, Human
ugcaucccccccaccuc

SEQ ID NO: 2163809 - RNA, 15 nt, Human
ugcaucccccccacc

SEQ ID NO: 2163810 - RNA, 23 nt, Human
ugcauguuuguuguauacuuccu

SEQ ID NO: 2163811 - RNA, 13 nt, Human
ugccucccuggug

SEQ ID NO: 2163812 - RNA, 14 nt, Human
ugccucccugguga

SEQ ID NO: 2163813 - RNA, 22 nt, Human
ugccucccuggugagagggccg

SEQ ID NO: 2163814 - RNA, 22 nt, Human
ugccuccgcgugaucaaagcca

SEQ ID NO: 2163815 - RNA, 18 nt, Human
uuuucccagcuacaccuu

SEQ ID NO: 2163816 - RNA, 19 nt, Human
uuuucccagcuacaccuuu

SEQ ID NO: 2163817 - RNA, 15 nt, Human
uuuucuucacugucc

SEQ ID NO: 2163818 - RNA, 14 nt, Human
uuuuaccuucacug

SEQ ID NO: 2163819 - RNA, 20 nt, Human
uuuguguauuuaacagggag

SEQ ID NO: 2163820 - RNA, 13 nt, Human
uuuguguauuuaa

SEQ ID NO: 2163821 - RNA, 23 nt, Human
uuugguaguggaaaaaaaaaaga

SEQ ID NO: 2163822 - RNA, 13 nt, Human
uuugcauucuccc

SEQ ID NO: 2163823 - RNA, 23 nt, Human
uuucccuuugagguugcuuuguu

SEQ ID NO: 2163824 - RNA, 20 nt, Human
uuugcacuaagauauuucca

SEQ ID NO: 2163825 - RNA, 19 nt, Human
uuuuucauugccaaaaacu

SEQ ID NO: 2163826 - RNA, 13 nt, Human
uuuuuaaucucca

SEQ ID NO: 2163827 - RNA, 19 nt, Human
uuuuuaaccccgucaacaa

SEQ ID NO: 2163828 - RNA, 20 nt, Human
uuuugacuuucauuggaaau

SEQ ID NO: 2163829 - RNA, 22 nt, Human
uuuuuaacucaauauuuuccau

SEQ ID NO: 2163830 - RNA, 20 nt, Human
uuuuuuaaccccgucaacaa

SEQ ID NO: 2163831 - RNA, 13 nt, Human
uuuuuuaaaaacu

SEQ ID NO: 2163832 - RNA, 23 nt, Human
uuuuucccuucaucugggcacug

SEQ ID NO: 2163833 - RNA, 19 nt, Human
uuuuucccagcuacaccuu

SEQ ID NO: 2163834 - RNA, 16 nt, Human
uugcacuaagauauuu

SEQ ID NO: 2163835 - RNA, 13 nt, Human
uuguaaaacaggu

SEQ ID NO: 2163836 - RNA, 15 nt, Human
uuguaaaacagguag

SEQ ID NO: 2163837 - RNA, 14 nt, Human
uuguaaaacaggua

SEQ ID NO: 2163838 - RNA, 17 nt, Human
uuguuaauauucauuuu

SEQ ID NO: 2163839 - RNA, 19 nt, Human
uuguuaaugguuugaauau

SEQ ID NO: 2163840 - RNA, 13 nt, Human
uuguuaucuggga

SEQ ID NO: 2163841 - RNA, 22 nt, Human
uuguggaggagcucaggacacu

SEQ ID NO: 2163842 - RNA, 13 nt, Human
uuguguucuuugu

SEQ ID NO: 2163843 - RNA, 22 nt, Human
uugugccaaccuauuuugaagu

SEQ ID NO: 2163844 - RNA, 17 nt, Human
uugugccucccugguga

SEQ ID NO: 2163845 - RNA, 18 nt, Human
uuuaacuccucaauucca

SEQ ID NO: 2163846 - RNA, 24 nt, Human
uuuaacucaauauuuuccaugaaa

SEQ ID NO: 2163847 - RNA, 21 nt, Human
uuuacaccaguuccuuucaau

SEQ ID NO: 2163848 - RNA, 18 nt, Human
uuuacagucuauuugaga

SEQ ID NO: 2163849 - RNA, 16 nt, Human
uuuacagucuauuuga

SEQ ID NO: 2163850 - RNA, 22 nt, Human
uuucacaaacagaaaacaugua

SEQ ID NO: 2163851 - RNA, 19 nt, Human
uuucaauuuccaagagcug

SEQ ID NO: 2163852 - RNA, 14 nt, Human
uuucagcagacuga

SEQ ID NO: 2163853 - RNA, 16 nt, Human
uuuccaagagcugagg

SEQ ID NO: 2163854 - RNA, 14 nt, Human
uuuccaagagcuga

SEQ ID NO: 2163855 - RNA, 13 nt, Human
uuuccaagagcug

SEQ ID NO: 2163856 - RNA, 15 nt, Human
uucugcucauucuaa

SEQ ID NO: 2163857 - RNA, 19 nt, Human
uucugcucauucuaaugau

SEQ ID NO: 2163858 - RNA, 18 nt, Human
uucucugaggaagcuggg

SEQ ID NO: 2163859 - RNA, 13 nt, Human
uucucugaggaag

SEQ ID NO: 2163860 - RNA, 23 nt, Human
uucucauugaauuauaaaagcca

SEQ ID NO: 2163861 - RNA, 13 nt, Human
uucuacuugcucu

SEQ ID NO: 2163862 - RNA, 16 nt, Human
uucuacuugcucugga

SEQ ID NO: 2163863 - RNA, 14 nt, Human
uucuacuugcucug

SEQ ID NO: 2163864 - RNA, 23 nt, Human
uucuacuugcucuggaccugccc

SEQ ID NO: 2163865 - RNA, 20 nt, Human
uucuacuugcucuggaccug

SEQ ID NO: 2163866 - RNA, 19 nt, Human
uucuacuugcucuggaccu

SEQ ID NO: 2163867 - RNA, 22 nt, Human
uucuacuugcucuggaccugcc

SEQ ID NO: 2163868 - RNA, 21 nt, Human
uuccugcaggccaggccagcu

SEQ ID NO: 2163869 - RNA, 23 nt, Human
uuccugagggaucuauacuugcu

SEQ ID NO: 2163870 - RNA, 22 nt, Human
uuccauggccguguagaagcau

SEQ ID NO: 2163871 - RNA, 20 nt, Human
uuccuuguagccuuuugacu

SEQ ID NO: 2163872 - RNA, 16 nt, Human
uuccuuuauguucuca

SEQ ID NO: 2163873 - RNA, 18 nt, Human
uucugcuggaaacagacu

SEQ ID NO: 2163874 - RNA, 14 nt, Human
uucugcuguucucu

SEQ ID NO: 2163875 - RNA, 19 nt, Human
uucuuucacaaaaaagaag

SEQ ID NO: 2163876 - RNA, 13 nt, Human
uucuucccauucu

SEQ ID NO: 2163877 - RNA, 17 nt, Human
uucuucccauucuccau

SEQ ID NO: 2163878 - RNA, 18 nt, Human
uugauauaaauaaaacau

SEQ ID NO: 2163879 - RNA, 20 nt, Human
uugaacuguaccaugugcua

SEQ ID NO: 2163880 - RNA, 15 nt, Human
uucaauauccuuugc

SEQ ID NO: 2163881 - RNA, 19 nt, Human
uuauuucuuaaacaaaugu

SEQ ID NO: 2163882 - RNA, 16 nt, Human
uucaaccaugaagucu

SEQ ID NO: 2163883 - RNA, 22 nt, Human
uucaaccagggauuguuucugu

SEQ ID NO: 2163884 - RNA, 18 nt, Human
uucaaccagggauuguuu

SEQ ID NO: 2163885 - RNA, 11 nt, Human
uuccagaaucc

SEQ ID NO: 2163886 - RNA, 21 nt, Human
uucauuuuuguuauccuuuuu

SEQ ID NO: 2163887 - RNA, 22 nt, Human
uuccaacacugauuuccccuuu

SEQ ID NO: 2163888 - RNA, 16 nt, Human
uuccaacacugauuuc

SEQ ID NO: 2163889 - RNA, 15 nt, Human
uucauaaagaauugu

SEQ ID NO: 2163890 - RNA, 16 nt, Human
uuauuaaauggaaacu

SEQ ID NO: 2163891 - RNA, 11 nt, Human
uuaucuaauuu

SEQ ID NO: 2163892 - RNA, 16 nt, Human
uuaucuaauuuauaaa

SEQ ID NO: 2163893 - RNA, 17 nt, Human
uuaucuaauuuauaaaa

SEQ ID NO: 2163894 - RNA, 24 nt, Human
uuauccuuuuuuaaaaguaaaugu

SEQ ID NO: 2163895 - RNA, 13 nt, Human immunodeficiency virus 1 (HIV-1)
aagauagaagagg

SEQ ID NO: 2163896 - RNA, 18 nt, Human immunodeficiency virus 1 (HIV-1)
ugaggcgcaacagcaucu

SEQ ID NO: 2163897 - RNA, 20 nt, Human immunodeficiency virus 1 (HIV-1)
ugcacugauuugaagaauga

SEQ ID NO: 2163898 - RNA, 19 nt, Human immunodeficiency virus 1 (HIV-1)
aaaaucugaaaacaggaaa

SEQ ID NO: 2163899 - RNA, 19 nt, Human immunodeficiency virus 1 (HIV-1)
ggauggagugggacagaga

SEQ ID NO: 2163900 - RNA, 19 nt, Human immunodeficiency virus 1 (HIV-1)
aggauauguuacuaauaga

SEQ ID NO: 2163901 - RNA, 18 nt, Human immunodeficiency virus 1 (HIV-1)
aguaucaacucaacugcu

SEQ ID NO: 2163902 - RNA, 19 nt, Human immunodeficiency virus 1 (HIV-1)
cauuaucguuucagaccca

SEQ ID NO: 2163903 - RNA, 16 nt, Human immunodeficiency virus 1 (HIV-1)
agacaucacuaugaaa

SEQ ID NO: 2163904 - RNA, 14 nt, Human immunodeficiency virus 1 (HIV-1)
auuuagaaggaaaa

SEQ ID NO: 2163905 - RNA, 20 nt, Human immunodeficiency virus 1 (HIV-1)
agagggagccacacaaugaa

SEQ ID NO: 2163906 - RNA, 18 nt, Human immunodeficiency virus 1 (HIV-1)
auggaaaaggaagggaaa

SEQ ID NO: 2163907 - RNA, 22 nt, Human immunodeficiency virus 1 (HIV-1)
aagggacuuuccgcuggggacu

SEQ ID NO: 2163908 - RNA, 22 nt, Human immunodeficiency virus 1 (HIV-1)
ugccucuucagcuaccaccgcu

SEQ ID NO: 2163909 - RNA, 15 nt, Human immunodeficiency virus 1 (HIV-1)
acgagcugagccagc

SEQ ID NO: 2163910 - RNA, 16 nt, Human immunodeficiency virus 1 (HIV-1)
gaccagaucugagccu

SEQ ID NO: 2163911 - RNA, 16 nt, Human immunodeficiency virus 1 (HIV-1)
gccacuuuuuaaaaga

SEQ ID NO: 2163912 - RNA, 20 nt, Human immunodeficiency virus 1 (HIV-1)
aagauaauagugacauaaaa

SEQ ID NO: 2163913 - RNA, 20 nt, Human immunodeficiency virus 1 (HIV-1)
caaugcugcuugugccuggc

SEQ ID NO: 2163914 - RNA, 21 nt, Human immunodeficiency virus 1 (HIV-1)
accuggauggagugggacaga

SEQ ID NO: 2163915 - RNA, 18 nt, Human immunodeficiency virus 1 (HIV-1)
agaacagucagacucauc

SEQ ID NO: 2163916 - RNA, 20 nt, Human immunodeficiency virus 1 (HIV-1)
uaacaccaaaaaagauaaag

SEQ ID NO: 2163917 - RNA, 23 nt, Human immunodeficiency virus 1 (HIV-1)
ggagaaauaucagcacuugugga

SEQ ID NO: 2163918 - RNA, 19 nt, Human immunodeficiency virus 1 (HIV-1)
ccggaguacuucaagaacu

SEQ ID NO: 2163919 - RNA, 17 nt, Human immunodeficiency virus 1 (HIV-1)
auacuugggcaggagug

SEQ ID NO: 2163920 - RNA, 22 nt, Human immunodeficiency virus 1 (HIV-1)
gcaaucacaaguagcaauacag

SEQ ID NO: 2163921 - RNA, 16 nt, Human immunodeficiency virus 1 (HIV-1)
aaguaagacaguauga

SEQ ID NO: 2163922 - RNA, 16 nt, Human immunodeficiency virus 1 (HIV-1)
guaauaaaucucugga

SEQ ID NO: 2163923 - RNA, 21 nt, Human immunodeficiency virus 1 (HIV-1)
auauaaaguaguaaaaauuga

SEQ ID NO: 2163924 - RNA, 20 nt, Human immunodeficiency virus 1 (HIV-1)
cagaauaaaacaaauuauaa

SEQ ID NO: 2163925 - RNA, 18 nt, Human immunodeficiency virus 1 (HIV-1)
aaguaguacaaggagcuu

SEQ ID NO: 2163926 - RNA, 19 nt, Human immunodeficiency virus 1 (HIV-1)
auuugggguugcucuggaa

SEQ ID NO: 2163927 - RNA, 23 nt, Human immunodeficiency virus 1 (HIV-1)
cgcagggggugggaagcccucaa

SEQ ID NO: 2163928 - RNA, 14 nt, Human immunodeficiency virus 1 (HIV-1)
cugggucucucugg

SEQ ID NO: 2163929 - RNA, 16 nt, Human immunodeficiency virus 1 (HIV-1)
ugggcaaguuugugga

SEQ ID NO: 2163930 - RNA, 16 nt, Human immunodeficiency virus 1 (HIV-1)
cagcuuguuacacccu

SEQ ID NO: 2163931 - RNA, 21 nt, Human immunodeficiency virus 1 (HIV-1)
agcccucaaauauugguggaa

SEQ ID NO: 2163932 - RNA, 16 nt, Human immunodeficiency virus 1 (HIV-1)
cugcugacaucgagcu

SEQ ID NO: 2163933 - RNA, 15 nt, Human immunodeficiency virus 1 (HIV-1)
aaggaguaguagaau

SEQ ID NO: 2163934 - RNA, 14 nt, Human immunodeficiency virus 1 (HIV-1)
cacccugugagccu

SEQ ID NO: 2163935 - RNA, 14 nt, Human immunodeficiency virus 1 (HIV-1)
agcaguagcugagg

SEQ ID NO: 2163936 - RNA, 15 nt, Human immunodeficiency virus 1 (HIV-1)
aaugaacaagaauua

SEQ ID NO: 2163937 - RNA, 16 nt, Human immunodeficiency virus 1 (HIV-1)
agacaguggcaaugag

SEQ ID NO: 2163938 - RNA, 18 nt, Human immunodeficiency virus 1 (HIV-1)
gccucuucagcuaccacc

SEQ ID NO: 2163939 - RNA, 13 nt, Human immunodeficiency virus 1 (HIV-1)
acacuuuaaaaca

SEQ ID NO: 2163940 - RNA, 15 nt, Human immunodeficiency virus 1 (HIV-1)
auauuaagacaaaga

SEQ ID NO: 2163941 - RNA, 21 nt, Human immunodeficiency virus 1 (HIV-1)
agggauuauggaaaacagaug

SEQ ID NO: 2163942 - RNA, 12 nt, Human immunodeficiency virus 1 (HIV-1)
guagaaauuaau

SEQ ID NO: 2163943 - RNA, 12 nt, Human immunodeficiency virus 1 (HIV-1)
uugggagcagca

SEQ ID NO: 2163944 - RNA, 23 nt, Human immunodeficiency virus 1 (HIV-1)
augagggacaauuggagaaguga

SEQ ID NO: 2163945 - RNA, 13 nt, Human immunodeficiency virus 1 (HIV-1)
cugggagcucucu

SEQ ID NO: 2163946 - RNA, 15 nt, Human immunodeficiency virus 1 (HIV-1)
aagagaucaggcuga

SEQ ID NO: 2163947 - RNA, 15 nt, Human immunodeficiency virus 1 (HIV-1)
aaguuuaguaaaaca

SEQ ID NO: 2163948 - RNA, 19 nt, Human immunodeficiency virus 1 (HIV-1)
aauuaggaaaagcaggaua

SEQ ID NO: 2163949 - RNA, 18 nt, Human immunodeficiency virus 1 (HIV-1)
aguacuucaagaacugcu

SEQ ID NO: 2163950 - RNA, 16 nt, Human immunodeficiency virus 1 (HIV-1)
uccggaguacuucaag

SEQ ID NO: 2163951 - RNA, 23 nt, Human immunodeficiency virus 1 (HIV-1)
aaaaguagugugauuggauggcc

SEQ ID NO: 2163952 - RNA, 11 nt, Human immunodeficiency virus 1 (HIV-1)
cgagcccucag

SEQ ID NO: 2163953 - RNA, 22 nt, Human immunodeficiency virus 1 (HIV-1)
uauucgccacauaccuagaaga

SEQ ID NO: 2163954 - RNA, 13 nt, Human immunodeficiency virus 1 (HIV-1)
ccugagugggagu

SEQ ID NO: 2163955 - RNA, 16 nt, Human immunodeficiency virus 1 (HIV-1)
uaaaaaguguugcuuu

SEQ ID NO: 2163956 - RNA, 14 nt, Human immunodeficiency virus 1 (HIV-1)
aauagcaacaauga

SEQ ID NO: 2163957 - RNA, 14 nt, Human immunodeficiency virus 1 (HIV-1)
gcuagcaaauuaag

SEQ ID NO: 2163958 - RNA, 14 nt, Human immunodeficiency virus 1 (HIV-1)
cagagacagaucca

SEQ ID NO: 2163959 - RNA, 16 nt, Human immunodeficiency virus 1 (HIV-1)
acuggcagaaaacaga

SEQ ID NO: 2163960 - RNA, 22 nt, Human immunodeficiency virus 1 (HIV-1)
cuuuccagggaggcguggccug

SEQ ID NO: 2163961 - RNA, 12 nt, Human immunodeficiency virus 1 (HIV-1)
caagaauuauug

SEQ ID NO: 2163962 - RNA, 14 nt, Human immunodeficiency virus 1 (HIV-1)
cgagcugagccagc

SEQ ID NO: 2163963 - RNA, 22 nt, Human immunodeficiency virus 1 (HIV-1)
accagaucugagccugggagcu

SEQ ID NO: 2163964 - RNA, 17 nt, Human immunodeficiency virus 1 (HIV-1)
augagagugaaggagaa

SEQ ID NO: 2163965 - RNA, 12 nt, Human immunodeficiency virus 1 (HIV-1)
cagaagaagagg

SEQ ID NO: 2163966 - RNA, 23 nt, Human immunodeficiency virus 1 (HIV-1)
augcuccuugggauguugaugau

SEQ ID NO: 2163967 - RNA, 20 nt, Human immunodeficiency virus 1 (HIV-1)
cagagaacuuaauaagagaa

SEQ ID NO: 2163968 - RNA, 13 nt, Human immunodeficiency virus 1 (HIV-1)
ccauuuucagaau

SEQ ID NO: 2163969 - RNA, 10 nt, Human immunodeficiency virus 1 (HIV-1)
gacagagaaa

SEQ ID NO: 2163970 - RNA, 22 nt, Human immunodeficiency virus 1 (HIV-1)
acaauuacacaagcuuaauaca

SEQ ID NO: 2163971 - RNA, 18 nt, Human immunodeficiency virus 1 (HIV-1)
cagggggugggaagcccu

SEQ ID NO: 2163972 - RNA, 12 nt, Human immunodeficiency virus 1 (HIV-1)
acacaaugaaug

SEQ ID NO: 2163973 - RNA, 20 nt, Human immunodeficiency virus 1 (HIV-1)
aagaaugagacgagcugagc

SEQ ID NO: 2163974 - RNA, 23 nt, Human immunodeficiency virus 1 (HIV-1)
ucaaauauuacagggcugcuauu

SEQ ID NO: 2163975 - RNA, 15 nt, Human immunodeficiency virus 1 (HIV-1)
agacgagcugagcca

SEQ ID NO: 2163976 - RNA, 23 nt, Human immunodeficiency virus 1 (HIV-1)
aacugcuuguaccaauugcuauu

SEQ ID NO: 2163977 - RNA, 20 nt, Human immunodeficiency virus 1 (HIV-1)
caguauuggagucaggaacu

SEQ ID NO: 2163978 - RNA, 17 nt, Human immunodeficiency virus 1 (HIV-1)
guuacacccugugagcc

SEQ ID NO: 2163979 - RNA, 19 nt, Human immunodeficiency virus 1 (HIV-1)
cuggggaguggcgagcccu

SEQ ID NO: 2163980 - RNA, 21 nt, Human immunodeficiency virus 1 (HIV-1)
ggcuaacuagggaacccacug

SEQ ID NO: 2163981 - RNA, 16 nt, Human immunodeficiency virus 1 (HIV-1)
agcucaucagaacagu

SEQ ID NO: 2163982 - RNA, 19 nt, Human immunodeficiency virus 1 (HIV-1)
aguagugccaagaagaaaa

SEQ ID NO: 2163983 - RNA, 16 nt, Human immunodeficiency virus 1 (HIV-1)
aauaaguucagaagua

SEQ ID NO: 2163984 - RNA, 18 nt, Human immunodeficiency virus 1 (HIV-1)
acagagaaauuaacaauu

SEQ ID NO: 2163985 - RNA, 13 nt, Human immunodeficiency virus 1 (HIV-1)
uagugcagcagca

SEQ ID NO: 2163986 - RNA, 18 nt, Human immunodeficiency virus 1 (HIV-1)
guacugggucucucuggu

SEQ ID NO: 2163987 - RNA, 23 nt, Human immunodeficiency virus 1 (HIV-1)
gaauaggcguuacucgacagagg

SEQ ID NO: 2163988 - RNA, 16 nt, Human immunodeficiency virus 1 (HIV-1)
cagggcuuggaaagga

SEQ ID NO: 2163989 - RNA, 17 nt, Human immunodeficiency virus 1 (HIV-1)
aaauuuguacagagaug

SEQ ID NO: 2163990 - RNA, 17 nt, Human immunodeficiency virus 1 (HIV-1)
uagagcuauucgccaca

SEQ ID NO: 2163991 - RNA, 20 nt, Human immunodeficiency virus 1 (HIV-1)
agaauucugcaacaacugcu

SEQ ID NO: 2163992 - RNA, 19 nt, Human immunodeficiency virus 1 (HIV-1)
uguacagagauggaaaagg

SEQ ID NO: 2163993 - RNA, 15 nt, Human immunodeficiency virus 1 (HIV-1)
agaaaagaaugaaca

SEQ ID NO: 2163994 - RNA, 18 nt, Human immunodeficiency virus 1 (HIV-1)
aaauuaaagccaggaaug

SEQ ID NO: 2163995 - RNA, 22 nt, Human immunodeficiency virus 1 (HIV-1)
uggggaguggcgagcccucaga

SEQ ID NO: 2163996 - RNA, 16 nt, Human immunodeficiency virus 1 (HIV-1)
acauaccuagaagaau

SEQ ID NO: 2163997 - RNA, 16 nt, Human immunodeficiency virus 1 (HIV-1)
acgaucugcggagccu

SEQ ID NO: 2163998 - RNA, 15 nt, Human immunodeficiency virus 1 (HIV-1)
agaucugagccuggg

SEQ ID NO: 2163999 - RNA, 18 nt, Human immunodeficiency virus 1 (HIV-1)
caaugagagugaaggaga

SEQ ID NO: 2164000 - RNA, 19 nt, Human immunodeficiency virus 1 (HIV-1)
acaguggcaaugagaguga

SEQ ID NO: 2164001 - RNA, 13 nt, Human immunodeficiency virus 1 (HIV-1)
ccugggcgggacu

SEQ ID NO: 2164002 - RNA, 22 nt, Human immunodeficiency virus 1 (HIV-1)
uagcaguagcugaggggacaga

SEQ ID NO: 2164003 - RNA, 16 nt, Human immunodeficiency virus 1 (HIV-1)
augcuaguuggaguaa

SEQ ID NO: 2164004 - RNA, 14 nt, Human immunodeficiency virus 1 (HIV-1)
acaggagcagauga

SEQ ID NO: 2164005 - RNA, 19 nt, Human immunodeficiency virus 1 (HIV-1)
caguggacaaauuagaugu

SEQ ID NO: 2164006 - RNA, 12 nt, Human immunodeficiency virus 1 (HIV-1)
cacaagaggagg

SEQ ID NO: 2164007 - RNA, 14 nt, Human immunodeficiency virus 1 (HIV-1)
gcagaauaaaacaa

SEQ ID NO: 2164008 - RNA, 16 nt, Human immunodeficiency virus 1 (HIV-1)
aaaguaagacaguaug

SEQ ID NO: 2164009 - RNA, 16 nt, Human immunodeficiency virus 1 (HIV-1)
aaaggauuuugcuaua

SEQ ID NO: 2164010 - RNA, 13 nt, Human immunodeficiency virus 1 (HIV-1)
caguugagccaga

SEQ ID NO: 2164011 - RNA, 20 nt, Human immunodeficiency virus 1 (HIV-1)
ucaaugccacagccauagca

SEQ ID NO: 2164012 - RNA, 14 nt, Human immunodeficiency virus 1 (HIV-1)
caacaauacaagaa

SEQ ID NO: 2164013 - RNA, 16 nt, Human immunodeficiency virus 1 (HIV-1)
gaagacuucaggaagu

SEQ ID NO: 2164014 - RNA, 20 nt, Human immunodeficiency virus 1 (HIV-1)
aauagacagguuaauugaua

SEQ ID NO: 2164015 - RNA, 13 nt, Human immunodeficiency virus 1 (HIV-1)
cugagccagcagc

SEQ ID NO: 2164016 - RNA, 15 nt, Human immunodeficiency virus 1 (HIV-1)
caucaagcagcucca

SEQ ID NO: 2164017 - RNA, 19 nt, Human immunodeficiency virus 1 (HIV-1)
aaguaguauugguaaaugu

SEQ ID NO: 2164018 - RNA, 15 nt, Human immunodeficiency virus 1 (HIV-1)
uaacaauuacacaag

SEQ ID NO: 2164019 - RNA, 11 nt, Human immunodeficiency virus 1 (HIV-1)
gcaccacugcu

SEQ ID NO: 2164020 - RNA, 17 nt, Human immunodeficiency virus 1 (HIV-1)
uaaaauuagcaggaaga

SEQ ID NO: 2164021 - RNA, 14 nt, Human immunodeficiency virus 1 (HIV-1)
caauagauaaugau

SEQ ID NO: 2164022 - RNA, 16 nt, Human immunodeficiency virus 1 (HIV-1)
aauuauucauaaugau

SEQ ID NO: 2164023 - RNA, 15 nt, Human immunodeficiency virus 1 (HIV-1)
cagggaggcguggcc

SEQ ID NO: 2164024 - RNA, 20 nt, Human immunodeficiency virus 1 (HIV-1)
ucagguaccuuuaagaccaa

SEQ ID NO: 2164025 - RNA, 16 nt, Human immunodeficiency virus 1 (HIV-1)
gaauaaguucagaagu

SEQ ID NO: 2164026 - RNA, 14 nt, Human immunodeficiency virus 1 (HIV-1)
agauucuaaaagaa

SEQ ID NO: 2164027 - RNA, 20 nt, Human immunodeficiency virus 1 (HIV-1)
cagggaggcguggccugggc

SEQ ID NO: 2164028 - RNA, 16 nt, Human immunodeficiency virus 1 (HIV-1)
gauggggcaccaugcu

SEQ ID NO: 2164029 - RNA, 18 nt, Human immunodeficiency virus 1 (HIV-1)
aguugucacccuaacuga

SEQ ID NO: 2164030 - RNA, 15 nt, Human immunodeficiency virus 1 (HIV-1)
ugcugcuugugccug

SEQ ID NO: 2164031 - RNA, 18 nt, Human immunodeficiency virus 1 (HIV-1)
agaacagaugcaugagga

SEQ ID NO: 2164032 - RNA, 13 nt, Human immunodeficiency virus 1 (HIV-1)
gagagauaaaaaa

SEQ ID NO: 2164033 - RNA, 13 nt, Human immunodeficiency virus 1 (HIV-1)
agaccuggaggag

SEQ ID NO: 2164034 - RNA, 21 nt, Human immunodeficiency virus 1 (HIV-1)
cugggacgaucugcggagccu

SEQ ID NO: 2164035 - RNA, 20 nt, Human immunodeficiency virus 1 (HIV-1)
aagaauaguagacauaauag

SEQ ID NO: 2164036 - RNA, 13 nt, Human immunodeficiency virus 1 (HIV-1)
cagaucugagccu

SEQ ID NO: 2164037 - RNA, 12 nt, Human immunodeficiency virus 1 (HIV-1)
caccagcaauau

SEQ ID NO: 2164038 - RNA, 16 nt, Human immunodeficiency virus 1 (HIV-1)
ugcagcagcagaacaa

SEQ ID NO: 2164039 - RNA, 23 nt, Human immunodeficiency virus 1 (HIV-1)
aagcauaagagguaaggugcaga

SEQ ID NO: 2164040 - RNA, 9 nt, Human immunodeficiency virus 1 (HIV-1)
ggggggacu

SEQ ID NO: 2164041 - RNA, 22 nt, Human immunodeficiency virus 1 (HIV-1)
uccagagaggaccagggagagc

SEQ ID NO: 2164042 - RNA, 17 nt, Human immunodeficiency virus 1 (HIV-1)
agaaguaguacaaggag

SEQ ID NO: 2164043 - RNA, 17 nt, Human immunodeficiency virus 1 (HIV-1)
aaaauaaccacagaaag

SEQ ID NO: 2164044 - RNA, 18 nt, Human immunodeficiency virus 1 (HIV-1)
agcacuaacagaaguaau

SEQ ID NO: 2164045 - RNA, 20 nt, Human immunodeficiency virus 1 (HIV-1)
uuacucgacagaggagagca

SEQ ID NO: 2164046 - RNA, 21 nt, Human immunodeficiency virus 1 (HIV-1)
gcuauugaggcgcaacagcau

SEQ ID NO: 2164047 - RNA, 18 nt, Human immunodeficiency virus 1 (HIV-1)
aguaaacauaguaacaga

SEQ ID NO: 2164048 - RNA, 19 nt, Human immunodeficiency virus 1 (HIV-1)
agacagggcuuggaaagga

SEQ ID NO: 2164049 - RNA, 12 nt, Human immunodeficiency virus 1 (HIV-1)
cagggacagcag

SEQ ID NO: 2164050 - RNA, 19 nt, Human immunodeficiency virus 1 (HIV-1)
uaagaauaguuuuugcugu

SEQ ID NO: 2164051 - RNA, 22 nt, Human immunodeficiency virus 1 (HIV-1)
aaucuuagagccuuuuagaaaa

SEQ ID NO: 2164052 - RNA, 13 nt, Human immunodeficiency virus 1 (HIV-1)
aggcguggccugg

SEQ ID NO: 2164053 - RNA, 14 nt, Human immunodeficiency virus 1 (HIV-1)
cugagccugggagc

SEQ ID NO: 2164054 - RNA, 20 nt, Human immunodeficiency virus 1 (HIV-1)
cagacauacaaacuaaagaa

SEQ ID NO: 2164055 - RNA, 21 nt, Human immunodeficiency virus 1 (HIV-1)
caggaagaagcggagacagcg

SEQ ID NO: 2164056 - RNA, 19 nt, Human immunodeficiency virus 1 (HIV-1)
aagcuugccuugagugcuu

SEQ ID NO: 2164057 - RNA, 12 nt, Human immunodeficiency virus 1 (HIV-1)
cugcuuaagccu

SEQ ID NO: 2164058 - RNA, 14 nt, Human immunodeficiency virus 1 (HIV-1)
cugcuauuaacaag

SEQ ID NO: 2164059 - RNA, 22 nt, Human immunodeficiency virus 1 (HIV-1)
aagcaguaaguaguacauguaa

SEQ ID NO: 2164060 - RNA, 16 nt, Human immunodeficiency virus 1 (HIV-1)
acaaucacccucccau

SEQ ID NO: 2164061 - RNA, 21 nt, Human immunodeficiency virus 1 (HIV-1)
guaccaguugagccagauaag

SEQ ID NO: 2164062 - RNA, 23 nt, Human immunodeficiency virus 1 (HIV-1)
acuuuggaaaggaccagcaaagc

SEQ ID NO: 2164063 - RNA, 16 nt, Human immunodeficiency virus 1 (HIV-1)
cacaauuuuaaaagaa

SEQ ID NO: 2164064 - RNA, 15 nt, Human immunodeficiency virus 1 (HIV-1)
auuaagagaacaauu

SEQ ID NO: 2164065 - RNA, 15 nt, Human immunodeficiency virus 1 (HIV-1)
augauaauggagaaa

SEQ ID NO: 2164066 - RNA, 24 nt, Human immunodeficiency virus 1 (HIV-1)
caggaguggaagccauaauaagaa

SEQ ID NO: 2164067 - RNA, 12 nt, Human immunodeficiency virus 1 (HIV-1)
ggacagauaggg

SEQ ID NO: 2164068 - RNA, 22 nt, Human immunodeficiency virus 1 (HIV-1)
acagacauacaaacuaaagaau

SEQ ID NO: 2164069 - RNA, 17 nt, Human immunodeficiency virus 1 (HIV-1)
acauaccuagaagaaua

SEQ ID NO: 2164070 - RNA, 21 nt, Human immunodeficiency virus 1 (HIV-1)
uagaaaucuguggacauaaag

SEQ ID NO: 2164071 - RNA, 22 nt, Human immunodeficiency virus 1 (HIV-1)
uacacuccuuaauugaagaauc

SEQ ID NO: 2164072 - RNA, 14 nt, Human immunodeficiency virus 1 (HIV-1)
aaggcagcuguaga

SEQ ID NO: 2164073 - RNA, 23 nt, Human immunodeficiency virus 1 (HIV-1)
aguccgagaucuucagaccugga

SEQ ID NO: 2164074 - RNA, 14 nt, Human immunodeficiency virus 1 (HIV-1)
caauuuuaaaagaa

SEQ ID NO: 2164075 - RNA, 17 nt, Human immunodeficiency virus 1 (HIV-1)
gaaguaguacaaggagc

SEQ ID NO: 2164076 - RNA, 19 nt, Human immunodeficiency virus 1 (HIV-1)
uggaacagauuuggaauca

SEQ ID NO: 2164077 - RNA, 18 nt, Human immunodeficiency virus 1 (HIV-1)
uacaagacccaacaacaa

SEQ ID NO: 2164078 - RNA, 16 nt, Human immunodeficiency virus 1 (HIV-1)
aaucuguggacauaaa

SEQ ID NO: 2164079 - RNA, 18 nt, Human immunodeficiency virus 1 (HIV-1)
agcaggacauaacaaggu

SEQ ID NO: 2164080 - RNA, 13 nt, Human immunodeficiency virus 1 (HIV-1)
gacaccagggauu

SEQ ID NO: 2164081 - RNA, 12 nt, Human immunodeficiency virus 1 (HIV-1)
gagaacaccagc

SEQ ID NO: 2164082 - RNA, 12 nt, Human immunodeficiency virus 1 (HIV-1)
acagggagacua

SEQ ID NO: 2164083 - RNA, 19 nt, Human immunodeficiency virus 1 (HIV-1)
gagccagcagcagauaggg

SEQ ID NO: 2164084 - RNA, 21 nt, Human immunodeficiency virus 1 (HIV-1)
cagacucugcuauaagaaagg

SEQ ID NO: 2164085 - RNA, 14 nt, Human immunodeficiency virus 1 (HIV-1)
gcaggggaaagaau

SEQ ID NO: 2164086 - RNA, 22 nt, Human immunodeficiency virus 1 (HIV-1)
ggaaggaagcaaccaccacucu

SEQ ID NO: 2164087 - RNA, 11 nt, Human immunodeficiency virus 1 (HIV-1)
uuaggaaaagc

SEQ ID NO: 2164088 - RNA, 22 nt, Human immunodeficiency virus 1 (HIV-1)
ucugagccugggagcucucugg

SEQ ID NO: 2164089 - RNA, 17 nt, Human immunodeficiency virus 1 (HIV-1)
acagagaaauuaacaau

SEQ ID NO: 2164090 - RNA, 16 nt, Human immunodeficiency virus 1 (HIV-1)
aaaauaaccacagaaa

SEQ ID NO: 2164091 - RNA, 17 nt, Human immunodeficiency virus 1 (HIV-1)
cacaaucacccucccau

SEQ ID NO: 2164092 - RNA, 15 nt, Human immunodeficiency virus 1 (HIV-1)
guaauaccacuaaca

SEQ ID NO: 2164093 - RNA, 20 nt, Human immunodeficiency virus 1 (HIV-1)
aaaugucagcuaaaaggaga

SEQ ID NO: 2164094 - RNA, 14 nt, Human immunodeficiency virus 1 (HIV-1)
uagggugggagcag

SEQ ID NO: 2164095 - RNA, 14 nt, Human immunodeficiency virus 1 (HIV-1)
acaguuuuaauugu

SEQ ID NO: 2164096 - RNA, 21 nt, Human immunodeficiency virus 1 (HIV-1)
acaaucacccucccaugcaga

SEQ ID NO: 2164097 - RNA, 11 nt, Human immunodeficiency virus 1 (HIV-1)
ugccaggaaga

SEQ ID NO: 2164098 - RNA, 13 nt, Human immunodeficiency virus 1 (HIV-1)
caggaagaagcgg

SEQ ID NO: 2164099 - RNA, 11 nt, Human immunodeficiency virus 1 (HIV-1)
ugggaagcccu

SEQ ID NO: 2164100 - RNA, 21 nt, Human immunodeficiency virus 1 (HIV-1)
agcagaacuacacaccagggc

SEQ ID NO: 2164101 - RNA, 21 nt, Human immunodeficiency virus 1 (HIV-1)
cugaacaucuuaagacagcag

SEQ ID NO: 2164102 - RNA, 20 nt, Human immunodeficiency virus 1 (HIV-1)
gagccugggagcucucuggc

SEQ ID NO: 2164103 - RNA, 14 nt, Human immunodeficiency virus 1 (HIV-1)
gaaacugacagagg

SEQ ID NO: 2164104 - RNA, 13 nt, Human immunodeficiency virus 1 (HIV-1)
auuugaagaauga

SEQ ID NO: 2164105 - RNA, 23 nt, Human immunodeficiency virus 1 (HIV-1)
ccagcuuguuacacccugugagc

SEQ ID NO: 2164106 - RNA, 16 nt, Human immunodeficiency virus 1 (HIV-1)
auagaauggaggaaaa

SEQ ID NO: 2164107 - RNA, 18 nt, Human immunodeficiency virus 1 (HIV-1)
cagacucugcuauaagaa

SEQ ID NO: 2164108 - RNA, 20 nt, Human immunodeficiency virus 1 (HIV-1)
uacaggccagacaauuauug

SEQ ID NO: 2164109 - RNA, 18 nt, Human immunodeficiency virus 1 (HIV-1)
cugagccugggagcucuc

SEQ ID NO: 2164110 - RNA, 20 nt, Human immunodeficiency virus 1 (HIV-1)
aauaccaauagauaaugaua

SEQ ID NO: 2164111 - RNA, 21 nt, Human immunodeficiency virus 1 (HIV-1)
ugcagagagaaaaaagagcag

SEQ ID NO: 2164112 - RNA, 15 nt, Human immunodeficiency virus 1 (HIV-1)
aacugacagaggaua

SEQ ID NO: 2164113 - RNA, 23 nt, Human immunodeficiency virus 1 (HIV-1)
ccagcaagaaaagaaugaacaag

SEQ ID NO: 2164114 - RNA, 14 nt, Human immunodeficiency virus 1 (HIV-1)
aaauuagcaggaag

SEQ ID NO: 2164115 - RNA, 17 nt, Human immunodeficiency virus 1 (HIV-1)
ggagagagagacagaga

SEQ ID NO: 2164116 - RNA, 13 nt, Human immunodeficiency virus 1 (HIV-1)
auucauaaugaua

SEQ ID NO: 2164117 - RNA, 12 nt, Human immunodeficiency virus 1 (HIV-1)
gagcagcaucuc

SEQ ID NO: 2164118 - RNA, 15 nt, Human immunodeficiency virus 1 (HIV-1)
cuggggcaucaagca

SEQ ID NO: 2164119 - RNA, 19 nt, Human immunodeficiency virus 1 (HIV-1)
agugugauuggauggccua

SEQ ID NO: 2164120 - RNA, 22 nt, Human immunodeficiency virus 1 (HIV-1)
gaaaaggggggacuggaagggc

SEQ ID NO: 2164121 - RNA, 15 nt, Human immunodeficiency virus 1 (HIV-1)
aacauggagcaauca

SEQ ID NO: 2164122 - RNA, 20 nt, Human immunodeficiency virus 1 (HIV-1)
gaacaucuuaagacagcagu

SEQ ID NO: 2164123 - RNA, 14 nt, Human immunodeficiency virus 1 (HIV-1)
agcuaguaccaguu

SEQ ID NO: 2164124 - RNA, 13 nt, Human immunodeficiency virus 1 (HIV-1)
auaauagcaauag

SEQ ID NO: 2164125 - RNA, 17 nt, Human immunodeficiency virus 1 (HIV-1)
aguacuucaagaacugc

SEQ ID NO: 2164126 - RNA, 14 nt, Human immunodeficiency virus 1 (HIV-1)
cagcaagaaaagaa

SEQ ID NO: 2164127 - RNA, 16 nt, Human immunodeficiency virus 1 (HIV-1)
uaauucaacacaacug

SEQ ID NO: 2164128 - RNA, 14 nt, Human immunodeficiency virus 1 (HIV-1)
acuuuaaaacagau

SEQ ID NO: 2164129 - RNA, 14 nt, Human immunodeficiency virus 1 (HIV-1)
auacaaaaggaaac

SEQ ID NO: 2164130 - RNA, 22 nt, Human immunodeficiency virus 1 (HIV-1)
aaacaauggccauugacagaag

SEQ ID NO: 2164131 - RNA, 19 nt, Human immunodeficiency virus 1 (HIV-1)
agaagaggccaauaaagga

SEQ ID NO: 2164132 - RNA, 18 nt, Human immunodeficiency virus 1 (HIV-1)
ugugcuuccacagggaug

SEQ ID NO: 2164133 - RNA, 17 nt, Human immunodeficiency virus 1 (HIV-1)
aguaccaguugagccag

SEQ ID NO: 2164134 - RNA, 16 nt, Human immunodeficiency virus 1 (HIV-1)
aauuguggaggggaau

SEQ ID NO: 2164135 - RNA, 17 nt, Human immunodeficiency virus 1 (HIV-1)
caaggcaaagagaagag

SEQ ID NO: 2164136 - RNA, 10 nt, Human immunodeficiency virus 1 (HIV-1)
cuucugggac

SEQ ID NO: 2164137 - RNA, 16 nt, Human immunodeficiency virus 1 (HIV-1)
uagcaauacagcagcu

SEQ ID NO: 2164138 - RNA, 23 nt, Human immunodeficiency virus 1 (HIV-1)
aauucacucccaaagaagacaag

SEQ ID NO: 2164139 - RNA, 13 nt, Human immunodeficiency virus 1 (HIV-1)
agcugaggggaca

SEQ ID NO: 2164140 - RNA, 14 nt, Human immunodeficiency virus 1 (HIV-1)
aucaagcaggaauu

SEQ ID NO: 2164141 - RNA, 22 nt, Human immunodeficiency virus 1 (HIV-1)
augcagaauaaaacaaauuaua

SEQ ID NO: 2164142 - RNA, 23 nt, Human immunodeficiency virus 1 (HIV-1)
ugagccugcaugggauggaugac

SEQ ID NO: 2164143 - RNA, 15 nt, Human immunodeficiency virus 1 (HIV-1)
aaauaugcaagaaug

SEQ ID NO: 2164144 - RNA, 19 nt, Human immunodeficiency virus 1 (HIV-1)
caguauuugccauaaagaa

SEQ ID NO: 2164145 - RNA, 14 nt, Human immunodeficiency virus 1 (HIV-1)
aggcguggccuggg

SEQ ID NO: 2164146 - RNA, 17 nt, Human immunodeficiency virus 1 (HIV-1)
ggagcagcaggaagcac

SEQ ID NO: 2164147 - RNA, 18 nt, Human immunodeficiency virus 1 (HIV-1)
accaaugacuuacaaggc

SEQ ID NO: 2164148 - RNA, 23 nt, Human immunodeficiency virus 1 (HIV-1)
gcacccaccaaggcaaagagaag

SEQ ID NO: 2164149 - RNA, 21 nt, Human immunodeficiency virus 1 (HIV-1)
cauuagcccuauugagacugu

SEQ ID NO: 2164150 - RNA, 16 nt, Human immunodeficiency virus 1 (HIV-1)
aucagaugcuaaagca

SEQ ID NO: 2164151 - RNA, 12 nt, Human immunodeficiency virus 1 (HIV-1)
cagaaauuguaa

SEQ ID NO: 2164152 - RNA, 10 nt, Human immunodeficiency virus 1 (HIV-1)
aagcccucaa

SEQ ID NO: 2164153 - RNA, 16 nt, Human immunodeficiency virus 1 (HIV-1)
uagcacccaccaaggc

SEQ ID NO: 2164154 - RNA, 21 nt, Human immunodeficiency virus 1 (HIV-1)
gcaucuccuauggcaggaaga

SEQ ID NO: 2164155 - RNA, 22 nt, Human immunodeficiency virus 1 (HIV-1)
aauuaugguaccaguuagagaa

SEQ ID NO: 2164156 - RNA, 15 nt, Human immunodeficiency virus 1 (HIV-1)
aaggaauagaagaag

SEQ ID NO: 2164157 - RNA, 20 nt, Human immunodeficiency virus 1 (HIV-1)
uugucugguauagugcagca

SEQ ID NO: 2164158 - RNA, 15 nt, Human immunodeficiency virus 1 (HIV-1)
aauuauauaaauaua

SEQ ID NO: 2164159 - RNA, 20 nt, Human immunodeficiency virus 1 (HIV-1)
uacuguaagggaaagaauga

SEQ ID NO: 2164160 - RNA, 15 nt, Human immunodeficiency virus 1 (HIV-1)
uaccacacacaaggc

SEQ ID NO: 2164161 - RNA, 18 nt, Human immunodeficiency virus 1 (HIV-1)
cagccuaaaacugcuugu

SEQ ID NO: 2164162 - RNA, 20 nt, Human immunodeficiency virus 1 (HIV-1)
agggcugcuauuaacaagag

SEQ ID NO: 2164163 - RNA, 17 nt, Human immunodeficiency virus 1 (HIV-1)
augcagaauaaaacaaa

SEQ ID NO: 2164164 - RNA, 14 nt, Human immunodeficiency virus 1 (HIV-1)
gagcaaucacaagu

SEQ ID NO: 2164165 - RNA, 18 nt, Human immunodeficiency virus 1 (HIV-1)
cuguagaaauuaauugua

SEQ ID NO: 2164166 - RNA, 19 nt, Human immunodeficiency virus 1 (HIV-1)
aauaucagcacaagcauaa

SEQ ID NO: 2164167 - RNA, 19 nt, Human immunodeficiency virus 1 (HIV-1)
cuuggcacuuaucugggac

SEQ ID NO: 2164168 - RNA, 23 nt, Human immunodeficiency virus 1 (HIV-1)
agugccaagaagaaaagcaaaga

SEQ ID NO: 2164169 - RNA, 23 nt, Human immunodeficiency virus 1 (HIV-1)
aauuacaaaaacaaauuacaaaa

SEQ ID NO: 2164170 - RNA, 22 nt, Human immunodeficiency virus 1 (HIV-1)
guccaaagguauccuuugagcc

SEQ ID NO: 2164171 - RNA, 17 nt, Human immunodeficiency virus 1 (HIV-1)
gagcccucagauccugc

SEQ ID NO: 2164172 - RNA, 16 nt, Human immunodeficiency virus 1 (HIV-1)
gacccggagagagaag

SEQ ID NO: 2164173 - RNA, 17 nt, Human immunodeficiency virus 1 (HIV-1)
uacagcagcuaccaaug

SEQ ID NO: 2164174 - RNA, 13 nt, Human immunodeficiency virus 1 (HIV-1)
agaaaaauugugg

SEQ ID NO: 2164175 - RNA, 21 nt, Human immunodeficiency virus 1 (HIV-1)
cagucuagcagaagaagaggu

SEQ ID NO: 2164176 - RNA, 15 nt, Human immunodeficiency virus 1 (HIV-1)
gucagauauccacug

SEQ ID NO: 2164177 - RNA, 21 nt, Human immunodeficiency virus 1 (HIV-1)
gggacgaucugcggagccugu

SEQ ID NO: 2164178 - RNA, 21 nt, Human immunodeficiency virus 1 (HIV-1)
auaaaauuauucauaaugaua

SEQ ID NO: 2164179 - RNA, 13 nt, Human immunodeficiency virus 1 (HIV-1)
uggaaaacucauu

SEQ ID NO: 2164180 - RNA, 16 nt, Human immunodeficiency virus 1 (HIV-1)
caguauuggagucagg

SEQ ID NO: 2164181 - RNA, 13 nt, Human immunodeficiency virus 1 (HIV-1)
caggguuaaaaaa

SEQ ID NO: 2164182 - RNA, 16 nt, Human immunodeficiency virus 1 (HIV-1)
auagaauauaggaaaa

SEQ ID NO: 2164183 - RNA, 18 nt, Human immunodeficiency virus 1 (HIV-1)
agugggacagagaaauua

SEQ ID NO: 2164184 - RNA, 20 nt, Human immunodeficiency virus 1 (HIV-1)
acugucaaugacauacagaa

SEQ ID NO: 2164185 - RNA, 18 nt, Human immunodeficiency virus 1 (HIV-1)
acgcagggggugggaagc

SEQ ID NO: 2164186 - RNA, 17 nt, Human immunodeficiency virus 1 (HIV-1)
gcaagaauccuggcugu

SEQ ID NO: 2164187 - RNA, 13 nt, Human immunodeficiency virus 1 (HIV-1)
uuacccagggauu

SEQ ID NO: 2164188 - RNA, 18 nt, Human immunodeficiency virus 1 (HIV-1)
acaggagaaagagacugg

SEQ ID NO: 2164189 - RNA, 15 nt, Human immunodeficiency virus 1 (HIV-1)
caauaguagcaauag

SEQ ID NO: 2164190 - RNA, 12 nt, Human immunodeficiency virus 1 (HIV-1)
gggacuggaagg

SEQ ID NO: 2164191 - RNA, 16 nt, Human immunodeficiency virus 1 (HIV-1)
uggcccgagagcugca

SEQ ID NO: 2164192 - RNA, 15 nt, Human immunodeficiency virus 1 (HIV-1)
acaagccccagaaga

SEQ ID NO: 2164193 - RNA, 15 nt, Human immunodeficiency virus 1 (HIV-1)
cuguacugggucucu

SEQ ID NO: 2164194 - RNA, 13 nt, Human immunodeficiency virus 1 (HIV-1)
acuaauagaaaga

SEQ ID NO: 2164195 - RNA, 20 nt, Human immunodeficiency virus 1 (HIV-1)
ucucugguuagaccagaucu

SEQ ID NO: 2164196 - RNA, 21 nt, Human immunodeficiency virus 1 (HIV-1)
uccuuggguucuugggagcag

SEQ ID NO: 2164197 - RNA, 18 nt, Human immunodeficiency virus 1 (HIV-1)
aguagugccaagaagaaa

SEQ ID NO: 2164198 - RNA, 15 nt, Human immunodeficiency virus 1 (HIV-1)
agggauuauggaaaa

SEQ ID NO: 2164199 - RNA, 13 nt, Human immunodeficiency virus 1 (HIV-1)
ccagggagagcau

SEQ ID NO: 2164200 - RNA, 21 nt, Human immunodeficiency virus 1 (HIV-1)
acugaaggaagugacacaauc

SEQ ID NO: 2164201 - RNA, 14 nt, Human immunodeficiency virus 1 (HIV-1)
guaccaguugagcc

SEQ ID NO: 2164202 - RNA, 21 nt, Human immunodeficiency virus 1 (HIV-1)
uagaccagaucugagccuggg

SEQ ID NO: 2164203 - RNA, 13 nt, Human immunodeficiency virus 1 (HIV-1)
aucaacagcuccu

SEQ ID NO: 2164204 - RNA, 15 nt, Human immunodeficiency virus 1 (HIV-1)
aaccccgaggggacc

SEQ ID NO: 2164205 - RNA, 14 nt, Human immunodeficiency virus 1 (HIV-1)
agcucaucagaaca

SEQ ID NO: 2164206 - RNA, 14 nt, Human immunodeficiency virus 1 (HIV-1)
cccauaguaggagc

SEQ ID NO: 2164207 - RNA, 22 nt, Human immunodeficiency virus 1 (HIV-1)
aaauuaggaaaagcaggauaug

SEQ ID NO: 2164208 - RNA, 23 nt, Human immunodeficiency virus 1 (HIV-1)
aguccaggaauauggcaacuaga

SEQ ID NO: 2164209 - RNA, 20 nt, Human immunodeficiency virus 1 (HIV-1)
accagcuauaaguugacaag

SEQ ID NO: 2164210 - RNA, 17 nt, Human immunodeficiency virus 1 (HIV-1)
agacauacaaacuaaag

SEQ ID NO: 2164211 - RNA, 19 nt, Human immunodeficiency virus 1 (HIV-1)
agcaaauuaagagaacaau

SEQ ID NO: 2164212 - RNA, 13 nt, Human immunodeficiency virus 1 (HIV-1)
auggaaaacagau

SEQ ID NO: 2164213 - RNA, 13 nt, Human immunodeficiency virus 1 (HIV-1)
caagcauaagagg

SEQ ID NO: 2164214 - RNA, 13 nt, Human immunodeficiency virus 1 (HIV-1)
cagaggagagcaa

SEQ ID NO: 2164215 - RNA, 14 nt, Human immunodeficiency virus 1 (HIV-1)
auuuucagaauugg

SEQ ID NO: 2164216 - RNA, 12 nt, Human immunodeficiency virus 1 (HIV-1)
ugccccucccau

SEQ ID NO: 2164217 - RNA, 15 nt, Human immunodeficiency virus 1 (HIV-1)
agcacaagcauaaga

SEQ ID NO: 2164218 - RNA, 15 nt, Human immunodeficiency virus 1 (HIV-1)
uacaauguacacaug

SEQ ID NO: 2164219 - RNA, 23 nt, Human immunodeficiency virus 1 (HIV-1)
cagcagcuaccaaugcugcuugu

SEQ ID NO: 2164220 - RNA, 23 nt, Human immunodeficiency virus 1 (HIV-1)
uaggaaaauauuaagacaaagaa

SEQ ID NO: 2164221 - RNA, 14 nt, Human immunodeficiency virus 1 (HIV-1)
aucaagcagcucca

SEQ ID NO: 2164222 - RNA, 17 nt, Human immunodeficiency virus 1 (HIV-1)
agggacaauuggagaag

SEQ ID NO: 2164223 - RNA, 14 nt, Human immunodeficiency virus 1 (HIV-1)
cagagaggaccagg

SEQ ID NO: 2164224 - RNA, 13 nt, Human immunodeficiency virus 1 (HIV-1)
ccuggcuagaagc

SEQ ID NO: 2164225 - RNA, 19 nt, Human immunodeficiency virus 1 (HIV-1)
gugggacagagaaauuaac

SEQ ID NO: 2164226 - RNA, 21 nt, Human immunodeficiency virus 1 (HIV-1)
gaacccacugcuuaagccuca

SEQ ID NO: 2164227 - RNA, 22 nt, Human immunodeficiency virus 1 (HIV-1)
uagaggaaccaaagcacuaaca

SEQ ID NO: 2164228 - RNA, 22 nt, Human immunodeficiency virus 1 (HIV-1)
cuuaauacacuccuuaauugaa

SEQ ID NO: 2164229 - RNA, 18 nt, Human immunodeficiency virus 1 (HIV-1)
agucaggaacuaaagaau

SEQ ID NO: 2164230 - RNA, 17 nt, Human immunodeficiency virus 1 (HIV-1)
cagauagggugggagca

SEQ ID NO: 2164231 - RNA, 15 nt, Human immunodeficiency virus 1 (HIV-1)
gacaauggcagcaau

SEQ ID NO: 2164232 - RNA, 21 nt, Human immunodeficiency virus 1 (HIV-1)
caaugcugcuugugccuggcu

SEQ ID NO: 2164233 - RNA, 23 nt, Human immunodeficiency virus 1 (HIV-1)
acaauggccauugacagaagaaa

SEQ ID NO: 2164234 - RNA, 13 nt, Human immunodeficiency virus 1 (HIV-1)
ugagccagcagca

SEQ ID NO: 2164235 - RNA, 21 nt, Human immunodeficiency virus 1 (HIV-1)
gaacuacacaccagggccagg

SEQ ID NO: 2164236 - RNA, 19 nt, Human immunodeficiency virus 1 (HIV-1)
acagaaaauuuuaacaugu

SEQ ID NO: 2164237 - RNA, 13 nt, Human immunodeficiency virus 1 (HIV-1)
agcuuaagaauga

SEQ ID NO: 2164238 - RNA, 16 nt, Human immunodeficiency virus 1 (HIV-1)
uagaacauggaaaagu

SEQ ID NO: 2164239 - RNA, 19 nt, Human immunodeficiency virus 1 (HIV-1)
gaguaauaaaucucuggaa

SEQ ID NO: 2164240 - RNA, 14 nt, Human immunodeficiency virus 1 (HIV-1)
guggaucuaccaca

SEQ ID NO: 2164241 - RNA, 15 nt, Human immunodeficiency virus 1 (HIV-1)
aagcacaagaggagg

SEQ ID NO: 2164242 - RNA, 19 nt, Human immunodeficiency virus 1 (HIV-1)
agcaauacagcagcuacca

SEQ ID NO: 2164243 - RNA, 17 nt, Human immunodeficiency virus 1 (HIV-1)
auaggguuauagaagua

SEQ ID NO: 2164244 - RNA, 18 nt, Human immunodeficiency virus 1 (HIV-1)
cagaucugagccugggag

SEQ ID NO: 2164245 - RNA, 14 nt, Human immunodeficiency virus 1 (HIV-1)
auauccacugaccu

SEQ ID NO: 2164246 - RNA, 18 nt, Human immunodeficiency virus 1 (HIV-1)
gaauccguauccagagag

SEQ ID NO: 2164247 - RNA, 19 nt, Human immunodeficiency virus 1 (HIV-1)
uaaacugcccauacaaaag

SEQ ID NO: 2164248 - RNA, 16 nt, Human immunodeficiency virus 1 (HIV-1)
ccugggagcucucugg

SEQ ID NO: 2164249 - RNA, 21 nt, Human immunodeficiency virus 1 (HIV-1)
uagcagaccaacuaauucauc

SEQ ID NO: 2164250 - RNA, 13 nt, Human immunodeficiency virus 1 (HIV-1)
uuugacagccgcc

SEQ ID NO: 2164251 - RNA, 19 nt, Human immunodeficiency virus 1 (HIV-1)
aaagcuugccuugagugcu

SEQ ID NO: 2164252 - RNA, 12 nt, Human immunodeficiency virus 1 (HIV-1)
cugagccuggga

SEQ ID NO: 2164253 - RNA, 16 nt, Human immunodeficiency virus 1 (HIV-1)
accaaggcaaagagaa

SEQ ID NO: 2164254 - RNA, 13 nt, Human immunodeficiency virus 1 (HIV-1)
auagaggagcuga

SEQ ID NO: 2164255 - RNA, 22 nt, Human immunodeficiency virus 1 (HIV-1)
aucaagcuucucuaucaaagca

SEQ ID NO: 2164256 - RNA, 16 nt, Human immunodeficiency virus 1 (HIV-1)
gaagccauaauaagaa

SEQ ID NO: 2164257 - RNA, 21 nt, Human immunodeficiency virus 1 (HIV-1)
acaguacuaaauggagaaaau

SEQ ID NO: 2164258 - RNA, 14 nt, Human immunodeficiency virus 1 (HIV-1)
gguucuugggagca

SEQ ID NO: 2164259 - RNA, 15 nt, Human immunodeficiency virus 1 (HIV-1)
augacaugguagaac

SEQ ID NO: 2164260 - RNA, 16 nt, Human immunodeficiency virus 1 (HIV-1)
aguggcgagcccucag

SEQ ID NO: 2164261 - RNA, 15 nt, Human immunodeficiency virus 1 (HIV-1)
uuuagaaggaaaagu

SEQ ID NO: 2164262 - RNA, 23 nt, Human immunodeficiency virus 1 (HIV-1)
aggccaauaaaggagagaacacc

SEQ ID NO: 2164263 - RNA, 20 nt, Human immunodeficiency virus 1 (HIV-1)
agucuccauagaauggagga

SEQ ID NO: 2164264 - RNA, 22 nt, Human immunodeficiency virus 1 (HIV-1)
cacaagaggaggaggagguggg

SEQ ID NO: 2164265 - RNA, 18 nt, Human immunodeficiency virus 1 (HIV-1)
uugugccuggcuagaagc

SEQ ID NO: 2164266 - RNA, 21 nt, Human immunodeficiency virus 1 (HIV-1)
cuggcuagaagcacaagagga

SEQ ID NO: 2164267 - RNA, 19 nt, Human immunodeficiency virus 1 (HIV-1)
ggaacagauuuggaaucac

SEQ ID NO: 2164268 - RNA, 13 nt, Human immunodeficiency virus 1 (HIV-1)
agaagcacaagag

SEQ ID NO: 2164269 - RNA, 21 nt, Human immunodeficiency virus 1 (HIV-1)
aacuggcagaaaacagagaga

SEQ ID NO: 2164270 - RNA, 12 nt, Human immunodeficiency virus 1 (HIV-1)
guugcucuggaa

SEQ ID NO: 2164271 - RNA, 23 nt, Human immunodeficiency virus 1 (HIV-1)
uugccuguacugggucucucugg

SEQ ID NO: 2164272 - RNA, 23 nt, Human immunodeficiency virus 1 (HIV-1)
gcacaagaggaggaggagguggg

SEQ ID NO: 2164273 - RNA, 17 nt, Human immunodeficiency virus 1 (HIV-1)
ugggguaccugugugga

SEQ ID NO: 2164274 - RNA, 18 nt, Human immunodeficiency virus 1 (HIV-1)
uuggaaauaauaaaacaa

SEQ ID NO: 2164275 - RNA, 15 nt, Human immunodeficiency virus 1 (HIV-1)
aucugacuuagaaau

SEQ ID NO: 2164276 - RNA, 18 nt, Human immunodeficiency virus 1 (HIV-1)
aacauuaguagagcaaaa

SEQ ID NO: 2164277 - RNA, 12 nt, Human immunodeficiency virus 1 (HIV-1)
aaauagaggagc

SEQ ID NO: 2164278 - RNA, 23 nt, Human immunodeficiency virus 1 (HIV-1)
cacccugugagccugcaugggau

SEQ ID NO: 2164279 - RNA, 20 nt, Human immunodeficiency virus 1 (HIV-1)
auaucagcacaagcauaaga

SEQ ID NO: 2164280 - RNA, 22 nt, Human immunodeficiency virus 1 (HIV-1)
aggaaccaaagcacuaacagaa

SEQ ID NO: 2164281 - RNA, 14 nt, Human immunodeficiency virus 1 (HIV-1)
caguauuagaagaa

SEQ ID NO: 2164282 - RNA, 19 nt, Human immunodeficiency virus 1 (HIV-1)
uaguacagcugaacacauc

SEQ ID NO: 2164283 - RNA, 17 nt, Human immunodeficiency virus 1 (HIV-1)
aggaaaauaugcaagaa

SEQ ID NO: 2164284 - RNA, 22 nt, Human immunodeficiency virus 1 (HIV-1)
uagcagaacuacacaccagggc

SEQ ID NO: 2164285 - RNA, 20 nt, Human immunodeficiency virus 1 (HIV-1)
uaauagaggaagacaaaaag

SEQ ID NO: 2164286 - RNA, 21 nt, Human immunodeficiency virus 1 (HIV-1)
agucacaccucagguaccuuu

SEQ ID NO: 2164287 - RNA, 21 nt, Human immunodeficiency virus 1 (HIV-1)
uuaagaccaaugacuuacaag

SEQ ID NO: 2164288 - RNA, 14 nt, Human immunodeficiency virus 1 (HIV-1)
agcccucagauccu

SEQ ID NO: 2164289 - RNA, 17 nt, Human immunodeficiency virus 1 (HIV-1)
aggguuaaaaaagaaaa

SEQ ID NO: 2164290 - RNA, 20 nt, Human immunodeficiency virus 1 (HIV-1)
caguggauauauagaagcag

SEQ ID NO: 2164291 - RNA, 23 nt, Human immunodeficiency virus 1 (HIV-1)
gaagaaucgcaaaaccagcaaga

SEQ ID NO: 2164292 - RNA, 23 nt, Human immunodeficiency virus 1 (HIV-1)
ugguuagaccagaucugagccug

SEQ ID NO: 2164293 - RNA, 11 nt, Human immunodeficiency virus 1 (HIV-1)
aggaggggacc

SEQ ID NO: 2164294 - RNA, 14 nt, Human immunodeficiency virus 1 (HIV-1)
auaccacuaacaga

SEQ ID NO: 2164295 - RNA, 22 nt, Human immunodeficiency virus 1 (HIV-1)
aaaguaggaaaagcaauguaug

SEQ ID NO: 2164296 - RNA, 15 nt, Human immunodeficiency virus 1 (HIV-1)
agauaaaaaacugcu

SEQ ID NO: 2164297 - RNA, 19 nt, Human immunodeficiency virus 1 (HIV-1)
cagauaagauagaagaggc

SEQ ID NO: 2164298 - RNA, 17 nt, Human immunodeficiency virus 1 (HIV-1)
cuguagaaauuaauugu

SEQ ID NO: 2164299 - RNA, 22 nt, Human immunodeficiency virus 1 (HIV-1)
uggaaagauaccuaaaggauca

SEQ ID NO: 2164300 - RNA, 20 nt, Human immunodeficiency virus 1 (HIV-1)
gacuagagcccuggaagcau

SEQ ID NO: 2164301 - RNA, 16 nt, Human immunodeficiency virus 1 (HIV-1)
acccugugagccugca

SEQ ID NO: 2164302 - RNA, 16 nt, Human immunodeficiency virus 1 (HIV-1)
gagcugagccagcagc

SEQ ID NO: 2164303 - RNA, 13 nt, Human immunodeficiency virus 1 (HIV-1)
uaccaaugcugcu

SEQ ID NO: 2164304 - RNA, 18 nt, Human immunodeficiency virus 1 (HIV-1)
caaggcaaagagaagagu

SEQ ID NO: 2164305 - RNA, 18 nt, Human immunodeficiency virus 1 (HIV-1)
gcagucuagcagaagaag

SEQ ID NO: 2164306 - RNA, 19 nt, Human immunodeficiency virus 1 (HIV-1)
cuagagcuuuuagaggagc

SEQ ID NO: 2164307 - RNA, 19 nt, Human immunodeficiency virus 1 (HIV-1)
ugagacaagcacauuguaa

SEQ ID NO: 2164308 - RNA, 16 nt, Human immunodeficiency virus 1 (HIV-1)
aaagcacuaacagaag

SEQ ID NO: 2164309 - RNA, 15 nt, Human immunodeficiency virus 1 (HIV-1)
uuggcacuagcagca

SEQ ID NO: 2164310 - RNA, 13 nt, Human immunodeficiency virus 1 (HIV-1)
agacuucaggaag

SEQ ID NO: 2164311 - RNA, 19 nt, Human immunodeficiency virus 1 (HIV-1)
uuuguggaauugguuuaac

SEQ ID NO: 2164312 - RNA, 19 nt, Human immunodeficiency virus 1 (HIV-1)
agaaucuaugaauaaagaa

SEQ ID NO: 2164313 - RNA, 16 nt, Human immunodeficiency virus 1 (HIV-1)
aacagauggcagguga

SEQ ID NO: 2164314 - RNA, 15 nt, Human immunodeficiency virus 1 (HIV-1)
acugcuguuaaaugg

SEQ ID NO: 2164315 - RNA, 20 nt, Human immunodeficiency virus 1 (HIV-1)
ccagcagcagauaggguggg

SEQ ID NO: 2164316 - RNA, 16 nt, Human immunodeficiency virus 1 (HIV-1)
aggcguggccugggcg

SEQ ID NO: 2164317 - RNA, 12 nt, Human immunodeficiency virus 1 (HIV-1)
agcaacaaugag

SEQ ID NO: 2164318 - RNA, 14 nt, Human immunodeficiency virus 1 (HIV-1)
gcaauacagcagcu

SEQ ID NO: 2164319 - RNA, 18 nt, Human immunodeficiency virus 1 (HIV-1)
gugccucuucagcuacca

SEQ ID NO: 2164320 - RNA, 19 nt, Human immunodeficiency virus 1 (HIV-1)
aggauuagaacauggaaaa

SEQ ID NO: 2164321 - RNA, 18 nt, Human immunodeficiency virus 1 (HIV-1)
acauaccuagaagaauaa

SEQ ID NO: 2164322 - RNA, 17 nt, Human immunodeficiency virus 1 (HIV-1)
aacuagggaacccacug

SEQ ID NO: 2164323 - RNA, 17 nt, Human immunodeficiency virus 1 (HIV-1)
aucuccuauggcaggaa

SEQ ID NO: 2164324 - RNA, 21 nt, Human immunodeficiency virus 1 (HIV-1)
aguggaagccauaauaagaau

SEQ ID NO: 2164325 - RNA, 22 nt, Human immunodeficiency virus 1 (HIV-1)
gcagcaucucgagaccuggaaa

SEQ ID NO: 2164326 - RNA, 15 nt, Human immunodeficiency virus 1 (HIV-1)
aguacuugguuuaau

SEQ ID NO: 2164327 - RNA, 17 nt, Human immunodeficiency virus 1 (HIV-1)
uacagagguacauaaug

SEQ ID NO: 2164328 - RNA, 22 nt, Human immunodeficiency virus 1 (HIV-1)
augaauaaagaauuaaagaaaa

SEQ ID NO: 2164329 - RNA, 12 nt, Human immunodeficiency virus 1 (HIV-1)
ggaaggaagcaa

SEQ ID NO: 2164330 - RNA, 17 nt, Human immunodeficiency virus 1 (HIV-1)
augaguuugccaggaag

SEQ ID NO: 2164331 - RNA, 22 nt, Human immunodeficiency virus 1 (HIV-1)
acuuaauagcagaaauacagaa

SEQ ID NO: 2164332 - RNA, 11 nt, Human immunodeficiency virus 1 (HIV-1)
ugggagcagca

SEQ ID NO: 2164333 - RNA, 13 nt, Human immunodeficiency virus 1 (HIV-1)
guguaaaauuaac

SEQ ID NO: 2164334 - RNA, 11 nt, Human immunodeficiency virus 1 (HIV-1)
cccucagaucc

SEQ ID NO: 2164335 - RNA, 22 nt, Human immunodeficiency virus 1 (HIV-1)
uggggcaccaugcuccuuggga

SEQ ID NO: 2164336 - RNA, 22 nt, Human immunodeficiency virus 1 (HIV-1)
uuuuagaggagcuuaagaauga

SEQ ID NO: 2164337 - RNA, 20 nt, Human immunodeficiency virus 1 (HIV-1)
acagagggagccacacaaug

SEQ ID NO: 2164338 - RNA, 18 nt, Human immunodeficiency virus 1 (HIV-1)
aggcuugguagguuuaag

SEQ ID NO: 2164339 - RNA, 19 nt, Human immunodeficiency virus 1 (HIV-1)
agcaaaauggaauaacacu

SEQ ID NO: 2164340 - RNA, 18 nt, Human immunodeficiency virus 1 (HIV-1)
gagucaggaacuaaagaa

SEQ ID NO: 2164341 - RNA, 15 nt, Human immunodeficiency virus 1 (HIV-1)
aucucgagaccugga

SEQ ID NO: 2164342 - RNA, 15 nt, Human immunodeficiency virus 1 (HIV-1)
uaacaaauuggcugu

SEQ ID NO: 2164343 - RNA, 16 nt, Human immunodeficiency virus 1 (HIV-1)
acacaacaaaucagaa

SEQ ID NO: 2164344 - RNA, 21 nt, Human immunodeficiency virus 1 (HIV-1)
uagaaauagggcagcauagaa

SEQ ID NO: 2164345 - RNA, 15 nt, Human immunodeficiency virus 1 (HIV-1)
aaguagacaggauga

SEQ ID NO: 2164346 - RNA, 17 nt, Human immunodeficiency virus 1 (HIV-1)
accaauagauaaugaua

SEQ ID NO: 2164347 - RNA, 20 nt, Human immunodeficiency virus 1 (HIV-1)
agaacaauuuggaaauaaua

SEQ ID NO: 2164348 - RNA, 22 nt, Human immunodeficiency virus 1 (HIV-1)
gauggaaaggaucaccagcaau

SEQ ID NO: 2164349 - RNA, 14 nt, Human immunodeficiency virus 1 (HIV-1)
gugaacggauccuu

SEQ ID NO: 2164350 - RNA, 12 nt, Human immunodeficiency virus 1 (HIV-1)
agaucugagccu

SEQ ID NO: 2164351 - RNA, 14 nt, Human immunodeficiency virus 1 (HIV-1)
agccuaaaacugcu

SEQ ID NO: 2164352 - RNA, 20 nt, Human immunodeficiency virus 1 (HIV-1)
cugggacgaucugcggagcc

SEQ ID NO: 2164353 - RNA, 18 nt, Human immunodeficiency virus 1 (HIV-1)
uagaaucuaugaauaaag

SEQ ID NO: 2164354 - RNA, 18 nt, Human immunodeficiency virus 1 (HIV-1)
gccacauaccuagaagaa

SEQ ID NO: 2164355 - RNA, 15 nt, Human immunodeficiency virus 1 (HIV-1)
aucacacgaccugga

SEQ ID NO: 2164356 - RNA, 19 nt, Human immunodeficiency virus 1 (HIV-1)
acccucccaugcagaauaa

SEQ ID NO: 2164357 - RNA, 18 nt, Human immunodeficiency virus 1 (HIV-1)
agcaagaaauggagccag

SEQ ID NO: 2164358 - RNA, 19 nt, Human immunodeficiency virus 1 (HIV-1)
uaucagcacuuguggagau

SEQ ID NO: 2164359 - RNA, 10 nt, Human immunodeficiency virus 1 (HIV-1)
gacuggaagg

SEQ ID NO: 2164360 - RNA, 19 nt, Human immunodeficiency virus 1 (HIV-1)
uagcuugcucaaugccaca

SEQ ID NO: 2164361 - RNA, 17 nt, Human immunodeficiency virus 1 (HIV-1)
cagcuaccaccgcuuga

SEQ ID NO: 2164362 - RNA, 19 nt, Human immunodeficiency virus 1 (HIV-1)
aauaacaccaaaaaagaua

SEQ ID NO: 2164363 - RNA, 19 nt, Human immunodeficiency virus 1 (HIV-1)
augggauggaugacccgga

SEQ ID NO: 2164364 - RNA, 21 nt, Human immunodeficiency virus 1 (HIV-1)
auaguaguagcgggagaauga

SEQ ID NO: 2164365 - RNA, 22 nt, Human immunodeficiency virus 1 (HIV-1)
uggcgagcccucagauccugca

SEQ ID NO: 2164366 - RNA, 21 nt, Human immunodeficiency virus 1 (HIV-1)
uuuccagggaggcguggccug

SEQ ID NO: 2164367 - RNA, 16 nt, Human immunodeficiency virus 1 (HIV-1)
gaagcauccaggaagu

SEQ ID NO: 2164368 - RNA, 21 nt, Human immunodeficiency virus 1 (HIV-1)
agcaguuaauaaaaaaggaaa

SEQ ID NO: 2164369 - RNA, 22 nt, Human immunodeficiency virus 1 (HIV-1)
gaaccaaagcacuaacagaagu

SEQ ID NO: 2164370 - RNA, 18 nt, Human immunodeficiency virus 1 (HIV-1)
ccgcuugagagacuuacu

SEQ ID NO: 2164371 - RNA, 19 nt, Human immunodeficiency virus 1 (HIV-1)
uuaauaaaaaaggaaaagg

SEQ ID NO: 2164372 - RNA, 18 nt, Human immunodeficiency virus 1 (HIV-1)
aagaauaagacagggcuu

SEQ ID NO: 2164373 - RNA, 19 nt, Human immunodeficiency virus 1 (HIV-1)
uaggaaaauauuaagacaa

SEQ ID NO: 2164374 - RNA, 16 nt, Human immunodeficiency virus 1 (HIV-1)
acacaccagggccagg

SEQ ID NO: 2164375 - RNA, 14 nt, Human immunodeficiency virus 1 (HIV-1)
auuacaaaaacaaa

SEQ ID NO: 2164376 - RNA, 13 nt, Human immunodeficiency virus 1 (HIV-1)
ccagaucugagcc

SEQ ID NO: 2164377 - RNA, 18 nt, Human immunodeficiency virus 1 (HIV-1)
ucuccuauggcaggaaga

SEQ ID NO: 2164378 - RNA, 13 nt, Human immunodeficiency virus 1 (HIV-1)
agccucaauaaag

SEQ ID NO: 2164379 - RNA, 13 nt, Human immunodeficiency virus 1 (HIV-1)
aacccacaagaag

SEQ ID NO: 2164380 - RNA, 23 nt, Human immunodeficiency virus 1 (HIV-1)
ggcuaacuagggaacccacugcu

SEQ ID NO: 2164381 - RNA, 18 nt, Human immunodeficiency virus 1 (HIV-1)
ugcgauucuaaaauguaa

SEQ ID NO: 2164382 - RNA, 16 nt, Human immunodeficiency virus 1 (HIV-1)
agcaagaaaagaauga

SEQ ID NO: 2164383 - RNA, 15 nt, Human immunodeficiency virus 1 (HIV-1)
uguaguccaggaaua

SEQ ID NO: 2164384 - RNA, 15 nt, Human immunodeficiency virus 1 (HIV-1)
uaguaucaacucaac

SEQ ID NO: 2164385 - RNA, 14 nt, Human immunodeficiency virus 1 (HIV-1)
cucagauccugcau

SEQ ID NO: 2164386 - RNA, 12 nt, Human immunodeficiency virus 1 (HIV-1)
cgacagaggaga

SEQ ID NO: 2164387 - RNA, 15 nt, Human immunodeficiency virus 1 (HIV-1)
ugcagaauaaaacaa

SEQ ID NO: 2164388 - RNA, 22 nt, Human immunodeficiency virus 1 (HIV-1)
acaauuuggaaauaauaaaaca

SEQ ID NO: 2164389 - RNA, 14 nt, Human immunodeficiency virus 1 (HIV-1)
gcaaauuaagagaa

SEQ ID NO: 2164390 - RNA, 17 nt, Human immunodeficiency virus 1 (HIV-1)
uacacccugugagccug

SEQ ID NO: 2164391 - RNA, 11 nt, Human immunodeficiency virus 1 (HIV-1)
uaaaauuauuc

SEQ ID NO: 2164392 - RNA, 15 nt, Human immunodeficiency virus 1 (HIV-1)
gaccagaucugagcc

SEQ ID NO: 2164393 - RNA, 18 nt, Human immunodeficiency virus 1 (HIV-1)
augagacgagcugagcca

SEQ ID NO: 2164394 - RNA, 15 nt, Human immunodeficiency virus 1 (HIV-1)
auacaagaaaaagaa

SEQ ID NO: 2164395 - RNA, 14 nt, Human immunodeficiency virus 1 (HIV-1)
aauagugacauaaa

SEQ ID NO: 2164396 - RNA, 17 nt, Human immunodeficiency virus 1 (HIV-1)
acauuaguagagcaaaa

SEQ ID NO: 2164397 - RNA, 17 nt, Human immunodeficiency virus 1 (HIV-1)
acaaaucagaagacuga

SEQ ID NO: 2164398 - RNA, 13 nt, Human immunodeficiency virus 1 (HIV-1)
ccaaugacuuaca

SEQ ID NO: 2164399 - RNA, 23 nt, Human immunodeficiency virus 1 (HIV-1)
uggcaggaagaagcggagacagc

SEQ ID NO: 2164400 - RNA, 14 nt, Human immunodeficiency virus 1 (HIV-1)
gaacuacacaccag

SEQ ID NO: 2164401 - RNA, 17 nt, Human immunodeficiency virus 1 (HIV-1)
auguaugccccucccau

SEQ ID NO: 2164402 - RNA, 21 nt, Human immunodeficiency virus 1 (HIV-1)
agggagacuaaauuaggaaaa

SEQ ID NO: 2164403 - RNA, 21 nt, Human immunodeficiency virus 1 (HIV-1)
uggaaaaacauggagcaauca

SEQ ID NO: 2164404 - RNA, 16 nt, Human immunodeficiency virus 1 (HIV-1)
acaguauuagaagaaa

SEQ ID NO: 2164405 - RNA, 13 nt, Human immunodeficiency virus 1 (HIV-1)
cagauauccacug

SEQ ID NO: 2164406 - RNA, 16 nt, Human immunodeficiency virus 1 (HIV-1)
cagaccuggaggagga

SEQ ID NO: 2164407 - RNA, 23 nt, Human immunodeficiency virus 1 (HIV-1)
ggaguagcacccaccaaggcaaa

SEQ ID NO: 2164408 - RNA, 23 nt, Human immunodeficiency virus 1 (HIV-1)
agggucaaauaacacugaaggaa

SEQ ID NO: 2164409 - RNA, 15 nt, Human immunodeficiency virus 1 (HIV-1)
agauccuagacuaga

SEQ ID NO: 2164410 - RNA, 17 nt, Human immunodeficiency virus 1 (HIV-1)
gccacuuuuuaaaagaa

SEQ ID NO: 2164411 - RNA, 22 nt, Human immunodeficiency virus 1 (HIV-1)
cugguuagaccagaucugagcc

SEQ ID NO: 2164412 - RNA, 23 nt, Human immunodeficiency virus 1 (HIV-1)
cagaacuacacaccagggccagg

SEQ ID NO: 2164413 - RNA, 17 nt, Human immunodeficiency virus 1 (HIV-1)
guuacucgacagaggag

SEQ ID NO: 2164414 - RNA, 14 nt, Human immunodeficiency virus 1 (HIV-1)
uaccacacacaagg

SEQ ID NO: 2164415 - RNA, 21 nt, Human immunodeficiency virus 1 (HIV-1)
ccagggaggcguggccugggc

SEQ ID NO: 2164416 - RNA, 18 nt, Human immunodeficiency virus 1 (HIV-1)
ugccuggcuagaagcaca

SEQ ID NO: 2164417 - RNA, 18 nt, Human immunodeficiency virus 1 (HIV-1)
uuguaacgaggauugugg

SEQ ID NO: 2164418 - RNA, 18 nt, Human immunodeficiency virus 1 (HIV-1)
cagaccuggaggaggaga

SEQ ID NO: 2164419 - RNA, 15 nt, Human immunodeficiency virus 1 (HIV-1)
cucauccaagaauaa

SEQ ID NO: 2164420 - RNA, 23 nt, Human immunodeficiency virus 1 (HIV-1)
auauccacugaccuuuggauggu

SEQ ID NO: 2164421 - RNA, 17 nt, Human immunodeficiency virus 1 (HIV-1)
gcuauaagauggguggc

SEQ ID NO: 2164422 - RNA, 23 nt, Human immunodeficiency virus 1 (HIV-1)
guaacgcacaguuuuaauugugg

SEQ ID NO: 2164423 - RNA, 16 nt, Human immunodeficiency virus 1 (HIV-1)
cagacccaccucccaa

SEQ ID NO: 2164424 - RNA, 22 nt, Human immunodeficiency virus 1 (HIV-1)
agaaucgcaaaaccagcaagaa

SEQ ID NO: 2164425 - RNA, 18 nt, Human immunodeficiency virus 1 (HIV-1)
gaccagaucugagccugg

SEQ ID NO: 2164426 - RNA, 19 nt, Human immunodeficiency virus 1 (HIV-1)
caccaaggcaaagagaaga

SEQ ID NO: 2164427 - RNA, 20 nt, Human immunodeficiency virus 1 (HIV-1)
auggccuacuguaagggaaa

SEQ ID NO: 2164428 - RNA, 17 nt, Human immunodeficiency virus 1 (HIV-1)
gagagauucuaaaagaa

SEQ ID NO: 2164429 - RNA, 18 nt, Human immunodeficiency virus 1 (HIV-1)
aacaaauuauaaacaugu

SEQ ID NO: 2164430 - RNA, 14 nt, Human immunodeficiency virus 1 (HIV-1)
aaucaaauaauaga

SEQ ID NO: 2164431 - RNA, 16 nt, Human immunodeficiency virus 1 (HIV-1)
ccugauuagcagaacu

SEQ ID NO: 2164432 - RNA, 10 nt, Human immunodeficiency virus 1 (HIV-1)
aucucuggaa

SEQ ID NO: 2164433 - RNA, 13 nt, Human immunodeficiency virus 1 (HIV-1)
agcaagaaaagaa

SEQ ID NO: 2164434 - RNA, 18 nt, Human immunodeficiency virus 1 (HIV-1)
accaaagcacuaacagaa

SEQ ID NO: 2164435 - RNA, 16 nt, Human immunodeficiency virus 1 (HIV-1)
gcagucuagcagaaga

SEQ ID NO: 2164436 - RNA, 14 nt, Human immunodeficiency virus 1 (HIV-1)
agaaaagcaaagau

SEQ ID NO: 2164437 - RNA, 16 nt, Human immunodeficiency virus 1 (HIV-1)
cgagaucuucagaccu

SEQ ID NO: 2164438 - RNA, 21 nt, Human
gccucuuggaccucugcucug

SEQ ID NO: 2164439 - RNA, 18 nt, Human
gccugcgcccaccccgcu

SEQ ID NO: 2164440 - RNA, 23 nt, Human
gccugccuugaagccacugaagc

SEQ ID NO: 2164441 - RNA, 16 nt, Human
gccugccuugaagcca

SEQ ID NO: 2164442 - RNA, 21 nt, Human
gccugcgccaccgcccagaga

SEQ ID NO: 2164443 - RNA, 16 nt, Human
gccugccucuucucua

SEQ ID NO: 2164444 - RNA, 22 nt, Human
gccugccuccagggcuggacug

SEQ ID NO: 2164445 - RNA, 17 nt, Human
gccugccuccagggcug

SEQ ID NO: 2164446 - RNA, 18 nt, Human
gccugccuccagggcugg

SEQ ID NO: 2164447 - RNA, 17 nt, Human
gccugccuguucccauu

SEQ ID NO: 2164448 - RNA, 13 nt, Human
gccugccugucug

SEQ ID NO: 2164449 - RNA, 14 nt, Human
gccugccugucugu

SEQ ID NO: 2164450 - RNA, 16 nt, Human
gccugccugucugucu

SEQ ID NO: 2164451 - RNA, 22 nt, Human
gccugccugucugucucuccau

SEQ ID NO: 2164452 - RNA, 12 nt, Human
gccugccuggag

SEQ ID NO: 2164453 - RNA, 13 nt, Human
gccugccuggagc

SEQ ID NO: 2164454 - RNA, 14 nt, Human
gccugccuggagcg

SEQ ID NO: 2164455 - RNA, 13 nt, Human
gccugccuggcag

SEQ ID NO: 2164456 - RNA, 15 nt, Human
gccugccuggcaggc

SEQ ID NO: 2164457 - RNA, 16 nt, Human
gccugccuggcaggcu

SEQ ID NO: 2164458 - RNA, 17 nt, Human
gccugccuggcaggcug

SEQ ID NO: 2164459 - RNA, 15 nt, Human
gccuggccccucagg

SEQ ID NO: 2164460 - RNA, 16 nt, Human
gccuggccccucaggg

SEQ ID NO: 2164461 - RNA, 17 nt, Human
gccuggccccucagggu

SEQ ID NO: 2164462 - RNA, 21 nt, Human
gccugugugacaucaguggca

SEQ ID NO: 2164463 - RNA, 22 nt, Human
gccugugucccaugacccaccc

SEQ ID NO: 2164464 - RNA, 23 nt, Human
gccugugucccaugacccacccc

SEQ ID NO: 2164465 - RNA, 21 nt, Human
gccuguguccaugcgcucagg

SEQ ID NO: 2164466 - RNA, 23 nt, Human
gccuguguccaugcgcucagggc

SEQ ID NO: 2164467 - RNA, 15 nt, Human
gccugugucccauga

SEQ ID NO: 2164468 - RNA, 19 nt, Human
gccugugucccaugaccca

SEQ ID NO: 2164469 - RNA, 20 nt, Human
gccugugucccaugacccac

SEQ ID NO: 2164470 - RNA, 21 nt, Human
gccugugucccaugacccacc

SEQ ID NO: 2164471 - RNA, 20 nt, Human
gccuguguccaugcgcucag

SEQ ID NO: 2164472 - RNA, 21 nt, Human
gccugggaucccucauccuca

SEQ ID NO: 2164473 - RNA, 18 nt, Human
gccugggaucccucaucc

SEQ ID NO: 2164474 - RNA, 22 nt, Human
gccugggaggucaaggcugcag

SEQ ID NO: 2164475 - RNA, 14 nt, Human
gccugggaucccuc

SEQ ID NO: 2164476 - RNA, 15 nt, Human
gccugggaauguauu

SEQ ID NO: 2164477 - RNA, 23 nt, Human
gccugggaauguauuauucugca

SEQ ID NO: 2164478 - RNA, 21 nt, Human
gccugggaggucaaggcugca

SEQ ID NO: 2164479 - RNA, 17 nt, Human
gccuggcuucuggagcc

SEQ ID NO: 2164480 - RNA, 16 nt, Human
gccuggcuucuggagc

SEQ ID NO: 2164481 - RNA, 15 nt, Human
gccuggcuucuggag

SEQ ID NO: 2164482 - RNA, 14 nt, Human
gccuggcuucugga

SEQ ID NO: 2164483 - RNA, 22 nt, Human
gccuggcuucuggagcccuugg

SEQ ID NO: 2164484 - RNA, 18 nt, Human
gccuggcuucuggagccc

SEQ ID NO: 2164485 - RNA, 23 nt, Human
gccuggcuucuggagcccuuggg

SEQ ID NO: 2164486 - RNA, 10 nt, Human
gccuggccug

SEQ ID NO: 2164487 - RNA, 15 nt, Human
gccuggccggcaacc

SEQ ID NO: 2164488 - RNA, 18 nt, Human
gccuggccggcaacccca

SEQ ID NO: 2164489 - RNA, 20 nt, Human
gccuggccccucaggguccc

SEQ ID NO: 2164490 - RNA, 22 nt, Human
gccuggccccucagggucccug

SEQ ID NO: 2164491 - RNA, 17 nt, Human
gccuccugccugccccu

SEQ ID NO: 2164492 - RNA, 23 nt, Human
gccuccugccugccccucucccg

SEQ ID NO: 2164493 - RNA, 13 nt, Human
gccuccuguguaa

SEQ ID NO: 2164494 - RNA, 18 nt, Human
gccuccuguguagcuggg

SEQ ID NO: 2164495 - RNA, 12 nt, Human
gccucugcuggc

SEQ ID NO: 2164496 - RNA, 15 nt, Human
gccucugcugccaug

SEQ ID NO: 2164497 - RNA, 12 nt, Human
gccucuggcuag

SEQ ID NO: 2164498 - RNA, 17 nt, Human
gccucuggauuguggga

SEQ ID NO: 2164499 - RNA, 13 nt, Human
gccuccugugugu

SEQ ID NO: 2164500 - RNA, 12 nt, Human
gccucugugccu

SEQ ID NO: 2164501 - RNA, 23 nt, Human
gccucuggcuagaggccagcccc

SEQ ID NO: 2164502 - RNA, 22 nt, Human
gccucuggcuagaggccagccc

SEQ ID NO: 2164503 - RNA, 21 nt, Human
gccucuggcuagaggccagcc

SEQ ID NO: 2164504 - RNA, 19 nt, Human
gccucuggcuagaggccag

SEQ ID NO: 2164505 - RNA, 18 nt, Human
gccucuggcuagaggcca

SEQ ID NO: 2164506 - RNA, 13 nt, Human
gccucuggcuaga

SEQ ID NO: 2164507 - RNA, 12 nt, Human
gccucugggacu

SEQ ID NO: 2164508 - RNA, 12 nt, Human
gccuccucaucc

SEQ ID NO: 2164509 - RNA, 15 nt, Human
gccuccucaucccgu

SEQ ID NO: 2164510 - RNA, 13 nt, Human
gccuccuccagcc

SEQ ID NO: 2164511 - RNA, 15 nt, Human
gccuccuccugacca

SEQ ID NO: 2164512 - RNA, 14 nt, Human
gccuccugccugcc

SEQ ID NO: 2164513 - RNA, 18 nt, Human
gccuccugcccuuaccug

SEQ ID NO: 2164514 - RNA, 17 nt, Human
gccuccucccuuagcuc

SEQ ID NO: 2164515 - RNA, 13 nt, Human
gccuccuccugac

SEQ ID NO: 2164516 - RNA, 16 nt, Human
gccuccuccuucccaa

SEQ ID NO: 2164517 - RNA, 17 nt, Human
gccuccucaucccgugu

SEQ ID NO: 2164518 - RNA, 22 nt, Human
gccuccucaucccguguucucc

SEQ ID NO: 2164519 - RNA, 14 nt, Human
gccuccucaucugg

SEQ ID NO: 2164520 - RNA, 23 nt, Human
gccuccucaucugggggagugga

SEQ ID NO: 2164521 - RNA, 16 nt, Human
gccuccucccuuagcu

SEQ ID NO: 2164522 - RNA, 23 nt, Human
gccucuucucuacucuagggaaa

SEQ ID NO: 2164523 - RNA, 12 nt, Human
gccucuucucua

SEQ ID NO: 2164524 - RNA, 17 nt, Human
gccucuucuagagccgu

SEQ ID NO: 2164525 - RNA, 19 nt, Human
gccucuuaaagcugccugu

SEQ ID NO: 2164526 - RNA, 17 nt, Human
gccucuguuugacaaac

SEQ ID NO: 2164527 - RNA, 15 nt, Human
gccucuucugggagg

SEQ ID NO: 2164528 - RNA, 14 nt, Human
gccucuucugggag

SEQ ID NO: 2164529 - RNA, 15 nt, Human
gccucuucuucuuca

SEQ ID NO: 2164530 - RNA, 18 nt, Human
gccucuucugggagggca

SEQ ID NO: 2164531 - RNA, 21 nt, Human
gccucuucuucuucagaagac

SEQ ID NO: 2164532 - RNA, 20 nt, Human
gccucuucuucuucagaaga

SEQ ID NO: 2164533 - RNA, 16 nt, Human
gccucuucuucuucag

SEQ ID NO: 2164534 - RNA, 18 nt, Human
gccucuuaaagcugccug

SEQ ID NO: 2164535 - RNA, 18 nt, Human
gccucuguguccuucccu

SEQ ID NO: 2164536 - RNA, 21 nt, Human
gccucuguguccuucccugca

SEQ ID NO: 2164537 - RNA, 20 nt, Human
gccucugugucacuggcugc

SEQ ID NO: 2164538 - RNA, 22 nt, Human
gccucugugucacuggcugccu

SEQ ID NO: 2164539 - RNA, 14 nt, Human
gccucuguguccuu

SEQ ID NO: 2164540 - RNA, 15 nt, Human
gccucuguguccuuc

SEQ ID NO: 2164541 - RNA, 22 nt, Human
gccucuuccucccucauuccac

SEQ ID NO: 2164542 - RNA, 12 nt, Human
gccucuuccucc

SEQ ID NO: 2164543 - RNA, 21 nt, Human
gccucuguggagccccagcau

SEQ ID NO: 2164544 - RNA, 18 nt, Human
gccucugugcugugugug

SEQ ID NO: 2164545 - RNA, 12 nt, Human
gccucuguguca

SEQ ID NO: 2164546 - RNA, 15 nt, Human
gccucugugucacug

SEQ ID NO: 2164547 - RNA, 16 nt, Human
gccucugugucacugg

SEQ ID NO: 2164548 - RNA, 19 nt, Human
gccucugugucacuggcug

SEQ ID NO: 2164549 - RNA, 11 nt, Human
gccucugugcu

SEQ ID NO: 2164550 - RNA, 12 nt, Human
gccucugugcug

SEQ ID NO: 2164551 - RNA, 14 nt, Human
gccucugugcugug

SEQ ID NO: 2164552 - RNA, 17 nt, Human
gccucugugcugugugu

SEQ ID NO: 2164553 - RNA, 20 nt, Human
gccucuugcggucccuucuu

SEQ ID NO: 2164554 - RNA, 21 nt, Human
gccucuugagcaguggcuggu

SEQ ID NO: 2164555 - RNA, 19 nt, Human
gccucuugagcaguggcug

SEQ ID NO: 2164556 - RNA, 20 nt, Human
gccucuugagcaguggcugg

SEQ ID NO: 2164557 - RNA, 18 nt, Human
gccucuugagcaguggcu

SEQ ID NO: 2164558 - RNA, 17 nt, Human
gccugcccaggccccug

SEQ ID NO: 2164559 - RNA, 18 nt, Human
gccugcccaggccccugc

SEQ ID NO: 2164560 - RNA, 21 nt, Human
gccugccgguaaacacgccug

SEQ ID NO: 2164561 - RNA, 11 nt, Human
gccugccucca

SEQ ID NO: 2164562 - RNA, 16 nt, Human
gccugccuccagggcu

SEQ ID NO: 2164563 - RNA, 16 nt, Human
gccugccgguaaacac

SEQ ID NO: 2164564 - RNA, 20 nt, Human
gccucuuggaccucugcucu

SEQ ID NO: 2164565 - RNA, 19 nt, Human
gccugcccaggccccugcc

SEQ ID NO: 2164566 - RNA, 20 nt, Human
gccugcccaggccccugcca

SEQ ID NO: 2164567 - RNA, 18 nt, Human
gccucuuggaaaaaguga

SEQ ID NO: 2164568 - RNA, 17 nt, Human
gccucuuggaccucugc

SEQ ID NO: 2164569 - RNA, 18 nt, Human
gccucuuggaccucugcu

SEQ ID NO: 2164570 - RNA, 19 nt, Human
gccucuuggaccucugcuc

SEQ ID NO: 2164571 - RNA, 22 nt, Human
gccuaccggcaauuuccggcca

SEQ ID NO: 2164572 - RNA, 21 nt, Human
gccuaccccgcagacaccuug

SEQ ID NO: 2164573 - RNA, 14 nt, Human
gccuaccccgcaga

SEQ ID NO: 2164574 - RNA, 17 nt, Human
gccuaccccgcagacac

SEQ ID NO: 2164575 - RNA, 12 nt, Human
gccuacucacga

SEQ ID NO: 2164576 - RNA, 17 nt, Human
gccuacuccaaaauguu

SEQ ID NO: 2164577 - RNA, 19 nt, Human
gccggccucucuggccucc

SEQ ID NO: 2164578 - RNA, 13 nt, Human
gccuaccugcucu

SEQ ID NO: 2164579 - RNA, 14 nt, Human
gccuaccugcucuc

SEQ ID NO: 2164580 - RNA, 20 nt, Human
gccggccucucuggccuccc

SEQ ID NO: 2164581 - RNA, 14 nt, Human
gccggcccuggggc

SEQ ID NO: 2164582 - RNA, 13 nt, Human
gccggcccugggg

SEQ ID NO: 2164583 - RNA, 12 nt, Human
gccggccucucu

SEQ ID NO: 2164584 - RNA, 13 nt, Human
gccggccucucug

SEQ ID NO: 2164585 - RNA, 20 nt, Human
gccggcccuggggcuaggcu

SEQ ID NO: 2164586 - RNA, 12 nt, Human
gccggcccuggg

SEQ ID NO: 2164587 - RNA, 13 nt, Human
gccggccaggugg

SEQ ID NO: 2164588 - RNA, 18 nt, Human
gccggccaggugggcggg

SEQ ID NO: 2164589 - RNA, 19 nt, Human
gccuacaugcuuugugaac

SEQ ID NO: 2164590 - RNA, 14 nt, Human
gccggccucucugg

SEQ ID NO: 2164591 - RNA, 15 nt, Human
gccggccucucuggc

SEQ ID NO: 2164592 - RNA, 16 nt, Human
gccggccucucuggcc

SEQ ID NO: 2164593 - RNA, 18 nt, Human
gccggccucucuggccuc

SEQ ID NO: 2164594 - RNA, 17 nt, Human
gccuacccacccccagg

SEQ ID NO: 2164595 - RNA, 16 nt, Human
gccuacccacccccag

SEQ ID NO: 2164596 - RNA, 14 nt, Human
gccgcccaaggccc

SEQ ID NO: 2164597 - RNA, 21 nt, Human
gccgccauugccaccaggaga

SEQ ID NO: 2164598 - RNA, 13 nt, Human
gccgccucccagc

SEQ ID NO: 2164599 - RNA, 12 nt, Human
gccgccucccag

SEQ ID NO: 2164600 - RNA, 17 nt, Human
gccgccucccagccugg

SEQ ID NO: 2164601 - RNA, 16 nt, Human
gccgccucccagccug

SEQ ID NO: 2164602 - RNA, 15 nt, Human
gccgccucccagccu

SEQ ID NO: 2164603 - RNA, 14 nt, Human
gccgccucccagcc

SEQ ID NO: 2164604 - RNA, 18 nt, Human
gccgccauugccaccagg

SEQ ID NO: 2164605 - RNA, 17 nt, Human
gccgccauugccaccag

SEQ ID NO: 2164606 - RNA, 16 nt, Human
gccgccauugccacca

SEQ ID NO: 2164607 - RNA, 16 nt, Human
gccgccaugcuccugg

SEQ ID NO: 2164608 - RNA, 18 nt, Human
gccgcauucccugaguca

SEQ ID NO: 2164609 - RNA, 16 nt, Human
gccgcauucccugagu

SEQ ID NO: 2164610 - RNA, 20 nt, Human
gcccuguugacacaggucuu

SEQ ID NO: 2164611 - RNA, 17 nt, Human
gcccuguuguguauaga

SEQ ID NO: 2164612 - RNA, 16 nt, Human
gcccuuacacuuacug

SEQ ID NO: 2164613 - RNA, 20 nt, Human
gcccuuacacuuacuguugu

SEQ ID NO: 2164614 - RNA, 15 nt, Human
gccgccaugcuccug

SEQ ID NO: 2164615 - RNA, 16 nt, Human
gcccuuaccugccagg

SEQ ID NO: 2164616 - RNA, 20 nt, Human
gcccuuaccugccaggaagc

SEQ ID NO: 2164617 - RNA, 18 nt, Human
gccgccugguacucaagc

SEQ ID NO: 2164618 - RNA, 23 nt, Human
gccgcuccugucugccagccagc

SEQ ID NO: 2164619 - RNA, 15 nt, Human
gccgcucggaggccc

SEQ ID NO: 2164620 - RNA, 16 nt, Human
gccgcucggaggcccc

SEQ ID NO: 2164621 - RNA, 17 nt, Human
gccgcucggaggcccca

SEQ ID NO: 2164622 - RNA, 18 nt, Human
gccgcucggaggccccaa

SEQ ID NO: 2164623 - RNA, 20 nt, Human
gccgcucggaggccccaaag

SEQ ID NO: 2164624 - RNA, 21 nt, Human
gccgcucggaggccccaaagg

SEQ ID NO: 2164625 - RNA, 22 nt, Human
gccgcucggaggccccaaagga

SEQ ID NO: 2164626 - RNA, 13 nt, Human
gccgccugguacu

SEQ ID NO: 2164627 - RNA, 15 nt, Human
gccgccugguacuca

SEQ ID NO: 2164628 - RNA, 23 nt, Human
gccgccugcccgucucucuccca

SEQ ID NO: 2164629 - RNA, 19 nt, Human
gccgccucccagccugggg

SEQ ID NO: 2164630 - RNA, 13 nt, Human
gccgccucgccca

SEQ ID NO: 2164631 - RNA, 15 nt, Human
gccgccucgcccacc

SEQ ID NO: 2164632 - RNA, 16 nt, Human
gccgccucgcccaccg

SEQ ID NO: 2164633 - RNA, 17 nt, Human
gccgccucgcccaccgc

SEQ ID NO: 2164634 - RNA, 17 nt, Human
gccgcuguucacccaca

SEQ ID NO: 2164635 - RNA, 16 nt, Human
gccgcuguucacccac

SEQ ID NO: 2164636 - RNA, 16 nt, Human
gccgcuuuucuccucu

SEQ ID NO: 2164637 - RNA, 14 nt, Human
gccggccagccccu

SEQ ID NO: 2164638 - RNA, 12 nt, Human
gccggccagccc

SEQ ID NO: 2164639 - RNA, 15 nt, Human
gccggcauggcuggg

SEQ ID NO: 2164640 - RNA, 15 nt, Human
gccgcuguucaccca

SEQ ID NO: 2164641 - RNA, 23 nt, Human
gccgcugugagccccugguccug

SEQ ID NO: 2164642 - RNA, 12 nt, Human
gccgcugugagc

SEQ ID NO: 2164643 - RNA, 17 nt, Human
gccgcugugagccccug

SEQ ID NO: 2164644 - RNA, 17 nt, Human
gccgcugccacccaccu

SEQ ID NO: 2164645 - RNA, 19 nt, Human
gccgcugcccggcgcccuc

SEQ ID NO: 2164646 - RNA, 12 nt, Human
gccgcugccacg

SEQ ID NO: 2164647 - RNA, 14 nt, Human
gccgcugccaccca

SEQ ID NO: 2164648 - RNA, 12 nt, Human
gccgcugccacc

SEQ ID NO: 2164649 - RNA, 16 nt, Human
gccgcugaguggcagg

SEQ ID NO: 2164650 - RNA, 17 nt, Human
gccgcugagcgaggaga

SEQ ID NO: 2164651 - RNA, 15 nt, Human
gccgcugagcgagga

SEQ ID NO: 2164652 - RNA, 14 nt, Human
gcccugccuccuuu

SEQ ID NO: 2164653 - RNA, 13 nt, Human
gcccugccucugu

SEQ ID NO: 2164654 - RNA, 15 nt, Human
gcccugccucuguuu

SEQ ID NO: 2164655 - RNA, 16 nt, Human
gcccugcugaguccca

SEQ ID NO: 2164656 - RNA, 11 nt, Human
gcccugccuga

SEQ ID NO: 2164657 - RNA, 12 nt, Human
gcccugccugag

SEQ ID NO: 2164658 - RNA, 13 nt, Human
gcccugccugagg

SEQ ID NO: 2164659 - RNA, 14 nt, Human
gcccugccugaggg

SEQ ID NO: 2164660 - RNA, 16 nt, Human
gcccugccuccuuugu

SEQ ID NO: 2164661 - RNA, 22 nt, Human
gcccugccuccuuugugaggaa

SEQ ID NO: 2164662 - RNA, 19 nt, Human
gcccuguugacacaggucu

SEQ ID NO: 2164663 - RNA, 21 nt, Human
gcccuguugacacaggucuuu

SEQ ID NO: 2164664 - RNA, 16 nt, Human
gcccuguugacacagg

SEQ ID NO: 2164665 - RNA, 20 nt, Human
gcccuguucagcuacuccca

SEQ ID NO: 2164666 - RNA, 22 nt, Human
gcccuguucucuaccaagcuau

SEQ ID NO: 2164667 - RNA, 22 nt, Human
gcccugcugcugacccagccug

SEQ ID NO: 2164668 - RNA, 17 nt, Human
gcccuguucagcuacuc

SEQ ID NO: 2164669 - RNA, 17 nt, Human
gcccuguuaaaagauga

SEQ ID NO: 2164670 - RNA, 14 nt, Human
gcccuguuaaaaga

SEQ ID NO: 2164671 - RNA, 23 nt, Human
gcccugcugccgccucccagccu

SEQ ID NO: 2164672 - RNA, 22 nt, Human
gcccugcugccgccucccagcc

SEQ ID NO: 2164673 - RNA, 21 nt, Human
gcccugcugccgccucccagc

SEQ ID NO: 2164674 - RNA, 13 nt, Human
gcccuguuaaaag

SEQ ID NO: 2164675 - RNA, 22 nt, Human
gcccugcugagucccaggcuga

SEQ ID NO: 2164676 - RNA, 21 nt, Human
gcccugcugagucccaggcug

SEQ ID NO: 2164677 - RNA, 23 nt, Human
gcccugcugagucccaggcugag

SEQ ID NO: 2164678 - RNA, 15 nt, Human
gcccugccugagggc

SEQ ID NO: 2164679 - RNA, 16 nt, Human
gcccugccugagggcc

SEQ ID NO: 2164680 - RNA, 22 nt, Human
gcccauggcccucccaguaccu

SEQ ID NO: 2164681 - RNA, 15 nt, Human
gcccaugggcacugc

SEQ ID NO: 2164682 - RNA, 16 nt, Human
gcccaugggcacugcu

SEQ ID NO: 2164683 - RNA, 17 nt, Human
gcccaugggcacugcug

SEQ ID NO: 2164684 - RNA, 20 nt, Human
gcccaugggagcugguuaga

SEQ ID NO: 2164685 - RNA, 21 nt, Human
gcccaugguugagaaaugaau

SEQ ID NO: 2164686 - RNA, 22 nt, Human
gcccaugggcacugcugggugg

SEQ ID NO: 2164687 - RNA, 23 nt, Human
gcccaugggcacugcuggguggc

SEQ ID NO: 2164688 - RNA, 18 nt, Human
gcccaugggcacugcugg

SEQ ID NO: 2164689 - RNA, 19 nt, Human
gcccaugggcacugcuggg

SEQ ID NO: 2164690 - RNA, 20 nt, Human
gcccaugggcacugcugggu

SEQ ID NO: 2164691 - RNA, 21 nt, Human
gcccaugggcacugcugggug

SEQ ID NO: 2164692 - RNA, 19 nt, Human
gcccaugucgcgcucagca

SEQ ID NO: 2164693 - RNA, 20 nt, Human
gcccaugucgcgcucagcau

SEQ ID NO: 2164694 - RNA, 21 nt, Human
gcccaugucgcgcucagcaug

SEQ ID NO: 2164695 - RNA, 16 nt, Human
gcccacugcccacccc

SEQ ID NO: 2164696 - RNA, 19 nt, Human
gcccacugcccacccccuc

SEQ ID NO: 2164697 - RNA, 18 nt, Human
gcccacugcccacccccu

SEQ ID NO: 2164698 - RNA, 18 nt, Human
gcccacuauggucaucuu

SEQ ID NO: 2164699 - RNA, 23 nt, Human
gcccacuagacccacuggacuca

SEQ ID NO: 2164700 - RNA, 13 nt, Human
gcccacucccugc

SEQ ID NO: 2164701 - RNA, 23 nt, Human
gcccacguccugucagugccgcc

SEQ ID NO: 2164702 - RNA, 15 nt, Human
gcccacguccuguca

SEQ ID NO: 2164703 - RNA, 16 nt, Human
gcccacguccugucag

SEQ ID NO: 2164704 - RNA, 17 nt, Human
gcccacuagacccacug

SEQ ID NO: 2164705 - RNA, 15 nt, Human
gcccacguagggcgg

SEQ ID NO: 2164706 - RNA, 16 nt, Human
gcccacguagggcggc

SEQ ID NO: 2164707 - RNA, 17 nt, Human
gcccacguagggcggca

SEQ ID NO: 2164708 - RNA, 13 nt, Human
gcccacguccugu

SEQ ID NO: 2164709 - RNA, 14 nt, Human
gcccacguccuguc

SEQ ID NO: 2164710 - RNA, 17 nt, Human
gcccacucugcucgccu

SEQ ID NO: 2164711 - RNA, 19 nt, Human
gcccacucccugcaaccug

SEQ ID NO: 2164712 - RNA, 14 nt, Human
gcccacucccugca

SEQ ID NO: 2164713 - RNA, 15 nt, Human
gcccacucccugcaa

SEQ ID NO: 2164714 - RNA, 23 nt, Human
gcccuaaugcgcaggcuggcccu

SEQ ID NO: 2164715 - RNA, 15 nt, Human
gcccuaaaagcacac

SEQ ID NO: 2164716 - RNA, 23 nt, Human
gcccguugucucccuggcccuca

SEQ ID NO: 2164717 - RNA, 19 nt, Human
gcccuaaaauuccacugcg

SEQ ID NO: 2164718 - RNA, 16 nt, Human
gcccuacagaggucuc

SEQ ID NO: 2164719 - RNA, 15 nt, Human
gcccuacaccuugag

SEQ ID NO: 2164720 - RNA, 13 nt, Human
gcccuaccagcgc

SEQ ID NO: 2164721 - RNA, 20 nt, Human
gcccuacagaggucucugcc

SEQ ID NO: 2164722 - RNA, 21 nt, Human
gcccuacagaggucucugccg

SEQ ID NO: 2164723 - RNA, 14 nt, Human
gcccuacuauucag

SEQ ID NO: 2164724 - RNA, 20 nt, Human
gcccuaccagcgcccgcugg

SEQ ID NO: 2164725 - RNA, 21 nt, Human
gcccuaccagcgcccgcuggg

SEQ ID NO: 2164726 - RNA, 22 nt, Human
gcccuaccagcgcccgcugggc

SEQ ID NO: 2164727 - RNA, 23 nt, Human
gcccuaccagcgcccgcugggcu

SEQ ID NO: 2164728 - RNA, 21 nt, Human
gcccuacuucuuugcuuugcc

SEQ ID NO: 2164729 - RNA, 17 nt, Human
gcccuagagcacacugu

SEQ ID NO: 2164730 - RNA, 13 nt, Human
gcccuagagcaca

SEQ ID NO: 2164731 - RNA, 19 nt, Human
gcccuagagcacacuguag

SEQ ID NO: 2164732 - RNA, 18 nt, Human
gcccguguggccccuuca

SEQ ID NO: 2164733 - RNA, 17 nt, Human
gcccguguggccccuuc

SEQ ID NO: 2164734 - RNA, 16 nt, Human
gcccguguggccccuu

SEQ ID NO: 2164735 - RNA, 15 nt, Human
gcccguguggccccu

SEQ ID NO: 2164736 - RNA, 13 nt, Human
gcccguguggccc

SEQ ID NO: 2164737 - RNA, 20 nt, Human
gcccgugacauccccacccu

SEQ ID NO: 2164738 - RNA, 22 nt, Human
gcccuaaaguguauuuuuuuac

SEQ ID NO: 2164739 - RNA, 17 nt, Human
gcccguugaggaugagg

SEQ ID NO: 2164740 - RNA, 16 nt, Human
gcccguugucucccug

SEQ ID NO: 2164741 - RNA, 17 nt, Human
gcccguugucucccugg

SEQ ID NO: 2164742 - RNA, 18 nt, Human
gcccguugucucccuggc

SEQ ID NO: 2164743 - RNA, 19 nt, Human
gcccguugucucccuggcc

SEQ ID NO: 2164744 - RNA, 20 nt, Human
gcccguugucucccuggccc

SEQ ID NO: 2164745 - RNA, 21 nt, Human
gcccguugucucccuggcccu

SEQ ID NO: 2164746 - RNA, 22 nt, Human
gcccguugucucccuggcccuc

SEQ ID NO: 2164747 - RNA, 15 nt, Human
gccccugcccggcug

SEQ ID NO: 2164748 - RNA, 16 nt, Human
gccccuggaugcagcc

SEQ ID NO: 2164749 - RNA, 18 nt, Human
gccccuggaugcagccuc

SEQ ID NO: 2164750 - RNA, 22 nt, Human
gccccuggaugcagccucacag

SEQ ID NO: 2164751 - RNA, 13 nt, Human
gccccugcccggc

SEQ ID NO: 2164752 - RNA, 14 nt, Human
gccccugcccggcu

SEQ ID NO: 2164753 - RNA, 22 nt, Human
gccccugccccgucaccaucuc

SEQ ID NO: 2164754 - RNA, 20 nt, Human
gccccugccccgucaccauc

SEQ ID NO: 2164755 - RNA, 16 nt, Human
gccccugccccgucac

SEQ ID NO: 2164756 - RNA, 15 nt, Human
gccccugccccguca

SEQ ID NO: 2164757 - RNA, 14 nt, Human
gccccugccccguc

SEQ ID NO: 2164758 - RNA, 17 nt, Human
gcccccucgugccaguc

SEQ ID NO: 2164759 - RNA, 12 nt, Human
gccccugccccg

SEQ ID NO: 2164760 - RNA, 14 nt, Human
gcccccucugcccu

SEQ ID NO: 2164761 - RNA, 12 nt, Human
gcccccucgugc

SEQ ID NO: 2164762 - RNA, 14 nt, Human
gcccccucgugcca

SEQ ID NO: 2164763 - RNA, 16 nt, Human
gcccccucgugccagu

SEQ ID NO: 2164764 - RNA, 13 nt, Human
gcccccaucucau

SEQ ID NO: 2164765 - RNA, 21 nt, Human
gcccccaguccccaccccugc

SEQ ID NO: 2164766 - RNA, 22 nt, Human
gcccccaguccccaccccugcc

SEQ ID NO: 2164767 - RNA, 18 nt, Human
gcccccuccgcccugcca

SEQ ID NO: 2164768 - RNA, 20 nt, Human
gcccccuccgcccugccacu

SEQ ID NO: 2164769 - RNA, 22 nt, Human
gcccccuccgcccugccacuca

SEQ ID NO: 2164770 - RNA, 16 nt, Human
gcccccuccucuagcu

SEQ ID NO: 2164771 - RNA, 19 nt, Human
gcccccuccucuagcugug

SEQ ID NO: 2164772 - RNA, 20 nt, Human
gcccccuccucuagcugugg

SEQ ID NO: 2164773 - RNA, 21 nt, Human
gcccccuccucuagcuguggg

SEQ ID NO: 2164774 - RNA, 15 nt, Human
gcccccuccucuccc

SEQ ID NO: 2164775 - RNA, 16 nt, Human
gcccccuccucuccca

SEQ ID NO: 2164776 - RNA, 17 nt, Human
gcccccuccucucccau

SEQ ID NO: 2164777 - RNA, 21 nt, Human
gcccccuccucucccaucccc

SEQ ID NO: 2164778 - RNA, 19 nt, Human
gcccccuccucucccaucc

SEQ ID NO: 2164779 - RNA, 17 nt, Human
gcccccaggcugcugga

SEQ ID NO: 2164780 - RNA, 16 nt, Human
gcccccaggcugcugg

SEQ ID NO: 2164781 - RNA, 20 nt, Human
gcccccagggcacuucacag

SEQ ID NO: 2164782 - RNA, 22 nt, Human
gcccccagggcacuucacagag

SEQ ID NO: 2164783 - RNA, 23 nt, Human
gccccaaaaccacagcccuguca

SEQ ID NO: 2164784 - RNA, 17 nt, Human
gcccccaggacugggcc

SEQ ID NO: 2164785 - RNA, 18 nt, Human
gcccccaggacugggcca

SEQ ID NO: 2164786 - RNA, 19 nt, Human
gccccaaaacucuccucug

SEQ ID NO: 2164787 - RNA, 16 nt, Human
gcccccaggugccagu

SEQ ID NO: 2164788 - RNA, 15 nt, Human
gcccccaguccccac

SEQ ID NO: 2164789 - RNA, 17 nt, Human
gcccccaguccccaccc

SEQ ID NO: 2164790 - RNA, 18 nt, Human
gcccccaguccccacccc

SEQ ID NO: 2164791 - RNA, 20 nt, Human
gcccccaguccccaccccug

SEQ ID NO: 2164792 - RNA, 22 nt, Human
gccccaaaaccacagcccuguc

SEQ ID NO: 2164793 - RNA, 21 nt, Human
gccccaaaaccacagcccugu

SEQ ID NO: 2164794 - RNA, 20 nt, Human
gccccaaaaccacagcccug

SEQ ID NO: 2164795 - RNA, 19 nt, Human
gccccaaaaccacagcccu

SEQ ID NO: 2164796 - RNA, 16 nt, Human
gccccaaaaccacagc

SEQ ID NO: 2164797 - RNA, 15 nt, Human
gccccaaaaccacag

SEQ ID NO: 2164798 - RNA, 18 nt, Human
gccccaaaacucuccucu

SEQ ID NO: 2164799 - RNA, 15 nt, Human
gcccaugugugagug

SEQ ID NO: 2164800 - RNA, 14 nt, Human
gcccaugugugagu

SEQ ID NO: 2164801 - RNA, 13 nt, Human
gcccaugugugag

SEQ ID NO: 2164802 - RNA, 20 nt, Human
gcccaugugugagugugugc

SEQ ID NO: 2164803 - RNA, 17 nt, Human
gcccauguguucccucu

SEQ ID NO: 2164804 - RNA, 22 nt, Human
gcacuuggagccaaggguucag

SEQ ID NO: 2164805 - RNA, 16 nt, Human
gcacuuggagaggcug

SEQ ID NO: 2164806 - RNA, 14 nt, Human
gcacuuggccucug

SEQ ID NO: 2164807 - RNA, 15 nt, Human
gcacuuggcugcaua

SEQ ID NO: 2164808 - RNA, 16 nt, Human
gcacuuggagccaagg

SEQ ID NO: 2164809 - RNA, 13 nt, Human
gcacuuggagcca

SEQ ID NO: 2164810 - RNA, 18 nt, Human
gcacuuggagacuuguau

SEQ ID NO: 2164811 - RNA, 20 nt, Human
gccacaugagucccaguggg

SEQ ID NO: 2164812 - RNA, 21 nt, Human
gccacauggcuuccuccugcg

SEQ ID NO: 2164813 - RNA, 22 nt, Human
gccacauggcuuccuccugcgc

SEQ ID NO: 2164814 - RNA, 16 nt, Human
gccacauuccugaugc

SEQ ID NO: 2164815 - RNA, 20 nt, Human
gccacauuccugaugcuucu

SEQ ID NO: 2164816 - RNA, 17 nt, Human
gccacauggggcugggc

SEQ ID NO: 2164817 - RNA, 14 nt, Human
gccacauuuggaau

SEQ ID NO: 2164818 - RNA, 15 nt, Human
gccacaugggaggcu

SEQ ID NO: 2164819 - RNA, 20 nt, Human
gccacauggggcugggcagc

SEQ ID NO: 2164820 - RNA, 19 nt, Human
gccacauuuggaauacuuu

SEQ ID NO: 2164821 - RNA, 16 nt, Human
gccacauugggcagcg

SEQ ID NO: 2164822 - RNA, 22 nt, Human
gccacauuuggaauacuuuuug

SEQ ID NO: 2164823 - RNA, 12 nt, Human
gccaccaacucu

SEQ ID NO: 2164824 - RNA, 22 nt, Human
gccaccaacucuugcaggucuc

SEQ ID NO: 2164825 - RNA, 19 nt, Human
gccaccaagagggacgccu

SEQ ID NO: 2164826 - RNA, 14 nt, Human
gccaccaagaggga

SEQ ID NO: 2164827 - RNA, 22 nt, Human
gccaccaacauacucccaucug

SEQ ID NO: 2164828 - RNA, 16 nt, Human
gccaccaccccccacu

SEQ ID NO: 2164829 - RNA, 22 nt, Human
gccaccaccccccacucugugc

SEQ ID NO: 2164830 - RNA, 14 nt, Human
gccaccacgcccgg

SEQ ID NO: 2164831 - RNA, 13 nt, Human
gccaccacccccc

SEQ ID NO: 2164832 - RNA, 22 nt, Human
gccaccaagagggacgccuggg

SEQ ID NO: 2164833 - RNA, 13 nt, Human
gccaccacgcccg

SEQ ID NO: 2164834 - RNA, 17 nt, Human
gccaccaaaggccaggg

SEQ ID NO: 2164835 - RNA, 16 nt, Human
gccaccaaaggccagg

SEQ ID NO: 2164836 - RNA, 19 nt, Human
gccaccaacauacucccau

SEQ ID NO: 2164837 - RNA, 20 nt, Human
gccaccaacauacucccauc

SEQ ID NO: 2164838 - RNA, 21 nt, Human
gccaccaacauacucccaucu

SEQ ID NO: 2164839 - RNA, 23 nt, Human
gccaccauauucagugcuguggc

SEQ ID NO: 2164840 - RNA, 16 nt, Human
gccaccagucacuguc

SEQ ID NO: 2164841 - RNA, 18 nt, Human
gccaccauccuauugcaa

SEQ ID NO: 2164842 - RNA, 22 nt, Human
gccaccauauucagugcugugg

SEQ ID NO: 2164843 - RNA, 20 nt, Human
gccaccaggcuggcgcagcc

SEQ ID NO: 2164844 - RNA, 18 nt, Human
gccaccaggcuggcgcag

SEQ ID NO: 2164845 - RNA, 19 nt, Human
gccaccaggcuggcgcagc

SEQ ID NO: 2164846 - RNA, 18 nt, Human
gccaccauggccagccaa

SEQ ID NO: 2164847 - RNA, 17 nt, Human
gccaccauggccagcca

SEQ ID NO: 2164848 - RNA, 16 nt, Human
gccaccauggccagcc

SEQ ID NO: 2164849 - RNA, 14 nt, Human
gccaccauggccag

SEQ ID NO: 2164850 - RNA, 22 nt, Human
gccaccaugcccagcucagagg

SEQ ID NO: 2164851 - RNA, 16 nt, Human
gccaccaugcccagcu

SEQ ID NO: 2164852 - RNA, 12 nt, Human
gccaccauccug

SEQ ID NO: 2164853 - RNA, 17 nt, Human
gccaccauccugcagcc

SEQ ID NO: 2164854 - RNA, 14 nt, Human
gccaccauccugcu

SEQ ID NO: 2164855 - RNA, 15 nt, Human
gccaccauccugcug

SEQ ID NO: 2164856 - RNA, 15 nt, Human
gccaccacguccagc

SEQ ID NO: 2164857 - RNA, 14 nt, Human
gccaccacguccag

SEQ ID NO: 2164858 - RNA, 16 nt, Human
gccaccacguccagcu

SEQ ID NO: 2164859 - RNA, 12 nt, Human
gccaccagagac

SEQ ID NO: 2164860 - RNA, 10 nt, Human
gccaccagcg

SEQ ID NO: 2164861 - RNA, 19 nt, Human
gccaccagagaccguccuc

SEQ ID NO: 2164862 - RNA, 21 nt, Human
gccaccagagaccguccucac

SEQ ID NO: 2164863 - RNA, 22 nt, Human
gccaccagagaccguccucacc

SEQ ID NO: 2164864 - RNA, 23 nt, Human
gccaccagagaccguccucaccc

SEQ ID NO: 2164865 - RNA, 12 nt, Human
gccaccaggcca

SEQ ID NO: 2164866 - RNA, 12 nt, Human
gccaccaggaug

SEQ ID NO: 2164867 - RNA, 15 nt, Human
gccaccaggccaccu

SEQ ID NO: 2164868 - RNA, 18 nt, Human
gccaccaggccaccuccc

SEQ ID NO: 2164869 - RNA, 20 nt, Human
gccaccaggccaccucccca

SEQ ID NO: 2164870 - RNA, 17 nt, Human
gccaccaggauggcccu

SEQ ID NO: 2164871 - RNA, 12 nt, Human
gccaccaggcug

SEQ ID NO: 2164872 - RNA, 13 nt, Human
gccaccaggcugg

SEQ ID NO: 2164873 - RNA, 14 nt, Human
gccaccaggcuggc

SEQ ID NO: 2164874 - RNA, 16 nt, Human
gccaccaggcuggcgc

SEQ ID NO: 2164875 - RNA, 17 nt, Human
gccaccaggcuggcgca

SEQ ID NO: 2164876 - RNA, 12 nt, Human
gccacccugggc

SEQ ID NO: 2164877 - RNA, 13 nt, Human
gccacccugggcu

SEQ ID NO: 2164878 - RNA, 14 nt, Human
gccacccugggcuc

SEQ ID NO: 2164879 - RNA, 16 nt, Human
gccacccucaugcugu

SEQ ID NO: 2164880 - RNA, 15 nt, Human
gccacccucaugcug

SEQ ID NO: 2164881 - RNA, 16 nt, Human
gccaccccuccuuccu

SEQ ID NO: 2164882 - RNA, 18 nt, Human
gccacccguucugcuggc

SEQ ID NO: 2164883 - RNA, 21 nt, Human
gccacccguucugcuggccug

SEQ ID NO: 2164884 - RNA, 22 nt, Human
gccacccguucugcuggccugg

SEQ ID NO: 2164885 - RNA, 21 nt, Human
gccaccccgggcucucugcug

SEQ ID NO: 2164886 - RNA, 15 nt, Human
gccaccccuccuucc

SEQ ID NO: 2164887 - RNA, 13 nt, Human
gccacccucaugc

SEQ ID NO: 2164888 - RNA, 18 nt, Human
gccacccuaccuguucag

SEQ ID NO: 2164889 - RNA, 23 nt, Human
gccacccguucugcuggccugga

SEQ ID NO: 2164890 - RNA, 13 nt, Human
gccacccuaccug

SEQ ID NO: 2164891 - RNA, 19 nt, Human
gccacccuaccuguucagu

SEQ ID NO: 2164892 - RNA, 19 nt, Human
gccaccccgggcucucugc

SEQ ID NO: 2164893 - RNA, 18 nt, Human
gccaccccgggcucucug

SEQ ID NO: 2164894 - RNA, 20 nt, Human
gccaccccacccucccugga

SEQ ID NO: 2164895 - RNA, 21 nt, Human
gccaccccacccucccuggag

SEQ ID NO: 2164896 - RNA, 22 nt, Human
gccaccccacccucccuggagu

SEQ ID NO: 2164897 - RNA, 22 nt, Human
gccaccauuccuggaaaccaca

SEQ ID NO: 2164898 - RNA, 14 nt, Human
gccaccauuccugg

SEQ ID NO: 2164899 - RNA, 16 nt, Human
gccaccauuccuggaa

SEQ ID NO: 2164900 - RNA, 21 nt, Human
gccacccaccucccugccucc

SEQ ID NO: 2164901 - RNA, 18 nt, Human
gccacccaccucccugcc

SEQ ID NO: 2164902 - RNA, 17 nt, Human
gccacccaccucccugc

SEQ ID NO: 2164903 - RNA, 16 nt, Human
gccacccaccucccug

SEQ ID NO: 2164904 - RNA, 15 nt, Human
gccaccccacccucc

SEQ ID NO: 2164905 - RNA, 18 nt, Human
gccaccccacccucccug

SEQ ID NO: 2164906 - RNA, 19 nt, Human
gccacugcauaccaaccug

SEQ ID NO: 2164907 - RNA, 22 nt, Human
gccaccgccgacuuuguacccc

SEQ ID NO: 2164908 - RNA, 15 nt, Human
gccacugcacuccgg

SEQ ID NO: 2164909 - RNA, 18 nt, Human
gccacugcccgagcuggu

SEQ ID NO: 2164910 - RNA, 17 nt, Human
gccacugcccgagcugg

SEQ ID NO: 2164911 - RNA, 16 nt, Human
gccacugcccgagcug

SEQ ID NO: 2164912 - RNA, 22 nt, Human
gccacugcacuccagccugggc

SEQ ID NO: 2164913 - RNA, 21 nt, Human
gccacugcacuccagccuggg

SEQ ID NO: 2164914 - RNA, 20 nt, Human
gccacugcacuccagccugg

SEQ ID NO: 2164915 - RNA, 19 nt, Human
gccacugcacuccagccug

SEQ ID NO: 2164916 - RNA, 21 nt, Human
gccacugcacuauagccuagg

SEQ ID NO: 2164917 - RNA, 18 nt, Human
gccacugcacuccagccu

SEQ ID NO: 2164918 - RNA, 13 nt, Human
gccacccugggga

SEQ ID NO: 2164919 - RNA, 19 nt, Human
gccacccuggggagaaagu

SEQ ID NO: 2164920 - RNA, 23 nt, Human
gccacugcaccgggccacagaga

SEQ ID NO: 2164921 - RNA, 16 nt, Human
gccaccgccuccuaca

SEQ ID NO: 2164922 - RNA, 17 nt, Human
gccacccugggcucugu

SEQ ID NO: 2164923 - RNA, 18 nt, Human
gccacccugggcucugug

SEQ ID NO: 2164924 - RNA, 19 nt, Human
gccacccugggcucugugg

SEQ ID NO: 2164925 - RNA, 21 nt, Human
gccacccugggcucugugggc

SEQ ID NO: 2164926 - RNA, 10 nt, Human
gccagaaaaa

SEQ ID NO: 2164927 - RNA, 20 nt, Human
gccagaaaaacguguugccu

SEQ ID NO: 2164928 - RNA, 18 nt, Human
gccagaacaguuuguaca

SEQ ID NO: 2164929 - RNA, 16 nt, Human
gccagaacaguuugua

SEQ ID NO: 2164930 - RNA, 12 nt, Human
gccagaaauaaa

SEQ ID NO: 2164931 - RNA, 23 nt, Human
gccacuuuugacuagggauucag

SEQ ID NO: 2164932 - RNA, 23 nt, Human
gccacuuugguacauggccagug

SEQ ID NO: 2164933 - RNA, 22 nt, Human
gccacuuugguacauggccagu

SEQ ID NO: 2164934 - RNA, 21 nt, Human
gccacuuugguacauggccag

SEQ ID NO: 2164935 - RNA, 19 nt, Human
gccacuuugcaaaggagcu

SEQ ID NO: 2164936 - RNA, 13 nt, Human
gccacuucccagg

SEQ ID NO: 2164937 - RNA, 21 nt, Human
gccacuuaccuucaauaaagu

SEQ ID NO: 2164938 - RNA, 19 nt, Human
gccacuuaccuucaauaaa

SEQ ID NO: 2164939 - RNA, 14 nt, Human
gccacuuaccuuca

SEQ ID NO: 2164940 - RNA, 18 nt, Human
gccacuuaaaauguucac

SEQ ID NO: 2164941 - RNA, 23 nt, Human
gccacuuaccuucaauaaaguau

SEQ ID NO: 2164942 - RNA, 22 nt, Human
gccacuuaccuucaauaaagua

SEQ ID NO: 2164943 - RNA, 15 nt, Human
gccacuucccaggua

SEQ ID NO: 2164944 - RNA, 14 nt, Human
gccacuucugggug

SEQ ID NO: 2164945 - RNA, 20 nt, Human
gccacuucuggguggggcag

SEQ ID NO: 2164946 - RNA, 21 nt, Human
gccacuugaugacccccaacc

SEQ ID NO: 2164947 - RNA, 23 nt, Human
gccacuucuggguggggcagugg

SEQ ID NO: 2164948 - RNA, 19 nt, Human
gccacugugaagagaacca

SEQ ID NO: 2164949 - RNA, 18 nt, Human
gccacugugaagagaacc

SEQ ID NO: 2164950 - RNA, 17 nt, Human
gccacuggccaucucca

SEQ ID NO: 2164951 - RNA, 21 nt, Human
gccacugcccgagcuggugca

SEQ ID NO: 2164952 - RNA, 19 nt, Human
gccacugcccgagcuggug

SEQ ID NO: 2164953 - RNA, 18 nt, Human
gccacugccuucgcuucu

SEQ ID NO: 2164954 - RNA, 23 nt, Human
gccacugccuucgcuucuugccu

SEQ ID NO: 2164955 - RNA, 12 nt, Human
gccacuggccau

SEQ ID NO: 2164956 - RNA, 16 nt, Human
gccacuggccaucucc

SEQ ID NO: 2164957 - RNA, 22 nt, Human
gccacugccuucgcuucuugcc

SEQ ID NO: 2164958 - RNA, 13 nt, Human
gccacugcugcuu

SEQ ID NO: 2164959 - RNA, 12 nt, Human
gccacugccucu

SEQ ID NO: 2164960 - RNA, 13 nt, Human
gccacugccucuu

SEQ ID NO: 2164961 - RNA, 16 nt, Human
gccacugccucuuccu

SEQ ID NO: 2164962 - RNA, 17 nt, Human
gccacugccucuuccuc

SEQ ID NO: 2164963 - RNA, 20 nt, Human
gccauguuccaauaaacagg

SEQ ID NO: 2164964 - RNA, 19 nt, Human
gccauguuccaauaaacag

SEQ ID NO: 2164965 - RNA, 22 nt, Human
gccauucacuucauaauccagu

SEQ ID NO: 2164966 - RNA, 21 nt, Human
gccauucacuucauaauccag

SEQ ID NO: 2164967 - RNA, 14 nt, Human
gccauuccaacagc

SEQ ID NO: 2164968 - RNA, 18 nt, Human
gccauucacugcccccag

SEQ ID NO: 2164969 - RNA, 20 nt, Human
gccauuccugguacccagcc

SEQ ID NO: 2164970 - RNA, 22 nt, Human
gccauuccugguacccagccau

SEQ ID NO: 2164971 - RNA, 16 nt, Human
gccauucucaagcccu

SEQ ID NO: 2164972 - RNA, 18 nt, Human
gccauucucaagcccugc

SEQ ID NO: 2164973 - RNA, 18 nt, Human
gccauuccccgucucugg

SEQ ID NO: 2164974 - RNA, 17 nt, Human
gccauuccccgucucug

SEQ ID NO: 2164975 - RNA, 19 nt, Human
gccauguuggccaggcugg

SEQ ID NO: 2164976 - RNA, 20 nt, Human
gccauguuggccaggcuggu

SEQ ID NO: 2164977 - RNA, 22 nt, Human
gccauguuggccaggcuggucu

SEQ ID NO: 2164978 - RNA, 24 nt, Human
gccauguuggccaggcuggucuca

SEQ ID NO: 2164979 - RNA, 18 nt, Human
gcccaccuuggcucaagu

SEQ ID NO: 2164980 - RNA, 17 nt, Human
gccauucuccacagcaa

SEQ ID NO: 2164981 - RNA, 13 nt, Human
gcccacgccccca

SEQ ID NO: 2164982 - RNA, 14 nt, Human
gcccacgcccccac

SEQ ID NO: 2164983 - RNA, 15 nt, Human
gcccacgcuggagug

SEQ ID NO: 2164984 - RNA, 17 nt, Human
gccauucugacucauau

SEQ ID NO: 2164985 - RNA, 16 nt, Human
gcccacgcuggagugc

SEQ ID NO: 2164986 - RNA, 17 nt, Human
gcccacgcuggagugca

SEQ ID NO: 2164987 - RNA, 19 nt, Human
gccauauucuguuggccag

SEQ ID NO: 2164988 - RNA, 20 nt, Human
gccauauucuguuggccagu

SEQ ID NO: 2164989 - RNA, 15 nt, Human
gccauguagaagcug

SEQ ID NO: 2164990 - RNA, 16 nt, Human
gccauguagaagcugc

SEQ ID NO: 2164991 - RNA, 18 nt, Human
gccauguagaagcugcau

SEQ ID NO: 2164992 - RNA, 21 nt, Human
gccauauugcacaugucuuaa

SEQ ID NO: 2164993 - RNA, 22 nt, Human
gccauauugcacaugucuuaau

SEQ ID NO: 2164994 - RNA, 20 nt, Human
gccaugguacccccuucugg

SEQ ID NO: 2164995 - RNA, 21 nt, Human
gccaugguacccccuucuggg

SEQ ID NO: 2164996 - RNA, 15 nt, Human
gccauguuggccagg

SEQ ID NO: 2164997 - RNA, 16 nt, Human
gccauguuggccaggc

SEQ ID NO: 2164998 - RNA, 17 nt, Human
gccauguuggccaggcu

SEQ ID NO: 2164999 - RNA, 18 nt, Human
gccauguuggccaggcug

SEQ ID NO: 2165000 - RNA, 17 nt, Human
gccaugugaagagggag

SEQ ID NO: 2165001 - RNA, 15 nt, Human
gccaugugaagaggg

SEQ ID NO: 2165002 - RNA, 14 nt, Human
gccauguuggccag

SEQ ID NO: 2165003 - RNA, 22 nt, Human
gccaugucugggaacagggacg

SEQ ID NO: 2165004 - RNA, 21 nt, Human
gccaggccugggucugugucu

SEQ ID NO: 2165005 - RNA, 14 nt, Human
gccaggccuggguc

SEQ ID NO: 2165006 - RNA, 13 nt, Human
gccaggccgggcc

SEQ ID NO: 2165007 - RNA, 17 nt, Human
gccaggccucuuggcag

SEQ ID NO: 2165008 - RNA, 21 nt, Human
gccaggccucuuggcagucac

SEQ ID NO: 2165009 - RNA, 22 nt, Human
gccaggagcucuucaggccucc

SEQ ID NO: 2165010 - RNA, 13 nt, Human
gccaggagcuggg

SEQ ID NO: 2165011 - RNA, 22 nt, Human
gccaggagcugggcagaaggcc

SEQ ID NO: 2165012 - RNA, 23 nt, Human
gccaggagcugggcagaaggcca

SEQ ID NO: 2165013 - RNA, 16 nt, Human
gccaggaggccaggcu

SEQ ID NO: 2165014 - RNA, 20 nt, Human
gccaggagcucuucaggccu

SEQ ID NO: 2165015 - RNA, 14 nt, Human
gccagccagcagcc

SEQ ID NO: 2165016 - RNA, 13 nt, Human
gccagccagcagc

SEQ ID NO: 2165017 - RNA, 12 nt, Human
gccagccagcag

SEQ ID NO: 2165018 - RNA, 19 nt, Human
gccaggaguuugagaccag

SEQ ID NO: 2165019 - RNA, 17 nt, Human
gccaggaucauggugua

SEQ ID NO: 2165020 - RNA, 19 nt, Human
gccaggaucaugguguaau

SEQ ID NO: 2165021 - RNA, 23 nt, Human
gccaggccacaagacccuugugg

SEQ ID NO: 2165022 - RNA, 12 nt, Human
gccaggccagag

SEQ ID NO: 2165023 - RNA, 15 nt, Human
gccaggccaccagga

SEQ ID NO: 2165024 - RNA, 16 nt, Human
gccaggccaccaggau

SEQ ID NO: 2165025 - RNA, 19 nt, Human
gccaggccaccaggauggc

SEQ ID NO: 2165026 - RNA, 20 nt, Human
gccaggauggaacacggcca

SEQ ID NO: 2165027 - RNA, 22 nt, Human
gccaggaucaugguguaauaag

SEQ ID NO: 2165028 - RNA, 24 nt, Human
gccaggaucaugguguaauaagac

SEQ ID NO: 2165029 - RNA, 13 nt, Human
gccaggccagagg

SEQ ID NO: 2165030 - RNA, 15 nt, Human
gccaggcccucugcc

SEQ ID NO: 2165031 - RNA, 19 nt, Human
gccaggccacuggccccug

SEQ ID NO: 2165032 - RNA, 16 nt, Human
gccaggcccucugccc

SEQ ID NO: 2165033 - RNA, 17 nt, Human
gccaggcccucugccca

SEQ ID NO: 2165034 - RNA, 21 nt, Human
gccaggcccucugcccacucc

SEQ ID NO: 2165035 - RNA, 23 nt, Human
gccaggccggcgagcccugugga

SEQ ID NO: 2165036 - RNA, 20 nt, Human
gccaggccggcgagcccugu

SEQ ID NO: 2165037 - RNA, 19 nt, Human
gccaggccggcgagcccug

SEQ ID NO: 2165038 - RNA, 20 nt, Human
gccaggccaccuccagaaac

SEQ ID NO: 2165039 - RNA, 19 nt, Human
gccaggcccucugcccacu

SEQ ID NO: 2165040 - RNA, 20 nt, Human
gccaggcccucugcccacuc

SEQ ID NO: 2165041 - RNA, 21 nt, Human
gccagaagcugagcaccaggg

SEQ ID NO: 2165042 - RNA, 18 nt, Human
gccagaagggggccauga

SEQ ID NO: 2165043 - RNA, 19 nt, Human
gccagaagauccccucagg

SEQ ID NO: 2165044 - RNA, 12 nt, Human
gccagaagcuga

SEQ ID NO: 2165045 - RNA, 17 nt, Human
gccagaaccuggagggc

SEQ ID NO: 2165046 - RNA, 18 nt, Human
gccagaacguggcucugc

SEQ ID NO: 2165047 - RNA, 20 nt, Human
gccagaacguggcucugcug

SEQ ID NO: 2165048 - RNA, 22 nt, Human
gccagaacguggcucugcuggc

SEQ ID NO: 2165049 - RNA, 17 nt, Human
gccagaagauccccuca

SEQ ID NO: 2165050 - RNA, 18 nt, Human
gccagaagauccccucag

SEQ ID NO: 2165051 - RNA, 14 nt, Human
gccagacauguggu

SEQ ID NO: 2165052 - RNA, 18 nt, Human
gccagacaugccacaagg

SEQ ID NO: 2165053 - RNA, 13 nt, Human
gccagacacucug

SEQ ID NO: 2165054 - RNA, 15 nt, Human
gccagacacucugcu

SEQ ID NO: 2165055 - RNA, 22 nt, Human
gccagacaucaacagauaaaua

SEQ ID NO: 2165056 - RNA, 21 nt, Human
gccagaaguuugucaagucaa

SEQ ID NO: 2165057 - RNA, 15 nt, Human
gccagaauuucaaac

SEQ ID NO: 2165058 - RNA, 17 nt, Human
gccagacacaggcccuc

SEQ ID NO: 2165059 - RNA, 16 nt, Human
gccagacacaggcccu

SEQ ID NO: 2165060 - RNA, 17 nt, Human
gccagacccccuggaga

SEQ ID NO: 2165061 - RNA, 19 nt, Human
gccagacacucugcucugc

SEQ ID NO: 2165062 - RNA, 23 nt, Human
gccagacggcacccacccagcac

SEQ ID NO: 2165063 - RNA, 22 nt, Human
gccagacggcacccacccagca

SEQ ID NO: 2165064 - RNA, 14 nt, Human
gccagcaaagcccc

SEQ ID NO: 2165065 - RNA, 16 nt, Human
gccagcaaagccccau

SEQ ID NO: 2165066 - RNA, 23 nt, Human
gccagcaaagccccaugcuggag

SEQ ID NO: 2165067 - RNA, 13 nt, Human
gccagcaaugaca

SEQ ID NO: 2165068 - RNA, 14 nt, Human
gccagcaacugaau

SEQ ID NO: 2165069 - RNA, 16 nt, Human
gccagcaacugaauaa

SEQ ID NO: 2165070 - RNA, 22 nt, Human
gccagcaaagccccaugcugga

SEQ ID NO: 2165071 - RNA, 13 nt, Human
gccagcaacugaa

SEQ ID NO: 2165072 - RNA, 13 nt, Human
gccagcacacagg

SEQ ID NO: 2165073 - RNA, 12 nt, Human
gccagcacacag

SEQ ID NO: 2165074 - RNA, 20 nt, Human
gccagcaaugacaucucagg

SEQ ID NO: 2165075 - RNA, 23 nt, Human
gccagcaaugacaucucaggggc

SEQ ID NO: 2165076 - RNA, 21 nt, Human
gccagcaaugauguccagaag

SEQ ID NO: 2165077 - RNA, 22 nt, Human
gccagcaaugauguccagaaga

SEQ ID NO: 2165078 - RNA, 22 nt, Human
gccagcacacagggcagugagg

SEQ ID NO: 2165079 - RNA, 20 nt, Human
gccagcacagaaacagagga

SEQ ID NO: 2165080 - RNA, 22 nt, Human
gccagcacagaaacagaggaga

SEQ ID NO: 2165081 - RNA, 18 nt, Human
gccagcacacagggcagu

SEQ ID NO: 2165082 - RNA, 17 nt, Human
gccagcacacagggcag

SEQ ID NO: 2165083 - RNA, 16 nt, Human
gccagcacacagggca

SEQ ID NO: 2165084 - RNA, 15 nt, Human
gccagcacacagggc

SEQ ID NO: 2165085 - RNA, 15 nt, Human
gccagcagccagcuc

SEQ ID NO: 2165086 - RNA, 13 nt, Human
gccagcagccagc

SEQ ID NO: 2165087 - RNA, 12 nt, Human
gccagcagccag

SEQ ID NO: 2165088 - RNA, 17 nt, Human
gccagcagacauuguca

SEQ ID NO: 2165089 - RNA, 15 nt, Human
gccagcagacauugu

SEQ ID NO: 2165090 - RNA, 16 nt, Human
gccagcagacauuguc

SEQ ID NO: 2165091 - RNA, 20 nt, Human
gccagcacuuguccagcuga

SEQ ID NO: 2165092 - RNA, 13 nt, Human
gccagcagacauu

SEQ ID NO: 2165093 - RNA, 14 nt, Human
gccagcagacauug

SEQ ID NO: 2165094 - RNA, 19 nt, Human
gccagcacuuguccagcug

SEQ ID NO: 2165095 - RNA, 14 nt, Human
gccagcacuugucc

SEQ ID NO: 2165096 - RNA, 14 nt, Human
gccagcaccuggca

SEQ ID NO: 2165097 - RNA, 15 nt, Human
gccagcacuuguaua

SEQ ID NO: 2165098 - RNA, 16 nt, Human
gccagcacuuguauau

SEQ ID NO: 2165099 - RNA, 23 nt, Human
gccagcagccagcucucagccaa

SEQ ID NO: 2165100 - RNA, 22 nt, Human
gccagcagccagcucucagcca

SEQ ID NO: 2165101 - RNA, 21 nt, Human
gccagcagccagcucucagcc

SEQ ID NO: 2165102 - RNA, 20 nt, Human
gccagcagccagcucucagc

SEQ ID NO: 2165103 - RNA, 19 nt, Human
gccagcagccagcucucag

SEQ ID NO: 2165104 - RNA, 18 nt, Human
gccagcagccagcucuca

SEQ ID NO: 2165105 - RNA, 17 nt, Human
gccagcagccagcucuc

SEQ ID NO: 2165106 - RNA, 16 nt, Human
gccagcagccagcucu

SEQ ID NO: 2165107 - RNA, 13 nt, Human
gccagcaggcucu

SEQ ID NO: 2165108 - RNA, 16 nt, Human
gccagcaggcucucag

SEQ ID NO: 2165109 - RNA, 17 nt, Human
gccagcaggcucucagg

SEQ ID NO: 2165110 - RNA, 18 nt, Human
gccagcaggcucucaggc

SEQ ID NO: 2165111 - RNA, 19 nt, Human
gccagcaggcucucaggcc

SEQ ID NO: 2165112 - RNA, 20 nt, Human
gccagcaggcucucaggcca

SEQ ID NO: 2165113 - RNA, 21 nt, Human
gccagcaggcucucaggccag

SEQ ID NO: 2165114 - RNA, 23 nt, Human
gccagcaggcucucaggccagcu

SEQ ID NO: 2165115 - RNA, 16 nt, Human
gcucuacaucuucugc

SEQ ID NO: 2165116 - RNA, 17 nt, Human
gcucuacaucuucugcc

SEQ ID NO: 2165117 - RNA, 15 nt, Human
gcucucaggccagcu

SEQ ID NO: 2165118 - RNA, 16 nt, Human
gcucucaggccagcug

SEQ ID NO: 2165119 - RNA, 20 nt, Human
gcucuacagcuaaucagcau

SEQ ID NO: 2165120 - RNA, 22 nt, Human
gcucuacagcuaaucagcauuc

SEQ ID NO: 2165121 - RNA, 13 nt, Human
gcucucaggccag

SEQ ID NO: 2165122 - RNA, 14 nt, Human
gcucucaggccagc

SEQ ID NO: 2165123 - RNA, 20 nt, Human
gcucccaggcauuccccagg

SEQ ID NO: 2165124 - RNA, 21 nt, Human
gcucccaggcauuccccagga

SEQ ID NO: 2165125 - RNA, 22 nt, Human
gcucccaggcauuccccaggag

SEQ ID NO: 2165126 - RNA, 14 nt, Human
gcuccccagcccag

SEQ ID NO: 2165127 - RNA, 13 nt, Human
gcuccccagccca

SEQ ID NO: 2165128 - RNA, 20 nt, Human
gcuccccacugccuacugca

SEQ ID NO: 2165129 - RNA, 19 nt, Human
gcuccccacugccuacugc

SEQ ID NO: 2165130 - RNA, 17 nt, Human
gcucccauuucuacucu

SEQ ID NO: 2165131 - RNA, 18 nt, Human
gcucccauuucuacucuc

SEQ ID NO: 2165132 - RNA, 16 nt, Human
gcuccccagcccaggg

SEQ ID NO: 2165133 - RNA, 15 nt, Human
gcuccccagcccagg

SEQ ID NO: 2165134 - RNA, 14 nt, Human
gcuccccagcccug

SEQ ID NO: 2165135 - RNA, 15 nt, Human
gcuccccagcccugg

SEQ ID NO: 2165136 - RNA, 16 nt, Human
gcuccccagcccuggc

SEQ ID NO: 2165137 - RNA, 18 nt, Human
gcuccccagcccuggcuc

SEQ ID NO: 2165138 - RNA, 20 nt, Human
gcuccccagcccuggcucug

SEQ ID NO: 2165139 - RNA, 14 nt, Human
gcuccccagcccca

SEQ ID NO: 2165140 - RNA, 16 nt, Human
gcuccccgccuguucc

SEQ ID NO: 2165141 - RNA, 18 nt, Human
gcucccccuguccccuca

SEQ ID NO: 2165142 - RNA, 19 nt, Human
gcuccccagcccuggcucu

SEQ ID NO: 2165143 - RNA, 12 nt, Human
gcucccccuguc

SEQ ID NO: 2165144 - RNA, 13 nt, Human
gcucccccugucc

SEQ ID NO: 2165145 - RNA, 14 nt, Human
gcucccccuguccc

SEQ ID NO: 2165146 - RNA, 17 nt, Human
gcuccccgccuguuccc

SEQ ID NO: 2165147 - RNA, 20 nt, Human
gcuccccgccuguucccccg

SEQ ID NO: 2165148 - RNA, 12 nt, Human
gcuccccuccaa

SEQ ID NO: 2165149 - RNA, 22 nt, Human
gcuccccgccuguucccccgcc

SEQ ID NO: 2165150 - RNA, 16 nt, Human
gcuccucugggcagga

SEQ ID NO: 2165151 - RNA, 14 nt, Human
gcuccucugggcag

SEQ ID NO: 2165152 - RNA, 13 nt, Human
gcuccucugggca

SEQ ID NO: 2165153 - RNA, 12 nt, Human
gcuccucugggc

SEQ ID NO: 2165154 - RNA, 19 nt, Human
gcuccucugggcaggaccu

SEQ ID NO: 2165155 - RNA, 11 nt, Human
gcuccucuggg

SEQ ID NO: 2165156 - RNA, 18 nt, Human
gcuccucuccuggaggau

SEQ ID NO: 2165157 - RNA, 12 nt, Human
gcuccucugcuu

SEQ ID NO: 2165158 - RNA, 14 nt, Human
gcuccucuccugga

SEQ ID NO: 2165159 - RNA, 15 nt, Human
gcuccucuccuggag

SEQ ID NO: 2165160 - RNA, 16 nt, Human
gcuccucuccuggagg

SEQ ID NO: 2165161 - RNA, 17 nt, Human
gcuccucuccuggagga

SEQ ID NO: 2165162 - RNA, 15 nt, Human
gcuccccucccuccu

SEQ ID NO: 2165163 - RNA, 13 nt, Human
gcuccccuccucu

SEQ ID NO: 2165164 - RNA, 18 nt, Human
gcuccccuccucuccccu

SEQ ID NO: 2165165 - RNA, 18 nt, Human
gcuccccucggagaagag

SEQ ID NO: 2165166 - RNA, 15 nt, Human
gcuccccucggagaa

SEQ ID NO: 2165167 - RNA, 22 nt, Human
gcuccugccaccacgcccggcu

SEQ ID NO: 2165168 - RNA, 19 nt, Human
gcuccugccaguguggaac

SEQ ID NO: 2165169 - RNA, 12 nt, Human
gcuccugcccac

SEQ ID NO: 2165170 - RNA, 15 nt, Human
gcuccugccgcagag

SEQ ID NO: 2165171 - RNA, 17 nt, Human
gcuccugccgcagagcu

SEQ ID NO: 2165172 - RNA, 15 nt, Human
gcuccugccuucugu

SEQ ID NO: 2165173 - RNA, 22 nt, Human
gcuccugccgcagagcuggccg

SEQ ID NO: 2165174 - RNA, 18 nt, Human
gcuccugccgcagagcug

SEQ ID NO: 2165175 - RNA, 19 nt, Human
gcuccugccgcagagcugg

SEQ ID NO: 2165176 - RNA, 19 nt, Human
gcuccugccuucuguccug

SEQ ID NO: 2165177 - RNA, 17 nt, Human
gcuccugccuucugucc

SEQ ID NO: 2165178 - RNA, 18 nt, Human
gcuccugccuucuguccu

SEQ ID NO: 2165179 - RNA, 14 nt, Human
gcuccugcuccaca

SEQ ID NO: 2165180 - RNA, 17 nt, Human
gcuccugcuccacagcc

SEQ ID NO: 2165181 - RNA, 20 nt, Human
gcuccugcuccacagccauc

SEQ ID NO: 2165182 - RNA, 15 nt, Human
gcucggaggaagccc

SEQ ID NO: 2165183 - RNA, 21 nt, Human
gcucgcuguugcugaauaggc

SEQ ID NO: 2165184 - RNA, 14 nt, Human
gcucgcuguugcug

SEQ ID NO: 2165185 - RNA, 16 nt, Human
gcucgcuguugcugaa

SEQ ID NO: 2165186 - RNA, 13 nt, Human
gcucgcuguugcu

SEQ ID NO: 2165187 - RNA, 22 nt, Human
gcucgcugcugcgcccugggcu

SEQ ID NO: 2165188 - RNA, 11 nt, Human
gcuccugcugc

SEQ ID NO: 2165189 - RNA, 12 nt, Human
gcuccugcugca

SEQ ID NO: 2165190 - RNA, 15 nt, Human
gcuccugcugcacca

SEQ ID NO: 2165191 - RNA, 23 nt, Human
gcucggaggcugcccccggcccc

SEQ ID NO: 2165192 - RNA, 17 nt, Human
gcucggaggcugccccc

SEQ ID NO: 2165193 - RNA, 18 nt, Human
gcucggaggcugcccccg

SEQ ID NO: 2165194 - RNA, 14 nt, Human
gcuccugcugcacc

SEQ ID NO: 2165195 - RNA, 14 nt, Human
gcucggaggcccca

SEQ ID NO: 2165196 - RNA, 18 nt, Human
gcucggaggccccaaagg

SEQ ID NO: 2165197 - RNA, 19 nt, Human
gcucggaggccccaaagga

SEQ ID NO: 2165198 - RNA, 21 nt, Human
gcucggaggccccaaaggaaa

SEQ ID NO: 2165199 - RNA, 14 nt, Human
gcucggaggcugcc

SEQ ID NO: 2165200 - RNA, 15 nt, Human
gcucggaggcugccc

SEQ ID NO: 2165201 - RNA, 16 nt, Human
gcucggaggcugcccc

SEQ ID NO: 2165202 - RNA, 12 nt, Human
gcucgggcccag

SEQ ID NO: 2165203 - RNA, 13 nt, Human
gcucgggcccagg

SEQ ID NO: 2165204 - RNA, 14 nt, Human
gcucgggcccaggc

SEQ ID NO: 2165205 - RNA, 15 nt, Human
gcucgggcccaggcc

SEQ ID NO: 2165206 - RNA, 11 nt, Human
gcucuggcuga

SEQ ID NO: 2165207 - RNA, 22 nt, Human
gcucugccaacuucuucagagc

SEQ ID NO: 2165208 - RNA, 15 nt, Human
gcucuggcugaaccc

SEQ ID NO: 2165209 - RNA, 16 nt, Human
gcucuggcugaacccu

SEQ ID NO: 2165210 - RNA, 19 nt, Human
gcucuggcugaacccugug

SEQ ID NO: 2165211 - RNA, 20 nt, Human
gcucuggcugaacccugugc

SEQ ID NO: 2165212 - RNA, 21 nt, Human
gcucuggcugaacccugugcu

SEQ ID NO: 2165213 - RNA, 15 nt, Human
gcucuguccugggag

SEQ ID NO: 2165214 - RNA, 14 nt, Human
gcucuguccuggga

SEQ ID NO: 2165215 - RNA, 17 nt, Human
gcucuguguugccaugu

SEQ ID NO: 2165216 - RNA, 21 nt, Human
gcucugggauagcugacccag

SEQ ID NO: 2165217 - RNA, 16 nt, Human
gcucuguccugggagu

SEQ ID NO: 2165218 - RNA, 19 nt, Human
gcucugucgcccaggcugg

SEQ ID NO: 2165219 - RNA, 22 nt, Human
gcucuggcugaacccugugcug

SEQ ID NO: 2165220 - RNA, 15 nt, Human
gcucugggagaggau

SEQ ID NO: 2165221 - RNA, 20 nt, Human
gcugaaauacugaggggucu

SEQ ID NO: 2165222 - RNA, 15 nt, Human
gcugaaaugcugcau

SEQ ID NO: 2165223 - RNA, 14 nt, Human
gcugaaauucuccu

SEQ ID NO: 2165224 - RNA, 15 nt, Human
gcugaaauucuccug

SEQ ID NO: 2165225 - RNA, 16 nt, Human
gcugaaauucuccugg

SEQ ID NO: 2165226 - RNA, 19 nt, Human
gcucuucagugggagaaaa

SEQ ID NO: 2165227 - RNA, 17 nt, Human
gcucuucauaauucuaa

SEQ ID NO: 2165228 - RNA, 19 nt, Human
gcucuucauaauucuaaga

SEQ ID NO: 2165229 - RNA, 12 nt, Human
gcugaaauacug

SEQ ID NO: 2165230 - RNA, 14 nt, Human
gcucuucauguuuc

SEQ ID NO: 2165231 - RNA, 15 nt, Human
gcucuuccaggcugg

SEQ ID NO: 2165232 - RNA, 16 nt, Human
gcucuuccaggcuggg

SEQ ID NO: 2165233 - RNA, 18 nt, Human
gcucuucaggccucccuc

SEQ ID NO: 2165234 - RNA, 15 nt, Human
gcucuucaggccucc

SEQ ID NO: 2165235 - RNA, 12 nt, Human
gcucuucaggcc

SEQ ID NO: 2165236 - RNA, 12 nt, Human
gcucuuccaggc

SEQ ID NO: 2165237 - RNA, 16 nt, Human
gcucuuagcagcuucc

SEQ ID NO: 2165238 - RNA, 19 nt, Human
gcucuuaauuguucauuuu

SEQ ID NO: 2165239 - RNA, 19 nt, Human
gcucuuagcagcuuccaga

SEQ ID NO: 2165240 - RNA, 17 nt, Human
gcucuuagcagcuucca

SEQ ID NO: 2165241 - RNA, 18 nt, Human
gcucuuagcagcuuccag

SEQ ID NO: 2165242 - RNA, 16 nt, Human
gcugacagacacaggc

SEQ ID NO: 2165243 - RNA, 23 nt, Human
gcugagcgaggagaugcuccuug

SEQ ID NO: 2165244 - RNA, 14 nt, Human
gcugagcgccagga

SEQ ID NO: 2165245 - RNA, 14 nt, Human
gcugagcucucugu

SEQ ID NO: 2165246 - RNA, 14 nt, Human
gcugacagacacag

SEQ ID NO: 2165247 - RNA, 15 nt, Human
gcugacagacacagg

SEQ ID NO: 2165248 - RNA, 14 nt, Human
gcugaauuaucuau

SEQ ID NO: 2165249 - RNA, 23 nt, Human
gcugaaggacugugacaggcagc

SEQ ID NO: 2165250 - RNA, 20 nt, Human
gcugaauguugggacugcua

SEQ ID NO: 2165251 - RNA, 23 nt, Human
gcugaauguugggacugcuaaau

SEQ ID NO: 2165252 - RNA, 19 nt, Human
gcugaauaggcgaucacaa

SEQ ID NO: 2165253 - RNA, 21 nt, Human
gcugaaggacugugacaggca

SEQ ID NO: 2165254 - RNA, 22 nt, Human
gcugaaggacugugacaggcag

SEQ ID NO: 2165255 - RNA, 17 nt, Human
gcugaauguugggacug

SEQ ID NO: 2165256 - RNA, 15 nt, Human
gcugaauccagauca

SEQ ID NO: 2165257 - RNA, 22 nt, Human
gcugaauacagaggcaacugca

SEQ ID NO: 2165258 - RNA, 17 nt, Human
gcugaaugguuuucaaa

SEQ ID NO: 2165259 - RNA, 12 nt, Human
gcugaaggcucg

SEQ ID NO: 2165260 - RNA, 20 nt, Human
gcugaaggcucgagcaugcc

SEQ ID NO: 2165261 - RNA, 13 nt, Human
gcugaagcugccu

SEQ ID NO: 2165262 - RNA, 15 nt, Human
gcugaagcugccugc

SEQ ID NO: 2165263 - RNA, 18 nt, Human
gcugaagauggcauccug

SEQ ID NO: 2165264 - RNA, 21 nt, Human
gcugaacacuccaauuaagga

SEQ ID NO: 2165265 - RNA, 20 nt, Human
gcugaacacuccaauuaagg

SEQ ID NO: 2165266 - RNA, 12 nt, Human
gcugaaggacug

SEQ ID NO: 2165267 - RNA, 13 nt, Human
gcugaaggacugu

SEQ ID NO: 2165268 - RNA, 14 nt, Human
gcugaaggacugug

SEQ ID NO: 2165269 - RNA, 19 nt, Human
gcugaaggaaaccagugca

SEQ ID NO: 2165270 - RNA, 16 nt, Human
gcugaagcugccugcu

SEQ ID NO: 2165271 - RNA, 17 nt, Human
gcugaagcugccugcuu

SEQ ID NO: 2165272 - RNA, 16 nt, Human
gcugaaaugcugcauu

SEQ ID NO: 2165273 - RNA, 17 nt, Human
gcugaaauucuccugga

SEQ ID NO: 2165274 - RNA, 18 nt, Human
gcugaaauucuccuggag

SEQ ID NO: 2165275 - RNA, 17 nt, Human
gcugaaauuuuauaugc

SEQ ID NO: 2165276 - RNA, 15 nt, Human
gcugaaauuuuauau

SEQ ID NO: 2165277 - RNA, 20 nt, Human
gcucugacagaaagcagaua

SEQ ID NO: 2165278 - RNA, 15 nt, Human
gcucugacccaguga

SEQ ID NO: 2165279 - RNA, 17 nt, Human
gcucugacccagugaga

SEQ ID NO: 2165280 - RNA, 21 nt, Human
gcucugaccgaaacagcgcug

SEQ ID NO: 2165281 - RNA, 15 nt, Human
gcucugcacagaugg

SEQ ID NO: 2165282 - RNA, 13 nt, Human
gcucugcagccca

SEQ ID NO: 2165283 - RNA, 15 nt, Human
gcucugcagcccagg

SEQ ID NO: 2165284 - RNA, 18 nt, Human
gcucugcagcccagggac

SEQ ID NO: 2165285 - RNA, 18 nt, Human
gcucugcacagauggauu

SEQ ID NO: 2165286 - RNA, 14 nt, Human
gcucugcacagaug

SEQ ID NO: 2165287 - RNA, 13 nt, Human
gcucugcacagau

SEQ ID NO: 2165288 - RNA, 12 nt, Human
gcucugcacaga

SEQ ID NO: 2165289 - RNA, 11 nt, Human
gcucugcacag

SEQ ID NO: 2165290 - RNA, 23 nt, Human
gcucugcaauuccccucugcugc

SEQ ID NO: 2165291 - RNA, 13 nt, Human
gcucugagccagu

SEQ ID NO: 2165292 - RNA, 18 nt, Human
gcucugcaauuccccucu

SEQ ID NO: 2165293 - RNA, 20 nt, Human
gcucugagcaaauguggcuc

SEQ ID NO: 2165294 - RNA, 21 nt, Human
gcucugagcaaauguggcucc

SEQ ID NO: 2165295 - RNA, 23 nt, Human
gcucuggagcccacuguacuugc

SEQ ID NO: 2165296 - RNA, 13 nt, Human
gcucuggagggga

SEQ ID NO: 2165297 - RNA, 23 nt, Human
gcucugccaacuucuucagagcu

SEQ ID NO: 2165298 - RNA, 15 nt, Human
gcucuggaggggagg

SEQ ID NO: 2165299 - RNA, 16 nt, Human
gcucuggaggggaggg

SEQ ID NO: 2165300 - RNA, 19 nt, Human
gcucugcagcccagggacc

SEQ ID NO: 2165301 - RNA, 14 nt, Human
gcucugcaggcacc

SEQ ID NO: 2165302 - RNA, 15 nt, Human
gcucugcaggcaccu

SEQ ID NO: 2165303 - RNA, 16 nt, Human
gcucugcaggcaccuu

SEQ ID NO: 2165304 - RNA, 18 nt, Human
gcucugcaggcaccuuag

SEQ ID NO: 2165305 - RNA, 11 nt, Human
gcucugcaugc

SEQ ID NO: 2165306 - RNA, 15 nt, Human
gcucugcaugcggcc

SEQ ID NO: 2165307 - RNA, 16 nt, Human
gcucugcaugcggccc

SEQ ID NO: 2165308 - RNA, 17 nt, Human
gcucugcaugcggccca

SEQ ID NO: 2165309 - RNA, 18 nt, Human
gcucugcaugcggcccag

SEQ ID NO: 2165310 - RNA, 19 nt, Human
gcucugcaugcggcccagc

SEQ ID NO: 2165311 - RNA, 20 nt, Human
gcucugcaugcggcccagcc

SEQ ID NO: 2165312 - RNA, 21 nt, Human
gcucugcaugcggcccagccc

SEQ ID NO: 2165313 - RNA, 22 nt, Human
gcucugcaugcggcccagcccg

SEQ ID NO: 2165314 - RNA, 15 nt, Human
gcucugcauuugucu

SEQ ID NO: 2165315 - RNA, 19 nt, Human
gccuguuauaacucugcac

SEQ ID NO: 2165316 - RNA, 11 nt, Human
gccuguucagu

SEQ ID NO: 2165317 - RNA, 20 nt, Human
gccuguucagcuccagcuca

SEQ ID NO: 2165318 - RNA, 22 nt, Human
gccugugugacaucaguggcau

SEQ ID NO: 2165319 - RNA, 22 nt, Human
gccuguuagacucuuacuuuuu

SEQ ID NO: 2165320 - RNA, 19 nt, Human
gccuguucagcuccagcuc

SEQ ID NO: 2165321 - RNA, 24 nt, Human
gccuguucaguuacagaaaguggu

SEQ ID NO: 2165322 - RNA, 12 nt, Human
gccuguucaguu

SEQ ID NO: 2165323 - RNA, 13 nt, Human
gccuguucaguua

SEQ ID NO: 2165324 - RNA, 15 nt, Human
gccuguucaguuaca

SEQ ID NO: 2165325 - RNA, 16 nt, Human
gccuguucaguuacag

SEQ ID NO: 2165326 - RNA, 19 nt, Human
gccuguucaguuacagaaa

SEQ ID NO: 2165327 - RNA, 20 nt, Human
gccuguucaguuacagaaag

SEQ ID NO: 2165328 - RNA, 21 nt, Human
gccuguucaguuacagaaagu

SEQ ID NO: 2165329 - RNA, 22 nt, Human
gccuguucaguuacagaaagug

SEQ ID NO: 2165330 - RNA, 18 nt, Human
gcuaggaacacuccuuca

SEQ ID NO: 2165331 - RNA, 19 nt, Human
gcuaggaacacuccuucac

SEQ ID NO: 2165332 - RNA, 21 nt, Human
gcuaggaacacuccuucacag

SEQ ID NO: 2165333 - RNA, 18 nt, Human
gcuaugggagccccaggg

SEQ ID NO: 2165334 - RNA, 23 nt, Human
gcuagucaagcuccuccucccug

SEQ ID NO: 2165335 - RNA, 21 nt, Human
gcuagucaagcuccuccuccc

SEQ ID NO: 2165336 - RNA, 16 nt, Human
gcuagucaagcuccuc

SEQ ID NO: 2165337 - RNA, 19 nt, Human
gcuagucaagcuccuccuc

SEQ ID NO: 2165338 - RNA, 18 nt, Human
gcuagucaagcuccuccu

SEQ ID NO: 2165339 - RNA, 18 nt, Human
gcuaggcauacaaguagg

SEQ ID NO: 2165340 - RNA, 16 nt, Human
gcuaguaucaaaagaa

SEQ ID NO: 2165341 - RNA, 21 nt, Human
gcuaguaauuggaaaggcagc

SEQ ID NO: 2165342 - RNA, 14 nt, Human
gcuaggccuggcca

SEQ ID NO: 2165343 - RNA, 15 nt, Human
gcuaggccuggccag

SEQ ID NO: 2165344 - RNA, 21 nt, Human
gcuaugggagccccagggucu

SEQ ID NO: 2165345 - RNA, 19 nt, Human
gcuaugggagccccagggu

SEQ ID NO: 2165346 - RNA, 19 nt, Human
gcuauggggauagaugugu

SEQ ID NO: 2165347 - RNA, 18 nt, Human
gcuauggggagaaaagac

SEQ ID NO: 2165348 - RNA, 14 nt, Human
gcuauggugagaug

SEQ ID NO: 2165349 - RNA, 15 nt, Human
gcuauggugagaugc

SEQ ID NO: 2165350 - RNA, 16 nt, Human
gcuauggugagaugca

SEQ ID NO: 2165351 - RNA, 21 nt, Human
gcuauggggauagaugugugg

SEQ ID NO: 2165352 - RNA, 22 nt, Human
gcuauguauggaauacaguguu

SEQ ID NO: 2165353 - RNA, 22 nt, Human
gcuauggugagaugcagcugga

SEQ ID NO: 2165354 - RNA, 11 nt, Human
gcuaugugacu

SEQ ID NO: 2165355 - RNA, 16 nt, Human
gcuauugucaccaggg

SEQ ID NO: 2165356 - RNA, 22 nt, Human
gcucaccuggggugugggaggc

SEQ ID NO: 2165357 - RNA, 15 nt, Human
gcucaccuguugcuu

SEQ ID NO: 2165358 - RNA, 19 nt, Human
gcucaccuguugcuuacaa

SEQ ID NO: 2165359 - RNA, 20 nt, Human
gcucaccuguugcuuacaau

SEQ ID NO: 2165360 - RNA, 13 nt, Human
gcucaccuggggu

SEQ ID NO: 2165361 - RNA, 12 nt, Human
gcucaccugggg

SEQ ID NO: 2165362 - RNA, 17 nt, Human
gcuauuuccauuccaga

SEQ ID NO: 2165363 - RNA, 15 nt, Human
gcuauuucaucuauu

SEQ ID NO: 2165364 - RNA, 14 nt, Human
gcuauuucaucuau

SEQ ID NO: 2165365 - RNA, 13 nt, Human
gcuauuuaaaacu

SEQ ID NO: 2165366 - RNA, 16 nt, Human
gcuauuguaaauaugu

SEQ ID NO: 2165367 - RNA, 22 nt, Human
gcuauuguuucuuuaagaaagu

SEQ ID NO: 2165368 - RNA, 22 nt, Human
gcuauuuaaaaaaaaaagagga

SEQ ID NO: 2165369 - RNA, 14 nt, Human
gcuauuuaaaacuu

SEQ ID NO: 2165370 - RNA, 21 nt, Human
gcuauugucaccagggcugga

SEQ ID NO: 2165371 - RNA, 20 nt, Human
gcuauugucaccagggcugg

SEQ ID NO: 2165372 - RNA, 21 nt, Human
gcucaccuguugcuuacaauu

SEQ ID NO: 2165373 - RNA, 22 nt, Human
gcucaccuguugcuuacaauuu

SEQ ID NO: 2165374 - RNA, 22 nt, Human
gcucacgccuaugaucccagca

SEQ ID NO: 2165375 - RNA, 21 nt, Human
gcucacgccuaugaucccagc

SEQ ID NO: 2165376 - RNA, 22 nt, Human
gcucacgccuguaaucccagca

SEQ ID NO: 2165377 - RNA, 23 nt, Human
gcucacgccuguaaucccagcac

SEQ ID NO: 2165378 - RNA, 21 nt, Human
gcucacgccuguaaucccagc

SEQ ID NO: 2165379 - RNA, 23 nt, Human
gcucaccuguugcuuacaauuuu

SEQ ID NO: 2165380 - RNA, 15 nt, Human
gcucacgucacacuu

SEQ ID NO: 2165381 - RNA, 14 nt, Human
gcucacgucacacu

SEQ ID NO: 2165382 - RNA, 22 nt, Human
gcucacgugagagugucuucac

SEQ ID NO: 2165383 - RNA, 17 nt, Human
gcucacgugugugacuc

SEQ ID NO: 2165384 - RNA, 16 nt, Human
gcucacuaccuccuca

SEQ ID NO: 2165385 - RNA, 15 nt, Human
gcucacgugugugac

SEQ ID NO: 2165386 - RNA, 13 nt, Human
gcucacgugugug

SEQ ID NO: 2165387 - RNA, 18 nt, Human
gcucacuaccuccucagg

SEQ ID NO: 2165388 - RNA, 21 nt, Human
gcucacuaccuccucagggau

SEQ ID NO: 2165389 - RNA, 14 nt, Human
gcucacuaugaauc

SEQ ID NO: 2165390 - RNA, 16 nt, Human
gcucacuaugaaucua

SEQ ID NO: 2165391 - RNA, 15 nt, Human
gcucagagagggugg

SEQ ID NO: 2165392 - RNA, 14 nt, Human
gcucaggagcccug

SEQ ID NO: 2165393 - RNA, 22 nt, Human
gcucagagagggugggaguggg

SEQ ID NO: 2165394 - RNA, 18 nt, Human
gcucagagagggugggag

SEQ ID NO: 2165395 - RNA, 20 nt, Human
gcucagagagggugggagug

SEQ ID NO: 2165396 - RNA, 20 nt, Human
gcucaggggcguguggcuca

SEQ ID NO: 2165397 - RNA, 15 nt, Human
gcucaggucccuggg

SEQ ID NO: 2165398 - RNA, 17 nt, Human
gcucagggccuggcuca

SEQ ID NO: 2165399 - RNA, 19 nt, Human
gcucaggacucagaagccu

SEQ ID NO: 2165400 - RNA, 23 nt, Human
gcucagggccaugcugaggccug

SEQ ID NO: 2165401 - RNA, 13 nt, Human
gcucagggccugg

SEQ ID NO: 2165402 - RNA, 16 nt, Human
gcucagggccuggcuc

SEQ ID NO: 2165403 - RNA, 21 nt, Human
gcucaggagcccugggaggcu

SEQ ID NO: 2165404 - RNA, 18 nt, Human
gcucaggacucagaagcc

SEQ ID NO: 2165405 - RNA, 17 nt, Human
gcucaggacucagaagc

SEQ ID NO: 2165406 - RNA, 12 nt, Human
gcucagggccug

SEQ ID NO: 2165407 - RNA, 15 nt, Human
gcucaggagcccugg

SEQ ID NO: 2165408 - RNA, 18 nt, Human
gcucaggagcccugggag

SEQ ID NO: 2165409 - RNA, 19 nt, Human
gcucaggucccuggggcua

SEQ ID NO: 2165410 - RNA, 21 nt, Human
gcucagguggggucacucugg

SEQ ID NO: 2165411 - RNA, 22 nt, Human
gcucagguggggucacucuggc

SEQ ID NO: 2165412 - RNA, 16 nt, Human
gcuucuuucauuuucu

SEQ ID NO: 2165413 - RNA, 23 nt, Human
gcuucuuucuuugggaauauuug

SEQ ID NO: 2165414 - RNA, 12 nt, Human
gcuucuuucuuu

SEQ ID NO: 2165415 - RNA, 18 nt, Human
gcuucuuucuuugggaau

SEQ ID NO: 2165416 - RNA, 23 nt, Human
gcuucuuuuaguuguaucucuuu

SEQ ID NO: 2165417 - RNA, 17 nt, Human
gcuugaaaaaugugcaa

SEQ ID NO: 2165418 - RNA, 14 nt, Human
gcuuggccugcugu

SEQ ID NO: 2165419 - RNA, 19 nt, Human
gcuugaaacccguggcgcu

SEQ ID NO: 2165420 - RNA, 14 nt, Human
gcuuggcugcuugg

SEQ ID NO: 2165421 - RNA, 15 nt, Human
gcuuggccugcugug

SEQ ID NO: 2165422 - RNA, 16 nt, Human
gcuuggccugcuguga

SEQ ID NO: 2165423 - RNA, 22 nt, Human
gcuuccuuuguuuuuuuuuccu

SEQ ID NO: 2165424 - RNA, 22 nt, Human
gcuuccuuggcaucacagggca

SEQ ID NO: 2165425 - RNA, 23 nt, Human
gcuuccuuuguuuuuuuuuccug

SEQ ID NO: 2165426 - RNA, 12 nt, Human
gcuuccuuucuu

SEQ ID NO: 2165427 - RNA, 21 nt, Human
gcuucgaggcccagcgaccuc

SEQ ID NO: 2165428 - RNA, 19 nt, Human
gcuucgaggcccagcgacc

SEQ ID NO: 2165429 - RNA, 22 nt, Human
gcuucgguuucuaacuuggagc

SEQ ID NO: 2165430 - RNA, 19 nt, Human
gcuucuugccucugugcug

SEQ ID NO: 2165431 - RNA, 20 nt, Human
gcuucgggcccuucccacag

SEQ ID NO: 2165432 - RNA, 18 nt, Human
gcuucgggcccuucccac

SEQ ID NO: 2165433 - RNA, 20 nt, Human
gcuucuugccucugugcugu

SEQ ID NO: 2165434 - RNA, 21 nt, Human
gcuucuugccucugugcugug

SEQ ID NO: 2165435 - RNA, 21 nt, Human
gcuuggguguaacaggucucc

SEQ ID NO: 2165436 - RNA, 19 nt, Human
gcuuggguguaacaggucu

SEQ ID NO: 2165437 - RNA, 20 nt, Human
gcuuggguggagaagccauu

SEQ ID NO: 2165438 - RNA, 21 nt, Human
gcuuggguggagaagccauug

SEQ ID NO: 2165439 - RNA, 16 nt, Human
gcuuggguggagaagc

SEQ ID NO: 2165440 - RNA, 17 nt, Human
gcuuggguggagaagcc

SEQ ID NO: 2165441 - RNA, 18 nt, Human
gcuuggguggagaagcca

SEQ ID NO: 2165442 - RNA, 19 nt, Human
gcuuggguggagaagccau

SEQ ID NO: 2165443 - RNA, 24 nt, Human
gcuugggggaugacuagaggcagg

SEQ ID NO: 2165444 - RNA, 16 nt, Human
gcuuggggcuuccuaa

SEQ ID NO: 2165445 - RNA, 13 nt, Human
gcuuggguggaga

SEQ ID NO: 2165446 - RNA, 14 nt, Human
gcuuggguggagaa

SEQ ID NO: 2165447 - RNA, 16 nt, Human
gcuuguacauaaugcg

SEQ ID NO: 2165448 - RNA, 14 nt, Human
gcuuguacauaaug

SEQ ID NO: 2165449 - RNA, 14 nt, Human
gcuugggacaaauc

SEQ ID NO: 2165450 - RNA, 19 nt, Human
gcuugggaccgccagaugg

SEQ ID NO: 2165451 - RNA, 14 nt, Human
gcuugggcccagcu

SEQ ID NO: 2165452 - RNA, 15 nt, Human
gcuugggcccagcug

SEQ ID NO: 2165453 - RNA, 17 nt, Human
gcuugggcccagcuggg

SEQ ID NO: 2165454 - RNA, 18 nt, Human
gcuugggcccagcugggc

SEQ ID NO: 2165455 - RNA, 19 nt, Human
gcuugggcccagcugggcu

SEQ ID NO: 2165456 - RNA, 20 nt, Human
gcuugggcccagcugggcuc

SEQ ID NO: 2165457 - RNA, 19 nt, Human
gcuugggcuucauccuccu

SEQ ID NO: 2165458 - RNA, 16 nt, Human
gcuuggggcucacaca

SEQ ID NO: 2165459 - RNA, 20 nt, Human
gcuuggggcucacacaccug

SEQ ID NO: 2165460 - RNA, 20 nt, Human
gcuuccauuugugugugugc

SEQ ID NO: 2165461 - RNA, 15 nt, Human
gcuucccccauagcc

SEQ ID NO: 2165462 - RNA, 14 nt, Human
gcuucccccauagc

SEQ ID NO: 2165463 - RNA, 19 nt, Human
gcuucccauuguggcuccu

SEQ ID NO: 2165464 - RNA, 17 nt, Human
gcuucccauccuacccu

SEQ ID NO: 2165465 - RNA, 22 nt, Human
gcuucccauccuacccucgggc

SEQ ID NO: 2165466 - RNA, 18 nt, Human
gcuucccccauagccacc

SEQ ID NO: 2165467 - RNA, 16 nt, Human
gcuucccccauagcca

SEQ ID NO: 2165468 - RNA, 16 nt, Human
gcuuccccucucuccu

SEQ ID NO: 2165469 - RNA, 14 nt, Human
gcuuccccucucuc

SEQ ID NO: 2165470 - RNA, 18 nt, Human
gcuucccaguggcugcug

SEQ ID NO: 2165471 - RNA, 19 nt, Human
gcuucccaguggcugcugc

SEQ ID NO: 2165472 - RNA, 20 nt, Human
gcuucccaguggcugcugcc

SEQ ID NO: 2165473 - RNA, 21 nt, Human
gcuucccaguggcugcugccc

SEQ ID NO: 2165474 - RNA, 22 nt, Human
gcuucccaguggcugcugccca

SEQ ID NO: 2165475 - RNA, 12 nt, Human
gcuucccauccu

SEQ ID NO: 2165476 - RNA, 13 nt, Human
gcuucccauccua

SEQ ID NO: 2165477 - RNA, 18 nt, Human
gcuuccccucucuccucc

SEQ ID NO: 2165478 - RNA, 13 nt, Human
gcuucccuaaucu

SEQ ID NO: 2165479 - RNA, 23 nt, Human
gcuucccgcucagcccucccugc

SEQ ID NO: 2165480 - RNA, 15 nt, Human
gcuucccucugccug

SEQ ID NO: 2165481 - RNA, 13 nt, Human
gcuucccucugcc

SEQ ID NO: 2165482 - RNA, 12 nt, Human
gcuucccucugc

SEQ ID NO: 2165483 - RNA, 14 nt, Human
gcuucccuaaucua

SEQ ID NO: 2165484 - RNA, 15 nt, Human
gcuucccgcucagcc

SEQ ID NO: 2165485 - RNA, 16 nt, Human
gcuucccgcucagccc

SEQ ID NO: 2165486 - RNA, 17 nt, Human
gcuucccgcucagcccu

SEQ ID NO: 2165487 - RNA, 18 nt, Human
gcuucccgcucagcccuc

SEQ ID NO: 2165488 - RNA, 23 nt, Human
gcuucccucugccugucccucuc

SEQ ID NO: 2165489 - RNA, 20 nt, Human
gcuucccucugccugucccu

SEQ ID NO: 2165490 - RNA, 19 nt, Human
gcuucccucugccuguccc

SEQ ID NO: 2165491 - RNA, 17 nt, Human
gcuucccucugccuguc

SEQ ID NO: 2165492 - RNA, 14 nt, Human
gcuuccgcauccua

SEQ ID NO: 2165493 - RNA, 18 nt, Human
gcuucccugacucauucu

SEQ ID NO: 2165494 - RNA, 14 nt, Human
gcuucccugacuca

SEQ ID NO: 2165495 - RNA, 22 nt, Human
gcuuccuucugugaaaguacau

SEQ ID NO: 2165496 - RNA, 17 nt, Human
gcuuccuucauuuccuc

SEQ ID NO: 2165497 - RNA, 14 nt, Human
gcuuccuucauuuc

SEQ ID NO: 2165498 - RNA, 13 nt, Human
gcuuccuucauuu

SEQ ID NO: 2165499 - RNA, 21 nt, Human
gcuuccuagaaguuacugaau

SEQ ID NO: 2165500 - RNA, 23 nt, Human
gcuuccuacccacaccucugcca

SEQ ID NO: 2165501 - RNA, 18 nt, Human
gcuuccuagaaguuacug

SEQ ID NO: 2165502 - RNA, 18 nt, Human
gcuuccggcuccugugcu

SEQ ID NO: 2165503 - RNA, 16 nt, Human
gcuuccggcuccugug

SEQ ID NO: 2165504 - RNA, 22 nt, Human
gcuuccuacccacaccucugcc

SEQ ID NO: 2165505 - RNA, 14 nt, Human
gcuggguucugcac

SEQ ID NO: 2165506 - RNA, 17 nt, Human
gcuggguuggcgcaccc

SEQ ID NO: 2165507 - RNA, 21 nt, Human
gcuggguuggcgcacccuccc

SEQ ID NO: 2165508 - RNA, 22 nt, Human
gcuggguuggcgcacccucccc

SEQ ID NO: 2165509 - RNA, 16 nt, Human
gcuggguuggugcaca

SEQ ID NO: 2165510 - RNA, 14 nt, Human
gcuggguuggaggg

SEQ ID NO: 2165511 - RNA, 21 nt, Human
gcuggguuggaggguguccca

SEQ ID NO: 2165512 - RNA, 15 nt, Human
gcuggguucuaccca

SEQ ID NO: 2165513 - RNA, 15 nt, Human
gcuggguucugaucc

SEQ ID NO: 2165514 - RNA, 15 nt, Human
gcuguaaauaaaugc

SEQ ID NO: 2165515 - RNA, 14 nt, Human
gcuguaaaaucuug

SEQ ID NO: 2165516 - RNA, 16 nt, Human
gcuguaaaaugcauga

SEQ ID NO: 2165517 - RNA, 14 nt, Human
gcuguaaauaaaug

SEQ ID NO: 2165518 - RNA, 20 nt, Human
gcuguaaaaugcaugauuuu

SEQ ID NO: 2165519 - RNA, 16 nt, Human
gcuguaagaagagacu

SEQ ID NO: 2165520 - RNA, 14 nt, Human
gcugguuuuucagu

SEQ ID NO: 2165521 - RNA, 15 nt, Human
gcugguuuuucaguu

SEQ ID NO: 2165522 - RNA, 22 nt, Human
gcugguuuuguaagaugcuggg

SEQ ID NO: 2165523 - RNA, 14 nt, Human
gcuguaucuuguuu

SEQ ID NO: 2165524 - RNA, 18 nt, Human
gcuguaucuuguuuuucc

SEQ ID NO: 2165525 - RNA, 16 nt, Human
gcuguaucuuguuuuu

SEQ ID NO: 2165526 - RNA, 17 nt, Human
gcuguauuaagccacuu

SEQ ID NO: 2165527 - RNA, 21 nt, Human
gcuguacaaauauaagaauaa

SEQ ID NO: 2165528 - RNA, 20 nt, Human
gcuguaucccaugagccuca

SEQ ID NO: 2165529 - RNA, 23 nt, Human
gcuguaucccaugagccucagca

SEQ ID NO: 2165530 - RNA, 24 nt, Human
gcuguaagaagagacugggaagau

SEQ ID NO: 2165531 - RNA, 17 nt, Human
gcuguaaggcaugaagg

SEQ ID NO: 2165532 - RNA, 19 nt, Human
gcuguaaggcaugaaggau

SEQ ID NO: 2165533 - RNA, 18 nt, Human
gcuguaaggcaugaagga

SEQ ID NO: 2165534 - RNA, 22 nt, Human
gcuguaaucuaugaauucuaag

SEQ ID NO: 2165535 - RNA, 12 nt, Human
gcuguacacugc

SEQ ID NO: 2165536 - RNA, 16 nt, Human
gcuguacacugcacga

SEQ ID NO: 2165537 - RNA, 16 nt, Human
gcuguacaaauauaag

SEQ ID NO: 2165538 - RNA, 21 nt, Human
gcuguaaugaaacaccuucuc

SEQ ID NO: 2165539 - RNA, 12 nt, Human
gcuuaaagaugu

SEQ ID NO: 2165540 - RNA, 16 nt, Human
gcuuaaaggugucuuc

SEQ ID NO: 2165541 - RNA, 17 nt, Human
gcuuaaaggugucuucc

SEQ ID NO: 2165542 - RNA, 20 nt, Human
gcuuaaaggugucuuccucc

SEQ ID NO: 2165543 - RNA, 22 nt, Human
gcuuaaaggugucuuccuccca

SEQ ID NO: 2165544 - RNA, 23 nt, Human
gcuuaaaggugucuuccucccaa

SEQ ID NO: 2165545 - RNA, 22 nt, Human
gcuucaaggauccugagccaga

SEQ ID NO: 2165546 - RNA, 19 nt, Human
gcuucaccccaaucccagc

SEQ ID NO: 2165547 - RNA, 14 nt, Human
gcuucaccagagca

SEQ ID NO: 2165548 - RNA, 15 nt, Human
gcuucaccagagcau

SEQ ID NO: 2165549 - RNA, 20 nt, Human
gcuucaccccaaucccagcu

SEQ ID NO: 2165550 - RNA, 22 nt, Human
gcuucacccugaaugguuccau

SEQ ID NO: 2165551 - RNA, 14 nt, Human
gcuuaacuucacau

SEQ ID NO: 2165552 - RNA, 22 nt, Human
gcuucaauacccaaauccucuc

SEQ ID NO: 2165553 - RNA, 15 nt, Human
gcuucaauuaauaaa

SEQ ID NO: 2165554 - RNA, 17 nt, Human
gcuucacuguauaaaua

SEQ ID NO: 2165555 - RNA, 19 nt, Human
gcuucagcauauuuauagc

SEQ ID NO: 2165556 - RNA, 16 nt, Human
gcuucagccacaguuu

SEQ ID NO: 2165557 - RNA, 17 nt, Human
gcuucagcauauuuaua

SEQ ID NO: 2165558 - RNA, 14 nt, Human
gcuucagccaggag

SEQ ID NO: 2165559 - RNA, 22 nt, Human
gcuucagccacaguuuccucau

SEQ ID NO: 2165560 - RNA, 14 nt, Human
gcuucacuguauaa

SEQ ID NO: 2165561 - RNA, 15 nt, Human
gcuucacuguauaaa

SEQ ID NO: 2165562 - RNA, 16 nt, Human
gcuucacuguauaaau

SEQ ID NO: 2165563 - RNA, 20 nt, Human
gcuucacggaagagccuugc

SEQ ID NO: 2165564 - RNA, 21 nt, Human
gcuguuggcugggggccucag

SEQ ID NO: 2165565 - RNA, 22 nt, Human
gcuguuggcugggggccucagu

SEQ ID NO: 2165566 - RNA, 16 nt, Human
gcuguugucccucugc

SEQ ID NO: 2165567 - RNA, 15 nt, Human
gcuguuguacauuua

SEQ ID NO: 2165568 - RNA, 16 nt, Human
gcuguuguacauuuau

SEQ ID NO: 2165569 - RNA, 12 nt, Human
gcuguuguacau

SEQ ID NO: 2165570 - RNA, 13 nt, Human
gcuguuguacauu

SEQ ID NO: 2165571 - RNA, 14 nt, Human
gcuguuguacauuu

SEQ ID NO: 2165572 - RNA, 17 nt, Human
gcuguugucccucugcu

SEQ ID NO: 2165573 - RNA, 18 nt, Human
gcuguugucccucugcua

SEQ ID NO: 2165574 - RNA, 16 nt, Human
gcugugagccccuggu

SEQ ID NO: 2165575 - RNA, 20 nt, Human
gcugugagccccugguccug

SEQ ID NO: 2165576 - RNA, 15 nt, Human
gcuguggaagcaaca

SEQ ID NO: 2165577 - RNA, 19 nt, Human
gcugugcugcccugcccac

SEQ ID NO: 2165578 - RNA, 22 nt, Human
gcugugcugcccugcccaccug

SEQ ID NO: 2165579 - RNA, 21 nt, Human
gcugugcucuggacaggcaug

SEQ ID NO: 2165580 - RNA, 12 nt, Human
gcugugcugccc

SEQ ID NO: 2165581 - RNA, 13 nt, Human
gcugugcugcccu

SEQ ID NO: 2165582 - RNA, 13 nt, Human
gcugugagccuug

SEQ ID NO: 2165583 - RNA, 20 nt, Human
gcugugaauuuguguaagga

SEQ ID NO: 2165584 - RNA, 22 nt, Human
gcugugacaauggcaacaauuu

SEQ ID NO: 2165585 - RNA, 18 nt, Human
gcugugaacauggacucu

SEQ ID NO: 2165586 - RNA, 13 nt, Human
gcugugaaaaaaa

SEQ ID NO: 2165587 - RNA, 16 nt, Human
gcugugacuucuccag

SEQ ID NO: 2165588 - RNA, 17 nt, Human
gcugugacuucuccagg

SEQ ID NO: 2165589 - RNA, 15 nt, Human
gcugugagacagugg

SEQ ID NO: 2165590 - RNA, 18 nt, Human
gcugugagacagugggaa

SEQ ID NO: 2165591 - RNA, 20 nt, Human
gcugugagacagugggaaau

SEQ ID NO: 2165592 - RNA, 23 nt, Human
gcugugagacagugggaaauauu

SEQ ID NO: 2165593 - RNA, 12 nt, Human
gcugugagcccc

SEQ ID NO: 2165594 - RNA, 15 nt, Human
gcugugagccccugg

SEQ ID NO: 2165595 - RNA, 21 nt, Human
gcugaggggggccgugcccag

SEQ ID NO: 2165596 - RNA, 22 nt, Human
gcugaggggaggaucacuggag

SEQ ID NO: 2165597 - RNA, 18 nt, Human
gcugagggugagugggug

SEQ ID NO: 2165598 - RNA, 23 nt, Human
gcugaggggggccgugcccaggg

SEQ ID NO: 2165599 - RNA, 23 nt, Human
gcugaggaaaggccagcuggcag

SEQ ID NO: 2165600 - RNA, 22 nt, Human
gcugaggaaaggccagcuggca

SEQ ID NO: 2165601 - RNA, 21 nt, Human
gcugaggaaaggccagcuggc

SEQ ID NO: 2165602 - RNA, 17 nt, Human
gcugaggaaaggccagc

SEQ ID NO: 2165603 - RNA, 14 nt, Human
gcugaggaggccuc

SEQ ID NO: 2165604 - RNA, 16 nt, Human
gcugaggaaaggccag

SEQ ID NO: 2165605 - RNA, 15 nt, Human
gcugaggaaaggcca

SEQ ID NO: 2165606 - RNA, 12 nt, Human
gcugaggaaagg

SEQ ID NO: 2165607 - RNA, 16 nt, Human
gcugagggaccagcca

SEQ ID NO: 2165608 - RNA, 16 nt, Human
gcugaggaggccucca

SEQ ID NO: 2165609 - RNA, 14 nt, Human
gcugagggagccug

SEQ ID NO: 2165610 - RNA, 21 nt, Human
gcugagggauggacugaugcu

SEQ ID NO: 2165611 - RNA, 22 nt, Human
gcugagggauggacugaugcuu

SEQ ID NO: 2165612 - RNA, 23 nt, Human
gcugagggauggacugaugcuuu

SEQ ID NO: 2165613 - RNA, 15 nt, Human
gcugagggaccagcc

SEQ ID NO: 2165614 - RNA, 18 nt, Human
gcugaggcuggcacagga

SEQ ID NO: 2165615 - RNA, 16 nt, Human
gcugaggcuggcacag

SEQ ID NO: 2165616 - RNA, 15 nt, Human
gcugaggcuggcaca

SEQ ID NO: 2165617 - RNA, 14 nt, Human
gcugcaccggcugg

SEQ ID NO: 2165618 - RNA, 16 nt, Human
gcugcaccggcuggcc

SEQ ID NO: 2165619 - RNA, 17 nt, Human
gcugcaccggcuggccu

SEQ ID NO: 2165620 - RNA, 20 nt, Human
gcugcaccugccagccuggc

SEQ ID NO: 2165621 - RNA, 19 nt, Human
gcugcaccugccagccugg

SEQ ID NO: 2165622 - RNA, 18 nt, Human
gcugcaccugccagccug

SEQ ID NO: 2165623 - RNA, 17 nt, Human
gcugcaccugccagccu

SEQ ID NO: 2165624 - RNA, 22 nt, Human
gcugcaccggcuggccuggccc

SEQ ID NO: 2165625 - RNA, 18 nt, Human
gcugcaccggcuggccug

SEQ ID NO: 2165626 - RNA, 19 nt, Human
gcugcaccggcuggccugg

SEQ ID NO: 2165627 - RNA, 22 nt, Human
gcugcaccugccagccuggcuu

SEQ ID NO: 2165628 - RNA, 21 nt, Human
gcugcaccugccagccuggcu

SEQ ID NO: 2165629 - RNA, 14 nt, Human
gcugcacucugugc

SEQ ID NO: 2165630 - RNA, 15 nt, Human
gcugcacucugugcc

SEQ ID NO: 2165631 - RNA, 16 nt, Human
gcugcacucugugccc

SEQ ID NO: 2165632 - RNA, 17 nt, Human
gcugcacucugugccca

SEQ ID NO: 2165633 - RNA, 12 nt, Human
gcugccagagaa

SEQ ID NO: 2165634 - RNA, 14 nt, Human
gcugccacuuuuua

SEQ ID NO: 2165635 - RNA, 18 nt, Human
gcugcacucugugcccau

SEQ ID NO: 2165636 - RNA, 19 nt, Human
gcugcacucugugcccaug

SEQ ID NO: 2165637 - RNA, 20 nt, Human
gcugcacucugugcccaugg

SEQ ID NO: 2165638 - RNA, 19 nt, Human
gcugccagccgagauagcc

SEQ ID NO: 2165639 - RNA, 21 nt, Human
gcugccagccgagauagccaa

SEQ ID NO: 2165640 - RNA, 21 nt, Human
gcugccauccagguucagcuu

SEQ ID NO: 2165641 - RNA, 18 nt, Human
gcugccagcucuguauca

SEQ ID NO: 2165642 - RNA, 17 nt, Human
gcugccagcucuguauc

SEQ ID NO: 2165643 - RNA, 22 nt, Human
gcugccauggcgugucccucuc

SEQ ID NO: 2165644 - RNA, 23 nt, Human
gcugccauggcgugucccucucg

SEQ ID NO: 2165645 - RNA, 23 nt, Human
gcugccauccagguucagcuugu

SEQ ID NO: 2165646 - RNA, 23 nt, Human
gcugcugccuuuagucgcugagg

SEQ ID NO: 2165647 - RNA, 13 nt, Human
gcugcugcccugc

SEQ ID NO: 2165648 - RNA, 12 nt, Human
gcugcugcgccc

SEQ ID NO: 2165649 - RNA, 17 nt, Human
gcugcugcgcccugggc

SEQ ID NO: 2165650 - RNA, 20 nt, Human
gcugcugcuaaucuucaggg

SEQ ID NO: 2165651 - RNA, 15 nt, Human
gcugcugcugcgccc

SEQ ID NO: 2165652 - RNA, 12 nt, Human
gcugcugcugcu

SEQ ID NO: 2165653 - RNA, 21 nt, Human
gcugcugcguggcauagccca

SEQ ID NO: 2165654 - RNA, 12 nt, Human
gcugcugcccag

SEQ ID NO: 2165655 - RNA, 13 nt, Human
gcugcugcccagg

SEQ ID NO: 2165656 - RNA, 15 nt, Human
gcugcugcccaggcc

SEQ ID NO: 2165657 - RNA, 17 nt, Human
gcugcugcccccacccc

SEQ ID NO: 2165658 - RNA, 21 nt, Human
gcugccuggcccccagcugug

SEQ ID NO: 2165659 - RNA, 19 nt, Human
gcugcuccuagagggaggg

SEQ ID NO: 2165660 - RNA, 22 nt, Human
gcugccuggcccccagcugugg

SEQ ID NO: 2165661 - RNA, 21 nt, Human
gcugcuccuagagggaggggc

SEQ ID NO: 2165662 - RNA, 23 nt, Human
gcugcuccuagagggaggggccu

SEQ ID NO: 2165663 - RNA, 19 nt, Human
gcugccugggaucccucau

SEQ ID NO: 2165664 - RNA, 16 nt, Human
gcugccugggaucccu

SEQ ID NO: 2165665 - RNA, 18 nt, Human
gcugccugggaucccuca

SEQ ID NO: 2165666 - RNA, 23 nt, Human
gcugcuccuccagggccacgugc

SEQ ID NO: 2165667 - RNA, 18 nt, Human
gcugcuccuccagggcca

SEQ ID NO: 2165668 - RNA, 15 nt, Human
gcugcuccuccaggg

SEQ ID NO: 2165669 - RNA, 14 nt, Human
gcugcuccuccagg

SEQ ID NO: 2165670 - RNA, 12 nt, Human
gcugcuccucca

SEQ ID NO: 2165671 - RNA, 11 nt, Human
gcugcuccucc

SEQ ID NO: 2165672 - RNA, 13 nt, Human
gcugcuccucaug

SEQ ID NO: 2165673 - RNA, 17 nt, Human
gcugcuccuuccuucac

SEQ ID NO: 2165674 - RNA, 22 nt, Human
gcugcucugaauuaguccuugc

SEQ ID NO: 2165675 - RNA, 23 nt, Human
gcugcucuauuguagcauuucuu

SEQ ID NO: 2165676 - RNA, 12 nt, Human
gcugcucuggaa

SEQ ID NO: 2165677 - RNA, 17 nt, Human
gcugcccacacacccca

SEQ ID NO: 2165678 - RNA, 17 nt, Human
gcugccaugugaagagg

SEQ ID NO: 2165679 - RNA, 21 nt, Human
gcugccaugugaagagggaga

SEQ ID NO: 2165680 - RNA, 13 nt, Human
gcugccaugugaa

SEQ ID NO: 2165681 - RNA, 14 nt, Human
gcugcccagaguug

SEQ ID NO: 2165682 - RNA, 17 nt, Human
gcugcccagaguugcug

SEQ ID NO: 2165683 - RNA, 12 nt, Human
gcugcccaggcc

SEQ ID NO: 2165684 - RNA, 14 nt, Human
gcugcccaggccca

SEQ ID NO: 2165685 - RNA, 19 nt, Human
gcugcccaggggagcccuc

SEQ ID NO: 2165686 - RNA, 23 nt, Human
gcugccccauuuauccaccucca

SEQ ID NO: 2165687 - RNA, 18 nt, Human
gcugccccaucagugcuc

SEQ ID NO: 2165688 - RNA, 14 nt, Human
gcugccccagccag

SEQ ID NO: 2165689 - RNA, 16 nt, Human
gcugccccagccagau

SEQ ID NO: 2165690 - RNA, 18 nt, Human
gcugcccaggggagcccu

SEQ ID NO: 2165691 - RNA, 14 nt, Human
gcugccccaaccug

SEQ ID NO: 2165692 - RNA, 16 nt, Human
gcugccccaaccugcu

SEQ ID NO: 2165693 - RNA, 17 nt, Human
gcugccccaaccugcug

SEQ ID NO: 2165694 - RNA, 18 nt, Human
gcugccccaaccugcuga

SEQ ID NO: 2165695 - RNA, 20 nt, Human
gcugccccaaccugcugaag

SEQ ID NO: 2165696 - RNA, 19 nt, Human
gcugccccacagguguguu

SEQ ID NO: 2165697 - RNA, 12 nt, Human
gcugccccagcc

SEQ ID NO: 2165698 - RNA, 20 nt, Human
gcugccgccucccagccugg

SEQ ID NO: 2165699 - RNA, 19 nt, Human
gcugccgccucccagccug

SEQ ID NO: 2165700 - RNA, 18 nt, Human
gcugccgccucccagccu

SEQ ID NO: 2165701 - RNA, 16 nt, Human
gcugccgccucccagc

SEQ ID NO: 2165702 - RNA, 15 nt, Human
gcugccgccucccag

SEQ ID NO: 2165703 - RNA, 13 nt, Human
gcugccgccuccc

SEQ ID NO: 2165704 - RNA, 22 nt, Human
gcugccgcaccccagagugugg

SEQ ID NO: 2165705 - RNA, 18 nt, Human
gcugccgcaccccagagu

SEQ ID NO: 2165706 - RNA, 15 nt, Human
gcugccgcaccccag

SEQ ID NO: 2165707 - RNA, 16 nt, Human
gcugccuaaguggcug

SEQ ID NO: 2165708 - RNA, 17 nt, Human
gcugccuaaguggcugc

SEQ ID NO: 2165709 - RNA, 13 nt, Human
gcugccguggggc

SEQ ID NO: 2165710 - RNA, 22 nt, Human
gcugccguggggccgccgccuc

SEQ ID NO: 2165711 - RNA, 17 nt, Human
gcugccgccccacccag

SEQ ID NO: 2165712 - RNA, 18 nt, Human
gcugccuaaguggcugcu

SEQ ID NO: 2165713 - RNA, 11 nt, Human
gcugccugccu

SEQ ID NO: 2165714 - RNA, 13 nt, Human
gcugccugccugu

SEQ ID NO: 2165715 - RNA, 14 nt, Human
gcugccugccuguc

SEQ ID NO: 2165716 - RNA, 15 nt, Human
gcugccugccugucu

SEQ ID NO: 2165717 - RNA, 16 nt, Human
gcugccugccugucug

SEQ ID NO: 2165718 - RNA, 21 nt, Human
gcugccugcgcccaccccgcu

SEQ ID NO: 2165719 - RNA, 22 nt, Human
gcugccugcgcccaccccgcuc

SEQ ID NO: 2165720 - RNA, 22 nt, Human
gcugccugccgguaaacacgcc

SEQ ID NO: 2165721 - RNA, 22 nt, Human
gcugccugcccguaaacacgcc

SEQ ID NO: 2165722 - RNA, 13 nt, Human
gcugccugcccgu

SEQ ID NO: 2165723 - RNA, 17 nt, Human
gcugccugcccacacag

SEQ ID NO: 2165724 - RNA, 19 nt, Human
gcugccuggcccccagcug

SEQ ID NO: 2165725 - RNA, 21 nt, Human
gcugccugcuuuucacugcug

SEQ ID NO: 2165726 - RNA, 13 nt, Human
gcugccugggauc

SEQ ID NO: 2165727 - RNA, 18 nt, Human
gcugccugcccacacagg

SEQ ID NO: 2165728 - RNA, 15 nt, Human
gcugccugcccacac

SEQ ID NO: 2165729 - RNA, 14 nt, Human
gcugccugcccaca

SEQ ID NO: 2165730 - RNA, 16 nt, Human
gcuggacggcauuccu

SEQ ID NO: 2165731 - RNA, 14 nt, Human
gcuggacuacccac

SEQ ID NO: 2165732 - RNA, 19 nt, Human
gcuggacggggacugggga

SEQ ID NO: 2165733 - RNA, 21 nt, Human
gcuggacggggacuggggaug

SEQ ID NO: 2165734 - RNA, 13 nt, Human
gcuggacugaggc

SEQ ID NO: 2165735 - RNA, 14 nt, Human
gcuggacugaggcc

SEQ ID NO: 2165736 - RNA, 22 nt, Human
gcuggacucucagucucugagc

SEQ ID NO: 2165737 - RNA, 21 nt, Human
gcuggacucucagucucugag

SEQ ID NO: 2165738 - RNA, 14 nt, Human
gcuggagcucugcc

SEQ ID NO: 2165739 - RNA, 16 nt, Human
gcuggacugaggccug

SEQ ID NO: 2165740 - RNA, 17 nt, Human
gcuggacugaggccuga

SEQ ID NO: 2165741 - RNA, 18 nt, Human
gcuggacugaggccugag

SEQ ID NO: 2165742 - RNA, 19 nt, Human
gcuggacugaggccugagc

SEQ ID NO: 2165743 - RNA, 22 nt, Human
gcuggagcuggcgucugucuuc

SEQ ID NO: 2165744 - RNA, 12 nt, Human
gcuggagcuggc

SEQ ID NO: 2165745 - RNA, 21 nt, Human
gcuggaggacuagaaccugga

SEQ ID NO: 2165746 - RNA, 23 nt, Human
gcuggaggacuagaaccuggagg

SEQ ID NO: 2165747 - RNA, 17 nt, Human
gcuggagcucugcccau

SEQ ID NO: 2165748 - RNA, 12 nt, Human
gcuggagugcag

SEQ ID NO: 2165749 - RNA, 20 nt, Human
gcugggcacacgccucccac

SEQ ID NO: 2165750 - RNA, 22 nt, Human
gcugggcacacgccucccacug

SEQ ID NO: 2165751 - RNA, 19 nt, Human
gcugggauuacagguguga

SEQ ID NO: 2165752 - RNA, 17 nt, Human
gcugggauuacagggau

SEQ ID NO: 2165753 - RNA, 17 nt, Human
gcugggauuacaggugu

SEQ ID NO: 2165754 - RNA, 18 nt, Human
gcugggauuacaggugug

SEQ ID NO: 2165755 - RNA, 13 nt, Human
gcugggcagaagg

SEQ ID NO: 2165756 - RNA, 19 nt, Human
gcugggcagaaggccaaga

SEQ ID NO: 2165757 - RNA, 13 nt, Human
gcugggcagagga

SEQ ID NO: 2165758 - RNA, 14 nt, Human
gcugggcagaggaa

SEQ ID NO: 2165759 - RNA, 15 nt, Human
gcugggcagaggaaa

SEQ ID NO: 2165760 - RNA, 14 nt, Human
gcuggagugcagug

SEQ ID NO: 2165761 - RNA, 15 nt, Human
gcuggagugcaguga

SEQ ID NO: 2165762 - RNA, 16 nt, Human
gcuggccuggccccuc

SEQ ID NO: 2165763 - RNA, 17 nt, Human
gcuggccuggccccuca

SEQ ID NO: 2165764 - RNA, 16 nt, Human
gcugggauuacaggug

SEQ ID NO: 2165765 - RNA, 23 nt, Human
gcugggauuacaggcuccugcca

SEQ ID NO: 2165766 - RNA, 22 nt, Human
gcugggauuacaggcuccugcc

SEQ ID NO: 2165767 - RNA, 18 nt, Human
gcuggccuggccccucag

SEQ ID NO: 2165768 - RNA, 19 nt, Human
gcuggccuggccccucagg

SEQ ID NO: 2165769 - RNA, 14 nt, Human
gcugggcagcuguu

SEQ ID NO: 2165770 - RNA, 16 nt, Human
gcugggucgcccugga

SEQ ID NO: 2165771 - RNA, 17 nt, Human
gcugggucgcccuggac

SEQ ID NO: 2165772 - RNA, 18 nt, Human
gcugggucgcccuggacu

SEQ ID NO: 2165773 - RNA, 18 nt, Human
gcugggugcgaccccauc

SEQ ID NO: 2165774 - RNA, 14 nt, Human
gcuggguggcacug

SEQ ID NO: 2165775 - RNA, 15 nt, Human
gcuggguggcacugc

SEQ ID NO: 2165776 - RNA, 17 nt, Human
gcuggguggcacugcca

SEQ ID NO: 2165777 - RNA, 13 nt, Human
gcuggguggccca

SEQ ID NO: 2165778 - RNA, 14 nt, Human
gcuggguggcccau

SEQ ID NO: 2165779 - RNA, 19 nt, Human
gcugggucgcccuggacug

SEQ ID NO: 2165780 - RNA, 15 nt, Human
gcuggguguggcgca

SEQ ID NO: 2165781 - RNA, 17 nt, Human
gcugggugguacccucu

SEQ ID NO: 2165782 - RNA, 16 nt, Human
gcuggguucauuugug

SEQ ID NO: 2165783 - RNA, 16 nt, Human
gcuggguggcccaucc

SEQ ID NO: 2165784 - RNA, 20 nt, Human
gcuggguggcccaucccccc

SEQ ID NO: 2165785 - RNA, 21 nt, Human
gcuggguggcccauccccccu

SEQ ID NO: 2165786 - RNA, 22 nt, Human
gcuggguggcccauccccccuc

SEQ ID NO: 2165787 - RNA, 12 nt, Human
gcugggcagcug

SEQ ID NO: 2165788 - RNA, 13 nt, Human
gcugggcagcugu

SEQ ID NO: 2165789 - RNA, 12 nt, Human
gcugggcagcua

SEQ ID NO: 2165790 - RNA, 13 nt, Human
gcugggcagcuac

SEQ ID NO: 2165791 - RNA, 19 nt, Human
gcugggcagaggaaagcaa

SEQ ID NO: 2165792 - RNA, 16 nt, Human
gcugggcagaggaaag

SEQ ID NO: 2165793 - RNA, 17 nt, Human
gcugggcagaggaaagc

SEQ ID NO: 2165794 - RNA, 12 nt, Human
gcugggcucccu

SEQ ID NO: 2165795 - RNA, 16 nt, Human
gcugggcucccuuccc

SEQ ID NO: 2165796 - RNA, 17 nt, Human
gcugggcucccuuccca

SEQ ID NO: 2165797 - RNA, 20 nt, Human
gcugggcucccuucccaccu

SEQ ID NO: 2165798 - RNA, 22 nt, Human
ggagagcgccugccccucccag

SEQ ID NO: 2165799 - RNA, 20 nt, Human
ggagagcuagaacccggcag

SEQ ID NO: 2165800 - RNA, 20 nt, Human
ggagagcgccugccccuccc

SEQ ID NO: 2165801 - RNA, 18 nt, Human
ggagagcgccugccccuc

SEQ ID NO: 2165802 - RNA, 22 nt, Human
ggagagcuagaacccggcaggc

SEQ ID NO: 2165803 - RNA, 16 nt, Human
ggagagcuagaaccug

SEQ ID NO: 2165804 - RNA, 18 nt, Human
ggagagcuagaaccugga

SEQ ID NO: 2165805 - RNA, 19 nt, Human
ggagagcuagaaccuggag

SEQ ID NO: 2165806 - RNA, 15 nt, Human
ggagagcuagcagca

SEQ ID NO: 2165807 - RNA, 22 nt, Human
ggagagcuagaaccuggagggc

SEQ ID NO: 2165808 - RNA, 20 nt, Human
ggagagcuagaaccuggaga

SEQ ID NO: 2165809 - RNA, 22 nt, Human
ggagagcuagaaccuggagagc

SEQ ID NO: 2165810 - RNA, 20 nt, Human
ggagagcuagaaccuggagg

SEQ ID NO: 2165811 - RNA, 21 nt, Human
ggagagcuagaaccuggaggg

SEQ ID NO: 2165812 - RNA, 16 nt, Human
ggagagcgccugcccc

SEQ ID NO: 2165813 - RNA, 16 nt, Human
ggagagccugcuggca

SEQ ID NO: 2165814 - RNA, 13 nt, Human
ggagagccugcug

SEQ ID NO: 2165815 - RNA, 14 nt, Human
ggagagccugcugg

SEQ ID NO: 2165816 - RNA, 11 nt, Human
ggagagccugc

SEQ ID NO: 2165817 - RNA, 12 nt, Human
ggagagccugcu

SEQ ID NO: 2165818 - RNA, 22 nt, Human
ggagagccuuccagggguggga

SEQ ID NO: 2165819 - RNA, 17 nt, Human
ggagagccuuccagggg

SEQ ID NO: 2165820 - RNA, 18 nt, Human
ggagagccuuccaggggu

SEQ ID NO: 2165821 - RNA, 12 nt, Human
ggagagcccagc

SEQ ID NO: 2165822 - RNA, 11 nt, Human
ggagagcccag

SEQ ID NO: 2165823 - RNA, 21 nt, Human
ggagagccagcccucccuguc

SEQ ID NO: 2165824 - RNA, 18 nt, Human
ggagagccagcccucccu

SEQ ID NO: 2165825 - RNA, 23 nt, Human
ggagagccagcccucccuguccu

SEQ ID NO: 2165826 - RNA, 13 nt, Human
ggagagccuucca

SEQ ID NO: 2165827 - RNA, 16 nt, Human
ggagagccuuccaggg

SEQ ID NO: 2165828 - RNA, 14 nt, Human
ggagagaggggaau

SEQ ID NO: 2165829 - RNA, 12 nt, Human
ggagagagggga

SEQ ID NO: 2165830 - RNA, 17 nt, Human
ggagagaguugaaccua

SEQ ID NO: 2165831 - RNA, 20 nt, Human
ggagagaguugaaccuaaac

SEQ ID NO: 2165832 - RNA, 21 nt, Human
ggagagaggggaauaauagaa

SEQ ID NO: 2165833 - RNA, 11 nt, Human
ggagagcagcg

SEQ ID NO: 2165834 - RNA, 12 nt, Human
ggagagcaggcu

SEQ ID NO: 2165835 - RNA, 13 nt, Human
ggagagcaggcug

SEQ ID NO: 2165836 - RNA, 23 nt, Human
ggagagcaggcuggcagcucucc

SEQ ID NO: 2165837 - RNA, 14 nt, Human
ggagagcaggcugg

SEQ ID NO: 2165838 - RNA, 16 nt, Human
ggagagcaggcuggca

SEQ ID NO: 2165839 - RNA, 15 nt, Human
ggagagccagcccuc

SEQ ID NO: 2165840 - RNA, 14 nt, Human
ggagagccagcccu

SEQ ID NO: 2165841 - RNA, 12 nt, Human
ggagagccagcc

SEQ ID NO: 2165842 - RNA, 11 nt, Human
ggagagccagc

SEQ ID NO: 2165843 - RNA, 14 nt, Human
ggagagccagagaa

SEQ ID NO: 2165844 - RNA, 15 nt, Human
ggagagccagagaag

SEQ ID NO: 2165845 - RNA, 16 nt, Human
ggagagccagagaagu

SEQ ID NO: 2165846 - RNA, 21 nt, Human
ggagagccagagaagugacag

SEQ ID NO: 2165847 - RNA, 16 nt, Human
ggagagccagaaccug

SEQ ID NO: 2165848 - RNA, 22 nt, Human
ggagagccaccaagagggacgc

SEQ ID NO: 2165849 - RNA, 19 nt, Human
ggagagccagaaccuggag

SEQ ID NO: 2165850 - RNA, 20 nt, Human
ggagagccagaaccuggagg

SEQ ID NO: 2165851 - RNA, 21 nt, Human
ggagagccagaaccuggaggg

SEQ ID NO: 2165852 - RNA, 13 nt, Human
ggagagccagaga

SEQ ID NO: 2165853 - RNA, 14 nt, Human
ggagagagacucca

SEQ ID NO: 2165854 - RNA, 14 nt, Human
ggagagagaaagcc

SEQ ID NO: 2165855 - RNA, 17 nt, Human
ggagagagaaagccagg

SEQ ID NO: 2165856 - RNA, 18 nt, Human
ggagagagaaagccaggc

SEQ ID NO: 2165857 - RNA, 20 nt, Human
ggagagagaaagccaggcag

SEQ ID NO: 2165858 - RNA, 21 nt, Human
ggagagagaaagccaggcagg

SEQ ID NO: 2165859 - RNA, 19 nt, Human
ggagagagacguguacaua

SEQ ID NO: 2165860 - RNA, 19 nt, Human
ggagagagagagagagagg

SEQ ID NO: 2165861 - RNA, 22 nt, Human
ggagagagcagcuucugccacu

SEQ ID NO: 2165862 - RNA, 10 nt, Human
ggagagaggc

SEQ ID NO: 2165863 - RNA, 13 nt, Human
ggagagaggcaga

SEQ ID NO: 2165864 - RNA, 16 nt, Human
ggagagaggcagagag

SEQ ID NO: 2165865 - RNA, 18 nt, Human
ggagagaggcagagagcg

SEQ ID NO: 2165866 - RNA, 10 nt, Human
ggagagagaa

SEQ ID NO: 2165867 - RNA, 11 nt, Human
ggagagagaaa

SEQ ID NO: 2165868 - RNA, 12 nt, Human
ggagagagaaag

SEQ ID NO: 2165869 - RNA, 22 nt, Human
ggagacuuagggcaccaggggu

SEQ ID NO: 2165870 - RNA, 14 nt, Human
ggacuagccccugu

SEQ ID NO: 2165871 - RNA, 22 nt, Human
ggacuagccccuguggagacug

SEQ ID NO: 2165872 - RNA, 15 nt, Human
ggacuauagcccagg

SEQ ID NO: 2165873 - RNA, 16 nt, Human
ggacuaggguccuggg

SEQ ID NO: 2165874 - RNA, 22 nt, Human
ggacucaaugcacugacauugu

SEQ ID NO: 2165875 - RNA, 15 nt, Human
ggacucacuugccca

SEQ ID NO: 2165876 - RNA, 19 nt, Human
ggacucaauuucuccccag

SEQ ID NO: 2165877 - RNA, 20 nt, Human
ggacuauauuugggccugcu

SEQ ID NO: 2165878 - RNA, 13 nt, Human
ggacucagcccug

SEQ ID NO: 2165879 - RNA, 18 nt, Human
ggacucagaagccucugg

SEQ ID NO: 2165880 - RNA, 18 nt, Human
ggacucaauuucucccca

SEQ ID NO: 2165881 - RNA, 17 nt, Human
ggacucagaagccucug

SEQ ID NO: 2165882 - RNA, 21 nt, Human
ggacuagagggaccucuccca

SEQ ID NO: 2165883 - RNA, 19 nt, Human
ggacuagagggaccucucc

SEQ ID NO: 2165884 - RNA, 18 nt, Human
ggacuagagggaccucuc

SEQ ID NO: 2165885 - RNA, 14 nt, Human
ggacuagaaccugg

SEQ ID NO: 2165886 - RNA, 17 nt, Human
ggacuagaaccuggagg

SEQ ID NO: 2165887 - RNA, 21 nt, Human
ggaccucagaguccaggcccc

SEQ ID NO: 2165888 - RNA, 21 nt, Human
ggaccuauguccuaaggacac

SEQ ID NO: 2165889 - RNA, 16 nt, Human
ggaccucagcugcuuc

SEQ ID NO: 2165890 - RNA, 21 nt, Human
ggacuacguuaagggaaggaa

SEQ ID NO: 2165891 - RNA, 12 nt, Human
ggaccucaggcc

SEQ ID NO: 2165892 - RNA, 20 nt, Human
ggaccuaggauaucuucucc

SEQ ID NO: 2165893 - RNA, 19 nt, Human
ggaccucagaguccaggcc

SEQ ID NO: 2165894 - RNA, 17 nt, Human
ggaccuauguccuaagg

SEQ ID NO: 2165895 - RNA, 20 nt, Human
ggacuacaggugugagucac

SEQ ID NO: 2165896 - RNA, 23 nt, Human
ggacuguugacauccaagcuucc

SEQ ID NO: 2165897 - RNA, 15 nt, Human
ggacucagccuucag

SEQ ID NO: 2165898 - RNA, 23 nt, Human
ggacuguuuuuuccugagcuugg

SEQ ID NO: 2165899 - RNA, 21 nt, Human
ggacuguuuuuuccugagcuu

SEQ ID NO: 2165900 - RNA, 20 nt, Human
ggacuguuuuuuccugagcu

SEQ ID NO: 2165901 - RNA, 23 nt, Human
ggacugugugcucaggagcccug

SEQ ID NO: 2165902 - RNA, 17 nt, Human
ggacucagcccugaggu

SEQ ID NO: 2165903 - RNA, 16 nt, Human
ggacucagcccugagg

SEQ ID NO: 2165904 - RNA, 15 nt, Human
ggacucagcccugag

SEQ ID NO: 2165905 - RNA, 14 nt, Human
ggacucagcccuga

SEQ ID NO: 2165906 - RNA, 22 nt, Human
ggacugugugcucaggagcccu

SEQ ID NO: 2165907 - RNA, 17 nt, Human
ggacuuagcugggagaa

SEQ ID NO: 2165908 - RNA, 15 nt, Human
ggacuuagaaagcag

SEQ ID NO: 2165909 - RNA, 17 nt, Human
ggacuuagaaagcaggg

SEQ ID NO: 2165910 - RNA, 18 nt, Human
ggacuuagaaagcagggg

SEQ ID NO: 2165911 - RNA, 15 nt, Human
ggacuuaacggcucc

SEQ ID NO: 2165912 - RNA, 17 nt, Human
ggacuuaacggcuccag

SEQ ID NO: 2165913 - RNA, 19 nt, Human
ggacuuaacggcuccagga

SEQ ID NO: 2165914 - RNA, 20 nt, Human
ggacuuaacggcuccaggau

SEQ ID NO: 2165915 - RNA, 20 nt, Human
ggacuuagaaagcaggggcu

SEQ ID NO: 2165916 - RNA, 21 nt, Human
ggacuucacgaaguguugcau

SEQ ID NO: 2165917 - RNA, 11 nt, Human
ggacuuccugu

SEQ ID NO: 2165918 - RNA, 21 nt, Human
ggacuuccuguccagcuccaa

SEQ ID NO: 2165919 - RNA, 20 nt, Human
ggacuuccuguccagcucca

SEQ ID NO: 2165920 - RNA, 19 nt, Human
ggacuuccuguccagcucc

SEQ ID NO: 2165921 - RNA, 18 nt, Human
ggacuuccuguccagcuc

SEQ ID NO: 2165922 - RNA, 15 nt, Human
ggagaaccucaggcu

SEQ ID NO: 2165923 - RNA, 20 nt, Human
ggagaaccaaaucuggaagc

SEQ ID NO: 2165924 - RNA, 17 nt, Human
ggagaaccuugugccug

SEQ ID NO: 2165925 - RNA, 18 nt, Human
ggagaaccuugugccugg

SEQ ID NO: 2165926 - RNA, 18 nt, Human
ggagaacuagaaccugga

SEQ ID NO: 2165927 - RNA, 22 nt, Human
ggagaacuagaaccuggagggc

SEQ ID NO: 2165928 - RNA, 22 nt, Human
ggagaaccaaaaagaggcuaug

SEQ ID NO: 2165929 - RNA, 23 nt, Human
ggagaaaugcauccauuccucag

SEQ ID NO: 2165930 - RNA, 17 nt, Human
ggagaaauguuguucau

SEQ ID NO: 2165931 - RNA, 20 nt, Human
ggagaaaugcauccauuccu

SEQ ID NO: 2165932 - RNA, 14 nt, Human
ggagaaacagagac

SEQ ID NO: 2165933 - RNA, 15 nt, Human
ggagaaauugacaga

SEQ ID NO: 2165934 - RNA, 14 nt, Human
ggagaaauugacag

SEQ ID NO: 2165935 - RNA, 13 nt, Human
ggagaaacagaga

SEQ ID NO: 2165936 - RNA, 11 nt, Human
ggagaaacaca

SEQ ID NO: 2165937 - RNA, 20 nt, Human
ggagaaaauucaauuguaaa

SEQ ID NO: 2165938 - RNA, 18 nt, Human
ggagaaaugaaaaaauau

SEQ ID NO: 2165939 - RNA, 13 nt, Human
ggagaacuagaga

SEQ ID NO: 2165940 - RNA, 22 nt, Human
ggagacugcugagucaacccaa

SEQ ID NO: 2165941 - RNA, 14 nt, Human
ggagacugcuuccc

SEQ ID NO: 2165942 - RNA, 15 nt, Human
ggagacugcuuccca

SEQ ID NO: 2165943 - RNA, 20 nt, Human
ggagacugggcugagggagc

SEQ ID NO: 2165944 - RNA, 17 nt, Human
ggagacugggcugaggg

SEQ ID NO: 2165945 - RNA, 13 nt, Human
ggagacugggcug

SEQ ID NO: 2165946 - RNA, 18 nt, Human
ggagacugcuucccaucc

SEQ ID NO: 2165947 - RNA, 19 nt, Human
ggagacugcuucccauccu

SEQ ID NO: 2165948 - RNA, 16 nt, Human
ggagacugucucaaga

SEQ ID NO: 2165949 - RNA, 23 nt, Human
ggagacugggcugagggagccug

SEQ ID NO: 2165950 - RNA, 23 nt, Human
ggagacugcuucccauccuaccc

SEQ ID NO: 2165951 - RNA, 15 nt, Human
ggagacuggggggcu

SEQ ID NO: 2165952 - RNA, 18 nt, Human
ggagacuggggggcuuga

SEQ ID NO: 2165953 - RNA, 20 nt, Human
ggagacugguccugugugca

SEQ ID NO: 2165954 - RNA, 15 nt, Human
ggacuuggaagcucc

SEQ ID NO: 2165955 - RNA, 15 nt, Human
ggacuuccuugcucu

SEQ ID NO: 2165956 - RNA, 23 nt, Human
ggacuuccuguccagcuccaacc

SEQ ID NO: 2165957 - RNA, 18 nt, Human
ggacuuccuugcucuccc

SEQ ID NO: 2165958 - RNA, 14 nt, Human
ggacuuguauauuu

SEQ ID NO: 2165959 - RNA, 16 nt, Human
ggacuuggagguagcu

SEQ ID NO: 2165960 - RNA, 17 nt, Human
ggacuuggaagcuccgc

SEQ ID NO: 2165961 - RNA, 13 nt, Human
ggagaaaacacuu

SEQ ID NO: 2165962 - RNA, 12 nt, Human
ggagaaaaacaa

SEQ ID NO: 2165963 - RNA, 13 nt, Human
ggacuuuucugca

SEQ ID NO: 2165964 - RNA, 19 nt, Human
ggagaaaauggacguguua

SEQ ID NO: 2165965 - RNA, 18 nt, Human
ggacuuuuauuuccagug

SEQ ID NO: 2165966 - RNA, 16 nt, Human
ggacuugugucucugu

SEQ ID NO: 2165967 - RNA, 15 nt, Human
ggacuuguauauuug

SEQ ID NO: 2165968 - RNA, 19 nt, Human
ggacuuguauauuuguaca

SEQ ID NO: 2165969 - RNA, 20 nt, Human
ggacuuguauauuuguacaa

SEQ ID NO: 2165970 - RNA, 17 nt, Human
ggaccgguacagaaagg

SEQ ID NO: 2165971 - RNA, 17 nt, Human
ggaccuaaauggccuca

SEQ ID NO: 2165972 - RNA, 22 nt, Human
ggaccuaaauggccucaugugg

SEQ ID NO: 2165973 - RNA, 23 nt, Human
ggaccgccagauggggccucugu

SEQ ID NO: 2165974 - RNA, 23 nt, Human
ggaccgggccgcuagaugggcau

SEQ ID NO: 2165975 - RNA, 19 nt, Human
ggacccgcucuggaccaac

SEQ ID NO: 2165976 - RNA, 15 nt, Human
ggacccgcucuggac

SEQ ID NO: 2165977 - RNA, 17 nt, Human
ggacccgcucuggacca

SEQ ID NO: 2165978 - RNA, 19 nt, Human
ggacccugaggcccagagg

SEQ ID NO: 2165979 - RNA, 20 nt, Human
ggacccggaggggccuggca

SEQ ID NO: 2165980 - RNA, 21 nt, Human
ggacccggaggggccuggcag

SEQ ID NO: 2165981 - RNA, 14 nt, Human
ggacccugaggccc

SEQ ID NO: 2165982 - RNA, 15 nt, Human
ggacccugaggccca

SEQ ID NO: 2165983 - RNA, 18 nt, Human
ggacccugaggcccagag

SEQ ID NO: 2165984 - RNA, 13 nt, Human
ggaccccucaccu

SEQ ID NO: 2165985 - RNA, 16 nt, Human
ggaccccuccucccuu

SEQ ID NO: 2165986 - RNA, 21 nt, Human
ggaccccgagccuggcuccaa

SEQ ID NO: 2165987 - RNA, 13 nt, Human
ggaccccugcccu

SEQ ID NO: 2165988 - RNA, 14 nt, Human
ggacccgcucugga

SEQ ID NO: 2165989 - RNA, 18 nt, Human
ggaccccuggugguucac

SEQ ID NO: 2165990 - RNA, 18 nt, Human
ggaccccaucugugaaua

SEQ ID NO: 2165991 - RNA, 17 nt, Human
ggaccccaucugugaau

SEQ ID NO: 2165992 - RNA, 14 nt, Human
ggaccccaucugug

SEQ ID NO: 2165993 - RNA, 21 nt, Human
ggaccccagcugugagccuug

SEQ ID NO: 2165994 - RNA, 20 nt, Human
ggaccccaucugugaauaag

SEQ ID NO: 2165995 - RNA, 18 nt, Human
ggaccccagcugugagcc

SEQ ID NO: 2165996 - RNA, 13 nt, Human
ggacccccagcuu

SEQ ID NO: 2165997 - RNA, 18 nt, Human
ggaccccgagccuggcuc

SEQ ID NO: 2165998 - RNA, 12 nt, Human
ggaccccagcug

SEQ ID NO: 2165999 - RNA, 11 nt, Human
ggaccccagcu

SEQ ID NO: 2166000 - RNA, 13 nt, Human
ggaccccagcugg

SEQ ID NO: 2166001 - RNA, 14 nt, Human
ggaccccagcuggg

SEQ ID NO: 2166002 - RNA, 18 nt, Human
ggaccccagcugggaggc

SEQ ID NO: 2166003 - RNA, 20 nt, Human
ggaccccagcugggaggcaa

SEQ ID NO: 2166004 - RNA, 21 nt, Human
ggaccccagcugggaggcaag

SEQ ID NO: 2166005 - RNA, 23 nt, Human
gcuuggguguaacaggucuccuc

SEQ ID NO: 2166006 - RNA, 22 nt, Human
gcuuggguguaacaggucuccu

SEQ ID NO: 2166007 - RNA, 22 nt, Human
gcuugguggaugaaaugucagu

SEQ ID NO: 2166008 - RNA, 19 nt, Human
gcuuguacauaaugcgugc

SEQ ID NO: 2166009 - RNA, 18 nt, Human
ggagguguggagccgagg

SEQ ID NO: 2166010 - RNA, 21 nt, Human
ggagguuaaggcugaggaaag

SEQ ID NO: 2166011 - RNA, 19 nt, Human
ggagguuaaggcugaggaa

SEQ ID NO: 2166012 - RNA, 17 nt, Human
ggagguuaaggcugagg

SEQ ID NO: 2166013 - RNA, 21 nt, Human
ggagguguuuaaagagagguu

SEQ ID NO: 2166014 - RNA, 16 nt, Human
ggagguucucucggag

SEQ ID NO: 2166015 - RNA, 19 nt, Human
ggaggcugaggcaggagga

SEQ ID NO: 2166016 - RNA, 13 nt, Human
ggaggcugaggcg

SEQ ID NO: 2166017 - RNA, 19 nt, Human
ggaggugucaggcugcugg

SEQ ID NO: 2166018 - RNA, 18 nt, Human
ggaggucgaggcaggagg

SEQ ID NO: 2166019 - RNA, 14 nt, Human
ggagguugcaggga

SEQ ID NO: 2166020 - RNA, 12 nt, Human
ggagguugcagg

SEQ ID NO: 2166021 - RNA, 19 nt, Human
ggagguugaucagaucuga

SEQ ID NO: 2166022 - RNA, 12 nt, Human
ggagguugauaa

SEQ ID NO: 2166023 - RNA, 14 nt, Human
ggagguugaagcca

SEQ ID NO: 2166024 - RNA, 16 nt, Human
ggagguugaagccaag

SEQ ID NO: 2166025 - RNA, 20 nt, Human
ggagguugcagugagcugag

SEQ ID NO: 2166026 - RNA, 17 nt, Human
ggagguugcagggagcc

SEQ ID NO: 2166027 - RNA, 21 nt, Human
ggagguugcagugagcugaga

SEQ ID NO: 2166028 - RNA, 17 nt, Human
ggaggcugaggcaggag

SEQ ID NO: 2166029 - RNA, 18 nt, Human
ggaggcugaggcagaaga

SEQ ID NO: 2166030 - RNA, 16 nt, Human
ggaggcugaggcagaa

SEQ ID NO: 2166031 - RNA, 15 nt, Human
ggaggcugaggcaga

SEQ ID NO: 2166032 - RNA, 19 nt, Human
ggaggcugagacaggagaa

SEQ ID NO: 2166033 - RNA, 14 nt, Human
ggaggcugaggcag

SEQ ID NO: 2166034 - RNA, 12 nt, Human
ggaggcugaggc

SEQ ID NO: 2166035 - RNA, 15 nt, Human
ggaggcugagacagg

SEQ ID NO: 2166036 - RNA, 18 nt, Human
ggaggcugagacaggaga

SEQ ID NO: 2166037 - RNA, 16 nt, Human
ggaggucgaggcagga

SEQ ID NO: 2166038 - RNA, 15 nt, Human
ggaggucgaggcagg

SEQ ID NO: 2166039 - RNA, 21 nt, Human
ggaggcucuggagcccacugu

SEQ ID NO: 2166040 - RNA, 19 nt, Human
ggaggcccaguucacccug

SEQ ID NO: 2166041 - RNA, 15 nt, Human
ggaggccccaaagga

SEQ ID NO: 2166042 - RNA, 15 nt, Human
ggaggcucuggagcc

SEQ ID NO: 2166043 - RNA, 14 nt, Human
ggaggcugagacag

SEQ ID NO: 2166044 - RNA, 19 nt, Human
ggaggcugagaugggagaa

SEQ ID NO: 2166045 - RNA, 15 nt, Human
ggaggcugagauggg

SEQ ID NO: 2166046 - RNA, 15 nt, Human
ggagcuggccccgcc

SEQ ID NO: 2166047 - RNA, 16 nt, Human
ggagcuggccccgccg

SEQ ID NO: 2166048 - RNA, 21 nt, Human
ggagcuucucugaugugauau

SEQ ID NO: 2166049 - RNA, 15 nt, Human
ggagcuugggaaugg

SEQ ID NO: 2166050 - RNA, 20 nt, Human
ggagcuuucaaagaaggaau

SEQ ID NO: 2166051 - RNA, 12 nt, Human
ggagcuggcccc

SEQ ID NO: 2166052 - RNA, 23 nt, Human
ggagcugcuggcuugcagugcgc

SEQ ID NO: 2166053 - RNA, 15 nt, Human
ggagcugcuggcuug

SEQ ID NO: 2166054 - RNA, 13 nt, Human
ggagcugcuggcu

SEQ ID NO: 2166055 - RNA, 18 nt, Human
ggagcugcuauagccugg

SEQ ID NO: 2166056 - RNA, 19 nt, Human
ggagcugcuauagccuggg

SEQ ID NO: 2166057 - RNA, 24 nt, Human
ggagcugcucacuaccuccucagg

SEQ ID NO: 2166058 - RNA, 21 nt, Human
ggagcugccuuggcucagaca

SEQ ID NO: 2166059 - RNA, 18 nt, Human
ggagcugccuuggcucag

SEQ ID NO: 2166060 - RNA, 17 nt, Human
ggagcucuucaggccuc

SEQ ID NO: 2166061 - RNA, 19 nt, Human
ggagcuccucuccuggagg

SEQ ID NO: 2166062 - RNA, 20 nt, Human
ggagcuccucuccuggagga

SEQ ID NO: 2166063 - RNA, 13 nt, Human
ggagcuccucucc

SEQ ID NO: 2166064 - RNA, 17 nt, Human
ggagcuccucuccugga

SEQ ID NO: 2166065 - RNA, 18 nt, Human
ggagcuccucuccuggag

SEQ ID NO: 2166066 - RNA, 16 nt, Human
ggagcugaguggggga

SEQ ID NO: 2166067 - RNA, 20 nt, Human
ggagcucuucaggccucccu

SEQ ID NO: 2166068 - RNA, 18 nt, Human
ggagcucuucaggccucc

SEQ ID NO: 2166069 - RNA, 17 nt, Human
ggagcugccuuggcuca

SEQ ID NO: 2166070 - RNA, 21 nt, Human
ggagcuccucuccuggaggau

SEQ ID NO: 2166071 - RNA, 15 nt, Human
ggagcugaaaaauca

SEQ ID NO: 2166072 - RNA, 22 nt, Human
ggagcugccuguucagcuccag

SEQ ID NO: 2166073 - RNA, 13 nt, Human
ggagccccagggu

SEQ ID NO: 2166074 - RNA, 12 nt, Human
ggagccccaggg

SEQ ID NO: 2166075 - RNA, 13 nt, Human
ggagccccaggcc

SEQ ID NO: 2166076 - RNA, 14 nt, Human
ggagccccaggccu

SEQ ID NO: 2166077 - RNA, 20 nt, Human
ggagccccaggccucugugu

SEQ ID NO: 2166078 - RNA, 22 nt, Human
ggagccccaggccucugugucc

SEQ ID NO: 2166079 - RNA, 20 nt, Human
ggagccccagggucuucccu

SEQ ID NO: 2166080 - RNA, 14 nt, Human
ggagccccaggguc

SEQ ID NO: 2166081 - RNA, 14 nt, Human
ggagccccagugcc

SEQ ID NO: 2166082 - RNA, 16 nt, Human
ggagccccauuccugg

SEQ ID NO: 2166083 - RNA, 17 nt, Human
ggagccccauuccuggg

SEQ ID NO: 2166084 - RNA, 23 nt, Human
ggagccccaggccucuguguccu

SEQ ID NO: 2166085 - RNA, 20 nt, Human
ggagcuccacucugcuucuc

SEQ ID NO: 2166086 - RNA, 13 nt, Human
ggagccccagccc

SEQ ID NO: 2166087 - RNA, 12 nt, Human
ggagcccacugu

SEQ ID NO: 2166088 - RNA, 15 nt, Human
ggagccccagccccc

SEQ ID NO: 2166089 - RNA, 16 nt, Human
ggagccccagcccccu

SEQ ID NO: 2166090 - RNA, 20 nt, Human
ggagccccagcccccuuugg

SEQ ID NO: 2166091 - RNA, 17 nt, Human
ggagccccagcuacccu

SEQ ID NO: 2166092 - RNA, 18 nt, Human
ggagccccagcuacccuu

SEQ ID NO: 2166093 - RNA, 18 nt, Human
ggagcccacuguacuugc

SEQ ID NO: 2166094 - RNA, 22 nt, Human
ggagcccacuguacuugcucuu

SEQ ID NO: 2166095 - RNA, 18 nt, Human
ggagccaguaaacagagg

SEQ ID NO: 2166096 - RNA, 17 nt, Human
ggaggccauugugugag

SEQ ID NO: 2166097 - RNA, 13 nt, Human
ggaggcccaguuc

SEQ ID NO: 2166098 - RNA, 17 nt, Human
ggaggcucuggagccca

SEQ ID NO: 2166099 - RNA, 20 nt, Human
ggaggcucuggagcccacug

SEQ ID NO: 2166100 - RNA, 18 nt, Human
ggaggccaaggugggagg

SEQ ID NO: 2166101 - RNA, 17 nt, Human
ggaggcauggcccuggg

SEQ ID NO: 2166102 - RNA, 23 nt, Human
ggaggccaggccggcgagcccug

SEQ ID NO: 2166103 - RNA, 14 nt, Human
ggaggccaggccgg

SEQ ID NO: 2166104 - RNA, 13 nt, Human
ggaggccagccuu

SEQ ID NO: 2166105 - RNA, 19 nt, Human
ggaggaagcagguugaggg

SEQ ID NO: 2166106 - RNA, 11 nt, Human
ggaggaagccc

SEQ ID NO: 2166107 - RNA, 17 nt, Human
ggaggaagcagaauaaa

SEQ ID NO: 2166108 - RNA, 19 nt, Human
ggaggaagcagaauaaagc

SEQ ID NO: 2166109 - RNA, 20 nt, Human
ggaggaagcagaauaaagca

SEQ ID NO: 2166110 - RNA, 22 nt, Human
ggaggaagcagaauaaagcaau

SEQ ID NO: 2166111 - RNA, 12 nt, Human
ggaggaaagcaa

SEQ ID NO: 2166112 - RNA, 21 nt, Human
ggaggaagaagcuuaggcagg

SEQ ID NO: 2166113 - RNA, 11 nt, Human
ggaggaagcag

SEQ ID NO: 2166114 - RNA, 12 nt, Human
ggaggaagcaga

SEQ ID NO: 2166115 - RNA, 13 nt, Human
ggaggaagcagaa

SEQ ID NO: 2166116 - RNA, 14 nt, Human
ggaggaagcagaau

SEQ ID NO: 2166117 - RNA, 15 nt, Human
ggaggaagcagaaua

SEQ ID NO: 2166118 - RNA, 14 nt, Human
ggaggcaucugcac

SEQ ID NO: 2166119 - RNA, 15 nt, Human
ggaggcauggcccug

SEQ ID NO: 2166120 - RNA, 16 nt, Human
ggaggcauggcccugg

SEQ ID NO: 2166121 - RNA, 23 nt, Human
ggaggaagcagaauaaagcaauu

SEQ ID NO: 2166122 - RNA, 21 nt, Human
ggaggcaugugaugagaggaa

SEQ ID NO: 2166123 - RNA, 20 nt, Human
ggaggaaaaccaagccgugg

SEQ ID NO: 2166124 - RNA, 21 nt, Human
ggagcuuuuuuccuuaaucca

SEQ ID NO: 2166125 - RNA, 21 nt, Human
ggaggaaaaccaagccguggc

SEQ ID NO: 2166126 - RNA, 22 nt, Human
ggaggaaaaccaagccguggcu

SEQ ID NO: 2166127 - RNA, 18 nt, Human
ggaggaacacugcacucu

SEQ ID NO: 2166128 - RNA, 23 nt, Human
ggaggaaauuugaauggguccau

SEQ ID NO: 2166129 - RNA, 12 nt, Human
ggaggaagagaa

SEQ ID NO: 2166130 - RNA, 21 nt, Human
ggagcaggcggugggcaccca

SEQ ID NO: 2166131 - RNA, 15 nt, Human
ggagcaggggcgugg

SEQ ID NO: 2166132 - RNA, 14 nt, Human
ggagcagugcaggc

SEQ ID NO: 2166133 - RNA, 18 nt, Human
ggagcagugcaggcacag

SEQ ID NO: 2166134 - RNA, 18 nt, Human
ggagcaguaucaugaagc

SEQ ID NO: 2166135 - RNA, 12 nt, Human
ggagcagugucu

SEQ ID NO: 2166136 - RNA, 13 nt, Human
ggagccagggcug

SEQ ID NO: 2166137 - RNA, 22 nt, Human
ggagccaugcgcccccuccgcc

SEQ ID NO: 2166138 - RNA, 23 nt, Human
ggagccaugcgcccccuccgccc

SEQ ID NO: 2166139 - RNA, 15 nt, Human
ggagcccacuguacu

SEQ ID NO: 2166140 - RNA, 13 nt, Human
ggagcagccacau

SEQ ID NO: 2166141 - RNA, 12 nt, Human
ggagcagagggg

SEQ ID NO: 2166142 - RNA, 21 nt, Human
ggagcagccacauuccugaug

SEQ ID NO: 2166143 - RNA, 15 nt, Human
ggagcaggagauuga

SEQ ID NO: 2166144 - RNA, 13 nt, Human
ggagcagccucag

SEQ ID NO: 2166145 - RNA, 16 nt, Human
ggagcaggagauugag

SEQ ID NO: 2166146 - RNA, 21 nt, Human
ggagcaggagauugagaagga

SEQ ID NO: 2166147 - RNA, 22 nt, Human
ggagcaggagauugagaaggag

SEQ ID NO: 2166148 - RNA, 23 nt, Human
ggagcaggagauugagaaggaga

SEQ ID NO: 2166149 - RNA, 19 nt, Human
ggagcagagcaagucugca

SEQ ID NO: 2166150 - RNA, 15 nt, Human
ggagcagaccacccc

SEQ ID NO: 2166151 - RNA, 20 nt, Human
ggagcagacaggaggaauca

SEQ ID NO: 2166152 - RNA, 17 nt, Human
ggagcagagcucugccg

SEQ ID NO: 2166153 - RNA, 12 nt, Human
ggagcagaacug

SEQ ID NO: 2166154 - RNA, 13 nt, Human
ggagcagaaucag

SEQ ID NO: 2166155 - RNA, 16 nt, Human
ggagcagaacugaacc

SEQ ID NO: 2166156 - RNA, 23 nt, Human
ggagcagaaucaguauugggagc

SEQ ID NO: 2166157 - RNA, 14 nt, Human
ggccaggugcacag

SEQ ID NO: 2166158 - RNA, 14 nt, Human
ggccaggugcagug

SEQ ID NO: 2166159 - RNA, 23 nt, Human
ggccagggucacugaaggccugg

SEQ ID NO: 2166160 - RNA, 16 nt, Human
ggccagggugagagcu

SEQ ID NO: 2166161 - RNA, 21 nt, Human
ggccaggucccagcuugagcu

SEQ ID NO: 2166162 - RNA, 19 nt, Human
ggccagcccggcugguuuu

SEQ ID NO: 2166163 - RNA, 16 nt, Human
ggccagccuccgagag

SEQ ID NO: 2166164 - RNA, 19 nt, Human
ggccagccuccgagaggga

SEQ ID NO: 2166165 - RNA, 22 nt, Human
ggccagccuccgagagggagag

SEQ ID NO: 2166166 - RNA, 20 nt, Human
ggccagccuccgagagggag

SEQ ID NO: 2166167 - RNA, 17 nt, Human
ggccaggggucucccug

SEQ ID NO: 2166168 - RNA, 17 nt, Human
ggccagguuucugccca

SEQ ID NO: 2166169 - RNA, 23 nt, Human
ggccaggugggcgggcagcacag

SEQ ID NO: 2166170 - RNA, 20 nt, Human
ggccaguaagggaaauagaa

SEQ ID NO: 2166171 - RNA, 19 nt, Human
ggccagguggccacuccag

SEQ ID NO: 2166172 - RNA, 14 nt, Human
ggccaguccaggcu

SEQ ID NO: 2166173 - RNA, 16 nt, Human
ggccaguaccuuucca

SEQ ID NO: 2166174 - RNA, 18 nt, Human
ggccaguaccuuuccauu

SEQ ID NO: 2166175 - RNA, 15 nt, Human
ggccaguccaggcug

SEQ ID NO: 2166176 - RNA, 16 nt, Human
ggccaguccaggcugc

SEQ ID NO: 2166177 - RNA, 21 nt, Human
ggccaguaucuauauaugugu

SEQ ID NO: 2166178 - RNA, 21 nt, Human
ggccaguccaggcugccgugg

SEQ ID NO: 2166179 - RNA, 16 nt, Human
ggccaaggagggugag

SEQ ID NO: 2166180 - RNA, 16 nt, Human
ggccaaggagcugcua

SEQ ID NO: 2166181 - RNA, 16 nt, Human
ggccaaggccuucucc

SEQ ID NO: 2166182 - RNA, 18 nt, Human
ggccaaggccuucuccuc

SEQ ID NO: 2166183 - RNA, 19 nt, Human
ggccaaggccuucuccucc

SEQ ID NO: 2166184 - RNA, 16 nt, Human
ggccagaguggccugg

SEQ ID NO: 2166185 - RNA, 15 nt, Human
ggccagaguggccug

SEQ ID NO: 2166186 - RNA, 14 nt, Human
ggccagaguggccu

SEQ ID NO: 2166187 - RNA, 18 nt, Human
ggccaagugcaggcuggc

SEQ ID NO: 2166188 - RNA, 16 nt, Human
ggccaagugcaggcug

SEQ ID NO: 2166189 - RNA, 23 nt, Human
ggccagagggagugacagaggca

SEQ ID NO: 2166190 - RNA, 16 nt, Human
ggccaacccuucuccu

SEQ ID NO: 2166191 - RNA, 20 nt, Human
ggccaacccuucuccucuug

SEQ ID NO: 2166192 - RNA, 13 nt, Human
ggccaacauggua

SEQ ID NO: 2166193 - RNA, 18 nt, Human
ggccaacaccagggaugg

SEQ ID NO: 2166194 - RNA, 15 nt, Human
ggccaacaccaggga

SEQ ID NO: 2166195 - RNA, 12 nt, Human
ggccaacaaagc

SEQ ID NO: 2166196 - RNA, 15 nt, Human
ggccaacaaagcugu

SEQ ID NO: 2166197 - RNA, 16 nt, Human
ggccaacaaagcuguu

SEQ ID NO: 2166198 - RNA, 13 nt, Human
ggccaaaguguua

SEQ ID NO: 2166199 - RNA, 21 nt, Human
ggccaaauuauuuguguaaua

SEQ ID NO: 2166200 - RNA, 14 nt, Human
ggccaacaaagaac

SEQ ID NO: 2166201 - RNA, 13 nt, Human
ggccaagguggga

SEQ ID NO: 2166202 - RNA, 21 nt, Human
ggccaaggaugccccgucccc

SEQ ID NO: 2166203 - RNA, 15 nt, Human
ggccaaggagcugcu

SEQ ID NO: 2166204 - RNA, 14 nt, Human
ggccaaggagcugc

SEQ ID NO: 2166205 - RNA, 19 nt, Human
ggccaacaucgugaaaccc

SEQ ID NO: 2166206 - RNA, 21 nt, Human
ggccagccccucccaccacag

SEQ ID NO: 2166207 - RNA, 18 nt, Human
ggccagccccucccacca

SEQ ID NO: 2166208 - RNA, 23 nt, Human
ggccagccccucccaccacagca

SEQ ID NO: 2166209 - RNA, 14 nt, Human
ggccagcccggcug

SEQ ID NO: 2166210 - RNA, 15 nt, Human
ggccagcccggcugg

SEQ ID NO: 2166211 - RNA, 16 nt, Human
ggccagcccggcuggu

SEQ ID NO: 2166212 - RNA, 18 nt, Human
ggccagcccggcugguuu

SEQ ID NO: 2166213 - RNA, 16 nt, Human
ggccagccccucccac

SEQ ID NO: 2166214 - RNA, 15 nt, Human
ggccagccccuccca

SEQ ID NO: 2166215 - RNA, 14 nt, Human
ggccagccccuccc

SEQ ID NO: 2166216 - RNA, 20 nt, Human
ggccagccccggcccugggc

SEQ ID NO: 2166217 - RNA, 12 nt, Human
ggccagccccuc

SEQ ID NO: 2166218 - RNA, 17 nt, Human
ggccagccccggcccug

SEQ ID NO: 2166219 - RNA, 19 nt, Human
ggccagccccggcccuggg

SEQ ID NO: 2166220 - RNA, 19 nt, Human
ggccagaguauuggucucc

SEQ ID NO: 2166221 - RNA, 18 nt, Human
ggccagcaccaucucuuu

SEQ ID NO: 2166222 - RNA, 19 nt, Human
ggccagaguggccuggcca

SEQ ID NO: 2166223 - RNA, 18 nt, Human
ggccagaguggccuggcc

SEQ ID NO: 2166224 - RNA, 20 nt, Human
ggccagaguggccuggccag

SEQ ID NO: 2166225 - RNA, 12 nt, Human
ggccagauccag

SEQ ID NO: 2166226 - RNA, 17 nt, Human
ggccagaugcaccagcc

SEQ ID NO: 2166227 - RNA, 16 nt, Human
ggccagauccagccug

SEQ ID NO: 2166228 - RNA, 13 nt, Human
ggccagauccagc

SEQ ID NO: 2166229 - RNA, 19 nt, Human
ggccagaugcaccagcccu

SEQ ID NO: 2166230 - RNA, 20 nt, Human
ggccagaugcaccagcccuu

SEQ ID NO: 2166231 - RNA, 13 nt, Human
ggcauugcuuucc

SEQ ID NO: 2166232 - RNA, 18 nt, Human
ggcauuggcagcaggugc

SEQ ID NO: 2166233 - RNA, 12 nt, Human
ggcauugcuuuc

SEQ ID NO: 2166234 - RNA, 16 nt, Human
ggcauugauggggaag

SEQ ID NO: 2166235 - RNA, 19 nt, Human
ggcauugucccugugccua

SEQ ID NO: 2166236 - RNA, 19 nt, Human
ggcauuggcagcaggugcu

SEQ ID NO: 2166237 - RNA, 21 nt, Human
ggcauuggcagcaggugcugc

SEQ ID NO: 2166238 - RNA, 12 nt, Human
ggcauuguggga

SEQ ID NO: 2166239 - RNA, 22 nt, Human
ggccaaaggagggucaggaagg

SEQ ID NO: 2166240 - RNA, 21 nt, Human
ggccaaaggagggucaggaag

SEQ ID NO: 2166241 - RNA, 21 nt, Human
ggccaaaggaagcacaugccu

SEQ ID NO: 2166242 - RNA, 15 nt, Human
ggccaaagccaaagc

SEQ ID NO: 2166243 - RNA, 12 nt, Human
ggccaaaggaag

SEQ ID NO: 2166244 - RNA, 23 nt, Human
ggcauugauggggaaggaggcug

SEQ ID NO: 2166245 - RNA, 15 nt, Human
ggcauuccugcuuau

SEQ ID NO: 2166246 - RNA, 12 nt, Human
ggcauuccuucu

SEQ ID NO: 2166247 - RNA, 12 nt, Human
ggcauucucuga

SEQ ID NO: 2166248 - RNA, 16 nt, Human
ggccccaaaaccacag

SEQ ID NO: 2166249 - RNA, 21 nt, Human
ggccccaaaaccacagcccug

SEQ ID NO: 2166250 - RNA, 20 nt, Human
ggccccaaaaccacagcccu

SEQ ID NO: 2166251 - RNA, 24 nt, Human
ggcccauaucugugaaaugcuggc

SEQ ID NO: 2166252 - RNA, 16 nt, Human
ggcccaucaguguacc

SEQ ID NO: 2166253 - RNA, 22 nt, Human
ggcccaucaguguacccccgcc

SEQ ID NO: 2166254 - RNA, 13 nt, Human
ggcccaucccccc

SEQ ID NO: 2166255 - RNA, 19 nt, Human
ggcccauccccccucacca

SEQ ID NO: 2166256 - RNA, 16 nt, Human
ggcccauccccccuca

SEQ ID NO: 2166257 - RNA, 18 nt, Human
ggcccauccccccucacc

SEQ ID NO: 2166258 - RNA, 14 nt, Human
ggccccaccaccua

SEQ ID NO: 2166259 - RNA, 19 nt, Human
ggccccagccuggcccagc

SEQ ID NO: 2166260 - RNA, 15 nt, Human
ggccccaccaccuag

SEQ ID NO: 2166261 - RNA, 18 nt, Human
ggccccaggaaaggccca

SEQ ID NO: 2166262 - RNA, 20 nt, Human
ggccccagccuggcccagcu

SEQ ID NO: 2166263 - RNA, 21 nt, Human
ggccccagccuggcccagcuc

SEQ ID NO: 2166264 - RNA, 22 nt, Human
ggccccagccuggcccagcucc

SEQ ID NO: 2166265 - RNA, 23 nt, Human
ggccccagccuggcccagcuccc

SEQ ID NO: 2166266 - RNA, 18 nt, Human
ggccccagggcuacccuc

SEQ ID NO: 2166267 - RNA, 13 nt, Human
ggccccagucagc

SEQ ID NO: 2166268 - RNA, 15 nt, Human
ggccccagucagccu

SEQ ID NO: 2166269 - RNA, 17 nt, Human
ggccccagggcuacccu

SEQ ID NO: 2166270 - RNA, 22 nt, Human
ggccccaggcauugccaagggc

SEQ ID NO: 2166271 - RNA, 15 nt, Human
ggccccaggaagccg

SEQ ID NO: 2166272 - RNA, 14 nt, Human
ggccccaggaagcc

SEQ ID NO: 2166273 - RNA, 13 nt, Human
ggccccaggaagc

SEQ ID NO: 2166274 - RNA, 21 nt, Human
ggccccaggaccuggcugcca

SEQ ID NO: 2166275 - RNA, 16 nt, Human
ggccccaggaccuggc

SEQ ID NO: 2166276 - RNA, 15 nt, Human
ggcccgccuggcaga

SEQ ID NO: 2166277 - RNA, 16 nt, Human
ggcccgcacagagcug

SEQ ID NO: 2166278 - RNA, 23 nt, Human
ggcccgccuggcagaacugagcu

SEQ ID NO: 2166279 - RNA, 19 nt, Human
ggcccgccuggcagaacug

SEQ ID NO: 2166280 - RNA, 15 nt, Human
ggcccgacagccugg

SEQ ID NO: 2166281 - RNA, 16 nt, Human
ggcccgacagccuggc

SEQ ID NO: 2166282 - RNA, 17 nt, Human
ggcccgacagccuggca

SEQ ID NO: 2166283 - RNA, 16 nt, Human
ggccccagucagccuc

SEQ ID NO: 2166284 - RNA, 17 nt, Human
ggccccagucagccucu

SEQ ID NO: 2166285 - RNA, 21 nt, Human
ggccccagucagccucucucc

SEQ ID NO: 2166286 - RNA, 23 nt, Human
ggccccagucagccucucuccca

SEQ ID NO: 2166287 - RNA, 22 nt, Human
ggcccucccuguuccccagaga

SEQ ID NO: 2166288 - RNA, 21 nt, Human
ggcccucccuguuccccagag

SEQ ID NO: 2166289 - RNA, 20 nt, Human
ggcccucccuguuccccaga

SEQ ID NO: 2166290 - RNA, 19 nt, Human
ggcccucccuguuccccag

SEQ ID NO: 2166291 - RNA, 12 nt, Human
ggcccucccagu

SEQ ID NO: 2166292 - RNA, 13 nt, Human
ggcccgcuugccu

SEQ ID NO: 2166293 - RNA, 14 nt, Human
ggcccgcuugccuc

SEQ ID NO: 2166294 - RNA, 17 nt, Human
ggcccgcuugccucggc

SEQ ID NO: 2166295 - RNA, 19 nt, Human
ggcccgcuugccucggcuc

SEQ ID NO: 2166296 - RNA, 21 nt, Human
ggcccgcuugccucggcuccu

SEQ ID NO: 2166297 - RNA, 12 nt, Human
ggcccucagcau

SEQ ID NO: 2166298 - RNA, 20 nt, Human
ggcccucauuaaugacacuu

SEQ ID NO: 2166299 - RNA, 20 nt, Human
ggcccucagcauauuuguau

SEQ ID NO: 2166300 - RNA, 13 nt, Human
ggcccagccccca

SEQ ID NO: 2166301 - RNA, 16 nt, Human
ggcccagcccccacag

SEQ ID NO: 2166302 - RNA, 17 nt, Human
ggcccagcccccacagu

SEQ ID NO: 2166303 - RNA, 19 nt, Human
ggcccagcccccacagugc

SEQ ID NO: 2166304 - RNA, 16 nt, Human
ggcccagcgaccucgg

SEQ ID NO: 2166305 - RNA, 16 nt, Human
ggcccagcggccccuc

SEQ ID NO: 2166306 - RNA, 12 nt, Human
ggcccagccggc

SEQ ID NO: 2166307 - RNA, 16 nt, Human
ggcccagccggccucu

SEQ ID NO: 2166308 - RNA, 17 nt, Human
ggcccagccggccucuc

SEQ ID NO: 2166309 - RNA, 19 nt, Human
ggcccagccggccucucug

SEQ ID NO: 2166310 - RNA, 20 nt, Human
ggcccagccggccucucugg

SEQ ID NO: 2166311 - RNA, 21 nt, Human
ggcccagccggccucucuggc

SEQ ID NO: 2166312 - RNA, 22 nt, Human
ggcccagccggccucucuggcc

SEQ ID NO: 2166313 - RNA, 16 nt, Human
ggcccagcccugcugg

SEQ ID NO: 2166314 - RNA, 22 nt, Human
ggcccagcccugcuggccgccu

SEQ ID NO: 2166315 - RNA, 12 nt, Human
ggcccagcccug

SEQ ID NO: 2166316 - RNA, 13 nt, Human
ggcccagcccugc

SEQ ID NO: 2166317 - RNA, 14 nt, Human
ggcccagcccugcu

SEQ ID NO: 2166318 - RNA, 15 nt, Human
ggcccagcccugcug

SEQ ID NO: 2166319 - RNA, 21 nt, Human
ggcccagcccccacagugcug

SEQ ID NO: 2166320 - RNA, 11 nt, Human
ggcccagcccg

SEQ ID NO: 2166321 - RNA, 12 nt, Human
ggcccagcccgg

SEQ ID NO: 2166322 - RNA, 14 nt, Human
ggcccagcccggcu

SEQ ID NO: 2166323 - RNA, 15 nt, Human
ggcccagcccggcuc

SEQ ID NO: 2166324 - RNA, 16 nt, Human
ggcccagcccggcucc

SEQ ID NO: 2166325 - RNA, 19 nt, Human
ggcccagcccggcucccac

SEQ ID NO: 2166326 - RNA, 20 nt, Human
ggcccagggagaggccauga

SEQ ID NO: 2166327 - RNA, 23 nt, Human
ggcccagggacaccagccaggcu

SEQ ID NO: 2166328 - RNA, 19 nt, Human
ggcccagggacaccagcca

SEQ ID NO: 2166329 - RNA, 20 nt, Human
ggcccagggacaccagccag

SEQ ID NO: 2166330 - RNA, 10 nt, Human
ggcccaggga

SEQ ID NO: 2166331 - RNA, 17 nt, Human
ggcccagggacaccagc

SEQ ID NO: 2166332 - RNA, 14 nt, Human
ggcccagggcccag

SEQ ID NO: 2166333 - RNA, 15 nt, Human
ggcccaggcaggcca

SEQ ID NO: 2166334 - RNA, 13 nt, Human
ggcccaggccauc

SEQ ID NO: 2166335 - RNA, 13 nt, Human
ggccucccaaagu

SEQ ID NO: 2166336 - RNA, 16 nt, Human
ggccucccaaagugcu

SEQ ID NO: 2166337 - RNA, 13 nt, Human
ggccucccaacuc

SEQ ID NO: 2166338 - RNA, 14 nt, Human
ggccucccaacuca

SEQ ID NO: 2166339 - RNA, 18 nt, Human
ggcccuuccucuccacug

SEQ ID NO: 2166340 - RNA, 15 nt, Human
ggcccucccuuggaa

SEQ ID NO: 2166341 - RNA, 23 nt, Human
ggcccucccuuggaaaccugccc

SEQ ID NO: 2166342 - RNA, 23 nt, Human
ggcccucccuguuccccagagaa

SEQ ID NO: 2166343 - RNA, 14 nt, Human
ggcccucccaguac

SEQ ID NO: 2166344 - RNA, 13 nt, Human
ggcccucccuugg

SEQ ID NO: 2166345 - RNA, 19 nt, Human
ggcccuuccucuccacugc

SEQ ID NO: 2166346 - RNA, 22 nt, Human
ggcccuuccucuccacugccuu

SEQ ID NO: 2166347 - RNA, 23 nt, Human
ggcccuuccucuccacugccuuc

SEQ ID NO: 2166348 - RNA, 15 nt, Human
ggcccuccgacagcc

SEQ ID NO: 2166349 - RNA, 20 nt, Human
ggccuccggcgucagccucc

SEQ ID NO: 2166350 - RNA, 21 nt, Human
ggccuccggcgucagccucca

SEQ ID NO: 2166351 - RNA, 22 nt, Human
ggccuccggcgucagccuccag

SEQ ID NO: 2166352 - RNA, 23 nt, Human
ggccuccggcgucagccuccagc

SEQ ID NO: 2166353 - RNA, 23 nt, Human
ggccucccucucucuucugcucc

SEQ ID NO: 2166354 - RNA, 15 nt, Human
ggccucccucucucu

SEQ ID NO: 2166355 - RNA, 22 nt, Human
ggccuccccugccaccaggcca

SEQ ID NO: 2166356 - RNA, 14 nt, Human
ggccuccccugcug

SEQ ID NO: 2166357 - RNA, 14 nt, Human
ggccuccggccucc

SEQ ID NO: 2166358 - RNA, 16 nt, Human
ggccuccggccucccc

SEQ ID NO: 2166359 - RNA, 19 nt, Human
ggccuccggcgucagccuc

SEQ ID NO: 2166360 - RNA, 15 nt, Human
ggccuccccugcuga

SEQ ID NO: 2166361 - RNA, 14 nt, Human
ggccucccacccga

SEQ ID NO: 2166362 - RNA, 20 nt, Human
ggccucccacccgaugcugc

SEQ ID NO: 2166363 - RNA, 21 nt, Human
ggccucccacccgaugcugcu

SEQ ID NO: 2166364 - RNA, 23 nt, Human
ggccucccacccgaugcugcuuu

SEQ ID NO: 2166365 - RNA, 15 nt, Human
ggccuccccugccac

SEQ ID NO: 2166366 - RNA, 17 nt, Human
ggccuccccugccacca

SEQ ID NO: 2166367 - RNA, 19 nt, Human
ggccuccccugccaccagg

SEQ ID NO: 2166368 - RNA, 20 nt, Human
ggcaaccacaggcagcauuu

SEQ ID NO: 2166369 - RNA, 19 nt, Human
ggcaacauugcuggcugga

SEQ ID NO: 2166370 - RNA, 19 nt, Human
ggcaacagaucuggaaccu

SEQ ID NO: 2166371 - RNA, 14 nt, Human
ggcaacaucuuuau

SEQ ID NO: 2166372 - RNA, 19 nt, Human
ggcaacagagcaagauccu

SEQ ID NO: 2166373 - RNA, 15 nt, Human
ggcaacagaucugga

SEQ ID NO: 2166374 - RNA, 14 nt, Human
ggcaacagaucugg

SEQ ID NO: 2166375 - RNA, 21 nt, Human
ggcaaccacaggcagcauuua

SEQ ID NO: 2166376 - RNA, 16 nt, Human
ggcaaccccaguucug

SEQ ID NO: 2166377 - RNA, 17 nt, Human
ggcaaccccaguucugc

SEQ ID NO: 2166378 - RNA, 18 nt, Human
ggcaaccccaguucugcu

SEQ ID NO: 2166379 - RNA, 19 nt, Human
ggcaaccacuaagaauuca

SEQ ID NO: 2166380 - RNA, 16 nt, Human
ggcaaccacuaagaau

SEQ ID NO: 2166381 - RNA, 20 nt, Human
ggcaaccccaguucugcucc

SEQ ID NO: 2166382 - RNA, 21 nt, Human
ggcaaccccaguucugcuccu

SEQ ID NO: 2166383 - RNA, 20 nt, Human
ggcaaagguggcucuccagu

SEQ ID NO: 2166384 - RNA, 12 nt, Human
ggcaaauaaaag

SEQ ID NO: 2166385 - RNA, 16 nt, Human
ggcaaaucaguuacua

SEQ ID NO: 2166386 - RNA, 16 nt, Human
ggcaaauaucuugaaa

SEQ ID NO: 2166387 - RNA, 13 nt, Human
ggcaaaugacuuu

SEQ ID NO: 2166388 - RNA, 21 nt, Human
ggcaacacagcgagacuccgu

SEQ ID NO: 2166389 - RNA, 12 nt, Human
ggcaacagagca

SEQ ID NO: 2166390 - RNA, 20 nt, Human
ggcaacacagcgagacuccg

SEQ ID NO: 2166391 - RNA, 20 nt, Human
ggcaaauuaacuugaguuuu

SEQ ID NO: 2166392 - RNA, 16 nt, Human
ggcaaaugcccaaggg

SEQ ID NO: 2166393 - RNA, 13 nt, Human
ggcaaaugcccaa

SEQ ID NO: 2166394 - RNA, 16 nt, Human
ggcaaauuaacuugag

SEQ ID NO: 2166395 - RNA, 13 nt, Human
ggcaaacaggcag

SEQ ID NO: 2166396 - RNA, 23 nt, Human
ggcaaaaugagagggcaguguuu

SEQ ID NO: 2166397 - RNA, 23 nt, Human
ggcaaacaggcaguuggccagag

SEQ ID NO: 2166398 - RNA, 16 nt, Human
ggcaaagacagaagcc

SEQ ID NO: 2166399 - RNA, 17 nt, Human
ggcaaacuucagacuga

SEQ ID NO: 2166400 - RNA, 13 nt, Human
ggcaaacccauca

SEQ ID NO: 2166401 - RNA, 22 nt, Human
ggcaaagcacgaaauguuauuu

SEQ ID NO: 2166402 - RNA, 18 nt, Human
ggcaaagcuuuuagaaau

SEQ ID NO: 2166403 - RNA, 16 nt, Human
ggcaaaggaaggugga

SEQ ID NO: 2166404 - RNA, 17 nt, Human
ggcaaaggaagguggau

SEQ ID NO: 2166405 - RNA, 19 nt, Human
ggcaaaggaagguggaugg

SEQ ID NO: 2166406 - RNA, 20 nt, Human
ggcaaagggagcagaacuga

SEQ ID NO: 2166407 - RNA, 21 nt, Human
ggcaaagggagcagaacugaa

SEQ ID NO: 2166408 - RNA, 23 nt, Human
ggauguuucugucacaucagcuc

SEQ ID NO: 2166409 - RNA, 23 nt, Human
ggauguuuuaauuccaugaaucg

SEQ ID NO: 2166410 - RNA, 18 nt, Human
ggauguuuuucaugaaaa

SEQ ID NO: 2166411 - RNA, 23 nt, Human
ggauuaaacuuaaucuaaaugga

SEQ ID NO: 2166412 - RNA, 16 nt, Human
ggauuaauaugaaaac

SEQ ID NO: 2166413 - RNA, 15 nt, Human
ggauuaauaugaaaa

SEQ ID NO: 2166414 - RNA, 14 nt, Human
ggauuaauaugaaa

SEQ ID NO: 2166415 - RNA, 18 nt, Human
ggauuugaugcuguuuga

SEQ ID NO: 2166416 - RNA, 14 nt, Human
ggauuugccccuuc

SEQ ID NO: 2166417 - RNA, 22 nt, Human
ggauuugccccuucccaucucu

SEQ ID NO: 2166418 - RNA, 15 nt, Human
ggauuaaccucugca

SEQ ID NO: 2166419 - RNA, 16 nt, Human
ggauuaaccucugcac

SEQ ID NO: 2166420 - RNA, 17 nt, Human
ggauuaaccucugcacu

SEQ ID NO: 2166421 - RNA, 18 nt, Human
ggauuaaccucugcacua

SEQ ID NO: 2166422 - RNA, 21 nt, Human
ggauuuugauccaagcugguc

SEQ ID NO: 2166423 - RNA, 13 nt, Human
ggcaaaauugcaa

SEQ ID NO: 2166424 - RNA, 16 nt, Human
ggcaaaauccuugcuu

SEQ ID NO: 2166425 - RNA, 12 nt, Human
ggauuuugagua

SEQ ID NO: 2166426 - RNA, 16 nt, Human
ggauuuugucaagcag

SEQ ID NO: 2166427 - RNA, 16 nt, Human
ggauuuucaucagggg

SEQ ID NO: 2166428 - RNA, 22 nt, Human
ggauuuucuauuguuacucugg

SEQ ID NO: 2166429 - RNA, 19 nt, Human
ggauuuggguuggaaguga

SEQ ID NO: 2166430 - RNA, 22 nt, Human
ggauuuuaacaaaagcaagacu

SEQ ID NO: 2166431 - RNA, 21 nt, Human
ggaugacaugcacucagcucu

SEQ ID NO: 2166432 - RNA, 15 nt, Human
ggaugacaugucccu

SEQ ID NO: 2166433 - RNA, 20 nt, Human
ggaugacaugucccuacacc

SEQ ID NO: 2166434 - RNA, 16 nt, Human
ggaugacaugucccua

SEQ ID NO: 2166435 - RNA, 21 nt, Human
ggaugaauuccaaauucugcu

SEQ ID NO: 2166436 - RNA, 18 nt, Human
ggaugaaugaggucccag

SEQ ID NO: 2166437 - RNA, 14 nt, Human
ggaugaaugagguc

SEQ ID NO: 2166438 - RNA, 22 nt, Human
ggaugaaugaggucccaggcag

SEQ ID NO: 2166439 - RNA, 23 nt, Human
ggaugaauguaugugcacuguca

SEQ ID NO: 2166440 - RNA, 18 nt, Human
ggaugacuagaggcaggg

SEQ ID NO: 2166441 - RNA, 23 nt, Human
ggaugacgguauuaugcuucuug

SEQ ID NO: 2166442 - RNA, 21 nt, Human
ggaugagaauuugagugcucu

SEQ ID NO: 2166443 - RNA, 16 nt, Human
ggaugacaugugacuc

SEQ ID NO: 2166444 - RNA, 14 nt, Human
ggaugaccagaaca

SEQ ID NO: 2166445 - RNA, 22 nt, Human
ggaugacgguauuaugcuucuu

SEQ ID NO: 2166446 - RNA, 19 nt, Human
ggaugacuagaggcaggga

SEQ ID NO: 2166447 - RNA, 14 nt, Human
ggaugagagcccag

SEQ ID NO: 2166448 - RNA, 23 nt, Human
ggaugagaauuugagugcucuga

SEQ ID NO: 2166449 - RNA, 15 nt, Human
ggaugagagcccaga

SEQ ID NO: 2166450 - RNA, 16 nt, Human
ggaugagagcccagag

SEQ ID NO: 2166451 - RNA, 18 nt, Human
ggaugagagcccagaggu

SEQ ID NO: 2166452 - RNA, 19 nt, Human
ggaugagagcccagaggua

SEQ ID NO: 2166453 - RNA, 12 nt, Human
ggaugagaaagg

SEQ ID NO: 2166454 - RNA, 22 nt, Human
ggaugagaaagguugaagcacc

SEQ ID NO: 2166455 - RNA, 20 nt, Human
ggauguaaacagugccugcu

SEQ ID NO: 2166456 - RNA, 13 nt, Human
ggaugucuuccuu

SEQ ID NO: 2166457 - RNA, 14 nt, Human
ggaugucuuccuug

SEQ ID NO: 2166458 - RNA, 17 nt, Human
ggaugucuuccuuggag

SEQ ID NO: 2166459 - RNA, 21 nt, Human
ggauguaaacagugccugcug

SEQ ID NO: 2166460 - RNA, 19 nt, Human
ggauguaaacagugccugc

SEQ ID NO: 2166461 - RNA, 18 nt, Human
ggauguaaacagugccug

SEQ ID NO: 2166462 - RNA, 17 nt, Human
ggauguaaacagugccu

SEQ ID NO: 2166463 - RNA, 16 nt, Human
ggauguaaacagugcc

SEQ ID NO: 2166464 - RNA, 20 nt, Human
ggaugagagcccagagguaa

SEQ ID NO: 2166465 - RNA, 23 nt, Human
ggaugagagcccagagguaacag

SEQ ID NO: 2166466 - RNA, 15 nt, Human
ggaugguguucaaaa

SEQ ID NO: 2166467 - RNA, 22 nt, Human
ggaugguucccuugaugaagaa

SEQ ID NO: 2166468 - RNA, 23 nt, Human
ggaugguucccuugaugaagaag

SEQ ID NO: 2166469 - RNA, 15 nt, Human
ggauguucuggcccu

SEQ ID NO: 2166470 - RNA, 23 nt, Human
ggauguucagcacugucccuugc

SEQ ID NO: 2166471 - RNA, 13 nt, Human
ggaugugugcaug

SEQ ID NO: 2166472 - RNA, 20 nt, Human
ggauguucagcacugucccu

SEQ ID NO: 2166473 - RNA, 16 nt, Human
ggaugugguggcagug

SEQ ID NO: 2166474 - RNA, 23 nt, Human
ggaugugggagggagcagacagg

SEQ ID NO: 2166475 - RNA, 15 nt, Human
ggaugugggagggag

SEQ ID NO: 2166476 - RNA, 22 nt, Human
ggaugugggguccccaucaucc

SEQ ID NO: 2166477 - RNA, 17 nt, Human
ggauguggcugcagcag

SEQ ID NO: 2166478 - RNA, 23 nt, Human
ggauguggcugcagcagcggugg

SEQ ID NO: 2166479 - RNA, 18 nt, Human
ggaugugauuguggaaug

SEQ ID NO: 2166480 - RNA, 22 nt, Human
ggaugugaauugccugcagaga

SEQ ID NO: 2166481 - RNA, 16 nt, Human
ggcaggcuggcuggcc

SEQ ID NO: 2166482 - RNA, 20 nt, Human
ggcaggcuggccaguccagg

SEQ ID NO: 2166483 - RNA, 11 nt, Human
ggcaggcuggc

SEQ ID NO: 2166484 - RNA, 12 nt, Human
ggcaggcuggcc

SEQ ID NO: 2166485 - RNA, 13 nt, Human
ggcaggcuggcca

SEQ ID NO: 2166486 - RNA, 17 nt, Human
ggcaggcuggccagucc

SEQ ID NO: 2166487 - RNA, 13 nt, Human
ggcaggcccugca

SEQ ID NO: 2166488 - RNA, 14 nt, Human
ggcaggcccugcac

SEQ ID NO: 2166489 - RNA, 15 nt, Human
ggcaggcccugcacu

SEQ ID NO: 2166490 - RNA, 16 nt, Human
ggcaggcccugcacug

SEQ ID NO: 2166491 - RNA, 19 nt, Human
ggcaggcccugcacugucc

SEQ ID NO: 2166492 - RNA, 21 nt, Human
ggcaggcccugcacuguccug

SEQ ID NO: 2166493 - RNA, 10 nt, Human
ggcaggcagu

SEQ ID NO: 2166494 - RNA, 16 nt, Human
ggcaggcugacaucug

SEQ ID NO: 2166495 - RNA, 18 nt, Human
ggcaggcugacaucugug

SEQ ID NO: 2166496 - RNA, 15 nt, Human
ggcaggcucacugcc

SEQ ID NO: 2166497 - RNA, 16 nt, Human
ggcaggcucacugcca

SEQ ID NO: 2166498 - RNA, 19 nt, Human
ggcaggcucacugccaggc

SEQ ID NO: 2166499 - RNA, 22 nt, Human
ggcaggcucacugccaggccag

SEQ ID NO: 2166500 - RNA, 22 nt, Human
ggcaggcccugcacuguccugc

SEQ ID NO: 2166501 - RNA, 17 nt, Human
ggcaggcuaaggcgugg

SEQ ID NO: 2166502 - RNA, 21 nt, Human
ggcaggcuaaggcguggagcu

SEQ ID NO: 2166503 - RNA, 22 nt, Human
ggcaggcuaaggcguggagcug

SEQ ID NO: 2166504 - RNA, 18 nt, Human
ggcaggcuagaaccuggc

SEQ ID NO: 2166505 - RNA, 19 nt, Human
ggcaggcuagaaccuggca

SEQ ID NO: 2166506 - RNA, 13 nt, Human
ggcaggcucacug

SEQ ID NO: 2166507 - RNA, 16 nt, Human
ggcaggacucagcucc

SEQ ID NO: 2166508 - RNA, 21 nt, Human
ggcaggacucagcuccccaga

SEQ ID NO: 2166509 - RNA, 23 nt, Human
ggcaggacucagcuccccagagu

SEQ ID NO: 2166510 - RNA, 18 nt, Human
ggcaggcacagcacaggg

SEQ ID NO: 2166511 - RNA, 23 nt, Human
ggcaggaccuucgggcugugccc

SEQ ID NO: 2166512 - RNA, 21 nt, Human
ggcaggaccuucgggcugugc

SEQ ID NO: 2166513 - RNA, 15 nt, Human
ggcaggcagcgccaa

SEQ ID NO: 2166514 - RNA, 13 nt, Human
ggcaggcagcgcc

SEQ ID NO: 2166515 - RNA, 14 nt, Human
ggcaggcagcgcca

SEQ ID NO: 2166516 - RNA, 23 nt, Human
ggcaggacaugcugaagccaaag

SEQ ID NO: 2166517 - RNA, 21 nt, Human
ggcaggacaacgaggaagccc

SEQ ID NO: 2166518 - RNA, 20 nt, Human
ggcaggacaacgaggaagcc

SEQ ID NO: 2166519 - RNA, 21 nt, Human
ggcaggaccucagaguccagg

SEQ ID NO: 2166520 - RNA, 15 nt, Human
ggcaggaccucagag

SEQ ID NO: 2166521 - RNA, 14 nt, Human
ggcaggaccaggac

SEQ ID NO: 2166522 - RNA, 15 nt, Human
ggcaggaccaggacu

SEQ ID NO: 2166523 - RNA, 18 nt, Human
ggcaggacaacgaggaag

SEQ ID NO: 2166524 - RNA, 19 nt, Human
ggcaggacaacgaggaagc

SEQ ID NO: 2166525 - RNA, 22 nt, Human
ggcagccucccauccagggccc

SEQ ID NO: 2166526 - RNA, 21 nt, Human
ggcagccucccauccagggcc

SEQ ID NO: 2166527 - RNA, 14 nt, Human
ggcagccucccauc

SEQ ID NO: 2166528 - RNA, 22 nt, Human
ggcagccgugccuucagcucua

SEQ ID NO: 2166529 - RNA, 19 nt, Human
ggcagccgugccuucagcu

SEQ ID NO: 2166530 - RNA, 21 nt, Human
ggcagccgugccuucagcucu

SEQ ID NO: 2166531 - RNA, 18 nt, Human
ggcagccgugccuucagc

SEQ ID NO: 2166532 - RNA, 15 nt, Human
ggcagccaggcugcc

SEQ ID NO: 2166533 - RNA, 13 nt, Human
ggcagccaggcug

SEQ ID NO: 2166534 - RNA, 19 nt, Human
ggcagccaggcugccaagg

SEQ ID NO: 2166535 - RNA, 12 nt, Human
ggcagccaggcu

SEQ ID NO: 2166536 - RNA, 23 nt, Human
ggcagagauuggaaugggcagcu

SEQ ID NO: 2166537 - RNA, 14 nt, Human
ggcagccaggccac

SEQ ID NO: 2166538 - RNA, 10 nt, Human
ggcagagcag

SEQ ID NO: 2166539 - RNA, 15 nt, Human
ggcagccaggccaca

SEQ ID NO: 2166540 - RNA, 17 nt, Human
ggcagccaggccacaag

SEQ ID NO: 2166541 - RNA, 14 nt, Human
ggcacuuuuuaauu

SEQ ID NO: 2166542 - RNA, 22 nt, Human
ggcacuuugaaggggccucacc

SEQ ID NO: 2166543 - RNA, 22 nt, Human
ggcagaaagcaaaugugaccug

SEQ ID NO: 2166544 - RNA, 17 nt, Human
ggcagaaagcaaaauua

SEQ ID NO: 2166545 - RNA, 11 nt, Human
ggcagaaaauu

SEQ ID NO: 2166546 - RNA, 17 nt, Human
ggcagaaaauugcacaa

SEQ ID NO: 2166547 - RNA, 13 nt, Human
ggcagaacugagc

SEQ ID NO: 2166548 - RNA, 20 nt, Human
ggcagaacagccgcuccugu

SEQ ID NO: 2166549 - RNA, 18 nt, Human
ggcagaacagccgcuccu

SEQ ID NO: 2166550 - RNA, 14 nt, Human
ggcagaacagccgc

SEQ ID NO: 2166551 - RNA, 16 nt, Human
ggcagaaaguggccau

SEQ ID NO: 2166552 - RNA, 14 nt, Human
ggcagaaaguggcc

SEQ ID NO: 2166553 - RNA, 20 nt, Human
ggcagaaagguucugcccgg

SEQ ID NO: 2166554 - RNA, 22 nt, Human
ggcagaaagguucugcccggga

SEQ ID NO: 2166555 - RNA, 14 nt, Human
ggcagaacacuaac

SEQ ID NO: 2166556 - RNA, 15 nt, Human
ggcagaacacuaacc

SEQ ID NO: 2166557 - RNA, 20 nt, Human
ggcagaacacuaaccugacc

SEQ ID NO: 2166558 - RNA, 21 nt, Human
ggcagaacacuaaccugaccg

SEQ ID NO: 2166559 - RNA, 23 nt, Human
ggcagaagaauugaacccaggag

SEQ ID NO: 2166560 - RNA, 22 nt, Human
ggcagaagaauugaacccagga

SEQ ID NO: 2166561 - RNA, 12 nt, Human
ggcagaagacac

SEQ ID NO: 2166562 - RNA, 15 nt, Human
ggcagaagacaccag

SEQ ID NO: 2166563 - RNA, 17 nt, Human
ggcagaagaauugaacc

SEQ ID NO: 2166564 - RNA, 21 nt, Human
ggcagaacugagcuccucugg

SEQ ID NO: 2166565 - RNA, 15 nt, Human
ggcagaacugagcuc

SEQ ID NO: 2166566 - RNA, 14 nt, Human
ggcagaacugagcu

SEQ ID NO: 2166567 - RNA, 12 nt, Human
ggcagaaggaag

SEQ ID NO: 2166568 - RNA, 14 nt, Human
ggcagagaaucaua

SEQ ID NO: 2166569 - RNA, 9 nt, Human
ggcagagag

SEQ ID NO: 2166570 - RNA, 10 nt, Human
ggcagagagc

SEQ ID NO: 2166571 - RNA, 19 nt, Human
ggcagagagcggucucagg

SEQ ID NO: 2166572 - RNA, 14 nt, Human
ggcagacuggguuu

SEQ ID NO: 2166573 - RNA, 14 nt, Human
ggcagagaaagaag

SEQ ID NO: 2166574 - RNA, 17 nt, Human
ggcagagaaagaagaga

SEQ ID NO: 2166575 - RNA, 18 nt, Human
ggcagagaaagaagagac

SEQ ID NO: 2166576 - RNA, 21 nt, Human
ggcagagaaagaagagacagg

SEQ ID NO: 2166577 - RNA, 16 nt, Human
ggcagaaggccaagag

SEQ ID NO: 2166578 - RNA, 22 nt, Human
ggcagaagacaccagagcagau

SEQ ID NO: 2166579 - RNA, 15 nt, Human
ggcagaagggagaag

SEQ ID NO: 2166580 - RNA, 19 nt, Human
ggcagaauaaucuuugggu

SEQ ID NO: 2166581 - RNA, 17 nt, Human
ggcagaaggcaaaccca

SEQ ID NO: 2166582 - RNA, 20 nt, Human
ggcagaagacaccagagcag

SEQ ID NO: 2166583 - RNA, 21 nt, Human
ggcagaagacaccagagcaga

SEQ ID NO: 2166584 - RNA, 16 nt, Human
ggcagaagacaccaga

SEQ ID NO: 2166585 - RNA, 17 nt, Human
ggcagaagacaccagag

SEQ ID NO: 2166586 - RNA, 18 nt, Human
ggcagaagacaccagagc

SEQ ID NO: 2166587 - RNA, 19 nt, Human
ggcagaagacaccagagca

SEQ ID NO: 2166588 - RNA, 23 nt, Human
ggcugggacguggcucagccagc

SEQ ID NO: 2166589 - RNA, 19 nt, Human
ggcugggacguggcucagc

SEQ ID NO: 2166590 - RNA, 18 nt, Human
ggcugggacguggcucag

SEQ ID NO: 2166591 - RNA, 19 nt, Human
ggcugggaacucaccuggg

SEQ ID NO: 2166592 - RNA, 21 nt, Human
ggcugggaacugcagaccugu

SEQ ID NO: 2166593 - RNA, 23 nt, Human
ggcugggaacugcagaccugucc

SEQ ID NO: 2166594 - RNA, 17 nt, Human
ggcuggcuaacuggaag

SEQ ID NO: 2166595 - RNA, 20 nt, Human
ggcuggcggcuacucagcag

SEQ ID NO: 2166596 - RNA, 19 nt, Human
ggcuggcgcagccaaggcc

SEQ ID NO: 2166597 - RNA, 21 nt, Human
ggcuggcgcagccaaggccga

SEQ ID NO: 2166598 - RNA, 14 nt, Human
ggcuggccuuccug

SEQ ID NO: 2166599 - RNA, 14 nt, Human
ggcuggcgcagcca

SEQ ID NO: 2166600 - RNA, 16 nt, Human
ggcuggcgcagccaag

SEQ ID NO: 2166601 - RNA, 17 nt, Human
ggcuggcgcagccaagg

SEQ ID NO: 2166602 - RNA, 22 nt, Human
ggcuggcuccagaugcagggca

SEQ ID NO: 2166603 - RNA, 16 nt, Human
ggcuggcucccucuug

SEQ ID NO: 2166604 - RNA, 24 nt, Human
ggcuggcuccagaugcagggcagu

SEQ ID NO: 2166605 - RNA, 15 nt, Human
ggcuggcugcaguga

SEQ ID NO: 2166606 - RNA, 14 nt, Human
ggcuggcugcagug

SEQ ID NO: 2166607 - RNA, 13 nt, Human
ggcuggcugggca

SEQ ID NO: 2166608 - RNA, 12 nt, Human
ggcuggcugggg

SEQ ID NO: 2166609 - RNA, 13 nt, Human
ggcuggcuggggc

SEQ ID NO: 2166610 - RNA, 13 nt, Human
ggcuggcuucagg

SEQ ID NO: 2166611 - RNA, 16 nt, Human
ggcuggcuucaggagg

SEQ ID NO: 2166612 - RNA, 20 nt, Human
ggcugcccacacaccccaau

SEQ ID NO: 2166613 - RNA, 18 nt, Human
ggcugcccacuaugguca

SEQ ID NO: 2166614 - RNA, 19 nt, Human
ggcugccccaaccugcuga

SEQ ID NO: 2166615 - RNA, 19 nt, Human
ggcugcccccggcccccug

SEQ ID NO: 2166616 - RNA, 20 nt, Human
ggcugcccccggcccccugg

SEQ ID NO: 2166617 - RNA, 21 nt, Human
ggcugcccccggcccccuggu

SEQ ID NO: 2166618 - RNA, 17 nt, Human
ggcuggaucugugaggg

SEQ ID NO: 2166619 - RNA, 17 nt, Human
ggcugcccacacacccc

SEQ ID NO: 2166620 - RNA, 19 nt, Human
ggcugcccacacaccccaa

SEQ ID NO: 2166621 - RNA, 18 nt, Human
ggcugccaugugaagagg

SEQ ID NO: 2166622 - RNA, 15 nt, Human
ggcuggauguggugg

SEQ ID NO: 2166623 - RNA, 15 nt, Human
ggcuggaugaaauuu

SEQ ID NO: 2166624 - RNA, 19 nt, Human
ggcuggaugugguggcaua

SEQ ID NO: 2166625 - RNA, 18 nt, Human
ggcuggaugugguggcau

SEQ ID NO: 2166626 - RNA, 21 nt, Human
ggcuggauuuugaauuuucuu

SEQ ID NO: 2166627 - RNA, 13 nt, Human
ggcuggcacagga

SEQ ID NO: 2166628 - RNA, 19 nt, Human
ggcuggcaccgccuucucu

SEQ ID NO: 2166629 - RNA, 14 nt, Human
ggcuggcagcucuc

SEQ ID NO: 2166630 - RNA, 15 nt, Human
ggcuggcagcucucc

SEQ ID NO: 2166631 - RNA, 16 nt, Human
ggcuggcagcucucca

SEQ ID NO: 2166632 - RNA, 15 nt, Human
ggcuggcacaggaca

SEQ ID NO: 2166633 - RNA, 14 nt, Human
ggcuggcacaggac

SEQ ID NO: 2166634 - RNA, 18 nt, Human
ggcuggcagcucuccagu

SEQ ID NO: 2166635 - RNA, 20 nt, Human
ggcuggcagcucuccaguca

SEQ ID NO: 2166636 - RNA, 13 nt, Human
ggcuggcccagcc

SEQ ID NO: 2166637 - RNA, 14 nt, Human
ggcuggcccagccc

SEQ ID NO: 2166638 - RNA, 15 nt, Human
ggcuggcccagcccu

SEQ ID NO: 2166639 - RNA, 16 nt, Human
ggcuggcccagcccug

SEQ ID NO: 2166640 - RNA, 17 nt, Human
ggcuggcccagcccugc

SEQ ID NO: 2166641 - RNA, 18 nt, Human
ggcuggcccagcccugcu

SEQ ID NO: 2166642 - RNA, 14 nt, Human
ggcuggcgugcagu

SEQ ID NO: 2166643 - RNA, 16 nt, Human
ggcuggcccugcccug

SEQ ID NO: 2166644 - RNA, 21 nt, Human
ggcuggcccagcccugcuggc

SEQ ID NO: 2166645 - RNA, 13 nt, Human
ggcuggccuuccu

SEQ ID NO: 2166646 - RNA, 16 nt, Human
ggcuggcgugcagugg

SEQ ID NO: 2166647 - RNA, 20 nt, Human
ggcuggcgugcaguggugcg

SEQ ID NO: 2166648 - RNA, 15 nt, Human
ggcuggcccugcccu

SEQ ID NO: 2166649 - RNA, 14 nt, Human
ggcuggcccugccc

SEQ ID NO: 2166650 - RNA, 13 nt, Human
ggcuggcccugcc

SEQ ID NO: 2166651 - RNA, 19 nt, Human
ggcuggcccagcccugcug

SEQ ID NO: 2166652 - RNA, 20 nt, Human
ggcuggcccagcccugcugg

SEQ ID NO: 2166653 - RNA, 22 nt, Human
ggcuggcccagcccugcuggcc

SEQ ID NO: 2166654 - RNA, 17 nt, Human
ggcuggccuggccccuc

SEQ ID NO: 2166655 - RNA, 22 nt, Human
ggcuggccuggccccucagggu

SEQ ID NO: 2166656 - RNA, 9 nt, Human
ggcuccugc

SEQ ID NO: 2166657 - RNA, 12 nt, Human
ggcuccugccac

SEQ ID NO: 2166658 - RNA, 12 nt, Human
ggcuccugccag

SEQ ID NO: 2166659 - RNA, 13 nt, Human
ggcuccugccacc

SEQ ID NO: 2166660 - RNA, 12 nt, Human
ggcuccugaggg

SEQ ID NO: 2166661 - RNA, 12 nt, Human
ggcuccucucag

SEQ ID NO: 2166662 - RNA, 17 nt, Human
ggcuccucccggugccc

SEQ ID NO: 2166663 - RNA, 22 nt, Human
ggcuccgucaguaucaggccug

SEQ ID NO: 2166664 - RNA, 18 nt, Human
ggcuccgucaguaucagg

SEQ ID NO: 2166665 - RNA, 15 nt, Human
ggcuccgaacacccu

SEQ ID NO: 2166666 - RNA, 24 nt, Human
ggcuccgucaguaucaggccugcc

SEQ ID NO: 2166667 - RNA, 20 nt, Human
ggcuccuaucuguguuuuga

SEQ ID NO: 2166668 - RNA, 20 nt, Human
ggcucccuucccaccucucu

SEQ ID NO: 2166669 - RNA, 22 nt, Human
ggcucccuucccaccucucuca

SEQ ID NO: 2166670 - RNA, 16 nt, Human
ggcucccuucccaccu

SEQ ID NO: 2166671 - RNA, 17 nt, Human
ggcucccuucccaccuc

SEQ ID NO: 2166672 - RNA, 18 nt, Human
ggcucccuucccaccucu

SEQ ID NO: 2166673 - RNA, 20 nt, Human
ggcugaaagaggccaaugcc

SEQ ID NO: 2166674 - RNA, 16 nt, Human
ggcucuucuccccaga

SEQ ID NO: 2166675 - RNA, 22 nt, Human
ggcucuucucauuucaccccuc

SEQ ID NO: 2166676 - RNA, 13 nt, Human
ggcucuucucauu

SEQ ID NO: 2166677 - RNA, 20 nt, Human
ggcucuucucauuucacccc

SEQ ID NO: 2166678 - RNA, 20 nt, Human
ggcucuuccaggcugggaga

SEQ ID NO: 2166679 - RNA, 12 nt, Human
ggcucuucucau

SEQ ID NO: 2166680 - RNA, 20 nt, Human
ggcuccuuuuucucccucug

SEQ ID NO: 2166681 - RNA, 19 nt, Human
ggcucgauuuuguaucugc

SEQ ID NO: 2166682 - RNA, 23 nt, Human
ggcucuuccaggcugggagagcc

SEQ ID NO: 2166683 - RNA, 24 nt, Human
ggcucuuccaggcugggagagccu

SEQ ID NO: 2166684 - RNA, 21 nt, Human
ggcucgagcaguccugccuca

SEQ ID NO: 2166685 - RNA, 20 nt, Human
ggcucgaaucucugugccuu

SEQ ID NO: 2166686 - RNA, 18 nt, Human
ggcucgaaucucugugcc

SEQ ID NO: 2166687 - RNA, 19 nt, Human
ggcucgaaucucugugccu

SEQ ID NO: 2166688 - RNA, 18 nt, Human
ggcucgagcaugccugga

SEQ ID NO: 2166689 - RNA, 17 nt, Human
ggcuccugccuucuguc

SEQ ID NO: 2166690 - RNA, 12 nt, Human
ggcuccuuucuc

SEQ ID NO: 2166691 - RNA, 13 nt, Human
ggcuccuuucucc

SEQ ID NO: 2166692 - RNA, 17 nt, Human
ggcuccuuucuccagcc

SEQ ID NO: 2166693 - RNA, 19 nt, Human
ggcuccuuucuccagccag

SEQ ID NO: 2166694 - RNA, 13 nt, Human
ggcucgaaucucu

SEQ ID NO: 2166695 - RNA, 20 nt, Human
ggcuccuuucuccagccagc

SEQ ID NO: 2166696 - RNA, 21 nt, Human
ggcuccuuucuccagccagca

SEQ ID NO: 2166697 - RNA, 15 nt, Human
ggcucgaaucucugu

SEQ ID NO: 2166698 - RNA, 17 nt, Human
ggcucgaaucucugugc

SEQ ID NO: 2166699 - RNA, 17 nt, Human
ggcugcagggaguccga

SEQ ID NO: 2166700 - RNA, 21 nt, Human
ggcugaacacuccaauuaagg

SEQ ID NO: 2166701 - RNA, 14 nt, Human
ggcugaacccugug

SEQ ID NO: 2166702 - RNA, 15 nt, Human
ggcugaacccugugc

SEQ ID NO: 2166703 - RNA, 16 nt, Human
ggcugaacccugugcu

SEQ ID NO: 2166704 - RNA, 17 nt, Human
ggcugaacccugugcug

SEQ ID NO: 2166705 - RNA, 19 nt, Human
ggcugaacccugugcuggu

SEQ ID NO: 2166706 - RNA, 20 nt, Human
ggcugaacccugugcuggug

SEQ ID NO: 2166707 - RNA, 11 nt, Human
ggcugaaagcc

SEQ ID NO: 2166708 - RNA, 14 nt, Human
ggcugaaauucucc

SEQ ID NO: 2166709 - RNA, 16 nt, Human
ggcugaaauucuccug

SEQ ID NO: 2166710 - RNA, 17 nt, Human
ggcugaaauucuccugg

SEQ ID NO: 2166711 - RNA, 18 nt, Human
ggcugaaauucuccugga

SEQ ID NO: 2166712 - RNA, 19 nt, Human
ggcugaaauucuccuggag

SEQ ID NO: 2166713 - RNA, 21 nt, Human
ggcugaaauucuccuggaggu

SEQ ID NO: 2166714 - RNA, 22 nt, Human
ggcugaaauucuccuggagguc

SEQ ID NO: 2166715 - RNA, 22 nt, Human
ggcugcagugacgugcaccugu

SEQ ID NO: 2166716 - RNA, 20 nt, Human
ggcugaacggggagaaaagg

SEQ ID NO: 2166717 - RNA, 17 nt, Human
ggcugaacggggagaaa

SEQ ID NO: 2166718 - RNA, 15 nt, Human
ggcugaacggggaga

SEQ ID NO: 2166719 - RNA, 23 nt, Human
ggcugaacccugugcuggugucc

SEQ ID NO: 2166720 - RNA, 21 nt, Human
ggcugaacccugugcuggugu

SEQ ID NO: 2166721 - RNA, 22 nt, Human
ggcugaacccugugcugguguc

SEQ ID NO: 2166722 - RNA, 20 nt, Human
ggcugcaugcgggcuuccuc

SEQ ID NO: 2166723 - RNA, 13 nt, Human
ggcugccaccaag

SEQ ID NO: 2166724 - RNA, 23 nt, Human
ggcugcaucugggauucccacca

SEQ ID NO: 2166725 - RNA, 15 nt, Human
ggcugcagugagcca

SEQ ID NO: 2166726 - RNA, 22 nt, Human
ggcugcaugcgggcuuccuccu

SEQ ID NO: 2166727 - RNA, 12 nt, Human
aaaaaaaaaguu

SEQ ID NO: 2166728 - RNA, 13 nt, Human
aaaaaaaaaguuc

SEQ ID NO: 2166729 - RNA, 10 nt, Human
aaaaaaaaga

SEQ ID NO: 2166730 - RNA, 13 nt, Human
aaaaaaaaagaaa

SEQ ID NO: 2166731 - RNA, 13 nt, Human
aaaaaaacacaaa

SEQ ID NO: 2166732 - RNA, 11 nt, Human
aaaaaaaagaa

SEQ ID NO: 2166733 - RNA, 13 nt, Human
aaaaaaaauacuu

SEQ ID NO: 2166734 - RNA, 11 nt, Human
aaaaaaaaguu

SEQ ID NO: 2166735 - RNA, 12 nt, Human
aaaaaaaaguua

SEQ ID NO: 2166736 - RNA, 12 nt, Human
aaaaaaguuaua

SEQ ID NO: 2166737 - RNA, 13 nt, Human
aaaaaaguuauau

SEQ ID NO: 2166738 - RNA, 15 nt, Human
aaaaaaguuauauag

SEQ ID NO: 2166739 - RNA, 18 nt, Human
aaaaaaguuauauagguu

SEQ ID NO: 2166740 - RNA, 21 nt, Human
aaaaaagaggaaagaaugaaa

SEQ ID NO: 2166741 - RNA, 13 nt, Human
aaaaaagauauau

SEQ ID NO: 2166742 - RNA, 19 nt, Human
aaaaaaggacaauuucaaa

SEQ ID NO: 2166743 - RNA, 16 nt, Human
aaaaaaggcauuguuu

SEQ ID NO: 2166744 - RNA, 20 nt, Human
aaaaaauaaucuauuucuau

SEQ ID NO: 2166745 - RNA, 11 nt, Human
aaaaaauacug

SEQ ID NO: 2166746 - RNA, 14 nt, Human
aaaaaauacugcca

SEQ ID NO: 2166747 - RNA, 20 nt, Human
aaaaaaguuuacaaguguau

SEQ ID NO: 2166748 - RNA, 12 nt, Human
aaaaaaguuuua

SEQ ID NO: 2166749 - RNA, 16 nt, Human
aaaaaauaaaacauuu

SEQ ID NO: 2166750 - RNA, 11 nt, Human
aaaaaauacuu

SEQ ID NO: 2166751 - RNA, 16 nt, Human
aaaaaauacugccaga

SEQ ID NO: 2166752 - RNA, 20 nt, Human
aaaaaauacugccagaugcu

SEQ ID NO: 2166753 - RNA, 13 nt, Human
aaaaaauacuugu

SEQ ID NO: 2166754 - RNA, 13 nt, Human
aaaaagcuucccc

SEQ ID NO: 2166755 - RNA, 19 nt, Human
aaaaagcuuccaugauucu

SEQ ID NO: 2166756 - RNA, 19 nt, Human
aaaaaggaaaaaauuaaua

SEQ ID NO: 2166757 - RNA, 18 nt, Human
aaaaagcucauauuuugu

SEQ ID NO: 2166758 - RNA, 20 nt, Human
aaaaagcuccuguccuccca

SEQ ID NO: 2166759 - RNA, 19 nt, Human
aaaaagcucauauuuugua

SEQ ID NO: 2166760 - RNA, 20 nt, Human
aaaaagcuccaaaugcagcu

SEQ ID NO: 2166761 - RNA, 22 nt, Human
aaaaagggcagggcaucuccug

SEQ ID NO: 2166762 - RNA, 21 nt, Human
aaaaagggauccguacauuca

SEQ ID NO: 2166763 - RNA, 21 nt, Human
aaaaaguaaguaccacucagg

SEQ ID NO: 2166764 - RNA, 19 nt, Human
aaaaaguaggaaaugaaug

SEQ ID NO: 2166765 - RNA, 14 nt, Human
aaaaaguauuauuu

SEQ ID NO: 2166766 - RNA, 13 nt, Human
aaaaaguauuauu

SEQ ID NO: 2166767 - RNA, 19 nt, Human
aaaaaguauuauuuuccaa

SEQ ID NO: 2166768 - RNA, 15 nt, Human
aaaaaguauuauuuu

SEQ ID NO: 2166769 - RNA, 22 nt, Human
aaaaagucuacgcucuccuuuc

SEQ ID NO: 2166770 - RNA, 13 nt, Human
aaaaagugacaca

SEQ ID NO: 2166771 - RNA, 20 nt, Human
aaaaagucagacugcuggga

SEQ ID NO: 2166772 - RNA, 13 nt, Human
gggaaaagcagcu

SEQ ID NO: 2166773 - RNA, 16 nt, Human
ggcuuuuuuuuucucu

SEQ ID NO: 2166774 - RNA, 23 nt, Human
gggaaaaucagccugcuccagcu

SEQ ID NO: 2166775 - RNA, 18 nt, Human
gggaaaauuauuugcaua

SEQ ID NO: 2166776 - RNA, 17 nt, Human
gggaaaauuauuugcau

SEQ ID NO: 2166777 - RNA, 14 nt, Human
gggaaacuuggcuc

SEQ ID NO: 2166778 - RNA, 21 nt, Human
gggaaagacauccauaaagaa

SEQ ID NO: 2166779 - RNA, 13 nt, Human
gggaaaaucagcc

SEQ ID NO: 2166780 - RNA, 15 nt, Human
ggcuucucucucacc

SEQ ID NO: 2166781 - RNA, 16 nt, Human
ggcuucucucucacca

SEQ ID NO: 2166782 - RNA, 23 nt, Human
gggaaaaagaggaucuggagaac

SEQ ID NO: 2166783 - RNA, 17 nt, Human
ggcuuuuuuuuucucuu

SEQ ID NO: 2166784 - RNA, 20 nt, Human
ggcuucucauacguccacca

SEQ ID NO: 2166785 - RNA, 21 nt, Human
ggcuucucauacguccaccau

SEQ ID NO: 2166786 - RNA, 16 nt, Human
ggcuucuccgccagcc

SEQ ID NO: 2166787 - RNA, 17 nt, Human
ggcuucuccgccagccu

SEQ ID NO: 2166788 - RNA, 18 nt, Human
ggcuucuccgccagccuc

SEQ ID NO: 2166789 - RNA, 21 nt, Human
ggcuucuccgccagccuccuc

SEQ ID NO: 2166790 - RNA, 23 nt, Human
ggcuucuccgccagccuccucug

SEQ ID NO: 2166791 - RNA, 12 nt, Human
ggcuucuccuga

SEQ ID NO: 2166792 - RNA, 13 nt, Human
ggcuucuccugac

SEQ ID NO: 2166793 - RNA, 15 nt, Human
ggcuucuccugaccc

SEQ ID NO: 2166794 - RNA, 16 nt, Human
ggcuucuccugaccca

SEQ ID NO: 2166795 - RNA, 11 nt, Human
ggcuucucucu

SEQ ID NO: 2166796 - RNA, 12 nt, Human
ggcuucucucuc

SEQ ID NO: 2166797 - RNA, 13 nt, Human
ggcuucucucuca

SEQ ID NO: 2166798 - RNA, 21 nt, Human
ggcuuccagaaaaccccagca

SEQ ID NO: 2166799 - RNA, 22 nt, Human
ggcuuccaagguggucugcucg

SEQ ID NO: 2166800 - RNA, 13 nt, Human
ggcuuccagagag

SEQ ID NO: 2166801 - RNA, 14 nt, Human
ggcuuccagagagu

SEQ ID NO: 2166802 - RNA, 20 nt, Human
ggcuuccagagaguccucug

SEQ ID NO: 2166803 - RNA, 22 nt, Human
ggcuuccagagaguccucugga

SEQ ID NO: 2166804 - RNA, 12 nt, Human
ggcuuccaggua

SEQ ID NO: 2166805 - RNA, 18 nt, Human
ggcuucauuagagcaggc

SEQ ID NO: 2166806 - RNA, 16 nt, Human
ggcuucaugccagcua

SEQ ID NO: 2166807 - RNA, 14 nt, Human
ggcuucauucaagu

SEQ ID NO: 2166808 - RNA, 17 nt, Human
ggcuucauucaagucua

SEQ ID NO: 2166809 - RNA, 14 nt, Human
ggcuuccaaggugg

SEQ ID NO: 2166810 - RNA, 19 nt, Human
ggcuuccaagguggucugc

SEQ ID NO: 2166811 - RNA, 16 nt, Human
ggcuucaguggcagcu

SEQ ID NO: 2166812 - RNA, 18 nt, Human
ggcuucaggggagucccg

SEQ ID NO: 2166813 - RNA, 15 nt, Human
ggcuucaugccagcu

SEQ ID NO: 2166814 - RNA, 22 nt, Human
ggcuuccauuugugugugugca

SEQ ID NO: 2166815 - RNA, 18 nt, Human
ggcuuccauuugugugug

SEQ ID NO: 2166816 - RNA, 17 nt, Human
ggcuuccauuugugugu

SEQ ID NO: 2166817 - RNA, 21 nt, Human
ggcuuccagguaucuccagga

SEQ ID NO: 2166818 - RNA, 17 nt, Human
ggcuucccaguggcugc

SEQ ID NO: 2166819 - RNA, 21 nt, Human
ggcuuccucuagaagccaagg

SEQ ID NO: 2166820 - RNA, 19 nt, Human
ggcuucccaguggcugcug

SEQ ID NO: 2166821 - RNA, 20 nt, Human
ggcuucccaguggcugcugc

SEQ ID NO: 2166822 - RNA, 21 nt, Human
ggcuucccaguggcugcugcc

SEQ ID NO: 2166823 - RNA, 22 nt, Human
ggcuucccaguggcugcugccc

SEQ ID NO: 2166824 - RNA, 19 nt, Human
ggcuuccugcguccuccuc

SEQ ID NO: 2166825 - RNA, 20 nt, Human
ggcuuccugcguccuccuca

SEQ ID NO: 2166826 - RNA, 12 nt, Human
ggcuuccuuucu

SEQ ID NO: 2166827 - RNA, 23 nt, Human
aaaaaguguuuauuuuucauauu

SEQ ID NO: 2166828 - RNA, 12 nt, Human
aaaaaguuauau

SEQ ID NO: 2166829 - RNA, 17 nt, Human
aaaaaguuauauagguu

SEQ ID NO: 2166830 - RNA, 10 nt, Human
ggcuggugcc

SEQ ID NO: 2166831 - RNA, 15 nt, Human
ggcuggugccagccu

SEQ ID NO: 2166832 - RNA, 18 nt, Human
ggcuggugccagccuucc

SEQ ID NO: 2166833 - RNA, 14 nt, Human
ggcugguggcccag

SEQ ID NO: 2166834 - RNA, 13 nt, Human
ggcugguggccca

SEQ ID NO: 2166835 - RNA, 19 nt, Human
ggcuggugcuguggccagg

SEQ ID NO: 2166836 - RNA, 13 nt, Human
aaaaaguguuuau

SEQ ID NO: 2166837 - RNA, 12 nt, Human
aaaaaguguuua

SEQ ID NO: 2166838 - RNA, 14 nt, Human
aaaaagugacacag

SEQ ID NO: 2166839 - RNA, 15 nt, Human
aaaaagugacacagc

SEQ ID NO: 2166840 - RNA, 16 nt, Human
aaaaagugacacagca

SEQ ID NO: 2166841 - RNA, 17 nt, Human
aaaaagugacacagcag

SEQ ID NO: 2166842 - RNA, 19 nt, Human
aaaaagugacacagcagcu

SEQ ID NO: 2166843 - RNA, 20 nt, Human
aaaaagugacacagcagcuu

SEQ ID NO: 2166844 - RNA, 23 nt, Human
aaaaagugacacagcagcuucac

SEQ ID NO: 2166845 - RNA, 19 nt, Human
ggcuguaucccaugagccu

SEQ ID NO: 2166846 - RNA, 16 nt, Human
ggcuggugucaccuga

SEQ ID NO: 2166847 - RNA, 16 nt, Human
ggcugguggcccagga

SEQ ID NO: 2166848 - RNA, 21 nt, Human
ggcugguggcucccggagggc

SEQ ID NO: 2166849 - RNA, 13 nt, Human
ggcuggugggagg

SEQ ID NO: 2166850 - RNA, 17 nt, Human
ggcuggugggaggggcg

SEQ ID NO: 2166851 - RNA, 18 nt, Human
ggcugucaguaugacauu

SEQ ID NO: 2166852 - RNA, 18 nt, Human
ggcugucagcaggaagca

SEQ ID NO: 2166853 - RNA, 17 nt, Human
ggcugucagcaggaagc

SEQ ID NO: 2166854 - RNA, 16 nt, Human
ggcugucagcaggaag

SEQ ID NO: 2166855 - RNA, 15 nt, Human
ggcugucagcaggaa

SEQ ID NO: 2166856 - RNA, 11 nt, Human
ggcuguccagu

SEQ ID NO: 2166857 - RNA, 15 nt, Human
ggcuguccagugccc

SEQ ID NO: 2166858 - RNA, 17 nt, Human
ggcugucaucugugcac

SEQ ID NO: 2166859 - RNA, 14 nt, Human
ggcugucaucugug

SEQ ID NO: 2166860 - RNA, 20 nt, Human
ggcuucagcauauuuauagc

SEQ ID NO: 2166861 - RNA, 16 nt, Human
ggcuguccagugccca

SEQ ID NO: 2166862 - RNA, 19 nt, Human
ggcuguccagugcccauuc

SEQ ID NO: 2166863 - RNA, 15 nt, Human
ggcuucaguggcagc

SEQ ID NO: 2166864 - RNA, 20 nt, Human
ggcuguaucccaugagccuc

SEQ ID NO: 2166865 - RNA, 22 nt, Human
ggcuguaucccaugagccucag

SEQ ID NO: 2166866 - RNA, 23 nt, Human
ggcuguaucccaugagccucagc

SEQ ID NO: 2166867 - RNA, 15 nt, Human
ggcugucaauuacag

SEQ ID NO: 2166868 - RNA, 14 nt, Human
gggacuucuuuuca

SEQ ID NO: 2166869 - RNA, 13 nt, Human
gggacuugaaguu

SEQ ID NO: 2166870 - RNA, 12 nt, Human
gggacugugugu

SEQ ID NO: 2166871 - RNA, 15 nt, Human
gggacuuccuugcuc

SEQ ID NO: 2166872 - RNA, 19 nt, Human
gggacuuccuugcucuccc

SEQ ID NO: 2166873 - RNA, 20 nt, Human
gggacuuccuugcucucccu

SEQ ID NO: 2166874 - RNA, 21 nt, Human
gggacugucuuucagauacau

SEQ ID NO: 2166875 - RNA, 20 nt, Human
gggacuggggaugugggagg

SEQ ID NO: 2166876 - RNA, 12 nt, Human
gggacuggguuu

SEQ ID NO: 2166877 - RNA, 20 nt, Human
gggacuggguuuggacccca

SEQ ID NO: 2166878 - RNA, 21 nt, Human
gggacuggguuuggaccccag

SEQ ID NO: 2166879 - RNA, 17 nt, Human
gggacugggagggccca

SEQ ID NO: 2166880 - RNA, 15 nt, Human
gggacugggagggcc

SEQ ID NO: 2166881 - RNA, 14 nt, Human
gggacugggagggc

SEQ ID NO: 2166882 - RNA, 13 nt, Human
gggacugggaggg

SEQ ID NO: 2166883 - RNA, 15 nt, Human
gggacugcuaaauaa

SEQ ID NO: 2166884 - RNA, 19 nt, Human
gggacuggaaccagggaga

SEQ ID NO: 2166885 - RNA, 20 nt, Human
gggacugggagccgcagcag

SEQ ID NO: 2166886 - RNA, 16 nt, Human
gggacugcuaaauaaa

SEQ ID NO: 2166887 - RNA, 12 nt, Human
gggagagccagc

SEQ ID NO: 2166888 - RNA, 23 nt, Human
gggagagcaggcuggcagcucuc

SEQ ID NO: 2166889 - RNA, 15 nt, Human
gggagagcaggcugg

SEQ ID NO: 2166890 - RNA, 16 nt, Human
gggagagcaggcuggc

SEQ ID NO: 2166891 - RNA, 23 nt, Human
gggagagagagagagagaggaca

SEQ ID NO: 2166892 - RNA, 12 nt, Human
gggagagcaggc

SEQ ID NO: 2166893 - RNA, 13 nt, Human
gggagagcaggcu

SEQ ID NO: 2166894 - RNA, 14 nt, Human
gggagagcaggcug

SEQ ID NO: 2166895 - RNA, 11 nt, Human
gggaggcagag

SEQ ID NO: 2166896 - RNA, 12 nt, Human
gggagagagaga

SEQ ID NO: 2166897 - RNA, 18 nt, Human
gggagagagacguguaca

SEQ ID NO: 2166898 - RNA, 14 nt, Human
gggagagagagaga

SEQ ID NO: 2166899 - RNA, 22 nt, Human
gggagagagagagagagaggac

SEQ ID NO: 2166900 - RNA, 13 nt, Human
gggagagacccuu

SEQ ID NO: 2166901 - RNA, 12 nt, Human
gggagagaccuc

SEQ ID NO: 2166902 - RNA, 22 nt, Human
gggagagaccucaucaggauga

SEQ ID NO: 2166903 - RNA, 20 nt, Human
gggagacugggcugagggag

SEQ ID NO: 2166904 - RNA, 19 nt, Human
gggagacugggcugaggga

SEQ ID NO: 2166905 - RNA, 16 nt, Human
gggagacugggcugag

SEQ ID NO: 2166906 - RNA, 14 nt, Human
gggagacugggcug

SEQ ID NO: 2166907 - RNA, 20 nt, Human
gggaggcagagguugcagug

SEQ ID NO: 2166908 - RNA, 13 nt, Human
gggaggcagccgg

SEQ ID NO: 2166909 - RNA, 18 nt, Human
gggacuugaaucuuucca

SEQ ID NO: 2166910 - RNA, 16 nt, Human
gggaggcauggcccug

SEQ ID NO: 2166911 - RNA, 12 nt, Human
gggagagcccag

SEQ ID NO: 2166912 - RNA, 15 nt, Human
gggagagccagcucc

SEQ ID NO: 2166913 - RNA, 14 nt, Human
gggagagccagcuc

SEQ ID NO: 2166914 - RNA, 17 nt, Human
gggaggcauggcccugg

SEQ ID NO: 2166915 - RNA, 13 nt, Human
gggaggccaagga

SEQ ID NO: 2166916 - RNA, 13 nt, Human
gggagggcagcag

SEQ ID NO: 2166917 - RNA, 11 nt, Human
gggagggcagc

SEQ ID NO: 2166918 - RNA, 13 nt, Human
gggagggccuggg

SEQ ID NO: 2166919 - RNA, 21 nt, Human
gggagggcggcaggggccugg

SEQ ID NO: 2166920 - RNA, 22 nt, Human
gggagggcggcaggggccugga

SEQ ID NO: 2166921 - RNA, 11 nt, Human
gggagggcucc

SEQ ID NO: 2166922 - RNA, 13 nt, Human
gggagggcuccag

SEQ ID NO: 2166923 - RNA, 20 nt, Human
aaaagcuauggugagaugca

SEQ ID NO: 2166924 - RNA, 15 nt, Human
aaaagcuauuagcca

SEQ ID NO: 2166925 - RNA, 17 nt, Human
aaaagcuauuagccagg

SEQ ID NO: 2166926 - RNA, 14 nt, Human
aaaagcucauauuu

SEQ ID NO: 2166927 - RNA, 20 nt, Human
aaaagcuauuagccaggauc

SEQ ID NO: 2166928 - RNA, 21 nt, Human
aaaagcuauuagccaggauca

SEQ ID NO: 2166929 - RNA, 22 nt, Human
aaaagcuccauuuuuagugaaa

SEQ ID NO: 2166930 - RNA, 13 nt, Human
aaaagcugcucag

SEQ ID NO: 2166931 - RNA, 10 nt, Human
aaaagcugau

SEQ ID NO: 2166932 - RNA, 13 nt, Human
aaaagcuccuguc

SEQ ID NO: 2166933 - RNA, 20 nt, Human
aaaagcucuuacacuacauu

SEQ ID NO: 2166934 - RNA, 18 nt, Human
aaaagcucauauuuugua

SEQ ID NO: 2166935 - RNA, 12 nt, Human
aaaagcuccugu

SEQ ID NO: 2166936 - RNA, 14 nt, Human
aaaagcuuccauga

SEQ ID NO: 2166937 - RNA, 14 nt, Human
aaaagcugggcagg

SEQ ID NO: 2166938 - RNA, 17 nt, Human
aaaacuuguaaaugcug

SEQ ID NO: 2166939 - RNA, 19 nt, Human
aaaacuuuacuaagaugac

SEQ ID NO: 2166940 - RNA, 14 nt, Human
aaaacuuuccucgc

SEQ ID NO: 2166941 - RNA, 16 nt, Human
aaaacuuuccucgccu

SEQ ID NO: 2166942 - RNA, 20 nt, Human
aaaacuuuccucgccugaca

SEQ ID NO: 2166943 - RNA, 22 nt, Human
aaaacuugauguguuaucucuu

SEQ ID NO: 2166944 - RNA, 21 nt, Human
aaaacuuuaugcuaagugaaa

SEQ ID NO: 2166945 - RNA, 20 nt, Human
aaaacuuuacuaagaugaca

SEQ ID NO: 2166946 - RNA, 19 nt, Human
aaaagccugcaauuucaua

SEQ ID NO: 2166947 - RNA, 16 nt, Human
aaaagccuguuuaaga

SEQ ID NO: 2166948 - RNA, 18 nt, Human
aaaagccuguuuaagaga

SEQ ID NO: 2166949 - RNA, 20 nt, Human
aaaaaucugcagaaggaaaa

SEQ ID NO: 2166950 - RNA, 18 nt, Human
aaaaaucugcagaaggaa

SEQ ID NO: 2166951 - RNA, 18 nt, Human
gggaacagacaggagaaa

SEQ ID NO: 2166952 - RNA, 22 nt, Human
aaaaaucugaccaaaacaaaca

SEQ ID NO: 2166953 - RNA, 15 nt, Human
aaaaaugauguucau

SEQ ID NO: 2166954 - RNA, 18 nt, Human
aaaaaugcaaauccuaug

SEQ ID NO: 2166955 - RNA, 20 nt, Human
aaaaaugcaaauccuaugug

SEQ ID NO: 2166956 - RNA, 20 nt, Human
aaaaaugacuaaaaauauua

SEQ ID NO: 2166957 - RNA, 17 nt, Human
aaaaaugacagauguug

SEQ ID NO: 2166958 - RNA, 14 nt, Human
aaaaaugaaauuau

SEQ ID NO: 2166959 - RNA, 12 nt, Human
aaaaaugaaagc

SEQ ID NO: 2166960 - RNA, 18 nt, Human
aaaaaugcccuuaaauca

SEQ ID NO: 2166961 - RNA, 23 nt, Human
aaaaaugcaaauccuaugugauu

SEQ ID NO: 2166962 - RNA, 22 nt, Human
aaaaaugcaaauccuaugugau

SEQ ID NO: 2166963 - RNA, 21 nt, Human
aaaaaugcacguagcugaggc

SEQ ID NO: 2166964 - RNA, 22 nt, Human
aaaaaugucuuggguaggcggg

SEQ ID NO: 2166965 - RNA, 12 nt, Human
aaaaaugccuuu

SEQ ID NO: 2166966 - RNA, 13 nt, Human
aaaaaugccuuug

SEQ ID NO: 2166967 - RNA, 18 nt, Human
aaaaaugugcaaaacagc

SEQ ID NO: 2166968 - RNA, 12 nt, Human
aaaaauguguaa

SEQ ID NO: 2166969 - RNA, 20 nt, Human
aaaaauguuaaaauguauuc

SEQ ID NO: 2166970 - RNA, 12 nt, Human
aaaaauuaaaau

SEQ ID NO: 2166971 - RNA, 16 nt, Human
aaaaauguuggauuua

SEQ ID NO: 2166972 - RNA, 20 nt, Human
aaaaauguuggauuuauaaa

SEQ ID NO: 2166973 - RNA, 14 nt, Human
gggaacagacugga

SEQ ID NO: 2166974 - RNA, 19 nt, Human
gggaacagacaacagaagu

SEQ ID NO: 2166975 - RNA, 19 nt, Human
gggaacaaggguggcaucc

SEQ ID NO: 2166976 - RNA, 14 nt, Human
gggaaauggugccu

SEQ ID NO: 2166977 - RNA, 14 nt, Human
gggaaauaagagag

SEQ ID NO: 2166978 - RNA, 17 nt, Human
gggaaauacuacuccug

SEQ ID NO: 2166979 - RNA, 13 nt, Human
gggaaaggggugc

SEQ ID NO: 2166980 - RNA, 22 nt, Human
gggaaaggcucugaaagccagc

SEQ ID NO: 2166981 - RNA, 15 nt, Human
gggaaaggauauuuu

SEQ ID NO: 2166982 - RNA, 15 nt, Human
gggaaagccaccucu

SEQ ID NO: 2166983 - RNA, 19 nt, Human
gggaaagccagugacucca

SEQ ID NO: 2166984 - RNA, 22 nt, Human
gggaaagccagugacuccagga

SEQ ID NO: 2166985 - RNA, 16 nt, Human
gggaacagacaggaga

SEQ ID NO: 2166986 - RNA, 15 nt, Human
gggaacagacaggag

SEQ ID NO: 2166987 - RNA, 14 nt, Human
gggaacagacagga

SEQ ID NO: 2166988 - RNA, 17 nt, Human
aaaaaucucaaauuucu

SEQ ID NO: 2166989 - RNA, 22 nt, Human
gggaacagacuggaagcacagc

SEQ ID NO: 2166990 - RNA, 20 nt, Human
aaaaaucucaaauuucuaaa

SEQ ID NO: 2166991 - RNA, 19 nt, Human
aaaaaucucaaauuucuaa

SEQ ID NO: 2166992 - RNA, 19 nt, Human
aaaacauuuucacacaaua

SEQ ID NO: 2166993 - RNA, 21 nt, Human
aaaacauuuuuuaauagaaua

SEQ ID NO: 2166994 - RNA, 16 nt, Human
aaaacauuuuaaaugg

SEQ ID NO: 2166995 - RNA, 17 nt, Human
aaaacauuuuaaaugga

SEQ ID NO: 2166996 - RNA, 13 nt, Human
aaaaauuagcuga

SEQ ID NO: 2166997 - RNA, 22 nt, Human
aaaaauguuggauuuauaaaug

SEQ ID NO: 2166998 - RNA, 15 nt, Human
aaaaccaauguucuc

SEQ ID NO: 2166999 - RNA, 14 nt, Human
aaaaccaagaagau

SEQ ID NO: 2167000 - RNA, 13 nt, Human
aaaaccaaagagg

SEQ ID NO: 2167001 - RNA, 22 nt, Human
aaaaccaaagagggcuuccucu

SEQ ID NO: 2167002 - RNA, 19 nt, Human
aaaacauuuuaaauggaca

SEQ ID NO: 2167003 - RNA, 14 nt, Human
aaaacguggcugcu

SEQ ID NO: 2167004 - RNA, 16 nt, Human
aaaacguggcugcuuc

SEQ ID NO: 2167005 - RNA, 17 nt, Human
aaaacguggcugcuuca

SEQ ID NO: 2167006 - RNA, 18 nt, Human
aaaacguggcugcuucaa

SEQ ID NO: 2167007 - RNA, 21 nt, Human
aaaacuacaaaucaaguauuu

SEQ ID NO: 2167008 - RNA, 18 nt, Human
aaaacuaaauagcaugua

SEQ ID NO: 2167009 - RNA, 19 nt, Human
aaaacuaaauagcauguau

SEQ ID NO: 2167010 - RNA, 22 nt, Human
aaaacuaaauagcauguauugu

SEQ ID NO: 2167011 - RNA, 18 nt, Human
aaaacuaaaucucuaaua

SEQ ID NO: 2167012 - RNA, 19 nt, Human
aaaacuaaaucucuaauau

SEQ ID NO: 2167013 - RNA, 19 nt, Human
aaaacguuuuauuguguuu

SEQ ID NO: 2167014 - RNA, 17 nt, Human
aaaacguuuuauugugu

SEQ ID NO: 2167015 - RNA, 16 nt, Human
aaaacguuuuauugug

SEQ ID NO: 2167016 - RNA, 15 nt, Human
aaaacguuuuauugu

SEQ ID NO: 2167017 - RNA, 19 nt, Human
aaaaccaagccguggcuuc

SEQ ID NO: 2167018 - RNA, 21 nt, Human
aaaacguggcugcuucaagga

SEQ ID NO: 2167019 - RNA, 19 nt, Human
aaaacugcguuaaaggcuc

SEQ ID NO: 2167020 - RNA, 19 nt, Human
aaaacugcucauaugaugu

SEQ ID NO: 2167021 - RNA, 18 nt, Human
aaaacugauuuuuuuuuc

SEQ ID NO: 2167022 - RNA, 22 nt, Human
aaaacugauuuuuuuuuccuuc

SEQ ID NO: 2167023 - RNA, 14 nt, Human
aaaauacaaaauua

SEQ ID NO: 2167024 - RNA, 14 nt, Human
aaaauaccagccag

SEQ ID NO: 2167025 - RNA, 21 nt, Human
aaaauaauuuuuauauuugaa

SEQ ID NO: 2167026 - RNA, 23 nt, Human
aaaauaauuuuuauauuugaaau

SEQ ID NO: 2167027 - RNA, 15 nt, Human
aaaauacuauucuga

SEQ ID NO: 2167028 - RNA, 22 nt, Human
aaaauagcaacacucuauauuu

SEQ ID NO: 2167029 - RNA, 21 nt, Human
aaaauagcaacacucuauauu

SEQ ID NO: 2167030 - RNA, 22 nt, Human
aaaauacuauuuuuacugccac

SEQ ID NO: 2167031 - RNA, 22 nt, Human
aaaauagauaagaguagaaacu

SEQ ID NO: 2167032 - RNA, 15 nt, Human
aaaauaccagccagu

SEQ ID NO: 2167033 - RNA, 14 nt, Human
aaaauaccaaggaa

SEQ ID NO: 2167034 - RNA, 15 nt, Human
aaaauaaauauauau

SEQ ID NO: 2167035 - RNA, 12 nt, Human
aaaauaaauaua

SEQ ID NO: 2167036 - RNA, 14 nt, Human
aaaauaaauauaua

SEQ ID NO: 2167037 - RNA, 11 nt, Human
aaaauaaauau

SEQ ID NO: 2167038 - RNA, 12 nt, Human
aaaauaaauaaa

SEQ ID NO: 2167039 - RNA, 14 nt, Human
aaaauaacacacau

SEQ ID NO: 2167040 - RNA, 12 nt, Human
aaaauaaauuau

SEQ ID NO: 2167041 - RNA, 12 nt, Human
aaaaguaacuug

SEQ ID NO: 2167042 - RNA, 22 nt, Human
aaaaguaaguaccacucaggcc

SEQ ID NO: 2167043 - RNA, 23 nt, Human
aaaagguuuuauuuuguaauuau

SEQ ID NO: 2167044 - RNA, 19 nt, Human
aaaagguuuuauuuuguaa

SEQ ID NO: 2167045 - RNA, 11 nt, Human
aaaaguaaaca

SEQ ID NO: 2167046 - RNA, 15 nt, Human
aaaagguuuuauuuu

SEQ ID NO: 2167047 - RNA, 16 nt, Human
aaaagguuuuauuuug

SEQ ID NO: 2167048 - RNA, 17 nt, Human
aaaagguuuuauuuugu

SEQ ID NO: 2167049 - RNA, 23 nt, Human
aaaaguaaguaccacucaggcca

SEQ ID NO: 2167050 - RNA, 15 nt, Human
aaaaguacaauuuac

SEQ ID NO: 2167051 - RNA, 21 nt, Human
aaaaguacauuuaauacagca

SEQ ID NO: 2167052 - RNA, 13 nt, Human
aaaaguacauuua

SEQ ID NO: 2167053 - RNA, 17 nt, Human
aaaaguacauuuaauac

SEQ ID NO: 2167054 - RNA, 18 nt, Human
aaaauagguauacagugg

SEQ ID NO: 2167055 - RNA, 18 nt, Human
aaaauaguaaaugcuuug

SEQ ID NO: 2167056 - RNA, 19 nt, Human
aaaauaguaaaugcuuugu

SEQ ID NO: 2167057 - RNA, 12 nt, Human
aaaauagcuugu

SEQ ID NO: 2167058 - RNA, 21 nt, Human
aaaauagcuuguauaguguaa

SEQ ID NO: 2167059 - RNA, 13 nt, Human
aaaauagcuugua

SEQ ID NO: 2167060 - RNA, 19 nt, Human
aaaauagcuuguauagugu

SEQ ID NO: 2167061 - RNA, 10 nt, Human
aaaauagcca

SEQ ID NO: 2167062 - RNA, 17 nt, Human
aaaauagcaauccuaaa

SEQ ID NO: 2167063 - RNA, 23 nt, Human
aaaauagcaaccuuuuuaucucc

SEQ ID NO: 2167064 - RNA, 12 nt, Human
aaaauagccugc

SEQ ID NO: 2167065 - RNA, 10 nt, Human
aaaauauaac

SEQ ID NO: 2167066 - RNA, 13 nt, Human
aaaauauaaaaua

SEQ ID NO: 2167067 - RNA, 22 nt, Human
aaaauauaaaacugcguuaaag

SEQ ID NO: 2167068 - RNA, 10 nt, Human
aaaauauaaa

SEQ ID NO: 2167069 - RNA, 14 nt, Human
aaaauauaaaacug

SEQ ID NO: 2167070 - RNA, 17 nt, Human
aaaauauaaaacugcgu

SEQ ID NO: 2167071 - RNA, 18 nt, Human
aaaauaguggugugauuu

SEQ ID NO: 2167072 - RNA, 21 nt, Human
aaaauaguugagccagcagac

SEQ ID NO: 2167073 - RNA, 23 nt, Human
aaaauaguuaagacaugauuucc

SEQ ID NO: 2167074 - RNA, 18 nt, Human
aaaauaguugagccagca

SEQ ID NO: 2167075 - RNA, 20 nt, Human
aaaauaguugagccagcaga

SEQ ID NO: 2167076 - RNA, 20 nt, Human
aaaauauggguugcauuugg

SEQ ID NO: 2167077 - RNA, 21 nt, Human
aaaauauggaacuucuaauau

SEQ ID NO: 2167078 - RNA, 14 nt, Human
aaaauauauuuaau

SEQ ID NO: 2167079 - RNA, 18 nt, Human
aaaauauauaucaaauau

SEQ ID NO: 2167080 - RNA, 21 nt, Human
aaaauauagcuguacaaauau

SEQ ID NO: 2167081 - RNA, 24 nt, Human
aaaauauaauuuuuuagagagcug

SEQ ID NO: 2167082 - RNA, 11 nt, Human
aaaauauacug

SEQ ID NO: 2167083 - RNA, 15 nt, Human
aaaauauacuguaaa

SEQ ID NO: 2167084 - RNA, 14 nt, Human
aaaauauacuguaa

SEQ ID NO: 2167085 - RNA, 13 nt, Human
aaaauauacugua

SEQ ID NO: 2167086 - RNA, 12 nt, Human
aaaauauacugu

SEQ ID NO: 2167087 - RNA, 16 nt, Human
aaaauauagcuguaca

SEQ ID NO: 2167088 - RNA, 20 nt, Human
aaaauauagcuguacaaaua

SEQ ID NO: 2167089 - RNA, 23 nt, Human
aaaauauacuguaaagaaagaga

SEQ ID NO: 2167090 - RNA, 22 nt, Human
aaaauauacuguaaagaaagag

SEQ ID NO: 2167091 - RNA, 20 nt, Human
aaaauauacuguaaagaaag

SEQ ID NO: 2167092 - RNA, 18 nt, Human
aaaauauacuguaaagaa

SEQ ID NO: 2167093 - RNA, 17 nt, Human
aaaauauacuguaaaga

SEQ ID NO: 2167094 - RNA, 16 nt, Human
aaaauauacuguaaag

SEQ ID NO: 2167095 - RNA, 20 nt, Human
gggauuuccagccagggcug

SEQ ID NO: 2167096 - RNA, 17 nt, Human
gggauuucucccagcuc

SEQ ID NO: 2167097 - RNA, 19 nt, Human
gggauucugguuccagggu

SEQ ID NO: 2167098 - RNA, 21 nt, Human
gggauucuacuuuaagcacua

SEQ ID NO: 2167099 - RNA, 15 nt, Human
gggauuuccaugaug

SEQ ID NO: 2167100 - RNA, 14 nt, Human
gggcaaacaggcag

SEQ ID NO: 2167101 - RNA, 16 nt, Human
gggcaaaacugaauua

SEQ ID NO: 2167102 - RNA, 18 nt, Human
gggcaaaauucccaggga

SEQ ID NO: 2167103 - RNA, 23 nt, Human
gggcagagcagagaccaucccug

SEQ ID NO: 2167104 - RNA, 15 nt, Human
gggauuucucccagc

SEQ ID NO: 2167105 - RNA, 21 nt, Human
gggcaaaaaacucgaggacug

SEQ ID NO: 2167106 - RNA, 17 nt, Human
gggcagagccgggaagc

SEQ ID NO: 2167107 - RNA, 11 nt, Human
gggcagagcug

SEQ ID NO: 2167108 - RNA, 16 nt, Human
gggcagagcuggcucu

SEQ ID NO: 2167109 - RNA, 17 nt, Human
gggcagagcuggcucug

SEQ ID NO: 2167110 - RNA, 19 nt, Human
gggcagagcuggcucugag

SEQ ID NO: 2167111 - RNA, 14 nt, Human
gggcagagccggga

SEQ ID NO: 2167112 - RNA, 13 nt, Human
gggcagagccggg

SEQ ID NO: 2167113 - RNA, 14 nt, Human
gggcagagcccaag

SEQ ID NO: 2167114 - RNA, 12 nt, Human
gggcagagccca

SEQ ID NO: 2167115 - RNA, 15 nt, Human
gggcaaacaggcagu

SEQ ID NO: 2167116 - RNA, 16 nt, Human
gggauucaggcugcuu

SEQ ID NO: 2167117 - RNA, 15 nt, Human
gggauucaggcugcu

SEQ ID NO: 2167118 - RNA, 15 nt, Human
gggauucccaccaag

SEQ ID NO: 2167119 - RNA, 13 nt, Human
gggauuccugacc

SEQ ID NO: 2167120 - RNA, 14 nt, Human
gggauuccugaccc

SEQ ID NO: 2167121 - RNA, 14 nt, Human
gggauucaggcugc

SEQ ID NO: 2167122 - RNA, 16 nt, Human
gggauuccugacccag

SEQ ID NO: 2167123 - RNA, 17 nt, Human
gggauuccugacccagg

SEQ ID NO: 2167124 - RNA, 19 nt, Human
gggauuccugacccaggcc

SEQ ID NO: 2167125 - RNA, 21 nt, Human
gggauuccugacccaggccgc

SEQ ID NO: 2167126 - RNA, 21 nt, Human
gggaggggcgcuggcccagcc

SEQ ID NO: 2167127 - RNA, 19 nt, Human
gggaggggcgcuggcccag

SEQ ID NO: 2167128 - RNA, 20 nt, Human
gggaggggcgcuggcccagc

SEQ ID NO: 2167129 - RNA, 14 nt, Human
gggaggggccuagg

SEQ ID NO: 2167130 - RNA, 13 nt, Human
gggaggggcccgc

SEQ ID NO: 2167131 - RNA, 16 nt, Human
gggaggggcaggcuga

SEQ ID NO: 2167132 - RNA, 17 nt, Human
gggaggggcaggcugac

SEQ ID NO: 2167133 - RNA, 10 nt, Human
gggaggggcg

SEQ ID NO: 2167134 - RNA, 18 nt, Human
gggaggggcgcccaccuc

SEQ ID NO: 2167135 - RNA, 16 nt, Human
gggaggggcgcuggcc

SEQ ID NO: 2167136 - RNA, 18 nt, Human
gggaggggcgcuggccca

SEQ ID NO: 2167137 - RNA, 15 nt, Human
gggagggcccacuuc

SEQ ID NO: 2167138 - RNA, 12 nt, Human
gggaggggcagg

SEQ ID NO: 2167139 - RNA, 13 nt, Human
gggaggggcaggc

SEQ ID NO: 2167140 - RNA, 14 nt, Human
gggaggggcaggcu

SEQ ID NO: 2167141 - RNA, 18 nt, Human
aaaagggaacugaacauu

SEQ ID NO: 2167142 - RNA, 14 nt, Human
aaaagggaagucua

SEQ ID NO: 2167143 - RNA, 19 nt, Human
aaaagggaaguugugccuu

SEQ ID NO: 2167144 - RNA, 20 nt, Human
aaaagggaaguugugccuuu

SEQ ID NO: 2167145 - RNA, 20 nt, Human
aaaaggcuagguacacagcu

SEQ ID NO: 2167146 - RNA, 16 nt, Human
aaaagggacugagaaa

SEQ ID NO: 2167147 - RNA, 19 nt, Human
gggcagcuguuagagucca

SEQ ID NO: 2167148 - RNA, 18 nt, Human
gggcagcugggcccaacc

SEQ ID NO: 2167149 - RNA, 19 nt, Human
gggcagcugggcccaaccc

SEQ ID NO: 2167150 - RNA, 18 nt, Human
gggcaggaaggagagccu

SEQ ID NO: 2167151 - RNA, 16 nt, Human
gggcaggaaggagagc

SEQ ID NO: 2167152 - RNA, 21 nt, Human
gggcaggaaggagagccugcu

SEQ ID NO: 2167153 - RNA, 19 nt, Human
gggcaggaaggagagccug

SEQ ID NO: 2167154 - RNA, 19 nt, Human
gggcagcuugccccggccc

SEQ ID NO: 2167155 - RNA, 23 nt, Human
gggcaggacucagcuccccagag

SEQ ID NO: 2167156 - RNA, 18 nt, Human
gggcaggagggcccuacc

SEQ ID NO: 2167157 - RNA, 22 nt, Human
gggcaggacucagcuccccaga

SEQ ID NO: 2167158 - RNA, 16 nt, Human
gggcagcacagagagg

SEQ ID NO: 2167159 - RNA, 12 nt, Human
gggcagcacagc

SEQ ID NO: 2167160 - RNA, 20 nt, Human
gggcagcagaaggggguggu

SEQ ID NO: 2167161 - RNA, 13 nt, Human
gggcagcacagca

SEQ ID NO: 2167162 - RNA, 14 nt, Human
gggcagcacagcaa

SEQ ID NO: 2167163 - RNA, 16 nt, Human
gggcagccaggcugcc

SEQ ID NO: 2167164 - RNA, 14 nt, Human
gggcagccaggcug

SEQ ID NO: 2167165 - RNA, 17 nt, Human
gggcagccaaacccaug

SEQ ID NO: 2167166 - RNA, 13 nt, Human
gggcagccaggcu

SEQ ID NO: 2167167 - RNA, 20 nt, Human
gggcagcauagcaagacaca

SEQ ID NO: 2167168 - RNA, 14 nt, Human
gggcagcagggcua

SEQ ID NO: 2167169 - RNA, 13 nt, Human
gggcagcugggcc

SEQ ID NO: 2167170 - RNA, 14 nt, Human
gggcagcugggccc

SEQ ID NO: 2167171 - RNA, 16 nt, Human
gggcagcugggcccaa

SEQ ID NO: 2167172 - RNA, 17 nt, Human
gggcagcugggcccaac

SEQ ID NO: 2167173 - RNA, 17 nt, Human
gguccaugggcagagcc

SEQ ID NO: 2167174 - RNA, 14 nt, Human
gguccaccccaugu

SEQ ID NO: 2167175 - RNA, 12 nt, Human
ggucccaacagg

SEQ ID NO: 2167176 - RNA, 18 nt, Human
gguccaugggcagagccc

SEQ ID NO: 2167177 - RNA, 16 nt, Human
gguccaugggcagagc

SEQ ID NO: 2167178 - RNA, 22 nt, Human
ggucccaacaggaggacaauuc

SEQ ID NO: 2167179 - RNA, 23 nt, Human
ggucccaacaggaggacaauuca

SEQ ID NO: 2167180 - RNA, 15 nt, Human
ggucccaagcugggc

SEQ ID NO: 2167181 - RNA, 20 nt, Human
gguccacccaggagccccga

SEQ ID NO: 2167182 - RNA, 22 nt, Human
gguccacccaggagccccgagg

SEQ ID NO: 2167183 - RNA, 23 nt, Human
ggucccaagcugggccccagccc

SEQ ID NO: 2167184 - RNA, 13 nt, Human
ggucccacacugg

SEQ ID NO: 2167185 - RNA, 16 nt, Human
ggucccaagcugggcc

SEQ ID NO: 2167186 - RNA, 19 nt, Human
ggucccaagcugggcccca

SEQ ID NO: 2167187 - RNA, 20 nt, Human
ggucccaagcugggccccag

SEQ ID NO: 2167188 - RNA, 21 nt, Human
ggucccaagcugggccccagc

SEQ ID NO: 2167189 - RNA, 12 nt, Human
ggucccacccca

SEQ ID NO: 2167190 - RNA, 18 nt, Human
aaacuuguuacuaaagaa

SEQ ID NO: 2167191 - RNA, 24 nt, Human
aaacuuuuuugaaauaauaaaucu

SEQ ID NO: 2167192 - RNA, 16 nt, Human
aaagaaugauuaugaa

SEQ ID NO: 2167193 - RNA, 20 nt, Human
aaacuuuacccaaaaacuaa

SEQ ID NO: 2167194 - RNA, 14 nt, Human
aaacuuuaccuuuu

SEQ ID NO: 2167195 - RNA, 13 nt, Human
aaacuuuaauaua

SEQ ID NO: 2167196 - RNA, 19 nt, Human
gguauuccuuuuguguaca

SEQ ID NO: 2167197 - RNA, 12 nt, Human
gguauuguauuu

SEQ ID NO: 2167198 - RNA, 17 nt, Human
gguauuguauuuauuca

SEQ ID NO: 2167199 - RNA, 18 nt, Human
gguauuccuuuuguguac

SEQ ID NO: 2167200 - RNA, 14 nt, Human
gguauuccugccuc

SEQ ID NO: 2167201 - RNA, 14 nt, Human
gguauuagaaagug

SEQ ID NO: 2167202 - RNA, 18 nt, Human
gguauuaugcuucuugga

SEQ ID NO: 2167203 - RNA, 20 nt, Human
gguauuacacuguauuugua

SEQ ID NO: 2167204 - RNA, 23 nt, Human
gguauuggcuagagguucaaaga

SEQ ID NO: 2167205 - RNA, 19 nt, Human
gguccacccaggagccccg

SEQ ID NO: 2167206 - RNA, 15 nt, Human
gguccaaauaaaaac

SEQ ID NO: 2167207 - RNA, 11 nt, Human
gguccaaauaa

SEQ ID NO: 2167208 - RNA, 17 nt, Human
gguccaaauaaaaacua

SEQ ID NO: 2167209 - RNA, 15 nt, Human
ggucauuuaugaaaa

SEQ ID NO: 2167210 - RNA, 20 nt, Human
ggucaugcccuccucuccca

SEQ ID NO: 2167211 - RNA, 15 nt, Human
ggucaugguggugca

SEQ ID NO: 2167212 - RNA, 15 nt, Human
ggucaugcccuccuc

SEQ ID NO: 2167213 - RNA, 17 nt, Human
ggucaugcccuccucuc

SEQ ID NO: 2167214 - RNA, 16 nt, Human
ggucaugcccuccucu

SEQ ID NO: 2167215 - RNA, 21 nt, Human
gguauggaaggguuuguggcu

SEQ ID NO: 2167216 - RNA, 14 nt, Human
gguaugugugugua

SEQ ID NO: 2167217 - RNA, 17 nt, Human
gguauaaugguugacug

SEQ ID NO: 2167218 - RNA, 16 nt, Human
gguauaaaagaugggg

SEQ ID NO: 2167219 - RNA, 18 nt, Human
gguauaaguggugugugu

SEQ ID NO: 2167220 - RNA, 18 nt, Human
gguaguugcaauugaauu

SEQ ID NO: 2167221 - RNA, 12 nt, Human
gguauaaaagau

SEQ ID NO: 2167222 - RNA, 13 nt, Human
gguauaaaagaug

SEQ ID NO: 2167223 - RNA, 21 nt, Human
gguauaaaacuuuccucgccu

SEQ ID NO: 2167224 - RNA, 22 nt, Human
gguauaaaacuuuccucgccug

SEQ ID NO: 2167225 - RNA, 19 nt, Human
gguaguuaguagcauguug

SEQ ID NO: 2167226 - RNA, 16 nt, Human
gguaguuaguagcaug

SEQ ID NO: 2167227 - RNA, 22 nt, Human
gguaguacuccugcaaaauuuu

SEQ ID NO: 2167228 - RNA, 23 nt, Human
gguaguacuccugcaaaauuuua

SEQ ID NO: 2167229 - RNA, 14 nt, Human
aaacuguauugaug

SEQ ID NO: 2167230 - RNA, 22 nt, Human
aaacuguauugaugacaguagu

SEQ ID NO: 2167231 - RNA, 16 nt, Human
aaacuguagucucagg

SEQ ID NO: 2167232 - RNA, 15 nt, Human
aaacuguagucucag

SEQ ID NO: 2167233 - RNA, 18 nt, Human
aaacuguagaaaugauga

SEQ ID NO: 2167234 - RNA, 16 nt, Human
aaacuguagaaaugau

SEQ ID NO: 2167235 - RNA, 15 nt, Human
aaacuguagaaauga

SEQ ID NO: 2167236 - RNA, 17 nt, Human
aaagaugcucuucugug

SEQ ID NO: 2167237 - RNA, 23 nt, Human
aaagauggggucuguaaaaucuu

SEQ ID NO: 2167238 - RNA, 22 nt, Human
aaagaugccggguuuuauauuu

SEQ ID NO: 2167239 - RNA, 22 nt, Human
aaagaugcaucuaccgcucuug

SEQ ID NO: 2167240 - RNA, 20 nt, Human
aaagaugcaaggaccaggac

SEQ ID NO: 2167241 - RNA, 14 nt, Human
aaagaugcaaugua

SEQ ID NO: 2167242 - RNA, 20 nt, Human
aaagaggcugaaagaggcca

SEQ ID NO: 2167243 - RNA, 21 nt, Human
aaagaugauuuaaaagggaag

SEQ ID NO: 2167244 - RNA, 22 nt, Human
aaagauuacuuuuucuuuaugu

SEQ ID NO: 2167245 - RNA, 21 nt, Human
aaagauguuugucagauauga

SEQ ID NO: 2167246 - RNA, 19 nt, Human
aaagauuacuuagaggaaa

SEQ ID NO: 2167247 - RNA, 19 nt, Human
aaagauucagguauguugc

SEQ ID NO: 2167248 - RNA, 20 nt, Human
aaagauguuugucagauaug

SEQ ID NO: 2167249 - RNA, 14 nt, Human
aaagauuuucagaa

SEQ ID NO: 2167250 - RNA, 15 nt, Human
aaagauuuucagaaa

SEQ ID NO: 2167251 - RNA, 20 nt, Human
aaagauucauuuuuaaucau

SEQ ID NO: 2167252 - RNA, 13 nt, Human
aaagauucauuuu

SEQ ID NO: 2167253 - RNA, 15 nt, Human
aaagauucauuuuua

SEQ ID NO: 2167254 - RNA, 19 nt, Human
aaagauucauuuuuaauca

SEQ ID NO: 2167255 - RNA, 18 nt, Human
aaagagagaauguagaua

SEQ ID NO: 2167256 - RNA, 22 nt, Human
aaagagagaaaacuuauuugag

SEQ ID NO: 2167257 - RNA, 22 nt, Human
aaagagagaaaauaaaaaguua

SEQ ID NO: 2167258 - RNA, 21 nt, Human
aaagagagaaaauaaaaaguu

SEQ ID NO: 2167259 - RNA, 20 nt, Human
aaagaggcagcuugaaacug

SEQ ID NO: 2167260 - RNA, 19 nt, Human
aaagagagaaaauaaaaag

SEQ ID NO: 2167261 - RNA, 18 nt, Human
aaagagagaaaauaaaaa

SEQ ID NO: 2167262 - RNA, 17 nt, Human
aaagagagaaaauaaaa

SEQ ID NO: 2167263 - RNA, 16 nt, Human
aaagagagaaaauaaa

SEQ ID NO: 2167264 - RNA, 15 nt, Human
aaagagagaaaauaa

SEQ ID NO: 2167265 - RNA, 14 nt, Human
aaagagagaaaaua

SEQ ID NO: 2167266 - RNA, 13 nt, Human
aaagagagaaaau

SEQ ID NO: 2167267 - RNA, 13 nt, Human
aaagagagaaaac

SEQ ID NO: 2167268 - RNA, 18 nt, Human
aaagagagaaaacuuauu

SEQ ID NO: 2167269 - RNA, 13 nt, Human
aaagagagaaugu

SEQ ID NO: 2167270 - RNA, 16 nt, Human
aaagaggcugaaagag

SEQ ID NO: 2167271 - RNA, 20 nt, Human
aaagaggcgucuguauauuu

SEQ ID NO: 2167272 - RNA, 18 nt, Human
aaagaggcgucuguauau

SEQ ID NO: 2167273 - RNA, 15 nt, Human
aaagaugagugagca

SEQ ID NO: 2167274 - RNA, 13 nt, Human
aaagaggcuaugu

SEQ ID NO: 2167275 - RNA, 18 nt, Human
aaagaggcuaugugagca

SEQ ID NO: 2167276 - RNA, 18 nt, Human
aaagagaaaaaaaguuug

SEQ ID NO: 2167277 - RNA, 13 nt, Human
aaagagaaaagaa

SEQ ID NO: 2167278 - RNA, 12 nt, Human
aaagagaaaaga

SEQ ID NO: 2167279 - RNA, 14 nt, Human
aaagagaaaagaaa

SEQ ID NO: 2167280 - RNA, 20 nt, Human
aaagacuuaguauauuuucu

SEQ ID NO: 2167281 - RNA, 18 nt, Human
aaagacuuaguauauuuu

SEQ ID NO: 2167282 - RNA, 19 nt, Human
aaagacuuuuccaacccuc

SEQ ID NO: 2167283 - RNA, 14 nt, Human
aaagagaaggagcc

SEQ ID NO: 2167284 - RNA, 15 nt, Human
aaagagaaguauuau

SEQ ID NO: 2167285 - RNA, 18 nt, Human
aaagagaacuuccagauc

SEQ ID NO: 2167286 - RNA, 21 nt, Human
aaagagaauugggggcuuagg

SEQ ID NO: 2167287 - RNA, 12 nt, Human
aaagagagaaaa

SEQ ID NO: 2167288 - RNA, 15 nt, Human
aaagagacuggagca

SEQ ID NO: 2167289 - RNA, 18 nt, Human
aaagagagaaaaacaaau

SEQ ID NO: 2167290 - RNA, 17 nt, Human
aaagagaccuaccucag

SEQ ID NO: 2167291 - RNA, 18 nt, Human
aaagagaccuaccucagg

SEQ ID NO: 2167292 - RNA, 20 nt, Human
aaagagaccuaccucagguu

SEQ ID NO: 2167293 - RNA, 21 nt, Human
aaagagaccuaccucagguug

SEQ ID NO: 2167294 - RNA, 15 nt, Human
aaagacuguacaaag

SEQ ID NO: 2167295 - RNA, 15 nt, Human
aaagacucaguguuc

SEQ ID NO: 2167296 - RNA, 14 nt, Human
aaagacuccaaaga

SEQ ID NO: 2167297 - RNA, 23 nt, Human
aaagacuauucaaacagucucag

SEQ ID NO: 2167298 - RNA, 13 nt, Human
aaagacuccaaag

SEQ ID NO: 2167299 - RNA, 17 nt, Human
aaagaauggaaggugga

SEQ ID NO: 2167300 - RNA, 12 nt, Human
aaagaaugggca

SEQ ID NO: 2167301 - RNA, 18 nt, Human
aaagaaugggcaguuaca

SEQ ID NO: 2167302 - RNA, 23 nt, Human
aaagaaugggcaguuacaugcau

SEQ ID NO: 2167303 - RNA, 22 nt, Human
aaagacuauucaaacagucuca

SEQ ID NO: 2167304 - RNA, 22 nt, Human
ggucugcucuuucucugccagu

SEQ ID NO: 2167305 - RNA, 22 nt, Human
ggucuggagaagcagugagccg

SEQ ID NO: 2167306 - RNA, 23 nt, Human
ggucuggagaagcucccaggaac

SEQ ID NO: 2167307 - RNA, 22 nt, Human
ggucuggcagccucccauccag

SEQ ID NO: 2167308 - RNA, 15 nt, Human
ggucuggcagccucc

SEQ ID NO: 2167309 - RNA, 21 nt, Human
aaagauuuucagaaaauauua

SEQ ID NO: 2167310 - RNA, 14 nt, Human
ggucugucccacca

SEQ ID NO: 2167311 - RNA, 14 nt, Human
ggucuguagggauu

SEQ ID NO: 2167312 - RNA, 18 nt, Human
ggucuguacguuaccucu

SEQ ID NO: 2167313 - RNA, 12 nt, Human
ggucuguaaaau

SEQ ID NO: 2167314 - RNA, 14 nt, Human
ggucuguaaaaucu

SEQ ID NO: 2167315 - RNA, 17 nt, Human
ggucugggacuuccuug

SEQ ID NO: 2167316 - RNA, 16 nt, Human
ggucugggacuuccuu

SEQ ID NO: 2167317 - RNA, 21 nt, Human
ggucugggaggaauggacaga

SEQ ID NO: 2167318 - RNA, 13 nt, Human
ggucuggcugcuu

SEQ ID NO: 2167319 - RNA, 14 nt, Human
ggucuggccucagg

SEQ ID NO: 2167320 - RNA, 15 nt, Human
ggucuggcugagcug

SEQ ID NO: 2167321 - RNA, 15 nt, Human
ggucugucccaccag

SEQ ID NO: 2167322 - RNA, 13 nt, Human
ggucuguucuuga

SEQ ID NO: 2167323 - RNA, 12 nt, Human
ggucuguucuuu

SEQ ID NO: 2167324 - RNA, 24 nt, Human
ggucugugagaugcuagaacuccc

SEQ ID NO: 2167325 - RNA, 14 nt, Human
ggucugugagaugc

SEQ ID NO: 2167326 - RNA, 21 nt, Human
ggucuugaacuccuggccuca

SEQ ID NO: 2167327 - RNA, 22 nt, Human
ggucuugaacuccuggccucaa

SEQ ID NO: 2167328 - RNA, 19 nt, Human
ggucuguucuuuccaaagu

SEQ ID NO: 2167329 - RNA, 17 nt, Human
ggucuguucuuuccaaa

SEQ ID NO: 2167330 - RNA, 20 nt, Human
ggugcacagacgucccucca

SEQ ID NO: 2167331 - RNA, 15 nt, Human
ggugauuucagagag

SEQ ID NO: 2167332 - RNA, 16 nt, Human
ggugcacagugauuuu

SEQ ID NO: 2167333 - RNA, 15 nt, Human
ggugcacagugauuu

SEQ ID NO: 2167334 - RNA, 16 nt, Human
ggugcagagcugaaga

SEQ ID NO: 2167335 - RNA, 15 nt, Human
ggugccaguuauggc

SEQ ID NO: 2167336 - RNA, 22 nt, Human
ggugauuacauaaucuguacaa

SEQ ID NO: 2167337 - RNA, 16 nt, Human
ggugaugcugggcugg

SEQ ID NO: 2167338 - RNA, 13 nt, Human
ggugaugccaggu

SEQ ID NO: 2167339 - RNA, 15 nt, Human
ggugaugcugggcug

SEQ ID NO: 2167340 - RNA, 16 nt, Human
ggugcacaagcuccaa

SEQ ID NO: 2167341 - RNA, 22 nt, Human
ggugcacaagcuccaagcuccc

SEQ ID NO: 2167342 - RNA, 16 nt, Human
ggucuuucauggggug

SEQ ID NO: 2167343 - RNA, 21 nt, Human
ggucuuucauggggugaugcu

SEQ ID NO: 2167344 - RNA, 19 nt, Human
ggucuuuccuaucauggag

SEQ ID NO: 2167345 - RNA, 19 nt, Human
ggucuuuccuaaggcugca

SEQ ID NO: 2167346 - RNA, 18 nt, Human
ggucuuuccuaaggcugc

SEQ ID NO: 2167347 - RNA, 21 nt, Human
ggucuugguuccagccugcca

SEQ ID NO: 2167348 - RNA, 20 nt, Human
ggucuugguuccagccugcc

SEQ ID NO: 2167349 - RNA, 18 nt, Human
ggucuuggagcugagccu

SEQ ID NO: 2167350 - RNA, 23 nt, Human
ggucuuggagcugagccucucac

SEQ ID NO: 2167351 - RNA, 13 nt, Human
ggucuugggaaau

SEQ ID NO: 2167352 - RNA, 20 nt, Human
ggucuugggaaauaugaaug

SEQ ID NO: 2167353 - RNA, 13 nt, Human
ggucuugaucucc

SEQ ID NO: 2167354 - RNA, 18 nt, Human
ggucuguucuugaagcag

SEQ ID NO: 2167355 - RNA, 16 nt, Human
ggucuguuggcaggcu

SEQ ID NO: 2167356 - RNA, 18 nt, Human
ggucuguuggcaggcugg

SEQ ID NO: 2167357 - RNA, 17 nt, Human
ggucuuuugacaugugg

SEQ ID NO: 2167358 - RNA, 17 nt, Human
ggucuuuuuaugcauuu

SEQ ID NO: 2167359 - RNA, 21 nt, Human
ggugauccacucgccuucauc

SEQ ID NO: 2167360 - RNA, 21 nt, Human
ggucuuuugacauguggaaag

SEQ ID NO: 2167361 - RNA, 20 nt, Human
ggucuuuucaucugggaaag

SEQ ID NO: 2167362 - RNA, 16 nt, Human
ggucuuuucaucuggg

SEQ ID NO: 2167363 - RNA, 19 nt, Human
ggucuuuguaagaguguag

SEQ ID NO: 2167364 - RNA, 19 nt, Human
ggucuuuucaucugggaaa

SEQ ID NO: 2167365 - RNA, 12 nt, Human
ggucuuuguaag

SEQ ID NO: 2167366 - RNA, 13 nt, Human
ggucuuuguaaga

SEQ ID NO: 2167367 - RNA, 14 nt, Human
ggucuuuguaagag

SEQ ID NO: 2167368 - RNA, 15 nt, Human
ggucuuuguaagagu

SEQ ID NO: 2167369 - RNA, 20 nt, Human
ggucuuuguaagaguguaga

SEQ ID NO: 2167370 - RNA, 20 nt, Human
aaagcuugaagaucguuagu

SEQ ID NO: 2167371 - RNA, 19 nt, Human
aaagcuugcaacaaaauuc

SEQ ID NO: 2167372 - RNA, 21 nt, Human
aaagcuucuaucccaggaggu

SEQ ID NO: 2167373 - RNA, 19 nt, Human
aaagcuucuaucccaggag

SEQ ID NO: 2167374 - RNA, 16 nt, Human
aaaggaaaaagcacaa

SEQ ID NO: 2167375 - RNA, 19 nt, Human
aaaggaaaaagcacaagaa

SEQ ID NO: 2167376 - RNA, 19 nt, Human
aaagcuuuuuauuccuccu

SEQ ID NO: 2167377 - RNA, 11 nt, Human
aaagcuucccc

SEQ ID NO: 2167378 - RNA, 20 nt, Human
aaagcuuccaugauucuauu

SEQ ID NO: 2167379 - RNA, 18 nt, Human
aaagcuuccaugauucua

SEQ ID NO: 2167380 - RNA, 17 nt, Human
aaagcuuccaugauucu

SEQ ID NO: 2167381 - RNA, 23 nt, Human
aaagcuaaaaugauuuuaucugu

SEQ ID NO: 2167382 - RNA, 15 nt, Human
aaagcuauggugaga

SEQ ID NO: 2167383 - RNA, 22 nt, Human
aaagcuauggugagaugcagcu

SEQ ID NO: 2167384 - RNA, 15 nt, Human
aaagcuauuagccag

SEQ ID NO: 2167385 - RNA, 17 nt, Human
aaagcuauuagccagga

SEQ ID NO: 2167386 - RNA, 18 nt, Human
aaagcuauuagccaggau

SEQ ID NO: 2167387 - RNA, 19 nt, Human
aaagcuauuagccaggauc

SEQ ID NO: 2167388 - RNA, 20 nt, Human
aaagcuauuagccaggauca

SEQ ID NO: 2167389 - RNA, 22 nt, Human
aaagcuauuagccaggaucaug

SEQ ID NO: 2167390 - RNA, 23 nt, Human
aaagcuauuagccaggaucaugg

SEQ ID NO: 2167391 - RNA, 14 nt, Human
aaaggaagucuagg

SEQ ID NO: 2167392 - RNA, 23 nt, Human
aaaggaagguucuggugugaacu

SEQ ID NO: 2167393 - RNA, 20 nt, Human
aaaggaagguucugguguga

SEQ ID NO: 2167394 - RNA, 17 nt, Human
aaaggaaucauuucuau

SEQ ID NO: 2167395 - RNA, 21 nt, Human
aaaggaauccacucccaggca

SEQ ID NO: 2167396 - RNA, 18 nt, Human
aaaggaaaauaguaaugu

SEQ ID NO: 2167397 - RNA, 11 nt, Human
aaaggaaagag

SEQ ID NO: 2167398 - RNA, 23 nt, Human
aaaggaauuggcauguguauguu

SEQ ID NO: 2167399 - RNA, 15 nt, Human
aaaggacaauuucaa

SEQ ID NO: 2167400 - RNA, 16 nt, Human
aaaggacaauuucaaa

SEQ ID NO: 2167401 - RNA, 22 nt, Human
aaaggacaccuuuuaacucacc

SEQ ID NO: 2167402 - RNA, 19 nt, Human
aaaggacagaguaugaaca

SEQ ID NO: 2167403 - RNA, 13 nt, Human
aaaggaauuuaaa

SEQ ID NO: 2167404 - RNA, 20 nt, Human
aaagcacacucauccccuca

SEQ ID NO: 2167405 - RNA, 21 nt, Human
aaagcaauuuuccuugaagcc

SEQ ID NO: 2167406 - RNA, 22 nt, Human
aaagcaauuuuccuugaagccg

SEQ ID NO: 2167407 - RNA, 23 nt, Human
aaagcaauuuuccuugaagccga

SEQ ID NO: 2167408 - RNA, 20 nt, Human
ggugcccagaaugaggcugc

SEQ ID NO: 2167409 - RNA, 23 nt, Human
ggugcccagaauaaguuauugca

SEQ ID NO: 2167410 - RNA, 14 nt, Human
ggugcccacaggcc

SEQ ID NO: 2167411 - RNA, 13 nt, Human
ggugcccacaggc

SEQ ID NO: 2167412 - RNA, 14 nt, Human
ggugcccaagccag

SEQ ID NO: 2167413 - RNA, 17 nt, Human
ggugcccaagccagagg

SEQ ID NO: 2167414 - RNA, 18 nt, Human
ggugcccaagccagaggc

SEQ ID NO: 2167415 - RNA, 22 nt, Human
ggugcccaagcucagaaggcuc

SEQ ID NO: 2167416 - RNA, 23 nt, Human
ggugcccaagccagaggcugggu

SEQ ID NO: 2167417 - RNA, 21 nt, Human
ggugcccaagccagaggcugg

SEQ ID NO: 2167418 - RNA, 22 nt, Human
ggugcccaagccagaggcuggg

SEQ ID NO: 2167419 - RNA, 16 nt, Human
aaagcacauugaaaga

SEQ ID NO: 2167420 - RNA, 16 nt, Human
aaagcacaguuugaac

SEQ ID NO: 2167421 - RNA, 17 nt, Human
aaagcacaguuugaaca

SEQ ID NO: 2167422 - RNA, 17 nt, Human
aaagcaccaaaauaaga

SEQ ID NO: 2167423 - RNA, 16 nt, Human
aaagcaccaaaauaag

SEQ ID NO: 2167424 - RNA, 13 nt, Human
aaagcacaagaag

SEQ ID NO: 2167425 - RNA, 16 nt, Human
aaagcacaagaagcgu

SEQ ID NO: 2167426 - RNA, 22 nt, Human
aaagcacaggugggcuucccag

SEQ ID NO: 2167427 - RNA, 14 nt, Human
aaagcacaguguua

SEQ ID NO: 2167428 - RNA, 20 nt, Human
aaagcacaguguuaaaugaa

SEQ ID NO: 2167429 - RNA, 21 nt, Human
aaagcacaguguuaaaugaaa

SEQ ID NO: 2167430 - RNA, 15 nt, Human
aaagcacaguuugaa

SEQ ID NO: 2167431 - RNA, 21 nt, Human
aaagcaccaaaauaagaaaag

SEQ ID NO: 2167432 - RNA, 20 nt, Human
aaagcaccaaaauaagaaaa

SEQ ID NO: 2167433 - RNA, 19 nt, Human
aaagcaccaaaauaagaaa

SEQ ID NO: 2167434 - RNA, 18 nt, Human
aaagcaccaaaauaagaa

SEQ ID NO: 2167435 - RNA, 17 nt, Human
aaagcagugcaugcugu

SEQ ID NO: 2167436 - RNA, 19 nt, Human
aaagcggacaucagcuggu

SEQ ID NO: 2167437 - RNA, 22 nt, Human
aaagcaccaaaauaagaaaaga

SEQ ID NO: 2167438 - RNA, 23 nt, Human
aaagcaccaaaauaagaaaagau

SEQ ID NO: 2167439 - RNA, 16 nt, Human
aaagcagugcaugcug

SEQ ID NO: 2167440 - RNA, 23 nt, Human
aaagcaguuaacuuuaagacuga

SEQ ID NO: 2167441 - RNA, 21 nt, Human
aaagcagugcaugcugucccu

SEQ ID NO: 2167442 - RNA, 22 nt, Human
aaagcagugcaugcugucccuu

SEQ ID NO: 2167443 - RNA, 17 nt, Human
aaagcuaggccuggcca

SEQ ID NO: 2167444 - RNA, 18 nt, Human
aaagcuaggccuggccag

SEQ ID NO: 2167445 - RNA, 18 nt, Human
aaagcuaaaguaucugua

SEQ ID NO: 2167446 - RNA, 17 nt, Human
aaagcuaaaaugauuuu

SEQ ID NO: 2167447 - RNA, 14 nt, Human
aaacauaaauaaaa

SEQ ID NO: 2167448 - RNA, 17 nt, Human
aaacauaaauaaaauga

SEQ ID NO: 2167449 - RNA, 13 nt, Human
aaacauaaauaaa

SEQ ID NO: 2167450 - RNA, 21 nt, Human
aaacacagacauucugccagg

SEQ ID NO: 2167451 - RNA, 17 nt, Human
aaacacacugaggcagg

SEQ ID NO: 2167452 - RNA, 19 nt, Human
aaacacacugaggcaggga

SEQ ID NO: 2167453 - RNA, 16 nt, Human
aaacacacugaggcag

SEQ ID NO: 2167454 - RNA, 15 nt, Human
aaacacacugaggca

SEQ ID NO: 2167455 - RNA, 23 nt, Human
aaacacaccaggcugugggccuc

SEQ ID NO: 2167456 - RNA, 18 nt, Human
aaacacaccaggcugugg

SEQ ID NO: 2167457 - RNA, 17 nt, Human
aaacacaccaggcugug

SEQ ID NO: 2167458 - RNA, 16 nt, Human
aaacacaccaggcugu

SEQ ID NO: 2167459 - RNA, 14 nt, Human
aaacacaauauuuu

SEQ ID NO: 2167460 - RNA, 13 nt, Human
aaacacaaaugca

SEQ ID NO: 2167461 - RNA, 14 nt, Human
aaacacaaaugcag

SEQ ID NO: 2167462 - RNA, 19 nt, Human
aaacacaaaugcagggauu

SEQ ID NO: 2167463 - RNA, 15 nt, Human
aaacaauaaaugugc

SEQ ID NO: 2167464 - RNA, 15 nt, Human
aaacaagugcuggca

SEQ ID NO: 2167465 - RNA, 14 nt, Human
aaacaauaaagaga

SEQ ID NO: 2167466 - RNA, 15 nt, Human
aaacaauaaagagau

SEQ ID NO: 2167467 - RNA, 14 nt, Human
aaacacaacuauau

SEQ ID NO: 2167468 - RNA, 21 nt, Human
aaacauaauucuuguauauua

SEQ ID NO: 2167469 - RNA, 20 nt, Human
aaacauaaucuucugccuuc

SEQ ID NO: 2167470 - RNA, 13 nt, Human
aaacauaauucuu

SEQ ID NO: 2167471 - RNA, 13 nt, Human
aaacauauauaac

SEQ ID NO: 2167472 - RNA, 16 nt, Human
aaacauauauaacaau

SEQ ID NO: 2167473 - RNA, 19 nt, Human
aaacauauauaacaaugcu

SEQ ID NO: 2167474 - RNA, 22 nt, Human
aaacaugcuacacacugcaugu

SEQ ID NO: 2167475 - RNA, 16 nt, Human
aaacaugcuacacacu

SEQ ID NO: 2167476 - RNA, 21 nt, Human
aaacauauauaacaaugcugu

SEQ ID NO: 2167477 - RNA, 24 nt, Human
ggggaaaaucagccugcuccagcu

SEQ ID NO: 2167478 - RNA, 13 nt, Human
ggggaaagcacag

SEQ ID NO: 2167479 - RNA, 13 nt, Human
ggggaacuccugg

SEQ ID NO: 2167480 - RNA, 21 nt, Human
ggggaacucagauccagggac

SEQ ID NO: 2167481 - RNA, 18 nt, Human
ggggaacucagauccagg

SEQ ID NO: 2167482 - RNA, 22 nt, Human
ggggaaaggcaagguccggccc

SEQ ID NO: 2167483 - RNA, 17 nt, Human
ggggaaaggcaaggucc

SEQ ID NO: 2167484 - RNA, 13 nt, Human
ggggaccucaggc

SEQ ID NO: 2167485 - RNA, 15 nt, Human
ggggaccucaggccu

SEQ ID NO: 2167486 - RNA, 16 nt, Human
ggggaccucaggccug

SEQ ID NO: 2167487 - RNA, 17 nt, Human
ggggaccucaggccugg

SEQ ID NO: 2167488 - RNA, 13 nt, Human
ggggccaggcugg

SEQ ID NO: 2167489 - RNA, 14 nt, Human
ggggccaggcuggg

SEQ ID NO: 2167490 - RNA, 16 nt, Human
ggggccaggcuggguc

SEQ ID NO: 2167491 - RNA, 17 nt, Human
ggggccaguuggucccc

SEQ ID NO: 2167492 - RNA, 19 nt, Human
ggggccaguuggucccccu

SEQ ID NO: 2167493 - RNA, 16 nt, Human
ggggcccugccuccuu

SEQ ID NO: 2167494 - RNA, 19 nt, Human
ggggcccugccuccuuugu

SEQ ID NO: 2167495 - RNA, 23 nt, Human
ggggcccugccuccuuugugagg

SEQ ID NO: 2167496 - RNA, 12 nt, Human
gggcuggcccag

SEQ ID NO: 2167497 - RNA, 13 nt, Human
gggcuggcccagc

SEQ ID NO: 2167498 - RNA, 14 nt, Human
gggcuggcccagcc

SEQ ID NO: 2167499 - RNA, 16 nt, Human
gggcuggcccagcccu

SEQ ID NO: 2167500 - RNA, 14 nt, Human
gggcuggacugagg

SEQ ID NO: 2167501 - RNA, 18 nt, Human
gggcuggaaucuggagag

SEQ ID NO: 2167502 - RNA, 21 nt, Human
gggcuggaaucuggagagcua

SEQ ID NO: 2167503 - RNA, 15 nt, Human
gggcuggacugaggc

SEQ ID NO: 2167504 - RNA, 19 nt, Human
gggcuggacugaggccuga

SEQ ID NO: 2167505 - RNA, 19 nt, Human
aaaauauuauaacuuaaaa

SEQ ID NO: 2167506 - RNA, 16 nt, Human
aaaauauuauaacuua

SEQ ID NO: 2167507 - RNA, 21 nt, Human
aaaauauuauguguuuccaua

SEQ ID NO: 2167508 - RNA, 18 nt, Human
gggcugcuuccuccugga

SEQ ID NO: 2167509 - RNA, 19 nt, Human
gggcugcuuccuccuggaa

SEQ ID NO: 2167510 - RNA, 20 nt, Human
gggcugcuuccuccuggaaa

SEQ ID NO: 2167511 - RNA, 11 nt, Human
gggcuggaaca

SEQ ID NO: 2167512 - RNA, 23 nt, Human
gggcuggaacagauucacacugu

SEQ ID NO: 2167513 - RNA, 14 nt, Human
aaaauauguucuuu

SEQ ID NO: 2167514 - RNA, 14 nt, Human
aaaauauuaugugu

SEQ ID NO: 2167515 - RNA, 15 nt, Human
aaaauauuauguguu

SEQ ID NO: 2167516 - RNA, 21 nt, Human
aaaauguaagcuguuuauuuu

SEQ ID NO: 2167517 - RNA, 22 nt, Human
aaaauggaggccauugugugag

SEQ ID NO: 2167518 - RNA, 21 nt, Human
aaaauggacguguuaugacuc

SEQ ID NO: 2167519 - RNA, 14 nt, Human
aaaauguauaugca

SEQ ID NO: 2167520 - RNA, 21 nt, Human
aaaauguaggcuuaguuugug

SEQ ID NO: 2167521 - RNA, 21 nt, Human
aaaauguaggguuauaauaau

SEQ ID NO: 2167522 - RNA, 10 nt, Human
aaaauguacu

SEQ ID NO: 2167523 - RNA, 18 nt, Human
aaaauguacugagauuuu

SEQ ID NO: 2167524 - RNA, 22 nt, Human
aaaauuuaaaggguguacuuau

SEQ ID NO: 2167525 - RNA, 12 nt, Human
aaacaaaauaga

SEQ ID NO: 2167526 - RNA, 19 nt, Human
aaaauuuuuaaucuuuaau

SEQ ID NO: 2167527 - RNA, 19 nt, Human
aaaauuuuuucucuaggaa

SEQ ID NO: 2167528 - RNA, 16 nt, Human
aaaauugugauguguc

SEQ ID NO: 2167529 - RNA, 13 nt, Human
aaaauugugauca

SEQ ID NO: 2167530 - RNA, 21 nt, Human
aaaauuguauagagauaugca

SEQ ID NO: 2167531 - RNA, 21 nt, Human
aaaauuguauguuaaguuacu

SEQ ID NO: 2167532 - RNA, 17 nt, Human
aaaauugguuggagaau

SEQ ID NO: 2167533 - RNA, 16 nt, Human
aaaauugguuggagaa

SEQ ID NO: 2167534 - RNA, 17 nt, Human
aaaauguauaugcacuu

SEQ ID NO: 2167535 - RNA, 15 nt, Human
aaaauuguaaaauug

SEQ ID NO: 2167536 - RNA, 13 nt, Human
aaaauuguauaga

SEQ ID NO: 2167537 - RNA, 15 nt, Human
aaaauuguauagaga

SEQ ID NO: 2167538 - RNA, 16 nt, Human
aaaauuguauagagau

SEQ ID NO: 2167539 - RNA, 21 nt, Human
aaaauuguuuugagcuuucca

SEQ ID NO: 2167540 - RNA, 20 nt, Human
aaaauuguuaauuuuuccua

SEQ ID NO: 2167541 - RNA, 15 nt, Human
aaaauuuuuaaucuu

SEQ ID NO: 2167542 - RNA, 16 nt, Human
aaaauuuuuaaucuuu

SEQ ID NO: 2167543 - RNA, 12 nt, Human
aaacaaagccag

SEQ ID NO: 2167544 - RNA, 20 nt, Human
aaacaaaauuuguuugaaau

SEQ ID NO: 2167545 - RNA, 11 nt, Human
aaacaaagaag

SEQ ID NO: 2167546 - RNA, 13 nt, Human
aaacaaagaaauu

SEQ ID NO: 2167547 - RNA, 14 nt, Human
aaacaaaauuucua

SEQ ID NO: 2167548 - RNA, 15 nt, Human
aaacaaaauuucuau

SEQ ID NO: 2167549 - RNA, 17 nt, Human
aaacaacucuuugagaa

SEQ ID NO: 2167550 - RNA, 19 nt, Human
aaacaacuucaauauccaa

SEQ ID NO: 2167551 - RNA, 18 nt, Human
aaacaagaccacguuucu

SEQ ID NO: 2167552 - RNA, 17 nt, Human
aaacaaggaugaauuaa

SEQ ID NO: 2167553 - RNA, 23 nt, Human
aaacauuuaacuuguuuccaaug

SEQ ID NO: 2167554 - RNA, 21 nt, Human
aaacauugguucuuguauuaa

SEQ ID NO: 2167555 - RNA, 20 nt, Human
aaacauugguucuuguauua

SEQ ID NO: 2167556 - RNA, 18 nt, Human
aaacauugguucuuguau

SEQ ID NO: 2167557 - RNA, 20 nt, Human
aaacauugaaguaaugaauu

SEQ ID NO: 2167558 - RNA, 17 nt, Human
aaacauugguucuugua

SEQ ID NO: 2167559 - RNA, 12 nt, Human
aaaccaagaaga

SEQ ID NO: 2167560 - RNA, 18 nt, Human
aaaccaaaucacugaacu

SEQ ID NO: 2167561 - RNA, 14 nt, Human
aaaccaagccgugg

SEQ ID NO: 2167562 - RNA, 21 nt, Human
aaaccaaagagggcuuccucu

SEQ ID NO: 2167563 - RNA, 15 nt, Human
aaaccaaagaagaaa

SEQ ID NO: 2167564 - RNA, 17 nt, Human
aaaccaaagagggcuuc

SEQ ID NO: 2167565 - RNA, 19 nt, Human
aaaccaaagagggcuuccu

SEQ ID NO: 2167566 - RNA, 20 nt, Human
aaaccaaagagggcuuccuc

SEQ ID NO: 2167567 - RNA, 14 nt, Human
aaaccaaagaagaa

SEQ ID NO: 2167568 - RNA, 15 nt, Human
aaaccaaaaacugaa

SEQ ID NO: 2167569 - RNA, 22 nt, Human
gggucucacuauguugcccagg

SEQ ID NO: 2167570 - RNA, 20 nt, Human
gggucgucaccaccucuccu

SEQ ID NO: 2167571 - RNA, 19 nt, Human
gggucaggaaggaugagca

SEQ ID NO: 2167572 - RNA, 14 nt, Human
gggucuagggagag

SEQ ID NO: 2167573 - RNA, 12 nt, Human
gggucucacucu

SEQ ID NO: 2167574 - RNA, 23 nt, Human
gggucucacuauguugcccaggc

SEQ ID NO: 2167575 - RNA, 12 nt, Human
aaacauguuucc

SEQ ID NO: 2167576 - RNA, 19 nt, Human
aaacauguuucuuuguaau

SEQ ID NO: 2167577 - RNA, 22 nt, Human
aaacauguuucuuuguaaugaa

SEQ ID NO: 2167578 - RNA, 23 nt, Human
aaacauguuucuuuguaaugaaa

SEQ ID NO: 2167579 - RNA, 21 nt, Human
ggggcgaucgcggcggagcug

SEQ ID NO: 2167580 - RNA, 13 nt, Human
ggggcgaggcaga

SEQ ID NO: 2167581 - RNA, 14 nt, Human
ggggcgcccaccuc

SEQ ID NO: 2167582 - RNA, 22 nt, Human
ggggcgccgcaaaccacacugg

SEQ ID NO: 2167583 - RNA, 22 nt, Human
gggguccuucaaguuagcucag

SEQ ID NO: 2167584 - RNA, 19 nt, Human
ggggcgcccaccuccccac

SEQ ID NO: 2167585 - RNA, 20 nt, Human
ggggucucccucuccugccu

SEQ ID NO: 2167586 - RNA, 19 nt, Human
ggggucucccucuccugcc

SEQ ID NO: 2167587 - RNA, 15 nt, Human
ggggucuccaggagg

SEQ ID NO: 2167588 - RNA, 22 nt, Human
ggggucucccucuccugccuac

SEQ ID NO: 2167589 - RNA, 21 nt, Human
ggggucuggaguugaucugga

SEQ ID NO: 2167590 - RNA, 20 nt, Human
ggggucuggaguugaucugg

SEQ ID NO: 2167591 - RNA, 23 nt, Human
ggggucugggaggaauggacaga

SEQ ID NO: 2167592 - RNA, 21 nt, Human
ggggcccugguccuuccaggc

SEQ ID NO: 2167593 - RNA, 12 nt, Human
ggggcccugguc

SEQ ID NO: 2167594 - RNA, 21 nt, Human
ggggccuugcgguauccgccc

SEQ ID NO: 2167595 - RNA, 17 nt, Human
ggggcgaggcagaggac

SEQ ID NO: 2167596 - RNA, 19 nt, Human
gggucagacgccugaggaa

SEQ ID NO: 2167597 - RNA, 13 nt, Human
ggguauauucauu

SEQ ID NO: 2167598 - RNA, 23 nt, Human
ggguauaaaacuuuccucgccug

SEQ ID NO: 2167599 - RNA, 19 nt, Human
gggucagccagggccaggg

SEQ ID NO: 2167600 - RNA, 13 nt, Human
gggucaggaagga

SEQ ID NO: 2167601 - RNA, 12 nt, Human
gggucagccagg

SEQ ID NO: 2167602 - RNA, 13 nt, Human
gggucagccaggg

SEQ ID NO: 2167603 - RNA, 17 nt, Human
gggucagccagggccag

SEQ ID NO: 2167604 - RNA, 15 nt, Human
gggucaggccacggc

SEQ ID NO: 2167605 - RNA, 14 nt, Human
gggucaggagaggg

SEQ ID NO: 2167606 - RNA, 17 nt, Human
gggucaggccacggcag

SEQ ID NO: 2167607 - RNA, 21 nt, Human
gggucaggccacggcagccua

SEQ ID NO: 2167608 - RNA, 18 nt, Human
ggguaggaggaugggcuc

SEQ ID NO: 2167609 - RNA, 12 nt, Human
ggguaggcggga

SEQ ID NO: 2167610 - RNA, 23 nt, Human
ggguagcuguaaggcaugaagga

SEQ ID NO: 2167611 - RNA, 15 nt, Human
ggggucuguaaaauc

SEQ ID NO: 2167612 - RNA, 23 nt, Human
ggggucuguguguuuaugugugu

SEQ ID NO: 2167613 - RNA, 16 nt, Human
ggguaggcgggaagga

SEQ ID NO: 2167614 - RNA, 20 nt, Human
ggguaucaggugcugccauc

SEQ ID NO: 2167615 - RNA, 12 nt, Human
aaacgcugccug

SEQ ID NO: 2167616 - RNA, 16 nt, Human
aaacgcugccugccca

SEQ ID NO: 2167617 - RNA, 14 nt, Human
aaacgcugccugcc

SEQ ID NO: 2167618 - RNA, 23 nt, Human
aaacggauuagggcauuugagaa

SEQ ID NO: 2167619 - RNA, 12 nt, Human
aaacggauuauu

SEQ ID NO: 2167620 - RNA, 14 nt, Human
aaacggauuauuuu

SEQ ID NO: 2167621 - RNA, 16 nt, Human
aaacggauuauuuuuu

SEQ ID NO: 2167622 - RNA, 18 nt, Human
aaacggauuauuuuuuca

SEQ ID NO: 2167623 - RNA, 20 nt, Human
aaacggauuauuuuuucaga

SEQ ID NO: 2167624 - RNA, 23 nt, Human
aaacggccucacuaggcuucugg

SEQ ID NO: 2167625 - RNA, 21 nt, Human
aaacggauuauuuuuucagac

SEQ ID NO: 2167626 - RNA, 22 nt, Human
aaacggauuauuuuuucagacc

SEQ ID NO: 2167627 - RNA, 23 nt, Human
aaacggauuauuuuuucagaccg

SEQ ID NO: 2167628 - RNA, 13 nt, Human
aaacggcccucuu

SEQ ID NO: 2167629 - RNA, 17 nt, Human
aaaccacagcccuguca

SEQ ID NO: 2167630 - RNA, 16 nt, Human
aaaccacagcccuguc

SEQ ID NO: 2167631 - RNA, 15 nt, Human
aaaccacagcccugu

SEQ ID NO: 2167632 - RNA, 15 nt, Human
aaaccaagcaaagga

SEQ ID NO: 2167633 - RNA, 18 nt, Human
aaaccacagcccugucag

SEQ ID NO: 2167634 - RNA, 14 nt, Human
aaaccacagcugcu

SEQ ID NO: 2167635 - RNA, 14 nt, Human
aaaccaccagaagc

SEQ ID NO: 2167636 - RNA, 21 nt, Human
aaaccacauuggagauguuua

SEQ ID NO: 2167637 - RNA, 15 nt, Human
aaaccacagcaguug

SEQ ID NO: 2167638 - RNA, 16 nt, Human
aaaccacagcaguuga

SEQ ID NO: 2167639 - RNA, 22 nt, Human
aaacuacacaucccuaaugugu

SEQ ID NO: 2167640 - RNA, 20 nt, Human
aaacuaccuaacauuauuua

SEQ ID NO: 2167641 - RNA, 18 nt, Human
aaacuaaggcccucuuga

SEQ ID NO: 2167642 - RNA, 15 nt, Human
aaacuaacagauaag

SEQ ID NO: 2167643 - RNA, 20 nt, Human
aaacuaaauuguaaacuccu

SEQ ID NO: 2167644 - RNA, 20 nt, Human
aaacuaacagauaagcaaga

SEQ ID NO: 2167645 - RNA, 16 nt, Human
aaacuaauauuuuaug

SEQ ID NO: 2167646 - RNA, 11 nt, Human
aaacuaaucca

SEQ ID NO: 2167647 - RNA, 18 nt, Human
aaacgucuuauuguggua

SEQ ID NO: 2167648 - RNA, 13 nt, Human
aaacuaaauugua

SEQ ID NO: 2167649 - RNA, 15 nt, Human
aaacuaaauuguaaa

SEQ ID NO: 2167650 - RNA, 20 nt, Human
aaacguggcugcuucaagga

SEQ ID NO: 2167651 - RNA, 17 nt, Human
aaacguggcugcuucaa

SEQ ID NO: 2167652 - RNA, 12 nt, Human
aaacgugaaaau

SEQ ID NO: 2167653 - RNA, 16 nt, Human
aaacguggcugcuuca

SEQ ID NO: 2167654 - RNA, 11 nt, Human
aaacuccugac

SEQ ID NO: 2167655 - RNA, 14 nt, Human
aaacuccugccccu

SEQ ID NO: 2167656 - RNA, 22 nt, Human
aaacuccugccccuguucucuu

SEQ ID NO: 2167657 - RNA, 11 nt, Human
aaacugccccc

SEQ ID NO: 2167658 - RNA, 12 nt, Human
aaacugcccccu

SEQ ID NO: 2167659 - RNA, 19 nt, Human
aaacuccgucuuagaagug

SEQ ID NO: 2167660 - RNA, 23 nt, Human
aaacucccacuugucaugugaca

SEQ ID NO: 2167661 - RNA, 16 nt, Human
aaacuccacaucugcc

SEQ ID NO: 2167662 - RNA, 23 nt, Human
aaacuagcucgugauuggcauau

SEQ ID NO: 2167663 - RNA, 19 nt, Human
aaacuccacaucugccuua

SEQ ID NO: 2167664 - RNA, 17 nt, Human
aaacuccacaucugccu

SEQ ID NO: 2167665 - RNA, 18 nt, Human
aaacuccacaucugccuu

SEQ ID NO: 2167666 - RNA, 14 nt, Human
aaacuagcauaucu

SEQ ID NO: 2167667 - RNA, 15 nt, Human
aaacuagcucgugau

SEQ ID NO: 2167668 - RNA, 19 nt, Human
aaacuagcauaucugccuu

SEQ ID NO: 2167669 - RNA, 20 nt, Human
aaacuagcauaucugccuuu

SEQ ID NO: 2167670 - RNA, 21 nt, Human
aaacuagcauaucugccuuua

SEQ ID NO: 2167671 - RNA, 22 nt, Human
aaacuagcauaucugccuuuau

SEQ ID NO: 2167672 - RNA, 22 nt, Human
aaacugguuuguugcagccaaa

SEQ ID NO: 2167673 - RNA, 22 nt, Human
aaacugguauuuuaucuuugau

SEQ ID NO: 2167674 - RNA, 16 nt, Human
aaacuggggccucccu

SEQ ID NO: 2167675 - RNA, 16 nt, Human
aaacugguauuuuauc

SEQ ID NO: 2167676 - RNA, 16 nt, Human
aaacuggguuccugca

SEQ ID NO: 2167677 - RNA, 20 nt, Human
aaacuggggccuccagaacu

SEQ ID NO: 2167678 - RNA, 15 nt, Human
aaacuggguuccugc

SEQ ID NO: 2167679 - RNA, 20 nt, Human
aaacuggcaaacuucagacu

SEQ ID NO: 2167680 - RNA, 13 nt, Human
aaacuggcuuugg

SEQ ID NO: 2167681 - RNA, 14 nt, Human
aaacuggcuuuggc

SEQ ID NO: 2167682 - RNA, 18 nt, Human
aaacuggggccuccagaa

SEQ ID NO: 2167683 - RNA, 17 nt, Human
aaacuggggccuccaga

SEQ ID NO: 2167684 - RNA, 20 nt, Human
aaacugcccccucugcccug

SEQ ID NO: 2167685 - RNA, 19 nt, Human
aaacugcccccucugcccu

SEQ ID NO: 2167686 - RNA, 17 nt, Human
aaacugcccccucugcc

SEQ ID NO: 2167687 - RNA, 13 nt, Human
aaacugcccccuc

SEQ ID NO: 2167688 - RNA, 16 nt, Human
aaacuggauuaaacuu

SEQ ID NO: 2167689 - RNA, 14 nt, Human
gacuuucagguacu

SEQ ID NO: 2167690 - RNA, 12 nt, Human
gacuuucaggua

SEQ ID NO: 2167691 - RNA, 19 nt, Human
gacuuuauuuucugguaga

SEQ ID NO: 2167692 - RNA, 17 nt, Human
gacuuuagucugcaaaa

SEQ ID NO: 2167693 - RNA, 21 nt, Human
gacuuuaucuaauaccucugu

SEQ ID NO: 2167694 - RNA, 22 nt, Human
gacuuuaucuaauaccucugug

SEQ ID NO: 2167695 - RNA, 13 nt, Human
gacuuuagggacu

SEQ ID NO: 2167696 - RNA, 23 nt, Human
gacuguucaagagcacacuuggc

SEQ ID NO: 2167697 - RNA, 18 nt, Human
gacuuguuuuugcacaug

SEQ ID NO: 2167698 - RNA, 22 nt, Human
gacuguguguugccacaggaca

SEQ ID NO: 2167699 - RNA, 21 nt, Human
gacuguguguugccacaggac

SEQ ID NO: 2167700 - RNA, 21 nt, Human
gacuguugggguggguauaaa

SEQ ID NO: 2167701 - RNA, 14 nt, Human
gacuguuccugucu

SEQ ID NO: 2167702 - RNA, 22 nt, Human
gacuguuagaaaauggacacug

SEQ ID NO: 2167703 - RNA, 14 nt, Human
gacuguucaagagc

SEQ ID NO: 2167704 - RNA, 18 nt, Human
gacuguucaagagcacac

SEQ ID NO: 2167705 - RNA, 19 nt, Human
gacuguucaagagcacacu

SEQ ID NO: 2167706 - RNA, 15 nt, Human
gacuguggcugcuag

SEQ ID NO: 2167707 - RNA, 14 nt, Human
gacuguggcugcua

SEQ ID NO: 2167708 - RNA, 12 nt, Human
gacuguggcugc

SEQ ID NO: 2167709 - RNA, 13 nt, Human
gacugugaugcca

SEQ ID NO: 2167710 - RNA, 20 nt, Human
gacugugacaggcagcagag

SEQ ID NO: 2167711 - RNA, 19 nt, Human
gacugugaugccacacaga

SEQ ID NO: 2167712 - RNA, 22 nt, Human
gacugugugcucaggagcccug

SEQ ID NO: 2167713 - RNA, 11 nt, Human
gacuguagaaa

SEQ ID NO: 2167714 - RNA, 18 nt, Human
gacugaauuguccccagu

SEQ ID NO: 2167715 - RNA, 13 nt, Human
gacuguagggagg

SEQ ID NO: 2167716 - RNA, 22 nt, Human
gacuguagggagggcggcaggg

SEQ ID NO: 2167717 - RNA, 23 nt, Human
gacuguagggagggcggcagggg

SEQ ID NO: 2167718 - RNA, 14 nt, Human
gacuguauauaaag

SEQ ID NO: 2167719 - RNA, 19 nt, Human
gacuguauauaaaggaaaa

SEQ ID NO: 2167720 - RNA, 15 nt, Human
gacuguauuugugac

SEQ ID NO: 2167721 - RNA, 14 nt, Human
gacuguauuuguga

SEQ ID NO: 2167722 - RNA, 13 nt, Human
gacugucuuucag

SEQ ID NO: 2167723 - RNA, 16 nt, Human
gacuguauuugugacu

SEQ ID NO: 2167724 - RNA, 17 nt, Human
gacugugacaggcagca

SEQ ID NO: 2167725 - RNA, 18 nt, Human
gacugugacaggcagcag

SEQ ID NO: 2167726 - RNA, 19 nt, Human
gacugugacaggcagcaga

SEQ ID NO: 2167727 - RNA, 18 nt, Human
gacugaagaugcagcuca

SEQ ID NO: 2167728 - RNA, 16 nt, Human
gacugaagccugcagg

SEQ ID NO: 2167729 - RNA, 14 nt, Human
gacugaauuucuuu

SEQ ID NO: 2167730 - RNA, 18 nt, Human
gacuguacuccucccagg

SEQ ID NO: 2167731 - RNA, 23 nt, Human
gacuguacuccucccaggcgccc

SEQ ID NO: 2167732 - RNA, 22 nt, Human
gacucaccucccccaucucuuc

SEQ ID NO: 2167733 - RNA, 15 nt, Human
gacucaccuccccca

SEQ ID NO: 2167734 - RNA, 23 nt, Human
gacucacuuaucccaagagaaug

SEQ ID NO: 2167735 - RNA, 18 nt, Human
gacucaccucugccucaa

SEQ ID NO: 2167736 - RNA, 17 nt, Human
gacucaccuguuacuug

SEQ ID NO: 2167737 - RNA, 17 nt, Human
gacucaccucugccuca

SEQ ID NO: 2167738 - RNA, 15 nt, Human
gacucaccucugccu

SEQ ID NO: 2167739 - RNA, 14 nt, Human
gacucaccucugcc

SEQ ID NO: 2167740 - RNA, 13 nt, Human
gacucaccucugc

SEQ ID NO: 2167741 - RNA, 12 nt, Human
gacucaccucug

SEQ ID NO: 2167742 - RNA, 12 nt, Human
gacucacccaag

SEQ ID NO: 2167743 - RNA, 12 nt, Human
gacucugccucc

SEQ ID NO: 2167744 - RNA, 16 nt, Human
gacucugccuccucuu

SEQ ID NO: 2167745 - RNA, 10 nt, Human
gacucugccc

SEQ ID NO: 2167746 - RNA, 12 nt, Human
gacucugccccc

SEQ ID NO: 2167747 - RNA, 13 nt, Human
gacucugcccccu

SEQ ID NO: 2167748 - RNA, 14 nt, Human
gacucugcccccug

SEQ ID NO: 2167749 - RNA, 15 nt, Human
gacucugcccccugc

SEQ ID NO: 2167750 - RNA, 16 nt, Human
gacucugcccccugcu

SEQ ID NO: 2167751 - RNA, 17 nt, Human
gacucugcccccugcug

SEQ ID NO: 2167752 - RNA, 18 nt, Human
gacucugcccccugcugg

SEQ ID NO: 2167753 - RNA, 20 nt, Human
gacucugcacaugucuugua

SEQ ID NO: 2167754 - RNA, 17 nt, Human
gacucagaagccucugg

SEQ ID NO: 2167755 - RNA, 16 nt, Human
gacucagaagccucug

SEQ ID NO: 2167756 - RNA, 15 nt, Human
gacucagaagccucu

SEQ ID NO: 2167757 - RNA, 13 nt, Human
gacucagaagccu

SEQ ID NO: 2167758 - RNA, 19 nt, Human
gacucugucucaaaaaaac

SEQ ID NO: 2167759 - RNA, 22 nt, Human
gacucugcccccugcuggcucu

SEQ ID NO: 2167760 - RNA, 19 nt, Human
gacucugcccccugcuggc

SEQ ID NO: 2167761 - RNA, 21 nt, Human
gacucugcccccugcuggcuc

SEQ ID NO: 2167762 - RNA, 14 nt, Human
gacucuuaagaaga

SEQ ID NO: 2167763 - RNA, 15 nt, Human
gacucuuaagaagac

SEQ ID NO: 2167764 - RNA, 18 nt, Human
gacucuguggggccuugg

SEQ ID NO: 2167765 - RNA, 17 nt, Human
gacucuguggggccuug

SEQ ID NO: 2167766 - RNA, 15 nt, Human
gacucuuacuuuuua

SEQ ID NO: 2167767 - RNA, 21 nt, Human
gacucuuaagaagacugcauu

SEQ ID NO: 2167768 - RNA, 9 nt, Human
gacucuugu

SEQ ID NO: 2167769 - RNA, 15 nt, Human
gacucuugcucuuuc

SEQ ID NO: 2167770 - RNA, 16 nt, Human
gacucuugcucuuucu

SEQ ID NO: 2167771 - RNA, 14 nt, Human
gacucuuguuuuca

SEQ ID NO: 2167772 - RNA, 12 nt, Human
gacucuugcucu

SEQ ID NO: 2167773 - RNA, 17 nt, Human
gacucuucugagcaccu

SEQ ID NO: 2167774 - RNA, 16 nt, Human
gaccucguccuccccc

SEQ ID NO: 2167775 - RNA, 15 nt, Human
gaccucguccucccc

SEQ ID NO: 2167776 - RNA, 21 nt, Human
gaccucguccucccccugcca

SEQ ID NO: 2167777 - RNA, 19 nt, Human
gaccucguccucccccugc

SEQ ID NO: 2167778 - RNA, 18 nt, Human
gaccucguccucccccug

SEQ ID NO: 2167779 - RNA, 17 nt, Human
gaccucguccucccccu

SEQ ID NO: 2167780 - RNA, 23 nt, Human
gaccauccacucuacccucccac

SEQ ID NO: 2167781 - RNA, 21 nt, Human
gaccauccacucuacccuccc

SEQ ID NO: 2167782 - RNA, 13 nt, Human
gaccauccuauuu

SEQ ID NO: 2167783 - RNA, 20 nt, Human
gaccaucccugaaggccccg

SEQ ID NO: 2167784 - RNA, 14 nt, Human
gaccucucccaggg

SEQ ID NO: 2167785 - RNA, 22 nt, Human
gaccucuccccuggaacugucu

SEQ ID NO: 2167786 - RNA, 12 nt, Human
gaccucucccag

SEQ ID NO: 2167787 - RNA, 22 nt, Human
gaccucguccucccccugccag

SEQ ID NO: 2167788 - RNA, 14 nt, Human
gaccucugcagcaa

SEQ ID NO: 2167789 - RNA, 16 nt, Human
gaccucugcucugagg

SEQ ID NO: 2167790 - RNA, 15 nt, Human
gaccucugcucugag

SEQ ID NO: 2167791 - RNA, 16 nt, Human
gaccucuguuguccuc

SEQ ID NO: 2167792 - RNA, 19 nt, Human
gaccucuccaucuucagcu

SEQ ID NO: 2167793 - RNA, 14 nt, Human
gaccugaggaagcg

SEQ ID NO: 2167794 - RNA, 13 nt, Human
gaccugaggaagc

SEQ ID NO: 2167795 - RNA, 22 nt, Human
gaccugagcuccccaccacccc

SEQ ID NO: 2167796 - RNA, 18 nt, Human
gaccugagcuccccacca

SEQ ID NO: 2167797 - RNA, 16 nt, Human
gaccugagcuccccac

SEQ ID NO: 2167798 - RNA, 15 nt, Human
gaccugacuauugaa

SEQ ID NO: 2167799 - RNA, 22 nt, Human
gaccugaaguucaccauuaaaa

SEQ ID NO: 2167800 - RNA, 13 nt, Human
gaccugaaguuca

SEQ ID NO: 2167801 - RNA, 16 nt, Human
gaccugaagagugguc

SEQ ID NO: 2167802 - RNA, 12 nt, Human
gaccugaagaau

SEQ ID NO: 2167803 - RNA, 12 nt, Human
gaccucuguugu

SEQ ID NO: 2167804 - RNA, 14 nt, Human
gaccucuguugucc

SEQ ID NO: 2167805 - RNA, 11 nt, Human
gaccugaggcc

SEQ ID NO: 2167806 - RNA, 13 nt, Human
gaccugaggcccu

SEQ ID NO: 2167807 - RNA, 14 nt, Human
gaccugaggcccuu

SEQ ID NO: 2167808 - RNA, 16 nt, Human
gacgccaucccagccc

SEQ ID NO: 2167809 - RNA, 15 nt, Human
gacgcgucuccuguu

SEQ ID NO: 2167810 - RNA, 17 nt, Human
gacgcucucuggccuuc

SEQ ID NO: 2167811 - RNA, 16 nt, Human
gacgcucucuggccuu

SEQ ID NO: 2167812 - RNA, 19 nt, Human
gacgccugggggugccagg

SEQ ID NO: 2167813 - RNA, 12 nt, Human
gacgccuggggg

SEQ ID NO: 2167814 - RNA, 14 nt, Human
gacgcgucuccugu

SEQ ID NO: 2167815 - RNA, 21 nt, Human
gacgccugggggugccaggac

SEQ ID NO: 2167816 - RNA, 17 nt, Human
gacgccaucccagcccc

SEQ ID NO: 2167817 - RNA, 18 nt, Human
gacgccaucccagcccca

SEQ ID NO: 2167818 - RNA, 16 nt, Human
gacgcuacccgggaag

SEQ ID NO: 2167819 - RNA, 18 nt, Human
gacgcuacccgggaaggg

SEQ ID NO: 2167820 - RNA, 19 nt, Human
gacgcuacccgggaagggg

SEQ ID NO: 2167821 - RNA, 15 nt, Human
gacgcucucuggccu

SEQ ID NO: 2167822 - RNA, 17 nt, Human
gacacaggaugaaggca

SEQ ID NO: 2167823 - RNA, 20 nt, Human
gacacaggaugaaggcaaug

SEQ ID NO: 2167824 - RNA, 17 nt, Human
gacacagcucuucucca

SEQ ID NO: 2167825 - RNA, 22 nt, Human
gacacagcucuucuccaggcug

SEQ ID NO: 2167826 - RNA, 23 nt, Human
gacacagcucuucuccaggcugu

SEQ ID NO: 2167827 - RNA, 12 nt, Human
gacacaggcccg

SEQ ID NO: 2167828 - RNA, 23 nt, Human
gacacagcuuuaucaccagagag

SEQ ID NO: 2167829 - RNA, 22 nt, Human
gacacagcuuuaucaccagaga

SEQ ID NO: 2167830 - RNA, 14 nt, Human
gacacagcucuucu

SEQ ID NO: 2167831 - RNA, 16 nt, Human
gacacagcucuucucc

SEQ ID NO: 2167832 - RNA, 13 nt, Human
gacacagcucuuc

SEQ ID NO: 2167833 - RNA, 18 nt, Human
gacacagaaaauguugag

SEQ ID NO: 2167834 - RNA, 16 nt, Human
gacacagaaaauguug

SEQ ID NO: 2167835 - RNA, 11 nt, Human
gacacagaaaa

SEQ ID NO: 2167836 - RNA, 15 nt, Human
gacacacugaagaag

SEQ ID NO: 2167837 - RNA, 16 nt, Human
gacacacugaagaagc

SEQ ID NO: 2167838 - RNA, 13 nt, Human
gacagaacacugu

SEQ ID NO: 2167839 - RNA, 14 nt, Human
gacagaacacuguc

SEQ ID NO: 2167840 - RNA, 15 nt, Human
gacagaacacugucu

SEQ ID NO: 2167841 - RNA, 21 nt, Human
gacagaaagcagaacagugau

SEQ ID NO: 2167842 - RNA, 17 nt, Human
gacagcccgggcucugc

SEQ ID NO: 2167843 - RNA, 15 nt, Human
gacagaagcagcucu

SEQ ID NO: 2167844 - RNA, 20 nt, Human
gacagaaccccuacaugaaa

SEQ ID NO: 2167845 - RNA, 13 nt, Human
gacauucaugccu

SEQ ID NO: 2167846 - RNA, 21 nt, Human
gacauucaccugccccaacuc

SEQ ID NO: 2167847 - RNA, 16 nt, Human
gacauuccaagacagu

SEQ ID NO: 2167848 - RNA, 22 nt, Human
gacagugccugggaauguauua

SEQ ID NO: 2167849 - RNA, 21 nt, Human
gacagugccugggaauguauu

SEQ ID NO: 2167850 - RNA, 17 nt, Human
gacagugccugggaaug

SEQ ID NO: 2167851 - RNA, 16 nt, Human
gacagugaucuccaua

SEQ ID NO: 2167852 - RNA, 16 nt, Human
gacagugcuucagccu

SEQ ID NO: 2167853 - RNA, 18 nt, Human
gacauucaccugccccaa

SEQ ID NO: 2167854 - RNA, 13 nt, Human
gacagugccuggg

SEQ ID NO: 2167855 - RNA, 21 nt, Human
gacagugaucuccauauguua

SEQ ID NO: 2167856 - RNA, 15 nt, Human
gacagugaucuccau

SEQ ID NO: 2167857 - RNA, 21 nt, Human
gacagugagacucugucucag

SEQ ID NO: 2167858 - RNA, 13 nt, Human
gacagaagaaggc

SEQ ID NO: 2167859 - RNA, 20 nt, Human
gacagcccgggcucugccuc

SEQ ID NO: 2167860 - RNA, 16 nt, Human
gacagaagcagcucuu

SEQ ID NO: 2167861 - RNA, 18 nt, Human
gacagcccgggcucugcc

SEQ ID NO: 2167862 - RNA, 19 nt, Human
gacagcccgggcucugccu

SEQ ID NO: 2167863 - RNA, 17 nt, Human
gacauuguuggcagcau

SEQ ID NO: 2167864 - RNA, 15 nt, Human
gacauugucaauaaa

SEQ ID NO: 2167865 - RNA, 18 nt, Human
gacauuguggcacauucu

SEQ ID NO: 2167866 - RNA, 14 nt, Human
gacauugucaauaa

SEQ ID NO: 2167867 - RNA, 13 nt, Human
gacauugucaaua

SEQ ID NO: 2167868 - RNA, 17 nt, Human
gacauugucagcaaauu

SEQ ID NO: 2167869 - RNA, 19 nt, Human
gacauuguagagcuucugg

SEQ ID NO: 2167870 - RNA, 12 nt, Human
gacauugucaau

SEQ ID NO: 2167871 - RNA, 14 nt, Human
gacauugcggacag

SEQ ID NO: 2167872 - RNA, 15 nt, Human
gacauugcggacagc

SEQ ID NO: 2167873 - RNA, 14 nt, Human
gacauucugccagg

SEQ ID NO: 2167874 - RNA, 22 nt, Human
gacauucugccaggcccccaag

SEQ ID NO: 2167875 - RNA, 11 nt, Human
gacauucuguc

SEQ ID NO: 2167876 - RNA, 17 nt, Human
gacauucugccaggccc

SEQ ID NO: 2167877 - RNA, 23 nt, Human
gacauucugucgccuuagcaugu

SEQ ID NO: 2167878 - RNA, 17 nt, Human
gacagugcuucagccug

SEQ ID NO: 2167879 - RNA, 16 nt, Human
gacauucaugccuggc

SEQ ID NO: 2167880 - RNA, 18 nt, Human
gacauucaugccuggcuu

SEQ ID NO: 2167881 - RNA, 20 nt, Human
gacauuccuaaacuaucuuu

SEQ ID NO: 2167882 - RNA, 22 nt, Human
gacauuccuaaacuaucuuuuu

SEQ ID NO: 2167883 - RNA, 16 nt, Human
gacauuccugggcaca

SEQ ID NO: 2167884 - RNA, 17 nt, Human
gacauuccugggcacag

SEQ ID NO: 2167885 - RNA, 23 nt, Human
gacauuccugggcacaguuuggu

SEQ ID NO: 2167886 - RNA, 22 nt, Human
gacauuguuuugccaacauugc

SEQ ID NO: 2167887 - RNA, 22 nt, Human
gacauuguuggcagcauaaagg

SEQ ID NO: 2167888 - RNA, 13 nt, Human
gacauuguuuugc

SEQ ID NO: 2167889 - RNA, 14 nt, Human
gacauuguuuugcc

SEQ ID NO: 2167890 - RNA, 20 nt, Human
gacauuguuuugccaacauu

SEQ ID NO: 2167891 - RNA, 19 nt, Human
gacauuguuggccaaagcc

SEQ ID NO: 2167892 - RNA, 11 nt, Human
gacauuuccca

SEQ ID NO: 2167893 - RNA, 21 nt, Human
gacauuguuuugccaacauug

SEQ ID NO: 2167894 - RNA, 18 nt, Human
gacauuuauacucuuuuu

SEQ ID NO: 2167895 - RNA, 16 nt, Human
gacauuucucuaagag

SEQ ID NO: 2167896 - RNA, 13 nt, Human
gacauuucucuaa

SEQ ID NO: 2167897 - RNA, 16 nt, Human
gacauuucuuugugcu

SEQ ID NO: 2167898 - RNA, 19 nt, Human
gacauuucucuuacugcaa

SEQ ID NO: 2167899 - RNA, 20 nt, Human
gacauuucucuuacugcaaa

SEQ ID NO: 2167900 - RNA, 21 nt, Human
gacauuucucuuacugcaaau

SEQ ID NO: 2167901 - RNA, 15 nt, Human
gacauuugccuugcu

SEQ ID NO: 2167902 - RNA, 16 nt, Human
gacauuugcucaugga

SEQ ID NO: 2167903 - RNA, 17 nt, Human
gacauuugcucauggaa

SEQ ID NO: 2167904 - RNA, 22 nt, Human
gaccagccuggccaacauggua

SEQ ID NO: 2167905 - RNA, 17 nt, Human
gaccagccugggcagca

SEQ ID NO: 2167906 - RNA, 12 nt, Human
gaccagccuggg

SEQ ID NO: 2167907 - RNA, 12 nt, Human
gaccagcucagg

SEQ ID NO: 2167908 - RNA, 23 nt, Human
gaccagccuguuggacccgcucu

SEQ ID NO: 2167909 - RNA, 23 nt, Human
gaccagcuggggcguggggaggg

SEQ ID NO: 2167910 - RNA, 11 nt, Human
gaccagcuggg

SEQ ID NO: 2167911 - RNA, 12 nt, Human
gaccagcugggg

SEQ ID NO: 2167912 - RNA, 13 nt, Human
gaccagcuggggc

SEQ ID NO: 2167913 - RNA, 18 nt, Human
gaccagggauuuccauga

SEQ ID NO: 2167914 - RNA, 22 nt, Human
gaccagcucaggacagaugcca

SEQ ID NO: 2167915 - RNA, 14 nt, Human
gaccagcucaggac

SEQ ID NO: 2167916 - RNA, 13 nt, Human
gaccagcucagga

SEQ ID NO: 2167917 - RNA, 19 nt, Human
gaccauccacucuacccuc

SEQ ID NO: 2167918 - RNA, 15 nt, Human
gaccauaauguuaca

SEQ ID NO: 2167919 - RNA, 13 nt, Human
gaccauacuaauu

SEQ ID NO: 2167920 - RNA, 20 nt, Human
gaccauaauguuacauuauu

SEQ ID NO: 2167921 - RNA, 16 nt, Human
gaccagggcagggcca

SEQ ID NO: 2167922 - RNA, 15 nt, Human
gaccagggcagggcc

SEQ ID NO: 2167923 - RNA, 20 nt, Human
gaccagggauuuccaugaug

SEQ ID NO: 2167924 - RNA, 14 nt, Human
gaccagggcagggc

SEQ ID NO: 2167925 - RNA, 22 nt, Human
gaccagggagccuuugguucug

SEQ ID NO: 2167926 - RNA, 15 nt, Human
gaccagggagccuuu

SEQ ID NO: 2167927 - RNA, 14 nt, Human
gaccagggagccuu

SEQ ID NO: 2167928 - RNA, 12 nt, Human
gaccaucccuga

SEQ ID NO: 2167929 - RNA, 13 nt, Human
gaccaucccugaa

SEQ ID NO: 2167930 - RNA, 18 nt, Human
gaccaucccugaaggccc

SEQ ID NO: 2167931 - RNA, 19 nt, Human
gaccaucccugaaggcccc

SEQ ID NO: 2167932 - RNA, 19 nt, Human
gaagcucagcccacccccc

SEQ ID NO: 2167933 - RNA, 15 nt, Human
gaagcucugaaguca

SEQ ID NO: 2167934 - RNA, 13 nt, Human
gaagcucugaagu

SEQ ID NO: 2167935 - RNA, 23 nt, Human
gaagcuccucuccccagcccaga

SEQ ID NO: 2167936 - RNA, 22 nt, Human
gaagcuccucuccccagcccag

SEQ ID NO: 2167937 - RNA, 21 nt, Human
gaagcuccucuccccagccca

SEQ ID NO: 2167938 - RNA, 20 nt, Human
gaagcuccucuccccagccc

SEQ ID NO: 2167939 - RNA, 18 nt, Human
gaagcucagcccaccccc

SEQ ID NO: 2167940 - RNA, 17 nt, Human
gaagcucagcccacccc

SEQ ID NO: 2167941 - RNA, 15 nt, Human
gaagcucagcccacc

SEQ ID NO: 2167942 - RNA, 14 nt, Human
gaagcucagcccac

SEQ ID NO: 2167943 - RNA, 19 nt, Human
gaagcuccucuccccagcc

SEQ ID NO: 2167944 - RNA, 17 nt, Human
gaagcuccucuccccag

SEQ ID NO: 2167945 - RNA, 22 nt, Human
gaagcuccgcuuucuacccagc

SEQ ID NO: 2167946 - RNA, 18 nt, Human
gaagcugaggcgggagaa

SEQ ID NO: 2167947 - RNA, 17 nt, Human
gaagcugagcaccaggg

SEQ ID NO: 2167948 - RNA, 14 nt, Human
gaagcugagcacca

SEQ ID NO: 2167949 - RNA, 19 nt, Human
gaagcugagcaccagggga

SEQ ID NO: 2167950 - RNA, 17 nt, Human
gaagcugaugcuuugcu

SEQ ID NO: 2167951 - RNA, 21 nt, Human
gaagcugaugcuuugcuucaa

SEQ ID NO: 2167952 - RNA, 17 nt, Human
gaaggccccgcccaggc

SEQ ID NO: 2167953 - RNA, 18 nt, Human
gaagcucuugaagacacu

SEQ ID NO: 2167954 - RNA, 22 nt, Human
gaagcugaaaaccuaaguccuu

SEQ ID NO: 2167955 - RNA, 19 nt, Human
gaagcugacgaacuuccau

SEQ ID NO: 2167956 - RNA, 18 nt, Human
gaagcugacgaacuucca

SEQ ID NO: 2167957 - RNA, 22 nt, Human
gaagcugaagugcauccaaagg

SEQ ID NO: 2167958 - RNA, 23 nt, Human
gaagcugaagugcauccaaaggu

SEQ ID NO: 2167959 - RNA, 20 nt, Human
gaagcucugaagucacauca

SEQ ID NO: 2167960 - RNA, 16 nt, Human
gaagcucugaagucac

SEQ ID NO: 2167961 - RNA, 12 nt, Human
gaagcucuggcu

SEQ ID NO: 2167962 - RNA, 19 nt, Human
gaagcucuggcugaacccu

SEQ ID NO: 2167963 - RNA, 20 nt, Human
gaagcucuggcugaacccug

SEQ ID NO: 2167964 - RNA, 23 nt, Human
gaagcucuggcugaacccugugc

SEQ ID NO: 2167965 - RNA, 12 nt, Human
gaagcuagcucc

SEQ ID NO: 2167966 - RNA, 13 nt, Human
gaagcucagccca

SEQ ID NO: 2167967 - RNA, 12 nt, Human
gaagcucagccc

SEQ ID NO: 2167968 - RNA, 14 nt, Human
gaagcucagacugg

SEQ ID NO: 2167969 - RNA, 22 nt, Human
gaagcucaccuguugcuuacaa

SEQ ID NO: 2167970 - RNA, 19 nt, Human
gaagcuauaaauuccucuu

SEQ ID NO: 2167971 - RNA, 20 nt, Human
gaagcucaccuguugcuuac

SEQ ID NO: 2167972 - RNA, 19 nt, Human
gaagcuccgcuuucuaccc

SEQ ID NO: 2167973 - RNA, 20 nt, Human
gaagcuaucguaaaauuaag

SEQ ID NO: 2167974 - RNA, 14 nt, Human
gaagcuagcucccc

SEQ ID NO: 2167975 - RNA, 15 nt, Human
gaagcuagcuccccu

SEQ ID NO: 2167976 - RNA, 16 nt, Human
gaagcuagcuccccuc

SEQ ID NO: 2167977 - RNA, 22 nt, Human
gaagcuagcuccccuccucucc

SEQ ID NO: 2167978 - RNA, 17 nt, Human
gaagcuagcuccccucc

SEQ ID NO: 2167979 - RNA, 19 nt, Human
gaagcuagcuccccuccuc

SEQ ID NO: 2167980 - RNA, 18 nt, Human
gaaggcucuucuccccag

SEQ ID NO: 2167981 - RNA, 23 nt, Human
gaaggcucuucuccccagaguuc

SEQ ID NO: 2167982 - RNA, 16 nt, Human
gaaggcuggcugggca

SEQ ID NO: 2167983 - RNA, 13 nt, Human
gaaggcuggcugg

SEQ ID NO: 2167984 - RNA, 15 nt, Human
gaaggcuggguucug

SEQ ID NO: 2167985 - RNA, 19 nt, Human
gaaggcuggguucugaucc

SEQ ID NO: 2167986 - RNA, 22 nt, Human
gaaggccgagaagcaagaaaga

SEQ ID NO: 2167987 - RNA, 20 nt, Human
gaaggccucccuagccagca

SEQ ID NO: 2167988 - RNA, 18 nt, Human
gaaggccgagaagcaaga

SEQ ID NO: 2167989 - RNA, 17 nt, Human
gaaggccgagaagcaag

SEQ ID NO: 2167990 - RNA, 21 nt, Human
gaaggcucgagcaugccugga

SEQ ID NO: 2167991 - RNA, 18 nt, Human
gaaggccccgcccaggcu

SEQ ID NO: 2167992 - RNA, 19 nt, Human
gaaggccccgcccaggcuu

SEQ ID NO: 2167993 - RNA, 16 nt, Human
gaaggggacccccgcc

SEQ ID NO: 2167994 - RNA, 21 nt, Human
gaagggcuuggacucaagcaa

SEQ ID NO: 2167995 - RNA, 21 nt, Human
gaagggcccuucacugccuuu

SEQ ID NO: 2167996 - RNA, 19 nt, Human
gaagggccagucugggcug

SEQ ID NO: 2167997 - RNA, 20 nt, Human
gaagggccagucugggcugc

SEQ ID NO: 2167998 - RNA, 19 nt, Human
gaagggcuagaaccuggag

SEQ ID NO: 2167999 - RNA, 20 nt, Human
gaagggcuagaaccuggaga

SEQ ID NO: 2168000 - RNA, 22 nt, Human
gaagggcuagaaccuggagagc

SEQ ID NO: 2168001 - RNA, 20 nt, Human
gaagggcuagaaccuggagg

SEQ ID NO: 2168002 - RNA, 22 nt, Human
gaagggccaguccugccuggcc

SEQ ID NO: 2168003 - RNA, 14 nt, Human
gaagggccagucug

SEQ ID NO: 2168004 - RNA, 18 nt, Human
gaagggccagucugggcu

SEQ ID NO: 2168005 - RNA, 20 nt, Human
gaagggccaguccugccugg

SEQ ID NO: 2168006 - RNA, 19 nt, Human
gaagggccaguccugccug

SEQ ID NO: 2168007 - RNA, 18 nt, Human
gaagggccaguccugccu

SEQ ID NO: 2168008 - RNA, 16 nt, Human
gaagggccaguccugc

SEQ ID NO: 2168009 - RNA, 14 nt, Human
gaagggccaguccu

SEQ ID NO: 2168010 - RNA, 11 nt, Human
gaagggccagu

SEQ ID NO: 2168011 - RNA, 17 nt, Human
gaaggcuguccuuaccc

SEQ ID NO: 2168012 - RNA, 12 nt, Human
gaaggcuguccu

SEQ ID NO: 2168013 - RNA, 21 nt, Human
gaaggcucuucuccccagagu

SEQ ID NO: 2168014 - RNA, 14 nt, Human
gaagggccagagcc

SEQ ID NO: 2168015 - RNA, 16 nt, Human
gaaggcuucucucugu

SEQ ID NO: 2168016 - RNA, 18 nt, Human
gaagggccagagccaggg

SEQ ID NO: 2168017 - RNA, 17 nt, Human
gaagggccagagccagg

SEQ ID NO: 2168018 - RNA, 16 nt, Human
gaagggccagagccag

SEQ ID NO: 2168019 - RNA, 15 nt, Human
gaagggccagagcca

SEQ ID NO: 2168020 - RNA, 20 nt, Human
gaaggcuggguucugauccu

SEQ ID NO: 2168021 - RNA, 22 nt, Human
gaaggcuggguucugauccuag

SEQ ID NO: 2168022 - RNA, 18 nt, Human
gaaggggacccccgcccc

SEQ ID NO: 2168023 - RNA, 20 nt, Human
gaaggggacccccgcccccu

SEQ ID NO: 2168024 - RNA, 21 nt, Human
gaaggggacccccgcccccug

SEQ ID NO: 2168025 - RNA, 22 nt, Human
gaaggggagauaaggguaucug

SEQ ID NO: 2168026 - RNA, 15 nt, Human
gaaggggaggagggc

SEQ ID NO: 2168027 - RNA, 23 nt, Human
gaaggggaggcagccggcaccca

SEQ ID NO: 2168028 - RNA, 17 nt, Human
gaaggggaggagggcgg

SEQ ID NO: 2168029 - RNA, 24 nt, Human
gaagugugggucugugugugugua

SEQ ID NO: 2168030 - RNA, 21 nt, Human
gaagugugggucugugugugu

SEQ ID NO: 2168031 - RNA, 15 nt, Human
gaaguguguuuccuu

SEQ ID NO: 2168032 - RNA, 17 nt, Human
gaaguguuaauacuagu

SEQ ID NO: 2168033 - RNA, 13 nt, Human
gaaguguugcaug

SEQ ID NO: 2168034 - RNA, 15 nt, Human
gaaguguugcaugga

SEQ ID NO: 2168035 - RNA, 18 nt, Human
gaaguguugcauggaugu

SEQ ID NO: 2168036 - RNA, 21 nt, Human
gaaguguugcauggauguuuu

SEQ ID NO: 2168037 - RNA, 22 nt, Human
gaaguguugcauggauguuuua

SEQ ID NO: 2168038 - RNA, 21 nt, Human
gaaguguuucacgagagcccg

SEQ ID NO: 2168039 - RNA, 22 nt, Human
gaaguguuucacgagagcccgg

SEQ ID NO: 2168040 - RNA, 14 nt, Human
gaaguuacugaaug

SEQ ID NO: 2168041 - RNA, 18 nt, Human
gaaguuacuguuauagag

SEQ ID NO: 2168042 - RNA, 15 nt, Human
gaaguuaacagagac

SEQ ID NO: 2168043 - RNA, 15 nt, Human
gaaguuacugaaugc

SEQ ID NO: 2168044 - RNA, 16 nt, Human
gaaguuacugaaugca

SEQ ID NO: 2168045 - RNA, 13 nt, Human
gaaguuagaauuc

SEQ ID NO: 2168046 - RNA, 14 nt, Human
gaaguuagaauucc

SEQ ID NO: 2168047 - RNA, 20 nt, Human
gaaguuagaauuccuucagg

SEQ ID NO: 2168048 - RNA, 21 nt, Human
gaaguuagaauuccuucaggg

SEQ ID NO: 2168049 - RNA, 21 nt, Human
gaaguuauuuucuacaguggu

SEQ ID NO: 2168050 - RNA, 15 nt, Human
gaaguucaccauuaa

SEQ ID NO: 2168051 - RNA, 19 nt, Human
gaaguucaccauuaaaagg

SEQ ID NO: 2168052 - RNA, 20 nt, Human
gaaguucaccauuaaaaggg

SEQ ID NO: 2168053 - RNA, 22 nt, Human
gaaguucaccauuaaaagggau

SEQ ID NO: 2168054 - RNA, 15 nt, Human
gaaguugaaugggca

SEQ ID NO: 2168055 - RNA, 16 nt, Human
gaauaguugagcccca

SEQ ID NO: 2168056 - RNA, 13 nt, Human
gaauauaaacacu

SEQ ID NO: 2168057 - RNA, 18 nt, Human
gaauaguauccuccaggu

SEQ ID NO: 2168058 - RNA, 19 nt, Human
gaauaguauccuccagguu

SEQ ID NO: 2168059 - RNA, 20 nt, Human
gaauaguauccuccagguuu

SEQ ID NO: 2168060 - RNA, 21 nt, Human
gaauaguauccuccagguuuu

SEQ ID NO: 2168061 - RNA, 22 nt, Human
gaaguuguuacuaacuaaacuc

SEQ ID NO: 2168062 - RNA, 14 nt, Human
gaaguuguuuguca

SEQ ID NO: 2168063 - RNA, 16 nt, Human
gaauaguauccuccag

SEQ ID NO: 2168064 - RNA, 17 nt, Human
gaauaguauccuccagg

SEQ ID NO: 2168065 - RNA, 22 nt, Human
gaaguuggagugaguguggcuc

SEQ ID NO: 2168066 - RNA, 17 nt, Human
gaaguugcagugagcug

SEQ ID NO: 2168067 - RNA, 18 nt, Human
gaaguugauauagaacag

SEQ ID NO: 2168068 - RNA, 21 nt, Human
gaaguugauauagaacagugc

SEQ ID NO: 2168069 - RNA, 20 nt, Human
gaaguugugccuuuuauagc

SEQ ID NO: 2168070 - RNA, 21 nt, Human
gaaguuguuacuaacuaaacu

SEQ ID NO: 2168071 - RNA, 21 nt, Human
gaauauaaacacuauauggca

SEQ ID NO: 2168072 - RNA, 14 nt, Human
gaauauaaacacua

SEQ ID NO: 2168073 - RNA, 23 nt, Human
gaauagucuagauggcuccucuc

SEQ ID NO: 2168074 - RNA, 16 nt, Human
gaauauaauacuguau

SEQ ID NO: 2168075 - RNA, 19 nt, Human
gaauauaauauauuugugu

SEQ ID NO: 2168076 - RNA, 20 nt, Human
gaauauaauauauuugugua

SEQ ID NO: 2168077 - RNA, 12 nt, Human
gaauauaauuau

SEQ ID NO: 2168078 - RNA, 13 nt, Human
gaauauaauuauc

SEQ ID NO: 2168079 - RNA, 21 nt, Human
gaauaugggagaaauagugug

SEQ ID NO: 2168080 - RNA, 12 nt, Human
gaauauuagcuu

SEQ ID NO: 2168081 - RNA, 21 nt, Human
gaauauuagcuuuacuguuug

SEQ ID NO: 2168082 - RNA, 20 nt, Human
gaauauuagugaccucagcu

SEQ ID NO: 2168083 - RNA, 14 nt, Human
gaauauugcugaug

SEQ ID NO: 2168084 - RNA, 15 nt, Human
gaauauugcugaugg

SEQ ID NO: 2168085 - RNA, 11 nt, Human
gaauauuugaa

SEQ ID NO: 2168086 - RNA, 12 nt, Human
gaauauuugaau

SEQ ID NO: 2168087 - RNA, 13 nt, Human
gaauauuugaauc

SEQ ID NO: 2168088 - RNA, 20 nt, Human
gaauauuuauauuucacuau

SEQ ID NO: 2168089 - RNA, 19 nt, Human
gaauauuuccauauggauu

SEQ ID NO: 2168090 - RNA, 10 nt, Human
gaauauuuga

SEQ ID NO: 2168091 - RNA, 19 nt, Human
gaauauuuauuaccucuga

SEQ ID NO: 2168092 - RNA, 21 nt, Human
gaauauuuauuaccucugaua

SEQ ID NO: 2168093 - RNA, 13 nt, Human
gaauauuuauuac

SEQ ID NO: 2168094 - RNA, 15 nt, Human
gaauauuuauuaccu

SEQ ID NO: 2168095 - RNA, 17 nt, Human
gaauauuuauuaccucu

SEQ ID NO: 2168096 - RNA, 18 nt, Human
gaauauuuauuaccucug

SEQ ID NO: 2168097 - RNA, 18 nt, Human
gaauauuuauauuucacu

SEQ ID NO: 2168098 - RNA, 10 nt, Human
gaauauuuau

SEQ ID NO: 2168099 - RNA, 19 nt, Human
gaauauuuauauuucacua

SEQ ID NO: 2168100 - RNA, 12 nt, Human
gaauauuuauua

SEQ ID NO: 2168101 - RNA, 11 nt, Human
gaauauucagg

SEQ ID NO: 2168102 - RNA, 13 nt, Human
gaauauuguccau

SEQ ID NO: 2168103 - RNA, 12 nt, Human
gaauauucagga

SEQ ID NO: 2168104 - RNA, 19 nt, Human
gaauauugcugauggugca

SEQ ID NO: 2168105 - RNA, 20 nt, Human
gaauauugcugauggugcaa

SEQ ID NO: 2168106 - RNA, 23 nt, Human
gaagacaccagagcagaugcaga

SEQ ID NO: 2168107 - RNA, 20 nt, Human
gaagcagaugcaaagaggca

SEQ ID NO: 2168108 - RNA, 19 nt, Human
gaagcagaugcaaagaggc

SEQ ID NO: 2168109 - RNA, 21 nt, Human
gaagcagaugcaaagaggcaa

SEQ ID NO: 2168110 - RNA, 15 nt, Human
gaagcagaggaagga

SEQ ID NO: 2168111 - RNA, 20 nt, Human
gaagcagaauaaagcaauuu

SEQ ID NO: 2168112 - RNA, 21 nt, Human
gaagcagaauaaagcaauuuu

SEQ ID NO: 2168113 - RNA, 23 nt, Human
gaagcagaauaaagcaauuuucc

SEQ ID NO: 2168114 - RNA, 22 nt, Human
gaagcagaauaaagcaauuuuc

SEQ ID NO: 2168115 - RNA, 23 nt, Human
gaagcacuuugggauucuuucca

SEQ ID NO: 2168116 - RNA, 12 nt, Human
gaagcagaauaa

SEQ ID NO: 2168117 - RNA, 13 nt, Human
gaagcagaauaaa

SEQ ID NO: 2168118 - RNA, 14 nt, Human
gaagcagaauaaag

SEQ ID NO: 2168119 - RNA, 15 nt, Human
gaagcagaauaaagc

SEQ ID NO: 2168120 - RNA, 16 nt, Human
gaagcagaauaaagca

SEQ ID NO: 2168121 - RNA, 17 nt, Human
gaagcagaauaaagcaa

SEQ ID NO: 2168122 - RNA, 18 nt, Human
gaagcagaauaaagcaau

SEQ ID NO: 2168123 - RNA, 19 nt, Human
gaagcagaauaaagcaauu

SEQ ID NO: 2168124 - RNA, 17 nt, Human
gaagcaaacacauuaag

SEQ ID NO: 2168125 - RNA, 16 nt, Human
gaagcaaagcaccagc

SEQ ID NO: 2168126 - RNA, 17 nt, Human
gaagcaaacuaagcccc

SEQ ID NO: 2168127 - RNA, 23 nt, Human
gaagcaacccaaauguucaucaa

SEQ ID NO: 2168128 - RNA, 16 nt, Human
gaagcaacgaagggaa

SEQ ID NO: 2168129 - RNA, 20 nt, Human
gaagcaaugcuucaucccuu

SEQ ID NO: 2168130 - RNA, 16 nt, Human
gaagcaacagaaaaaa

SEQ ID NO: 2168131 - RNA, 19 nt, Human
gaagcaauaaagaagagug

SEQ ID NO: 2168132 - RNA, 18 nt, Human
gaagcaauaaagaagagu

SEQ ID NO: 2168133 - RNA, 15 nt, Human
gaagcacaugccucu

SEQ ID NO: 2168134 - RNA, 17 nt, Human
gaagcacaugccucucu

SEQ ID NO: 2168135 - RNA, 20 nt, Human
gaagcacaugccucucucag

SEQ ID NO: 2168136 - RNA, 15 nt, Human
gaagcaaacacauua

SEQ ID NO: 2168137 - RNA, 13 nt, Human
gaagcaaacacau

SEQ ID NO: 2168138 - RNA, 22 nt, Human
gaagacaccagagcagaugcag

SEQ ID NO: 2168139 - RNA, 18 nt, Human
gaagacaccagagcagau

SEQ ID NO: 2168140 - RNA, 21 nt, Human
gaagacaccagagcagaugca

SEQ ID NO: 2168141 - RNA, 14 nt, Human
gaagcaaaauuuuu

SEQ ID NO: 2168142 - RNA, 23 nt, Human
gaagauuuugaaauuuuuauuaa

SEQ ID NO: 2168143 - RNA, 14 nt, Human
gaagacaccagagc

SEQ ID NO: 2168144 - RNA, 15 nt, Human
gaagacaccagagca

SEQ ID NO: 2168145 - RNA, 16 nt, Human
gaagacaccagagcag

SEQ ID NO: 2168146 - RNA, 17 nt, Human
gaagacaccagagcaga

SEQ ID NO: 2168147 - RNA, 21 nt, Human
gaagacacagacugcgauuug

SEQ ID NO: 2168148 - RNA, 12 nt, Human
gaagacacagac

SEQ ID NO: 2168149 - RNA, 21 nt, Human
gaagaauuuucagaccccagc

SEQ ID NO: 2168150 - RNA, 20 nt, Human
gaagaauuuucagaccccag

SEQ ID NO: 2168151 - RNA, 17 nt, Human
gaagaauuuucagaccc

SEQ ID NO: 2168152 - RNA, 16 nt, Human
gaagacaaugacuuac

SEQ ID NO: 2168153 - RNA, 23 nt, Human
gaagacaaugugaaaagaaaaau

SEQ ID NO: 2168154 - RNA, 22 nt, Human
gaagacaaugacuuacuguaca

SEQ ID NO: 2168155 - RNA, 23 nt, Human
gaacuggacucaggaugcccagg

SEQ ID NO: 2168156 - RNA, 21 nt, Human
gaacuggacucaggaugccca

SEQ ID NO: 2168157 - RNA, 15 nt, Human
gaacuggacucagga

SEQ ID NO: 2168158 - RNA, 14 nt, Human
gaacuggacucagg

SEQ ID NO: 2168159 - RNA, 22 nt, Human
gaacuggacccuguugcuaagc

SEQ ID NO: 2168160 - RNA, 23 nt, Human
gaacuggacccuguugcuaagcc

SEQ ID NO: 2168161 - RNA, 16 nt, Human
gaacugcuuucuuucg

SEQ ID NO: 2168162 - RNA, 18 nt, Human
gaacuggacccuguugcu

SEQ ID NO: 2168163 - RNA, 20 nt, Human
gaacuggacccuguugcuaa

SEQ ID NO: 2168164 - RNA, 20 nt, Human
gaacugcugggcuuggcagc

SEQ ID NO: 2168165 - RNA, 17 nt, Human
gaacugcugggcuuggc

SEQ ID NO: 2168166 - RNA, 20 nt, Human
gaacugaaccggcuuuacca

SEQ ID NO: 2168167 - RNA, 12 nt, Human
gaacucugaaau

SEQ ID NO: 2168168 - RNA, 21 nt, Human
gaacugccuuuggcagaguuc

SEQ ID NO: 2168169 - RNA, 22 nt, Human
gaacugcuagucaagugcgucc

SEQ ID NO: 2168170 - RNA, 17 nt, Human
gaacugccucuuuccug

SEQ ID NO: 2168171 - RNA, 19 nt, Human
gaacugagcuccucugggc

SEQ ID NO: 2168172 - RNA, 17 nt, Human
gaacugagcuccucugg

SEQ ID NO: 2168173 - RNA, 12 nt, Human
gaacugaacuca

SEQ ID NO: 2168174 - RNA, 17 nt, Human
gaacugaaguuucacau

SEQ ID NO: 2168175 - RNA, 11 nt, Human
gaacuggcugc

SEQ ID NO: 2168176 - RNA, 12 nt, Human
gaacuggcugca

SEQ ID NO: 2168177 - RNA, 19 nt, Human
gaagaauauucaggacuua

SEQ ID NO: 2168178 - RNA, 20 nt, Human
gaagaaucuguuucccagca

SEQ ID NO: 2168179 - RNA, 17 nt, Human
gaagaauauucaggacu

SEQ ID NO: 2168180 - RNA, 14 nt, Human
gaagaauauucagg

SEQ ID NO: 2168181 - RNA, 15 nt, Human
gaagaauuuucagac

SEQ ID NO: 2168182 - RNA, 23 nt, Human
gaagaauuuuaaaaaugaauccu

SEQ ID NO: 2168183 - RNA, 14 nt, Human
gaagaauuuuaaaa

SEQ ID NO: 2168184 - RNA, 15 nt, Human
gaagaauuuuaaaaa

SEQ ID NO: 2168185 - RNA, 13 nt, Human
gaagaauuuguua

SEQ ID NO: 2168186 - RNA, 14 nt, Human
gaagaauuuguuau

SEQ ID NO: 2168187 - RNA, 12 nt, Human
gaagaauuuuaa

SEQ ID NO: 2168188 - RNA, 13 nt, Human
gaagaauuuuaaa

SEQ ID NO: 2168189 - RNA, 20 nt, Human
gaagaauugaacccaggagg

SEQ ID NO: 2168190 - RNA, 19 nt, Human
gaagaauugaacccaggag

SEQ ID NO: 2168191 - RNA, 18 nt, Human
gaagaauugaacccagga

SEQ ID NO: 2168192 - RNA, 23 nt, Human
gaagaauugaacccaggaggugg

SEQ ID NO: 2168193 - RNA, 14 nt, Human
gaagaaugaacaaa

SEQ ID NO: 2168194 - RNA, 12 nt, Human
gaagaauuccag

SEQ ID NO: 2168195 - RNA, 13 nt, Human
gaacccugugcug

SEQ ID NO: 2168196 - RNA, 18 nt, Human
gaacccugcguggggaca

SEQ ID NO: 2168197 - RNA, 16 nt, Human
gaacccuuggcuugcc

SEQ ID NO: 2168198 - RNA, 12 nt, Human
gaacccuuggcu

SEQ ID NO: 2168199 - RNA, 19 nt, Human
gaacccugcguggggacag

SEQ ID NO: 2168200 - RNA, 14 nt, Human
gaacccugugcugg

SEQ ID NO: 2168201 - RNA, 17 nt, Human
gaacccugugcuggugu

SEQ ID NO: 2168202 - RNA, 17 nt, Human
gaaccgagcaaagauca

SEQ ID NO: 2168203 - RNA, 19 nt, Human
gaacccuuuuggcccccga

SEQ ID NO: 2168204 - RNA, 18 nt, Human
gaacccuuuuggcccccg

SEQ ID NO: 2168205 - RNA, 17 nt, Human
gaacccuuuuggccccc

SEQ ID NO: 2168206 - RNA, 23 nt, Human
gaacccugugcugguguccugac

SEQ ID NO: 2168207 - RNA, 21 nt, Human
gaacccuuggcuugcccacgu

SEQ ID NO: 2168208 - RNA, 20 nt, Human
gaacccuuggcuugcccacg

SEQ ID NO: 2168209 - RNA, 18 nt, Human
gaacccuuggcuugccca

SEQ ID NO: 2168210 - RNA, 17 nt, Human
gaacccuuggcuugccc

SEQ ID NO: 2168211 - RNA, 23 nt, Human
gaacccuuuuggcccccgagcug

SEQ ID NO: 2168212 - RNA, 19 nt, Human
gaaccgagcaaagaucaaa

SEQ ID NO: 2168213 - RNA, 21 nt, Human
gaaccgagcaaagaucaaaau

SEQ ID NO: 2168214 - RNA, 23 nt, Human
gaaccgagcaaagaucaaaauaa

SEQ ID NO: 2168215 - RNA, 21 nt, Human
gaaccgaggggcucaggaaaa

SEQ ID NO: 2168216 - RNA, 18 nt, Human
gaaccgaggggcucagga

SEQ ID NO: 2168217 - RNA, 14 nt, Human
gaacuccugggcuc

SEQ ID NO: 2168218 - RNA, 15 nt, Human
gaacuccuugauuuu

SEQ ID NO: 2168219 - RNA, 21 nt, Human
gaaccgcagaagccuccccag

SEQ ID NO: 2168220 - RNA, 20 nt, Human
gaaccgcagaagccucccca

SEQ ID NO: 2168221 - RNA, 17 nt, Human
gaacucucuccacccua

SEQ ID NO: 2168222 - RNA, 20 nt, Human
gaacucugacaacagacuuc

SEQ ID NO: 2168223 - RNA, 20 nt, Human
gaacuccugggcucaagcag

SEQ ID NO: 2168224 - RNA, 22 nt, Human
gaacuccuugauuuuagccuuc

SEQ ID NO: 2168225 - RNA, 14 nt, Human
gaacugaaaucaua

SEQ ID NO: 2168226 - RNA, 16 nt, Human
gaacucuggcuuccag

SEQ ID NO: 2168227 - RNA, 13 nt, Human
gaguuuaaagcaa

SEQ ID NO: 2168228 - RNA, 16 nt, Human
gaguuuaaauuguaau

SEQ ID NO: 2168229 - RNA, 22 nt, Human
gaguuguuuucagacucagacu

SEQ ID NO: 2168230 - RNA, 16 nt, Human
gaguuguuuucagacu

SEQ ID NO: 2168231 - RNA, 15 nt, Human
gaguuguugcccugg

SEQ ID NO: 2168232 - RNA, 13 nt, Human
gaguuggcuggga

SEQ ID NO: 2168233 - RNA, 22 nt, Human
gaguuguuacauuuuuaagugc

SEQ ID NO: 2168234 - RNA, 18 nt, Human
gaguugauucagcucugc

SEQ ID NO: 2168235 - RNA, 14 nt, Human
gaguugaugucucc

SEQ ID NO: 2168236 - RNA, 18 nt, Human
gaguugcugcaaaccuga

SEQ ID NO: 2168237 - RNA, 16 nt, Human
gaggugaaagggagcu

SEQ ID NO: 2168238 - RNA, 23 nt, Human
gaggugaccccagguuucuaugu

SEQ ID NO: 2168239 - RNA, 14 nt, Human
gaggucucuugagg

SEQ ID NO: 2168240 - RNA, 16 nt, Human
gaggucucugccggcu

SEQ ID NO: 2168241 - RNA, 22 nt, Human
gaggucucgcugaugcugggcu

SEQ ID NO: 2168242 - RNA, 23 nt, Human
gaggucucgcugaugcugggcug

SEQ ID NO: 2168243 - RNA, 17 nt, Human
gaggucucgcugaugcu

SEQ ID NO: 2168244 - RNA, 20 nt, Human
gaggucucgcugaugcuggg

SEQ ID NO: 2168245 - RNA, 22 nt, Human
gaggucuuuugacauguggaaa

SEQ ID NO: 2168246 - RNA, 15 nt, Human
gaggucucuugaggg

SEQ ID NO: 2168247 - RNA, 19 nt, Human
gaggucuuuugacaugugg

SEQ ID NO: 2168248 - RNA, 15 nt, Human
gaggugaaagggagc

SEQ ID NO: 2168249 - RNA, 15 nt, Human
gaggucgaggcagga

SEQ ID NO: 2168250 - RNA, 20 nt, Human
gaggucgggaguucgagacc

SEQ ID NO: 2168251 - RNA, 22 nt, Human
gaggucgaccccaaagccccuu

SEQ ID NO: 2168252 - RNA, 21 nt, Human
gaggucgguagguucagccaa

SEQ ID NO: 2168253 - RNA, 22 nt, Human
gaggucgguagguucagccaag

SEQ ID NO: 2168254 - RNA, 23 nt, Human
gaggucgguagguucagccaagg

SEQ ID NO: 2168255 - RNA, 13 nt, Human
gaggucuaaucua

SEQ ID NO: 2168256 - RNA, 21 nt, Human
gagugcaagccccugcuccag

SEQ ID NO: 2168257 - RNA, 16 nt, Human
gagugcaacaguagca

SEQ ID NO: 2168258 - RNA, 22 nt, Human
gagugauacaacuucaagugca

SEQ ID NO: 2168259 - RNA, 19 nt, Human
gagugcaaugacacagucu

SEQ ID NO: 2168260 - RNA, 19 nt, Human
gaguggagguuaaggcuga

SEQ ID NO: 2168261 - RNA, 17 nt, Human
gaguggaggaggccugg

SEQ ID NO: 2168262 - RNA, 18 nt, Human
gaguggaggaggccuggg

SEQ ID NO: 2168263 - RNA, 18 nt, Human
gaguggaguggaagaaga

SEQ ID NO: 2168264 - RNA, 16 nt, Human
gagugcagccguuuga

SEQ ID NO: 2168265 - RNA, 23 nt, Human
gagugcagccguuugagaagaaa

SEQ ID NO: 2168266 - RNA, 19 nt, Human
gagugaguguggcuccccu

SEQ ID NO: 2168267 - RNA, 19 nt, Human
gagugauagucuuuugcuu

SEQ ID NO: 2168268 - RNA, 20 nt, Human
gagugacggucccacacugg

SEQ ID NO: 2168269 - RNA, 18 nt, Human
gagugacucgaggguugg

SEQ ID NO: 2168270 - RNA, 15 nt, Human
gagugacucgagggu

SEQ ID NO: 2168271 - RNA, 18 nt, Human
gagucccaaggaaagccc

SEQ ID NO: 2168272 - RNA, 20 nt, Human
gaguccauucucccagguac

SEQ ID NO: 2168273 - RNA, 19 nt, Human
gagugacaguggauugcau

SEQ ID NO: 2168274 - RNA, 15 nt, Human
gagugacggucccac

SEQ ID NO: 2168275 - RNA, 18 nt, Human
gagugacggucccacacu

SEQ ID NO: 2168276 - RNA, 20 nt, Human
gagugacagaggcagcccca

SEQ ID NO: 2168277 - RNA, 18 nt, Human
gaguggaugauguuucgu

SEQ ID NO: 2168278 - RNA, 19 nt, Human
gaguggaucuccaaggacc

SEQ ID NO: 2168279 - RNA, 22 nt, Human
gaguggaucuccaaggaccagg

SEQ ID NO: 2168280 - RNA, 16 nt, Human
gaguggaucuccaagg

SEQ ID NO: 2168281 - RNA, 17 nt, Human
gaguggaucuccaagga

SEQ ID NO: 2168282 - RNA, 16 nt, Human
gaguugaucuggaacc

SEQ ID NO: 2168283 - RNA, 14 nt, Human
gaguugaucuggaa

SEQ ID NO: 2168284 - RNA, 23 nt, Human
gaguggcaggggacaggagucca

SEQ ID NO: 2168285 - RNA, 14 nt, Human
gaguggcaggggac

SEQ ID NO: 2168286 - RNA, 16 nt, Human
gaguggcaggggacag

SEQ ID NO: 2168287 - RNA, 19 nt, Human
gaguggcaggggacaggag

SEQ ID NO: 2168288 - RNA, 17 nt, Human
gaguugauucagcucug

SEQ ID NO: 2168289 - RNA, 16 nt, Human
gaguugauucagcucu

SEQ ID NO: 2168290 - RNA, 15 nt, Human
gaguugauucagcuc

SEQ ID NO: 2168291 - RNA, 21 nt, Human
gaguugaucuggaacccagac

SEQ ID NO: 2168292 - RNA, 20 nt, Human
gaguugaucuggaacccaga

SEQ ID NO: 2168293 - RNA, 19 nt, Human
gaguugaucuggaacccag

SEQ ID NO: 2168294 - RNA, 17 nt, Human
gaguugaucuggaaccc

SEQ ID NO: 2168295 - RNA, 20 nt, Human
gagucacccaugaagacagg

SEQ ID NO: 2168296 - RNA, 14 nt, Human
gagucaccaggaau

SEQ ID NO: 2168297 - RNA, 20 nt, Human
gagguggaagcccuccuucc

SEQ ID NO: 2168298 - RNA, 17 nt, Human
gagucaccaagcccagu

SEQ ID NO: 2168299 - RNA, 15 nt, Human
gagguggaagcccuc

SEQ ID NO: 2168300 - RNA, 19 nt, Human
gagguggaagaagggagaa

SEQ ID NO: 2168301 - RNA, 17 nt, Human
gagguggaagaagggag

SEQ ID NO: 2168302 - RNA, 18 nt, Human
gagguggaagaagggaga

SEQ ID NO: 2168303 - RNA, 15 nt, Human
gagucaccaagccca

SEQ ID NO: 2168304 - RNA, 16 nt, Human
gagucaccaagcccag

SEQ ID NO: 2168305 - RNA, 20 nt, Human
gagguggaagagggcugcaa

SEQ ID NO: 2168306 - RNA, 17 nt, Human
gagguggaagagggcug

SEQ ID NO: 2168307 - RNA, 22 nt, Human
gaggugcuuaagcagaagcauu

SEQ ID NO: 2168308 - RNA, 13 nt, Human
gagguggaagaag

SEQ ID NO: 2168309 - RNA, 15 nt, Human
gagguggaagaaggg

SEQ ID NO: 2168310 - RNA, 16 nt, Human
gagguggaagaaggga

SEQ ID NO: 2168311 - RNA, 20 nt, Human
gaggugcuuaagcagaagca

SEQ ID NO: 2168312 - RNA, 22 nt, Human
gagucagggaccccugcccuug

SEQ ID NO: 2168313 - RNA, 18 nt, Human
gagucagggaccccugcc

SEQ ID NO: 2168314 - RNA, 17 nt, Human
gagucagggaccccugc

SEQ ID NO: 2168315 - RNA, 18 nt, Human
gagucagggagagcugaa

SEQ ID NO: 2168316 - RNA, 11 nt, Human
gagucagccuu

SEQ ID NO: 2168317 - RNA, 22 nt, Human
gagucagacauuuuaagauggu

SEQ ID NO: 2168318 - RNA, 22 nt, Human
gagucagaaguuucugccgcag

SEQ ID NO: 2168319 - RNA, 12 nt, Human
gagucccaccuu

SEQ ID NO: 2168320 - RNA, 14 nt, Human
gagucccaaggaaa

SEQ ID NO: 2168321 - RNA, 17 nt, Human
gaguccauucucccagg

SEQ ID NO: 2168322 - RNA, 18 nt, Human
gaguccauucucccaggu

SEQ ID NO: 2168323 - RNA, 18 nt, Human
gagucagguuugggguuc

SEQ ID NO: 2168324 - RNA, 15 nt, Human
gaguccauucuccca

SEQ ID NO: 2168325 - RNA, 16 nt, Human
gaguccauucucccag

SEQ ID NO: 2168326 - RNA, 16 nt, Human
gagucccaaggaaagc

SEQ ID NO: 2168327 - RNA, 15 nt, Human
gagucccaaggaaag

SEQ ID NO: 2168328 - RNA, 18 nt, Human
gagugacagaggcagccc

SEQ ID NO: 2168329 - RNA, 12 nt, Human
gagcugcuggcu

SEQ ID NO: 2168330 - RNA, 13 nt, Human
gagcugcugcccu

SEQ ID NO: 2168331 - RNA, 14 nt, Human
gagcugcugcccug

SEQ ID NO: 2168332 - RNA, 16 nt, Human
gagcugcucuggaaaa

SEQ ID NO: 2168333 - RNA, 14 nt, Human
gagcugcucugaau

SEQ ID NO: 2168334 - RNA, 24 nt, Human
gagcugcucugaauuaguccuugc

SEQ ID NO: 2168335 - RNA, 21 nt, Human
gagcugcuauagccuggggug

SEQ ID NO: 2168336 - RNA, 13 nt, Human
gagcugcucacua

SEQ ID NO: 2168337 - RNA, 20 nt, Human
gagcugcuauagccuggggu

SEQ ID NO: 2168338 - RNA, 18 nt, Human
gagcugcuauagccuggg

SEQ ID NO: 2168339 - RNA, 22 nt, Human
gagcugccuuggcucagacaug

SEQ ID NO: 2168340 - RNA, 21 nt, Human
gagcugccuuggcucagacau

SEQ ID NO: 2168341 - RNA, 21 nt, Human
gagcugcuggcuugcagugcg

SEQ ID NO: 2168342 - RNA, 16 nt, Human
gagcugcuggcuugca

SEQ ID NO: 2168343 - RNA, 18 nt, Human
gagcgcaccugcccccug

SEQ ID NO: 2168344 - RNA, 22 nt, Human
gagccuucugaggacauuccaa

SEQ ID NO: 2168345 - RNA, 13 nt, Human
gagccuugaacuu

SEQ ID NO: 2168346 - RNA, 23 nt, Human
gagccuuccaggggugggacacc

SEQ ID NO: 2168347 - RNA, 16 nt, Human
gagcgcaucaggccug

SEQ ID NO: 2168348 - RNA, 12 nt, Human
gagcgccccucc

SEQ ID NO: 2168349 - RNA, 17 nt, Human
gagcgcccgcgcccgcg

SEQ ID NO: 2168350 - RNA, 20 nt, Human
gagcgcaccugcccccuggu

SEQ ID NO: 2168351 - RNA, 21 nt, Human
gagcgcccacuagacccacug

SEQ ID NO: 2168352 - RNA, 18 nt, Human
gagcugccuuggcucaga

SEQ ID NO: 2168353 - RNA, 15 nt, Human
gagcugccuuggcuc

SEQ ID NO: 2168354 - RNA, 19 nt, Human
gagcgccuccauccaaggc

SEQ ID NO: 2168355 - RNA, 23 nt, Human
gagcgccuccauccaaggccagg

SEQ ID NO: 2168356 - RNA, 21 nt, Human
gagcgccgugaguucucaggg

SEQ ID NO: 2168357 - RNA, 22 nt, Human
gagcgccgugaguucucagggc

SEQ ID NO: 2168358 - RNA, 20 nt, Human
gagccuuccaggggugggac

SEQ ID NO: 2168359 - RNA, 14 nt, Human
gaggggccucaggu

SEQ ID NO: 2168360 - RNA, 13 nt, Human
gaggggcccgagc

SEQ ID NO: 2168361 - RNA, 22 nt, Human
gaggggccccugcuucuccagc

SEQ ID NO: 2168362 - RNA, 14 nt, Human
gaggggccccugcu

SEQ ID NO: 2168363 - RNA, 17 nt, Human
gaggggcccgcuugccu

SEQ ID NO: 2168364 - RNA, 21 nt, Human
gaggggcccguugucucccug

SEQ ID NO: 2168365 - RNA, 12 nt, Human
gaggggccucuu

SEQ ID NO: 2168366 - RNA, 23 nt, Human
gaggggccuaggccucagccaga

SEQ ID NO: 2168367 - RNA, 22 nt, Human
gaggggccuaggccucagccag

SEQ ID NO: 2168368 - RNA, 19 nt, Human
gaggggccuaggccucagc

SEQ ID NO: 2168369 - RNA, 17 nt, Human
gaggggccuaggccuca

SEQ ID NO: 2168370 - RNA, 19 nt, Human
gaggggcauggccagcagc

SEQ ID NO: 2168371 - RNA, 15 nt, Human
gaggggcagguaaac

SEQ ID NO: 2168372 - RNA, 22 nt, Human
gaggggcaucugccccuccccc

SEQ ID NO: 2168373 - RNA, 17 nt, Human
gaggggcaucugccccu

SEQ ID NO: 2168374 - RNA, 14 nt, Human
gaggggcaggcuga

SEQ ID NO: 2168375 - RNA, 16 nt, Human
gaggggcaggcugaca

SEQ ID NO: 2168376 - RNA, 13 nt, Human
gaggggcaggccc

SEQ ID NO: 2168377 - RNA, 14 nt, Human
gaggggcaggcccu

SEQ ID NO: 2168378 - RNA, 15 nt, Human
gaggggcaggcccug

SEQ ID NO: 2168379 - RNA, 17 nt, Human
gaggggcaggcccugca

SEQ ID NO: 2168380 - RNA, 23 nt, Human
gaggggcaggcccugcacugucc

SEQ ID NO: 2168381 - RNA, 13 nt, Human
gaggggcaggcug

SEQ ID NO: 2168382 - RNA, 15 nt, Human
gagggcuggaaucug

SEQ ID NO: 2168383 - RNA, 13 nt, Human
gagggcuggaauc

SEQ ID NO: 2168384 - RNA, 18 nt, Human
gagggcuggaaucuggag

SEQ ID NO: 2168385 - RNA, 19 nt, Human
gagggcuggaaucuggaga

SEQ ID NO: 2168386 - RNA, 20 nt, Human
gagggcuggaaucuggagag

SEQ ID NO: 2168387 - RNA, 21 nt, Human
gagggcuggaaucuggagagc

SEQ ID NO: 2168388 - RNA, 20 nt, Human
gaggcugcagaaggccaaga

SEQ ID NO: 2168389 - RNA, 13 nt, Human
gagggcugcccug

SEQ ID NO: 2168390 - RNA, 12 nt, Human
gaggcugaggcg

SEQ ID NO: 2168391 - RNA, 15 nt, Human
gaggcugaggcuggc

SEQ ID NO: 2168392 - RNA, 19 nt, Human
gaggcugaggcuggcacag

SEQ ID NO: 2168393 - RNA, 16 nt, Human
gaggcugaggcuggca

SEQ ID NO: 2168394 - RNA, 19 nt, Human
gaggcugcagccaggccac

SEQ ID NO: 2168395 - RNA, 20 nt, Human
gaggcugaggcuggcacagg

SEQ ID NO: 2168396 - RNA, 18 nt, Human
gaggcugcagccaggcca

SEQ ID NO: 2168397 - RNA, 13 nt, Human
gaggcagggucag

SEQ ID NO: 2168398 - RNA, 14 nt, Human
gaggcagugggucc

SEQ ID NO: 2168399 - RNA, 19 nt, Human
gaggcagugggucccacuu

SEQ ID NO: 2168400 - RNA, 22 nt, Human
gaggcagugggucccacuuccc

SEQ ID NO: 2168401 - RNA, 22 nt, Human
gaggccaaggugggaggauugc

SEQ ID NO: 2168402 - RNA, 17 nt, Human
gaggccaaggugggagg

SEQ ID NO: 2168403 - RNA, 15 nt, Human
gaggcagggucucac

SEQ ID NO: 2168404 - RNA, 12 nt, Human
gaggcagguccc

SEQ ID NO: 2168405 - RNA, 16 nt, Human
gaggcagguccccaga

SEQ ID NO: 2168406 - RNA, 13 nt, Human
gaggcaggucccc

SEQ ID NO: 2168407 - RNA, 15 nt, Human
gaggaccuuaucugu

SEQ ID NO: 2168408 - RNA, 19 nt, Human
gaggaccuuaucugugcgu

SEQ ID NO: 2168409 - RNA, 22 nt, Human
gaggacgagcgauugaggugua

SEQ ID NO: 2168410 - RNA, 15 nt, Human
gaggacgcucucugg

SEQ ID NO: 2168411 - RNA, 14 nt, Human
gaggcaggggcgga

SEQ ID NO: 2168412 - RNA, 23 nt, Human
gaggcagggccuugcccagagau

SEQ ID NO: 2168413 - RNA, 15 nt, Human
gaggcaggggcggag

SEQ ID NO: 2168414 - RNA, 14 nt, Human
gaggcagggucuca

SEQ ID NO: 2168415 - RNA, 17 nt, Human
gaggcugaggcaggagg

SEQ ID NO: 2168416 - RNA, 16 nt, Human
gaggcugaggcaggag

SEQ ID NO: 2168417 - RNA, 18 nt, Human
gaggcugaggcagaagaa

SEQ ID NO: 2168418 - RNA, 16 nt, Human
gaggcugaggcagaag

SEQ ID NO: 2168419 - RNA, 14 nt, Human
gaggcugaggccug

SEQ ID NO: 2168420 - RNA, 16 nt, Human
gaggcugaggccugga

SEQ ID NO: 2168421 - RNA, 18 nt, Human
gaggcugaggccuggacu

SEQ ID NO: 2168422 - RNA, 19 nt, Human
gaggcugaggccuggacuu

SEQ ID NO: 2168423 - RNA, 23 nt, Human
gaggcuccacuuggucugugaga

SEQ ID NO: 2168424 - RNA, 12 nt, Human
gaggcuccacuu

SEQ ID NO: 2168425 - RNA, 12 nt, Human
gaggcucagguc

SEQ ID NO: 2168426 - RNA, 18 nt, Human
gaggcuacuguaaggcaa

SEQ ID NO: 2168427 - RNA, 18 nt, Human
gaggccaccucuccaagg

SEQ ID NO: 2168428 - RNA, 21 nt, Human
gaggcuagaaccaagaagggc

SEQ ID NO: 2168429 - RNA, 20 nt, Human
gaggcuauuauuuucacugu

SEQ ID NO: 2168430 - RNA, 10 nt, Human
gaggcucagg

SEQ ID NO: 2168431 - RNA, 18 nt, Human
gaggcuccacuuggucug

SEQ ID NO: 2168432 - RNA, 19 nt, Human
gaggcuccacuuggucugu

SEQ ID NO: 2168433 - RNA, 17 nt, Human
gaggccaagugcaggcu

SEQ ID NO: 2168434 - RNA, 16 nt, Human
gaggccacaugagucc

SEQ ID NO: 2168435 - RNA, 17 nt, Human
gaggccacaugaguccc

SEQ ID NO: 2168436 - RNA, 22 nt, Human
gaggccacaugagucccagugg

SEQ ID NO: 2168437 - RNA, 21 nt, Human
gaggccacacucagcacaagg

SEQ ID NO: 2168438 - RNA, 18 nt, Human
gaggccacacucagcaca

SEQ ID NO: 2168439 - RNA, 15 nt, Human
gaggccaagugcagg

SEQ ID NO: 2168440 - RNA, 12 nt, Human
gaggccaccucu

SEQ ID NO: 2168441 - RNA, 14 nt, Human
gaggccaccucucc

SEQ ID NO: 2168442 - RNA, 15 nt, Human
gaggccaccucucca

SEQ ID NO: 2168443 - RNA, 23 nt, Human
gaggccacaugagucccaguggg

SEQ ID NO: 2168444 - RNA, 10 nt, Human
gaggccaccu

SEQ ID NO: 2168445 - RNA, 16 nt, Human
gaggccaccucuccaa

SEQ ID NO: 2168446 - RNA, 17 nt, Human
gaggccaccucuccaag

SEQ ID NO: 2168447 - RNA, 20 nt, Human
gaggccaccucuccaagggc

SEQ ID NO: 2168448 - RNA, 13 nt, Human
gaggccagagaca

SEQ ID NO: 2168449 - RNA, 14 nt, Human
gaggccagagacac

SEQ ID NO: 2168450 - RNA, 19 nt, Human
gaggccagagacacaagcc

SEQ ID NO: 2168451 - RNA, 22 nt, Human
gaggcuagugugguguuuccug

SEQ ID NO: 2168452 - RNA, 23 nt, Human
gauuauucccuguacaauauuua

SEQ ID NO: 2168453 - RNA, 22 nt, Human
gauuauucauuuaaaaugauua

SEQ ID NO: 2168454 - RNA, 20 nt, Human
gauuauucauuuaaaaugau

SEQ ID NO: 2168455 - RNA, 21 nt, Human
gauuauucauuuaaaaugauu

SEQ ID NO: 2168456 - RNA, 14 nt, Human
gauuauuguauuua

SEQ ID NO: 2168457 - RNA, 17 nt, Human
gauuauucugauuccac

SEQ ID NO: 2168458 - RNA, 19 nt, Human
gauuauucugauuccacuu

SEQ ID NO: 2168459 - RNA, 12 nt, Human
gauuauuggaaa

SEQ ID NO: 2168460 - RNA, 15 nt, Human
gauuauucaguguca

SEQ ID NO: 2168461 - RNA, 13 nt, Human
gauuauucauuua

SEQ ID NO: 2168462 - RNA, 14 nt, Human
gauuauucauuuaa

SEQ ID NO: 2168463 - RNA, 15 nt, Human
gauuauucauuuaaa

SEQ ID NO: 2168464 - RNA, 16 nt, Human
gauuauucauuuaaaa

SEQ ID NO: 2168465 - RNA, 19 nt, Human
gauuauucauuuaaaauga

SEQ ID NO: 2168466 - RNA, 14 nt, Human
gauuauucaguguc

SEQ ID NO: 2168467 - RNA, 13 nt, Human
gauuauucagugu

SEQ ID NO: 2168468 - RNA, 21 nt, Human
gauuauaguugugggugggag

SEQ ID NO: 2168469 - RNA, 20 nt, Human
gauuauaggcaccuaccacc

SEQ ID NO: 2168470 - RNA, 14 nt, Human
gauuauggagcuuu

SEQ ID NO: 2168471 - RNA, 20 nt, Human
gauuauagauuggagccacc

SEQ ID NO: 2168472 - RNA, 14 nt, Human
gauuauauuaugaa

SEQ ID NO: 2168473 - RNA, 21 nt, Human
gauguaggguaaggugccuuc

SEQ ID NO: 2168474 - RNA, 20 nt, Human
gauguaggguaaggugccuu

SEQ ID NO: 2168475 - RNA, 19 nt, Human
gauguaggguaaggugccu

SEQ ID NO: 2168476 - RNA, 17 nt, Human
gauguaggcauucugga

SEQ ID NO: 2168477 - RNA, 18 nt, Human
gauguauccaugggggca

SEQ ID NO: 2168478 - RNA, 20 nt, Human
gauguauguugaagccuuug

SEQ ID NO: 2168479 - RNA, 18 nt, Human
gauguauuuuuguacccu

SEQ ID NO: 2168480 - RNA, 15 nt, Human
gaugucaauuucugu

SEQ ID NO: 2168481 - RNA, 18 nt, Human
gaugucaauuucuguguu

SEQ ID NO: 2168482 - RNA, 13 nt, Human
gaugucacagggc

SEQ ID NO: 2168483 - RNA, 15 nt, Human
gaugucacagggcca

SEQ ID NO: 2168484 - RNA, 19 nt, Human
gauguaugcagcuaucugg

SEQ ID NO: 2168485 - RNA, 21 nt, Human
gauguauguugaagccuuugu

SEQ ID NO: 2168486 - RNA, 18 nt, Human
gauucuccugccucagcc

SEQ ID NO: 2168487 - RNA, 16 nt, Human
gauucugcaguaaauc

SEQ ID NO: 2168488 - RNA, 15 nt, Human
gauucugcaguaaau

SEQ ID NO: 2168489 - RNA, 14 nt, Human
gauucugagagcug

SEQ ID NO: 2168490 - RNA, 15 nt, Human
gauucuccugccuca

SEQ ID NO: 2168491 - RNA, 17 nt, Human
gauucuccugccucagc

SEQ ID NO: 2168492 - RNA, 21 nt, Human
gauuuaguguuuuuaccucug

SEQ ID NO: 2168493 - RNA, 22 nt, Human
gauuuagugaaagcuagagaua

SEQ ID NO: 2168494 - RNA, 20 nt, Human
gauuuaggagaagccaggaa

SEQ ID NO: 2168495 - RNA, 15 nt, Human
gauuuagaacuguau

SEQ ID NO: 2168496 - RNA, 18 nt, Human
gauuuauaaaugcuauuu

SEQ ID NO: 2168497 - RNA, 13 nt, Human
gauuuauaaaugc

SEQ ID NO: 2168498 - RNA, 22 nt, Human
gauuuaguguuuuuaccucugu

SEQ ID NO: 2168499 - RNA, 22 nt, Human
gauuuacaguuucaaaaacugu

SEQ ID NO: 2168500 - RNA, 20 nt, Human
gauuuaccuguuuucgcacc

SEQ ID NO: 2168501 - RNA, 15 nt, Human
gauuuacgcucauug

SEQ ID NO: 2168502 - RNA, 16 nt, Human
gauuuaccacuugugu

SEQ ID NO: 2168503 - RNA, 17 nt, Human
gauuuauaguuuguaca

SEQ ID NO: 2168504 - RNA, 20 nt, Human
gauuuauaguuuguacaugc

SEQ ID NO: 2168505 - RNA, 21 nt, Human
gauuuauaguuuguacaugca

SEQ ID NO: 2168506 - RNA, 12 nt, Human
gauuuaucaaau

SEQ ID NO: 2168507 - RNA, 13 nt, Human
gauuuaucaaauc

SEQ ID NO: 2168508 - RNA, 14 nt, Human
gauuuaucaaauca

SEQ ID NO: 2168509 - RNA, 15 nt, Human
gauuuaucaaaucag

SEQ ID NO: 2168510 - RNA, 20 nt, Human
gauuuuuuacagcugccugc

SEQ ID NO: 2168511 - RNA, 15 nt, Human
gauucugggaggaag

SEQ ID NO: 2168512 - RNA, 22 nt, Human
gauucuggauaaagccacugaa

SEQ ID NO: 2168513 - RNA, 22 nt, Human
gauucugggaggaagcagguug

SEQ ID NO: 2168514 - RNA, 17 nt, Human
gauucugguuccagggu

SEQ ID NO: 2168515 - RNA, 16 nt, Human
gauucuucaaaagcau

SEQ ID NO: 2168516 - RNA, 22 nt, Human
gauucugguuccagggucccuc

SEQ ID NO: 2168517 - RNA, 21 nt, Human
gauucugcaguaaaucuuuua

SEQ ID NO: 2168518 - RNA, 19 nt, Human
gauucugcaguaaaucuuu

SEQ ID NO: 2168519 - RNA, 18 nt, Human
gauucugcaguaaaucuu

SEQ ID NO: 2168520 - RNA, 13 nt, Human
gauucugcuuuua

SEQ ID NO: 2168521 - RNA, 17 nt, Human
gauucuggauaaagcca

SEQ ID NO: 2168522 - RNA, 19 nt, Human
gauucuggauaaagccacu

SEQ ID NO: 2168523 - RNA, 18 nt, Human
gauucuuccucccucccu

SEQ ID NO: 2168524 - RNA, 17 nt, Human
gauucuuccucccuccc

SEQ ID NO: 2168525 - RNA, 16 nt, Human
gauuuacaguuucaaa

SEQ ID NO: 2168526 - RNA, 14 nt, Human
gauucuuccaucug

SEQ ID NO: 2168527 - RNA, 23 nt, Human
gauucuuauguagcaggaaauaa

SEQ ID NO: 2168528 - RNA, 15 nt, Human
gauuuaccacuugug

SEQ ID NO: 2168529 - RNA, 21 nt, Human
gaucugcucagcccuggaggu

SEQ ID NO: 2168530 - RNA, 17 nt, Human
gaucugcucagcccugg

SEQ ID NO: 2168531 - RNA, 18 nt, Human
gaucugcucagcccugga

SEQ ID NO: 2168532 - RNA, 19 nt, Human
gaucugcucagcccuggag

SEQ ID NO: 2168533 - RNA, 20 nt, Human
gaucugcucagcccuggagg

SEQ ID NO: 2168534 - RNA, 13 nt, Human
gaucugcucagcc

SEQ ID NO: 2168535 - RNA, 14 nt, Human
gaucugcucagccc

SEQ ID NO: 2168536 - RNA, 15 nt, Human
gaucugcucagcccu

SEQ ID NO: 2168537 - RNA, 16 nt, Human
gaucugcucagcccug

SEQ ID NO: 2168538 - RNA, 19 nt, Human
gaugaggugcugggaggga

SEQ ID NO: 2168539 - RNA, 20 nt, Human
gaugaguccccugugagauu

SEQ ID NO: 2168540 - RNA, 17 nt, Human
gaugaggugcugggagg

SEQ ID NO: 2168541 - RNA, 16 nt, Human
gaugaggugcugggag

SEQ ID NO: 2168542 - RNA, 14 nt, Human
gaugaggugcuggg

SEQ ID NO: 2168543 - RNA, 14 nt, Human
gaugaggggaggaa

SEQ ID NO: 2168544 - RNA, 16 nt, Human
gaugagugagcaugcc

SEQ ID NO: 2168545 - RNA, 18 nt, Human
gaugauacaagauuagaa

SEQ ID NO: 2168546 - RNA, 15 nt, Human
gaugaucuaggaaga

SEQ ID NO: 2168547 - RNA, 21 nt, Human
gaugaucuaggaagacuuugg

SEQ ID NO: 2168548 - RNA, 16 nt, Human
gaugaucuuuaaaaua

SEQ ID NO: 2168549 - RNA, 12 nt, Human
gauggacagacu

SEQ ID NO: 2168550 - RNA, 16 nt, Human
gaugcuggaugcuccu

SEQ ID NO: 2168551 - RNA, 14 nt, Human
gaugcuggaugcuc

SEQ ID NO: 2168552 - RNA, 16 nt, Human
gaugcuggagagguua

SEQ ID NO: 2168553 - RNA, 14 nt, Human
gaugcuggagaggu

SEQ ID NO: 2168554 - RNA, 15 nt, Human
gaugcuggagagguu

SEQ ID NO: 2168555 - RNA, 16 nt, Human
gaugcuggagaagaga

SEQ ID NO: 2168556 - RNA, 19 nt, Human
gaugcuggagaagagagga

SEQ ID NO: 2168557 - RNA, 20 nt, Human
gaugcuggagaagagaggag

SEQ ID NO: 2168558 - RNA, 21 nt, Human
gaugcuggagaagagaggaga

SEQ ID NO: 2168559 - RNA, 22 nt, Human
gauggagacuccaugagaagcc

SEQ ID NO: 2168560 - RNA, 16 nt, Human
gauggagagaggggaa

SEQ ID NO: 2168561 - RNA, 22 nt, Human
gauggagcagagcaagucugca

SEQ ID NO: 2168562 - RNA, 15 nt, Human
gauggagagagggga

SEQ ID NO: 2168563 - RNA, 14 nt, Human
gauggagagagggg

SEQ ID NO: 2168564 - RNA, 22 nt, Human
gauggagacugguccugugugc

SEQ ID NO: 2168565 - RNA, 23 nt, Human
gauggagacugguccugugugca

SEQ ID NO: 2168566 - RNA, 16 nt, Human
gaugcugccugaguca

SEQ ID NO: 2168567 - RNA, 14 nt, Human
gaugcugccugagu

SEQ ID NO: 2168568 - RNA, 11 nt, Human
gaugcugcuuu

SEQ ID NO: 2168569 - RNA, 12 nt, Human
gaugcugcuuuc

SEQ ID NO: 2168570 - RNA, 15 nt, Human
gaugcugcuuucccc

SEQ ID NO: 2168571 - RNA, 14 nt, Human
gaugcuggagaaga

SEQ ID NO: 2168572 - RNA, 23 nt, Human
gaugcugccagggcgccaucgcc

SEQ ID NO: 2168573 - RNA, 12 nt, Human
gaugcugccccu

SEQ ID NO: 2168574 - RNA, 12 nt, Human
gaugcugccuga

SEQ ID NO: 2168575 - RNA, 13 nt, Human
gaugcugccccuc

SEQ ID NO: 2168576 - RNA, 18 nt, Human
gaugauacauccaaagca

SEQ ID NO: 2168577 - RNA, 21 nt, Human
gaugauacaagauuagaagcu

SEQ ID NO: 2168578 - RNA, 15 nt, Human
gaugaucuacucaga

SEQ ID NO: 2168579 - RNA, 13 nt, Human
gaugcugauguuc

SEQ ID NO: 2168580 - RNA, 21 nt, Human
gaugaucuacucagaaauuuu

SEQ ID NO: 2168581 - RNA, 15 nt, Human
gaugcugauguucag

SEQ ID NO: 2168582 - RNA, 16 nt, Human
gaugcugauguucagu

SEQ ID NO: 2168583 - RNA, 17 nt, Human
gaugcugauguucagug

SEQ ID NO: 2168584 - RNA, 18 nt, Human
gaugcugauguucagugu

SEQ ID NO: 2168585 - RNA, 19 nt, Human
gaugcugauguucagugua

SEQ ID NO: 2168586 - RNA, 18 nt, Human
gauguaaaagacuuuuuu

SEQ ID NO: 2168587 - RNA, 16 nt, Human
gauguaaacagugccu

SEQ ID NO: 2168588 - RNA, 22 nt, Human
gauggagcgcaccugcccccug

SEQ ID NO: 2168589 - RNA, 22 nt, Human
gaugguucccuugaugaagaag

SEQ ID NO: 2168590 - RNA, 16 nt, Human
gauggagcgcaccugc

SEQ ID NO: 2168591 - RNA, 22 nt, Human
gauggagcccaggcgggagcgg

SEQ ID NO: 2168592 - RNA, 17 nt, Human
gaugguucguucuguuu

SEQ ID NO: 2168593 - RNA, 20 nt, Human
gauggagccagcucugcauu

SEQ ID NO: 2168594 - RNA, 14 nt, Human
gauggagcccaggc

SEQ ID NO: 2168595 - RNA, 17 nt, Human
gauggagcccaggcggg

SEQ ID NO: 2168596 - RNA, 19 nt, Human
gauggagcccaggcgggag

SEQ ID NO: 2168597 - RNA, 21 nt, Human
gauguaaacagugccugcuga

SEQ ID NO: 2168598 - RNA, 20 nt, Human
gauguaaacagugccugcug

SEQ ID NO: 2168599 - RNA, 19 nt, Human
gauguaaacagugccugcu

SEQ ID NO: 2168600 - RNA, 14 nt, Human
gauguagauuuauu

SEQ ID NO: 2168601 - RNA, 17 nt, Human
gauguagauuuauuuca

SEQ ID NO: 2168602 - RNA, 15 nt, Human
gauguagauuuauuu

SEQ ID NO: 2168603 - RNA, 18 nt, Human
gauguagccaugaccuua

SEQ ID NO: 2168604 - RNA, 18 nt, Human
gauguagaggagaaacug

SEQ ID NO: 2168605 - RNA, 17 nt, Human
gauguagaggagaaacu

SEQ ID NO: 2168606 - RNA, 17 nt, Human
gcacucacccaugugcc

SEQ ID NO: 2168607 - RNA, 17 nt, Human
gcacucacagaccugga

SEQ ID NO: 2168608 - RNA, 19 nt, Human
gcacucacagaccuggagc

SEQ ID NO: 2168609 - RNA, 16 nt, Human
gcacucacagaccugg

SEQ ID NO: 2168610 - RNA, 19 nt, Human
gcacuccucgguacuccca

SEQ ID NO: 2168611 - RNA, 20 nt, Human
gcacuccucgguacucccau

SEQ ID NO: 2168612 - RNA, 21 nt, Human
gcacucgggaaaccuggggcu

SEQ ID NO: 2168613 - RNA, 18 nt, Human
gcacuuggacucuugcuc

SEQ ID NO: 2168614 - RNA, 14 nt, Human
gcacuugcaucugu

SEQ ID NO: 2168615 - RNA, 14 nt, Human
gcacuccggaggua

SEQ ID NO: 2168616 - RNA, 17 nt, Human
gcacuccggccugauga

SEQ ID NO: 2168617 - RNA, 23 nt, Human
gcacucccuugguggcaagagcc

SEQ ID NO: 2168618 - RNA, 16 nt, Human
gcacuccccugcuggg

SEQ ID NO: 2168619 - RNA, 22 nt, Human
gcacuccccugcuggguguggc

SEQ ID NO: 2168620 - RNA, 13 nt, Human
gcacucagaagac

SEQ ID NO: 2168621 - RNA, 16 nt, Human
gcacucagaagacacu

SEQ ID NO: 2168622 - RNA, 17 nt, Human
gcacucagaagacacug

SEQ ID NO: 2168623 - RNA, 20 nt, Human
gcacucacagaccuggagcc

SEQ ID NO: 2168624 - RNA, 19 nt, Human
gcacucacccaugugccaa

SEQ ID NO: 2168625 - RNA, 20 nt, Human
gcacucacccaugugccaag

SEQ ID NO: 2168626 - RNA, 23 nt, Human
gcacucacccaugugccaaggug

SEQ ID NO: 2168627 - RNA, 17 nt, Human
gcacuccccugcugggu

SEQ ID NO: 2168628 - RNA, 21 nt, Human
gcaccuauagucccagcuacu

SEQ ID NO: 2168629 - RNA, 21 nt, Human
gcaccucacagaaaugagauc

SEQ ID NO: 2168630 - RNA, 18 nt, Human
gcaccuauagucccagcu

SEQ ID NO: 2168631 - RNA, 17 nt, Human
gcaccuauagucccagc

SEQ ID NO: 2168632 - RNA, 23 nt, Human
gcaccuacuacaucgcccuccac

SEQ ID NO: 2168633 - RNA, 21 nt, Human
gcaccuacuacaucgcccucc

SEQ ID NO: 2168634 - RNA, 14 nt, Human
gcaccuacuuacau

SEQ ID NO: 2168635 - RNA, 17 nt, Human
gcaccuaccaucaggga

SEQ ID NO: 2168636 - RNA, 19 nt, Human
gcaccuaccaucagggaca

SEQ ID NO: 2168637 - RNA, 20 nt, Human
gcaccuaccaucagggacag

SEQ ID NO: 2168638 - RNA, 23 nt, Human
gcaccuaccaucagggacaggau

SEQ ID NO: 2168639 - RNA, 16 nt, Human
gcaccuaguccaguga

SEQ ID NO: 2168640 - RNA, 23 nt, Human
gcaccgggccacagagaaaguac

SEQ ID NO: 2168641 - RNA, 13 nt, Human
gcacaucucugcu

SEQ ID NO: 2168642 - RNA, 21 nt, Human
gcaccuaccaccacgcccggc

SEQ ID NO: 2168643 - RNA, 22 nt, Human
gcaccuaccaccacgcccggcu

SEQ ID NO: 2168644 - RNA, 15 nt, Human
gcaccuaccaucagg

SEQ ID NO: 2168645 - RNA, 17 nt, Human
gcacauccuaugcaaua

SEQ ID NO: 2168646 - RNA, 20 nt, Human
gcacauccuaugcaauauau

SEQ ID NO: 2168647 - RNA, 14 nt, Human
gcaccgggccacag

SEQ ID NO: 2168648 - RNA, 23 nt, Human
gcacaucagcacgauuucuguuu

SEQ ID NO: 2168649 - RNA, 22 nt, Human
gcacaucagcacgauuucuguu

SEQ ID NO: 2168650 - RNA, 15 nt, Human
gauuuuuuuuucaua

SEQ ID NO: 2168651 - RNA, 14 nt, Human
gauuuuuuucugag

SEQ ID NO: 2168652 - RNA, 19 nt, Human
gauuuuuugcauuccugac

SEQ ID NO: 2168653 - RNA, 13 nt, Human
gcaagucaggguu

SEQ ID NO: 2168654 - RNA, 12 nt, Human
gcaagucaggac

SEQ ID NO: 2168655 - RNA, 24 nt, Human
gcaagucagaggauggccaguguc

SEQ ID NO: 2168656 - RNA, 15 nt, Human
gcaagucagaggaug

SEQ ID NO: 2168657 - RNA, 19 nt, Human
gcaagucagaggauggcca

SEQ ID NO: 2168658 - RNA, 21 nt, Human
gcaagucagaggauggccagu

SEQ ID NO: 2168659 - RNA, 23 nt, Human
gcaagucagaggauggccagugu

SEQ ID NO: 2168660 - RNA, 22 nt, Human
gcaagucccugacucucuguga

SEQ ID NO: 2168661 - RNA, 20 nt, Human
gcaagucccugacucucugu

SEQ ID NO: 2168662 - RNA, 17 nt, Human
gcaagucauggcugugc

SEQ ID NO: 2168663 - RNA, 17 nt, Human
gcaagugucugugugca

SEQ ID NO: 2168664 - RNA, 16 nt, Human
gcaagugucugugugc

SEQ ID NO: 2168665 - RNA, 15 nt, Human
gcaagugucugugug

SEQ ID NO: 2168666 - RNA, 21 nt, Human
gcaaguguaugcacgugugca

SEQ ID NO: 2168667 - RNA, 19 nt, Human
gcaagugauugggacagag

SEQ ID NO: 2168668 - RNA, 20 nt, Human
gcaagugauugggacagagg

SEQ ID NO: 2168669 - RNA, 23 nt, Human
gcaagugugugcacaugugugcg

SEQ ID NO: 2168670 - RNA, 13 nt, Human
gcaagugugugca

SEQ ID NO: 2168671 - RNA, 12 nt, Human
gcaagugugugc

SEQ ID NO: 2168672 - RNA, 23 nt, Human
gcaaguguguaugugcgugugug

SEQ ID NO: 2168673 - RNA, 22 nt, Human
gcaagugugugcaugugugcga

SEQ ID NO: 2168674 - RNA, 21 nt, Human
gcaagugugugcaugugugcg

SEQ ID NO: 2168675 - RNA, 19 nt, Human
gcaagugugugcaugugug

SEQ ID NO: 2168676 - RNA, 17 nt, Human
gcaaguucuagagaaga

SEQ ID NO: 2168677 - RNA, 22 nt, Human
gcaauagucaaauugugugaaa

SEQ ID NO: 2168678 - RNA, 20 nt, Human
gcaauaguguguucugauua

SEQ ID NO: 2168679 - RNA, 17 nt, Human
gcaauaguguguucuga

SEQ ID NO: 2168680 - RNA, 14 nt, Human
gcaauauagaaaca

SEQ ID NO: 2168681 - RNA, 13 nt, Human
gcaauaguguguu

SEQ ID NO: 2168682 - RNA, 17 nt, Human
gcaauagugggcccucc

SEQ ID NO: 2168683 - RNA, 20 nt, Human
gcaaguucuagagaagaggc

SEQ ID NO: 2168684 - RNA, 17 nt, Human
gcaauauagaaacacga

SEQ ID NO: 2168685 - RNA, 17 nt, Human
gcaauauaucuaaauug

SEQ ID NO: 2168686 - RNA, 23 nt, Human
gcaauauaucuaaauugaauaau

SEQ ID NO: 2168687 - RNA, 18 nt, Human
gcaagucagaauagaaau

SEQ ID NO: 2168688 - RNA, 20 nt, Human
gcaaguauuagaauaccaca

SEQ ID NO: 2168689 - RNA, 22 nt, Human
gcacaagcugcacccucaggca

SEQ ID NO: 2168690 - RNA, 21 nt, Human
gcaauauuaaugccuuuaaag

SEQ ID NO: 2168691 - RNA, 14 nt, Human
gcaauauguaaaua

SEQ ID NO: 2168692 - RNA, 19 nt, Human
gcacaaggcugaccaagag

SEQ ID NO: 2168693 - RNA, 17 nt, Human
gcacaauaaaaauguuu

SEQ ID NO: 2168694 - RNA, 16 nt, Human
gcacaauaaaaauguu

SEQ ID NO: 2168695 - RNA, 14 nt, Human
gcacaccgggcacu

SEQ ID NO: 2168696 - RNA, 17 nt, Human
gcacacccacucagcuc

SEQ ID NO: 2168697 - RNA, 15 nt, Human
gcacacccagguuug

SEQ ID NO: 2168698 - RNA, 18 nt, Human
gcacacccacucagcucc

SEQ ID NO: 2168699 - RNA, 19 nt, Human
gcacaauauugaacuuuuu

SEQ ID NO: 2168700 - RNA, 20 nt, Human
gcacaauauugaacuuuuuu

SEQ ID NO: 2168701 - RNA, 14 nt, Human
gcacacauuuuuua

SEQ ID NO: 2168702 - RNA, 15 nt, Human
gcacaauaguaaccu

SEQ ID NO: 2168703 - RNA, 20 nt, Human
gcacaauaguaaccugggua

SEQ ID NO: 2168704 - RNA, 17 nt, Human
gcacaauauugaacuuu

SEQ ID NO: 2168705 - RNA, 21 nt, Human
gcacauagcuaucaagugugc

SEQ ID NO: 2168706 - RNA, 15 nt, Human
gcacaguucaugguu

SEQ ID NO: 2168707 - RNA, 23 nt, Human
gcacaguuuucuggcuggagccu

SEQ ID NO: 2168708 - RNA, 23 nt, Human
gcacaguuuucugagaaagacua

SEQ ID NO: 2168709 - RNA, 22 nt, Human
gcacaguuuucugagaaagacu

SEQ ID NO: 2168710 - RNA, 20 nt, Human
gcacaguuuucugagaaaga

SEQ ID NO: 2168711 - RNA, 14 nt, Human
gcacagugccugca

SEQ ID NO: 2168712 - RNA, 16 nt, Human
gcacagugguggcagg

SEQ ID NO: 2168713 - RNA, 17 nt, Human
gcacagugguggcaggg

SEQ ID NO: 2168714 - RNA, 18 nt, Human
gcacagugguggcagggc

SEQ ID NO: 2168715 - RNA, 22 nt, Human
gcacagugguggcagggccuag

SEQ ID NO: 2168716 - RNA, 15 nt, Human
gcacagugucugggc

SEQ ID NO: 2168717 - RNA, 17 nt, Human
gcacagugucugggcug

SEQ ID NO: 2168718 - RNA, 18 nt, Human
gcacagugucugggcuga

SEQ ID NO: 2168719 - RNA, 19 nt, Human
gcacagugucugggcugac

SEQ ID NO: 2168720 - RNA, 21 nt, Human
gcacagugucugggcugacug

SEQ ID NO: 2168721 - RNA, 23 nt, Human
gcacagugucugggcugacuggg

SEQ ID NO: 2168722 - RNA, 17 nt, Human
gcacaguguuaaaugaa

SEQ ID NO: 2168723 - RNA, 20 nt, Human
gcacaguguuaaaugaaauu

SEQ ID NO: 2168724 - RNA, 19 nt, Human
gcacagugcaucucagccc

SEQ ID NO: 2168725 - RNA, 20 nt, Human
gcacagugcaucucagccca

SEQ ID NO: 2168726 - RNA, 21 nt, Human
gcacagugcaucucagcccac

SEQ ID NO: 2168727 - RNA, 21 nt, Human
cuuuuagggagagucauauuu

SEQ ID NO: 2168728 - RNA, 13 nt, Human
cuuuuauugucag

SEQ ID NO: 2168729 - RNA, 15 nt, Human
cuuuucaaaacauuu

SEQ ID NO: 2168730 - RNA, 22 nt, Human
cuuuucaaauagggucuaacuc

SEQ ID NO: 2168731 - RNA, 23 nt, Human
cuuuucaacuuggcuuccuuucu

SEQ ID NO: 2168732 - RNA, 17 nt, Human
cuuuuauuucuuaaaca

SEQ ID NO: 2168733 - RNA, 19 nt, Human
cuuuuauuuagcaccaggg

SEQ ID NO: 2168734 - RNA, 21 nt, Human
cuuuuauuguauaaacuauca

SEQ ID NO: 2168735 - RNA, 18 nt, Human
cuuuuauaaacuuuaccu

SEQ ID NO: 2168736 - RNA, 16 nt, Human
cuuuuauaaacuuuac

SEQ ID NO: 2168737 - RNA, 13 nt, Human
cuuuuagccuagu

SEQ ID NO: 2168738 - RNA, 22 nt, Human
cuuuuagcucaaacguggcuuu

SEQ ID NO: 2168739 - RNA, 16 nt, Human
cuuuuaggccaaaaaa

SEQ ID NO: 2168740 - RNA, 23 nt, Human
cuuuuagaaauacugcaagaaaa

SEQ ID NO: 2168741 - RNA, 21 nt, Human
cuuuuagaaauacugcaagaa

SEQ ID NO: 2168742 - RNA, 19 nt, Human
cuuuuagaaauacugcaag

SEQ ID NO: 2168743 - RNA, 15 nt, Human
cuuuuagaaauacug

SEQ ID NO: 2168744 - RNA, 18 nt, Human
cuuugguggcuuugcauu

SEQ ID NO: 2168745 - RNA, 14 nt, Human
cuuugguggcuuug

SEQ ID NO: 2168746 - RNA, 17 nt, Human
cuuugguggcuuugcau

SEQ ID NO: 2168747 - RNA, 18 nt, Human
cuuuuaggccaaaaaaau

SEQ ID NO: 2168748 - RNA, 17 nt, Human
cuuuuaggacccuuccc

SEQ ID NO: 2168749 - RNA, 16 nt, Human
cuuuuagggagaguca

SEQ ID NO: 2168750 - RNA, 20 nt, Human
cuuuuagggagagucauauu

SEQ ID NO: 2168751 - RNA, 15 nt, Human
cuuuuauaaacuuua

SEQ ID NO: 2168752 - RNA, 20 nt, Human
cuuuggggcuuuuacaccag

SEQ ID NO: 2168753 - RNA, 21 nt, Human
cuuuggggcuuuuacaccagu

SEQ ID NO: 2168754 - RNA, 22 nt, Human
cuuuggguaccuauuuucauug

SEQ ID NO: 2168755 - RNA, 18 nt, Human
cuuuggguaccuauuuuc

SEQ ID NO: 2168756 - RNA, 21 nt, Human
cuuuggguaccuauuuucauu

SEQ ID NO: 2168757 - RNA, 21 nt, Human
cuuuggggucagccagggcca

SEQ ID NO: 2168758 - RNA, 17 nt, Human
cuuuggggucagccagg

SEQ ID NO: 2168759 - RNA, 17 nt, Human
cuuugggguuuuuuaau

SEQ ID NO: 2168760 - RNA, 22 nt, Human
cuuugguacauggccaguguga

SEQ ID NO: 2168761 - RNA, 17 nt, Human
cuuuggguuaagcauua

SEQ ID NO: 2168762 - RNA, 20 nt, Human
cuuuggguuaagcauuacca

SEQ ID NO: 2168763 - RNA, 22 nt, Human
cuuuggguuaagcauuaccacu

SEQ ID NO: 2168764 - RNA, 16 nt, Human
cuuuggucuacacugu

SEQ ID NO: 2168765 - RNA, 20 nt, Human
cuuuuacugaagccuuucuu

SEQ ID NO: 2168766 - RNA, 17 nt, Human
cuuugguggagauaaag

SEQ ID NO: 2168767 - RNA, 14 nt, Human
cuuugguagaaaag

SEQ ID NO: 2168768 - RNA, 20 nt, Human
cuuuggucuacacugugcug

SEQ ID NO: 2168769 - RNA, 13 nt, Human
cuuugagugaucc

SEQ ID NO: 2168770 - RNA, 22 nt, Human
cuuugagguggaagagggcugc

SEQ ID NO: 2168771 - RNA, 21 nt, Human
cuuugagugucuuaauuaaaa

SEQ ID NO: 2168772 - RNA, 22 nt, Human
cuuugaguuuccucaggcugcu

SEQ ID NO: 2168773 - RNA, 19 nt, Human
cuuugaguuuccucaggcu

SEQ ID NO: 2168774 - RNA, 18 nt, Human
cuuugaguuuccucaggc

SEQ ID NO: 2168775 - RNA, 17 nt, Human
cuuugaguuuccucagg

SEQ ID NO: 2168776 - RNA, 16 nt, Human
cuuugaguuuccucag

SEQ ID NO: 2168777 - RNA, 21 nt, Human
cuuugagugcaguccugauca

SEQ ID NO: 2168778 - RNA, 14 nt, Human
cuuugauaaaauaa

SEQ ID NO: 2168779 - RNA, 17 nt, Human
cuuugauaaaauaaaug

SEQ ID NO: 2168780 - RNA, 18 nt, Human
cuuugauaaaauaaauga

SEQ ID NO: 2168781 - RNA, 13 nt, Human
cuuugauaauguu

SEQ ID NO: 2168782 - RNA, 14 nt, Human
cuuugauaauguua

SEQ ID NO: 2168783 - RNA, 15 nt, Human
cuuugauaauguuaa

SEQ ID NO: 2168784 - RNA, 16 nt, Human
cuuugauaauguuaaa

SEQ ID NO: 2168785 - RNA, 19 nt, Human
cuuugauguuaacacauuu

SEQ ID NO: 2168786 - RNA, 14 nt, Human
cuuugauucuccuu

SEQ ID NO: 2168787 - RNA, 21 nt, Human
cuuugauucauaguaacuucu

SEQ ID NO: 2168788 - RNA, 13 nt, Human
cuuugauucuccu

SEQ ID NO: 2168789 - RNA, 19 nt, Human
cuuugauucauaguaacuu

SEQ ID NO: 2168790 - RNA, 12 nt, Human
cuuugauucaua

SEQ ID NO: 2168791 - RNA, 17 nt, Human
cuuugauuaauccagaa

SEQ ID NO: 2168792 - RNA, 20 nt, Human
cuuugauuaaagacuccagu

SEQ ID NO: 2168793 - RNA, 16 nt, Human
cuuugauuaauccaga

SEQ ID NO: 2168794 - RNA, 23 nt, Human
cuuugauguuaacacauuuugua

SEQ ID NO: 2168795 - RNA, 20 nt, Human
cuuugauguuaacacauuuu

SEQ ID NO: 2168796 - RNA, 21 nt, Human
cuuugauguuaacacauuuug

SEQ ID NO: 2168797 - RNA, 16 nt, Human
cuuugagcuuaagaau

SEQ ID NO: 2168798 - RNA, 21 nt, Human
cuuugagcccacaaagccuua

SEQ ID NO: 2168799 - RNA, 19 nt, Human
cuuucucgauuuuaucuuu

SEQ ID NO: 2168800 - RNA, 14 nt, Human
cuuugacucaccug

SEQ ID NO: 2168801 - RNA, 20 nt, Human
cuuugagauagaagaacugc

SEQ ID NO: 2168802 - RNA, 14 nt, Human
cuuugagguggaag

SEQ ID NO: 2168803 - RNA, 13 nt, Human
cuuugaggaaacc

SEQ ID NO: 2168804 - RNA, 17 nt, Human
cuuugagguggaagagg

SEQ ID NO: 2168805 - RNA, 16 nt, Human
cuuugagguggaagag

SEQ ID NO: 2168806 - RNA, 13 nt, Human
cuuucucuacuuu

SEQ ID NO: 2168807 - RNA, 18 nt, Human
cuuugacgccaucccagc

SEQ ID NO: 2168808 - RNA, 19 nt, Human
cuuugacgccaucccagcc

SEQ ID NO: 2168809 - RNA, 21 nt, Human
cuuugacgccaucccagcccc

SEQ ID NO: 2168810 - RNA, 22 nt, Human
cuuugacgccaucccagcccca

SEQ ID NO: 2168811 - RNA, 23 nt, Human
cuuucuccuuuguacuuugugcu

SEQ ID NO: 2168812 - RNA, 18 nt, Human
cuuucucgauuuuaucuu

SEQ ID NO: 2168813 - RNA, 23 nt, Human
cuuucuccuuagucuucucauag

SEQ ID NO: 2168814 - RNA, 21 nt, Human
cuuucuccuuagucuucucau

SEQ ID NO: 2168815 - RNA, 20 nt, Human
cuuucuccuuagucuucuca

SEQ ID NO: 2168816 - RNA, 15 nt, Human
cuuucuccuuagucu

SEQ ID NO: 2168817 - RNA, 24 nt, Human
cuuucuccccugcccccaggacug

SEQ ID NO: 2168818 - RNA, 22 nt, Human
cuuucuccccugcccccaggac

SEQ ID NO: 2168819 - RNA, 23 nt, Human
cuuucuccccugcccccaggacu

SEQ ID NO: 2168820 - RNA, 20 nt, Human
cuuucucccaggccaggcuc

SEQ ID NO: 2168821 - RNA, 19 nt, Human
cuuucucccaggccaggcu

SEQ ID NO: 2168822 - RNA, 15 nt, Human
cuuucuauuccaaag

SEQ ID NO: 2168823 - RNA, 13 nt, Human
cuuucucccaggc

SEQ ID NO: 2168824 - RNA, 17 nt, Human
cuuucuauccucuguaa

SEQ ID NO: 2168825 - RNA, 21 nt, Human
cuuucucccaggccaggcucc

SEQ ID NO: 2168826 - RNA, 14 nt, Human
cuuucuccccugcc

SEQ ID NO: 2168827 - RNA, 18 nt, Human
cuuucuccccugccccca

SEQ ID NO: 2168828 - RNA, 19 nt, Human
cuuucuccccugcccccag

SEQ ID NO: 2168829 - RNA, 23 nt, Human
cuuucuagcuguugagcuguuuu

SEQ ID NO: 2168830 - RNA, 20 nt, Human
cuuucuaguccuauucuauu

SEQ ID NO: 2168831 - RNA, 21 nt, Human
cuuucuaguccuauucuauug

SEQ ID NO: 2168832 - RNA, 16 nt, Human
cuuucuaguggucuuu

SEQ ID NO: 2168833 - RNA, 18 nt, Human
cuuucuaguggucuuugu

SEQ ID NO: 2168834 - RNA, 19 nt, Human
cuuucuaguggucuuugua

SEQ ID NO: 2168835 - RNA, 20 nt, Human
cuuucuaguggucuuuguaa

SEQ ID NO: 2168836 - RNA, 14 nt, Human
cuuucuagcuguug

SEQ ID NO: 2168837 - RNA, 19 nt, Human
cuuucguuuguuuguuuca

SEQ ID NO: 2168838 - RNA, 18 nt, Human
cuuucuaaacaagauuuu

SEQ ID NO: 2168839 - RNA, 16 nt, Human
cuuucuauccucugua

SEQ ID NO: 2168840 - RNA, 12 nt, Human
cuuucuaucauu

SEQ ID NO: 2168841 - RNA, 14 nt, Human
cuuucuaucauuuu

SEQ ID NO: 2168842 - RNA, 18 nt, Human
cuuucuaguucagcugcc

SEQ ID NO: 2168843 - RNA, 21 nt, Human
cuuucuaguggucuuuguaag

SEQ ID NO: 2168844 - RNA, 22 nt, Human
cuuucuaguggucuuuguaaga

SEQ ID NO: 2168845 - RNA, 23 nt, Human
cuuucuaguggucuuuguaagag

SEQ ID NO: 2168846 - RNA, 17 nt, Human
cuuucuaguucagcugc

SEQ ID NO: 2168847 - RNA, 21 nt, Human
cuuuccuuuccccagcccagg

SEQ ID NO: 2168848 - RNA, 20 nt, Human
cuuucgacuugcauuuuugc

SEQ ID NO: 2168849 - RNA, 18 nt, Human
cuuuccuuuuuuaaaaau

SEQ ID NO: 2168850 - RNA, 17 nt, Human
cuuuccuuuuuuaaaaa

SEQ ID NO: 2168851 - RNA, 22 nt, Human
cuuucggggagaggcugaggac

SEQ ID NO: 2168852 - RNA, 15 nt, Human
cuuucguacauuggc

SEQ ID NO: 2168853 - RNA, 21 nt, Human
cuuucgacuugcauuuuugca

SEQ ID NO: 2168854 - RNA, 15 nt, Human
cuuucgcacagcagu

SEQ ID NO: 2168855 - RNA, 20 nt, Human
cuuucagauaacuguuauuu

SEQ ID NO: 2168856 - RNA, 19 nt, Human
cuuucagauacaugguugu

SEQ ID NO: 2168857 - RNA, 19 nt, Human
cuuuacaauguucauccca

SEQ ID NO: 2168858 - RNA, 23 nt, Human
cuuuaauuuuuuuaaccaaaggu

SEQ ID NO: 2168859 - RNA, 20 nt, Human
cuuuaauuuuuuuaaccaaa

SEQ ID NO: 2168860 - RNA, 21 nt, Human
cuuuaauuuuuuuaaccaaag

SEQ ID NO: 2168861 - RNA, 21 nt, Human
cuuuaaucuucaguuuuaucu

SEQ ID NO: 2168862 - RNA, 17 nt, Human
cuuuaaucuucaguuuu

SEQ ID NO: 2168863 - RNA, 22 nt, Human
cuuuaaucuucaguuuuaucuu

SEQ ID NO: 2168864 - RNA, 12 nt, Human
cuuuaauauaaa

SEQ ID NO: 2168865 - RNA, 17 nt, Human
cuuuaaguuucaggaua

SEQ ID NO: 2168866 - RNA, 17 nt, Human
cuuuaagugcacaacau

SEQ ID NO: 2168867 - RNA, 14 nt, Human
cuuuaaucuucagu

SEQ ID NO: 2168868 - RNA, 21 nt, Human
cuuuaauaucaucaguauuga

SEQ ID NO: 2168869 - RNA, 19 nt, Human
cuuuaauaucaucaguauu

SEQ ID NO: 2168870 - RNA, 18 nt, Human
cuuuaauaucaucaguau

SEQ ID NO: 2168871 - RNA, 16 nt, Human
cuugugcagaaaacau

SEQ ID NO: 2168872 - RNA, 22 nt, Human
cuuucacuauuuccuuuauaau

SEQ ID NO: 2168873 - RNA, 15 nt, Human
cuuuacacucaggcu

SEQ ID NO: 2168874 - RNA, 21 nt, Human
cuuucacuauuuccuuuauaa

SEQ ID NO: 2168875 - RNA, 16 nt, Human
cuuucacuauuuccuu

SEQ ID NO: 2168876 - RNA, 23 nt, Human
cuuuacacauucggcucccugga

SEQ ID NO: 2168877 - RNA, 22 nt, Human
cuuuacacaucagucacaaguu

SEQ ID NO: 2168878 - RNA, 21 nt, Human
cuuuacacauucggcucccug

SEQ ID NO: 2168879 - RNA, 20 nt, Human
cuuucaauaggaaaaacuga

SEQ ID NO: 2168880 - RNA, 21 nt, Human
cuuucaauaggaaaaacugau

SEQ ID NO: 2168881 - RNA, 22 nt, Human
cuuucaauaggaaaaacugauu

SEQ ID NO: 2168882 - RNA, 17 nt, Human
cuugugauuauuuauua

SEQ ID NO: 2168883 - RNA, 15 nt, Human
cuugugauuauuuau

SEQ ID NO: 2168884 - RNA, 17 nt, Human
cuugugaggaaagucau

SEQ ID NO: 2168885 - RNA, 19 nt, Human
cuugugaggaaagucauug

SEQ ID NO: 2168886 - RNA, 23 nt, Human
cuugugaggaaagucauuggcuu

SEQ ID NO: 2168887 - RNA, 13 nt, Human
cuugugaggaaag

SEQ ID NO: 2168888 - RNA, 16 nt, Human
cuugugaggaaaguca

SEQ ID NO: 2168889 - RNA, 22 nt, Human
cuuuaaaguaugaaucuaugcc

SEQ ID NO: 2168890 - RNA, 15 nt, Human
cuuuaaaucugugau

SEQ ID NO: 2168891 - RNA, 16 nt, Human
cuuguggacacagcuc

SEQ ID NO: 2168892 - RNA, 16 nt, Human
cuuuaaaguaugaauc

SEQ ID NO: 2168893 - RNA, 14 nt, Human
cuuguggacacagc

SEQ ID NO: 2168894 - RNA, 15 nt, Human
cuuguggacacagcu

SEQ ID NO: 2168895 - RNA, 13 nt, Human
cuuguggacacag

SEQ ID NO: 2168896 - RNA, 20 nt, Human
cuugugcacccucuauccca

SEQ ID NO: 2168897 - RNA, 23 nt, Human
cuugugcacccucuaucccaaua

SEQ ID NO: 2168898 - RNA, 14 nt, Human
cuugacagaacacu

SEQ ID NO: 2168899 - RNA, 22 nt, Human
cuugacaccugcugagaaaaca

SEQ ID NO: 2168900 - RNA, 16 nt, Human
cuugacagaacacugu

SEQ ID NO: 2168901 - RNA, 17 nt, Human
cuugacagaacacuguc

SEQ ID NO: 2168902 - RNA, 13 nt, Human
cuugacaccugcu

SEQ ID NO: 2168903 - RNA, 15 nt, Human
cuugacaccugcuga

SEQ ID NO: 2168904 - RNA, 23 nt, Human
cuugaaugaugccaugaggaaca

SEQ ID NO: 2168905 - RNA, 14 nt, Human
cuugacaacaucug

SEQ ID NO: 2168906 - RNA, 14 nt, Human
cuugaauccuaggg

SEQ ID NO: 2168907 - RNA, 18 nt, Human
cuugaauccuagggccug

SEQ ID NO: 2168908 - RNA, 14 nt, Human
cuugccuagggccu

SEQ ID NO: 2168909 - RNA, 23 nt, Human
cuugccgucuaccugaggggccu

SEQ ID NO: 2168910 - RNA, 12 nt, Human
cuugacagggca

SEQ ID NO: 2168911 - RNA, 20 nt, Human
cuugccgucuaccugagggg

SEQ ID NO: 2168912 - RNA, 20 nt, Human
cuugccuagggccuggucca

SEQ ID NO: 2168913 - RNA, 19 nt, Human
cuugccuagggccuggucc

SEQ ID NO: 2168914 - RNA, 18 nt, Human
cuugccuagggccugguc

SEQ ID NO: 2168915 - RNA, 16 nt, Human
cuugccuagggccugg

SEQ ID NO: 2168916 - RNA, 15 nt, Human
cuugccucaaugcca

SEQ ID NO: 2168917 - RNA, 19 nt, Human
cuugccucuguccccuucu

SEQ ID NO: 2168918 - RNA, 23 nt, Human
cuugccucuguccccuucucuca

SEQ ID NO: 2168919 - RNA, 13 nt, Human
cuugccucugugc

SEQ ID NO: 2168920 - RNA, 14 nt, Human
cuugccucugugcu

SEQ ID NO: 2168921 - RNA, 15 nt, Human
cuugccucugugcug

SEQ ID NO: 2168922 - RNA, 16 nt, Human
cuugccucugugcugu

SEQ ID NO: 2168923 - RNA, 19 nt, Human
cuugccucugugcugugug

SEQ ID NO: 2168924 - RNA, 20 nt, Human
cuugccucugugcugugugu

SEQ ID NO: 2168925 - RNA, 12 nt, Human
cuugccucuucc

SEQ ID NO: 2168926 - RNA, 13 nt, Human
cuugccucuuccu

SEQ ID NO: 2168927 - RNA, 16 nt, Human
cuugccucuuccuuga

SEQ ID NO: 2168928 - RNA, 18 nt, Human
cuugccucuuccuugaag

SEQ ID NO: 2168929 - RNA, 19 nt, Human
cuugcucuccccugcccug

SEQ ID NO: 2168930 - RNA, 17 nt, Human
cuugccugaacauccuu

SEQ ID NO: 2168931 - RNA, 17 nt, Human
cuugccucaaugccagu

SEQ ID NO: 2168932 - RNA, 18 nt, Human
cuugccugaacauccuuc

SEQ ID NO: 2168933 - RNA, 20 nt, Human
cuugccugaacauccuuccu

SEQ ID NO: 2168934 - RNA, 22 nt, Human
cuugccugaacauccuuccuuc

SEQ ID NO: 2168935 - RNA, 14 nt, Human
cuugccugauauaa

SEQ ID NO: 2168936 - RNA, 16 nt, Human
cuugccugcacaaacu

SEQ ID NO: 2168937 - RNA, 20 nt, Human
cuugcucgcuguaaaaucuu

SEQ ID NO: 2168938 - RNA, 14 nt, Human
cuugcucucccucu

SEQ ID NO: 2168939 - RNA, 20 nt, Human
cuugcucuccccugcccugc

SEQ ID NO: 2168940 - RNA, 15 nt, Human
cuugcucucccucuu

SEQ ID NO: 2168941 - RNA, 17 nt, Human
cuugcucucccucuucu

SEQ ID NO: 2168942 - RNA, 20 nt, Human
cuugcucucccucuucucaa

SEQ ID NO: 2168943 - RNA, 15 nt, Human
cuugcucucuggccu

SEQ ID NO: 2168944 - RNA, 12 nt, Human
cuugcucugcug

SEQ ID NO: 2168945 - RNA, 16 nt, Human
cuuggcaugccuucca

SEQ ID NO: 2168946 - RNA, 17 nt, Human
cuuggcaucagcuggcg

SEQ ID NO: 2168947 - RNA, 14 nt, Human
cuugcucugcaggc

SEQ ID NO: 2168948 - RNA, 16 nt, Human
cuuggcaucagcuggc

SEQ ID NO: 2168949 - RNA, 22 nt, Human
cuuggcaucacagggcagagcc

SEQ ID NO: 2168950 - RNA, 20 nt, Human
cuuggcaucacagggcagag

SEQ ID NO: 2168951 - RNA, 22 nt, Human
cuugcucucuggccuuuuccua

SEQ ID NO: 2168952 - RNA, 13 nt, Human
cuugcucugcacc

SEQ ID NO: 2168953 - RNA, 14 nt, Human
cuugcucugcaccc

SEQ ID NO: 2168954 - RNA, 17 nt, Human
cuuggccagaagggggc

SEQ ID NO: 2168955 - RNA, 15 nt, Human
cuuggccaagcaggg

SEQ ID NO: 2168956 - RNA, 17 nt, Human
cuuggccaagcagggag

SEQ ID NO: 2168957 - RNA, 20 nt, Human
cuuggcaugccuuccagcac

SEQ ID NO: 2168958 - RNA, 17 nt, Human
cuuggcaugccuuccag

SEQ ID NO: 2168959 - RNA, 22 nt, Human
cuuggccagaagggggccauga

SEQ ID NO: 2168960 - RNA, 18 nt, Human
cuuggccaguuaucccuu

SEQ ID NO: 2168961 - RNA, 18 nt, Human
cuucuucagagacuccug

SEQ ID NO: 2168962 - RNA, 22 nt, Human
cuucuucagagacuccugcagg

SEQ ID NO: 2168963 - RNA, 19 nt, Human
cuucugacgugccuuuugc

SEQ ID NO: 2168964 - RNA, 20 nt, Human
cuucugacgugccuuuugca

SEQ ID NO: 2168965 - RNA, 21 nt, Human
cuucugacugcugauucuccc

SEQ ID NO: 2168966 - RNA, 13 nt, Human
cuucugacugcug

SEQ ID NO: 2168967 - RNA, 22 nt, Human
cuucugacgugccuuuugcacc

SEQ ID NO: 2168968 - RNA, 13 nt, Human
cuucuuaaagagu

SEQ ID NO: 2168969 - RNA, 17 nt, Human
cuucuguuuucuguuuc

SEQ ID NO: 2168970 - RNA, 14 nt, Human
cuucuguuuucugu

SEQ ID NO: 2168971 - RNA, 15 nt, Human
cuucuguuuucuguu

SEQ ID NO: 2168972 - RNA, 14 nt, Human
cuucuuaaaguauu

SEQ ID NO: 2168973 - RNA, 19 nt, Human
cuucuuaaaguauucuucu

SEQ ID NO: 2168974 - RNA, 20 nt, Human
cuucugagcuauuucaucua

SEQ ID NO: 2168975 - RNA, 18 nt, Human
cuucugagcuauuucauc

SEQ ID NO: 2168976 - RNA, 20 nt, Human
cuucuucagagacuccugca

SEQ ID NO: 2168977 - RNA, 21 nt, Human
cuucuucagagacuccugcag

SEQ ID NO: 2168978 - RNA, 18 nt, Human
cuucugacuuaagugugc

SEQ ID NO: 2168979 - RNA, 17 nt, Human
cuucugagcuauuucau

SEQ ID NO: 2168980 - RNA, 16 nt, Human
cuucugagcuauuuca

SEQ ID NO: 2168981 - RNA, 15 nt, Human
cuucuguuuuauaau

SEQ ID NO: 2168982 - RNA, 20 nt, Human
cuucuguuuuauaauuuugu

SEQ ID NO: 2168983 - RNA, 10 nt, Human
cuugaaguug

SEQ ID NO: 2168984 - RNA, 22 nt, Human
cuugaaguuguuacuaacuaaa

SEQ ID NO: 2168985 - RNA, 22 nt, Human
cuugaauauccccucccaguca

SEQ ID NO: 2168986 - RNA, 20 nt, Human
cuugaaugaugccaugagga

SEQ ID NO: 2168987 - RNA, 12 nt, Human
cuuccaugugga

SEQ ID NO: 2168988 - RNA, 14 nt, Human
cuuccauguggaga

SEQ ID NO: 2168989 - RNA, 19 nt, Human
cuuccauggcccucauuaa

SEQ ID NO: 2168990 - RNA, 18 nt, Human
cuuccaugucggccucua

SEQ ID NO: 2168991 - RNA, 22 nt, Human
cuuccaugucggccucuaaccc

SEQ ID NO: 2168992 - RNA, 17 nt, Human
cuuccaugucgccucug

SEQ ID NO: 2168993 - RNA, 18 nt, Human
cuuccaugucgccucugc

SEQ ID NO: 2168994 - RNA, 19 nt, Human
cuuccaugucgccucugca

SEQ ID NO: 2168995 - RNA, 20 nt, Human
cuuccaugucgccucugcau

SEQ ID NO: 2168996 - RNA, 15 nt, Human
cuuccaugucgccuc

SEQ ID NO: 2168997 - RNA, 16 nt, Human
cuuccaugucgccucu

SEQ ID NO: 2168998 - RNA, 17 nt, Human
cuuccaugauucuauuu

SEQ ID NO: 2168999 - RNA, 14 nt, Human
cuuccaugauucua

SEQ ID NO: 2169000 - RNA, 16 nt, Human
cuuccauggcccucau

SEQ ID NO: 2169001 - RNA, 16 nt, Human
cuuccauggacuuugu

SEQ ID NO: 2169002 - RNA, 17 nt, Human
cuuccauggacuuuguu

SEQ ID NO: 2169003 - RNA, 18 nt, Human
cuuccagugaggcucugc

SEQ ID NO: 2169004 - RNA, 17 nt, Human
cuuccagugaggcucug

SEQ ID NO: 2169005 - RNA, 19 nt, Human
cuuccagugaggcucugcc

SEQ ID NO: 2169006 - RNA, 20 nt, Human
cuuccagugaggcucugccc

SEQ ID NO: 2169007 - RNA, 15 nt, Human
cuucacuguugaaaa

SEQ ID NO: 2169008 - RNA, 16 nt, Human
cuucacuguugaaaau

SEQ ID NO: 2169009 - RNA, 18 nt, Human
cuucacuguugaaaauua

SEQ ID NO: 2169010 - RNA, 19 nt, Human
cuucacuguugaaaauuau

SEQ ID NO: 2169011 - RNA, 21 nt, Human
cuucacuguccuccaagccag

SEQ ID NO: 2169012 - RNA, 18 nt, Human
cuucacuguccuccaagc

SEQ ID NO: 2169013 - RNA, 20 nt, Human
cuucaccugauucaacuaaa

SEQ ID NO: 2169014 - RNA, 18 nt, Human
cuucaccugauucaacua

SEQ ID NO: 2169015 - RNA, 21 nt, Human
cuucaccugauucaacuaaaa

SEQ ID NO: 2169016 - RNA, 17 nt, Human
cuucaccuuugucccca

SEQ ID NO: 2169017 - RNA, 20 nt, Human
cuucaccuuuguccccaccg

SEQ ID NO: 2169018 - RNA, 15 nt, Human
cuucaccucacugaa

SEQ ID NO: 2169019 - RNA, 14 nt, Human
cuucaccuuugucc

SEQ ID NO: 2169020 - RNA, 17 nt, Human
cuuauuagaacaggcaa

SEQ ID NO: 2169021 - RNA, 11 nt, Human
cuuauuagaac

SEQ ID NO: 2169022 - RNA, 18 nt, Human
cuuauugcccacgcugga

SEQ ID NO: 2169023 - RNA, 17 nt, Human
cuucagaagacacugca

SEQ ID NO: 2169024 - RNA, 19 nt, Human
cuucagacacaaaagucca

SEQ ID NO: 2169025 - RNA, 19 nt, Human
cuucagacagagaggacug

SEQ ID NO: 2169026 - RNA, 20 nt, Human
cuucagaaagugugcuuuau

SEQ ID NO: 2169027 - RNA, 16 nt, Human
cuucagaaugugauuu

SEQ ID NO: 2169028 - RNA, 11 nt, Human
cuucagacaua

SEQ ID NO: 2169029 - RNA, 21 nt, Human
cuucacuucugaccacacuuc

SEQ ID NO: 2169030 - RNA, 19 nt, Human
cuucacuucugaccacacu

SEQ ID NO: 2169031 - RNA, 17 nt, Human
cuucacuucugaccaca

SEQ ID NO: 2169032 - RNA, 16 nt, Human
cuucacuucugaccac

SEQ ID NO: 2169033 - RNA, 15 nt, Human
cuucacuucugacca

SEQ ID NO: 2169034 - RNA, 13 nt, Human
cuucacuucuccc

SEQ ID NO: 2169035 - RNA, 14 nt, Human
cuucacuucuccca

SEQ ID NO: 2169036 - RNA, 15 nt, Human
cuucacuuuaauucu

SEQ ID NO: 2169037 - RNA, 16 nt, Human
cuucacuuuaauucuc

SEQ ID NO: 2169038 - RNA, 21 nt, Human
cuucacuuuaauucucaugug

SEQ ID NO: 2169039 - RNA, 14 nt, Human
cuucagacuuugcu

SEQ ID NO: 2169040 - RNA, 15 nt, Human
cuucagacuuugcuu

SEQ ID NO: 2169041 - RNA, 20 nt, Human
cuucagacagagaggacugu

SEQ ID NO: 2169042 - RNA, 18 nt, Human
cuucagacuuugcuuccc

SEQ ID NO: 2169043 - RNA, 19 nt, Human
cuucagacuuugcuuccca

SEQ ID NO: 2169044 - RNA, 16 nt, Human
cuucagagacuccugc

SEQ ID NO: 2169045 - RNA, 21 nt, Human
cuucagagacuccugcaggca

SEQ ID NO: 2169046 - RNA, 22 nt, Human
cuucagagacuccugcaggcag

SEQ ID NO: 2169047 - RNA, 18 nt, Human
cuucagugggagaaaaca

SEQ ID NO: 2169048 - RNA, 17 nt, Human
cuucaucccacaaucuu

SEQ ID NO: 2169049 - RNA, 19 nt, Human
cuucauccggcagccugga

SEQ ID NO: 2169050 - RNA, 15 nt, Human
cuucauccuccucag

SEQ ID NO: 2169051 - RNA, 18 nt, Human
cuucaguuaagccuuugg

SEQ ID NO: 2169052 - RNA, 17 nt, Human
cuucaguuaugauuuuu

SEQ ID NO: 2169053 - RNA, 20 nt, Human
cuucaguguauggaaauaaa

SEQ ID NO: 2169054 - RNA, 13 nt, Human
cuucaucccucug

SEQ ID NO: 2169055 - RNA, 18 nt, Human
cuucaguggcagcugcuu

SEQ ID NO: 2169056 - RNA, 15 nt, Human
cuucagugggagaaa

SEQ ID NO: 2169057 - RNA, 13 nt, Human
cuucagugggaga

SEQ ID NO: 2169058 - RNA, 17 nt, Human
cuucaguguauggaaau

SEQ ID NO: 2169059 - RNA, 17 nt, Human
cuucaguuaagccuuug

SEQ ID NO: 2169060 - RNA, 23 nt, Human
cuucagagacuccugcaggcagc

SEQ ID NO: 2169061 - RNA, 24 nt, Human
cuucagagacuccugcaggcagcc

SEQ ID NO: 2169062 - RNA, 15 nt, Human
cuucaugcucagccc

SEQ ID NO: 2169063 - RNA, 16 nt, Human
cuucaugccagcuacu

SEQ ID NO: 2169064 - RNA, 14 nt, Human
cuucaugccagcua

SEQ ID NO: 2169065 - RNA, 15 nt, Human
cuucaugccagcuac

SEQ ID NO: 2169066 - RNA, 23 nt, Human
cuucaugcauggaaauucccuuc

SEQ ID NO: 2169067 - RNA, 21 nt, Human
cuucaugcauggaaauucccu

SEQ ID NO: 2169068 - RNA, 13 nt, Human
cuucauggauggg

SEQ ID NO: 2169069 - RNA, 19 nt, Human
cuucaugcucagcccugac

SEQ ID NO: 2169070 - RNA, 17 nt, Human
cuucaugcucagcccug

SEQ ID NO: 2169071 - RNA, 23 nt, Human
cuucaugcugucuacacuaagag

SEQ ID NO: 2169072 - RNA, 19 nt, Human
cuucaucguggggcucuca

SEQ ID NO: 2169073 - RNA, 17 nt, Human
cuucaucgaaucuacua

SEQ ID NO: 2169074 - RNA, 15 nt, Human
cuucaucgaaucuac

SEQ ID NO: 2169075 - RNA, 11 nt, Human
cuucauccucu

SEQ ID NO: 2169076 - RNA, 16 nt, Human
cuucauccuccucaga

SEQ ID NO: 2169077 - RNA, 22 nt, Human
cuucaucucccaaagugcuggg

SEQ ID NO: 2169078 - RNA, 13 nt, Human
cuucaucucccac

SEQ ID NO: 2169079 - RNA, 13 nt, Human
cuucaucuccagg

SEQ ID NO: 2169080 - RNA, 17 nt, Human
cuucaucuccagggagu

SEQ ID NO: 2169081 - RNA, 20 nt, Human
cuucaucucccaccuagcag

SEQ ID NO: 2169082 - RNA, 19 nt, Human
cuucaucucccaccuagca

SEQ ID NO: 2169083 - RNA, 21 nt, Human
cuuagcaggagaggagagcca

SEQ ID NO: 2169084 - RNA, 22 nt, Human
cuuagcaggagaggagagccag

SEQ ID NO: 2169085 - RNA, 18 nt, Human
cuuagcagcuuccagauu

SEQ ID NO: 2169086 - RNA, 13 nt, Human
cuuagcaggagag

SEQ ID NO: 2169087 - RNA, 14 nt, Human
cuuagcaggagagg

SEQ ID NO: 2169088 - RNA, 21 nt, Human
cuuagcagggaaacagcuaau

SEQ ID NO: 2169089 - RNA, 23 nt, Human
cuuagcagcuaucucucagugaa

SEQ ID NO: 2169090 - RNA, 22 nt, Human
cuuagcagcuaucucucaguga

SEQ ID NO: 2169091 - RNA, 15 nt, Human
cuuagcagcuuccag

SEQ ID NO: 2169092 - RNA, 16 nt, Human
cuuagcagcuuccaga

SEQ ID NO: 2169093 - RNA, 17 nt, Human
cuuagcagcuuccagau

SEQ ID NO: 2169094 - RNA, 18 nt, Human
cuuagcagggaaacagcu

SEQ ID NO: 2169095 - RNA, 12 nt, Human
cuuauugcccac

SEQ ID NO: 2169096 - RNA, 13 nt, Human
cuuauugcccacg

SEQ ID NO: 2169097 - RNA, 13 nt, Human
cuuauuaaaguuc

SEQ ID NO: 2169098 - RNA, 14 nt, Human
cuuauuaaaguucu

SEQ ID NO: 2169099 - RNA, 18 nt, Human
cuuauuaaaguucuguaa

SEQ ID NO: 2169100 - RNA, 19 nt, Human
cuuauguagcaggaaauaa

SEQ ID NO: 2169101 - RNA, 22 nt, Human
cuuaugggcuggguucuaccca

SEQ ID NO: 2169102 - RNA, 23 nt, Human
cuuaugggcuggguucuacccag

SEQ ID NO: 2169103 - RNA, 14 nt, Human
cuuauggaauugau

SEQ ID NO: 2169104 - RNA, 14 nt, Human
cuuaugggcugggu

SEQ ID NO: 2169105 - RNA, 21 nt, Human
cuuaugggcuggguucuaccc

SEQ ID NO: 2169106 - RNA, 23 nt, Human
cuuauggaauugauuugcauuga

SEQ ID NO: 2169107 - RNA, 21 nt, Human
cuuauggaauugauuugcauu

SEQ ID NO: 2169108 - RNA, 20 nt, Human
cuuauggaauugauuugcau

SEQ ID NO: 2169109 - RNA, 19 nt, Human
cuuauggaauugauuugca

SEQ ID NO: 2169110 - RNA, 17 nt, Human
cuuauggaauugauuug

SEQ ID NO: 2169111 - RNA, 16 nt, Human
cuuauggaauugauuu

SEQ ID NO: 2169112 - RNA, 13 nt, Human
cugugucuguguu

SEQ ID NO: 2169113 - RNA, 16 nt, Human
cuguucacuuuuccuc

SEQ ID NO: 2169114 - RNA, 18 nt, Human
cuguucacuuuuccuccc

SEQ ID NO: 2169115 - RNA, 17 nt, Human
cuguucacuuuuccucc

SEQ ID NO: 2169116 - RNA, 15 nt, Human
cuguucacucuacuu

SEQ ID NO: 2169117 - RNA, 16 nt, Human
cugugucuugcaaugg

SEQ ID NO: 2169118 - RNA, 19 nt, Human
cugugucuugcaauggcag

SEQ ID NO: 2169119 - RNA, 22 nt, Human
cuguucagcuacucccacuccc

SEQ ID NO: 2169120 - RNA, 13 nt, Human
cuguucagcucca

SEQ ID NO: 2169121 - RNA, 16 nt, Human
cugugucuguguuuua

SEQ ID NO: 2169122 - RNA, 14 nt, Human
cuguucagcuccag

SEQ ID NO: 2169123 - RNA, 17 nt, Human
cugugucucuuuucucu

SEQ ID NO: 2169124 - RNA, 14 nt, Human
cugugucuugcaau

SEQ ID NO: 2169125 - RNA, 14 nt, Human
cugugucucccuuc

SEQ ID NO: 2169126 - RNA, 19 nt, Human
cugugucucccuucauccu

SEQ ID NO: 2169127 - RNA, 13 nt, Human
cuguguagcuggg

SEQ ID NO: 2169128 - RNA, 21 nt, Human
cugugucagguggggcagcuu

SEQ ID NO: 2169129 - RNA, 20 nt, Human
cugugucagcauagaaguaa

SEQ ID NO: 2169130 - RNA, 19 nt, Human
cugugucagguggggcagc

SEQ ID NO: 2169131 - RNA, 19 nt, Human
cuguguaacagcuccuugg

SEQ ID NO: 2169132 - RNA, 18 nt, Human
cuguguaacagcuccuug

SEQ ID NO: 2169133 - RNA, 22 nt, Human
cuguguaacagcuccuugggag

SEQ ID NO: 2169134 - RNA, 19 nt, Human
cuguguaaucauuucuugg

SEQ ID NO: 2169135 - RNA, 14 nt, Human
cuguguacaaagaa

SEQ ID NO: 2169136 - RNA, 21 nt, Human
cuguguacagaauucugcuac

SEQ ID NO: 2169137 - RNA, 15 nt, Human
cuguguacaaagaaa

SEQ ID NO: 2169138 - RNA, 16 nt, Human
cuguguacaaagaaau

SEQ ID NO: 2169139 - RNA, 19 nt, Human
cuguguacauaacugaaaa

SEQ ID NO: 2169140 - RNA, 17 nt, Human
cuguguacauaacugaa

SEQ ID NO: 2169141 - RNA, 22 nt, Human
cuguguacauaacugaaaaugu

SEQ ID NO: 2169142 - RNA, 20 nt, Human
cuguguacauaacugaaaau

SEQ ID NO: 2169143 - RNA, 22 nt, Human
cugugcugcccgucuucagccu

SEQ ID NO: 2169144 - RNA, 20 nt, Human
cugugcugcccgucuucagc

SEQ ID NO: 2169145 - RNA, 17 nt, Human
cugugcucaggacucag

SEQ ID NO: 2169146 - RNA, 11 nt, Human
cugugcugccc

SEQ ID NO: 2169147 - RNA, 20 nt, Human
cugugcugagucugaaggcu

SEQ ID NO: 2169148 - RNA, 22 nt, Human
cugugcugagucugaaggcugg

SEQ ID NO: 2169149 - RNA, 16 nt, Human
cugugaccugugggga

SEQ ID NO: 2169150 - RNA, 14 nt, Human
cugugacucuuuuu

SEQ ID NO: 2169151 - RNA, 17 nt, Human
cugugacuucagcucug

SEQ ID NO: 2169152 - RNA, 20 nt, Human
cugugaccagcacugucuca

SEQ ID NO: 2169153 - RNA, 23 nt, Human
cugugaccagucugacccuuaca

SEQ ID NO: 2169154 - RNA, 15 nt, Human
cugugaccugugggg

SEQ ID NO: 2169155 - RNA, 14 nt, Human
cugugaccuguggg

SEQ ID NO: 2169156 - RNA, 13 nt, Human
cugugaccugugg

SEQ ID NO: 2169157 - RNA, 14 nt, Human
cugugagaccccca

SEQ ID NO: 2169158 - RNA, 15 nt, Human
cugugagacaguggg

SEQ ID NO: 2169159 - RNA, 19 nt, Human
cugugagacagugggaaau

SEQ ID NO: 2169160 - RNA, 21 nt, Human
cugugacuucuccaggucuca

SEQ ID NO: 2169161 - RNA, 12 nt, Human
cugugagacagu

SEQ ID NO: 2169162 - RNA, 14 nt, Human
cugugacugauguu

SEQ ID NO: 2169163 - RNA, 16 nt, Human
cugugacuucuccagg

SEQ ID NO: 2169164 - RNA, 22 nt, Human
cugugacuucagcucuguuuua

SEQ ID NO: 2169165 - RNA, 16 nt, Human
cugugcuaugaauuuu

SEQ ID NO: 2169166 - RNA, 15 nt, Human
cugugcuaugaauuu

SEQ ID NO: 2169167 - RNA, 22 nt, Human
cugugcuagggaaacuucccgu

SEQ ID NO: 2169168 - RNA, 16 nt, Human
cugugcucaggacuca

SEQ ID NO: 2169169 - RNA, 15 nt, Human
cugugcucaggacuc

SEQ ID NO: 2169170 - RNA, 12 nt, Human
cugugcucagga

SEQ ID NO: 2169171 - RNA, 13 nt, Human
cugugcuaugaau

SEQ ID NO: 2169172 - RNA, 18 nt, Human
cugugcuacuuugccuuu

SEQ ID NO: 2169173 - RNA, 21 nt, Human
cugugcuagggaaacuucccg

SEQ ID NO: 2169174 - RNA, 18 nt, Human
cugugcuaauaacagugc

SEQ ID NO: 2169175 - RNA, 14 nt, Human
cugugcuacuuugc

SEQ ID NO: 2169176 - RNA, 16 nt, Human
cugugcuacuuugccu

SEQ ID NO: 2169177 - RNA, 17 nt, Human
cugugcuacuuugccuu

SEQ ID NO: 2169178 - RNA, 17 nt, Human
cugugcguuacuaauug

SEQ ID NO: 2169179 - RNA, 14 nt, Human
cugugcgugaaaca

SEQ ID NO: 2169180 - RNA, 16 nt, Human
cugugcgugaaacaca

SEQ ID NO: 2169181 - RNA, 23 nt, Human
cugugaccaggaaggaagucagc

SEQ ID NO: 2169182 - RNA, 18 nt, Human
cugugaccaggaaggaag

SEQ ID NO: 2169183 - RNA, 14 nt, Human
cugugaccagcacu

SEQ ID NO: 2169184 - RNA, 17 nt, Human
cugugaccaaugucuug

SEQ ID NO: 2169185 - RNA, 16 nt, Human
cugugaccaaugucuu

SEQ ID NO: 2169186 - RNA, 15 nt, Human
cugugaccaaugucu

SEQ ID NO: 2169187 - RNA, 24 nt, Human
cugugacauggugccugagaggca

SEQ ID NO: 2169188 - RNA, 13 nt, Human
cugugacauguaa

SEQ ID NO: 2169189 - RNA, 16 nt, Human
cugugacauggugccu

SEQ ID NO: 2169190 - RNA, 17 nt, Human
cugugacauggugccug

SEQ ID NO: 2169191 - RNA, 18 nt, Human
cugugacauggugccuga

SEQ ID NO: 2169192 - RNA, 19 nt, Human
cugugacauggugccugag

SEQ ID NO: 2169193 - RNA, 20 nt, Human
cugugacauggugccugaga

SEQ ID NO: 2169194 - RNA, 21 nt, Human
cugugacauggugccugagag

SEQ ID NO: 2169195 - RNA, 22 nt, Human
cugugacauggugccugagagg

SEQ ID NO: 2169196 - RNA, 23 nt, Human
cugugacauggugccugagaggc

SEQ ID NO: 2169197 - RNA, 20 nt, Human
cuuacacccacaguggaaag

SEQ ID NO: 2169198 - RNA, 17 nt, Human
cuuacacuuacuguugu

SEQ ID NO: 2169199 - RNA, 11 nt, Human
cuuacacccac

SEQ ID NO: 2169200 - RNA, 13 nt, Human
cuuacacacaaaa

SEQ ID NO: 2169201 - RNA, 19 nt, Human
cuuacacaucucagacccu

SEQ ID NO: 2169202 - RNA, 13 nt, Human
cuuacacaauggu

SEQ ID NO: 2169203 - RNA, 21 nt, Human
cuuaaaggcugugguaguacu

SEQ ID NO: 2169204 - RNA, 18 nt, Human
cuuaaaggugucuuccuc

SEQ ID NO: 2169205 - RNA, 16 nt, Human
cuuaaaggugucuucc

SEQ ID NO: 2169206 - RNA, 21 nt, Human
cuuaaaggugucuuccuccca

SEQ ID NO: 2169207 - RNA, 14 nt, Human
cuuaaagucaguaa

SEQ ID NO: 2169208 - RNA, 23 nt, Human
cuuaaagcugccuguaguuagga

SEQ ID NO: 2169209 - RNA, 18 nt, Human
cuuaaagcugccuguagu

SEQ ID NO: 2169210 - RNA, 23 nt, Human
cuuaaaggcugugguaguacucc

SEQ ID NO: 2169211 - RNA, 20 nt, Human
cuuaaaggcaccaucuaaua

SEQ ID NO: 2169212 - RNA, 18 nt, Human
cuguuggcacucacagac

SEQ ID NO: 2169213 - RNA, 19 nt, Human
cuuaaacaaaaauuaaaau

SEQ ID NO: 2169214 - RNA, 13 nt, Human
cuuaaacaaaaau

SEQ ID NO: 2169215 - RNA, 19 nt, Human
cuuaaagauuuaucaaauc

SEQ ID NO: 2169216 - RNA, 20 nt, Human
cuuaaagauuuaucaaauca

SEQ ID NO: 2169217 - RNA, 16 nt, Human
cuuaaagauuuaucaa

SEQ ID NO: 2169218 - RNA, 13 nt, Human
cuuaaaauauuuu

SEQ ID NO: 2169219 - RNA, 17 nt, Human
cuuaaaauauauuucag

SEQ ID NO: 2169220 - RNA, 20 nt, Human
cuguugggguggguauaaaa

SEQ ID NO: 2169221 - RNA, 14 nt, Human
cuuaaaauauuuua

SEQ ID NO: 2169222 - RNA, 24 nt, Human
cuuaaaauguucacuuuugacaaa

SEQ ID NO: 2169223 - RNA, 18 nt, Human
cuuaaaauauuccugcau

SEQ ID NO: 2169224 - RNA, 20 nt, Human
cuuaaaauauuccugcauuu

SEQ ID NO: 2169225 - RNA, 17 nt, Human
cuguugggguggguaua

SEQ ID NO: 2169226 - RNA, 18 nt, Human
cuguugggguggguauaa

SEQ ID NO: 2169227 - RNA, 22 nt, Human
cuguuggauuuguuuaaaagga

SEQ ID NO: 2169228 - RNA, 20 nt, Human
cuguuggacccgcucuggac

SEQ ID NO: 2169229 - RNA, 19 nt, Human
cuguuggauuuguuuaaaa

SEQ ID NO: 2169230 - RNA, 16 nt, Human
cuguugcuuacaauuu

SEQ ID NO: 2169231 - RNA, 18 nt, Human
cuguuggacccgcucugg

SEQ ID NO: 2169232 - RNA, 19 nt, Human
cuguuggacccgcucugga

SEQ ID NO: 2169233 - RNA, 22 nt, Human
cuguuggacccgcucuggacca

SEQ ID NO: 2169234 - RNA, 16 nt, Human
cuguugggccaggagc

SEQ ID NO: 2169235 - RNA, 17 nt, Human
cuguugggccaggagcc

SEQ ID NO: 2169236 - RNA, 20 nt, Human
cuguugggccaggagccucc

SEQ ID NO: 2169237 - RNA, 15 nt, Human
cuuacagccucugac

SEQ ID NO: 2169238 - RNA, 14 nt, Human
cuuacagcugggug

SEQ ID NO: 2169239 - RNA, 17 nt, Human
cuuacccucauguucuu

SEQ ID NO: 2169240 - RNA, 19 nt, Human
cuuacccucauguucuuaa

SEQ ID NO: 2169241 - RNA, 18 nt, Human
cuuacccucauguucuua

SEQ ID NO: 2169242 - RNA, 16 nt, Human
cuuaccuccugcccag

SEQ ID NO: 2169243 - RNA, 15 nt, Human
cuuaccuccugccca

SEQ ID NO: 2169244 - RNA, 14 nt, Human
cuuaccuccugccc

SEQ ID NO: 2169245 - RNA, 21 nt, Human
cuuaccuaaacagauauaaau

SEQ ID NO: 2169246 - RNA, 13 nt, Human
cuuaccuccugcc

SEQ ID NO: 2169247 - RNA, 13 nt, Human
cuuaccucggugc

SEQ ID NO: 2169248 - RNA, 15 nt, Human
cuuacccuuagggag

SEQ ID NO: 2169249 - RNA, 20 nt, Human
cuuaccccuuagccucccug

SEQ ID NO: 2169250 - RNA, 16 nt, Human
cuuacagccucugacu

SEQ ID NO: 2169251 - RNA, 17 nt, Human
cuuacccucaccuguca

SEQ ID NO: 2169252 - RNA, 18 nt, Human
cuuaccuaaacagauaua

SEQ ID NO: 2169253 - RNA, 19 nt, Human
cuuaccuaaacagauauaa

SEQ ID NO: 2169254 - RNA, 20 nt, Human
cuuaccgugagcgacaaaga

SEQ ID NO: 2169255 - RNA, 22 nt, Human
cuuaccuaaacagauauaaaug

SEQ ID NO: 2169256 - RNA, 18 nt, Human
cuuaccuaccacaugcca

SEQ ID NO: 2169257 - RNA, 16 nt, Human
cuuagcagcuaucucu

SEQ ID NO: 2169258 - RNA, 14 nt, Human
cuuagcagaugcug

SEQ ID NO: 2169259 - RNA, 21 nt, Human
cuuagcacuaccacuccugcc

SEQ ID NO: 2169260 - RNA, 13 nt, Human
cuuaccucuuccg

SEQ ID NO: 2169261 - RNA, 20 nt, Human
cuuagauguuccaguaaucu

SEQ ID NO: 2169262 - RNA, 18 nt, Human
cuuagauguucuaagucu

SEQ ID NO: 2169263 - RNA, 14 nt, Human
cuuagauguucuaa

SEQ ID NO: 2169264 - RNA, 21 nt, Human
cuuagauuagcucuggaccag

SEQ ID NO: 2169265 - RNA, 16 nt, Human
cuuagauuagcucugg

SEQ ID NO: 2169266 - RNA, 17 nt, Human
cuuagauuagcucugga

SEQ ID NO: 2169267 - RNA, 18 nt, Human
cuuagauuagcucuggac

SEQ ID NO: 2169268 - RNA, 20 nt, Human
cuuagauuagcucuggacca

SEQ ID NO: 2169269 - RNA, 15 nt, Human
cuuaccucuuccgga

SEQ ID NO: 2169270 - RNA, 20 nt, Human
cuuaccuccugcccaggaga

SEQ ID NO: 2169271 - RNA, 19 nt, Human
cuuaccuccugcccaggag

SEQ ID NO: 2169272 - RNA, 18 nt, Human
cuuaccuccugcccagga

SEQ ID NO: 2169273 - RNA, 17 nt, Human
cuuaccuccugcccagg

SEQ ID NO: 2169274 - RNA, 13 nt, Human
cuuaccugccagg

SEQ ID NO: 2169275 - RNA, 19 nt, Human
cuuagauguauauauuucc

SEQ ID NO: 2169276 - RNA, 21 nt, Human
cuuaccucggugccuuccucu

SEQ ID NO: 2169277 - RNA, 19 nt, Human
cuuaccucggugccuuccu

SEQ ID NO: 2169278 - RNA, 14 nt, Human
cuguugcugccuca

SEQ ID NO: 2169279 - RNA, 15 nt, Human
cuguugcuuacaauu

SEQ ID NO: 2169280 - RNA, 17 nt, Human
cuguugcugccucaugc

SEQ ID NO: 2169281 - RNA, 16 nt, Human
cuguugcugccucaug

SEQ ID NO: 2169282 - RNA, 15 nt, Human
cuguugcugccucau

SEQ ID NO: 2169283 - RNA, 18 nt, Human
cugggagaaauugacaga

SEQ ID NO: 2169284 - RNA, 14 nt, Human
cuggcccugccuuc

SEQ ID NO: 2169285 - RNA, 20 nt, Human
cuggccgaggguccuggcuc

SEQ ID NO: 2169286 - RNA, 19 nt, Human
cuggccgaggguccuggcu

SEQ ID NO: 2169287 - RNA, 21 nt, Human
cuggccgaggguccuggcucc

SEQ ID NO: 2169288 - RNA, 17 nt, Human
cuggccgaggguccugg

SEQ ID NO: 2169289 - RNA, 12 nt, Human
cuggcccuggcu

SEQ ID NO: 2169290 - RNA, 13 nt, Human
cuggcccugugcc

SEQ ID NO: 2169291 - RNA, 12 nt, Human
cuggcccuuccu

SEQ ID NO: 2169292 - RNA, 22 nt, Human
cuggcuaugcauuugaaaauuu

SEQ ID NO: 2169293 - RNA, 16 nt, Human
cuggcuaugcauuuga

SEQ ID NO: 2169294 - RNA, 15 nt, Human
cuggcuaugcauuug

SEQ ID NO: 2169295 - RNA, 19 nt, Human
cuggcuagaguccucacuc

SEQ ID NO: 2169296 - RNA, 18 nt, Human
cuggcuagaguccucacu

SEQ ID NO: 2169297 - RNA, 17 nt, Human
cuggcuagaguccucac

SEQ ID NO: 2169298 - RNA, 16 nt, Human
cuggcuagaguccuca

SEQ ID NO: 2169299 - RNA, 21 nt, Human
cuggcuagaguccucacuccc

SEQ ID NO: 2169300 - RNA, 20 nt, Human
cuggcuagaguccucacucc

SEQ ID NO: 2169301 - RNA, 22 nt, Human
cuggcuagaguccucacuccca

SEQ ID NO: 2169302 - RNA, 14 nt, Human
cuggcuaugcauuu

SEQ ID NO: 2169303 - RNA, 13 nt, Human
cuggcuaugcauu

SEQ ID NO: 2169304 - RNA, 17 nt, Human
cuggcuccugaggggca

SEQ ID NO: 2169305 - RNA, 16 nt, Human
cuggcuccugaggggc

SEQ ID NO: 2169306 - RNA, 15 nt, Human
cuggcuccugagggg

SEQ ID NO: 2169307 - RNA, 14 nt, Human
cuggcuccugaggg

SEQ ID NO: 2169308 - RNA, 24 nt, Human
cuggcucccucuuggucuucccag

SEQ ID NO: 2169309 - RNA, 23 nt, Human
cuggcucccucuuggucuuccca

SEQ ID NO: 2169310 - RNA, 20 nt, Human
cuggcuccguccaggagccu

SEQ ID NO: 2169311 - RNA, 12 nt, Human
cuggcuccucaa

SEQ ID NO: 2169312 - RNA, 14 nt, Human
cugggacaugggaa

SEQ ID NO: 2169313 - RNA, 18 nt, Human
cugggacaugggaaaggg

SEQ ID NO: 2169314 - RNA, 22 nt, Human
cugggacaugggaaaggggaag

SEQ ID NO: 2169315 - RNA, 22 nt, Human
cugggaccacagguucaugcca

SEQ ID NO: 2169316 - RNA, 14 nt, Human
cugggaccacguga

SEQ ID NO: 2169317 - RNA, 20 nt, Human
cugggacguggcucagccag

SEQ ID NO: 2169318 - RNA, 16 nt, Human
cugggaccacgugaga

SEQ ID NO: 2169319 - RNA, 18 nt, Human
cugggacguggcucagcc

SEQ ID NO: 2169320 - RNA, 13 nt, Human
cugggacuacagg

SEQ ID NO: 2169321 - RNA, 15 nt, Human
cugggacuacaggca

SEQ ID NO: 2169322 - RNA, 16 nt, Human
cugggacuacaggcac

SEQ ID NO: 2169323 - RNA, 16 nt, Human
cugggagaaaugaaaa

SEQ ID NO: 2169324 - RNA, 23 nt, Human
cugggacguggcucagccagcac

SEQ ID NO: 2169325 - RNA, 21 nt, Human
cugggacguggcucagccagc

SEQ ID NO: 2169326 - RNA, 18 nt, Human
cugggacuugcaaaaagg

SEQ ID NO: 2169327 - RNA, 17 nt, Human
cugggagaaaugaaaaa

SEQ ID NO: 2169328 - RNA, 22 nt, Human
cugggagaaccaaaaagaggcu

SEQ ID NO: 2169329 - RNA, 17 nt, Human
cugggugacagagugag

SEQ ID NO: 2169330 - RNA, 23 nt, Human
cugggugacagagcaagacucug

SEQ ID NO: 2169331 - RNA, 14 nt, Human
cugggugacauuug

SEQ ID NO: 2169332 - RNA, 21 nt, Human
cugggugccccguccacggcu

SEQ ID NO: 2169333 - RNA, 13 nt, Human
cugggugacagag

SEQ ID NO: 2169334 - RNA, 22 nt, Human
cugggugacagagcaagacucu

SEQ ID NO: 2169335 - RNA, 14 nt, Human
cuggggcgugggga

SEQ ID NO: 2169336 - RNA, 15 nt, Human
cuggggcguggggag

SEQ ID NO: 2169337 - RNA, 16 nt, Human
cuggggcguggggagg

SEQ ID NO: 2169338 - RNA, 15 nt, Human
cuggggcgggccccu

SEQ ID NO: 2169339 - RNA, 18 nt, Human
cuggggcgggccccucau

SEQ ID NO: 2169340 - RNA, 15 nt, Human
cugggugcucccuac

SEQ ID NO: 2169341 - RNA, 23 nt, Human
cuggguggacauggccccuguga

SEQ ID NO: 2169342 - RNA, 14 nt, Human
cugggugcucccua

SEQ ID NO: 2169343 - RNA, 23 nt, Human
cugggugcgaccccaucugccca

SEQ ID NO: 2169344 - RNA, 21 nt, Human
cugggugcgaccccaucugcc

SEQ ID NO: 2169345 - RNA, 22 nt, Human
cugggugcgaccccaucugccc

SEQ ID NO: 2169346 - RNA, 20 nt, Human
cugggugcaugaucuugagc

SEQ ID NO: 2169347 - RNA, 20 nt, Human
cugggugcccaagcucagaa

SEQ ID NO: 2169348 - RNA, 21 nt, Human
cugggugcccaagcucagaag

SEQ ID NO: 2169349 - RNA, 19 nt, Human
cugggugcgaccccaucug

SEQ ID NO: 2169350 - RNA, 20 nt, Human
cuggguggcaccagcagccu

SEQ ID NO: 2169351 - RNA, 18 nt, Human
cuggguggcaccagcagc

SEQ ID NO: 2169352 - RNA, 12 nt, Human
cuggggccucuu

SEQ ID NO: 2169353 - RNA, 14 nt, Human
cuggggccuggacc

SEQ ID NO: 2169354 - RNA, 23 nt, Human
cuggggccucggagccucauccg

SEQ ID NO: 2169355 - RNA, 16 nt, Human
cuggggccuggaccug

SEQ ID NO: 2169356 - RNA, 17 nt, Human
cuggggccuggaccugc

SEQ ID NO: 2169357 - RNA, 19 nt, Human
cuggggccuggaccugccu

SEQ ID NO: 2169358 - RNA, 18 nt, Human
cuggggccuggaccugcc

SEQ ID NO: 2169359 - RNA, 13 nt, Human
cuggggagaaagu

SEQ ID NO: 2169360 - RNA, 23 nt, Human
cugggcccagaagguugugauga

SEQ ID NO: 2169361 - RNA, 14 nt, Human
cugggcccagaagg

SEQ ID NO: 2169362 - RNA, 20 nt, Human
cuggggaccugguacccucc

SEQ ID NO: 2169363 - RNA, 22 nt, Human
cuggggaccugguacccuccug

SEQ ID NO: 2169364 - RNA, 17 nt, Human
cuggggacggggggccc

SEQ ID NO: 2169365 - RNA, 19 nt, Human
cuggggacggggggcccca

SEQ ID NO: 2169366 - RNA, 22 nt, Human
cuggggacggggggccccaguc

SEQ ID NO: 2169367 - RNA, 23 nt, Human
cuggggacggggggccccaguca

SEQ ID NO: 2169368 - RNA, 18 nt, Human
cugggcccaacccugucu

SEQ ID NO: 2169369 - RNA, 19 nt, Human
cugggcccaacccugucug

SEQ ID NO: 2169370 - RNA, 22 nt, Human
cugggccauucuccacagcaac

SEQ ID NO: 2169371 - RNA, 14 nt, Human
cugggcccaacccu

SEQ ID NO: 2169372 - RNA, 17 nt, Human
cugggcccaacccuguc

SEQ ID NO: 2169373 - RNA, 19 nt, Human
cugggccauucuccacagc

SEQ ID NO: 2169374 - RNA, 21 nt, Human
cugggccauucuccacagcaa

SEQ ID NO: 2169375 - RNA, 20 nt, Human
cugggccauucuccacagca

SEQ ID NO: 2169376 - RNA, 13 nt, Human
cugggcauugcuu

SEQ ID NO: 2169377 - RNA, 12 nt, Human
cugggcauugcu

SEQ ID NO: 2169378 - RNA, 21 nt, Human
cugggcagcuguuagagucca

SEQ ID NO: 2169379 - RNA, 20 nt, Human
cugggcagguuggugggggc

SEQ ID NO: 2169380 - RNA, 17 nt, Human
cugggcaggacucagcu

SEQ ID NO: 2169381 - RNA, 16 nt, Human
cugggcauagaugcag

SEQ ID NO: 2169382 - RNA, 23 nt, Human
cugggcauagaugcaggugagcc

SEQ ID NO: 2169383 - RNA, 15 nt, Human
cugggcauccucagg

SEQ ID NO: 2169384 - RNA, 14 nt, Human
cugggcaucuguuc

SEQ ID NO: 2169385 - RNA, 15 nt, Human
cugggcaucuguucu

SEQ ID NO: 2169386 - RNA, 17 nt, Human
cugggcaucuguucugg

SEQ ID NO: 2169387 - RNA, 18 nt, Human
cugggcaucuguucuggu

SEQ ID NO: 2169388 - RNA, 12 nt, Human
cugggcagagga

SEQ ID NO: 2169389 - RNA, 13 nt, Human
cugggcagaggaa

SEQ ID NO: 2169390 - RNA, 16 nt, Human
cugggcagaggaaagc

SEQ ID NO: 2169391 - RNA, 18 nt, Human
cugggcagcauagcaaga

SEQ ID NO: 2169392 - RNA, 17 nt, Human
cugggcagcauagcaag

SEQ ID NO: 2169393 - RNA, 20 nt, Human
cugggcagaggaaagcaaag

SEQ ID NO: 2169394 - RNA, 18 nt, Human
cugggcagccaggcugcc

SEQ ID NO: 2169395 - RNA, 16 nt, Human
cugggcagccaggcug

SEQ ID NO: 2169396 - RNA, 15 nt, Human
cugggcagccaggcu

SEQ ID NO: 2169397 - RNA, 17 nt, Human
cugggcagccaggcugc

SEQ ID NO: 2169398 - RNA, 11 nt, Human
cugggcagcua

SEQ ID NO: 2169399 - RNA, 20 nt, Human
cugggcagcuaccauuuccc

SEQ ID NO: 2169400 - RNA, 23 nt, Human
cuggugcuauaggcuggagaagc

SEQ ID NO: 2169401 - RNA, 22 nt, Human
cuggugcuauaggcuggagaag

SEQ ID NO: 2169402 - RNA, 20 nt, Human
cuggugcuauaggcuggaga

SEQ ID NO: 2169403 - RNA, 21 nt, Human
cuggugcuauaggcuggagaa

SEQ ID NO: 2169404 - RNA, 19 nt, Human
cuggugcuauaggcuggag

SEQ ID NO: 2169405 - RNA, 14 nt, Human
cuggugcccggaga

SEQ ID NO: 2169406 - RNA, 21 nt, Human
cuggugccagccuuccucugc

SEQ ID NO: 2169407 - RNA, 20 nt, Human
cuggugcccuaaccucugag

SEQ ID NO: 2169408 - RNA, 13 nt, Human
cuggugccagccu

SEQ ID NO: 2169409 - RNA, 14 nt, Human
cuggugccagccuu

SEQ ID NO: 2169410 - RNA, 17 nt, Human
cuggugccagccuuccu

SEQ ID NO: 2169411 - RNA, 12 nt, Human
cuggugccucac

SEQ ID NO: 2169412 - RNA, 21 nt, Human
cuggugccucaccccuugcca

SEQ ID NO: 2169413 - RNA, 23 nt, Human
cuggugcccuaaccucugaguca

SEQ ID NO: 2169414 - RNA, 13 nt, Human
cuggguggucugc

SEQ ID NO: 2169415 - RNA, 15 nt, Human
cugggugcuggcugc

SEQ ID NO: 2169416 - RNA, 19 nt, Human
cugggugguacccucugga

SEQ ID NO: 2169417 - RNA, 16 nt, Human
cugggugguacccucu

SEQ ID NO: 2169418 - RNA, 21 nt, Human
cuggguggcaccagcagccug

SEQ ID NO: 2169419 - RNA, 21 nt, Human
cuggguggucugcaggcaggg

SEQ ID NO: 2169420 - RNA, 19 nt, Human
cuggguggucugcaggcag

SEQ ID NO: 2169421 - RNA, 14 nt, Human
cuggguguggcgca

SEQ ID NO: 2169422 - RNA, 19 nt, Human
cuggugcauuacagagagg

SEQ ID NO: 2169423 - RNA, 18 nt, Human
cuggugcauuacagagag

SEQ ID NO: 2169424 - RNA, 17 nt, Human
cuggugcauuacagaga

SEQ ID NO: 2169425 - RNA, 16 nt, Human
cuggugcauuacagag

SEQ ID NO: 2169426 - RNA, 15 nt, Human
cuggugcauuacaga

SEQ ID NO: 2169427 - RNA, 14 nt, Human
cuggugcauuacag

SEQ ID NO: 2169428 - RNA, 20 nt, Human
cuggugccaauuucaaguuc

SEQ ID NO: 2169429 - RNA, 18 nt, Human
cuggugccaauuucaagu

SEQ ID NO: 2169430 - RNA, 16 nt, Human
cuggugccaauuucaa

SEQ ID NO: 2169431 - RNA, 15 nt, Human
cuggugccaauuuca

SEQ ID NO: 2169432 - RNA, 12 nt, Human
cuggugcagugg

SEQ ID NO: 2169433 - RNA, 15 nt, Human
cuggguguggcgcag

SEQ ID NO: 2169434 - RNA, 20 nt, Human
cugcugucuaaccugugacc

SEQ ID NO: 2169435 - RNA, 14 nt, Human
cugcugucucagcc

SEQ ID NO: 2169436 - RNA, 15 nt, Human
cugcugucucagccu

SEQ ID NO: 2169437 - RNA, 23 nt, Human
cugcugugaauuuguguaaggau

SEQ ID NO: 2169438 - RNA, 19 nt, Human
cugcugugcugugcccaag

SEQ ID NO: 2169439 - RNA, 16 nt, Human
cugcugugauuccacu

SEQ ID NO: 2169440 - RNA, 22 nt, Human
cugcugugauuccacuacaccu

SEQ ID NO: 2169441 - RNA, 14 nt, Human
cugcugugugccuu

SEQ ID NO: 2169442 - RNA, 20 nt, Human
cugcuuaacuucacauauug

SEQ ID NO: 2169443 - RNA, 16 nt, Human
cugcugaaggcucauu

SEQ ID NO: 2169444 - RNA, 14 nt, Human
cugcucacauaucu

SEQ ID NO: 2169445 - RNA, 16 nt, Human
cugcucacauaucugu

SEQ ID NO: 2169446 - RNA, 19 nt, Human
cugcucacauaucugucau

SEQ ID NO: 2169447 - RNA, 12 nt, Human
cugcugaaggcu

SEQ ID NO: 2169448 - RNA, 16 nt, Human
cugcucacuaccuccu

SEQ ID NO: 2169449 - RNA, 19 nt, Human
cugcucacuaccuccucag

SEQ ID NO: 2169450 - RNA, 13 nt, Human
cugcugacagugu

SEQ ID NO: 2169451 - RNA, 15 nt, Human
cugcugacaguguug

SEQ ID NO: 2169452 - RNA, 23 nt, Human
cugcugagucccaggcugagccu

SEQ ID NO: 2169453 - RNA, 19 nt, Human
cugcugagucccaggcuga

SEQ ID NO: 2169454 - RNA, 20 nt, Human
cugcucacuaccuccucagg

SEQ ID NO: 2169455 - RNA, 21 nt, Human
cugcucacuaccuccucaggg

SEQ ID NO: 2169456 - RNA, 12 nt, Human
cugcugacagug

SEQ ID NO: 2169457 - RNA, 15 nt, Human
cugcugaaggcucga

SEQ ID NO: 2169458 - RNA, 13 nt, Human
cugcugaaggcuc

SEQ ID NO: 2169459 - RNA, 14 nt, Human
cugcugaaggcucg

SEQ ID NO: 2169460 - RNA, 14 nt, Human
cugcuuaaugaaaa

SEQ ID NO: 2169461 - RNA, 18 nt, Human
cugcuuacaauucccugc

SEQ ID NO: 2169462 - RNA, 20 nt, Human
cugcuuacaauucccugcug

SEQ ID NO: 2169463 - RNA, 15 nt, Human
cugcuuaggagagac

SEQ ID NO: 2169464 - RNA, 16 nt, Human
cugcuuaggagagacc

SEQ ID NO: 2169465 - RNA, 20 nt, Human
cugcuuagaauccaaacuug

SEQ ID NO: 2169466 - RNA, 22 nt, Human
cugcuuacaauucccugcuguc

SEQ ID NO: 2169467 - RNA, 23 nt, Human
cugcuuaccagauaaugcuacuu

SEQ ID NO: 2169468 - RNA, 19 nt, Human
cuggacugugugcucagga

SEQ ID NO: 2169469 - RNA, 22 nt, Human
cuggacugugugcucaggagcc

SEQ ID NO: 2169470 - RNA, 14 nt, Human
cuggagaagcagug

SEQ ID NO: 2169471 - RNA, 20 nt, Human
cuggagaagagaggagagga

SEQ ID NO: 2169472 - RNA, 18 nt, Human
cuggagaagagaggagag

SEQ ID NO: 2169473 - RNA, 19 nt, Human
cuggagaagagaggagagg

SEQ ID NO: 2169474 - RNA, 15 nt, Human
cuggacuugagcuug

SEQ ID NO: 2169475 - RNA, 18 nt, Human
cugcuuaggagagaccga

SEQ ID NO: 2169476 - RNA, 16 nt, Human
cuggagaagagaggag

SEQ ID NO: 2169477 - RNA, 13 nt, Human
cuggacuugagcu

SEQ ID NO: 2169478 - RNA, 23 nt, Human
cugcuuaucaauaaaccuguuug

SEQ ID NO: 2169479 - RNA, 23 nt, Human
cuggacugugugcucaggagccc

SEQ ID NO: 2169480 - RNA, 11 nt, Human
cuggagacagc

SEQ ID NO: 2169481 - RNA, 22 nt, Human
cuggagaagucuuagacuugaa

SEQ ID NO: 2169482 - RNA, 19 nt, Human
cuggagaagcugaugcuuu

SEQ ID NO: 2169483 - RNA, 15 nt, Human
cuggagaagcugaug

SEQ ID NO: 2169484 - RNA, 17 nt, Human
cuggagaagcugaugcu

SEQ ID NO: 2169485 - RNA, 21 nt, Human
cuggagaagcagugagccgca

SEQ ID NO: 2169486 - RNA, 18 nt, Human
cuggagaagcucacccaa

SEQ ID NO: 2169487 - RNA, 19 nt, Human
cuggagaagcucacccaau

SEQ ID NO: 2169488 - RNA, 15 nt, Human
cuggagaagcuccca

SEQ ID NO: 2169489 - RNA, 19 nt, Human
cuggagaagcucccaggaa

SEQ ID NO: 2169490 - RNA, 20 nt, Human
cuggagaagcucccaggaac

SEQ ID NO: 2169491 - RNA, 22 nt, Human
cuggagaagcucccaggaacaa

SEQ ID NO: 2169492 - RNA, 13 nt, Human
cuggagaagcuga

SEQ ID NO: 2169493 - RNA, 15 nt, Human
cuggaguucugguuc

SEQ ID NO: 2169494 - RNA, 13 nt, Human
cuggagacagccc

SEQ ID NO: 2169495 - RNA, 14 nt, Human
cuggagacagcccc

SEQ ID NO: 2169496 - RNA, 15 nt, Human
cuggagacagcccca

SEQ ID NO: 2169497 - RNA, 16 nt, Human
cuggagacagccccag

SEQ ID NO: 2169498 - RNA, 17 nt, Human
cuggagacagccccaga

SEQ ID NO: 2169499 - RNA, 19 nt, Human
cuggagacagccccagagc

SEQ ID NO: 2169500 - RNA, 20 nt, Human
cuggagacagccccagagca

SEQ ID NO: 2169501 - RNA, 21 nt, Human
cuggagacagccccagagcag

SEQ ID NO: 2169502 - RNA, 21 nt, Human
cuggaucugggacccuuuccu

SEQ ID NO: 2169503 - RNA, 20 nt, Human
cuggaucugggacccuuucc

SEQ ID NO: 2169504 - RNA, 23 nt, Human
cuggaucuccucaaguccccaag

SEQ ID NO: 2169505 - RNA, 14 nt, Human
cuggaucugugagg

SEQ ID NO: 2169506 - RNA, 17 nt, Human
cuggaguugaucuggaa

SEQ ID NO: 2169507 - RNA, 16 nt, Human
cuggaguugaucugga

SEQ ID NO: 2169508 - RNA, 15 nt, Human
cuggaguugaucugg

SEQ ID NO: 2169509 - RNA, 16 nt, Human
cuggaguucugguucc

SEQ ID NO: 2169510 - RNA, 17 nt, Human
cuggaguucugguuccu

SEQ ID NO: 2169511 - RNA, 23 nt, Human
cuggauggagcccaggcgggagc

SEQ ID NO: 2169512 - RNA, 16 nt, Human
cuggaugcuccuucca

SEQ ID NO: 2169513 - RNA, 11 nt, Human
cuggauggagc

SEQ ID NO: 2169514 - RNA, 15 nt, Human
cuggauggagcccag

SEQ ID NO: 2169515 - RNA, 16 nt, Human
cuggauggagcccagg

SEQ ID NO: 2169516 - RNA, 17 nt, Human
cuggauggagcccaggc

SEQ ID NO: 2169517 - RNA, 18 nt, Human
cuggauggagcccaggcg

SEQ ID NO: 2169518 - RNA, 14 nt, Human
cuggaugcauuucu

SEQ ID NO: 2169519 - RNA, 13 nt, Human
cuggaugagacuu

SEQ ID NO: 2169520 - RNA, 22 nt, Human
cuggaugaaauaacuccuucuu

SEQ ID NO: 2169521 - RNA, 13 nt, Human
cuggaugaaauuu

SEQ ID NO: 2169522 - RNA, 13 nt, Human
cuggaugaagauu

SEQ ID NO: 2169523 - RNA, 23 nt, Human
cuggaugaagauucuccugugcu

SEQ ID NO: 2169524 - RNA, 22 nt, Human
cuggaugcagccucacaguccu

SEQ ID NO: 2169525 - RNA, 20 nt, Human
cuggaugauggucuucagcc

SEQ ID NO: 2169526 - RNA, 13 nt, Human
cugcauuggcuuu

SEQ ID NO: 2169527 - RNA, 14 nt, Human
cugcauuuaaaaga

SEQ ID NO: 2169528 - RNA, 19 nt, Human
cugccccgugcagacugga

SEQ ID NO: 2169529 - RNA, 18 nt, Human
cugccccgugcagacugg

SEQ ID NO: 2169530 - RNA, 22 nt, Human
cugccccgugcagacuggaggg

SEQ ID NO: 2169531 - RNA, 13 nt, Human
cugccccucccuu

SEQ ID NO: 2169532 - RNA, 14 nt, Human
cugccccucccuuc

SEQ ID NO: 2169533 - RNA, 17 nt, Human
cugccccucccuucaac

SEQ ID NO: 2169534 - RNA, 18 nt, Human
cugccccuccucucugcc

SEQ ID NO: 2169535 - RNA, 17 nt, Human
cugccccuccucucugc

SEQ ID NO: 2169536 - RNA, 19 nt, Human
cugcccugugggcccccaa

SEQ ID NO: 2169537 - RNA, 19 nt, Human
cugccccuccucucugccc

SEQ ID NO: 2169538 - RNA, 19 nt, Human
cugcccuguuguguauaga

SEQ ID NO: 2169539 - RNA, 21 nt, Human
cugcccuguuguguauagaug

SEQ ID NO: 2169540 - RNA, 12 nt, Human
cugcccuuaccu

SEQ ID NO: 2169541 - RNA, 16 nt, Human
cugcccuuaccugcca

SEQ ID NO: 2169542 - RNA, 17 nt, Human
cugcccuuaccugccag

SEQ ID NO: 2169543 - RNA, 11 nt, Human
cugccagggcc

SEQ ID NO: 2169544 - RNA, 23 nt, Human
cugccagggagacagagcucaca

SEQ ID NO: 2169545 - RNA, 16 nt, Human
cugccagggcagggcc

SEQ ID NO: 2169546 - RNA, 15 nt, Human
cugccagggcagggc

SEQ ID NO: 2169547 - RNA, 13 nt, Human
cugccagggcagg

SEQ ID NO: 2169548 - RNA, 12 nt, Human
cugccagggcag

SEQ ID NO: 2169549 - RNA, 11 nt, Human
cugccagggca

SEQ ID NO: 2169550 - RNA, 13 nt, Human
cugccagggagcu

SEQ ID NO: 2169551 - RNA, 12 nt, Human
cugccagggagc

SEQ ID NO: 2169552 - RNA, 16 nt, Human
cugccagggagacaga

SEQ ID NO: 2169553 - RNA, 17 nt, Human
cugccagggagacagag

SEQ ID NO: 2169554 - RNA, 18 nt, Human
cugccagggagacagagc

SEQ ID NO: 2169555 - RNA, 19 nt, Human
cugccagggagacagagcu

SEQ ID NO: 2169556 - RNA, 23 nt, Human
cugccagggacagaggggguggc

SEQ ID NO: 2169557 - RNA, 18 nt, Human
cugcauuuaaaagauaca

SEQ ID NO: 2169558 - RNA, 17 nt, Human
cugcauuuaaaagauac

SEQ ID NO: 2169559 - RNA, 20 nt, Human
cugccagggacagagggggu

SEQ ID NO: 2169560 - RNA, 22 nt, Human
cugccagggacagagggggugg

SEQ ID NO: 2169561 - RNA, 22 nt, Human
cugccagucccccugccccagg

SEQ ID NO: 2169562 - RNA, 16 nt, Human
cugccaguccuagcug

SEQ ID NO: 2169563 - RNA, 17 nt, Human
cugccaguccuagcugc

SEQ ID NO: 2169564 - RNA, 18 nt, Human
cugccagucucacugugg

SEQ ID NO: 2169565 - RNA, 18 nt, Human
cugccaguccuagcugca

SEQ ID NO: 2169566 - RNA, 21 nt, Human
cugccaguccuagcugcacag

SEQ ID NO: 2169567 - RNA, 12 nt, Human
cugccagugaca

SEQ ID NO: 2169568 - RNA, 16 nt, Human
cugccagugacagaca

SEQ ID NO: 2169569 - RNA, 20 nt, Human
cugccagucccccugcccca

SEQ ID NO: 2169570 - RNA, 21 nt, Human
cugccagucccccugccccag

SEQ ID NO: 2169571 - RNA, 17 nt, Human
cugccagucccccugcc

SEQ ID NO: 2169572 - RNA, 20 nt, Human
cugccagugccuuaccuccu

SEQ ID NO: 2169573 - RNA, 18 nt, Human
cugccagugccuuaccuc

SEQ ID NO: 2169574 - RNA, 17 nt, Human
cugccagugccuuaccu

SEQ ID NO: 2169575 - RNA, 14 nt, Human
cugccagugccuua

SEQ ID NO: 2169576 - RNA, 13 nt, Human
cugccagugccuu

SEQ ID NO: 2169577 - RNA, 12 nt, Human
cugccagugccu

SEQ ID NO: 2169578 - RNA, 23 nt, Human
cugccagugacagacaggcucuu

SEQ ID NO: 2169579 - RNA, 19 nt, Human
cugccagugacagacaggc

SEQ ID NO: 2169580 - RNA, 21 nt, Human
cugccagugacagacaggcuc

SEQ ID NO: 2169581 - RNA, 22 nt, Human
cugccagugccuuaccuccugc

SEQ ID NO: 2169582 - RNA, 21 nt, Human
cugccagugccuuaccuccug

SEQ ID NO: 2169583 - RNA, 23 nt, Human
cugccagugccuuaccuccugcc

SEQ ID NO: 2169584 - RNA, 15 nt, Human
cugccaguguggaac

SEQ ID NO: 2169585 - RNA, 13 nt, Human
cugccaguuuugu

SEQ ID NO: 2169586 - RNA, 12 nt, Human
cugccaguuuug

SEQ ID NO: 2169587 - RNA, 13 nt, Human
cugccauaaaaca

SEQ ID NO: 2169588 - RNA, 20 nt, Human
cugccauaaaacauuaagaa

SEQ ID NO: 2169589 - RNA, 22 nt, Human
cugccauaaaacauuaagaaaa

SEQ ID NO: 2169590 - RNA, 23 nt, Human
cugccauaaaacauuaagaaaau

SEQ ID NO: 2169591 - RNA, 23 nt, Human
cugcccccagcucuucuccccag

SEQ ID NO: 2169592 - RNA, 21 nt, Human
cugccccccagccucuggcau

SEQ ID NO: 2169593 - RNA, 13 nt, Human
cugccccccagcc

SEQ ID NO: 2169594 - RNA, 16 nt, Human
cugccccccagccucu

SEQ ID NO: 2169595 - RNA, 19 nt, Human
cugccccccagccucuggc

SEQ ID NO: 2169596 - RNA, 19 nt, Human
cugcccccaggacugggcc

SEQ ID NO: 2169597 - RNA, 12 nt, Human
cugccccccagc

SEQ ID NO: 2169598 - RNA, 17 nt, Human
cugcccccaggacuggg

SEQ ID NO: 2169599 - RNA, 18 nt, Human
cugcccccaggacugggc

SEQ ID NO: 2169600 - RNA, 13 nt, Human
cugcccccaggac

SEQ ID NO: 2169601 - RNA, 14 nt, Human
cugcccccaggacu

SEQ ID NO: 2169602 - RNA, 15 nt, Human
cugcccccaggacug

SEQ ID NO: 2169603 - RNA, 16 nt, Human
cugcccccaggacugg

SEQ ID NO: 2169604 - RNA, 16 nt, Human
cugcccccggcccccu

SEQ ID NO: 2169605 - RNA, 17 nt, Human
cugcccccggcccccug

SEQ ID NO: 2169606 - RNA, 18 nt, Human
cugcccccggcccccugg

SEQ ID NO: 2169607 - RNA, 17 nt, Human
cugccccgcccagcugc

SEQ ID NO: 2169608 - RNA, 16 nt, Human
cugccccgcccagcug

SEQ ID NO: 2169609 - RNA, 15 nt, Human
cugccccgcccagcu

SEQ ID NO: 2169610 - RNA, 23 nt, Human
cugcccccuucucccacacugcu

SEQ ID NO: 2169611 - RNA, 22 nt, Human
cugcccccuucucccacacugc

SEQ ID NO: 2169612 - RNA, 17 nt, Human
cugccccgugcagacug

SEQ ID NO: 2169613 - RNA, 15 nt, Human
cugccccgugcagac

SEQ ID NO: 2169614 - RNA, 22 nt, Human
cugccccgucucaugaggggcc

SEQ ID NO: 2169615 - RNA, 23 nt, Human
cugccccgucaccaucucaggcc

SEQ ID NO: 2169616 - RNA, 21 nt, Human
cugccccgucaccaucucagg

SEQ ID NO: 2169617 - RNA, 19 nt, Human
cugccccgucaccaucuca

SEQ ID NO: 2169618 - RNA, 18 nt, Human
cugccccgucaccaucuc

SEQ ID NO: 2169619 - RNA, 23 nt, Human
cugccccgcccccaguccccacc

SEQ ID NO: 2169620 - RNA, 23 nt, Human
cugccccggggaggggcgcucgc

SEQ ID NO: 2169621 - RNA, 14 nt, Human
cugccccgccccca

SEQ ID NO: 2169622 - RNA, 16 nt, Human
cugccccgcccccagu

SEQ ID NO: 2169623 - RNA, 17 nt, Human
cugccccgcccccaguc

SEQ ID NO: 2169624 - RNA, 18 nt, Human
cugccccgcccccagucc

SEQ ID NO: 2169625 - RNA, 19 nt, Human
cugcccccaccacggccac

SEQ ID NO: 2169626 - RNA, 22 nt, Human
cugcccccaaauaagaagggau

SEQ ID NO: 2169627 - RNA, 22 nt, Human
cugcccccaccacggccacugg

SEQ ID NO: 2169628 - RNA, 21 nt, Human
cugccccauuuauccaccucc

SEQ ID NO: 2169629 - RNA, 22 nt, Human
cugccccauuuauccaccucca

SEQ ID NO: 2169630 - RNA, 14 nt, Human
cugcccccaaauaa

SEQ ID NO: 2169631 - RNA, 15 nt, Human
cugcccccaaauaag

SEQ ID NO: 2169632 - RNA, 17 nt, Human
cugccauccagggaugc

SEQ ID NO: 2169633 - RNA, 16 nt, Human
cugcccccagccccgg

SEQ ID NO: 2169634 - RNA, 15 nt, Human
cugcccccaccccgg

SEQ ID NO: 2169635 - RNA, 12 nt, Human
cugcccccacga

SEQ ID NO: 2169636 - RNA, 21 nt, Human
cugcccccacgagggucagga

SEQ ID NO: 2169637 - RNA, 14 nt, Human
cugcccccacuucc

SEQ ID NO: 2169638 - RNA, 16 nt, Human
cugcccccacuuccug

SEQ ID NO: 2169639 - RNA, 18 nt, Human
cugcccccacuuccuguu

SEQ ID NO: 2169640 - RNA, 16 nt, Human
cugccauauucuguug

SEQ ID NO: 2169641 - RNA, 16 nt, Human
cugccauccagguuca

SEQ ID NO: 2169642 - RNA, 18 nt, Human
cugccauccagguucagc

SEQ ID NO: 2169643 - RNA, 19 nt, Human
cugccauccagguucagcu

SEQ ID NO: 2169644 - RNA, 17 nt, Human
cugcaggccaggccagc

SEQ ID NO: 2169645 - RNA, 24 nt, Human
cugcaggccaagagcagaggcagc

SEQ ID NO: 2169646 - RNA, 23 nt, Human
cugcaggccaagagcagaggcag

SEQ ID NO: 2169647 - RNA, 22 nt, Human
cugcaggccaagagcagaggca

SEQ ID NO: 2169648 - RNA, 23 nt, Human
cugcaggccaggccagcugccuc

SEQ ID NO: 2169649 - RNA, 18 nt, Human
cugcaggccaggccagcu

SEQ ID NO: 2169650 - RNA, 20 nt, Human
cugcaggccccgcuugucca

SEQ ID NO: 2169651 - RNA, 14 nt, Human
cugcaggccccgcu

SEQ ID NO: 2169652 - RNA, 11 nt, Human
cugcaggcccc

SEQ ID NO: 2169653 - RNA, 17 nt, Human
cugcaggcaucacagcu

SEQ ID NO: 2169654 - RNA, 21 nt, Human
cugcaggccaagagcagaggc

SEQ ID NO: 2169655 - RNA, 19 nt, Human
cugcaggccaagagcagag

SEQ ID NO: 2169656 - RNA, 15 nt, Human
cugcaggccaagagc

SEQ ID NO: 2169657 - RNA, 12 nt, Human
cugcaggcaggg

SEQ ID NO: 2169658 - RNA, 11 nt, Human
cugcaggcagg

SEQ ID NO: 2169659 - RNA, 17 nt, Human
cugcaggcagacacgga

SEQ ID NO: 2169660 - RNA, 12 nt, Human
cugcaggcagac

SEQ ID NO: 2169661 - RNA, 13 nt, Human
cugcaggcagaca

SEQ ID NO: 2169662 - RNA, 14 nt, Human
cugcaggcagacac

SEQ ID NO: 2169663 - RNA, 15 nt, Human
cugcaggcagacacg

SEQ ID NO: 2169664 - RNA, 23 nt, Human
cugcaggccccgcuuguccagcg

SEQ ID NO: 2169665 - RNA, 22 nt, Human
cugcaggccccgcuuguccagc

SEQ ID NO: 2169666 - RNA, 13 nt, Human
cugcaggcccugg

SEQ ID NO: 2169667 - RNA, 14 nt, Human
cugcaggcccuggc

SEQ ID NO: 2169668 - RNA, 15 nt, Human
cugcaggcccuggcc

SEQ ID NO: 2169669 - RNA, 16 nt, Human
cugcaggcccuggccu

SEQ ID NO: 2169670 - RNA, 17 nt, Human
cugcaggcccuggccuc

SEQ ID NO: 2169671 - RNA, 18 nt, Human
cugcaggcccuggccucc

SEQ ID NO: 2169672 - RNA, 19 nt, Human
cugcaggcccuggccuccc

SEQ ID NO: 2169673 - RNA, 16 nt, Human
cugcaggaguuaaaaa

SEQ ID NO: 2169674 - RNA, 23 nt, Human
cugcaggacuugagaagaccuca

SEQ ID NO: 2169675 - RNA, 19 nt, Human
cugcaggacuugagaagac

SEQ ID NO: 2169676 - RNA, 22 nt, Human
cugcaggaccugccuguagccc

SEQ ID NO: 2169677 - RNA, 20 nt, Human
cugcaggauugauuaugcag

SEQ ID NO: 2169678 - RNA, 21 nt, Human
cugcaggauugauuaugcaga

SEQ ID NO: 2169679 - RNA, 12 nt, Human
cugcaggcaccu

SEQ ID NO: 2169680 - RNA, 20 nt, Human
cugcaggcaccuuaguggcu

SEQ ID NO: 2169681 - RNA, 21 nt, Human
cugcaggaccugccuguagcc

SEQ ID NO: 2169682 - RNA, 18 nt, Human
cugcaggaccugccugua

SEQ ID NO: 2169683 - RNA, 17 nt, Human
cugcaggaccugccugu

SEQ ID NO: 2169684 - RNA, 16 nt, Human
cugcaggaccugccug

SEQ ID NO: 2169685 - RNA, 15 nt, Human
cugcaggaccugccu

SEQ ID NO: 2169686 - RNA, 14 nt, Human
cugcaggaccugcc

SEQ ID NO: 2169687 - RNA, 12 nt, Human
cugcagcuuugu

SEQ ID NO: 2169688 - RNA, 17 nt, Human
cugcagcuguuuuaguu

SEQ ID NO: 2169689 - RNA, 17 nt, Human
cugcaggaaauggcugu

SEQ ID NO: 2169690 - RNA, 12 nt, Human
cugcagcuuuac

SEQ ID NO: 2169691 - RNA, 14 nt, Human
cugcagcuuuacau

SEQ ID NO: 2169692 - RNA, 21 nt, Human
cugcagcuuuacaugcaauuu

SEQ ID NO: 2169693 - RNA, 13 nt, Human
cugcaggcagcca

SEQ ID NO: 2169694 - RNA, 14 nt, Human
cugcaggcagccag

SEQ ID NO: 2169695 - RNA, 15 nt, Human
cugcaggcagccagg

SEQ ID NO: 2169696 - RNA, 16 nt, Human
cugcaggcagccaggc

SEQ ID NO: 2169697 - RNA, 17 nt, Human
cugcaggcagccaggcc

SEQ ID NO: 2169698 - RNA, 18 nt, Human
cugcaggcagccaggcca

SEQ ID NO: 2169699 - RNA, 19 nt, Human
cugcaggcagccaggccac

SEQ ID NO: 2169700 - RNA, 20 nt, Human
cugcaggcagccaggccaca

SEQ ID NO: 2169701 - RNA, 17 nt, Human
cugcacuccagccuggg

SEQ ID NO: 2169702 - RNA, 16 nt, Human
cugcacuccagccugg

SEQ ID NO: 2169703 - RNA, 19 nt, Human
cugcacuccagccugggcg

SEQ ID NO: 2169704 - RNA, 18 nt, Human
cugcacuccagccugggc

SEQ ID NO: 2169705 - RNA, 14 nt, Human
cugcacuccagccu

SEQ ID NO: 2169706 - RNA, 14 nt, Human
cugcacucaagcuu

SEQ ID NO: 2169707 - RNA, 18 nt, Human
cugcacuccagccugggu

SEQ ID NO: 2169708 - RNA, 20 nt, Human
cugcacuccagccugggcga

SEQ ID NO: 2169709 - RNA, 24 nt, Human
cugcagccucaaccuccugggcua

SEQ ID NO: 2169710 - RNA, 19 nt, Human
cugcacuccagccugggug

SEQ ID NO: 2169711 - RNA, 23 nt, Human
cugcagccucaaccuccugggcu

SEQ ID NO: 2169712 - RNA, 20 nt, Human
cugcagcggccacacuguac

SEQ ID NO: 2169713 - RNA, 20 nt, Human
cugcagccuuugccuccccg

SEQ ID NO: 2169714 - RNA, 18 nt, Human
cugcagccuuugccuccc

SEQ ID NO: 2169715 - RNA, 20 nt, Human
cugcagccuggaggccgggu

SEQ ID NO: 2169716 - RNA, 17 nt, Human
cugcagcucacccagcc

SEQ ID NO: 2169717 - RNA, 13 nt, Human
cugcagcugaccu

SEQ ID NO: 2169718 - RNA, 14 nt, Human
cugcagcugaccuc

SEQ ID NO: 2169719 - RNA, 23 nt, Human
cugcagcuguuuuaguuaaauuu

SEQ ID NO: 2169720 - RNA, 12 nt, Human
cugcagcugacc

SEQ ID NO: 2169721 - RNA, 21 nt, Human
cugcagcugaccucuguuguc

SEQ ID NO: 2169722 - RNA, 15 nt, Human
cugcagccuggaggc

SEQ ID NO: 2169723 - RNA, 14 nt, Human
cugcagccuggagg

SEQ ID NO: 2169724 - RNA, 11 nt, Human
cugcagccugg

SEQ ID NO: 2169725 - RNA, 20 nt, Human
cugcagccuccuccugacca

SEQ ID NO: 2169726 - RNA, 18 nt, Human
cugcagccuccuucuccu

SEQ ID NO: 2169727 - RNA, 13 nt, Human
cugcagccuccuc

SEQ ID NO: 2169728 - RNA, 16 nt, Human
cugcagccuccuccug

SEQ ID NO: 2169729 - RNA, 17 nt, Human
cugcagccuccuccuga

SEQ ID NO: 2169730 - RNA, 18 nt, Human
cugcagccuccuccugac

SEQ ID NO: 2169731 - RNA, 16 nt, Human
cugcacuauagccuag

SEQ ID NO: 2169732 - RNA, 17 nt, Human
cugcacuauagccuagg

SEQ ID NO: 2169733 - RNA, 18 nt, Human
cugcacuauagccuaggu

SEQ ID NO: 2169734 - RNA, 20 nt, Human
cugcacuauagccuagguga

SEQ ID NO: 2169735 - RNA, 16 nt, Human
cugcacuaauuugaug

SEQ ID NO: 2169736 - RNA, 16 nt, Human
cugcacuacuccucug

SEQ ID NO: 2169737 - RNA, 18 nt, Human
cugcacuacuccucugca

SEQ ID NO: 2169738 - RNA, 12 nt, Human
cugcacgucaug

SEQ ID NO: 2169739 - RNA, 19 nt, Human
cugcacggugggccuugcu

SEQ ID NO: 2169740 - RNA, 20 nt, Human
cugcacggugggccuugcug

SEQ ID NO: 2169741 - RNA, 18 nt, Human
cugcacggugggccuugc

SEQ ID NO: 2169742 - RNA, 22 nt, Human
cugcacgaauggaagaggcacc

SEQ ID NO: 2169743 - RNA, 15 nt, Human
cugcacuccagccug

SEQ ID NO: 2169744 - RNA, 16 nt, Human
cugcacuccagccuga

SEQ ID NO: 2169745 - RNA, 20 nt, Human
cugcacuccagccugagcga

SEQ ID NO: 2169746 - RNA, 17 nt, Human
cugcacuccagccugag

SEQ ID NO: 2169747 - RNA, 13 nt, Human
cugcacuccagcc

SEQ ID NO: 2169748 - RNA, 23 nt, Human
cugcacuacuccucugcagugcc

SEQ ID NO: 2169749 - RNA, 16 nt, Human
cugcacuacugacaug

SEQ ID NO: 2169750 - RNA, 14 nt, Human
cugcacuacugaca

SEQ ID NO: 2169751 - RNA, 19 nt, Human
cugcacuacuccucugcag

SEQ ID NO: 2169752 - RNA, 20 nt, Human
cugcacuacuccucugcagu

SEQ ID NO: 2169753 - RNA, 22 nt, Human
cugcacuauagccuaggugaca

SEQ ID NO: 2169754 - RNA, 23 nt, Human
cugcacuauagccuaggugacag

SEQ ID NO: 2169755 - RNA, 17 nt, Human
cugaugacagagcgaga

SEQ ID NO: 2169756 - RNA, 16 nt, Human
cucuuauucaguaaaa

SEQ ID NO: 2169757 - RNA, 16 nt, Human
cugaugacagagcgag

SEQ ID NO: 2169758 - RNA, 15 nt, Human
cugaugacagagcga

SEQ ID NO: 2169759 - RNA, 15 nt, Human
cucuuaugggcuggg

SEQ ID NO: 2169760 - RNA, 22 nt, Human
cucuuauagaauauuuauuacc

SEQ ID NO: 2169761 - RNA, 11 nt, Human
cucuuaucuca

SEQ ID NO: 2169762 - RNA, 15 nt, Human
cucuuaucucaguca

SEQ ID NO: 2169763 - RNA, 21 nt, Human
cucuuaucucagucaugcaua

SEQ ID NO: 2169764 - RNA, 22 nt, Human
cucuuaucucagucaugcauaa

SEQ ID NO: 2169765 - RNA, 23 nt, Human
cucuuaucucagucaugcauaaa

SEQ ID NO: 2169766 - RNA, 14 nt, Human
cucuuaugggcugg

SEQ ID NO: 2169767 - RNA, 22 nt, Human
cugaugcucccuccccugcccu

SEQ ID NO: 2169768 - RNA, 21 nt, Human
cugaugcucccuccccugccc

SEQ ID NO: 2169769 - RNA, 19 nt, Human
cugaugcucccuccccugc

SEQ ID NO: 2169770 - RNA, 18 nt, Human
cugaugcucccuccccug

SEQ ID NO: 2169771 - RNA, 17 nt, Human
cugaugcucccuccccu

SEQ ID NO: 2169772 - RNA, 15 nt, Human
cugaugcucccuccc

SEQ ID NO: 2169773 - RNA, 14 nt, Human
cugaugcucccucc

SEQ ID NO: 2169774 - RNA, 12 nt, Human
cugaugcucccu

SEQ ID NO: 2169775 - RNA, 20 nt, Human
cugaugauuucuugaaaagg

SEQ ID NO: 2169776 - RNA, 17 nt, Human
cugaugaugugccuggg

SEQ ID NO: 2169777 - RNA, 20 nt, Human
cugaugauuuguuuuuguau

SEQ ID NO: 2169778 - RNA, 23 nt, Human
cugaugcagucacguggaggagc

SEQ ID NO: 2169779 - RNA, 19 nt, Human
cugaugccaaguuguuuga

SEQ ID NO: 2169780 - RNA, 24 nt, Human
cugaugcucccuccccugcccugg

SEQ ID NO: 2169781 - RNA, 23 nt, Human
cugaugcucccuccccugcccug

SEQ ID NO: 2169782 - RNA, 14 nt, Human
cugaugcugccccu

SEQ ID NO: 2169783 - RNA, 12 nt, Human
cugaugcugaca

SEQ ID NO: 2169784 - RNA, 13 nt, Human
cugaugcugggcu

SEQ ID NO: 2169785 - RNA, 14 nt, Human
cugaugcugggcug

SEQ ID NO: 2169786 - RNA, 15 nt, Human
cugaugcugggcugg

SEQ ID NO: 2169787 - RNA, 16 nt, Human
cugaugcugggcuggg

SEQ ID NO: 2169788 - RNA, 17 nt, Human
cugaugcugggcugggu

SEQ ID NO: 2169789 - RNA, 18 nt, Human
cugaugcugggcugggug

SEQ ID NO: 2169790 - RNA, 19 nt, Human
cugaugcugggcugggugc

SEQ ID NO: 2169791 - RNA, 16 nt, Human
cugaugcuucuucaga

SEQ ID NO: 2169792 - RNA, 17 nt, Human
cugaugcuucuucagag

SEQ ID NO: 2169793 - RNA, 17 nt, Human
cugaugcuuugcuucaa

SEQ ID NO: 2169794 - RNA, 22 nt, Human
cugaugcuuugcuucaaaucca

SEQ ID NO: 2169795 - RNA, 18 nt, Human
cugaugcuuuuagcucaa

SEQ ID NO: 2169796 - RNA, 14 nt, Human
cugauggacaagga

SEQ ID NO: 2169797 - RNA, 15 nt, Human
cugauggaccuguca

SEQ ID NO: 2169798 - RNA, 20 nt, Human
cugaugcuucuucagagacu

SEQ ID NO: 2169799 - RNA, 18 nt, Human
cugaugcuucuucagaga

SEQ ID NO: 2169800 - RNA, 19 nt, Human
cugaugcuucuucagagac

SEQ ID NO: 2169801 - RNA, 18 nt, Human
cugaugggcaacccccag

SEQ ID NO: 2169802 - RNA, 21 nt, Human
cugaugggcaacccccagccu

SEQ ID NO: 2169803 - RNA, 22 nt, Human
cugauggcacuuagcuaucaga

SEQ ID NO: 2169804 - RNA, 16 nt, Human
cugauggcaggauggc

SEQ ID NO: 2169805 - RNA, 17 nt, Human
cugauggcaggauggcc

SEQ ID NO: 2169806 - RNA, 19 nt, Human
cugauggcaggauggccug

SEQ ID NO: 2169807 - RNA, 22 nt, Human
cugauggcaggauggccuggcc

SEQ ID NO: 2169808 - RNA, 19 nt, Human
cugauggcuucuccagggu

SEQ ID NO: 2169809 - RNA, 12 nt, Human
cugauggcuucu

SEQ ID NO: 2169810 - RNA, 18 nt, Human
cugauggcuucuccaggg

SEQ ID NO: 2169811 - RNA, 24 nt, Human
cugaugggcaacccccagccugcu

SEQ ID NO: 2169812 - RNA, 22 nt, Human
cugaugggcaacccccagccug

SEQ ID NO: 2169813 - RNA, 23 nt, Human
cugaugggcaacccccagccugc

SEQ ID NO: 2169814 - RNA, 21 nt, Human
cugcaaaggguaucaggugcu

SEQ ID NO: 2169815 - RNA, 18 nt, Human
cugcaaagcccagcuuga

SEQ ID NO: 2169816 - RNA, 17 nt, Human
cugcaaagcccagcuug

SEQ ID NO: 2169817 - RNA, 16 nt, Human
cugaugguacaggaaa

SEQ ID NO: 2169818 - RNA, 23 nt, Human
cugcaaagguaauaauacagcca

SEQ ID NO: 2169819 - RNA, 22 nt, Human
cugcaaaggacuguuuuuuccu

SEQ ID NO: 2169820 - RNA, 13 nt, Human
cugcaaaggacug

SEQ ID NO: 2169821 - RNA, 23 nt, Human
cugcaaaggacagauccagggac

SEQ ID NO: 2169822 - RNA, 15 nt, Human
cugcaaaggaaauac

SEQ ID NO: 2169823 - RNA, 16 nt, Human
cugcaaaggacagauc

SEQ ID NO: 2169824 - RNA, 14 nt, Human
cugcaaaggacaga

SEQ ID NO: 2169825 - RNA, 22 nt, Human
cugcaaaggguaucaggugcug

SEQ ID NO: 2169826 - RNA, 17 nt, Human
cugcaccguacugugga

SEQ ID NO: 2169827 - RNA, 14 nt, Human
cugcaccucccccc

SEQ ID NO: 2169828 - RNA, 11 nt, Human
cugcaccuccc

SEQ ID NO: 2169829 - RNA, 20 nt, Human
cugcaccuccccccacugca

SEQ ID NO: 2169830 - RNA, 19 nt, Human
cugcaccuccccccacugc

SEQ ID NO: 2169831 - RNA, 18 nt, Human
cugcaccuccccccacug

SEQ ID NO: 2169832 - RNA, 17 nt, Human
cugcaccuccccccacu

SEQ ID NO: 2169833 - RNA, 20 nt, Human
cugcaccugccagccuggcu

SEQ ID NO: 2169834 - RNA, 13 nt, Human
cugcaccugugca

SEQ ID NO: 2169835 - RNA, 14 nt, Human
cugcaccugugcag

SEQ ID NO: 2169836 - RNA, 19 nt, Human
cugcaccugccagccuggc

SEQ ID NO: 2169837 - RNA, 18 nt, Human
cugcaccugccagccugg

SEQ ID NO: 2169838 - RNA, 17 nt, Human
cugcaccugccagccug

SEQ ID NO: 2169839 - RNA, 16 nt, Human
cugcaccugccagccu

SEQ ID NO: 2169840 - RNA, 13 nt, Human
cugcaccugccag

SEQ ID NO: 2169841 - RNA, 22 nt, Human
cugcaccuccccccacugcagg

SEQ ID NO: 2169842 - RNA, 21 nt, Human
cugcaccuccccccacugcag

SEQ ID NO: 2169843 - RNA, 12 nt, Human
cugcaagucaga

SEQ ID NO: 2169844 - RNA, 13 nt, Human
cugcaagucagag

SEQ ID NO: 2169845 - RNA, 14 nt, Human
cugcaagucagagg

SEQ ID NO: 2169846 - RNA, 23 nt, Human
cugcaagguuuaggcugguggcc

SEQ ID NO: 2169847 - RNA, 22 nt, Human
cugcaagguuuaggcugguggc

SEQ ID NO: 2169848 - RNA, 20 nt, Human
cugcaagguuuaggcuggug

SEQ ID NO: 2169849 - RNA, 18 nt, Human
cugcaagguuuaggcugg

SEQ ID NO: 2169850 - RNA, 19 nt, Human
cugcaagucaguccaggau

SEQ ID NO: 2169851 - RNA, 20 nt, Human
cugcaccgggccacagagaa

SEQ ID NO: 2169852 - RNA, 15 nt, Human
cugcaagucagagga

SEQ ID NO: 2169853 - RNA, 16 nt, Human
cugcaagucagaggau

SEQ ID NO: 2169854 - RNA, 19 nt, Human
cugcaagucagaggauggc

SEQ ID NO: 2169855 - RNA, 21 nt, Human
cugcaagucagaggauggcca

SEQ ID NO: 2169856 - RNA, 23 nt, Human
cugcaccgggccacagagaaagu

SEQ ID NO: 2169857 - RNA, 20 nt, Human
cugcaagcacaucugcauuu

SEQ ID NO: 2169858 - RNA, 20 nt, Human
cugcaagauucugaaacauu

SEQ ID NO: 2169859 - RNA, 14 nt, Human
cugcaagcagggcu

SEQ ID NO: 2169860 - RNA, 18 nt, Human
cugcaagcagggcucugc

SEQ ID NO: 2169861 - RNA, 19 nt, Human
cugcaagcagggcucugcc

SEQ ID NO: 2169862 - RNA, 19 nt, Human
cugcaagccgacuacaccu

SEQ ID NO: 2169863 - RNA, 12 nt, Human
cugcaagccugc

SEQ ID NO: 2169864 - RNA, 21 nt, Human
cugcaagagccuuggugucca

SEQ ID NO: 2169865 - RNA, 19 nt, Human
cugcaagauucugaaacau

SEQ ID NO: 2169866 - RNA, 23 nt, Human
cugcaagagccuugguguccacc

SEQ ID NO: 2169867 - RNA, 19 nt, Human
cugcaagagccuugguguc

SEQ ID NO: 2169868 - RNA, 18 nt, Human
cugcaagagccuuggugu

SEQ ID NO: 2169869 - RNA, 17 nt, Human
cugcaagagccuuggug

SEQ ID NO: 2169870 - RNA, 15 nt, Human
cugcaagagccuugg

SEQ ID NO: 2169871 - RNA, 14 nt, Human
cugcaagagccuug

SEQ ID NO: 2169872 - RNA, 13 nt, Human
cugcaagagccuu

SEQ ID NO: 2169873 - RNA, 21 nt, Human
cugcaagaaaaugauguguac

SEQ ID NO: 2169874 - RNA, 21 nt, Human
cugcaacuuuaagcagcucuu

SEQ ID NO: 2169875 - RNA, 20 nt, Human
cugcaagaauugaagcagga

SEQ ID NO: 2169876 - RNA, 12 nt, Human
cugcaagggagu

SEQ ID NO: 2169877 - RNA, 14 nt, Human
cugcaagccugcgu

SEQ ID NO: 2169878 - RNA, 13 nt, Human
cugcaagccugcg

SEQ ID NO: 2169879 - RNA, 13 nt, Human
cugcaaggccuuu

SEQ ID NO: 2169880 - RNA, 16 nt, Human
cugcaaggccuuucug

SEQ ID NO: 2169881 - RNA, 17 nt, Human
cugcaaggccuuucugu

SEQ ID NO: 2169882 - RNA, 17 nt, Human
cugcaaggucuuugguu

SEQ ID NO: 2169883 - RNA, 17 nt, Human
cugcaagggcuccccac

SEQ ID NO: 2169884 - RNA, 22 nt, Human
cugcaagggcuccccacugccu

SEQ ID NO: 2169885 - RNA, 18 nt, Human
cugcaaggccuuucugug

SEQ ID NO: 2169886 - RNA, 20 nt, Human
cugcaaggccuuucugugug

SEQ ID NO: 2169887 - RNA, 22 nt, Human
cugcaagggcagaacacuaacc

SEQ ID NO: 2169888 - RNA, 16 nt, Human
cugcaagggcucccca

SEQ ID NO: 2169889 - RNA, 15 nt, Human
cugcaacuucugccu

SEQ ID NO: 2169890 - RNA, 18 nt, Human
cugcaacuuguaaaugug

SEQ ID NO: 2169891 - RNA, 14 nt, Human
cugcaacuucugcc

SEQ ID NO: 2169892 - RNA, 15 nt, Human
cugcaacucaaggac

SEQ ID NO: 2169893 - RNA, 23 nt, Human
cugcaacucaaggacuuugcagc

SEQ ID NO: 2169894 - RNA, 18 nt, Human
cugcaagaauugaagcag

SEQ ID NO: 2169895 - RNA, 19 nt, Human
cugcaacuuguaaaugugg

SEQ ID NO: 2169896 - RNA, 17 nt, Human
cugcaacggcuuagacu

SEQ ID NO: 2169897 - RNA, 17 nt, Human
cugcaacuuuaagcagc

SEQ ID NO: 2169898 - RNA, 19 nt, Human
cugcaacuuuaagcagcuc

SEQ ID NO: 2169899 - RNA, 20 nt, Human
cugcaacuuuaagcagcucu

SEQ ID NO: 2169900 - RNA, 15 nt, Human
cugcaaccuguugau

SEQ ID NO: 2169901 - RNA, 13 nt, Human
cugcaaccuccgc

SEQ ID NO: 2169902 - RNA, 22 nt, Human
cugcaaccugauugugucucuu

SEQ ID NO: 2169903 - RNA, 22 nt, Human
cugcaaccuucgccaccugggu

SEQ ID NO: 2169904 - RNA, 20 nt, Human
cugcaaccuucgccaccugg

SEQ ID NO: 2169905 - RNA, 19 nt, Human
cugcaaccuucgccaccug

SEQ ID NO: 2169906 - RNA, 17 nt, Human
cugcaaccuucgccacc

SEQ ID NO: 2169907 - RNA, 21 nt, Human
cugcaaaucagccaugugcug

SEQ ID NO: 2169908 - RNA, 19 nt, Human
cugcaaauccuugugggaa

SEQ ID NO: 2169909 - RNA, 16 nt, Human
cugcaaauccuugugg

SEQ ID NO: 2169910 - RNA, 20 nt, Human
cugcaaccuccgccucuugg

SEQ ID NO: 2169911 - RNA, 12 nt, Human
cugcaacaggcu

SEQ ID NO: 2169912 - RNA, 15 nt, Human
cugcaaaugucauca

SEQ ID NO: 2169913 - RNA, 22 nt, Human
cugcaaccuccgccucuugggu

SEQ ID NO: 2169914 - RNA, 14 nt, Human
cugcaaccugauug

SEQ ID NO: 2169915 - RNA, 19 nt, Human
cugcaaccugauugugucu

SEQ ID NO: 2169916 - RNA, 21 nt, Human
cugcaaccugauugugucucu

SEQ ID NO: 2169917 - RNA, 22 nt, Human
cucaauauuuuccaugaaaaug

SEQ ID NO: 2169918 - RNA, 15 nt, Human
cucaaucaagaaaau

SEQ ID NO: 2169919 - RNA, 18 nt, Human
cucaaucccagcuacuca

SEQ ID NO: 2169920 - RNA, 15 nt, Human
cucaauccauguucu

SEQ ID NO: 2169921 - RNA, 14 nt, Human
cucaauccauguuc

SEQ ID NO: 2169922 - RNA, 14 nt, Human
cucaauccucuaag

SEQ ID NO: 2169923 - RNA, 22 nt, Human
cucaauccuaauuucuccuccc

SEQ ID NO: 2169924 - RNA, 23 nt, Human
cucaauccuaauuucuccucccu

SEQ ID NO: 2169925 - RNA, 14 nt, Human
cucaauccuaauuu

SEQ ID NO: 2169926 - RNA, 19 nt, Human
cucaauccuaauuucuccu

SEQ ID NO: 2169927 - RNA, 20 nt, Human
cucaauccuaauuucuccuc

SEQ ID NO: 2169928 - RNA, 14 nt, Human
cucaauggacugga

SEQ ID NO: 2169929 - RNA, 17 nt, Human
cucaauggacuggaagg

SEQ ID NO: 2169930 - RNA, 20 nt, Human
cucaauggacuggaagggga

SEQ ID NO: 2169931 - RNA, 19 nt, Human
cucaauguuacuaucugcu

SEQ ID NO: 2169932 - RNA, 18 nt, Human
cucaauucccccuggcca

SEQ ID NO: 2169933 - RNA, 19 nt, Human
cucaauucccccuggccac

SEQ ID NO: 2169934 - RNA, 21 nt, Human
cucaaugugaaucagacccua

SEQ ID NO: 2169935 - RNA, 14 nt, Human
cucaaugugaccag

SEQ ID NO: 2169936 - RNA, 20 nt, Human
cucaaugugaaucagacccu

SEQ ID NO: 2169937 - RNA, 18 nt, Human
cucaaugugaccaggggu

SEQ ID NO: 2169938 - RNA, 15 nt, Human
cucaaugugaccagg

SEQ ID NO: 2169939 - RNA, 16 nt, Human
cucaaugugaccaggg

SEQ ID NO: 2169940 - RNA, 23 nt, Human
cucaauuauuuugcauuuuuucu

SEQ ID NO: 2169941 - RNA, 18 nt, Human
cucaauauuuuccaugaa

SEQ ID NO: 2169942 - RNA, 19 nt, Human
cucaauauuuuccaugaaa

SEQ ID NO: 2169943 - RNA, 13 nt, Human
cucaauauuuucc

SEQ ID NO: 2169944 - RNA, 23 nt, Human
cucaauaaaaucauguacauuuc

SEQ ID NO: 2169945 - RNA, 22 nt, Human
cucaauaaaaucauguacauuu

SEQ ID NO: 2169946 - RNA, 13 nt, Human
cucaauaaaauca

SEQ ID NO: 2169947 - RNA, 20 nt, Human
cucaaguuuuucagaaagca

SEQ ID NO: 2169948 - RNA, 18 nt, Human
cucaaguuuuucagaaag

SEQ ID NO: 2169949 - RNA, 19 nt, Human
cucaaguuuuucagaaagc

SEQ ID NO: 2169950 - RNA, 14 nt, Human
cucaaguugaaaga

SEQ ID NO: 2169951 - RNA, 22 nt, Human
cucaagugucucaguccaccug

SEQ ID NO: 2169952 - RNA, 22 nt, Human
cucaagugcccucuccgagcug

SEQ ID NO: 2169953 - RNA, 22 nt, Human
cucaagugggaacgacugggca

SEQ ID NO: 2169954 - RNA, 9 nt, Human
cucaagugc

SEQ ID NO: 2169955 - RNA, 15 nt, Human
cucaagugcccucuc

SEQ ID NO: 2169956 - RNA, 20 nt, Human
cuauguuuuuguucaaagcc

SEQ ID NO: 2169957 - RNA, 20 nt, Human
cuauguuuacaaauggacau

SEQ ID NO: 2169958 - RNA, 20 nt, Human
cuaugugacuugcaucgugg

SEQ ID NO: 2169959 - RNA, 18 nt, Human
cuauguuuugacauuuuu

SEQ ID NO: 2169960 - RNA, 19 nt, Human
cuauguuuugacauuuuua

SEQ ID NO: 2169961 - RNA, 21 nt, Human
cucaagugauucuccugccuc

SEQ ID NO: 2169962 - RNA, 22 nt, Human
cuauguuuuuguucaaagccag

SEQ ID NO: 2169963 - RNA, 22 nt, Human
cuauguccuaaggacacacuaa

SEQ ID NO: 2169964 - RNA, 23 nt, Human
cuauguccuaaggacacacuaau

SEQ ID NO: 2169965 - RNA, 15 nt, Human
cuauguccuaaggac

SEQ ID NO: 2169966 - RNA, 18 nt, Human
cuauguccuaaggacaca

SEQ ID NO: 2169967 - RNA, 20 nt, Human
cuauguccuaaggacacacu

SEQ ID NO: 2169968 - RNA, 21 nt, Human
cuauguccuaaggacacacua

SEQ ID NO: 2169969 - RNA, 14 nt, Human
cuaugugagaccau

SEQ ID NO: 2169970 - RNA, 16 nt, Human
cuaugucccuugcugu

SEQ ID NO: 2169971 - RNA, 14 nt, Human
cuauguccuaagga

SEQ ID NO: 2169972 - RNA, 13 nt, Human
cuaugucccuugc

SEQ ID NO: 2169973 - RNA, 21 nt, Human
cuaucucaucuaucucaaucc

SEQ ID NO: 2169974 - RNA, 12 nt, Human
cuaucucaucua

SEQ ID NO: 2169975 - RNA, 13 nt, Human
cuauccuggcucu

SEQ ID NO: 2169976 - RNA, 19 nt, Human
cuauccuggcucuuuggag

SEQ ID NO: 2169977 - RNA, 18 nt, Human
cuaucucaauccuaauuu

SEQ ID NO: 2169978 - RNA, 18 nt, Human
cuaucucauuuccaagca

SEQ ID NO: 2169979 - RNA, 13 nt, Human
cuaucucccccag

SEQ ID NO: 2169980 - RNA, 14 nt, Human
cuaucucccccagc

SEQ ID NO: 2169981 - RNA, 18 nt, Human
cuauguugcccaggcagg

SEQ ID NO: 2169982 - RNA, 19 nt, Human
cuauguugcccaggcaggu

SEQ ID NO: 2169983 - RNA, 21 nt, Human
cuauguugcccaggcaggucu

SEQ ID NO: 2169984 - RNA, 22 nt, Human
cuauguugcccaggcaggucuu

SEQ ID NO: 2169985 - RNA, 12 nt, Human
cuaugugacaau

SEQ ID NO: 2169986 - RNA, 17 nt, Human
cuaugugagcacaaagg

SEQ ID NO: 2169987 - RNA, 18 nt, Human
cuauguucuaagaaguga

SEQ ID NO: 2169988 - RNA, 19 nt, Human
cuaucaccuccccuccuug

SEQ ID NO: 2169989 - RNA, 17 nt, Human
cuaucaccuccccuccu

SEQ ID NO: 2169990 - RNA, 16 nt, Human
cuaucaccuccccucc

SEQ ID NO: 2169991 - RNA, 21 nt, Human
cuaucagaggugaaagcuaua

SEQ ID NO: 2169992 - RNA, 13 nt, Human
cuaucagaagacc

SEQ ID NO: 2169993 - RNA, 19 nt, Human
cuaucagaguugcugcaaa

SEQ ID NO: 2169994 - RNA, 15 nt, Human
cuaucagccugucuc

SEQ ID NO: 2169995 - RNA, 20 nt, Human
cuaucagccugucucuucca

SEQ ID NO: 2169996 - RNA, 12 nt, Human
cuaucagugugc

SEQ ID NO: 2169997 - RNA, 16 nt, Human
cuaucagugugccccc

SEQ ID NO: 2169998 - RNA, 15 nt, Human
cuaucaccuccccuc

SEQ ID NO: 2169999 - RNA, 14 nt, Human
cuaucaccuccccu

SEQ ID NO: 2170000 - RNA, 17 nt, Human
cuaucaccuauuuccau

SEQ ID NO: 2170001 - RNA, 16 nt, Human
cuaucaccuauuucca

SEQ ID NO: 2170002 - RNA, 13 nt, Human
cuauccuacccca

SEQ ID NO: 2170003 - RNA, 14 nt, Human
cuaucauggaguga

SEQ ID NO: 2170004 - RNA, 17 nt, Human
cuaucagugugcccccc

SEQ ID NO: 2170005 - RNA, 18 nt, Human
cuaucagugugcccccca

SEQ ID NO: 2170006 - RNA, 21 nt, Human
cuaucagugugccccccaucc

SEQ ID NO: 2170007 - RNA, 23 nt, Human
cuaucagugugccccccauccug

SEQ ID NO: 2170008 - RNA, 17 nt, Human
cuauccuacuuccccuu

SEQ ID NO: 2170009 - RNA, 12 nt, Human
cuauccucugua

SEQ ID NO: 2170010 - RNA, 13 nt, Human
cuauccucuguaa

SEQ ID NO: 2170011 - RNA, 19 nt, Human
cuauccugaaaauucugua

SEQ ID NO: 2170012 - RNA, 15 nt, Human
cuaauuuuggaugga

SEQ ID NO: 2170013 - RNA, 20 nt, Human
cuacaaaaccugauguuaaa

SEQ ID NO: 2170014 - RNA, 18 nt, Human
cuacaaaauuugaaauuu

SEQ ID NO: 2170015 - RNA, 17 nt, Human
cuacaaaauuugaaauu

SEQ ID NO: 2170016 - RNA, 21 nt, Human
cuacaaaaccugauguuaaaa

SEQ ID NO: 2170017 - RNA, 13 nt, Human
cuacaaacaaaau

SEQ ID NO: 2170018 - RNA, 15 nt, Human
cuacaaacaaaauuu

SEQ ID NO: 2170019 - RNA, 17 nt, Human
cuacaaacaaaauuucu

SEQ ID NO: 2170020 - RNA, 20 nt, Human
cuacaaacaaaauuucuauu

SEQ ID NO: 2170021 - RNA, 15 nt, Human
cucagaccagcucuu

SEQ ID NO: 2170022 - RNA, 14 nt, Human
cucagaccagcucu

SEQ ID NO: 2170023 - RNA, 16 nt, Human
cucagaccagcucuuc

SEQ ID NO: 2170024 - RNA, 13 nt, Human
cucagacccccac

SEQ ID NO: 2170025 - RNA, 22 nt, Human
cucagacccccacucucauucc

SEQ ID NO: 2170026 - RNA, 16 nt, Human
cucagacccccacucu

SEQ ID NO: 2170027 - RNA, 15 nt, Human
cucagacccccacuc

SEQ ID NO: 2170028 - RNA, 14 nt, Human
cucagacccccacu

SEQ ID NO: 2170029 - RNA, 14 nt, Human
cucagacuccauuu

SEQ ID NO: 2170030 - RNA, 23 nt, Human
cucagacccccacucucauuccc

SEQ ID NO: 2170031 - RNA, 22 nt, Human
cucagacucuuuuuguaccugg

SEQ ID NO: 2170032 - RNA, 17 nt, Human
cucagaagccugaggcu

SEQ ID NO: 2170033 - RNA, 16 nt, Human
cucagaagccugaggc

SEQ ID NO: 2170034 - RNA, 18 nt, Human
cucagaagccugaggcug

SEQ ID NO: 2170035 - RNA, 15 nt, Human
cucagaagccugagg

SEQ ID NO: 2170036 - RNA, 14 nt, Human
cucagaagccugag

SEQ ID NO: 2170037 - RNA, 13 nt, Human
cucagaagccuga

SEQ ID NO: 2170038 - RNA, 17 nt, Human
cucagaagccucugggu

SEQ ID NO: 2170039 - RNA, 11 nt, Human
cucagaagccu

SEQ ID NO: 2170040 - RNA, 15 nt, Human
cucagaagccucugg

SEQ ID NO: 2170041 - RNA, 13 nt, Human
cucagaagaaaga

SEQ ID NO: 2170042 - RNA, 23 nt, Human
cucagaagacacugaugggcaac

SEQ ID NO: 2170043 - RNA, 19 nt, Human
cucagccucccgaauagcu

SEQ ID NO: 2170044 - RNA, 21 nt, Human
cucagccucccgaauagcugg

SEQ ID NO: 2170045 - RNA, 21 nt, Human
cucagcccugggccccaccac

SEQ ID NO: 2170046 - RNA, 11 nt, Human
cucagcccugu

SEQ ID NO: 2170047 - RNA, 19 nt, Human
cucagcccugggccccacc

SEQ ID NO: 2170048 - RNA, 15 nt, Human
cucagcccugggccc

SEQ ID NO: 2170049 - RNA, 22 nt, Human
cucagccuccuguguagcuggg

SEQ ID NO: 2170050 - RNA, 20 nt, Human
cucagccucaauaagccuug

SEQ ID NO: 2170051 - RNA, 22 nt, Human
cucagccucccgaauagcuggg

SEQ ID NO: 2170052 - RNA, 14 nt, Human
cucagcccugggcc

SEQ ID NO: 2170053 - RNA, 13 nt, Human
cucagcccugggc

SEQ ID NO: 2170054 - RNA, 12 nt, Human
cucagcccuggg

SEQ ID NO: 2170055 - RNA, 22 nt, Human
cucagcccuggaggugccagca

SEQ ID NO: 2170056 - RNA, 15 nt, Human
cucagcccuggaggu

SEQ ID NO: 2170057 - RNA, 18 nt, Human
cucagcccuggaggugcc

SEQ ID NO: 2170058 - RNA, 19 nt, Human
cucagcccuggaggugcca

SEQ ID NO: 2170059 - RNA, 20 nt, Human
cucagcccuggaggugccag

SEQ ID NO: 2170060 - RNA, 11 nt, Human
cucagcccugg

SEQ ID NO: 2170061 - RNA, 12 nt, Human
cucagcccugga

SEQ ID NO: 2170062 - RNA, 13 nt, Human
cucagcccuggag

SEQ ID NO: 2170063 - RNA, 14 nt, Human
cucagcccuggagg

SEQ ID NO: 2170064 - RNA, 15 nt, Human
cucagcccugaggug

SEQ ID NO: 2170065 - RNA, 14 nt, Human
cucagcccugaggu

SEQ ID NO: 2170066 - RNA, 13 nt, Human
cucagcccugagg

SEQ ID NO: 2170067 - RNA, 19 nt, Human
cucagcccugacuggugcu

SEQ ID NO: 2170068 - RNA, 16 nt, Human
cucagacuuaccagga

SEQ ID NO: 2170069 - RNA, 13 nt, Human
cucagcccugacu

SEQ ID NO: 2170070 - RNA, 18 nt, Human
cucagcccugacuggugc

SEQ ID NO: 2170071 - RNA, 17 nt, Human
cucaccuuucccaucuu

SEQ ID NO: 2170072 - RNA, 20 nt, Human
cucacgccuaugaucccagc

SEQ ID NO: 2170073 - RNA, 19 nt, Human
cucacgcaccucccauccu

SEQ ID NO: 2170074 - RNA, 16 nt, Human
cucacgcaccucccau

SEQ ID NO: 2170075 - RNA, 15 nt, Human
cucacgcaccuccca

SEQ ID NO: 2170076 - RNA, 20 nt, Human
cucacgaauauuaugcccag

SEQ ID NO: 2170077 - RNA, 16 nt, Human
cucaccuuuucccggg

SEQ ID NO: 2170078 - RNA, 16 nt, Human
cucacgugagaguguc

SEQ ID NO: 2170079 - RNA, 21 nt, Human
cucacgggcaugggcacuccc

SEQ ID NO: 2170080 - RNA, 13 nt, Human
cucacguguguga

SEQ ID NO: 2170081 - RNA, 19 nt, Human
cucacgggcaguagcugug

SEQ ID NO: 2170082 - RNA, 17 nt, Human
cucacgggcaugggcac

SEQ ID NO: 2170083 - RNA, 23 nt, Human
cucacgccuguaaucccagcagu

SEQ ID NO: 2170084 - RNA, 22 nt, Human
cucacgccuguaaucccagcag

SEQ ID NO: 2170085 - RNA, 22 nt, Human
cucacgccuguaaucccagcau

SEQ ID NO: 2170086 - RNA, 21 nt, Human
cucacgccuguaaucccagca

SEQ ID NO: 2170087 - RNA, 20 nt, Human
cucacgccuguaaucccagc

SEQ ID NO: 2170088 - RNA, 19 nt, Human
cucacgccuguaaucccag

SEQ ID NO: 2170089 - RNA, 18 nt, Human
cucacgccuguaauccca

SEQ ID NO: 2170090 - RNA, 13 nt, Human
cucacgccuguaa

SEQ ID NO: 2170091 - RNA, 13 nt, Human
cucagaagacacu

SEQ ID NO: 2170092 - RNA, 21 nt, Human
cucagaacccuuggcuugccc

SEQ ID NO: 2170093 - RNA, 14 nt, Human
cucagaacccuugg

SEQ ID NO: 2170094 - RNA, 15 nt, Human
cucacuaggccccca

SEQ ID NO: 2170095 - RNA, 17 nt, Human
cucacuaccuccucagg

SEQ ID NO: 2170096 - RNA, 18 nt, Human
cucacuaccuccucaggg

SEQ ID NO: 2170097 - RNA, 20 nt, Human
cucacuacccuauucucucu

SEQ ID NO: 2170098 - RNA, 12 nt, Human
cucacuaccucc

SEQ ID NO: 2170099 - RNA, 15 nt, Human
cucacuaccuccuca

SEQ ID NO: 2170100 - RNA, 16 nt, Human
cucacuaccuccucag

SEQ ID NO: 2170101 - RNA, 18 nt, Human
cucacuaggcccccacuu

SEQ ID NO: 2170102 - RNA, 22 nt, Human
cucacuaggcccccacuugccu

SEQ ID NO: 2170103 - RNA, 20 nt, Human
cucacuaccuccucagggau

SEQ ID NO: 2170104 - RNA, 17 nt, Human
cucagaaauuuuuauuu

SEQ ID NO: 2170105 - RNA, 21 nt, Human
cucagaaauuuuuauuuuucu

SEQ ID NO: 2170106 - RNA, 15 nt, Human
cucagaagacacuga

SEQ ID NO: 2170107 - RNA, 17 nt, Human
cucagaagacacugaug

SEQ ID NO: 2170108 - RNA, 20 nt, Human
cucagaagacacugaugggc

SEQ ID NO: 2170109 - RNA, 22 nt, Human
cucagaagacacugaugggcaa

SEQ ID NO: 2170110 - RNA, 23 nt, Human
cucaggccuauaaccccagcucc

SEQ ID NO: 2170111 - RNA, 20 nt, Human
cucaggccugacucucagca

SEQ ID NO: 2170112 - RNA, 15 nt, Human
cucaggccacaccgg

SEQ ID NO: 2170113 - RNA, 22 nt, Human
cucaggccugggggcugggcag

SEQ ID NO: 2170114 - RNA, 11 nt, Human
cucaggccugg

SEQ ID NO: 2170115 - RNA, 16 nt, Human
cucaggccagcugcuu

SEQ ID NO: 2170116 - RNA, 17 nt, Human
cucaggccagcugcuug

SEQ ID NO: 2170117 - RNA, 18 nt, Human
cucaggccagcugcuugg

SEQ ID NO: 2170118 - RNA, 23 nt, Human
cucaggccgaaggaggagucagg

SEQ ID NO: 2170119 - RNA, 17 nt, Human
cucagccucugaauaug

SEQ ID NO: 2170120 - RNA, 23 nt, Human
cucagccuccuguguagcuggga

SEQ ID NO: 2170121 - RNA, 15 nt, Human
cucagccuggccaga

SEQ ID NO: 2170122 - RNA, 14 nt, Human
cucagccuggccag

SEQ ID NO: 2170123 - RNA, 13 nt, Human
cucagccuggcca

SEQ ID NO: 2170124 - RNA, 20 nt, Human
cucagccuggccagacacag

SEQ ID NO: 2170125 - RNA, 19 nt, Human
cucagccuggccagacaca

SEQ ID NO: 2170126 - RNA, 17 nt, Human
cucagccuggccagaca

SEQ ID NO: 2170127 - RNA, 16 nt, Human
cucagccuggccagac

SEQ ID NO: 2170128 - RNA, 19 nt, Human
cucaggccaacaagccaac

SEQ ID NO: 2170129 - RNA, 20 nt, Human
cucaggccaagaaacgucuu

SEQ ID NO: 2170130 - RNA, 21 nt, Human
cucaggccaaacucaccugcc

SEQ ID NO: 2170131 - RNA, 19 nt, Human
cucaggccaaacucaccug

SEQ ID NO: 2170132 - RNA, 20 nt, Human
cucaggccaaacucaccugc

SEQ ID NO: 2170133 - RNA, 23 nt, Human
cucagggaaaagcagcucucccc

SEQ ID NO: 2170134 - RNA, 19 nt, Human
cucagggacagagacaccu

SEQ ID NO: 2170135 - RNA, 17 nt, Human
cucagggaaaggccagu

SEQ ID NO: 2170136 - RNA, 20 nt, Human
cucagggacagagacaccug

SEQ ID NO: 2170137 - RNA, 17 nt, Human
cucagggaaaagcagcu

SEQ ID NO: 2170138 - RNA, 21 nt, Human
cucaggcuuucacuauuuccu

SEQ ID NO: 2170139 - RNA, 22 nt, Human
cucaggcuuucacuauuuccuu

SEQ ID NO: 2170140 - RNA, 17 nt, Human
cucaggcuuccuuggca

SEQ ID NO: 2170141 - RNA, 17 nt, Human
cucaggcuggugggagg

SEQ ID NO: 2170142 - RNA, 15 nt, Human
cucaggcuugaaaug

SEQ ID NO: 2170143 - RNA, 22 nt, Human
cucagggaaaagcagcucuccc

SEQ ID NO: 2170144 - RNA, 20 nt, Human
cucagggaaaagcagcucuc

SEQ ID NO: 2170145 - RNA, 14 nt, Human
cucagggacagaga

SEQ ID NO: 2170146 - RNA, 17 nt, Human
cucaggcugcuggagga

SEQ ID NO: 2170147 - RNA, 16 nt, Human
cucaggcugcuggagg

SEQ ID NO: 2170148 - RNA, 15 nt, Human
cucaggcugcuggag

SEQ ID NO: 2170149 - RNA, 14 nt, Human
cucaggcugcugga

SEQ ID NO: 2170150 - RNA, 13 nt, Human
cucaggcugcugg

SEQ ID NO: 2170151 - RNA, 12 nt, Human
cucaggcugcug

SEQ ID NO: 2170152 - RNA, 11 nt, Human
cucaggcugcu

SEQ ID NO: 2170153 - RNA, 22 nt, Human
cucaggcucugcccugcccuag

SEQ ID NO: 2170154 - RNA, 19 nt, Human
cucaggcucugcccugccc

SEQ ID NO: 2170155 - RNA, 17 nt, Human
cucaggcucugcccugc

SEQ ID NO: 2170156 - RNA, 16 nt, Human
cucaggcucugcccug

SEQ ID NO: 2170157 - RNA, 15 nt, Human
cucaggcucugcccu

SEQ ID NO: 2170158 - RNA, 14 nt, Human
cucaggcucugccc

SEQ ID NO: 2170159 - RNA, 21 nt, Human
cucaggcgauccaccugucuc

SEQ ID NO: 2170160 - RNA, 13 nt, Human
cucaggcucugcc

SEQ ID NO: 2170161 - RNA, 20 nt, Human
cucaggcgauccaccugucu

SEQ ID NO: 2170162 - RNA, 23 nt, Human
cucaggugucccugcacuugcag

SEQ ID NO: 2170163 - RNA, 14 nt, Human
cucagguguugcca

SEQ ID NO: 2170164 - RNA, 22 nt, Human
cucagguugucugaagucacug

SEQ ID NO: 2170165 - RNA, 15 nt, Human
cucagguguugccaa

SEQ ID NO: 2170166 - RNA, 12 nt, Human
cucagguuccua

SEQ ID NO: 2170167 - RNA, 20 nt, Human
cucagguuccuauggcuggc

SEQ ID NO: 2170168 - RNA, 20 nt, Human
cucagguugcugguugcugu

SEQ ID NO: 2170169 - RNA, 21 nt, Human
cucagguugcugguugcugug

SEQ ID NO: 2170170 - RNA, 22 nt, Human
cucagguugcugguugcugugu

SEQ ID NO: 2170171 - RNA, 23 nt, Human
cucagguugcugguugcugugug

SEQ ID NO: 2170172 - RNA, 12 nt, Human
cucaugcaucuc

SEQ ID NO: 2170173 - RNA, 14 nt, Human
cucaugcagccgug

SEQ ID NO: 2170174 - RNA, 15 nt, Human
cucaugcagccguga

SEQ ID NO: 2170175 - RNA, 14 nt, Human
cucaugcaucucca

SEQ ID NO: 2170176 - RNA, 16 nt, Human
cucaugcaucuccacc

SEQ ID NO: 2170177 - RNA, 17 nt, Human
cucaugcaucuccaccu

SEQ ID NO: 2170178 - RNA, 18 nt, Human
cucaugcaucuccaccug

SEQ ID NO: 2170179 - RNA, 14 nt, Human
cucauggccccucu

SEQ ID NO: 2170180 - RNA, 15 nt, Human
cucauggccccucug

SEQ ID NO: 2170181 - RNA, 17 nt, Human
cucauggccccucugac

SEQ ID NO: 2170182 - RNA, 19 nt, Human
cucauggccccucugaccu

SEQ ID NO: 2170183 - RNA, 20 nt, Human
cucaugaucuugugacauau

SEQ ID NO: 2170184 - RNA, 19 nt, Human
cucaugaucuugugacaua

SEQ ID NO: 2170185 - RNA, 16 nt, Human
cucaugcaaaucaauu

SEQ ID NO: 2170186 - RNA, 20 nt, Human
cucaugcaaaucaauuacug

SEQ ID NO: 2170187 - RNA, 19 nt, Human
cucaugcaaaucaauuacu

SEQ ID NO: 2170188 - RNA, 22 nt, Human
cucaugaggggcccgagcagaa

SEQ ID NO: 2170189 - RNA, 23 nt, Human
cucaugauagaaggcuaugggga

SEQ ID NO: 2170190 - RNA, 21 nt, Human
cucaguccuccccucacagcc

SEQ ID NO: 2170191 - RNA, 22 nt, Human
cucagucuggcccuuccuuuuc

SEQ ID NO: 2170192 - RNA, 20 nt, Human
cucagucuggcccuuccuuu

SEQ ID NO: 2170193 - RNA, 17 nt, Human
cucagucccccaacaga

SEQ ID NO: 2170194 - RNA, 14 nt, Human
cucaguccuccccu

SEQ ID NO: 2170195 - RNA, 16 nt, Human
cucaguccuccccuca

SEQ ID NO: 2170196 - RNA, 17 nt, Human
cucaguccuccccucac

SEQ ID NO: 2170197 - RNA, 18 nt, Human
cucaguccuccccucaca

SEQ ID NO: 2170198 - RNA, 19 nt, Human
cucaguccuccccucacag

SEQ ID NO: 2170199 - RNA, 20 nt, Human
cucaguccuccccucacagc

SEQ ID NO: 2170200 - RNA, 18 nt, Human
cucaguccaccugagcug

SEQ ID NO: 2170201 - RNA, 17 nt, Human
cucaguccaccugagcu

SEQ ID NO: 2170202 - RNA, 16 nt, Human
cucaguccaccugagc

SEQ ID NO: 2170203 - RNA, 18 nt, Human
cucagucauuagacuccu

SEQ ID NO: 2170204 - RNA, 22 nt, Human
cucagucaugcauaaauaugca

SEQ ID NO: 2170205 - RNA, 23 nt, Human
cucagucaugcauaaauaugcag

SEQ ID NO: 2170206 - RNA, 16 nt, Human
cucaguccaugaagau

SEQ ID NO: 2170207 - RNA, 22 nt, Human
cucagguuguaguaaagaaauu

SEQ ID NO: 2170208 - RNA, 19 nt, Human
cucagguuguaguaaagaa

SEQ ID NO: 2170209 - RNA, 14 nt, Human
cucagguugucuga

SEQ ID NO: 2170210 - RNA, 13 nt, Human
cucagucauaauc

SEQ ID NO: 2170211 - RNA, 13 nt, Human
cucagucaguauu

SEQ ID NO: 2170212 - RNA, 14 nt, Human
cucagucaugcaua

SEQ ID NO: 2170213 - RNA, 15 nt, Human
cucagucaugcauaa

SEQ ID NO: 2170214 - RNA, 16 nt, Human
cucagucaugcauaaa

SEQ ID NO: 2170215 - RNA, 18 nt, Human
cucagucaugcauaaaua

SEQ ID NO: 2170216 - RNA, 15 nt, Human
cucaguccauagcag

SEQ ID NO: 2170217 - RNA, 17 nt, Human
cucaguccauagcagag

SEQ ID NO: 2170218 - RNA, 12 nt, Human
cucucccugacc

SEQ ID NO: 2170219 - RNA, 13 nt, Human
cucucccugaccc

SEQ ID NO: 2170220 - RNA, 14 nt, Human
cucucccugacccu

SEQ ID NO: 2170221 - RNA, 20 nt, Human
cucucccugacccuguauau

SEQ ID NO: 2170222 - RNA, 12 nt, Human
cucuccuccaga

SEQ ID NO: 2170223 - RNA, 16 nt, Human
cucucccucuucucaa

SEQ ID NO: 2170224 - RNA, 13 nt, Human
cucuccuccagag

SEQ ID NO: 2170225 - RNA, 15 nt, Human
cucuccuccagaguc

SEQ ID NO: 2170226 - RNA, 16 nt, Human
cucuccuccagaguca

SEQ ID NO: 2170227 - RNA, 13 nt, Human
cucucuggccuuc

SEQ ID NO: 2170228 - RNA, 16 nt, Human
cucucuggccuucggc

SEQ ID NO: 2170229 - RNA, 14 nt, Human
cucucuggccuucg

SEQ ID NO: 2170230 - RNA, 19 nt, Human
cucucccgguucuuccagu

SEQ ID NO: 2170231 - RNA, 18 nt, Human
cucuccccucaaagucug

SEQ ID NO: 2170232 - RNA, 21 nt, Human
cucuccccucaaagucugcaa

SEQ ID NO: 2170233 - RNA, 12 nt, Human
cucuccccucaa

SEQ ID NO: 2170234 - RNA, 14 nt, Human
cucuccccucaaag

SEQ ID NO: 2170235 - RNA, 13 nt, Human
cucucccccaccc

SEQ ID NO: 2170236 - RNA, 16 nt, Human
cucucccccacccccu

SEQ ID NO: 2170237 - RNA, 17 nt, Human
cucuccccccccccucc

SEQ ID NO: 2170238 - RNA, 19 nt, Human
cucuccccccccccuccaa

SEQ ID NO: 2170239 - RNA, 21 nt, Human
cucuccccccccccuccaauc

SEQ ID NO: 2170240 - RNA, 23 nt, Human
cucuccccccccccuccaauccu

SEQ ID NO: 2170241 - RNA, 22 nt, Human
cucucccucuggcccugccuuc

SEQ ID NO: 2170242 - RNA, 21 nt, Human
cucucccucuggcccugccuu

SEQ ID NO: 2170243 - RNA, 19 nt, Human
cucucccucuggcccugcc

SEQ ID NO: 2170244 - RNA, 18 nt, Human
cucucccucuggcccugc

SEQ ID NO: 2170245 - RNA, 13 nt, Human
cucucccucuggc

SEQ ID NO: 2170246 - RNA, 12 nt, Human
cucucccucugg

SEQ ID NO: 2170247 - RNA, 23 nt, Human
cucucccucaacaagggagagac

SEQ ID NO: 2170248 - RNA, 17 nt, Human
cucucccuccccugcca

SEQ ID NO: 2170249 - RNA, 13 nt, Human
cucucccuccccu

SEQ ID NO: 2170250 - RNA, 15 nt, Human
cucucccgucagggc

SEQ ID NO: 2170251 - RNA, 16 nt, Human
cucucccgucagggcc

SEQ ID NO: 2170252 - RNA, 17 nt, Human
cucucccgucagggccc

SEQ ID NO: 2170253 - RNA, 21 nt, Human
cucucccgucagggcccaagu

SEQ ID NO: 2170254 - RNA, 21 nt, Human
cucuaugccagcucaguccca

SEQ ID NO: 2170255 - RNA, 22 nt, Human
cucuaugggcagaucuaccccu

SEQ ID NO: 2170256 - RNA, 19 nt, Human
cucuauguucuaagaagug

SEQ ID NO: 2170257 - RNA, 16 nt, Human
cucuccccaugauguu

SEQ ID NO: 2170258 - RNA, 15 nt, Human
cucuccccaugaugu

SEQ ID NO: 2170259 - RNA, 20 nt, Human
cucucuuaggagcagagcuc

SEQ ID NO: 2170260 - RNA, 18 nt, Human
cucucuuauagaauauuu

SEQ ID NO: 2170261 - RNA, 16 nt, Human
cucucugugcugugga

SEQ ID NO: 2170262 - RNA, 19 nt, Human
cucucugugggcuggcagu

SEQ ID NO: 2170263 - RNA, 19 nt, Human
cucucuuauagaauauuua

SEQ ID NO: 2170264 - RNA, 21 nt, Human
cucucuuauagaauauuuauu

SEQ ID NO: 2170265 - RNA, 16 nt, Human
cucucuucugcuccac

SEQ ID NO: 2170266 - RNA, 15 nt, Human
cucucuucugcucca

SEQ ID NO: 2170267 - RNA, 14 nt, Human
cucucuucugcucc

SEQ ID NO: 2170268 - RNA, 12 nt, Human
cucucuucugcu

SEQ ID NO: 2170269 - RNA, 23 nt, Human
cucucuuauagaauauuuauuac

SEQ ID NO: 2170270 - RNA, 23 nt, Human
cucucuggggcaggguuauuccu

SEQ ID NO: 2170271 - RNA, 18 nt, Human
cucucuggggccacacag

SEQ ID NO: 2170272 - RNA, 19 nt, Human
cucucuggggccacacaga

SEQ ID NO: 2170273 - RNA, 20 nt, Human
cucucuggggccacacagaa

SEQ ID NO: 2170274 - RNA, 15 nt, Human
cucucuggcugggga

SEQ ID NO: 2170275 - RNA, 15 nt, Human
cucuccuccccaaau

SEQ ID NO: 2170276 - RNA, 17 nt, Human
cucucuggccuuuuccu

SEQ ID NO: 2170277 - RNA, 19 nt, Human
cucucuggccuuuuccuau

SEQ ID NO: 2170278 - RNA, 13 nt, Human
cucucuggcuggg

SEQ ID NO: 2170279 - RNA, 11 nt, Human
cucuccucccc

SEQ ID NO: 2170280 - RNA, 13 nt, Human
cuccuuuguacuu

SEQ ID NO: 2170281 - RNA, 14 nt, Human
cuccuuuguacuuu

SEQ ID NO: 2170282 - RNA, 17 nt, Human
cuccuuuguacuuugug

SEQ ID NO: 2170283 - RNA, 20 nt, Human
cuccuuuguacuuugugcuu

SEQ ID NO: 2170284 - RNA, 19 nt, Human
cuccuuucaccccagggcc

SEQ ID NO: 2170285 - RNA, 20 nt, Human
cuccuuucacaaccuucugu

SEQ ID NO: 2170286 - RNA, 17 nt, Human
cuccuuugugaggaagc

SEQ ID NO: 2170287 - RNA, 18 nt, Human
cuccuuugugaggaagcc

SEQ ID NO: 2170288 - RNA, 17 nt, Human
cuccuuuggccauucca

SEQ ID NO: 2170289 - RNA, 12 nt, Human
cuccuuuguaua

SEQ ID NO: 2170290 - RNA, 13 nt, Human
cuccuuuguauau

SEQ ID NO: 2170291 - RNA, 11 nt, Human
cucggugguac

SEQ ID NO: 2170292 - RNA, 19 nt, Human
cucggugguaccaggucuc

SEQ ID NO: 2170293 - RNA, 16 nt, Human
cucgguguggagaagc

SEQ ID NO: 2170294 - RNA, 23 nt, Human
cucgguguggagaagcggcuggc

SEQ ID NO: 2170295 - RNA, 17 nt, Human
cucgguguggagaagcg

SEQ ID NO: 2170296 - RNA, 20 nt, Human
cucgucggggggacagcucc

SEQ ID NO: 2170297 - RNA, 24 nt, Human
cucguccucccccugccagugccu

SEQ ID NO: 2170298 - RNA, 17 nt, Human
cucgucugacugugugu

SEQ ID NO: 2170299 - RNA, 14 nt, Human
cucgucuucauuaa

SEQ ID NO: 2170300 - RNA, 22 nt, Human
cucguccucccccugccagugc

SEQ ID NO: 2170301 - RNA, 20 nt, Human
cucguccucccccugccagu

SEQ ID NO: 2170302 - RNA, 18 nt, Human
cucguccucccccugcca

SEQ ID NO: 2170303 - RNA, 17 nt, Human
cucguccucccccugcc

SEQ ID NO: 2170304 - RNA, 16 nt, Human
cucguccucccccugc

SEQ ID NO: 2170305 - RNA, 17 nt, Human
cucuaugccagcucagu

SEQ ID NO: 2170306 - RNA, 15 nt, Human
cucuaucuugcucug

SEQ ID NO: 2170307 - RNA, 20 nt, Human
cucuaugaacucuguuuucu

SEQ ID NO: 2170308 - RNA, 16 nt, Human
cucuaucuugcucugu

SEQ ID NO: 2170309 - RNA, 18 nt, Human
cucuaucuugcucuguaa

SEQ ID NO: 2170310 - RNA, 24 nt, Human
cucgugccagucgcgcugccugug

SEQ ID NO: 2170311 - RNA, 22 nt, Human
cucgugccagucgcgcugccug

SEQ ID NO: 2170312 - RNA, 18 nt, Human
cucgugauuggcauauaa

SEQ ID NO: 2170313 - RNA, 21 nt, Human
cucgugccagucgcgcugccu

SEQ ID NO: 2170314 - RNA, 18 nt, Human
cucugcagcugaccucug

SEQ ID NO: 2170315 - RNA, 15 nt, Human
cucugcaggcaccuu

SEQ ID NO: 2170316 - RNA, 21 nt, Human
cucugcuccucuccccagcaa

SEQ ID NO: 2170317 - RNA, 15 nt, Human
cucugcucgccuuag

SEQ ID NO: 2170318 - RNA, 13 nt, Human
cucugcucgccuu

SEQ ID NO: 2170319 - RNA, 14 nt, Human
cucugcaggcaccu

SEQ ID NO: 2170320 - RNA, 14 nt, Human
cucugcuccuggag

SEQ ID NO: 2170321 - RNA, 22 nt, Human
cucugcuccuggagccuuugaa

SEQ ID NO: 2170322 - RNA, 19 nt, Human
cucugcagccagcccagcc

SEQ ID NO: 2170323 - RNA, 18 nt, Human
cucugcagccagcccagc

SEQ ID NO: 2170324 - RNA, 17 nt, Human
cucugcagccagcccag

SEQ ID NO: 2170325 - RNA, 16 nt, Human
cucugcagccagccca

SEQ ID NO: 2170326 - RNA, 15 nt, Human
cucugcagccagccc

SEQ ID NO: 2170327 - RNA, 17 nt, Human
cucugcacuccccugcu

SEQ ID NO: 2170328 - RNA, 20 nt, Human
cucugcaggaaauggcugug

SEQ ID NO: 2170329 - RNA, 12 nt, Human
cucugcagcuga

SEQ ID NO: 2170330 - RNA, 14 nt, Human
cucugcagcugacc

SEQ ID NO: 2170331 - RNA, 15 nt, Human
cucugcagcugaccu

SEQ ID NO: 2170332 - RNA, 16 nt, Human
cucugcagcugaccuc

SEQ ID NO: 2170333 - RNA, 14 nt, Human
cucugcagcccagg

SEQ ID NO: 2170334 - RNA, 16 nt, Human
cucugcagcccaggga

SEQ ID NO: 2170335 - RNA, 21 nt, Human
cucugcugacagacacaggcc

SEQ ID NO: 2170336 - RNA, 22 nt, Human
cucugcugacagacacaggccc

SEQ ID NO: 2170337 - RNA, 20 nt, Human
cucugcugacagacacaggc

SEQ ID NO: 2170338 - RNA, 17 nt, Human
cucugcuccuggagccu

SEQ ID NO: 2170339 - RNA, 15 nt, Human
cucugcucugaggcu

SEQ ID NO: 2170340 - RNA, 17 nt, Human
cucugcucgccuuagca

SEQ ID NO: 2170341 - RNA, 16 nt, Human
cucugcucgccuuagc

SEQ ID NO: 2170342 - RNA, 15 nt, Human
cucugcugccauggc

SEQ ID NO: 2170343 - RNA, 13 nt, Human
cucugcugccaug

SEQ ID NO: 2170344 - RNA, 13 nt, Human
cucugcugcuggc

SEQ ID NO: 2170345 - RNA, 23 nt, Human
cucugcugacagacacaggcccg

SEQ ID NO: 2170346 - RNA, 11 nt, Human
cucugcucugc

SEQ ID NO: 2170347 - RNA, 12 nt, Human
cucugcucugcc

SEQ ID NO: 2170348 - RNA, 15 nt, Human
cucugcucugcccuu

SEQ ID NO: 2170349 - RNA, 13 nt, Human
cucugcucugccc

SEQ ID NO: 2170350 - RNA, 14 nt, Human
cucugcucugcccu

SEQ ID NO: 2170351 - RNA, 18 nt, Human
cucugcuggcccagccaa

SEQ ID NO: 2170352 - RNA, 14 nt, Human
cucugcuggcccag

SEQ ID NO: 2170353 - RNA, 13 nt, Human
cucugcugcuuag

SEQ ID NO: 2170354 - RNA, 13 nt, Human
cucugcugccgcc

SEQ ID NO: 2170355 - RNA, 11 nt, Human
cucugcugcuu

SEQ ID NO: 2170356 - RNA, 13 nt, Human
cucuguacagagc

SEQ ID NO: 2170357 - RNA, 14 nt, Human
cucuguacagagcc

SEQ ID NO: 2170358 - RNA, 15 nt, Human
cucuguacagagccc

SEQ ID NO: 2170359 - RNA, 16 nt, Human
cucugcugcuggcugg

SEQ ID NO: 2170360 - RNA, 16 nt, Human
cucugcugcugucccu

SEQ ID NO: 2170361 - RNA, 21 nt, Human
cucugcugccgccccacccag

SEQ ID NO: 2170362 - RNA, 21 nt, Human
cucugcugcugucccuccccc

SEQ ID NO: 2170363 - RNA, 22 nt, Human
cucugcugcugucccucccccu

SEQ ID NO: 2170364 - RNA, 14 nt, Human
cucugcugcuggcu

SEQ ID NO: 2170365 - RNA, 15 nt, Human
cucugcugcuggcug

SEQ ID NO: 2170366 - RNA, 19 nt, Human
cucuuaggaagagaaacca

SEQ ID NO: 2170367 - RNA, 13 nt, Human
cucuuagcugucu

SEQ ID NO: 2170368 - RNA, 16 nt, Human
cucuuauagaauauuu

SEQ ID NO: 2170369 - RNA, 13 nt, Human
cucuuagcugagu

SEQ ID NO: 2170370 - RNA, 17 nt, Human
cucuuauagaauauuua

SEQ ID NO: 2170371 - RNA, 18 nt, Human
cucuuauagaauauuuau

SEQ ID NO: 2170372 - RNA, 20 nt, Human
cucuuauagaauauuuauua

SEQ ID NO: 2170373 - RNA, 21 nt, Human
cucuuauagaauauuuauuac

SEQ ID NO: 2170374 - RNA, 23 nt, Human
cucuguccccuucucucaucucu

SEQ ID NO: 2170375 - RNA, 11 nt, Human
cucuguccuga

SEQ ID NO: 2170376 - RNA, 13 nt, Human
cucuguccugacu

SEQ ID NO: 2170377 - RNA, 12 nt, Human
cucuuagcugag

SEQ ID NO: 2170378 - RNA, 18 nt, Human
cucuguccugacuucagg

SEQ ID NO: 2170379 - RNA, 13 nt, Human
cucugcuggccug

SEQ ID NO: 2170380 - RNA, 22 nt, Human
cucugucccacuuggcaucagc

SEQ ID NO: 2170381 - RNA, 16 nt, Human
cucuguacagagccca

SEQ ID NO: 2170382 - RNA, 14 nt, Human
cucuguccccuucu

SEQ ID NO: 2170383 - RNA, 14 nt, Human
cucugcuggccgga

SEQ ID NO: 2170384 - RNA, 15 nt, Human
cucuguccccuucuc

SEQ ID NO: 2170385 - RNA, 17 nt, Human
cucuguccccuucucuc

SEQ ID NO: 2170386 - RNA, 18 nt, Human
cucuguccccuucucuca

SEQ ID NO: 2170387 - RNA, 21 nt, Human
cucuguccccuucucucaucu

SEQ ID NO: 2170388 - RNA, 15 nt, Human
cucugcacagaugga

SEQ ID NO: 2170389 - RNA, 14 nt, Human
cucugcacagaugg

SEQ ID NO: 2170390 - RNA, 10 nt, Human
cucugcacag

SEQ ID NO: 2170391 - RNA, 13 nt, Human
cucugcacauguc

SEQ ID NO: 2170392 - RNA, 14 nt, Human
cucugcacaugucu

SEQ ID NO: 2170393 - RNA, 14 nt, Human
cucugcacuccccu

SEQ ID NO: 2170394 - RNA, 15 nt, Human
cucugcacuccccug

SEQ ID NO: 2170395 - RNA, 16 nt, Human
cucugcacuccccugc

SEQ ID NO: 2170396 - RNA, 21 nt, Human
cucugcacaagcugcacccuc

SEQ ID NO: 2170397 - RNA, 20 nt, Human
cucugcacaagcugcacccu

SEQ ID NO: 2170398 - RNA, 19 nt, Human
cuccuggcccacugcaucg

SEQ ID NO: 2170399 - RNA, 23 nt, Human
cuccucuucuuuuuuuucauuau

SEQ ID NO: 2170400 - RNA, 19 nt, Human
cuccucuucugacgugccu

SEQ ID NO: 2170401 - RNA, 12 nt, Human
cuccucuugcca

SEQ ID NO: 2170402 - RNA, 15 nt, Human
cuccucuugccacug

SEQ ID NO: 2170403 - RNA, 16 nt, Human
cuccucuugccacugc

SEQ ID NO: 2170404 - RNA, 22 nt, Human
cuccuggcucuugauacccccc

SEQ ID NO: 2170405 - RNA, 19 nt, Human
cuccuggccucaagugauu

SEQ ID NO: 2170406 - RNA, 18 nt, Human
cuccugggcuaagugauc

SEQ ID NO: 2170407 - RNA, 20 nt, Human
cuccugggcccucucugcuc

SEQ ID NO: 2170408 - RNA, 19 nt, Human
cuccugggcccucucugcu

SEQ ID NO: 2170409 - RNA, 17 nt, Human
cuccugggcccucucug

SEQ ID NO: 2170410 - RNA, 15 nt, Human
cuccugggcccucuc

SEQ ID NO: 2170411 - RNA, 13 nt, Human
cuccucugggcag

SEQ ID NO: 2170412 - RNA, 12 nt, Human
cuccucugggca

SEQ ID NO: 2170413 - RNA, 21 nt, Human
cuccucuggacggcaggcuca

SEQ ID NO: 2170414 - RNA, 15 nt, Human
cuccucugcugcugg

SEQ ID NO: 2170415 - RNA, 13 nt, Human
cuccucugcugcu

SEQ ID NO: 2170416 - RNA, 14 nt, Human
cuccucugcugcug

SEQ ID NO: 2170417 - RNA, 13 nt, Human
cuccucugucccu

SEQ ID NO: 2170418 - RNA, 14 nt, Human
cuccucuuccaggc

SEQ ID NO: 2170419 - RNA, 18 nt, Human
cuccucuguccagggccc

SEQ ID NO: 2170420 - RNA, 17 nt, Human
cuccucuguccagggcc

SEQ ID NO: 2170421 - RNA, 14 nt, Human
cuccucuguccagg

SEQ ID NO: 2170422 - RNA, 23 nt, Human
cuccucugggcaggaccucagag

SEQ ID NO: 2170423 - RNA, 15 nt, Human
cuccucugggcagga

SEQ ID NO: 2170424 - RNA, 12 nt, Human
cuccucugucca

SEQ ID NO: 2170425 - RNA, 16 nt, Human
cuccucuguccagggc

SEQ ID NO: 2170426 - RNA, 15 nt, Human
cuccucuguccaggg

SEQ ID NO: 2170427 - RNA, 15 nt, Human
cuccucuguccaggc

SEQ ID NO: 2170428 - RNA, 15 nt, Human
cuccugucugccagc

SEQ ID NO: 2170429 - RNA, 14 nt, Human
cuccugucugccag

SEQ ID NO: 2170430 - RNA, 16 nt, Human
cuccugucugccagcc

SEQ ID NO: 2170431 - RNA, 16 nt, Human
cuccuuguaaagacug

SEQ ID NO: 2170432 - RNA, 13 nt, Human
cuccugucugcca

SEQ ID NO: 2170433 - RNA, 13 nt, Human
cuccuguccuuua

SEQ ID NO: 2170434 - RNA, 21 nt, Human
cuccuguccucccauccccug

SEQ ID NO: 2170435 - RNA, 14 nt, Human
cuccuuguguuacu

SEQ ID NO: 2170436 - RNA, 16 nt, Human
cuccuuguggccuggg

SEQ ID NO: 2170437 - RNA, 17 nt, Human
cuccugucuaacugcug

SEQ ID NO: 2170438 - RNA, 15 nt, Human
cuccuuguccaccca

SEQ ID NO: 2170439 - RNA, 20 nt, Human
cuccuuguggccugggccuc

SEQ ID NO: 2170440 - RNA, 16 nt, Human
cuccuuguccacccac

SEQ ID NO: 2170441 - RNA, 18 nt, Human
cuccuuguggccugggcc

SEQ ID NO: 2170442 - RNA, 13 nt, Human
cuccuuucacaac

SEQ ID NO: 2170443 - RNA, 15 nt, Human
cuccuuguuccuaga

SEQ ID NO: 2170444 - RNA, 14 nt, Human
cuccuuguuccuag

SEQ ID NO: 2170445 - RNA, 13 nt, Human
cuccuuguuccua

SEQ ID NO: 2170446 - RNA, 12 nt, Human
cuccuuguuccu

SEQ ID NO: 2170447 - RNA, 18 nt, Human
cuccuugugguuuauguc

SEQ ID NO: 2170448 - RNA, 17 nt, Human
cuccuugugguuuaugu

SEQ ID NO: 2170449 - RNA, 15 nt, Human
cuccuuucaccacau

SEQ ID NO: 2170450 - RNA, 16 nt, Human
cuccuuucacaaccuu

SEQ ID NO: 2170451 - RNA, 17 nt, Human
cuccuuucacaaccuuc

SEQ ID NO: 2170452 - RNA, 23 nt, Human
cuccuggucuugagaugucuucu

SEQ ID NO: 2170453 - RNA, 15 nt, Human
cuccuggucuugaga

SEQ ID NO: 2170454 - RNA, 14 nt, Human
cuccuggugggucc

SEQ ID NO: 2170455 - RNA, 20 nt, Human
cuccugguggguccaggggc

SEQ ID NO: 2170456 - RNA, 22 nt, Human
cuccuggguuuuguauucucug

SEQ ID NO: 2170457 - RNA, 23 nt, Human
cuccuggguuuuguauucucuga

SEQ ID NO: 2170458 - RNA, 13 nt, Human
cuccugggcucag

SEQ ID NO: 2170459 - RNA, 22 nt, Human
cuccugggcccucucugcucug

SEQ ID NO: 2170460 - RNA, 21 nt, Human
cuccugggcccucucugcucu

SEQ ID NO: 2170461 - RNA, 17 nt, Human
cuccuguacuuuuucca

SEQ ID NO: 2170462 - RNA, 14 nt, Human
cuccuguaauuccu

SEQ ID NO: 2170463 - RNA, 16 nt, Human
cuccuguaauuccuac

SEQ ID NO: 2170464 - RNA, 14 nt, Human
cuccuguccaaccu

SEQ ID NO: 2170465 - RNA, 18 nt, Human
cuccuguaauuccuaccu

SEQ ID NO: 2170466 - RNA, 12 nt, Human
cuccuguccucc

SEQ ID NO: 2170467 - RNA, 13 nt, Human
cuccuguccuccc

SEQ ID NO: 2170468 - RNA, 15 nt, Human
cuccuguccucccau

SEQ ID NO: 2170469 - RNA, 20 nt, Human
cuccuguccucccauccccu

SEQ ID NO: 2170470 - RNA, 16 nt, Human
cuccuguaccucuuga

SEQ ID NO: 2170471 - RNA, 20 nt, Human
cuccuguaacauacuggccu

SEQ ID NO: 2170472 - RNA, 17 nt, Human
cuccugguggguccagg

SEQ ID NO: 2170473 - RNA, 21 nt, Human
cuccuguaaaugguguacaua

SEQ ID NO: 2170474 - RNA, 22 nt, Human
cuccuguaacauacuggccugg

SEQ ID NO: 2170475 - RNA, 23 nt, Human
cuccuguaacauacuggccugga

SEQ ID NO: 2170476 - RNA, 15 nt, Human
cuccuacccugcgcc

SEQ ID NO: 2170477 - RNA, 18 nt, Human
cuccuaccccucccagcu

SEQ ID NO: 2170478 - RNA, 19 nt, Human
cuccuaccccucccagcug

SEQ ID NO: 2170479 - RNA, 18 nt, Human
cuccuacccugcgcccag

SEQ ID NO: 2170480 - RNA, 23 nt, Human
cuccuaccccucccagcugacag

SEQ ID NO: 2170481 - RNA, 21 nt, Human
cuccuaccgaaaccuugccuu

SEQ ID NO: 2170482 - RNA, 15 nt, Human
cuccuaccucagccu

SEQ ID NO: 2170483 - RNA, 14 nt, Human
cuccuaccucagcc

SEQ ID NO: 2170484 - RNA, 13 nt, Human
cuccuaccucagc

SEQ ID NO: 2170485 - RNA, 12 nt, Human
cuccuaccucag

SEQ ID NO: 2170486 - RNA, 18 nt, Human
cuccuaccucagccuaga

SEQ ID NO: 2170487 - RNA, 16 nt, Human
cuccuaccucagccua

SEQ ID NO: 2170488 - RNA, 13 nt, Human
cuccuaccuggua

SEQ ID NO: 2170489 - RNA, 22 nt, Human
cuccuaccgaaaccuugccuuu

SEQ ID NO: 2170490 - RNA, 12 nt, Human
cuccuagacuga

SEQ ID NO: 2170491 - RNA, 17 nt, Human
cuccucugccaccuccc

SEQ ID NO: 2170492 - RNA, 16 nt, Human
cuccucugccaccucc

SEQ ID NO: 2170493 - RNA, 15 nt, Human
cuccucugccaccuc

SEQ ID NO: 2170494 - RNA, 14 nt, Human
cuccucugccaccu

SEQ ID NO: 2170495 - RNA, 12 nt, Human
cuccucugccac

SEQ ID NO: 2170496 - RNA, 11 nt, Human
cuccucugcca

SEQ ID NO: 2170497 - RNA, 17 nt, Human
cuccucugcagugccuu

SEQ ID NO: 2170498 - RNA, 18 nt, Human
cuccucugcagugccuug

SEQ ID NO: 2170499 - RNA, 16 nt, Human
cuccucugcagugccu

SEQ ID NO: 2170500 - RNA, 22 nt, Human
cuccucugacucagggcuccug

SEQ ID NO: 2170501 - RNA, 20 nt, Human
cuccucugacucagggcucc

SEQ ID NO: 2170502 - RNA, 19 nt, Human
cuccucugacucagggcuc

SEQ ID NO: 2170503 - RNA, 18 nt, Human
cuccucugacucagggcu

SEQ ID NO: 2170504 - RNA, 13 nt, Human
cuccucugacuca

SEQ ID NO: 2170505 - RNA, 21 nt, Human
cuccggcccuccuacccugcg

SEQ ID NO: 2170506 - RNA, 15 nt, Human
cuccggccuccccuc

SEQ ID NO: 2170507 - RNA, 14 nt, Human
cuccggccuccccu

SEQ ID NO: 2170508 - RNA, 20 nt, Human
cuccggccugaugacagagc

SEQ ID NO: 2170509 - RNA, 22 nt, Human
cuccggagugagaagcuuugcc

SEQ ID NO: 2170510 - RNA, 16 nt, Human
cuccggaucgaggccu

SEQ ID NO: 2170511 - RNA, 13 nt, Human
cuccggagacagg

SEQ ID NO: 2170512 - RNA, 14 nt, Human
cuccuaccccuccc

SEQ ID NO: 2170513 - RNA, 16 nt, Human
cuccuaccccucccag

SEQ ID NO: 2170514 - RNA, 17 nt, Human
cuccuaccccucccagc

SEQ ID NO: 2170515 - RNA, 23 nt, Human
cuccggcgucagccuccagccuc

SEQ ID NO: 2170516 - RNA, 22 nt, Human
cuccggccugaugacagagcga

SEQ ID NO: 2170517 - RNA, 14 nt, Human
cuccggcgucagcc

SEQ ID NO: 2170518 - RNA, 16 nt, Human
cuccggcgucagccuc

SEQ ID NO: 2170519 - RNA, 17 nt, Human
cuccggcgucagccucc

SEQ ID NO: 2170520 - RNA, 18 nt, Human
cuccggcgucagccucca

SEQ ID NO: 2170521 - RNA, 20 nt, Human
cuccggcgucagccuccagc

SEQ ID NO: 2170522 - RNA, 21 nt, Human
cuccggcgucagccuccagcc

SEQ ID NO: 2170523 - RNA, 22 nt, Human
cuccggcgucagccuccagccu

SEQ ID NO: 2170524 - RNA, 23 nt, Human
cuccgcuuucuacccagcgagcc

SEQ ID NO: 2170525 - RNA, 23 nt, Human
cucccacugggguccagggagca

SEQ ID NO: 2170526 - RNA, 19 nt, Human
cucccacuucccugacacu

SEQ ID NO: 2170527 - RNA, 18 nt, Human
cucccacuucccugacac

SEQ ID NO: 2170528 - RNA, 24 nt, Human
cucccagaacacacuccaucagcu

SEQ ID NO: 2170529 - RNA, 13 nt, Human
cucccacuuggcc

SEQ ID NO: 2170530 - RNA, 15 nt, Human
cucccacuuggccaa

SEQ ID NO: 2170531 - RNA, 16 nt, Human
cucccagaacacacuc

SEQ ID NO: 2170532 - RNA, 15 nt, Human
cucccagaccugccu

SEQ ID NO: 2170533 - RNA, 22 nt, Human
cucccacuuggccaagcaggga

SEQ ID NO: 2170534 - RNA, 17 nt, Human
cucccagaccugccucu

SEQ ID NO: 2170535 - RNA, 20 nt, Human
cucccagaccugccucuucc

SEQ ID NO: 2170536 - RNA, 11 nt, Human
cucccagcuga

SEQ ID NO: 2170537 - RNA, 20 nt, Human
cuccaguauucuugucaaaa

SEQ ID NO: 2170538 - RNA, 15 nt, Human
cucccacaggcccuu

SEQ ID NO: 2170539 - RNA, 14 nt, Human
cucccacaggcccu

SEQ ID NO: 2170540 - RNA, 16 nt, Human
cucccacaggcccuuc

SEQ ID NO: 2170541 - RNA, 20 nt, Human
cucccacaggcccuuccucu

SEQ ID NO: 2170542 - RNA, 21 nt, Human
cucccacaggcccuuccucuc

SEQ ID NO: 2170543 - RNA, 11 nt, Human
cucccacagug

SEQ ID NO: 2170544 - RNA, 12 nt, Human
cucccacaguga

SEQ ID NO: 2170545 - RNA, 14 nt, Human
cucccacugaguuu

SEQ ID NO: 2170546 - RNA, 14 nt, Human
cucccacagugacu

SEQ ID NO: 2170547 - RNA, 20 nt, Human
cucccacagugacucgggcu

SEQ ID NO: 2170548 - RNA, 22 nt, Human
cucccacagugacucgggcucc

SEQ ID NO: 2170549 - RNA, 21 nt, Human
cucccacgugggagacaagaa

SEQ ID NO: 2170550 - RNA, 14 nt, Human
cuccaguauucuug

SEQ ID NO: 2170551 - RNA, 22 nt, Human
cuccagguuuuucaauuaaacg

SEQ ID NO: 2170552 - RNA, 23 nt, Human
cuccagguuuuucaauuaaacgg

SEQ ID NO: 2170553 - RNA, 18 nt, Human
cuccagguuuuucaauua

SEQ ID NO: 2170554 - RNA, 19 nt, Human
cuccagguuuuucaauuaa

SEQ ID NO: 2170555 - RNA, 20 nt, Human
cuccagguuuuucaauuaaa

SEQ ID NO: 2170556 - RNA, 21 nt, Human
cuccagguuuuucaauuaaac

SEQ ID NO: 2170557 - RNA, 14 nt, Human
cuccaggugugcac

SEQ ID NO: 2170558 - RNA, 12 nt, Human
cuccagguuuuu

SEQ ID NO: 2170559 - RNA, 13 nt, Human
cuccagguuuuuc

SEQ ID NO: 2170560 - RNA, 14 nt, Human
cuccagguuuuuca

SEQ ID NO: 2170561 - RNA, 15 nt, Human
cuccagguuuuucaa

SEQ ID NO: 2170562 - RNA, 16 nt, Human
cuccagguuuuucaau

SEQ ID NO: 2170563 - RNA, 17 nt, Human
cuccagguuuuucaauu

SEQ ID NO: 2170564 - RNA, 23 nt, Human
cuccaggugcacaagcuccaagc

SEQ ID NO: 2170565 - RNA, 14 nt, Human
cuccagguggcucu

SEQ ID NO: 2170566 - RNA, 17 nt, Human
cuccagguggcucugag

SEQ ID NO: 2170567 - RNA, 15 nt, Human
cuccaggcuccuuua

SEQ ID NO: 2170568 - RNA, 23 nt, Human
cuccaggcuccuuuagcgcccag

SEQ ID NO: 2170569 - RNA, 20 nt, Human
cuccaggcuguaucccauga

SEQ ID NO: 2170570 - RNA, 15 nt, Human
cucaugguggguuca

SEQ ID NO: 2170571 - RNA, 16 nt, Human
cucaugggguccaagu

SEQ ID NO: 2170572 - RNA, 20 nt, Human
cucauggccccucugaccug

SEQ ID NO: 2170573 - RNA, 16 nt, Human
cucauguaucaucugg

SEQ ID NO: 2170574 - RNA, 16 nt, Human
cucauguacauacccu

SEQ ID NO: 2170575 - RNA, 19 nt, Human
cucauguaucaucuggaua

SEQ ID NO: 2170576 - RNA, 20 nt, Human
cucaugcaucuccaccugcu

SEQ ID NO: 2170577 - RNA, 17 nt, Human
cucauguaucaucugga

SEQ ID NO: 2170578 - RNA, 11 nt, Human
cucccccugcc

SEQ ID NO: 2170579 - RNA, 17 nt, Human
cucccccucccccuucu

SEQ ID NO: 2170580 - RNA, 13 nt, Human
cuccccggcccua

SEQ ID NO: 2170581 - RNA, 22 nt, Human
cucccccgggaggggcccgcuu

SEQ ID NO: 2170582 - RNA, 18 nt, Human
cucccccgggaggggccc

SEQ ID NO: 2170583 - RNA, 21 nt, Human
cucccccgggaggggcccgcu

SEQ ID NO: 2170584 - RNA, 15 nt, Human
cucccccgccacucc

SEQ ID NO: 2170585 - RNA, 13 nt, Human
cucccccgggagg

SEQ ID NO: 2170586 - RNA, 17 nt, Human
cucccccgggaggggcc

SEQ ID NO: 2170587 - RNA, 21 nt, Human
cucccccccaugcacugugaa

SEQ ID NO: 2170588 - RNA, 20 nt, Human
cucccccccaugcacuguga

SEQ ID NO: 2170589 - RNA, 16 nt, Human
cuccccccccccucca

SEQ ID NO: 2170590 - RNA, 17 nt, Human
cuccccccccccuccaa

SEQ ID NO: 2170591 - RNA, 13 nt, Human
cucccccccgggg

SEQ ID NO: 2170592 - RNA, 12 nt, Human
cucccccgccac

SEQ ID NO: 2170593 - RNA, 21 nt, Human
cucccccccggggcuggguug

SEQ ID NO: 2170594 - RNA, 14 nt, Human
cucccccgccacuc

SEQ ID NO: 2170595 - RNA, 14 nt, Human
cucccccccggggc

SEQ ID NO: 2170596 - RNA, 15 nt, Human
cucccccccggggcu

SEQ ID NO: 2170597 - RNA, 18 nt, Human
cucccccccggggcuggg

SEQ ID NO: 2170598 - RNA, 19 nt, Human
cucccccccggggcugggu

SEQ ID NO: 2170599 - RNA, 19 nt, Human
cucccaggagacaguucaa

SEQ ID NO: 2170600 - RNA, 18 nt, Human
cucccccccaugcacugu

SEQ ID NO: 2170601 - RNA, 11 nt, Human
cucccaggaag

SEQ ID NO: 2170602 - RNA, 16 nt, Human
cucccaggagacaguu

SEQ ID NO: 2170603 - RNA, 18 nt, Human
cucccaggaacugggcca

SEQ ID NO: 2170604 - RNA, 21 nt, Human
cucccagcugacaguccucuc

SEQ ID NO: 2170605 - RNA, 11 nt, Human
cucccaggaac

SEQ ID NO: 2170606 - RNA, 18 nt, Human
cucccagcugacaguccu

SEQ ID NO: 2170607 - RNA, 20 nt, Human
cucccagcugacaguccucu

SEQ ID NO: 2170608 - RNA, 23 nt, Human
cucccagcugacaguccucucca

SEQ ID NO: 2170609 - RNA, 15 nt, Human
cuccccuaaugccug

SEQ ID NO: 2170610 - RNA, 16 nt, Human
cuccccuaaugccugc

SEQ ID NO: 2170611 - RNA, 19 nt, Human
cuccccuauccacccagcc

SEQ ID NO: 2170612 - RNA, 18 nt, Human
cuccccuauccacccagc

SEQ ID NO: 2170613 - RNA, 17 nt, Human
cuccccuauccacccag

SEQ ID NO: 2170614 - RNA, 15 nt, Human
cuccccuaccacugu

SEQ ID NO: 2170615 - RNA, 14 nt, Human
cuccccggcucgag

SEQ ID NO: 2170616 - RNA, 14 nt, Human
cuccccggcccuac

SEQ ID NO: 2170617 - RNA, 16 nt, Human
cuccccggcccuacca

SEQ ID NO: 2170618 - RNA, 13 nt, Human
cuccccucacagc

SEQ ID NO: 2170619 - RNA, 20 nt, Human
cuccccucaaagucugcaac

SEQ ID NO: 2170620 - RNA, 14 nt, Human
cuccccucacagcc

SEQ ID NO: 2170621 - RNA, 23 nt, Human
cuccccuauccacccagcccauu

SEQ ID NO: 2170622 - RNA, 21 nt, Human
cuccccuauccacccagccca

SEQ ID NO: 2170623 - RNA, 10 nt, Human
cuccccucaa

SEQ ID NO: 2170624 - RNA, 18 nt, Human
cuccccucaaagucugca

SEQ ID NO: 2170625 - RNA, 15 nt, Human
cuccccucacagccu

SEQ ID NO: 2170626 - RNA, 16 nt, Human
cuccccucacagccuc

SEQ ID NO: 2170627 - RNA, 17 nt, Human
cuccccucacagccucu

SEQ ID NO: 2170628 - RNA, 18 nt, Human
cuccccucacagccucug

SEQ ID NO: 2170629 - RNA, 17 nt, Human
cucccucgucgagcugg

SEQ ID NO: 2170630 - RNA, 19 nt, Human
cucccucuacugggagccu

SEQ ID NO: 2170631 - RNA, 13 nt, Human
cucccucuacugg

SEQ ID NO: 2170632 - RNA, 12 nt, Human
cucccucccaca

SEQ ID NO: 2170633 - RNA, 20 nt, Human
cucccucuuucccucccuuc

SEQ ID NO: 2170634 - RNA, 12 nt, Human
cucccucuccug

SEQ ID NO: 2170635 - RNA, 21 nt, Human
cucccucucacugucugagag

SEQ ID NO: 2170636 - RNA, 22 nt, Human
cucccucucacugucugagagu

SEQ ID NO: 2170637 - RNA, 19 nt, Human
cucccuccugccgacuccu

SEQ ID NO: 2170638 - RNA, 20 nt, Human
cucccucuacugggagccua

SEQ ID NO: 2170639 - RNA, 14 nt, Human
cucccucuauuuau

SEQ ID NO: 2170640 - RNA, 10 nt, Human
cucccucuca

SEQ ID NO: 2170641 - RNA, 14 nt, Human
cucccucucacugu

SEQ ID NO: 2170642 - RNA, 15 nt, Human
cucccucucacuguc

SEQ ID NO: 2170643 - RNA, 16 nt, Human
cucccucucacugucu

SEQ ID NO: 2170644 - RNA, 23 nt, Human
cucccugaaaauguuuuucugcc

SEQ ID NO: 2170645 - RNA, 21 nt, Human
cucccugaaaauguuuuucug

SEQ ID NO: 2170646 - RNA, 19 nt, Human
cucccugaaccaucccuga

SEQ ID NO: 2170647 - RNA, 13 nt, Human
cucccugaagcca

SEQ ID NO: 2170648 - RNA, 14 nt, Human
cucccugaagccag

SEQ ID NO: 2170649 - RNA, 20 nt, Human
cucccugaaguaagcaaaga

SEQ ID NO: 2170650 - RNA, 15 nt, Human
cucccugaagccagc

SEQ ID NO: 2170651 - RNA, 16 nt, Human
cucccugaagccagcc

SEQ ID NO: 2170652 - RNA, 17 nt, Human
cucccugaagccagccu

SEQ ID NO: 2170653 - RNA, 18 nt, Human
cucccugaagccagccuu

SEQ ID NO: 2170654 - RNA, 18 nt, Human
cucccugaagccuuugca

SEQ ID NO: 2170655 - RNA, 19 nt, Human
cucccugaagccagccuuc

SEQ ID NO: 2170656 - RNA, 16 nt, Human
cucccugacccgucua

SEQ ID NO: 2170657 - RNA, 18 nt, Human
ccuucccugucugccagg

SEQ ID NO: 2170658 - RNA, 17 nt, Human
ccuucccugucccucua

SEQ ID NO: 2170659 - RNA, 15 nt, Human
ccuucccugggcugu

SEQ ID NO: 2170660 - RNA, 18 nt, Human
ccuucccugggcugugcu

SEQ ID NO: 2170661 - RNA, 19 nt, Human
ccuucccugggcugugcua

SEQ ID NO: 2170662 - RNA, 12 nt, Human
ccuucccugucc

SEQ ID NO: 2170663 - RNA, 13 nt, Human
ccuucccuguccc

SEQ ID NO: 2170664 - RNA, 14 nt, Human
ccuucccugucccu

SEQ ID NO: 2170665 - RNA, 15 nt, Human
ccuucccugucccuc

SEQ ID NO: 2170666 - RNA, 16 nt, Human
ccuucccugucccucu

SEQ ID NO: 2170667 - RNA, 12 nt, Human
ccuucccugcaa

SEQ ID NO: 2170668 - RNA, 14 nt, Human
ccuucccugggcug

SEQ ID NO: 2170669 - RNA, 11 nt, Human
ccuucccuggc

SEQ ID NO: 2170670 - RNA, 12 nt, Human
ccuucccucucc

SEQ ID NO: 2170671 - RNA, 24 nt, Human
ccuucccucaccuuggcaccagac

SEQ ID NO: 2170672 - RNA, 16 nt, Human
ccuucccuugagcccu

SEQ ID NO: 2170673 - RNA, 17 nt, Human
ccuucccuucuccaucu

SEQ ID NO: 2170674 - RNA, 18 nt, Human
ccuuccuaauuccacagc

SEQ ID NO: 2170675 - RNA, 19 nt, Human
ccuuccguaacccaacucu

SEQ ID NO: 2170676 - RNA, 20 nt, Human
ccuuccuaauuccacagcug

SEQ ID NO: 2170677 - RNA, 19 nt, Human
ccuuccuaauuccacagcu

SEQ ID NO: 2170678 - RNA, 22 nt, Human
ccuuccccuugcccagggcuca

SEQ ID NO: 2170679 - RNA, 23 nt, Human
ccuucccucaccuuggcaccaga

SEQ ID NO: 2170680 - RNA, 12 nt, Human
ccuucccuagcu

SEQ ID NO: 2170681 - RNA, 15 nt, Human
ccuucccuagcuuua

SEQ ID NO: 2170682 - RNA, 20 nt, Human
ccuuccccuugcccagggcu

SEQ ID NO: 2170683 - RNA, 18 nt, Human
ccuuccccuugcccaggg

SEQ ID NO: 2170684 - RNA, 18 nt, Human
ccuuccccucccuggcuc

SEQ ID NO: 2170685 - RNA, 17 nt, Human
ccuuccccucccuggcu

SEQ ID NO: 2170686 - RNA, 15 nt, Human
ccuuccccucccugg

SEQ ID NO: 2170687 - RNA, 13 nt, Human
ccuuccccgaggg

SEQ ID NO: 2170688 - RNA, 23 nt, Human
ccuuccccgagggaugaugccac

SEQ ID NO: 2170689 - RNA, 22 nt, Human
ccuuccccucccuggcucccau

SEQ ID NO: 2170690 - RNA, 19 nt, Human
ccuuccccucccuggcucc

SEQ ID NO: 2170691 - RNA, 16 nt, Human
ccuuccccuccuucuc

SEQ ID NO: 2170692 - RNA, 15 nt, Human
ccuuccccagccucu

SEQ ID NO: 2170693 - RNA, 22 nt, Human
ccuuccccacugccugcccacc

SEQ ID NO: 2170694 - RNA, 13 nt, Human
ccuuccccagccu

SEQ ID NO: 2170695 - RNA, 12 nt, Human
ccuuccccacug

SEQ ID NO: 2170696 - RNA, 23 nt, Human
ccuucccaugacccaggcugggc

SEQ ID NO: 2170697 - RNA, 20 nt, Human
ccuuccccacugccugccca

SEQ ID NO: 2170698 - RNA, 19 nt, Human
ccuuccccacugcacacac

SEQ ID NO: 2170699 - RNA, 19 nt, Human
ccuucccccuccaauccca

SEQ ID NO: 2170700 - RNA, 13 nt, Human
ccuuccccauggg

SEQ ID NO: 2170701 - RNA, 15 nt, Human
ccuuccccagcgucc

SEQ ID NO: 2170702 - RNA, 17 nt, Human
ccuucccccucccaggg

SEQ ID NO: 2170703 - RNA, 16 nt, Human
ccuucccccucccagg

SEQ ID NO: 2170704 - RNA, 20 nt, Human
ccuucccccucccagggcca

SEQ ID NO: 2170705 - RNA, 16 nt, Human
ccuuccucuccacugc

SEQ ID NO: 2170706 - RNA, 17 nt, Human
ccuuccucuccacugcc

SEQ ID NO: 2170707 - RNA, 20 nt, Human
ccuucucuccagccccugga

SEQ ID NO: 2170708 - RNA, 21 nt, Human
ccuuccucuccacccucccag

SEQ ID NO: 2170709 - RNA, 19 nt, Human
ccuuccucgcagagaggcc

SEQ ID NO: 2170710 - RNA, 15 nt, Human
ccuuccucgcagaga

SEQ ID NO: 2170711 - RNA, 17 nt, Human
ccuuccucgcagagagg

SEQ ID NO: 2170712 - RNA, 13 nt, Human
ccuuccuccuggg

SEQ ID NO: 2170713 - RNA, 12 nt, Human
ccuuccuccugg

SEQ ID NO: 2170714 - RNA, 14 nt, Human
ccuuccucuccacu

SEQ ID NO: 2170715 - RNA, 15 nt, Human
ccuuccucuccacug

SEQ ID NO: 2170716 - RNA, 22 nt, Human
ccuuccucccaccucccccucc

SEQ ID NO: 2170717 - RNA, 20 nt, Human
ccuuccucauccaccccauc

SEQ ID NO: 2170718 - RNA, 21 nt, Human
ccuuccucauccaccccaucc

SEQ ID NO: 2170719 - RNA, 16 nt, Human
ccuuccucauccaccc

SEQ ID NO: 2170720 - RNA, 17 nt, Human
ccuuccucauccacccc

SEQ ID NO: 2170721 - RNA, 18 nt, Human
ccuuccucauccacccca

SEQ ID NO: 2170722 - RNA, 19 nt, Human
ccuuccucauccaccccau

SEQ ID NO: 2170723 - RNA, 14 nt, Human
ccuuccucacugcc

SEQ ID NO: 2170724 - RNA, 15 nt, Human
ccuuccucacuucca

SEQ ID NO: 2170725 - RNA, 22 nt, Human
ccuuccucaguuuaauccuucu

SEQ ID NO: 2170726 - RNA, 21 nt, Human
ccuuccuaauuccacagcugc

SEQ ID NO: 2170727 - RNA, 20 nt, Human
ccuuccuacacccuuggacu

SEQ ID NO: 2170728 - RNA, 16 nt, Human
ccuuccuacagauagu

SEQ ID NO: 2170729 - RNA, 20 nt, Human
ccuuccucuccacugccuuc

SEQ ID NO: 2170730 - RNA, 22 nt, Human
ccuuccucuccacccucccaga

SEQ ID NO: 2170731 - RNA, 15 nt, Human
ccuucucuccucccc

SEQ ID NO: 2170732 - RNA, 16 nt, Human
ccuucucuccucccca

SEQ ID NO: 2170733 - RNA, 20 nt, Human
ccuucucucucaauuuuugg

SEQ ID NO: 2170734 - RNA, 17 nt, Human
ccuucucuccuccccaa

SEQ ID NO: 2170735 - RNA, 20 nt, Human
ccuucucuccuccccaaauc

SEQ ID NO: 2170736 - RNA, 21 nt, Human
ccuucucuccagccccuggau

SEQ ID NO: 2170737 - RNA, 23 nt, Human
ccuucucuccagccccuggaugc

SEQ ID NO: 2170738 - RNA, 22 nt, Human
ccuucucugcuccaccacaucc

SEQ ID NO: 2170739 - RNA, 21 nt, Human
ccuucucuguagggaacucug

SEQ ID NO: 2170740 - RNA, 17 nt, Human
ccuucucugucucaugu

SEQ ID NO: 2170741 - RNA, 20 nt, Human
ccuucucugcuccaccacau

SEQ ID NO: 2170742 - RNA, 17 nt, Human
ccuucucugcuccacca

SEQ ID NO: 2170743 - RNA, 16 nt, Human
ccuucucugcuccacc

SEQ ID NO: 2170744 - RNA, 14 nt, Human
ccuucucugcucca

SEQ ID NO: 2170745 - RNA, 13 nt, Human
ccuucucugcucc

SEQ ID NO: 2170746 - RNA, 14 nt, Human
ccuucucugaagga

SEQ ID NO: 2170747 - RNA, 16 nt, Human
ccuucucugaaggaca

SEQ ID NO: 2170748 - RNA, 22 nt, Human
ccuucuguccuacucuguguca

SEQ ID NO: 2170749 - RNA, 14 nt, Human
ccuucucuuaauuu

SEQ ID NO: 2170750 - RNA, 15 nt, Human
ccuucuguccuggug

SEQ ID NO: 2170751 - RNA, 21 nt, Human
ccuucucuguucauuuccuca

SEQ ID NO: 2170752 - RNA, 19 nt, Human
ccuucucuguucauuuccu

SEQ ID NO: 2170753 - RNA, 16 nt, Human
ccuucuguccuggugu

SEQ ID NO: 2170754 - RNA, 17 nt, Human
ccuucuguccugguguc

SEQ ID NO: 2170755 - RNA, 20 nt, Human
ccuucuguccuacucugugu

SEQ ID NO: 2170756 - RNA, 21 nt, Human
ccuucuguccuacucuguguc

SEQ ID NO: 2170757 - RNA, 17 nt, Human
ccuucucuucacaguca

SEQ ID NO: 2170758 - RNA, 18 nt, Human
ccuucucuguucauuucc

SEQ ID NO: 2170759 - RNA, 17 nt, Human
ccuucucuguucauuuc

SEQ ID NO: 2170760 - RNA, 13 nt, Human
ccuucucuguuca

SEQ ID NO: 2170761 - RNA, 19 nt, Human
ccuucucugucucaugugu

SEQ ID NO: 2170762 - RNA, 13 nt, Human
ccuuuauuuuaga

SEQ ID NO: 2170763 - RNA, 21 nt, Human
ccuuuauuguguuugucauua

SEQ ID NO: 2170764 - RNA, 15 nt, Human
ccuuucaauaggaaa

SEQ ID NO: 2170765 - RNA, 16 nt, Human
ccuuuauuaaaaucuu

SEQ ID NO: 2170766 - RNA, 14 nt, Human
ccuuuauuaaaauc

SEQ ID NO: 2170767 - RNA, 23 nt, Human
ccuuuauuacccccuccuucaga

SEQ ID NO: 2170768 - RNA, 14 nt, Human
ccuuuauucuggca

SEQ ID NO: 2170769 - RNA, 12 nt, Human
ccuuuauugugu

SEQ ID NO: 2170770 - RNA, 13 nt, Human
ccuuuauugugau

SEQ ID NO: 2170771 - RNA, 15 nt, Human
ccuuuauuguguuug

SEQ ID NO: 2170772 - RNA, 20 nt, Human
ccuuuauuguguuugucauu

SEQ ID NO: 2170773 - RNA, 12 nt, Human
ccuuucccucca

SEQ ID NO: 2170774 - RNA, 12 nt, Human
ccuuucccuucu

SEQ ID NO: 2170775 - RNA, 15 nt, Human
ccuuucccuucuugg

SEQ ID NO: 2170776 - RNA, 20 nt, Human
ccuuucccuccacuccuucc

SEQ ID NO: 2170777 - RNA, 16 nt, Human
ccuuucaaauuucaca

SEQ ID NO: 2170778 - RNA, 15 nt, Human
ccuuucaaauuucac

SEQ ID NO: 2170779 - RNA, 18 nt, Human
ccuuucaauaggaaaaac

SEQ ID NO: 2170780 - RNA, 17 nt, Human
ccuuucaauaggaaaaa

SEQ ID NO: 2170781 - RNA, 21 nt, Human
ccuugcgcuuuugcuggucac

SEQ ID NO: 2170782 - RNA, 15 nt, Human
ccuugcgcuguugcg

SEQ ID NO: 2170783 - RNA, 23 nt, Human
ccuugccugaacauccuuccuuc

SEQ ID NO: 2170784 - RNA, 16 nt, Human
ccuugccuccugugua

SEQ ID NO: 2170785 - RNA, 21 nt, Human
ccuugccugaacauccuuccu

SEQ ID NO: 2170786 - RNA, 21 nt, Human
ccuugccaggguuucgagaag

SEQ ID NO: 2170787 - RNA, 13 nt, Human
ccuugccagacau

SEQ ID NO: 2170788 - RNA, 24 nt, Human
ccuugccaccccacccucccugga

SEQ ID NO: 2170789 - RNA, 13 nt, Human
ccuugccagagau

SEQ ID NO: 2170790 - RNA, 12 nt, Human
ccuugccagaga

SEQ ID NO: 2170791 - RNA, 23 nt, Human
ccuugccaccccacccucccugg

SEQ ID NO: 2170792 - RNA, 16 nt, Human
ccuugccagagaucca

SEQ ID NO: 2170793 - RNA, 17 nt, Human
ccuugcuaccucaaggg

SEQ ID NO: 2170794 - RNA, 14 nt, Human
ccuugcuaccucaa

SEQ ID NO: 2170795 - RNA, 12 nt, Human
ccuugcuaccuc

SEQ ID NO: 2170796 - RNA, 11 nt, Human
ccuugcuaccu

SEQ ID NO: 2170797 - RNA, 14 nt, Human
ccuugcuacccaga

SEQ ID NO: 2170798 - RNA, 20 nt, Human
ccuugcgguauccgccccca

SEQ ID NO: 2170799 - RNA, 21 nt, Human
ccuugcggggauaaagagaga

SEQ ID NO: 2170800 - RNA, 18 nt, Human
ccuugcucgcuguaaaau

SEQ ID NO: 2170801 - RNA, 18 nt, Human
ccuuuagugguggccauu

SEQ ID NO: 2170802 - RNA, 19 nt, Human
ccuuuaguaccugaaaagu

SEQ ID NO: 2170803 - RNA, 18 nt, Human
ccuuuaguaccugaaaag

SEQ ID NO: 2170804 - RNA, 23 nt, Human
ccuugcucaaccauggcugaagg

SEQ ID NO: 2170805 - RNA, 19 nt, Human
ccuuuauauuuagugaacu

SEQ ID NO: 2170806 - RNA, 22 nt, Human
ccuuuauaaugaggaugauuau

SEQ ID NO: 2170807 - RNA, 19 nt, Human
ccuuuauguggaaaacaga

SEQ ID NO: 2170808 - RNA, 23 nt, Human
ccuuuauguggaaaacagaacau

SEQ ID NO: 2170809 - RNA, 23 nt, Human
ccuugcaguucagcaccacccua

SEQ ID NO: 2170810 - RNA, 13 nt, Human
ccuugccacccca

SEQ ID NO: 2170811 - RNA, 17 nt, Human
ccuugccaccccacccu

SEQ ID NO: 2170812 - RNA, 19 nt, Human
ccuugccaccccacccucc

SEQ ID NO: 2170813 - RNA, 14 nt, Human
ccuugcauaauggu

SEQ ID NO: 2170814 - RNA, 22 nt, Human
ccuugcaguucagcaccacccu

SEQ ID NO: 2170815 - RNA, 20 nt, Human
ccuugcaguucagcaccacc

SEQ ID NO: 2170816 - RNA, 19 nt, Human
ccuugcaguucagcaccac

SEQ ID NO: 2170817 - RNA, 17 nt, Human
ccuugcaguucagcacc

SEQ ID NO: 2170818 - RNA, 15 nt, Human
ccuugcagcuaguuu

SEQ ID NO: 2170819 - RNA, 20 nt, Human
ccuugcagcacucacacagg

SEQ ID NO: 2170820 - RNA, 21 nt, Human
ccuugcagcacucacacagga

SEQ ID NO: 2170821 - RNA, 16 nt, Human
ccuugcaccugcaucc

SEQ ID NO: 2170822 - RNA, 14 nt, Human
ccuugcaccugcau

SEQ ID NO: 2170823 - RNA, 13 nt, Human
ccuugcaccugca

SEQ ID NO: 2170824 - RNA, 12 nt, Human
ccuugcaccugc

SEQ ID NO: 2170825 - RNA, 18 nt, Human
ccuugcaccccucacucu

SEQ ID NO: 2170826 - RNA, 14 nt, Human
ccuugcacauagua

SEQ ID NO: 2170827 - RNA, 13 nt, Human
ccuugcaccccuc

SEQ ID NO: 2170828 - RNA, 14 nt, Human
ccuugcaccccuca

SEQ ID NO: 2170829 - RNA, 17 nt, Human
ccuugcaccccucacuc

SEQ ID NO: 2170830 - RNA, 15 nt, Human
ccuugcaagaaucag

SEQ ID NO: 2170831 - RNA, 22 nt, Human
ccuugcacacuccccugcacug

SEQ ID NO: 2170832 - RNA, 19 nt, Human
ccuugcacacuccccugca

SEQ ID NO: 2170833 - RNA, 18 nt, Human
ccuugcacacucagaagc

SEQ ID NO: 2170834 - RNA, 22 nt, Human
ccuuaucuccaagaccagagau

SEQ ID NO: 2170835 - RNA, 16 nt, Human
ccuuaucuccaagacc

SEQ ID NO: 2170836 - RNA, 20 nt, Human
ccuuaucugugcgugaaaca

SEQ ID NO: 2170837 - RNA, 13 nt, Human
ccuuaucugugcg

SEQ ID NO: 2170838 - RNA, 16 nt, Human
ccuuauccucugaucu

SEQ ID NO: 2170839 - RNA, 15 nt, Human
ccuuauccucugauc

SEQ ID NO: 2170840 - RNA, 18 nt, Human
ccuuauccucugaucucc

SEQ ID NO: 2170841 - RNA, 12 nt, Human
ccuuauggaaca

SEQ ID NO: 2170842 - RNA, 17 nt, Human
ccuuaucugugcucagg

SEQ ID NO: 2170843 - RNA, 15 nt, Human
ccuuaucugugcuca

SEQ ID NO: 2170844 - RNA, 13 nt, Human
ccuuaucuugcac

SEQ ID NO: 2170845 - RNA, 15 nt, Human
ccuuaucauucauuc

SEQ ID NO: 2170846 - RNA, 17 nt, Human
ccuuaucaccagcugcc

SEQ ID NO: 2170847 - RNA, 16 nt, Human
ccuuaucauucauucu

SEQ ID NO: 2170848 - RNA, 17 nt, Human
ccuuaucauucauucuu

SEQ ID NO: 2170849 - RNA, 13 nt, Human
ccuuauccaggac

SEQ ID NO: 2170850 - RNA, 14 nt, Human
ccuuauccaggacu

SEQ ID NO: 2170851 - RNA, 15 nt, Human
ccuuauccaggacuc

SEQ ID NO: 2170852 - RNA, 17 nt, Human
ccuuauccaggacucug

SEQ ID NO: 2170853 - RNA, 13 nt, Human
ccuuauccucuga

SEQ ID NO: 2170854 - RNA, 18 nt, Human
ccuuaucaaaggacacca

SEQ ID NO: 2170855 - RNA, 14 nt, Human
ccuuaucaaaggac

SEQ ID NO: 2170856 - RNA, 12 nt, Human
ccuuaucaagug

SEQ ID NO: 2170857 - RNA, 13 nt, Human
ccuuaucaagugu

SEQ ID NO: 2170858 - RNA, 14 nt, Human
ccuuaucaaguguc

SEQ ID NO: 2170859 - RNA, 15 nt, Human
ccuuaucaagugucu

SEQ ID NO: 2170860 - RNA, 16 nt, Human
ccuuaucaagugucuu

SEQ ID NO: 2170861 - RNA, 13 nt, Human
ccuuaucaccagc

SEQ ID NO: 2170862 - RNA, 20 nt, Human
ccuuaucaccagcugccucu

SEQ ID NO: 2170863 - RNA, 16 nt, Human
ccuuaggcagggaagu

SEQ ID NO: 2170864 - RNA, 13 nt, Human
ccuuaggccuucc

SEQ ID NO: 2170865 - RNA, 15 nt, Human
ccuuaggccuuccuc

SEQ ID NO: 2170866 - RNA, 14 nt, Human
ccuuaggccuuccu

SEQ ID NO: 2170867 - RNA, 20 nt, Human
ccuuaggugauccacucgcc

SEQ ID NO: 2170868 - RNA, 23 nt, Human
ccuuaggccuuccucucuccaga

SEQ ID NO: 2170869 - RNA, 22 nt, Human
ccuuagcuuagaccucagccug

SEQ ID NO: 2170870 - RNA, 21 nt, Human
ccuuagcuuagaccucagccu

SEQ ID NO: 2170871 - RNA, 20 nt, Human
ccuuagcuuagaccucagcc

SEQ ID NO: 2170872 - RNA, 19 nt, Human
ccuuagcuuagaccucagc

SEQ ID NO: 2170873 - RNA, 15 nt, Human
ccuuaggcagggaag

SEQ ID NO: 2170874 - RNA, 13 nt, Human
ccuuaggcaggga

SEQ ID NO: 2170875 - RNA, 23 nt, Human
ccuuagcuuagaccucagccugu

SEQ ID NO: 2170876 - RNA, 13 nt, Human
ccuuagucuucuc

SEQ ID NO: 2170877 - RNA, 14 nt, Human
ccuuaguacugagu

SEQ ID NO: 2170878 - RNA, 14 nt, Human
ccuuagucuucuca

SEQ ID NO: 2170879 - RNA, 16 nt, Human
ccuuaguggcuuuuuu

SEQ ID NO: 2170880 - RNA, 20 nt, Human
ccuuaguggcuuuuuuccuc

SEQ ID NO: 2170881 - RNA, 20 nt, Human
ccuuagguuuuuuuccuucu

SEQ ID NO: 2170882 - RNA, 14 nt, Human
ccuuagucucaguu

SEQ ID NO: 2170883 - RNA, 20 nt, Human
ccuuagucucaguuugugug

SEQ ID NO: 2170884 - RNA, 13 nt, Human
ccuuaucaaagga

SEQ ID NO: 2170885 - RNA, 20 nt, Human
ccuuaguguuucugugcaug

SEQ ID NO: 2170886 - RNA, 12 nt, Human
ccuuaguguuuc

SEQ ID NO: 2170887 - RNA, 14 nt, Human
ccuuaguguuucug

SEQ ID NO: 2170888 - RNA, 16 nt, Human
ccuuaguguuucugug

SEQ ID NO: 2170889 - RNA, 19 nt, Human
ccuuaguguuucugugcau

SEQ ID NO: 2170890 - RNA, 21 nt, Human
ccuuaucugugcgugaaacac

SEQ ID NO: 2170891 - RNA, 22 nt, Human
ccuuauuacacggaaaacggug

SEQ ID NO: 2170892 - RNA, 21 nt, Human
ccuuauuagagugucuuucca

SEQ ID NO: 2170893 - RNA, 16 nt, Human
ccuuauuagagugucu

SEQ ID NO: 2170894 - RNA, 22 nt, Human
ccuuauggaacacucugagacu

SEQ ID NO: 2170895 - RNA, 19 nt, Human
ccuuauggaacacucugag

SEQ ID NO: 2170896 - RNA, 20 nt, Human
ccuuauggaacacucugaga

SEQ ID NO: 2170897 - RNA, 14 nt, Human
ccuuauggaacacu

SEQ ID NO: 2170898 - RNA, 16 nt, Human
ccuuauggaacacucu

SEQ ID NO: 2170899 - RNA, 17 nt, Human
ccuuauggaacacucug

SEQ ID NO: 2170900 - RNA, 18 nt, Human
ccuuauggaacacucuga

SEQ ID NO: 2170901 - RNA, 19 nt, Human
ccuucccaggaguggagga

SEQ ID NO: 2170902 - RNA, 21 nt, Human
ccuucccagcucucccucugg

SEQ ID NO: 2170903 - RNA, 19 nt, Human
ccuucccagcucucccucu

SEQ ID NO: 2170904 - RNA, 14 nt, Human
ccuucccaucgcug

SEQ ID NO: 2170905 - RNA, 15 nt, Human
ccuucccaucgcugu

SEQ ID NO: 2170906 - RNA, 22 nt, Human
ccuucccagcucucccucuggc

SEQ ID NO: 2170907 - RNA, 15 nt, Human
ccuucccaucucuuc

SEQ ID NO: 2170908 - RNA, 18 nt, Human
ccuucccaugacccaggc

SEQ ID NO: 2170909 - RNA, 21 nt, Human
ccuucccaugacccaggcugg

SEQ ID NO: 2170910 - RNA, 15 nt, Human
ccuucccaugcccug

SEQ ID NO: 2170911 - RNA, 18 nt, Human
ccuucccagcucucccuc

SEQ ID NO: 2170912 - RNA, 17 nt, Human
ccuucccagcucucccu

SEQ ID NO: 2170913 - RNA, 14 nt, Human
ccuucccagcucuc

SEQ ID NO: 2170914 - RNA, 13 nt, Human
ccuucccagcucu

SEQ ID NO: 2170915 - RNA, 12 nt, Human
ccuucccagcuc

SEQ ID NO: 2170916 - RNA, 18 nt, Human
ccuucccacucaccccgg

SEQ ID NO: 2170917 - RNA, 15 nt, Human
ccuucccacucaccc

SEQ ID NO: 2170918 - RNA, 17 nt, Human
ccuucccacucaccccg

SEQ ID NO: 2170919 - RNA, 12 nt, Human
ccuucccaccuc

SEQ ID NO: 2170920 - RNA, 15 nt, Human
ccuuauucaggaaaa

SEQ ID NO: 2170921 - RNA, 22 nt, Human
ccuucccacccaucgcugugug

SEQ ID NO: 2170922 - RNA, 14 nt, Human
ccuucccaccucuc

SEQ ID NO: 2170923 - RNA, 19 nt, Human
ccuucccaccucucucacu

SEQ ID NO: 2170924 - RNA, 18 nt, Human
ccuuagcuuagaccucag

SEQ ID NO: 2170925 - RNA, 17 nt, Human
ccuuagcuuagaccuca

SEQ ID NO: 2170926 - RNA, 22 nt, Human
ccuuagcuggcauuacagcugg

SEQ ID NO: 2170927 - RNA, 19 nt, Human
ccuuagcuggcauuacagc

SEQ ID NO: 2170928 - RNA, 16 nt, Human
ccuuagccucccugaa

SEQ ID NO: 2170929 - RNA, 15 nt, Human
ccuuagccucccuga

SEQ ID NO: 2170930 - RNA, 14 nt, Human
ccuuagccucccug

SEQ ID NO: 2170931 - RNA, 18 nt, Human
ccuuagcccccacccacu

SEQ ID NO: 2170932 - RNA, 21 nt, Human
ccuuagcccccacccacuucc

SEQ ID NO: 2170933 - RNA, 15 nt, Human
ccuuagcccccaccc

SEQ ID NO: 2170934 - RNA, 10 nt, Human
ccuuagccag

SEQ ID NO: 2170935 - RNA, 16 nt, Human
ccuuagcauguuugcu

SEQ ID NO: 2170936 - RNA, 19 nt, Human
ccuuagcauguuugcugaa

SEQ ID NO: 2170937 - RNA, 22 nt, Human
ccuuagcacaggggggccgccg

SEQ ID NO: 2170938 - RNA, 20 nt, Human
ccuuagcacuaccacuccug

SEQ ID NO: 2170939 - RNA, 19 nt, Human
ccuguuggacccgcucugg

SEQ ID NO: 2170940 - RNA, 17 nt, Human
ccuguugcuuacaauuu

SEQ ID NO: 2170941 - RNA, 20 nt, Human
ccuguuggacccgcucugga

SEQ ID NO: 2170942 - RNA, 23 nt, Human
ccuguuggacccgcucuggacca

SEQ ID NO: 2170943 - RNA, 17 nt, Human
ccuguuggauuuguuua

SEQ ID NO: 2170944 - RNA, 24 nt, Human
ccuguuggauuuguuuaaaaggau

SEQ ID NO: 2170945 - RNA, 16 nt, Human
ccuuagcaaauucugu

SEQ ID NO: 2170946 - RNA, 19 nt, Human
ccuuagcagggaaacagcu

SEQ ID NO: 2170947 - RNA, 20 nt, Human
ccuuagcagggaaacagcua

SEQ ID NO: 2170948 - RNA, 16 nt, Human
ccuguugcuuacaauu

SEQ ID NO: 2170949 - RNA, 22 nt, Human
ccuguugcuaagccccagcaag

SEQ ID NO: 2170950 - RNA, 13 nt, Human
ccuguugcuaagc

SEQ ID NO: 2170951 - RNA, 14 nt, Human
ccuguugcuaagcc

SEQ ID NO: 2170952 - RNA, 16 nt, Human
ccuguugggccaggag

SEQ ID NO: 2170953 - RNA, 12 nt, Human
ccuguugcuaag

SEQ ID NO: 2170954 - RNA, 22 nt, Human
ccuguugcacccagcccugguc

SEQ ID NO: 2170955 - RNA, 23 nt, Human
ccuguugcacccagcccuggucu

SEQ ID NO: 2170956 - RNA, 18 nt, Human
ccuguugcacccagcccu

SEQ ID NO: 2170957 - RNA, 19 nt, Human
ccuguugcacccagcccug

SEQ ID NO: 2170958 - RNA, 20 nt, Human
ccuguugcacccagcccugg

SEQ ID NO: 2170959 - RNA, 21 nt, Human
ccuguugcacccagcccuggu

SEQ ID NO: 2170960 - RNA, 20 nt, Human
ccuguugacgaagucucuuu

SEQ ID NO: 2170961 - RNA, 23 nt, Human
ccuguugacgaagucucuuuucu

SEQ ID NO: 2170962 - RNA, 14 nt, Human
ccuguugcacccag

SEQ ID NO: 2170963 - RNA, 15 nt, Human
ccuguugcacccagc

SEQ ID NO: 2170964 - RNA, 16 nt, Human
ccuguugcacccagcc

SEQ ID NO: 2170965 - RNA, 17 nt, Human
ccuguugcacccagccc

SEQ ID NO: 2170966 - RNA, 17 nt, Human
ccuguugggccaggagc

SEQ ID NO: 2170967 - RNA, 18 nt, Human
ccuguugggccaggagcc

SEQ ID NO: 2170968 - RNA, 19 nt, Human
ccuguugggccaggagccu

SEQ ID NO: 2170969 - RNA, 20 nt, Human
ccuguugggccaggagccuc

SEQ ID NO: 2170970 - RNA, 13 nt, Human
ccuguuccccaga

SEQ ID NO: 2170971 - RNA, 12 nt, Human
ccuguucccauu

SEQ ID NO: 2170972 - RNA, 18 nt, Human
ccuguucccaugagauga

SEQ ID NO: 2170973 - RNA, 23 nt, Human
ccuguuccccagagaaaggggag

SEQ ID NO: 2170974 - RNA, 22 nt, Human
ccuguucccccgccgcuuuucu

SEQ ID NO: 2170975 - RNA, 17 nt, Human
ccuguuccccucacugg

SEQ ID NO: 2170976 - RNA, 16 nt, Human
ccuguuccccagagaa

SEQ ID NO: 2170977 - RNA, 15 nt, Human
ccuguuccccagaga

SEQ ID NO: 2170978 - RNA, 18 nt, Human
ccuguuccccucacugga

SEQ ID NO: 2170979 - RNA, 22 nt, Human
ccuguuccccucacuggaugaa

SEQ ID NO: 2170980 - RNA, 21 nt, Human
ccuguucugaacuguggggug

SEQ ID NO: 2170981 - RNA, 14 nt, Human
ccuguucugaacug

SEQ ID NO: 2170982 - RNA, 13 nt, Human
ccuguucugaacu

SEQ ID NO: 2170983 - RNA, 22 nt, Human
ccuguugacacaggucuuuccu

SEQ ID NO: 2170984 - RNA, 19 nt, Human
ccuguugacacaggucuuu

SEQ ID NO: 2170985 - RNA, 17 nt, Human
ccuguugacacaggucu

SEQ ID NO: 2170986 - RNA, 16 nt, Human
ccuguucugcuuuccu

SEQ ID NO: 2170987 - RNA, 12 nt, Human
ccuguucuggca

SEQ ID NO: 2170988 - RNA, 17 nt, Human
ccuguucuggcagaguu

SEQ ID NO: 2170989 - RNA, 19 nt, Human
ccuguucagugucccgggc

SEQ ID NO: 2170990 - RNA, 11 nt, Human
ccuguucaguu

SEQ ID NO: 2170991 - RNA, 15 nt, Human
ccuguucaguuacag

SEQ ID NO: 2170992 - RNA, 17 nt, Human
ccuguucaguuacagaa

SEQ ID NO: 2170993 - RNA, 19 nt, Human
ccuguucaguuacagaaag

SEQ ID NO: 2170994 - RNA, 20 nt, Human
ccuguucaguuacagaaagu

SEQ ID NO: 2170995 - RNA, 23 nt, Human
ccuguucagcuccagcucaccag

SEQ ID NO: 2170996 - RNA, 20 nt, Human
ccuguucagcuccagcucac

SEQ ID NO: 2170997 - RNA, 21 nt, Human
ccuguucagcuccagcucacc

SEQ ID NO: 2170998 - RNA, 14 nt, Human
ccuguucagcucca

SEQ ID NO: 2170999 - RNA, 15 nt, Human
ccuguucagcuccag

SEQ ID NO: 2171000 - RNA, 16 nt, Human
ccuguucagcuccagc

SEQ ID NO: 2171001 - RNA, 19 nt, Human
ccuguucagcuccagcuca

SEQ ID NO: 2171002 - RNA, 21 nt, Human
ccuguuaccuaauuagagcag

SEQ ID NO: 2171003 - RNA, 22 nt, Human
ccuguuaccuaauuagagcaga

SEQ ID NO: 2171004 - RNA, 23 nt, Human
ccuguuaccuaauuagagcagau

SEQ ID NO: 2171005 - RNA, 13 nt, Human
ccuguucagcucc

SEQ ID NO: 2171006 - RNA, 18 nt, Human
ccuguuagcuguuauuuc

SEQ ID NO: 2171007 - RNA, 21 nt, Human
ccuguucacucuacuuagcau

SEQ ID NO: 2171008 - RNA, 16 nt, Human
ccuguuagcagacagg

SEQ ID NO: 2171009 - RNA, 15 nt, Human
ccuguuagcagacag

SEQ ID NO: 2171010 - RNA, 23 nt, Human
ccuguuacuugaaauaccaguga

SEQ ID NO: 2171011 - RNA, 19 nt, Human
ccuguuaccuacuuugacu

SEQ ID NO: 2171012 - RNA, 14 nt, Human
ccuguuacuuaccu

SEQ ID NO: 2171013 - RNA, 22 nt, Human
ccuguuacuugaaauaccagug

SEQ ID NO: 2171014 - RNA, 18 nt, Human
ccuguuaccuacuuugac

SEQ ID NO: 2171015 - RNA, 17 nt, Human
ccuguuaccuacuuuga

SEQ ID NO: 2171016 - RNA, 22 nt, Human
ccugcugccgccucccagccug

SEQ ID NO: 2171017 - RNA, 20 nt, Human
ccugcugcuguguuuuugcu

SEQ ID NO: 2171018 - RNA, 11 nt, Human
ccugcuggccc

SEQ ID NO: 2171019 - RNA, 19 nt, Human
ccugcuggcacccaccgug

SEQ ID NO: 2171020 - RNA, 15 nt, Human
ccugcuggcacccac

SEQ ID NO: 2171021 - RNA, 13 nt, Human
ccugcuggccccu

SEQ ID NO: 2171022 - RNA, 12 nt, Human
ccugcuggcccc

SEQ ID NO: 2171023 - RNA, 9 nt, Human
ccugcuggc

SEQ ID NO: 2171024 - RNA, 21 nt, Human
cgugaucaaagccacacucug

SEQ ID NO: 2171025 - RNA, 18 nt, Human
cgugaucaaagccacacu

SEQ ID NO: 2171026 - RNA, 15 nt, Human
cguguuaugacucca

SEQ ID NO: 2171027 - RNA, 16 nt, Human
cguguucuccuuuucc

SEQ ID NO: 2171028 - RNA, 15 nt, Human
cguguugccuugaac

SEQ ID NO: 2171029 - RNA, 22 nt, Human
cguguugccuugaaccacuucc

SEQ ID NO: 2171030 - RNA, 19 nt, Human
cguguuaugacuccagaau

SEQ ID NO: 2171031 - RNA, 14 nt, Human
cgugaucaaagcca

SEQ ID NO: 2171032 - RNA, 20 nt, Human
cgugaguucucagggcuccu

SEQ ID NO: 2171033 - RNA, 21 nt, Human
cgugaguucucagggcuccug

SEQ ID NO: 2171034 - RNA, 15 nt, Human
cgugaguucucaggg

SEQ ID NO: 2171035 - RNA, 16 nt, Human
cgugaguucucagggc

SEQ ID NO: 2171036 - RNA, 18 nt, Human
cgugaguucucagggcuc

SEQ ID NO: 2171037 - RNA, 19 nt, Human
cgugaguucucagggcucc

SEQ ID NO: 2171038 - RNA, 19 nt, Human
cgugagugaaccaucauua

SEQ ID NO: 2171039 - RNA, 14 nt, Human
cgugaguucucagg

SEQ ID NO: 2171040 - RNA, 16 nt, Human
cgugaggccagagaca

SEQ ID NO: 2171041 - RNA, 19 nt, Human
cgugaguccuggcauggga

SEQ ID NO: 2171042 - RNA, 18 nt, Human
cgugaguccuggcauggg

SEQ ID NO: 2171043 - RNA, 15 nt, Human
cguucaccccuccac

SEQ ID NO: 2171044 - RNA, 19 nt, Human
cguucaacuuuuccuuuga

SEQ ID NO: 2171045 - RNA, 22 nt, Human
cguuauguguguauauguaugu

SEQ ID NO: 2171046 - RNA, 14 nt, Human
cguuauuauaauug

SEQ ID NO: 2171047 - RNA, 16 nt, Human
cguuauuauaauugua

SEQ ID NO: 2171048 - RNA, 15 nt, Human
cguuauuguugacuu

SEQ ID NO: 2171049 - RNA, 20 nt, Human
cguuagucgugagcucuugu

SEQ ID NO: 2171050 - RNA, 16 nt, Human
cguuaugguguuucuc

SEQ ID NO: 2171051 - RNA, 13 nt, Human
cguuagcuccugu

SEQ ID NO: 2171052 - RNA, 15 nt, Human
cguguuucugacucu

SEQ ID NO: 2171053 - RNA, 14 nt, Human
cguguuucugacuc

SEQ ID NO: 2171054 - RNA, 14 nt, Human
cguuagcuccugug

SEQ ID NO: 2171055 - RNA, 15 nt, Human
cguuagcuccugugg

SEQ ID NO: 2171056 - RNA, 16 nt, Human
cguuagcuccuguggc

SEQ ID NO: 2171057 - RNA, 17 nt, Human
cguuagcuccuguggcc

SEQ ID NO: 2171058 - RNA, 20 nt, Human
cguucaccccuccacccuug

SEQ ID NO: 2171059 - RNA, 17 nt, Human
cgugacagacuccugag

SEQ ID NO: 2171060 - RNA, 11 nt, Human
cuaaagcagug

SEQ ID NO: 2171061 - RNA, 20 nt, Human
cuaaagcaauaaugguccca

SEQ ID NO: 2171062 - RNA, 18 nt, Human
cuaaagcaguggacacca

SEQ ID NO: 2171063 - RNA, 11 nt, Human
cuaaagcugcc

SEQ ID NO: 2171064 - RNA, 22 nt, Human
cuaagaaagcccuuaggaagaa

SEQ ID NO: 2171065 - RNA, 20 nt, Human
cuaagaaauaugcacaauag

SEQ ID NO: 2171066 - RNA, 22 nt, Human
cuaacuuggagccccagugcca

SEQ ID NO: 2171067 - RNA, 14 nt, Human
cuaacuuggagccg

SEQ ID NO: 2171068 - RNA, 20 nt, Human
cuaagaaagaggagugcuug

SEQ ID NO: 2171069 - RNA, 14 nt, Human
cuaagaaccuggaa

SEQ ID NO: 2171070 - RNA, 21 nt, Human
cuaagaaagaggagugcuugu

SEQ ID NO: 2171071 - RNA, 20 nt, Human
cuaagaaauaaaacuguuaa

SEQ ID NO: 2171072 - RNA, 16 nt, Human
cuaagaaccuggaacu

SEQ ID NO: 2171073 - RNA, 15 nt, Human
cuaagaaccuggaac

SEQ ID NO: 2171074 - RNA, 23 nt, Human
cuaagaagaaaauugcugugccu

SEQ ID NO: 2171075 - RNA, 21 nt, Human
cuaacuuggagccccagugcc

SEQ ID NO: 2171076 - RNA, 20 nt, Human
cuaacuuggagccccagugc

SEQ ID NO: 2171077 - RNA, 17 nt, Human
cuaacuuggagccccag

SEQ ID NO: 2171078 - RNA, 12 nt, Human
cuaacuaaacuc

SEQ ID NO: 2171079 - RNA, 13 nt, Human
cuaacuaaacucu

SEQ ID NO: 2171080 - RNA, 19 nt, Human
cuaacuaaacucucuuugg

SEQ ID NO: 2171081 - RNA, 22 nt, Human
cuaacguugagccccuggaggc

SEQ ID NO: 2171082 - RNA, 14 nt, Human
cuaacuugucuuug

SEQ ID NO: 2171083 - RNA, 22 nt, Human
cuaacuugucuuuggacccuga

SEQ ID NO: 2171084 - RNA, 17 nt, Human
cuaaaguagacuucauu

SEQ ID NO: 2171085 - RNA, 15 nt, Human
cuaaaguaugaagca

SEQ ID NO: 2171086 - RNA, 16 nt, Human
cuaaaguauguaaagu

SEQ ID NO: 2171087 - RNA, 20 nt, Human
cuaaaguauguaaaguaugu

SEQ ID NO: 2171088 - RNA, 20 nt, Human
cuaaagguguugucccuucu

SEQ ID NO: 2171089 - RNA, 19 nt, Human
cuaaagguguugucccuuc

SEQ ID NO: 2171090 - RNA, 17 nt, Human
cuaaagcccaaccuccu

SEQ ID NO: 2171091 - RNA, 23 nt, Human
cuaaaguaaaaacaaagaaauua

SEQ ID NO: 2171092 - RNA, 15 nt, Human
cuaacguaaauacac

SEQ ID NO: 2171093 - RNA, 17 nt, Human
cuaacguugagccccug

SEQ ID NO: 2171094 - RNA, 20 nt, Human
cuaacgacuucagggcaggg

SEQ ID NO: 2171095 - RNA, 15 nt, Human
cuaaagugagcucua

SEQ ID NO: 2171096 - RNA, 19 nt, Human
cuaaaguguauuuuuuuac

SEQ ID NO: 2171097 - RNA, 20 nt, Human
cuaacgaaguauccuucagc

SEQ ID NO: 2171098 - RNA, 22 nt, Human
cgugagccacugcaccgggcca

SEQ ID NO: 2171099 - RNA, 15 nt, Human
cgugacagacuccug

SEQ ID NO: 2171100 - RNA, 16 nt, Human
cgugacagacuccuga

SEQ ID NO: 2171101 - RNA, 12 nt, Human
cgugagccaggu

SEQ ID NO: 2171102 - RNA, 13 nt, Human
cgugagccaggua

SEQ ID NO: 2171103 - RNA, 21 nt, Human
cgugagccagguaaugaggga

SEQ ID NO: 2171104 - RNA, 19 nt, Human
cgugaggaugucacucaga

SEQ ID NO: 2171105 - RNA, 15 nt, Human
cgugagcucuuguga

SEQ ID NO: 2171106 - RNA, 19 nt, Human
cgugagcgacaaagaugau

SEQ ID NO: 2171107 - RNA, 14 nt, Human
cgugaggccagaga

SEQ ID NO: 2171108 - RNA, 14 nt, Human
cgugagccacugca

SEQ ID NO: 2171109 - RNA, 17 nt, Human
cgugacaauaaaacauu

SEQ ID NO: 2171110 - RNA, 19 nt, Human
cgugacaauaaaacauuaa

SEQ ID NO: 2171111 - RNA, 15 nt, Human
cgugagccacugcac

SEQ ID NO: 2171112 - RNA, 20 nt, Human
cgugagccacugcaccgggc

SEQ ID NO: 2171113 - RNA, 14 nt, Human
cgugacaacacuug

SEQ ID NO: 2171114 - RNA, 15 nt, Human
cgugacaacacuugu

SEQ ID NO: 2171115 - RNA, 19 nt, Human
cuaaguuucaguugauuuu

SEQ ID NO: 2171116 - RNA, 14 nt, Human
cuaaguuuuuaugg

SEQ ID NO: 2171117 - RNA, 10 nt, Human
cuaauaaaac

SEQ ID NO: 2171118 - RNA, 15 nt, Human
cuaaguccuuuaugu

SEQ ID NO: 2171119 - RNA, 17 nt, Human
cuaaguauuucccagca

SEQ ID NO: 2171120 - RNA, 14 nt, Human
cuaaguauuuccca

SEQ ID NO: 2171121 - RNA, 16 nt, Human
cuaaguauuucccagc

SEQ ID NO: 2171122 - RNA, 13 nt, Human
cuaaguauuuccc

SEQ ID NO: 2171123 - RNA, 18 nt, Human
cuaaguuccacugagcuc

SEQ ID NO: 2171124 - RNA, 20 nt, Human
cuaaguuccacugagcucca

SEQ ID NO: 2171125 - RNA, 13 nt, Human
cuaaguuucaguu

SEQ ID NO: 2171126 - RNA, 12 nt, Human
cuaauuuuuaag

SEQ ID NO: 2171127 - RNA, 22 nt, Human
cuaauuugcauuaaauucacaa

SEQ ID NO: 2171128 - RNA, 19 nt, Human
cuaauuucuccucccuucc

SEQ ID NO: 2171129 - RNA, 21 nt, Human
cuaauuugcauuaaauucaca

SEQ ID NO: 2171130 - RNA, 19 nt, Human
cuaauuugcauuaaauuca

SEQ ID NO: 2171131 - RNA, 19 nt, Human
cuacaaaaagcauaaaaau

SEQ ID NO: 2171132 - RNA, 20 nt, Human
cuacaaaaacacagcaaggg

SEQ ID NO: 2171133 - RNA, 13 nt, Human
cuaauaaaagcau

SEQ ID NO: 2171134 - RNA, 16 nt, Human
cuaauuugauguuuac

SEQ ID NO: 2171135 - RNA, 12 nt, Human
cuaauuugcauu

SEQ ID NO: 2171136 - RNA, 14 nt, Human
cuaauuugcauuaa

SEQ ID NO: 2171137 - RNA, 13 nt, Human
cuaauuugcauua

SEQ ID NO: 2171138 - RNA, 15 nt, Human
cuaauuugauguuua

SEQ ID NO: 2171139 - RNA, 20 nt, Human
cuaauuucuccucccuuccu

SEQ ID NO: 2171140 - RNA, 18 nt, Human
cuaauuucuccucccuuc

SEQ ID NO: 2171141 - RNA, 14 nt, Human
cuaagacuacagca

SEQ ID NO: 2171142 - RNA, 17 nt, Human
cuaagaauucaaacugg

SEQ ID NO: 2171143 - RNA, 16 nt, Human
cuaagagaaguuauuu

SEQ ID NO: 2171144 - RNA, 11 nt, Human
cuaagagaagu

SEQ ID NO: 2171145 - RNA, 22 nt, Human
cuaagacuccucggccuggcuc

SEQ ID NO: 2171146 - RNA, 23 nt, Human
cuaagacuccucggccuggcucc

SEQ ID NO: 2171147 - RNA, 19 nt, Human
cuaagagaaguuauuuucu

SEQ ID NO: 2171148 - RNA, 20 nt, Human
cgguggcucacgccuguaau

SEQ ID NO: 2171149 - RNA, 15 nt, Human
cggugggcacccacc

SEQ ID NO: 2171150 - RNA, 18 nt, Human
cggugggcacccacccug

SEQ ID NO: 2171151 - RNA, 20 nt, Human
cgguggcucaggccuauaac

SEQ ID NO: 2171152 - RNA, 16 nt, Human
cggggaacuccuggaa

SEQ ID NO: 2171153 - RNA, 22 nt, Human
cgguggcuagucaagcuccucc

SEQ ID NO: 2171154 - RNA, 11 nt, Human
cgguggcucac

SEQ ID NO: 2171155 - RNA, 21 nt, Human
cgguggcuagucaagcuccuc

SEQ ID NO: 2171156 - RNA, 20 nt, Human
cgguggcuagucaagcuccu

SEQ ID NO: 2171157 - RNA, 15 nt, Human
cggggaacuccugga

SEQ ID NO: 2171158 - RNA, 14 nt, Human
cggggaacuccugg

SEQ ID NO: 2171159 - RNA, 15 nt, Human
cgggcuuuuccccgg

SEQ ID NO: 2171160 - RNA, 12 nt, Human
cgggcugugccc

SEQ ID NO: 2171161 - RNA, 19 nt, Human
cggugggcacccacccugg

SEQ ID NO: 2171162 - RNA, 23 nt, Human
cggugggcacccacccugggacc

SEQ ID NO: 2171163 - RNA, 17 nt, Human
cguaaagcuagaaauga

SEQ ID NO: 2171164 - RNA, 16 nt, Human
cguaaagcuagaaaug

SEQ ID NO: 2171165 - RNA, 20 nt, Human
cgguggcugacaccuguaau

SEQ ID NO: 2171166 - RNA, 15 nt, Human
cguaaccacggaaaa

SEQ ID NO: 2171167 - RNA, 20 nt, Human
cguaaauacacaacacacac

SEQ ID NO: 2171168 - RNA, 15 nt, Human
cguaacuggcugugu

SEQ ID NO: 2171169 - RNA, 12 nt, Human
cguaaccagcca

SEQ ID NO: 2171170 - RNA, 13 nt, Human
cguaaccagccag

SEQ ID NO: 2171171 - RNA, 14 nt, Human
cguaaccagccaga

SEQ ID NO: 2171172 - RNA, 23 nt, Human
cguaaccagccagauccucuugg

SEQ ID NO: 2171173 - RNA, 12 nt, Human
cguaacccaacu

SEQ ID NO: 2171174 - RNA, 14 nt, Human
cguaacccaacucu

SEQ ID NO: 2171175 - RNA, 19 nt, Human
cguaacccaacucuccugg

SEQ ID NO: 2171176 - RNA, 17 nt, Human
cguacauucaauguuua

SEQ ID NO: 2171177 - RNA, 13 nt, Human
cguaccccacccu

SEQ ID NO: 2171178 - RNA, 14 nt, Human
cguaccccacccuc

SEQ ID NO: 2171179 - RNA, 15 nt, Human
cguaccccacccuca

SEQ ID NO: 2171180 - RNA, 14 nt, Human
cguacaugugaggc

SEQ ID NO: 2171181 - RNA, 13 nt, Human
cguacaguucuuc

SEQ ID NO: 2171182 - RNA, 22 nt, Human
cguacaguucuucgggaagaga

SEQ ID NO: 2171183 - RNA, 22 nt, Human
cguacacauuuuauuuuauuau

SEQ ID NO: 2171184 - RNA, 16 nt, Human
cguaaguuuaaaggau

SEQ ID NO: 2171185 - RNA, 22 nt, Human
cguacuuagcagcuaucucuca

SEQ ID NO: 2171186 - RNA, 18 nt, Human
cguagaaguuuuuguacu

SEQ ID NO: 2171187 - RNA, 19 nt, Human
cguagaaguuuuuguacug

SEQ ID NO: 2171188 - RNA, 23 nt, Human
cguagaaguuuuuguacuguaaa

SEQ ID NO: 2171189 - RNA, 14 nt, Human
cgggcugggcagcu

SEQ ID NO: 2171190 - RNA, 15 nt, Human
cgggcugggcagcug

SEQ ID NO: 2171191 - RNA, 16 nt, Human
cgggcugggcagcugu

SEQ ID NO: 2171192 - RNA, 17 nt, Human
cgggcugggcagcuguu

SEQ ID NO: 2171193 - RNA, 16 nt, Human
cgggcugggagcucug

SEQ ID NO: 2171194 - RNA, 20 nt, Human
cgggcugggagcucugcaga

SEQ ID NO: 2171195 - RNA, 12 nt, Human
cgggcucugccu

SEQ ID NO: 2171196 - RNA, 13 nt, Human
cgggcucugccuc

SEQ ID NO: 2171197 - RNA, 17 nt, Human
cgggcuccugugcccuu

SEQ ID NO: 2171198 - RNA, 14 nt, Human
cgggcugccugggc

SEQ ID NO: 2171199 - RNA, 15 nt, Human
cgggcugccugggcu

SEQ ID NO: 2171200 - RNA, 16 nt, Human
cgggcugccugggcug

SEQ ID NO: 2171201 - RNA, 19 nt, Human
cgggcucagcaaaagaugc

SEQ ID NO: 2171202 - RNA, 16 nt, Human
cgggccuggagaacua

SEQ ID NO: 2171203 - RNA, 20 nt, Human
cgggccuggagaacuagaga

SEQ ID NO: 2171204 - RNA, 15 nt, Human
cgggcucucugcugu

SEQ ID NO: 2171205 - RNA, 14 nt, Human
cgggcucucugcug

SEQ ID NO: 2171206 - RNA, 20 nt, Human
cgggcucagggaccacagca

SEQ ID NO: 2171207 - RNA, 14 nt, Human
cgggcuccugugcc

SEQ ID NO: 2171208 - RNA, 15 nt, Human
cgggcuccugugccc

SEQ ID NO: 2171209 - RNA, 16 nt, Human
cgggcuccugugcccu

SEQ ID NO: 2171210 - RNA, 18 nt, Human
cgggcucagggaccacag

SEQ ID NO: 2171211 - RNA, 19 nt, Human
cgggccgacggagccggga

SEQ ID NO: 2171212 - RNA, 20 nt, Human
cggcuacucagcagcccucc

SEQ ID NO: 2171213 - RNA, 19 nt, Human
cggcuacucagcagcccuc

SEQ ID NO: 2171214 - RNA, 18 nt, Human
cggcuacucagcagcccu

SEQ ID NO: 2171215 - RNA, 16 nt, Human
cggcuacucagcagcc

SEQ ID NO: 2171216 - RNA, 14 nt, Human
cggcuacucagcag

SEQ ID NO: 2171217 - RNA, 13 nt, Human
cggcuacucagca

SEQ ID NO: 2171218 - RNA, 12 nt, Human
cggcuacucagc

SEQ ID NO: 2171219 - RNA, 21 nt, Human
cggcuacucagcagcccuccu

SEQ ID NO: 2171220 - RNA, 23 nt, Human
cgggccagccaggcgggcucaag

SEQ ID NO: 2171221 - RNA, 17 nt, Human
cgggccagccaggcggg

SEQ ID NO: 2171222 - RNA, 18 nt, Human
cgggccagccaggcgggc

SEQ ID NO: 2171223 - RNA, 20 nt, Human
cgggccagccaggcgggcuc

SEQ ID NO: 2171224 - RNA, 21 nt, Human
cgggccagccaggcgggcuca

SEQ ID NO: 2171225 - RNA, 13 nt, Human
cgggccagccagg

SEQ ID NO: 2171226 - RNA, 14 nt, Human
cgggccagccaggc

SEQ ID NO: 2171227 - RNA, 15 nt, Human
cgggccagccaggcg

SEQ ID NO: 2171228 - RNA, 16 nt, Human
cgggccagccaggcgg

SEQ ID NO: 2171229 - RNA, 12 nt, Human
cgggccccucau

SEQ ID NO: 2171230 - RNA, 15 nt, Human
cgggccccugggcuu

SEQ ID NO: 2171231 - RNA, 23 nt, Human
cgggccccugggcuuggccugcu

SEQ ID NO: 2171232 - RNA, 15 nt, Human
cgggcccaggccauc

SEQ ID NO: 2171233 - RNA, 21 nt, Human
cgggcccuucccacaggacau

SEQ ID NO: 2171234 - RNA, 18 nt, Human
cgggcccguugaggauga

SEQ ID NO: 2171235 - RNA, 22 nt, Human
cgggcccguugaggaugaggcc

SEQ ID NO: 2171236 - RNA, 11 nt, Human
cgggcccuccc

SEQ ID NO: 2171237 - RNA, 17 nt, Human
cgggcccucccuuggaa

SEQ ID NO: 2171238 - RNA, 11 nt, Human
cgggcccaccu

SEQ ID NO: 2171239 - RNA, 13 nt, Human
cgggcccaccugg

SEQ ID NO: 2171240 - RNA, 15 nt, Human
cgggcccaccuggcc

SEQ ID NO: 2171241 - RNA, 16 nt, Human
cgggcccaccuggcca

SEQ ID NO: 2171242 - RNA, 17 nt, Human
cgggcccaccuggccac

SEQ ID NO: 2171243 - RNA, 18 nt, Human
cgggcccaccuggccacc

SEQ ID NO: 2171244 - RNA, 19 nt, Human
cgggcccaccuggccaccu

SEQ ID NO: 2171245 - RNA, 20 nt, Human
cgggcccaccuggccaccug

SEQ ID NO: 2171246 - RNA, 12 nt, Human
cgggcccagccc

SEQ ID NO: 2171247 - RNA, 15 nt, Human
cgggcccagccccca

SEQ ID NO: 2171248 - RNA, 18 nt, Human
cgggcccagcccccacag

SEQ ID NO: 2171249 - RNA, 23 nt, Human
cgggcccagcccccacagugcug

SEQ ID NO: 2171250 - RNA, 13 nt, Human
cgggcccaggcca

SEQ ID NO: 2171251 - RNA, 13 nt, Human
cggaggcugcccc

SEQ ID NO: 2171252 - RNA, 18 nt, Human
cggaggccccaaaggaaa

SEQ ID NO: 2171253 - RNA, 23 nt, Human
cggagagcgccugccccucccag

SEQ ID NO: 2171254 - RNA, 17 nt, Human
cggagaguacagugagc

SEQ ID NO: 2171255 - RNA, 18 nt, Human
cggagaguacagugagcc

SEQ ID NO: 2171256 - RNA, 19 nt, Human
cggagaguacagugagcca

SEQ ID NO: 2171257 - RNA, 21 nt, Human
cggagaguacagugagccaag

SEQ ID NO: 2171258 - RNA, 14 nt, Human
cggagacgggaccg

SEQ ID NO: 2171259 - RNA, 15 nt, Human
cggagacgggaccgg

SEQ ID NO: 2171260 - RNA, 20 nt, Human
cggagacggagucccaccuu

SEQ ID NO: 2171261 - RNA, 17 nt, Human
cggagacggagucccac

SEQ ID NO: 2171262 - RNA, 18 nt, Human
cggaggcuugucagagcu

SEQ ID NO: 2171263 - RNA, 17 nt, Human
cggaggcuugggaccgc

SEQ ID NO: 2171264 - RNA, 15 nt, Human
cggaggcuugggacc

SEQ ID NO: 2171265 - RNA, 16 nt, Human
cggaggcuugggaccg

SEQ ID NO: 2171266 - RNA, 16 nt, Human
cggaggcugcccccgg

SEQ ID NO: 2171267 - RNA, 19 nt, Human
cggaggcugcccccggccc

SEQ ID NO: 2171268 - RNA, 22 nt, Human
cggaggcugcccccggcccccu

SEQ ID NO: 2171269 - RNA, 23 nt, Human
cggaggcuugucagagcugggag

SEQ ID NO: 2171270 - RNA, 21 nt, Human
cggaggcuugucagagcuggg

SEQ ID NO: 2171271 - RNA, 20 nt, Human
cggaggcuugucagagcugg

SEQ ID NO: 2171272 - RNA, 19 nt, Human
cggaggcuugucagagcug

SEQ ID NO: 2171273 - RNA, 19 nt, Human
cggagggaauugaggucug

SEQ ID NO: 2171274 - RNA, 17 nt, Human
cggagggauuccccuaa

SEQ ID NO: 2171275 - RNA, 21 nt, Human
cggagucccaccuuggcugca

SEQ ID NO: 2171276 - RNA, 22 nt, Human
cggagucccaccuuggcugcag

SEQ ID NO: 2171277 - RNA, 23 nt, Human
cggagucccaccuuggcugcagg

SEQ ID NO: 2171278 - RNA, 15 nt, Human
cggaggggccuggca

SEQ ID NO: 2171279 - RNA, 15 nt, Human
cggagucguggggug

SEQ ID NO: 2171280 - RNA, 20 nt, Human
cggcgucagccuccagccuc

SEQ ID NO: 2171281 - RNA, 23 nt, Human
cggcgucagccuccagccucugu

SEQ ID NO: 2171282 - RNA, 18 nt, Human
cggcuaauuuuuguauuu

SEQ ID NO: 2171283 - RNA, 14 nt, Human
cggcgucagccucc

SEQ ID NO: 2171284 - RNA, 15 nt, Human
cggcgucagccucca

SEQ ID NO: 2171285 - RNA, 16 nt, Human
cggcgucagccuccag

SEQ ID NO: 2171286 - RNA, 17 nt, Human
cggcgucagccuccagc

SEQ ID NO: 2171287 - RNA, 18 nt, Human
cggcgucagccuccagcc

SEQ ID NO: 2171288 - RNA, 19 nt, Human
cggcgucagccuccagccu

SEQ ID NO: 2171289 - RNA, 19 nt, Human
cgcucuguugcccaggcug

SEQ ID NO: 2171290 - RNA, 20 nt, Human
cgcucugucgcccaggcugg

SEQ ID NO: 2171291 - RNA, 15 nt, Human
cgcucugucacccag

SEQ ID NO: 2171292 - RNA, 20 nt, Human
cgcucugcuggccuggccgg

SEQ ID NO: 2171293 - RNA, 21 nt, Human
cgcucugcuggccuggccggc

SEQ ID NO: 2171294 - RNA, 15 nt, Human
cgcucugcuggccug

SEQ ID NO: 2171295 - RNA, 16 nt, Human
cgcucugcuggccugg

SEQ ID NO: 2171296 - RNA, 17 nt, Human
cgcucugcuggccuggc

SEQ ID NO: 2171297 - RNA, 18 nt, Human
cgcucugcuggccuggcc

SEQ ID NO: 2171298 - RNA, 22 nt, Human
cgcucuguugcccaggcuggag

SEQ ID NO: 2171299 - RNA, 21 nt, Human
cgcucuuggcagguacucagc

SEQ ID NO: 2171300 - RNA, 13 nt, Human
cgcugaauaaaug

SEQ ID NO: 2171301 - RNA, 23 nt, Human
cgcugacaaccaccgcuccccag

SEQ ID NO: 2171302 - RNA, 14 nt, Human
cgcugaauaaaugu

SEQ ID NO: 2171303 - RNA, 15 nt, Human
cgcugaauaaauguc

SEQ ID NO: 2171304 - RNA, 13 nt, Human
cgcugaguggcag

SEQ ID NO: 2171305 - RNA, 17 nt, Human
cgcugaguggacuggag

SEQ ID NO: 2171306 - RNA, 14 nt, Human
cgcugaguggcagg

SEQ ID NO: 2171307 - RNA, 16 nt, Human
cgcugaguggcagggg

SEQ ID NO: 2171308 - RNA, 19 nt, Human
cgcugccccuggcagcccc

SEQ ID NO: 2171309 - RNA, 20 nt, Human
cgcugccccuggcagccccu

SEQ ID NO: 2171310 - RNA, 21 nt, Human
cgccaccuggcauuccuucug

SEQ ID NO: 2171311 - RNA, 20 nt, Human
cgccaccuggcauuccuucu

SEQ ID NO: 2171312 - RNA, 21 nt, Human
cgccugcaaacgcugccugcc

SEQ ID NO: 2171313 - RNA, 20 nt, Human
cgccugcaaacgcugccugc

SEQ ID NO: 2171314 - RNA, 22 nt, Human
cgccugcauguaaacacgccug

SEQ ID NO: 2171315 - RNA, 17 nt, Human
cgccugcauguaaacac

SEQ ID NO: 2171316 - RNA, 22 nt, Human
cgccugcaaacgcugccugccg

SEQ ID NO: 2171317 - RNA, 22 nt, Human
cgccugcaaacgcugccugccc

SEQ ID NO: 2171318 - RNA, 15 nt, Human
cgccacauggcuucc

SEQ ID NO: 2171319 - RNA, 16 nt, Human
cgccacauggcuuccu

SEQ ID NO: 2171320 - RNA, 17 nt, Human
cgccacauggcuuccuc

SEQ ID NO: 2171321 - RNA, 18 nt, Human
cgccacauggcuuccucc

SEQ ID NO: 2171322 - RNA, 22 nt, Human
cgccacauggcuuccuccugcg

SEQ ID NO: 2171323 - RNA, 23 nt, Human
cgccacauggcuuccuccugcgc

SEQ ID NO: 2171324 - RNA, 17 nt, Human
cgccaccccuccuuccu

SEQ ID NO: 2171325 - RNA, 15 nt, Human
cgccaccauuccugg

SEQ ID NO: 2171326 - RNA, 16 nt, Human
cgccaccauuccugga

SEQ ID NO: 2171327 - RNA, 13 nt, Human
cgccaccauccug

SEQ ID NO: 2171328 - RNA, 23 nt, Human
cgccaccauccugcagccuccuc

SEQ ID NO: 2171329 - RNA, 11 nt, Human
cgccaccauuc

SEQ ID NO: 2171330 - RNA, 16 nt, Human
cgccugccccucccag

SEQ ID NO: 2171331 - RNA, 15 nt, Human
cgccugccccuccca

SEQ ID NO: 2171332 - RNA, 14 nt, Human
cgccugccaguccu

SEQ ID NO: 2171333 - RNA, 15 nt, Human
cgccugccaguccua

SEQ ID NO: 2171334 - RNA, 17 nt, Human
cgccugcccucauggcc

SEQ ID NO: 2171335 - RNA, 20 nt, Human
cgccugcccgucucucuccc

SEQ ID NO: 2171336 - RNA, 23 nt, Human
cgccugcccgucucucucccaug

SEQ ID NO: 2171337 - RNA, 20 nt, Human
cgccugcccucauggccccu

SEQ ID NO: 2171338 - RNA, 22 nt, Human
cgccugcccucauggccccucu

SEQ ID NO: 2171339 - RNA, 13 nt, Human
cgccugcccuccc

SEQ ID NO: 2171340 - RNA, 17 nt, Human
cgccugcccuccccaga

SEQ ID NO: 2171341 - RNA, 20 nt, Human
cgccugcccuccccagagca

SEQ ID NO: 2171342 - RNA, 19 nt, Human
cgccugccuccccugugca

SEQ ID NO: 2171343 - RNA, 12 nt, Human
cgcucugcaugc

SEQ ID NO: 2171344 - RNA, 19 nt, Human
cgcucugcaugcggcccag

SEQ ID NO: 2171345 - RNA, 20 nt, Human
cgcucugcaugcggcccagc

SEQ ID NO: 2171346 - RNA, 21 nt, Human
cgcucugcaugcggcccagcc

SEQ ID NO: 2171347 - RNA, 22 nt, Human
cgcucugcaugcggcccagccc

SEQ ID NO: 2171348 - RNA, 23 nt, Human
cgcucugcaugcggcccagcccg

SEQ ID NO: 2171349 - RNA, 23 nt, Human
cgcuggcccagccggccucucug

SEQ ID NO: 2171350 - RNA, 24 nt, Human
cgcuggcccagccggccucucugg

SEQ ID NO: 2171351 - RNA, 18 nt, Human
cgcuggagguggggccug

SEQ ID NO: 2171352 - RNA, 10 nt, Human
cgcuggccca

SEQ ID NO: 2171353 - RNA, 11 nt, Human
cgcuggcccag

SEQ ID NO: 2171354 - RNA, 12 nt, Human
cgcuggcccagc

SEQ ID NO: 2171355 - RNA, 13 nt, Human
cgcuggcccagcc

SEQ ID NO: 2171356 - RNA, 14 nt, Human
cgcuggcccagccg

SEQ ID NO: 2171357 - RNA, 15 nt, Human
cgcuggcccagccgg

SEQ ID NO: 2171358 - RNA, 16 nt, Human
cgcuggcccagccggc

SEQ ID NO: 2171359 - RNA, 18 nt, Human
cgcugccgcaccccagag

SEQ ID NO: 2171360 - RNA, 13 nt, Human
cgcugccgcaccc

SEQ ID NO: 2171361 - RNA, 21 nt, Human
cgcugcccggcgcccucuguc

SEQ ID NO: 2171362 - RNA, 22 nt, Human
cgcugcccggcgcccucugucc

SEQ ID NO: 2171363 - RNA, 20 nt, Human
cgcugaguggcaggggacag

SEQ ID NO: 2171364 - RNA, 19 nt, Human
cgcugcccggcgcccucug

SEQ ID NO: 2171365 - RNA, 20 nt, Human
cgcugcccggcgcccucugu

SEQ ID NO: 2171366 - RNA, 20 nt, Human
cgcugccuaaguggcugcug

SEQ ID NO: 2171367 - RNA, 17 nt, Human
cgcugccuaaguggcug

SEQ ID NO: 2171368 - RNA, 21 nt, Human
cgcugccgcaccccagagugu

SEQ ID NO: 2171369 - RNA, 20 nt, Human
cgcugccgcaccccagagug

SEQ ID NO: 2171370 - RNA, 15 nt, Human
cgcugccugcccaca

SEQ ID NO: 2171371 - RNA, 13 nt, Human
cgcugccugugug

SEQ ID NO: 2171372 - RNA, 17 nt, Human
cgcuggagugcagugag

SEQ ID NO: 2171373 - RNA, 18 nt, Human
cgcuggagugcagugagc

SEQ ID NO: 2171374 - RNA, 13 nt, Human
ccuuuccuuccuu

SEQ ID NO: 2171375 - RNA, 13 nt, Human
ccuuuccuguagc

SEQ ID NO: 2171376 - RNA, 21 nt, Human
ccuuuccuuccuucccuggcu

SEQ ID NO: 2171377 - RNA, 12 nt, Human
ccuuuucccaac

SEQ ID NO: 2171378 - RNA, 12 nt, Human
ccuuuccuuccu

SEQ ID NO: 2171379 - RNA, 18 nt, Human
ccuuuccuuccaucccua

SEQ ID NO: 2171380 - RNA, 16 nt, Human
ccuuuccuuccauccc

SEQ ID NO: 2171381 - RNA, 16 nt, Human
ccuuuccucaggcaag

SEQ ID NO: 2171382 - RNA, 22 nt, Human
ccuuuccuggacacucagaccu

SEQ ID NO: 2171383 - RNA, 20 nt, Human
ccuuuucgcaggauucuucc

SEQ ID NO: 2171384 - RNA, 21 nt, Human
ccuuuucccggggaggagaga

SEQ ID NO: 2171385 - RNA, 13 nt, Human
ccuuuucccugcu

SEQ ID NO: 2171386 - RNA, 14 nt, Human
ccuuuucccugcuu

SEQ ID NO: 2171387 - RNA, 15 nt, Human
ccuuuucccugcuuc

SEQ ID NO: 2171388 - RNA, 18 nt, Human
ccuuuuccauuugaaaga

SEQ ID NO: 2171389 - RNA, 21 nt, Human
ccuuuuccauuugaaagaaag

SEQ ID NO: 2171390 - RNA, 16 nt, Human
ccuuuucccggggagg

SEQ ID NO: 2171391 - RNA, 19 nt, Human
ccuuuucccugcuuccagg

SEQ ID NO: 2171392 - RNA, 19 nt, Human
cgcagugcuucucuacaga

SEQ ID NO: 2171393 - RNA, 15 nt, Human
cgcagugccucuggu

SEQ ID NO: 2171394 - RNA, 21 nt, Human
cgcagucgucgcacagucucu

SEQ ID NO: 2171395 - RNA, 22 nt, Human
cgcagucgucgcacagucucuc

SEQ ID NO: 2171396 - RNA, 16 nt, Human
cgcagucgucgcacag

SEQ ID NO: 2171397 - RNA, 17 nt, Human
cgcagucgucgcacagu

SEQ ID NO: 2171398 - RNA, 19 nt, Human
cgcagucgucgcacagucu

SEQ ID NO: 2171399 - RNA, 23 nt, Human
cgcagugugcacuaaggggcccg

SEQ ID NO: 2171400 - RNA, 22 nt, Human
cgcagugugcacuaaggggccc

SEQ ID NO: 2171401 - RNA, 17 nt, Human
cgcagugugcacuaagg

SEQ ID NO: 2171402 - RNA, 21 nt, Human
cgccaagguagccaucccaug

SEQ ID NO: 2171403 - RNA, 22 nt, Human
cgccaagguagccaucccauga

SEQ ID NO: 2171404 - RNA, 20 nt, Human
cgagucucuucuccacugga

SEQ ID NO: 2171405 - RNA, 21 nt, Human
cgagucucuucuccacuggau

SEQ ID NO: 2171406 - RNA, 11 nt, Human
cgagugccagg

SEQ ID NO: 2171407 - RNA, 14 nt, Human
cgagugccaggacu

SEQ ID NO: 2171408 - RNA, 14 nt, Human
cgagguagaguuug

SEQ ID NO: 2171409 - RNA, 22 nt, Human
cgcaggcuggcccugcccuggu

SEQ ID NO: 2171410 - RNA, 21 nt, Human
cgcaggcuggcccugcccugg

SEQ ID NO: 2171411 - RNA, 15 nt, Human
cgcagucgucgcaca

SEQ ID NO: 2171412 - RNA, 16 nt, Human
cgcagggguugcagug

SEQ ID NO: 2171413 - RNA, 13 nt, Human
cgcaggggaaacg

SEQ ID NO: 2171414 - RNA, 17 nt, Human
cgcagucaggggcagcu

SEQ ID NO: 2171415 - RNA, 19 nt, Human
cgaggggaggguggcaggu

SEQ ID NO: 2171416 - RNA, 18 nt, Human
cgaggggaggguggcagg

SEQ ID NO: 2171417 - RNA, 21 nt, Human
cgagggcagggaccacacccu

SEQ ID NO: 2171418 - RNA, 12 nt, Human
cgagggcaggga

SEQ ID NO: 2171419 - RNA, 15 nt, Human
cgaggguccuggcuc

SEQ ID NO: 2171420 - RNA, 14 nt, Human
cgaggguccuggcu

SEQ ID NO: 2171421 - RNA, 18 nt, Human
cgaggggugucuugggca

SEQ ID NO: 2171422 - RNA, 19 nt, Human
cgaggggugucuugggcag

SEQ ID NO: 2171423 - RNA, 17 nt, Human
cgaggggcgggacccag

SEQ ID NO: 2171424 - RNA, 21 nt, Human
cgaggggcgggacccaggcac

SEQ ID NO: 2171425 - RNA, 16 nt, Human
cgaggggcucaggaaa

SEQ ID NO: 2171426 - RNA, 17 nt, Human
cgaggggcucaggaaaa

SEQ ID NO: 2171427 - RNA, 20 nt, Human
cgaggggcucucagcucagc

SEQ ID NO: 2171428 - RNA, 17 nt, Human
cgagucucuucuccacu

SEQ ID NO: 2171429 - RNA, 18 nt, Human
cgagucucuucuccacug

SEQ ID NO: 2171430 - RNA, 23 nt, Human
cgaggguccuggcuccugagggg

SEQ ID NO: 2171431 - RNA, 16 nt, Human
cgaggguccuggcucc

SEQ ID NO: 2171432 - RNA, 16 nt, Human
cgagucucuucuccac

SEQ ID NO: 2171433 - RNA, 14 nt, Human
cccauucuuuugua

SEQ ID NO: 2171434 - RNA, 20 nt, Human
cccauucuuccuaguuuucu

SEQ ID NO: 2171435 - RNA, 17 nt, Human
cccauucuuuuguaauu

SEQ ID NO: 2171436 - RNA, 20 nt, Human
cccauucuuuuguaauuuaa

SEQ ID NO: 2171437 - RNA, 21 nt, Human
cccauucuuuuguaauuuaaa

SEQ ID NO: 2171438 - RNA, 22 nt, Human
cccauucuuuuguaauuuaaau

SEQ ID NO: 2171439 - RNA, 14 nt, Human
cccauugcccuggu

SEQ ID NO: 2171440 - RNA, 14 nt, Human
cccauugccuccuc

SEQ ID NO: 2171441 - RNA, 17 nt, Human
cccauugccuccuccuu

SEQ ID NO: 2171442 - RNA, 20 nt, Human
ccccaaaaaccucacccgag

SEQ ID NO: 2171443 - RNA, 19 nt, Human
ccccaaaaccacagcccug

SEQ ID NO: 2171444 - RNA, 16 nt, Human
ccccaaaaccacagcc

SEQ ID NO: 2171445 - RNA, 15 nt, Human
ccccaaaaccacagc

SEQ ID NO: 2171446 - RNA, 14 nt, Human
cccauugucccucu

SEQ ID NO: 2171447 - RNA, 18 nt, Human
ccccaaaacucuccucug

SEQ ID NO: 2171448 - RNA, 11 nt, Human
ccccagcaggu

SEQ ID NO: 2171449 - RNA, 18 nt, Human
ccccagcaggugcugacu

SEQ ID NO: 2171450 - RNA, 19 nt, Human
ccccagcauuccagccccu

SEQ ID NO: 2171451 - RNA, 23 nt, Human
ccccagcaguugaaugacaacag

SEQ ID NO: 2171452 - RNA, 12 nt, Human
ccccagcaggug

SEQ ID NO: 2171453 - RNA, 9 nt, Human
ccccagcca

SEQ ID NO: 2171454 - RNA, 22 nt, Human
ccccaaaaccacagcccuguca

SEQ ID NO: 2171455 - RNA, 20 nt, Human
ccccaaaaccacagcccugu

SEQ ID NO: 2171456 - RNA, 23 nt, Human
ccccaaaaccacagcccugucag

SEQ ID NO: 2171457 - RNA, 16 nt, Human
ccccagcacugaggaa

SEQ ID NO: 2171458 - RNA, 20 nt, Human
ccccaaaacucuccucugcu

SEQ ID NO: 2171459 - RNA, 12 nt, Human
ccccagcccacc

SEQ ID NO: 2171460 - RNA, 16 nt, Human
ccccauucuuccuagu

SEQ ID NO: 2171461 - RNA, 23 nt, Human
ccccauucuuccuaguuuucucc

SEQ ID NO: 2171462 - RNA, 21 nt, Human
ccccauucuuccuaguuuucu

SEQ ID NO: 2171463 - RNA, 21 nt, Human
ccccauucugccugcccaggc

SEQ ID NO: 2171464 - RNA, 14 nt, Human
ccccagccccaucc

SEQ ID NO: 2171465 - RNA, 14 nt, Human
ccccagccccaaaa

SEQ ID NO: 2171466 - RNA, 11 nt, Human
ccccagccaga

SEQ ID NO: 2171467 - RNA, 23 nt, Human
ccccagccagauggacuccagcc

SEQ ID NO: 2171468 - RNA, 13 nt, Human
ccccagcccaagu

SEQ ID NO: 2171469 - RNA, 14 nt, Human
ccccagcccaaguc

SEQ ID NO: 2171470 - RNA, 15 nt, Human
ccccagcccaagucc

SEQ ID NO: 2171471 - RNA, 16 nt, Human
ccccagcccaagucca

SEQ ID NO: 2171472 - RNA, 10 nt, Human
ccccagcccc

SEQ ID NO: 2171473 - RNA, 12 nt, Human
ccccagccccaa

SEQ ID NO: 2171474 - RNA, 13 nt, Human
ccccgcccccugc

SEQ ID NO: 2171475 - RNA, 12 nt, Human
ccccgcccccag

SEQ ID NO: 2171476 - RNA, 16 nt, Human
ccccgcccccaguccc

SEQ ID NO: 2171477 - RNA, 17 nt, Human
ccccgcccccugcccuc

SEQ ID NO: 2171478 - RNA, 18 nt, Human
ccccgcccccugcccucc

SEQ ID NO: 2171479 - RNA, 21 nt, Human
ccccgcccccugcccuccccu

SEQ ID NO: 2171480 - RNA, 16 nt, Human
ccccgccccgccccac

SEQ ID NO: 2171481 - RNA, 18 nt, Human
ccccgccugcccucaugg

SEQ ID NO: 2171482 - RNA, 20 nt, Human
ccccgccccacauuccgaca

SEQ ID NO: 2171483 - RNA, 17 nt, Human
ccccgccccacauuccg

SEQ ID NO: 2171484 - RNA, 16 nt, Human
ccccgccccacauucc

SEQ ID NO: 2171485 - RNA, 13 nt, Human
ccccgccccacau

SEQ ID NO: 2171486 - RNA, 14 nt, Human
ccccgcccaggcug

SEQ ID NO: 2171487 - RNA, 15 nt, Human
ccccgcccaggcugg

SEQ ID NO: 2171488 - RNA, 16 nt, Human
ccccgcccaggcuggc

SEQ ID NO: 2171489 - RNA, 19 nt, Human
ccccgcccaggcuggccag

SEQ ID NO: 2171490 - RNA, 14 nt, Human
ccccgcccaggcuu

SEQ ID NO: 2171491 - RNA, 13 nt, Human
ccccgccccgccc

SEQ ID NO: 2171492 - RNA, 14 nt, Human
ccccgccuguuccc

SEQ ID NO: 2171493 - RNA, 13 nt, Human
ccccggccaccug

SEQ ID NO: 2171494 - RNA, 14 nt, Human
ccccggccaccugc

SEQ ID NO: 2171495 - RNA, 18 nt, Human
ccccggccaccugcggug

SEQ ID NO: 2171496 - RNA, 23 nt, Human
ccccgcccagcugcaccugccag

SEQ ID NO: 2171497 - RNA, 17 nt, Human
ccccgcccagcugcacc

SEQ ID NO: 2171498 - RNA, 12 nt, Human
ccccgcccaggc

SEQ ID NO: 2171499 - RNA, 22 nt, Human
cccccuucucugcuccaccaca

SEQ ID NO: 2171500 - RNA, 17 nt, Human
cccccuucucugcucca

SEQ ID NO: 2171501 - RNA, 20 nt, Human
ccccgcagaccuccccagcc

SEQ ID NO: 2171502 - RNA, 21 nt, Human
ccccgcagaccuccccagccc

SEQ ID NO: 2171503 - RNA, 23 nt, Human
ccccgcagaccuccccagccccu

SEQ ID NO: 2171504 - RNA, 16 nt, Human
cccccuucucugcucc

SEQ ID NO: 2171505 - RNA, 15 nt, Human
cccccuucucugcuc

SEQ ID NO: 2171506 - RNA, 17 nt, Human
cccccuucucccacacu

SEQ ID NO: 2171507 - RNA, 15 nt, Human
cccccuucucccaca

SEQ ID NO: 2171508 - RNA, 14 nt, Human
cccccuucucccac

SEQ ID NO: 2171509 - RNA, 13 nt, Human
cccccuucuccca

SEQ ID NO: 2171510 - RNA, 11 nt, Human
cccccuuccac

SEQ ID NO: 2171511 - RNA, 23 nt, Human
cccccuucagugcccaccaacau

SEQ ID NO: 2171512 - RNA, 15 nt, Human
cccccuucagugccc

SEQ ID NO: 2171513 - RNA, 14 nt, Human
cccccuucagugcc

SEQ ID NO: 2171514 - RNA, 14 nt, Human
cccccuuccaugga

SEQ ID NO: 2171515 - RNA, 15 nt, Human
ccccauucuuuugua

SEQ ID NO: 2171516 - RNA, 17 nt, Human
ccccauugccuccuccu

SEQ ID NO: 2171517 - RNA, 15 nt, Human
ccccauuguggucac

SEQ ID NO: 2171518 - RNA, 23 nt, Human
cccauucugccugcccaggcccc

SEQ ID NO: 2171519 - RNA, 12 nt, Human
cccauucuuccu

SEQ ID NO: 2171520 - RNA, 21 nt, Human
cccauucuuccuaguuuucuc

SEQ ID NO: 2171521 - RNA, 18 nt, Human
cccagcccagcugguggg

SEQ ID NO: 2171522 - RNA, 21 nt, Human
cccagcccauucucucuccug

SEQ ID NO: 2171523 - RNA, 20 nt, Human
cccagcuggggccaggcugg

SEQ ID NO: 2171524 - RNA, 23 nt, Human
cccagccccaaaacucuccucug

SEQ ID NO: 2171525 - RNA, 21 nt, Human
cccagcccaggguucccccag

SEQ ID NO: 2171526 - RNA, 18 nt, Human
cccagcccagggcuccug

SEQ ID NO: 2171527 - RNA, 16 nt, Human
cccagcccagagacau

SEQ ID NO: 2171528 - RNA, 11 nt, Human
cccagcccagg

SEQ ID NO: 2171529 - RNA, 21 nt, Human
cccagccccaaaacucuccuc

SEQ ID NO: 2171530 - RNA, 16 nt, Human
cccagcccagcuggug

SEQ ID NO: 2171531 - RNA, 13 nt, Human
cccagcccagcug

SEQ ID NO: 2171532 - RNA, 15 nt, Human
cccagcccagagaca

SEQ ID NO: 2171533 - RNA, 14 nt, Human
cccagcccagagac

SEQ ID NO: 2171534 - RNA, 13 nt, Human
cccagcccagaga

SEQ ID NO: 2171535 - RNA, 12 nt, Human
cccagcccagag

SEQ ID NO: 2171536 - RNA, 17 nt, Human
cccagcccacuucugcc

SEQ ID NO: 2171537 - RNA, 12 nt, Human
cccagccacccc

SEQ ID NO: 2171538 - RNA, 20 nt, Human
cccagcauuuuacugauuca

SEQ ID NO: 2171539 - RNA, 11 nt, Human
cccagcccaga

SEQ ID NO: 2171540 - RNA, 19 nt, Human
cccagcccacuucugccau

SEQ ID NO: 2171541 - RNA, 17 nt, Human
cccagccaaacccuguc

SEQ ID NO: 2171542 - RNA, 15 nt, Human
cccagcauugcuggu

SEQ ID NO: 2171543 - RNA, 18 nt, Human
cccagcauugcugguucu

SEQ ID NO: 2171544 - RNA, 22 nt, Human
cccagcauuccagccccucugg

SEQ ID NO: 2171545 - RNA, 19 nt, Human
cccagcauuccagccccuc

SEQ ID NO: 2171546 - RNA, 20 nt, Human
cccagcauuccagccccucu

SEQ ID NO: 2171547 - RNA, 21 nt, Human
cccagcauccuuuucugcaga

SEQ ID NO: 2171548 - RNA, 17 nt, Human
cccagcauaugggggcc

SEQ ID NO: 2171549 - RNA, 19 nt, Human
cccagcagguggggagggg

SEQ ID NO: 2171550 - RNA, 16 nt, Human
cccagcaguuugggag

SEQ ID NO: 2171551 - RNA, 18 nt, Human
cccagcauuccagccccu

SEQ ID NO: 2171552 - RNA, 22 nt, Human
cccagcuggugggaagcgucug

SEQ ID NO: 2171553 - RNA, 19 nt, Human
cccagcuggugggaagcgu

SEQ ID NO: 2171554 - RNA, 16 nt, Human
cccagcuggugggaag

SEQ ID NO: 2171555 - RNA, 22 nt, Human
cccagcccauucucucuccugu

SEQ ID NO: 2171556 - RNA, 19 nt, Human
cccagcugggucaggcagg

SEQ ID NO: 2171557 - RNA, 17 nt, Human
cccagcugggucaggca

SEQ ID NO: 2171558 - RNA, 18 nt, Human
cccaggcuggcgugcagu

SEQ ID NO: 2171559 - RNA, 22 nt, Human
cccagcuggggccaggcugggu

SEQ ID NO: 2171560 - RNA, 23 nt, Human
cccagcuggggccaggcuggguc

SEQ ID NO: 2171561 - RNA, 15 nt, Human
cccagcugugagccu

SEQ ID NO: 2171562 - RNA, 16 nt, Human
cccagcugugagccuu

SEQ ID NO: 2171563 - RNA, 17 nt, Human
cccagcugugagccuug

SEQ ID NO: 2171564 - RNA, 20 nt, Human
cccagggagcggaaagcagc

SEQ ID NO: 2171565 - RNA, 22 nt, Human
cccagggagcggaaagcagcuc

SEQ ID NO: 2171566 - RNA, 21 nt, Human
cccagggagcggaaagcagcu

SEQ ID NO: 2171567 - RNA, 19 nt, Human
cccaggcuggcgugcagug

SEQ ID NO: 2171568 - RNA, 20 nt, Human
cccaggcuggcgugcagugg

SEQ ID NO: 2171569 - RNA, 15 nt, Human
cccaucccacacccu

SEQ ID NO: 2171570 - RNA, 13 nt, Human
cccaucccacacc

SEQ ID NO: 2171571 - RNA, 14 nt, Human
cccauccaggcagu

SEQ ID NO: 2171572 - RNA, 14 nt, Human
cccauccucuguac

SEQ ID NO: 2171573 - RNA, 20 nt, Human
cccauccagucucccaacuu

SEQ ID NO: 2171574 - RNA, 13 nt, Human
cccauccagggcc

SEQ ID NO: 2171575 - RNA, 21 nt, Human
cccauccaguucaugagaauc

SEQ ID NO: 2171576 - RNA, 14 nt, Human
cccauccaguucau

SEQ ID NO: 2171577 - RNA, 13 nt, Human
cccauccaggcag

SEQ ID NO: 2171578 - RNA, 20 nt, Human
cccaucauucaugcuacugc

SEQ ID NO: 2171579 - RNA, 12 nt, Human
cccaucauucau

SEQ ID NO: 2171580 - RNA, 15 nt, Human
cccaucauucaugcu

SEQ ID NO: 2171581 - RNA, 20 nt, Human
cccagggccagggcccugca

SEQ ID NO: 2171582 - RNA, 23 nt, Human
cccagggccacucugccucugcc

SEQ ID NO: 2171583 - RNA, 18 nt, Human
cccagggccagggcccug

SEQ ID NO: 2171584 - RNA, 12 nt, Human
cccaucauccca

SEQ ID NO: 2171585 - RNA, 14 nt, Human
cccaucaucccagc

SEQ ID NO: 2171586 - RNA, 17 nt, Human
cccagggccagggcccu

SEQ ID NO: 2171587 - RNA, 15 nt, Human
cccagggccagggcc

SEQ ID NO: 2171588 - RNA, 18 nt, Human
cccagggccacucugccu

SEQ ID NO: 2171589 - RNA, 18 nt, Human
cccagggcacuucacaga

SEQ ID NO: 2171590 - RNA, 20 nt, Human
cccagggcacuucacagagu

SEQ ID NO: 2171591 - RNA, 22 nt, Human
cccagggcacuucacagagugu

SEQ ID NO: 2171592 - RNA, 20 nt, Human
cccauccucuguacagagcc

SEQ ID NO: 2171593 - RNA, 19 nt, Human
cccauccccauccuccagc

SEQ ID NO: 2171594 - RNA, 15 nt, Human
cccauccucuguaca

SEQ ID NO: 2171595 - RNA, 19 nt, Human
cccauccucuguacagagc

SEQ ID NO: 2171596 - RNA, 20 nt, Human
cccaacuuuguggaugucuu

SEQ ID NO: 2171597 - RNA, 14 nt, Human
cccaagccagaggc

SEQ ID NO: 2171598 - RNA, 15 nt, Human
cccaagccagaggcu

SEQ ID NO: 2171599 - RNA, 20 nt, Human
cccaagaauagaugcugacu

SEQ ID NO: 2171600 - RNA, 21 nt, Human
cccaagaauagaugcugacug

SEQ ID NO: 2171601 - RNA, 23 nt, Human
cccaagccuacuuuugccauuga

SEQ ID NO: 2171602 - RNA, 16 nt, Human
cccaagccagaggcug

SEQ ID NO: 2171603 - RNA, 20 nt, Human
cccaagcccccuccuugucu

SEQ ID NO: 2171604 - RNA, 18 nt, Human
cccaagcccgacuugcug

SEQ ID NO: 2171605 - RNA, 23 nt, Human
cccaagcccgacuugcuguuuug

SEQ ID NO: 2171606 - RNA, 16 nt, Human
cccaagccuggcaagg

SEQ ID NO: 2171607 - RNA, 17 nt, Human
cccaagcucuuguggua

SEQ ID NO: 2171608 - RNA, 13 nt, Human
cccaagcugggcc

SEQ ID NO: 2171609 - RNA, 14 nt, Human
cccaagcuuagaac

SEQ ID NO: 2171610 - RNA, 19 nt, Human
cccaagcuguuuucuucua

SEQ ID NO: 2171611 - RNA, 14 nt, Human
cccaagcugggccc

SEQ ID NO: 2171612 - RNA, 18 nt, Human
cccaagcugggccccagc

SEQ ID NO: 2171613 - RNA, 21 nt, Human
cccaagcugggccccagccca

SEQ ID NO: 2171614 - RNA, 22 nt, Human
cccaagcugggccccagcccac

SEQ ID NO: 2171615 - RNA, 17 nt, Human
cccaagcucugcuccuc

SEQ ID NO: 2171616 - RNA, 12 nt, Human
cccaagcucaga

SEQ ID NO: 2171617 - RNA, 18 nt, Human
cccaccaugucugcccca

SEQ ID NO: 2171618 - RNA, 15 nt, Human
cccacccaagcuugg

SEQ ID NO: 2171619 - RNA, 15 nt, Human
cccacccaagggccu

SEQ ID NO: 2171620 - RNA, 19 nt, Human
cccaaggaaagccccagca

SEQ ID NO: 2171621 - RNA, 14 nt, Human
cccaaggaaagccc

SEQ ID NO: 2171622 - RNA, 14 nt, Human
cccaagcuuggcag

SEQ ID NO: 2171623 - RNA, 18 nt, Human
cccaagcuuggcagccga

SEQ ID NO: 2171624 - RNA, 20 nt, Human
cccaagcuuggcagccgagc

SEQ ID NO: 2171625 - RNA, 22 nt, Human
cccaagcuuggcagccgagcuc

SEQ ID NO: 2171626 - RNA, 18 nt, Human
cccaccaucaugucuggc

SEQ ID NO: 2171627 - RNA, 22 nt, Human
cccacccccuucucugcuccac

SEQ ID NO: 2171628 - RNA, 15 nt, Human
cccaccccgcucugc

SEQ ID NO: 2171629 - RNA, 16 nt, Human
cccaccccgcucugca

SEQ ID NO: 2171630 - RNA, 13 nt, Human
cccaccccgggga

SEQ ID NO: 2171631 - RNA, 14 nt, Human
cccaccccggggac

SEQ ID NO: 2171632 - RNA, 17 nt, Human
cccaccccggggacccu

SEQ ID NO: 2171633 - RNA, 18 nt, Human
cccaccccggggacccug

SEQ ID NO: 2171634 - RNA, 19 nt, Human
cccacccccuucucugcuc

SEQ ID NO: 2171635 - RNA, 16 nt, Human
cccacccccuucucug

SEQ ID NO: 2171636 - RNA, 23 nt, Human
cccacccccuucagugcccacca

SEQ ID NO: 2171637 - RNA, 19 nt, Human
cccacccccuucagugccc

SEQ ID NO: 2171638 - RNA, 18 nt, Human
cccacccccugcccugca

SEQ ID NO: 2171639 - RNA, 19 nt, Human
cccacccccugcccugcac

SEQ ID NO: 2171640 - RNA, 19 nt, Human
cccacccccuccccagggg

SEQ ID NO: 2171641 - RNA, 13 nt, Human
cccacccccugcc

SEQ ID NO: 2171642 - RNA, 17 nt, Human
cccacccccuccccagg

SEQ ID NO: 2171643 - RNA, 15 nt, Human
cccacccccucaagc

SEQ ID NO: 2171644 - RNA, 14 nt, Human
cccacccccugccc

SEQ ID NO: 2171645 - RNA, 15 nt, Human
cccacccccugcccu

SEQ ID NO: 2171646 - RNA, 16 nt, Human
cccacccccugcccug

SEQ ID NO: 2171647 - RNA, 17 nt, Human
cccacccccugcccugc

SEQ ID NO: 2171648 - RNA, 18 nt, Human
cccacccaagggccuggc

SEQ ID NO: 2171649 - RNA, 13 nt, Human
cccacccccucaa

SEQ ID NO: 2171650 - RNA, 16 nt, Human
cccacccaagcuuggc

SEQ ID NO: 2171651 - RNA, 18 nt, Human
cccacccaagcuuggcag

SEQ ID NO: 2171652 - RNA, 22 nt, Human
cccacccaagcuuggcagccga

SEQ ID NO: 2171653 - RNA, 22 nt, Human
ccauuguuugaaacaaagaagg

SEQ ID NO: 2171654 - RNA, 21 nt, Human
ccauuguuugaaacaaagaag

SEQ ID NO: 2171655 - RNA, 12 nt, Human
ccauugugugag

SEQ ID NO: 2171656 - RNA, 15 nt, Human
ccauuguuugaaaca

SEQ ID NO: 2171657 - RNA, 13 nt, Human
ccauuuaaagcuu

SEQ ID NO: 2171658 - RNA, 13 nt, Human
cccaaccugcucu

SEQ ID NO: 2171659 - RNA, 14 nt, Human
cccaaccugcucuc

SEQ ID NO: 2171660 - RNA, 21 nt, Human
cccaaccugcucuccucuugc

SEQ ID NO: 2171661 - RNA, 11 nt, Human
cccaacugucu

SEQ ID NO: 2171662 - RNA, 12 nt, Human
cccaacucuccu

SEQ ID NO: 2171663 - RNA, 15 nt, Human
cccaacucuccugga

SEQ ID NO: 2171664 - RNA, 12 nt, Human
cccaacuguuau

SEQ ID NO: 2171665 - RNA, 15 nt, Human
cccaacugucuuuuu

SEQ ID NO: 2171666 - RNA, 13 nt, Human
cccaacugucuuu

SEQ ID NO: 2171667 - RNA, 15 nt, Human
cccaacucuccccug

SEQ ID NO: 2171668 - RNA, 20 nt, Human
cccaacucuccccugaccug

SEQ ID NO: 2171669 - RNA, 23 nt, Human
cccaaccugcucuccucuugcca

SEQ ID NO: 2171670 - RNA, 14 nt, Human
cccaaccugcugaa

SEQ ID NO: 2171671 - RNA, 16 nt, Human
ccauugucuuguucug

SEQ ID NO: 2171672 - RNA, 17 nt, Human
ccauugucuuguucugu

SEQ ID NO: 2171673 - RNA, 10 nt, Human
ccauugucuu

SEQ ID NO: 2171674 - RNA, 22 nt, Human
ccauugucccucugccccaucc

SEQ ID NO: 2171675 - RNA, 15 nt, Human
ccauugucuuguucu

SEQ ID NO: 2171676 - RNA, 19 nt, Human
ccauugucccucugcccca

SEQ ID NO: 2171677 - RNA, 17 nt, Human
ccauugucccucugccc

SEQ ID NO: 2171678 - RNA, 15 nt, Human
ccauugucccucugc

SEQ ID NO: 2171679 - RNA, 19 nt, Human
ccauuguccaauccuaugu

SEQ ID NO: 2171680 - RNA, 23 nt, Human
ccauuguaacuuggauguagcca

SEQ ID NO: 2171681 - RNA, 22 nt, Human
ccauuguggucacaggaaguag

SEQ ID NO: 2171682 - RNA, 20 nt, Human
ccauugucuuguucugugau

SEQ ID NO: 2171683 - RNA, 20 nt, Human
ccauuguggcuccuaucugu

SEQ ID NO: 2171684 - RNA, 13 nt, Human
ccauugguguuga

SEQ ID NO: 2171685 - RNA, 14 nt, Human
cccacccugggacc

SEQ ID NO: 2171686 - RNA, 20 nt, Human
cccaccccggggacccugug

SEQ ID NO: 2171687 - RNA, 21 nt, Human
cccaccccggggacccuguga

SEQ ID NO: 2171688 - RNA, 13 nt, Human
cccacccugggcc

SEQ ID NO: 2171689 - RNA, 14 nt, Human
cccacccugggccc

SEQ ID NO: 2171690 - RNA, 18 nt, Human
cccacccuggugggccaa

SEQ ID NO: 2171691 - RNA, 15 nt, Human
cccacccugggcucu

SEQ ID NO: 2171692 - RNA, 15 nt, Human
cccaccgcagacagg

SEQ ID NO: 2171693 - RNA, 18 nt, Human
cccaccgcagacaggacc

SEQ ID NO: 2171694 - RNA, 18 nt, Human
cccacuguacuugcucuu

SEQ ID NO: 2171695 - RNA, 19 nt, Human
cccacuguacuugcucuug

SEQ ID NO: 2171696 - RNA, 23 nt, Human
cccacuguacuugcucuugaugc

SEQ ID NO: 2171697 - RNA, 13 nt, Human
cccacuguccugg

SEQ ID NO: 2171698 - RNA, 14 nt, Human
cccacuguccuggg

SEQ ID NO: 2171699 - RNA, 16 nt, Human
cccacuguccugggcg

SEQ ID NO: 2171700 - RNA, 22 nt, Human
cccacuguccugggccugcaga

SEQ ID NO: 2171701 - RNA, 16 nt, Human
cccacuguccugggcc

SEQ ID NO: 2171702 - RNA, 15 nt, Human
cccacuguccugggc

SEQ ID NO: 2171703 - RNA, 14 nt, Human
ccaugggcacugcu

SEQ ID NO: 2171704 - RNA, 15 nt, Human
ccaugggcacugcug

SEQ ID NO: 2171705 - RNA, 21 nt, Human
ccaugagcaccccaaggcugc

SEQ ID NO: 2171706 - RNA, 22 nt, Human
ccaugagcaccccaaggcugcg

SEQ ID NO: 2171707 - RNA, 16 nt, Human
ccaugggcagagccca

SEQ ID NO: 2171708 - RNA, 14 nt, Human
ccaugggcagagcc

SEQ ID NO: 2171709 - RNA, 16 nt, Human
ccaugggcacugcugg

SEQ ID NO: 2171710 - RNA, 17 nt, Human
ccaugggcacugcuggg

SEQ ID NO: 2171711 - RNA, 20 nt, Human
ccaugggcacugcugggugg

SEQ ID NO: 2171712 - RNA, 22 nt, Human
ccaugggcacugcuggguggcc

SEQ ID NO: 2171713 - RNA, 18 nt, Human
ccaugggcacugugggua

SEQ ID NO: 2171714 - RNA, 13 nt, Human
ccaugagccucag

SEQ ID NO: 2171715 - RNA, 16 nt, Human
ccaugaggaacaaggc

SEQ ID NO: 2171716 - RNA, 17 nt, Human
ccaugaggaacaaggca

SEQ ID NO: 2171717 - RNA, 18 nt, Human
ccaugaggaacaaggcaa

SEQ ID NO: 2171718 - RNA, 23 nt, Human
ccaugagaugauacauccaaagc

SEQ ID NO: 2171719 - RNA, 22 nt, Human
ccaugagaauaagagaaagaaa

SEQ ID NO: 2171720 - RNA, 18 nt, Human
ccaugacuugagaaacaa

SEQ ID NO: 2171721 - RNA, 13 nt, Human
ccaugagaagagg

SEQ ID NO: 2171722 - RNA, 17 nt, Human
ccaugagaagagggccu

SEQ ID NO: 2171723 - RNA, 18 nt, Human
ccaugagaagagggccug

SEQ ID NO: 2171724 - RNA, 19 nt, Human
ccaugagaagagggccugu

SEQ ID NO: 2171725 - RNA, 21 nt, Human
ccaugagaagagggccugugg

SEQ ID NO: 2171726 - RNA, 16 nt, Human
ccaugaccuuacauuu

SEQ ID NO: 2171727 - RNA, 17 nt, Human
ccaugucugccccauca

SEQ ID NO: 2171728 - RNA, 13 nt, Human
ccaugucugcauu

SEQ ID NO: 2171729 - RNA, 20 nt, Human
ccaugucucugagcauuaga

SEQ ID NO: 2171730 - RNA, 16 nt, Human
ccaugucucucagaau

SEQ ID NO: 2171731 - RNA, 15 nt, Human
ccaugucggccucua

SEQ ID NO: 2171732 - RNA, 13 nt, Human
ccaugucggccuc

SEQ ID NO: 2171733 - RNA, 14 nt, Human
ccaugucggccucu

SEQ ID NO: 2171734 - RNA, 15 nt, Human
ccaugucucgacuca

SEQ ID NO: 2171735 - RNA, 14 nt, Human
ccaugucucgacuc

SEQ ID NO: 2171736 - RNA, 20 nt, Human
ccaugguacccccuucuggg

SEQ ID NO: 2171737 - RNA, 19 nt, Human
ccaugucgccucugcauuc

SEQ ID NO: 2171738 - RNA, 19 nt, Human
ccaugguacccccuucugg

SEQ ID NO: 2171739 - RNA, 18 nt, Human
ccaugucgcgcucagcau

SEQ ID NO: 2171740 - RNA, 17 nt, Human
ccaugggccuccugugu

SEQ ID NO: 2171741 - RNA, 17 nt, Human
ccaugggcagagcccaa

SEQ ID NO: 2171742 - RNA, 13 nt, Human
ccaugggcucuga

SEQ ID NO: 2171743 - RNA, 13 nt, Human
ccaugggcuucac

SEQ ID NO: 2171744 - RNA, 16 nt, Human
ccaugggcuucacugu

SEQ ID NO: 2171745 - RNA, 19 nt, Human
ccaugggcuucacuguaua

SEQ ID NO: 2171746 - RNA, 20 nt, Human
ccaugggcuucacuguauaa

SEQ ID NO: 2171747 - RNA, 21 nt, Human
ccaugggcuucacuguauaaa

SEQ ID NO: 2171748 - RNA, 11 nt, Human
ccauggggaag

SEQ ID NO: 2171749 - RNA, 14 nt, Human
ccaugggggcaggg

SEQ ID NO: 2171750 - RNA, 13 nt, Human
ccaugggggcagg

SEQ ID NO: 2171751 - RNA, 20 nt, Human
ccauggggagggauucuggu

SEQ ID NO: 2171752 - RNA, 12 nt, Human
ccauggggaggg

SEQ ID NO: 2171753 - RNA, 18 nt, Human
ccauggggagggauucug

SEQ ID NO: 2171754 - RNA, 15 nt, Human
ccaugguacccccuu

SEQ ID NO: 2171755 - RNA, 16 nt, Human
ccaugguacccccuuc

SEQ ID NO: 2171756 - RNA, 18 nt, Human
ccaugguacccccuucug

SEQ ID NO: 2171757 - RNA, 23 nt, Human
ccaugggguaggaggaugggcuc

SEQ ID NO: 2171758 - RNA, 14 nt, Human
ccaugguacccccu

SEQ ID NO: 2171759 - RNA, 13 nt, Human
ccaguccuuccac

SEQ ID NO: 2171760 - RNA, 17 nt, Human
ccaguccuuccaccucg

SEQ ID NO: 2171761 - RNA, 18 nt, Human
ccagucgauaucucacuu

SEQ ID NO: 2171762 - RNA, 14 nt, Human
ccagucgcgcugcc

SEQ ID NO: 2171763 - RNA, 15 nt, Human
ccagucgcgcugccu

SEQ ID NO: 2171764 - RNA, 16 nt, Human
ccagucgcgcugccug

SEQ ID NO: 2171765 - RNA, 19 nt, Human
ccagucgcgcugccugugu

SEQ ID NO: 2171766 - RNA, 17 nt, Human
ccagucgcgcugccugu

SEQ ID NO: 2171767 - RNA, 18 nt, Human
ccagucgcgcugccugug

SEQ ID NO: 2171768 - RNA, 22 nt, Human
ccaguccugccuggccaggcag

SEQ ID NO: 2171769 - RNA, 21 nt, Human
ccaguccugccuggccaggca

SEQ ID NO: 2171770 - RNA, 19 nt, Human
ccaguccugccuggccagg

SEQ ID NO: 2171771 - RNA, 18 nt, Human
ccaguccugccuggccag

SEQ ID NO: 2171772 - RNA, 12 nt, Human
ccaguccuggcc

SEQ ID NO: 2171773 - RNA, 14 nt, Human
ccaguauucuuguc

SEQ ID NO: 2171774 - RNA, 13 nt, Human
ccaguccuggccu

SEQ ID NO: 2171775 - RNA, 15 nt, Human
ccaguccuggccugg

SEQ ID NO: 2171776 - RNA, 20 nt, Human
ccaguccuggccuggcuucu

SEQ ID NO: 2171777 - RNA, 17 nt, Human
ccaguccugccuggcca

SEQ ID NO: 2171778 - RNA, 16 nt, Human
ccaguccugccuggcc

SEQ ID NO: 2171779 - RNA, 15 nt, Human
ccaguccugccuggc

SEQ ID NO: 2171780 - RNA, 14 nt, Human
ccaguccugccugg

SEQ ID NO: 2171781 - RNA, 22 nt, Human
ccaguauucuagguagugcccu

SEQ ID NO: 2171782 - RNA, 12 nt, Human
ccaguauucuug

SEQ ID NO: 2171783 - RNA, 19 nt, Human
ccagucaccccggccaccu

SEQ ID NO: 2171784 - RNA, 17 nt, Human
ccagucaccccggccac

SEQ ID NO: 2171785 - RNA, 18 nt, Human
ccagucaccccggccacc

SEQ ID NO: 2171786 - RNA, 16 nt, Human
ccaggggaugggaggu

SEQ ID NO: 2171787 - RNA, 23 nt, Human
ccaggcucuuuggggucagccag

SEQ ID NO: 2171788 - RNA, 15 nt, Human
ccaggggcaggcaca

SEQ ID NO: 2171789 - RNA, 16 nt, Human
ccaggggcaggcacag

SEQ ID NO: 2171790 - RNA, 17 nt, Human
ccaggggcaggcacagc

SEQ ID NO: 2171791 - RNA, 15 nt, Human
ccaggggccaugaau

SEQ ID NO: 2171792 - RNA, 18 nt, Human
ccaggggcaggcacagca

SEQ ID NO: 2171793 - RNA, 19 nt, Human
ccaggggcaggcacagcac

SEQ ID NO: 2171794 - RNA, 21 nt, Human
ccaggggcauguauuggccug

SEQ ID NO: 2171795 - RNA, 22 nt, Human
ccaggggcauguauuggccugg

SEQ ID NO: 2171796 - RNA, 23 nt, Human
ccaggggcauguauuggccugga

SEQ ID NO: 2171797 - RNA, 19 nt, Human
ccaggggcccaaggcggcc

SEQ ID NO: 2171798 - RNA, 22 nt, Human
ccaggggcccaaggcggccccu

SEQ ID NO: 2171799 - RNA, 18 nt, Human
ccaggggcccacagggaa

SEQ ID NO: 2171800 - RNA, 19 nt, Human
ccaggggcccacagggaac

SEQ ID NO: 2171801 - RNA, 12 nt, Human
ccaggggccccu

SEQ ID NO: 2171802 - RNA, 14 nt, Human
ccaggggccccucc

SEQ ID NO: 2171803 - RNA, 17 nt, Human
ccaggggccccuccagc

SEQ ID NO: 2171804 - RNA, 22 nt, Human
ccaggggccccuccagcuugug

SEQ ID NO: 2171805 - RNA, 13 nt, Human
ccaggcugccaag

SEQ ID NO: 2171806 - RNA, 22 nt, Human
ccaggcugagccucagucuccc

SEQ ID NO: 2171807 - RNA, 19 nt, Human
ccaggcugagccucagucu

SEQ ID NO: 2171808 - RNA, 17 nt, Human
ccaggcugagccucagu

SEQ ID NO: 2171809 - RNA, 16 nt, Human
ccaggcugagccucag

SEQ ID NO: 2171810 - RNA, 14 nt, Human
ccaggcugagccuc

SEQ ID NO: 2171811 - RNA, 13 nt, Human
ccaggcugagccu

SEQ ID NO: 2171812 - RNA, 23 nt, Human
ccaggcugaccacagcacagcca

SEQ ID NO: 2171813 - RNA, 21 nt, Human
ccaggcugaccacagcacagc

SEQ ID NO: 2171814 - RNA, 20 nt, Human
ccaggggugggacacccugu

SEQ ID NO: 2171815 - RNA, 21 nt, Human
ccaggggugggacacccugug

SEQ ID NO: 2171816 - RNA, 22 nt, Human
ccaggggugggacacccuguga

SEQ ID NO: 2171817 - RNA, 13 nt, Human
ccaguaucuugaa

SEQ ID NO: 2171818 - RNA, 19 nt, Human
ccaguaucuugaagacuuu

SEQ ID NO: 2171819 - RNA, 22 nt, Human
ccaguaucuugaagacuuuucu

SEQ ID NO: 2171820 - RNA, 16 nt, Human
ccagucaccccggcca

SEQ ID NO: 2171821 - RNA, 18 nt, Human
ccaggggccccuccagcu

SEQ ID NO: 2171822 - RNA, 19 nt, Human
ccaggggccccuccagcuu

SEQ ID NO: 2171823 - RNA, 20 nt, Human
ccaggggccccuccagcuug

SEQ ID NO: 2171824 - RNA, 15 nt, Human
ccaguaugagcccua

SEQ ID NO: 2171825 - RNA, 19 nt, Human
ccaggcagggccaacccuu

SEQ ID NO: 2171826 - RNA, 23 nt, Human
ccaggcagggccaacccuucucc

SEQ ID NO: 2171827 - RNA, 14 nt, Human
ccaggcaggcugug

SEQ ID NO: 2171828 - RNA, 20 nt, Human
ccaggcaggcuaaggcgugg

SEQ ID NO: 2171829 - RNA, 18 nt, Human
ccaggcaggcuaaggcgu

SEQ ID NO: 2171830 - RNA, 21 nt, Human
ccaggcagaucugugccccau

SEQ ID NO: 2171831 - RNA, 20 nt, Human
ccaggcagaucugugcccca

SEQ ID NO: 2171832 - RNA, 23 nt, Human
ccaggcagaucugugccccaugc

SEQ ID NO: 2171833 - RNA, 20 nt, Human
ccaggcugaccacagcacag

SEQ ID NO: 2171834 - RNA, 19 nt, Human
ccaggcugaccacagcaca

SEQ ID NO: 2171835 - RNA, 18 nt, Human
ccaggcugaccacagcac

SEQ ID NO: 2171836 - RNA, 17 nt, Human
ccaggcugaccacagca

SEQ ID NO: 2171837 - RNA, 16 nt, Human
ccaggcugaccacagc

SEQ ID NO: 2171838 - RNA, 15 nt, Human
ccaggcugaccacag

SEQ ID NO: 2171839 - RNA, 20 nt, Human
ccaggcugaagcagguuccc

SEQ ID NO: 2171840 - RNA, 13 nt, Human
ccaggcugaagca

SEQ ID NO: 2171841 - RNA, 19 nt, Human
ccaggcagguagccagggg

SEQ ID NO: 2171842 - RNA, 14 nt, Human
ccaggcucugugcu

SEQ ID NO: 2171843 - RNA, 15 nt, Human
ccaggcucugugcug

SEQ ID NO: 2171844 - RNA, 19 nt, Human
ccaggcucugugcugaccc

SEQ ID NO: 2171845 - RNA, 20 nt, Human
ccaggcucugugcugacccu

SEQ ID NO: 2171846 - RNA, 22 nt, Human
ccaggcucugugcugacccucc

SEQ ID NO: 2171847 - RNA, 23 nt, Human
ccaggcucugugcugacccuccu

SEQ ID NO: 2171848 - RNA, 22 nt, Human
ccaggcucuuuggggucagcca

SEQ ID NO: 2171849 - RNA, 13 nt, Human
ccaggcucugugc

SEQ ID NO: 2171850 - RNA, 14 nt, Human
ccaggcagguagcc

SEQ ID NO: 2171851 - RNA, 18 nt, Human
ccaggcagguagccaggg

SEQ ID NO: 2171852 - RNA, 21 nt, Human
ccaggcaggcuaaggcgugga

SEQ ID NO: 2171853 - RNA, 15 nt, Human
ccaggcagggguggg

SEQ ID NO: 2171854 - RNA, 21 nt, Human
ccaggcaggggugggggugga

SEQ ID NO: 2171855 - RNA, 22 nt, Human
ccaggcagggguggggguggag

SEQ ID NO: 2171856 - RNA, 18 nt, Human
ccaggaguuugagaccag

SEQ ID NO: 2171857 - RNA, 17 nt, Human
ccaggaguuugagacca

SEQ ID NO: 2171858 - RNA, 22 nt, Human
ccaggaguuugaggcugcagcg

SEQ ID NO: 2171859 - RNA, 21 nt, Human
ccaggaguuugaggcugcagc

SEQ ID NO: 2171860 - RNA, 20 nt, Human
ccaggaguuugaggcugcag

SEQ ID NO: 2171861 - RNA, 17 nt, Human
ccaggaguuugaggcug

SEQ ID NO: 2171862 - RNA, 13 nt, Human
ccagcggccccuc

SEQ ID NO: 2171863 - RNA, 23 nt, Human
ccagcgggaauggcagcugccac

SEQ ID NO: 2171864 - RNA, 17 nt, Human
ccagcgggaauggcagc

SEQ ID NO: 2171865 - RNA, 13 nt, Human
ccagcggcugagu

SEQ ID NO: 2171866 - RNA, 14 nt, Human
ccagcggccccucc

SEQ ID NO: 2171867 - RNA, 15 nt, Human
ccagcggccccuccc

SEQ ID NO: 2171868 - RNA, 22 nt, Human
ccagcgccuaguggggucuccc

SEQ ID NO: 2171869 - RNA, 16 nt, Human
ccagcgcccgcugggc

SEQ ID NO: 2171870 - RNA, 17 nt, Human
ccagcgcccgcugggcu

SEQ ID NO: 2171871 - RNA, 18 nt, Human
ccagcgcccgcugggcug

SEQ ID NO: 2171872 - RNA, 19 nt, Human
ccagcgcccgcugggcuga

SEQ ID NO: 2171873 - RNA, 22 nt, Human
ccagcgcccgcugggcugagcc

SEQ ID NO: 2171874 - RNA, 13 nt, Human
ccagcguccuccu

SEQ ID NO: 2171875 - RNA, 15 nt, Human
ccagcgucccagucu

SEQ ID NO: 2171876 - RNA, 21 nt, Human
ccagcgucccagucucuggca

SEQ ID NO: 2171877 - RNA, 20 nt, Human
ccagcuugaaaccuucacuu

SEQ ID NO: 2171878 - RNA, 17 nt, Human
ccagcguccuccucugu

SEQ ID NO: 2171879 - RNA, 23 nt, Human
ccagcuugcucuucagugggaga

SEQ ID NO: 2171880 - RNA, 16 nt, Human
ccagcuugcucuucag

SEQ ID NO: 2171881 - RNA, 14 nt, Human
ccagcuugcucuuc

SEQ ID NO: 2171882 - RNA, 22 nt, Human
ccagcgucccagucucuggcag

SEQ ID NO: 2171883 - RNA, 18 nt, Human
ccagcuugggcccagcug

SEQ ID NO: 2171884 - RNA, 19 nt, Human
ccagcuugggcccagcugg

SEQ ID NO: 2171885 - RNA, 21 nt, Human
ccagcuugggcccagcugggc

SEQ ID NO: 2171886 - RNA, 22 nt, Human
ccagcuugggcccagcugggcu

SEQ ID NO: 2171887 - RNA, 24 nt, Human
ccagcuugggcccagcugggcucu

SEQ ID NO: 2171888 - RNA, 23 nt, Human
ccagcuugggcccagcugggcuc

SEQ ID NO: 2171889 - RNA, 17 nt, Human
ccagcuuguuauuuaua

SEQ ID NO: 2171890 - RNA, 15 nt, Human
ccagcuuguuauuua

SEQ ID NO: 2171891 - RNA, 16 nt, Human
ccagcuuguuauuuau

SEQ ID NO: 2171892 - RNA, 20 nt, Human
ccaggaaaggcuccaggagc

SEQ ID NO: 2171893 - RNA, 17 nt, Human
ccaggaaaggcuccagg

SEQ ID NO: 2171894 - RNA, 17 nt, Human
ccagcuuguggagcccc

SEQ ID NO: 2171895 - RNA, 18 nt, Human
ccagcuuguggagcccca

SEQ ID NO: 2171896 - RNA, 19 nt, Human
ccagcuuguggagccccac

SEQ ID NO: 2171897 - RNA, 22 nt, Human
ccagcuuguggagccccacacu

SEQ ID NO: 2171898 - RNA, 23 nt, Human
ccagcuuguggagccccacacug

SEQ ID NO: 2171899 - RNA, 18 nt, Human
ccaggaaaggcuccagga

SEQ ID NO: 2171900 - RNA, 19 nt, Human
ccaggaaaggcuccaggag

SEQ ID NO: 2171901 - RNA, 12 nt, Human
ccagcagccugg

SEQ ID NO: 2171902 - RNA, 11 nt, Human
ccagcagccug

SEQ ID NO: 2171903 - RNA, 12 nt, Human
ccagcagcccua

SEQ ID NO: 2171904 - RNA, 21 nt, Human
ccagcagcccuaaggaucucu

SEQ ID NO: 2171905 - RNA, 22 nt, Human
ccagcagaaaugccuuacccuc

SEQ ID NO: 2171906 - RNA, 17 nt, Human
ccagcagaaaugccuua

SEQ ID NO: 2171907 - RNA, 16 nt, Human
ccagcagaaaugccuu

SEQ ID NO: 2171908 - RNA, 13 nt, Human
ccagcagccugga

SEQ ID NO: 2171909 - RNA, 23 nt, Human
ccagccccauccucuguacagag

SEQ ID NO: 2171910 - RNA, 13 nt, Human
ccagcccccacag

SEQ ID NO: 2171911 - RNA, 16 nt, Human
ccagcccccacagugc

SEQ ID NO: 2171912 - RNA, 18 nt, Human
ccagcccccacagugcug

SEQ ID NO: 2171913 - RNA, 21 nt, Human
ccagcccccacagugcugucu

SEQ ID NO: 2171914 - RNA, 15 nt, Human
ccagcccccuuuggg

SEQ ID NO: 2171915 - RNA, 13 nt, Human
ccagccccuggau

SEQ ID NO: 2171916 - RNA, 20 nt, Human
ccagcccccuuugggcccag

SEQ ID NO: 2171917 - RNA, 21 nt, Human
ccagcccccuuugggcccagg

SEQ ID NO: 2171918 - RNA, 22 nt, Human
ccagcccccuuugggcccaggg

SEQ ID NO: 2171919 - RNA, 23 nt, Human
ccagcccccuuugggcccaggga

SEQ ID NO: 2171920 - RNA, 14 nt, Human
ccagccccuggaug

SEQ ID NO: 2171921 - RNA, 15 nt, Human
ccagccccuggaugc

SEQ ID NO: 2171922 - RNA, 21 nt, Human
ccagcgagcccugguggcagu

SEQ ID NO: 2171923 - RNA, 18 nt, Human
ccagccccuucugaccca

SEQ ID NO: 2171924 - RNA, 16 nt, Human
ccagcgaggaggcucc

SEQ ID NO: 2171925 - RNA, 17 nt, Human
ccagccccggcccuggg

SEQ ID NO: 2171926 - RNA, 18 nt, Human
ccagccccggcccugggc

SEQ ID NO: 2171927 - RNA, 14 nt, Human
ccagcgcccgcugg

SEQ ID NO: 2171928 - RNA, 18 nt, Human
ccagccccuggaugcagc

SEQ ID NO: 2171929 - RNA, 15 nt, Human
ccagccccuucugac

SEQ ID NO: 2171930 - RNA, 16 nt, Human
ccagccccuucugacc

SEQ ID NO: 2171931 - RNA, 17 nt, Human
ccagccccuucugaccc

SEQ ID NO: 2171932 - RNA, 19 nt, Human
ccagaucuggucccuugca

SEQ ID NO: 2171933 - RNA, 19 nt, Human
ccagaugaggcuggccaag

SEQ ID NO: 2171934 - RNA, 13 nt, Human
ccagaugcaccag

SEQ ID NO: 2171935 - RNA, 14 nt, Human
ccagaugcaccagc

SEQ ID NO: 2171936 - RNA, 19 nt, Human
ccagaugaugggggagggg

SEQ ID NO: 2171937 - RNA, 19 nt, Human
ccagauauucaagucaccu

SEQ ID NO: 2171938 - RNA, 20 nt, Human
ccagauaccagccccuguau

SEQ ID NO: 2171939 - RNA, 21 nt, Human
ccagauacuucccauuuugga

SEQ ID NO: 2171940 - RNA, 13 nt, Human
ccagauaccagcc

SEQ ID NO: 2171941 - RNA, 16 nt, Human
ccagauaccagccccu

SEQ ID NO: 2171942 - RNA, 21 nt, Human
ccagauacacccaaaguauca

SEQ ID NO: 2171943 - RNA, 14 nt, Human
ccagauaagaaugc

SEQ ID NO: 2171944 - RNA, 22 nt, Human
ccagauaaaauuauagauggga

SEQ ID NO: 2171945 - RNA, 20 nt, Human
ccagaguuuuuauguagcag

SEQ ID NO: 2171946 - RNA, 19 nt, Human
ccagauaaaauuauagaug

SEQ ID NO: 2171947 - RNA, 13 nt, Human
ccagaucuggucc

SEQ ID NO: 2171948 - RNA, 19 nt, Human
ccagaucggaucuguugca

SEQ ID NO: 2171949 - RNA, 22 nt, Human
ccagaucggaucuguugcaaac

SEQ ID NO: 2171950 - RNA, 18 nt, Human
ccagaucaccagcccggc

SEQ ID NO: 2171951 - RNA, 21 nt, Human
ccagaucaccagcccggccug

SEQ ID NO: 2171952 - RNA, 23 nt, Human
ccagagagagaagugccccugcu

SEQ ID NO: 2171953 - RNA, 18 nt, Human
ccagagagcaacucugag

SEQ ID NO: 2171954 - RNA, 22 nt, Human
ccagagagagaagugccccugc

SEQ ID NO: 2171955 - RNA, 21 nt, Human
ccagagagagaagugccccug

SEQ ID NO: 2171956 - RNA, 20 nt, Human
ccagagagcaacucugagau

SEQ ID NO: 2171957 - RNA, 21 nt, Human
ccagagagcaacucugagauc

SEQ ID NO: 2171958 - RNA, 22 nt, Human
ccagagagccuggugcugcugc

SEQ ID NO: 2171959 - RNA, 21 nt, Human
ccagagagccuggugcugcug

SEQ ID NO: 2171960 - RNA, 16 nt, Human
ccagagaggaaucaga

SEQ ID NO: 2171961 - RNA, 19 nt, Human
ccagagagggacugacacc

SEQ ID NO: 2171962 - RNA, 23 nt, Human
ccagagagggacugacacccaug

SEQ ID NO: 2171963 - RNA, 13 nt, Human
ccagagagggugg

SEQ ID NO: 2171964 - RNA, 23 nt, Human
ccagagggguggguuccucuucc

SEQ ID NO: 2171965 - RNA, 16 nt, Human
ccagagggugggcuuc

SEQ ID NO: 2171966 - RNA, 17 nt, Human
ccagagguaacagaaca

SEQ ID NO: 2171967 - RNA, 18 nt, Human
ccagagguaacagaacag

SEQ ID NO: 2171968 - RNA, 19 nt, Human
ccagagguaacagaacagc

SEQ ID NO: 2171969 - RNA, 21 nt, Human
ccagagguaacagaacagcuu

SEQ ID NO: 2171970 - RNA, 23 nt, Human
ccagagguaacagaacagcuuca

SEQ ID NO: 2171971 - RNA, 19 nt, Human
ccagaggugggcagguggu

SEQ ID NO: 2171972 - RNA, 17 nt, Human
ccagaguuccugcggag

SEQ ID NO: 2171973 - RNA, 11 nt, Human
ccagaguugcu

SEQ ID NO: 2171974 - RNA, 12 nt, Human
ccagaguugcug

SEQ ID NO: 2171975 - RNA, 15 nt, Human
ccagaguugcuggga

SEQ ID NO: 2171976 - RNA, 21 nt, Human
ccagaguugcugggagcugaa

SEQ ID NO: 2171977 - RNA, 22 nt, Human
ccagagguaacagaacagcuuc

SEQ ID NO: 2171978 - RNA, 14 nt, Human
ccagaggugggcag

SEQ ID NO: 2171979 - RNA, 15 nt, Human
ccagaggugggcagg

SEQ ID NO: 2171980 - RNA, 16 nt, Human
ccagaggugggcaggu

SEQ ID NO: 2171981 - RNA, 17 nt, Human
ccagaggugggcaggug

SEQ ID NO: 2171982 - RNA, 18 nt, Human
ccagaggugggcaggugg

SEQ ID NO: 2171983 - RNA, 22 nt, Human
ccagaggugggcaggugguggc

SEQ ID NO: 2171984 - RNA, 14 nt, Human
ccagacucucugug

SEQ ID NO: 2171985 - RNA, 22 nt, Human
ccagacugcuuccaauuuucug

SEQ ID NO: 2171986 - RNA, 12 nt, Human
ccagacugugga

SEQ ID NO: 2171987 - RNA, 13 nt, Human
ccagacuguggag

SEQ ID NO: 2171988 - RNA, 16 nt, Human
ccagacuguggagaaa

SEQ ID NO: 2171989 - RNA, 14 nt, Human
ccagacuuccuuga

SEQ ID NO: 2171990 - RNA, 13 nt, Human
ccagacuuccuug

SEQ ID NO: 2171991 - RNA, 15 nt, Human
ccagacuuccuugag

SEQ ID NO: 2171992 - RNA, 18 nt, Human
ccagacuguggagaaaua

SEQ ID NO: 2171993 - RNA, 13 nt, Human
ccagacuguguau

SEQ ID NO: 2171994 - RNA, 17 nt, Human
ccagacuguguauucau

SEQ ID NO: 2171995 - RNA, 15 nt, Human
ccagacuguuagaaa

SEQ ID NO: 2171996 - RNA, 22 nt, Human
ccagacuuuacaugacacagcu

SEQ ID NO: 2171997 - RNA, 16 nt, Human
ccagagaaaggggagc

SEQ ID NO: 2171998 - RNA, 20 nt, Human
ccagagaaaggggagcccac

SEQ ID NO: 2171999 - RNA, 19 nt, Human
ccagagaaaggggagccca

SEQ ID NO: 2172000 - RNA, 21 nt, Human
ccagacuuuacaugacacagc

SEQ ID NO: 2172001 - RNA, 20 nt, Human
ccagacuuuacaugacacag

SEQ ID NO: 2172002 - RNA, 23 nt, Human
ccagagaagcaucggagggaauu

SEQ ID NO: 2172003 - RNA, 23 nt, Human
ccagagaaaggggagcccacugu

SEQ ID NO: 2172004 - RNA, 12 nt, Human
ccagagaagcua

SEQ ID NO: 2172005 - RNA, 14 nt, Human
ccagagaagccccu

SEQ ID NO: 2172006 - RNA, 18 nt, Human
ccagagaagccccuuccc

SEQ ID NO: 2172007 - RNA, 20 nt, Human
ccagagaagccccuucccca

SEQ ID NO: 2172008 - RNA, 14 nt, Human
ccagagaagugaca

SEQ ID NO: 2172009 - RNA, 15 nt, Human
ccagagaagugacag

SEQ ID NO: 2172010 - RNA, 16 nt, Human
ccagagaagugacagg

SEQ ID NO: 2172011 - RNA, 23 nt, Human
ccagagacaggaaaauccucugg

SEQ ID NO: 2172012 - RNA, 23 nt, Human
ccagagacauacuugaagggcca

SEQ ID NO: 2172013 - RNA, 22 nt, Human
ccagagacauacuugaagggcc

SEQ ID NO: 2172014 - RNA, 20 nt, Human
ccagagacauacuugaaggg

SEQ ID NO: 2172015 - RNA, 18 nt, Human
ccagagaccguccucacc

SEQ ID NO: 2172016 - RNA, 19 nt, Human
ccagagaccguccucaccc

SEQ ID NO: 2172017 - RNA, 21 nt, Human
ccagagaccguccucaccccu

SEQ ID NO: 2172018 - RNA, 19 nt, Human
ccagagacggaagccuuuu

SEQ ID NO: 2172019 - RNA, 15 nt, Human
ccagagacucagagg

SEQ ID NO: 2172020 - RNA, 20 nt, Human
ccagagagagaagugccccu

SEQ ID NO: 2172021 - RNA, 19 nt, Human
ccagagagagaagugcccc

SEQ ID NO: 2172022 - RNA, 18 nt, Human
ccagagagagaagugccc

SEQ ID NO: 2172023 - RNA, 14 nt, Human
ccagagagagaagu

SEQ ID NO: 2172024 - RNA, 12 nt, Human
ccagagacagga

SEQ ID NO: 2172025 - RNA, 22 nt, Human
ccagagaagugacagggaagcu

SEQ ID NO: 2172026 - RNA, 16 nt, Human
ccagagaauucuuaga

SEQ ID NO: 2172027 - RNA, 17 nt, Human
ccagagaagugacaggg

SEQ ID NO: 2172028 - RNA, 18 nt, Human
ccagagaagugacaggga

SEQ ID NO: 2172029 - RNA, 19 nt, Human
ccagagaagugacagggaa

SEQ ID NO: 2172030 - RNA, 20 nt, Human
ccagagaagugacagggaag

SEQ ID NO: 2172031 - RNA, 15 nt, Human
ccagagacaggaaaa

SEQ ID NO: 2172032 - RNA, 14 nt, Human
ccagagacaggaaa

SEQ ID NO: 2172033 - RNA, 13 nt, Human
ccagagacaggaa

SEQ ID NO: 2172034 - RNA, 18 nt, Human
ccagagacauacuugaag

SEQ ID NO: 2172035 - RNA, 17 nt, Human
ccagagacauacuugaa

SEQ ID NO: 2172036 - RNA, 16 nt, Human
ccagagacacaagccu

SEQ ID NO: 2172037 - RNA, 18 nt, Human
ccagagacacaagccuuc

SEQ ID NO: 2172038 - RNA, 15 nt, Human
ccagacggcacccac

SEQ ID NO: 2172039 - RNA, 19 nt, Human
ccagacgguucaccagccu

SEQ ID NO: 2172040 - RNA, 18 nt, Human
ccagacgguucaccagcc

SEQ ID NO: 2172041 - RNA, 17 nt, Human
ccagacgguucaccagc

SEQ ID NO: 2172042 - RNA, 16 nt, Human
ccagacggcacccacc

SEQ ID NO: 2172043 - RNA, 16 nt, Human
ccagacgguucaccag

SEQ ID NO: 2172044 - RNA, 20 nt, Human
ccagacgguucaccagccuc

SEQ ID NO: 2172045 - RNA, 17 nt, Human
ccagacguaggggaggg

SEQ ID NO: 2172046 - RNA, 18 nt, Human
ccagacuccaccaagccu

SEQ ID NO: 2172047 - RNA, 14 nt, Human
ccagacuccaccaa

SEQ ID NO: 2172048 - RNA, 24 nt, Human
ccagaccugauccuggaggcccag

SEQ ID NO: 2172049 - RNA, 14 nt, Human
ccagaccugccucu

SEQ ID NO: 2172050 - RNA, 23 nt, Human
ccagaccuguuagcagacaggcc

SEQ ID NO: 2172051 - RNA, 21 nt, Human
ccagaccuguuagcagacagg

SEQ ID NO: 2172052 - RNA, 20 nt, Human
ccagaccuguuagcagacag

SEQ ID NO: 2172053 - RNA, 21 nt, Human
ccagaccugccucuucccccu

SEQ ID NO: 2172054 - RNA, 18 nt, Human
ccagacgcacgugggucu

SEQ ID NO: 2172055 - RNA, 23 nt, Human
ccagacgcacgugggucuucagg

SEQ ID NO: 2172056 - RNA, 18 nt, Human
ccagaccuuugaggauau

SEQ ID NO: 2172057 - RNA, 14 nt, Human
ccagaccuuuuauc

SEQ ID NO: 2172058 - RNA, 15 nt, Human
ccagaccuucuagga

SEQ ID NO: 2172059 - RNA, 19 nt, Human
ccagaccuuguucacacuc

SEQ ID NO: 2172060 - RNA, 20 nt, Human
ccagacgaugucuucauacc

SEQ ID NO: 2172061 - RNA, 13 nt, Human
ccagacgaugucu

SEQ ID NO: 2172062 - RNA, 17 nt, Human
ccagacccggcugcgug

SEQ ID NO: 2172063 - RNA, 16 nt, Human
ccagacccggcugcgu

SEQ ID NO: 2172064 - RNA, 15 nt, Human
ccagaccugagcucc

SEQ ID NO: 2172065 - RNA, 13 nt, Human
ccagaccugagcu

SEQ ID NO: 2172066 - RNA, 23 nt, Human
ccagaccugauccuggaggccca

SEQ ID NO: 2172067 - RNA, 21 nt, Human
ccagaccugauccuggaggcc

SEQ ID NO: 2172068 - RNA, 20 nt, Human
ccagaccugauccuggaggc

SEQ ID NO: 2172069 - RNA, 19 nt, Human
ccagaccugauccuggagg

SEQ ID NO: 2172070 - RNA, 18 nt, Human
ccagaccugauccuggag

SEQ ID NO: 2172071 - RNA, 17 nt, Human
ccagaccugauccugga

SEQ ID NO: 2172072 - RNA, 16 nt, Human
ccagaccugauccugg

SEQ ID NO: 2172073 - RNA, 15 nt, Human
ccagaccugauccug

SEQ ID NO: 2172074 - RNA, 22 nt, Human
ccacuuuuguucuugguuugua

SEQ ID NO: 2172075 - RNA, 21 nt, Human
ccacuuuuguucuugguuugu

SEQ ID NO: 2172076 - RNA, 15 nt, Human
ccacuuuuguucuug

SEQ ID NO: 2172077 - RNA, 14 nt, Human
ccacuuuuguucuu

SEQ ID NO: 2172078 - RNA, 21 nt, Human
ccacuuugguacauggccagu

SEQ ID NO: 2172079 - RNA, 18 nt, Human
ccacuuuggucccgugca

SEQ ID NO: 2172080 - RNA, 21 nt, Human
ccacuuuggucccgugcagcu

SEQ ID NO: 2172081 - RNA, 17 nt, Human
ccacuuuggccuccguu

SEQ ID NO: 2172082 - RNA, 15 nt, Human
ccacuuuguucuuua

SEQ ID NO: 2172083 - RNA, 20 nt, Human
ccacuuuguucuuuaggaga

SEQ ID NO: 2172084 - RNA, 14 nt, Human
ccacuuuguuggaa

SEQ ID NO: 2172085 - RNA, 16 nt, Human
ccacuuuuauucauuu

SEQ ID NO: 2172086 - RNA, 22 nt, Human
ccacuuuguuucguggggaggu

SEQ ID NO: 2172087 - RNA, 20 nt, Human
ccacuuugcacagcucuccg

SEQ ID NO: 2172088 - RNA, 20 nt, Human
ccacuuucuagccagaggag

SEQ ID NO: 2172089 - RNA, 18 nt, Human
ccacuuucuagccagagg

SEQ ID NO: 2172090 - RNA, 19 nt, Human
ccacuuucuagccagagga

SEQ ID NO: 2172091 - RNA, 13 nt, Human
ccacuuucuagcc

SEQ ID NO: 2172092 - RNA, 19 nt, Human
ccacuuggucugugagaug

SEQ ID NO: 2172093 - RNA, 17 nt, Human
ccacuuggucugugaga

SEQ ID NO: 2172094 - RNA, 16 nt, Human
ccacuuggucugugag

SEQ ID NO: 2172095 - RNA, 15 nt, Human
ccacuuggucuguga

SEQ ID NO: 2172096 - RNA, 19 nt, Human
ccacuugucccacuaucug

SEQ ID NO: 2172097 - RNA, 17 nt, Human
ccacuugggucuucccu

SEQ ID NO: 2172098 - RNA, 15 nt, Human
ccacuuguccgcugg

SEQ ID NO: 2172099 - RNA, 21 nt, Human
ccacuuguccgcuggguggua

SEQ ID NO: 2172100 - RNA, 20 nt, Human
ccacuugucccacuaucugg

SEQ ID NO: 2172101 - RNA, 22 nt, Human
ccacuuggucugugagaugcua

SEQ ID NO: 2172102 - RNA, 20 nt, Human
ccacuuggucugugagaugc

SEQ ID NO: 2172103 - RNA, 16 nt, Human
ccacuucuuuuauaac

SEQ ID NO: 2172104 - RNA, 20 nt, Human
ccacuucuuguuccccacug

SEQ ID NO: 2172105 - RNA, 19 nt, Human
ccacuucuuguuccccacu

SEQ ID NO: 2172106 - RNA, 15 nt, Human
ccacuucuggguggg

SEQ ID NO: 2172107 - RNA, 17 nt, Human
ccacuucccugacacug

SEQ ID NO: 2172108 - RNA, 12 nt, Human
ccacuucccuca

SEQ ID NO: 2172109 - RNA, 15 nt, Human
ccacuucccugacac

SEQ ID NO: 2172110 - RNA, 23 nt, Human
ccacuucccagguaagcaggagg

SEQ ID NO: 2172111 - RNA, 13 nt, Human
ccacuuccccucc

SEQ ID NO: 2172112 - RNA, 14 nt, Human
ccacuuccccuccu

SEQ ID NO: 2172113 - RNA, 19 nt, Human
ccacuuccccuccuacccc

SEQ ID NO: 2172114 - RNA, 14 nt, Human
ccacuucccugggc

SEQ ID NO: 2172115 - RNA, 12 nt, Human
ccacuugccucu

SEQ ID NO: 2172116 - RNA, 13 nt, Human
ccacuugccucuu

SEQ ID NO: 2172117 - RNA, 16 nt, Human
ccacuugccucuuccu

SEQ ID NO: 2172118 - RNA, 17 nt, Human
ccacuugccucuuccuu

SEQ ID NO: 2172119 - RNA, 19 nt, Human
ccacuugccucuuccuuga

SEQ ID NO: 2172120 - RNA, 22 nt, Human
ccacuugccucuuccuugaaga

SEQ ID NO: 2172121 - RNA, 21 nt, Human
ccacuuggaggccuuucaucc

SEQ ID NO: 2172122 - RNA, 12 nt, Human
ccacuuggccaa

SEQ ID NO: 2172123 - RNA, 16 nt, Human
ccacuugggucuuccc

SEQ ID NO: 2172124 - RNA, 21 nt, Human
ccacuuggcuacacagggaug

SEQ ID NO: 2172125 - RNA, 18 nt, Human
ccacuuggcaucagcugg

SEQ ID NO: 2172126 - RNA, 17 nt, Human
ccacuuggccaagcagg

SEQ ID NO: 2172127 - RNA, 12 nt, Human
ccacuuggucug

SEQ ID NO: 2172128 - RNA, 17 nt, Human
ccacugcacuccagccu

SEQ ID NO: 2172129 - RNA, 14 nt, Human
ccacugcacuccag

SEQ ID NO: 2172130 - RNA, 21 nt, Human
ccacuucauucuugaaagcug

SEQ ID NO: 2172131 - RNA, 23 nt, Human
ccacuucauucuugaaagcugug

SEQ ID NO: 2172132 - RNA, 14 nt, Human
ccacuucccaggua

SEQ ID NO: 2172133 - RNA, 19 nt, Human
ccacugcacuauagccuag

SEQ ID NO: 2172134 - RNA, 20 nt, Human
ccacugcacuauagccuagg

SEQ ID NO: 2172135 - RNA, 13 nt, Human
ccacugcaccggg

SEQ ID NO: 2172136 - RNA, 14 nt, Human
ccacugcaccgggc

SEQ ID NO: 2172137 - RNA, 17 nt, Human
ccacugcaccgggccac

SEQ ID NO: 2172138 - RNA, 19 nt, Human
ccacugcaccgggccacag

SEQ ID NO: 2172139 - RNA, 12 nt, Human
ccacugagcucc

SEQ ID NO: 2172140 - RNA, 13 nt, Human
ccacugcacacac

SEQ ID NO: 2172141 - RNA, 13 nt, Human
ccacugagggcag

SEQ ID NO: 2172142 - RNA, 22 nt, Human
ccacugauagaugucuauucuu

SEQ ID NO: 2172143 - RNA, 11 nt, Human
ccacugagcuc

SEQ ID NO: 2172144 - RNA, 13 nt, Human
ccacugaccagaa

SEQ ID NO: 2172145 - RNA, 18 nt, Human
ccacugcacacaccucag

SEQ ID NO: 2172146 - RNA, 14 nt, Human
ccacugcacagagc

SEQ ID NO: 2172147 - RNA, 16 nt, Human
ccacugcacagagcuc

SEQ ID NO: 2172148 - RNA, 20 nt, Human
ccacugcacagagcucucca

SEQ ID NO: 2172149 - RNA, 23 nt, Human
ccacugcacagagcucuccagcu

SEQ ID NO: 2172150 - RNA, 11 nt, Human
ccacugcaccc

SEQ ID NO: 2172151 - RNA, 13 nt, Human
ccacugcaccccc

SEQ ID NO: 2172152 - RNA, 14 nt, Human
ccacugcacccccu

SEQ ID NO: 2172153 - RNA, 17 nt, Human
ccacugcacccccuccu

SEQ ID NO: 2172154 - RNA, 18 nt, Human
ccacugcacccccuccug

SEQ ID NO: 2172155 - RNA, 19 nt, Human
ccacugcacccccuccugc

SEQ ID NO: 2172156 - RNA, 20 nt, Human
ccacugcacccccuccugcu

SEQ ID NO: 2172157 - RNA, 21 nt, Human
ccacugcacccccuccugcug

SEQ ID NO: 2172158 - RNA, 22 nt, Human
ccacugcacccccuccugcugc

SEQ ID NO: 2172159 - RNA, 23 nt, Human
ccacugcacccccuccugcugca

SEQ ID NO: 2172160 - RNA, 18 nt, Human
ccacugcaccccgucuca

SEQ ID NO: 2172161 - RNA, 19 nt, Human
ccacugacagccucccacc

SEQ ID NO: 2172162 - RNA, 17 nt, Human
ccacugacagccuccca

SEQ ID NO: 2172163 - RNA, 16 nt, Human
ccacugacagccuccc

SEQ ID NO: 2172164 - RNA, 15 nt, Human
ccacugacagccucc

SEQ ID NO: 2172165 - RNA, 21 nt, Human
ccacugaaguagugugcaguu

SEQ ID NO: 2172166 - RNA, 16 nt, Human
ccacugaagcugggau

SEQ ID NO: 2172167 - RNA, 15 nt, Human
ccacugaagcuggga

SEQ ID NO: 2172168 - RNA, 14 nt, Human
ccacugaagcuggg

SEQ ID NO: 2172169 - RNA, 22 nt, Human
ccacucugugccugaccuugag

SEQ ID NO: 2172170 - RNA, 11 nt, Human
ccacucugugc

SEQ ID NO: 2172171 - RNA, 21 nt, Human
cccucgcuuggacggcugggc

SEQ ID NO: 2172172 - RNA, 23 nt, Human
cccucgcuuggacggcugggcac

SEQ ID NO: 2172173 - RNA, 13 nt, Human
cccucggagaaga

SEQ ID NO: 2172174 - RNA, 22 nt, Human
cccucgaagcgcgccacucgcu

SEQ ID NO: 2172175 - RNA, 17 nt, Human
cccuccucucccauccc

SEQ ID NO: 2172176 - RNA, 13 nt, Human
cccucgcccccgc

SEQ ID NO: 2172177 - RNA, 14 nt, Human
cccucgcugccagc

SEQ ID NO: 2172178 - RNA, 14 nt, Human
cccucgcugcuucu

SEQ ID NO: 2172179 - RNA, 15 nt, Human
cccucgcugcuucug

SEQ ID NO: 2172180 - RNA, 18 nt, Human
cccugaaagcccugagcu

SEQ ID NO: 2172181 - RNA, 19 nt, Human
cccucgggucuccucacuc

SEQ ID NO: 2172182 - RNA, 21 nt, Human
cccucgggucuccucacuccc

SEQ ID NO: 2172183 - RNA, 18 nt, Human
cccucgggucuccucacu

SEQ ID NO: 2172184 - RNA, 17 nt, Human
cccucgggcgagucacu

SEQ ID NO: 2172185 - RNA, 22 nt, Human
cccucgggcccagcccccacag

SEQ ID NO: 2172186 - RNA, 15 nt, Human
cccucgggcccagcc

SEQ ID NO: 2172187 - RNA, 19 nt, Human
cccucgggcccagccccca

SEQ ID NO: 2172188 - RNA, 20 nt, Human
cccucgggcccaccuggcca

SEQ ID NO: 2172189 - RNA, 21 nt, Human
cccucgggcccaccuggccac

SEQ ID NO: 2172190 - RNA, 13 nt, Human
cccucgggcccag

SEQ ID NO: 2172191 - RNA, 14 nt, Human
cccucgggcccagc

SEQ ID NO: 2172192 - RNA, 14 nt, Human
cccucgggcccacc

SEQ ID NO: 2172193 - RNA, 17 nt, Human
cccucgcugcuucugug

SEQ ID NO: 2172194 - RNA, 15 nt, Human
cccucgggcccaccu

SEQ ID NO: 2172195 - RNA, 16 nt, Human
cccucgggcccaccug

SEQ ID NO: 2172196 - RNA, 18 nt, Human
cccucgggcccaccuggc

SEQ ID NO: 2172197 - RNA, 19 nt, Human
cccucgggcccaccuggcc

SEQ ID NO: 2172198 - RNA, 17 nt, Human
cccuccuacccugcgcc

SEQ ID NO: 2172199 - RNA, 18 nt, Human
cccuccuacccugcgccc

SEQ ID NO: 2172200 - RNA, 11 nt, Human
cccuccuccug

SEQ ID NO: 2172201 - RNA, 18 nt, Human
cccuccuccuggacuccu

SEQ ID NO: 2172202 - RNA, 16 nt, Human
cccuccuccuggacuc

SEQ ID NO: 2172203 - RNA, 23 nt, Human
cccuccguggcaucaccuuaggc

SEQ ID NO: 2172204 - RNA, 18 nt, Human
cccuccguggcaucaccu

SEQ ID NO: 2172205 - RNA, 15 nt, Human
cccuccuaccccucc

SEQ ID NO: 2172206 - RNA, 18 nt, Human
cccuccuaccccucccag

SEQ ID NO: 2172207 - RNA, 20 nt, Human
cccuccuaccccucccagcu

SEQ ID NO: 2172208 - RNA, 21 nt, Human
cccuccuaccccucccagcug

SEQ ID NO: 2172209 - RNA, 22 nt, Human
cccuccuaccccucccagcuga

SEQ ID NO: 2172210 - RNA, 21 nt, Human
cccuccgccuucacuccggug

SEQ ID NO: 2172211 - RNA, 13 nt, Human
cccuccgccuuca

SEQ ID NO: 2172212 - RNA, 22 nt, Human
cccuccgccuucacuccggugu

SEQ ID NO: 2172213 - RNA, 21 nt, Human
cccucgaagcgcgccacucgc

SEQ ID NO: 2172214 - RNA, 19 nt, Human
cccucgaagcgcgccacuc

SEQ ID NO: 2172215 - RNA, 15 nt, Human
cccucgaagcgcgcc

SEQ ID NO: 2172216 - RNA, 15 nt, Human
cccuccuuuuuaugu

SEQ ID NO: 2172217 - RNA, 23 nt, Human
cccucgaggcggaucuuuggaca

SEQ ID NO: 2172218 - RNA, 22 nt, Human
cccucgaggcggaucuuuggac

SEQ ID NO: 2172219 - RNA, 20 nt, Human
cccuccuaucaccuccccuc

SEQ ID NO: 2172220 - RNA, 18 nt, Human
cccuccucuagcuguggg

SEQ ID NO: 2172221 - RNA, 13 nt, Human
cccuccucuccca

SEQ ID NO: 2172222 - RNA, 19 nt, Human
cccuccucuagcugugggg

SEQ ID NO: 2172223 - RNA, 14 nt, Human
cccuccucucugcc

SEQ ID NO: 2172224 - RNA, 14 nt, Human
cccuccucucccau

SEQ ID NO: 2172225 - RNA, 23 nt, Human
cccuccucccuuuuuccuugucc

SEQ ID NO: 2172226 - RNA, 15 nt, Human
cccuccucucccauc

SEQ ID NO: 2172227 - RNA, 16 nt, Human
cccuccucucccaucc

SEQ ID NO: 2172228 - RNA, 18 nt, Human
cccugaaccaucccugau

SEQ ID NO: 2172229 - RNA, 11 nt, Human
cccugaagcca

SEQ ID NO: 2172230 - RNA, 14 nt, Human
cccugaagccagcc

SEQ ID NO: 2172231 - RNA, 15 nt, Human
cccugaagccagccu

SEQ ID NO: 2172232 - RNA, 13 nt, Human
cccugaaccaucc

SEQ ID NO: 2172233 - RNA, 14 nt, Human
cccugaacaagaau

SEQ ID NO: 2172234 - RNA, 14 nt, Human
cccugaaggaacca

SEQ ID NO: 2172235 - RNA, 18 nt, Human
cccugaagccagccuucu

SEQ ID NO: 2172236 - RNA, 16 nt, Human
cccugaagccagccuu

SEQ ID NO: 2172237 - RNA, 17 nt, Human
cccugaagccagccuuc

SEQ ID NO: 2172238 - RNA, 12 nt, Human
cccugaaggccc

SEQ ID NO: 2172239 - RNA, 13 nt, Human
cccugaaggcccc

SEQ ID NO: 2172240 - RNA, 14 nt, Human
cccugaaggccccg

SEQ ID NO: 2172241 - RNA, 16 nt, Human
cccugaaggccccgcc

SEQ ID NO: 2172242 - RNA, 19 nt, Human
cccugaaggccccgcccag

SEQ ID NO: 2172243 - RNA, 14 nt, Human
cccugacaacacuc

SEQ ID NO: 2172244 - RNA, 17 nt, Human
cccugaaggggccauga

SEQ ID NO: 2172245 - RNA, 23 nt, Human
cccugaaggaacauuccuuaguc

SEQ ID NO: 2172246 - RNA, 20 nt, Human
cccugaagugagcacagccu

SEQ ID NO: 2172247 - RNA, 15 nt, Human
cccugaaucccccuu

SEQ ID NO: 2172248 - RNA, 20 nt, Human
cccugaaucccccuugccac

SEQ ID NO: 2172249 - RNA, 20 nt, Human
cccugaaggccccgcccagg

SEQ ID NO: 2172250 - RNA, 22 nt, Human
cccugaaggccccgcccaggcu

SEQ ID NO: 2172251 - RNA, 16 nt, Human
cccugacaacacucau

SEQ ID NO: 2172252 - RNA, 22 nt, Human
cccugacaacacucauugaccu

SEQ ID NO: 2172253 - RNA, 21 nt, Human
cccugaaucccccuugccacc

SEQ ID NO: 2172254 - RNA, 23 nt, Human
cccugaaucccccuugccacccc

SEQ ID NO: 2172255 - RNA, 20 nt, Human
cccugaaugguuccaugccu

SEQ ID NO: 2172256 - RNA, 20 nt, Human
cccugacacugcggggcuug

SEQ ID NO: 2172257 - RNA, 14 nt, Human
cccuccgcccugcc

SEQ ID NO: 2172258 - RNA, 15 nt, Human
cccuccgcccugcca

SEQ ID NO: 2172259 - RNA, 16 nt, Human
cccuccgcccugccac

SEQ ID NO: 2172260 - RNA, 19 nt, Human
cccuccgcccugccacuca

SEQ ID NO: 2172261 - RNA, 18 nt, Human
ccccggcccuaccagcgc

SEQ ID NO: 2172262 - RNA, 16 nt, Human
ccccggccccagccag

SEQ ID NO: 2172263 - RNA, 17 nt, Human
ccccggccccagccaga

SEQ ID NO: 2172264 - RNA, 18 nt, Human
ccccggccccagccagag

SEQ ID NO: 2172265 - RNA, 19 nt, Human
ccccggccccagccagagu

SEQ ID NO: 2172266 - RNA, 12 nt, Human
ccccggcccccu

SEQ ID NO: 2172267 - RNA, 13 nt, Human
ccccggcccccug

SEQ ID NO: 2172268 - RNA, 18 nt, Human
ccccggccccggccccag

SEQ ID NO: 2172269 - RNA, 13 nt, Human
ccccggcccuacc

SEQ ID NO: 2172270 - RNA, 16 nt, Human
cccugacccuguauau

SEQ ID NO: 2172271 - RNA, 15 nt, Human
cccugacccugugga

SEQ ID NO: 2172272 - RNA, 19 nt, Human
cccugacccuguggaagca

SEQ ID NO: 2172273 - RNA, 12 nt, Human
cccugacccugu

SEQ ID NO: 2172274 - RNA, 17 nt, Human
cccugaccucccucuaa

SEQ ID NO: 2172275 - RNA, 21 nt, Human
cccugaccucccagcccuaug

SEQ ID NO: 2172276 - RNA, 22 nt, Human
cccugaccucccagcccuaugg

SEQ ID NO: 2172277 - RNA, 16 nt, Human
cccugaccugugagcc

SEQ ID NO: 2172278 - RNA, 11 nt, Human
cccugaccucc

SEQ ID NO: 2172279 - RNA, 14 nt, Human
cccugaccucccag

SEQ ID NO: 2172280 - RNA, 15 nt, Human
cccugaccucccagc

SEQ ID NO: 2172281 - RNA, 16 nt, Human
cccugaccucccagcc

SEQ ID NO: 2172282 - RNA, 17 nt, Human
cccugaccucccagccc

SEQ ID NO: 2172283 - RNA, 18 nt, Human
cccugaccucccagcccu

SEQ ID NO: 2172284 - RNA, 19 nt, Human
cccugaccucccagcccua

SEQ ID NO: 2172285 - RNA, 20 nt, Human
cccugaccucccagcccuau

SEQ ID NO: 2172286 - RNA, 17 nt, Human
cccugacucucugugac

SEQ ID NO: 2172287 - RNA, 13 nt, Human
cccugacucucug

SEQ ID NO: 2172288 - RNA, 18 nt, Human
cccugacucucugugacc

SEQ ID NO: 2172289 - RNA, 13 nt, Human
cccugacugggag

SEQ ID NO: 2172290 - RNA, 20 nt, Human
cccugaccugugagcccagc

SEQ ID NO: 2172291 - RNA, 15 nt, Human
cccugacucauucug

SEQ ID NO: 2172292 - RNA, 21 nt, Human
cccugacucauucugaaggag

SEQ ID NO: 2172293 - RNA, 19 nt, Human
cccugacucauucugaagg

SEQ ID NO: 2172294 - RNA, 20 nt, Human
cccugagacaaauggaggcc

SEQ ID NO: 2172295 - RNA, 23 nt, Human
cccugagacaaauggaggccugu

SEQ ID NO: 2172296 - RNA, 18 nt, Human
cccugagaucucugcagg

SEQ ID NO: 2172297 - RNA, 16 nt, Human
cccugagacaaaugga

SEQ ID NO: 2172298 - RNA, 17 nt, Human
cccugagacaaauggag

SEQ ID NO: 2172299 - RNA, 14 nt, Human
cccugacuggugcu

SEQ ID NO: 2172300 - RNA, 22 nt, Human
cccugagcucgguggacccagg

SEQ ID NO: 2172301 - RNA, 14 nt, Human
cccugagcugaggc

SEQ ID NO: 2172302 - RNA, 13 nt, Human
cccugagcugagg

SEQ ID NO: 2172303 - RNA, 21 nt, Human
cccugagcugaggcagcagug

SEQ ID NO: 2172304 - RNA, 19 nt, Human
cccugagcugaggcagcag

SEQ ID NO: 2172305 - RNA, 17 nt, Human
cccugagcugaggcagc

SEQ ID NO: 2172306 - RNA, 16 nt, Human
cccugagcugaggcag

SEQ ID NO: 2172307 - RNA, 16 nt, Human
cccugagcuuucugcu

SEQ ID NO: 2172308 - RNA, 20 nt, Human
cccugcccaccuggccucug

SEQ ID NO: 2172309 - RNA, 16 nt, Human
cccugagcaaugucug

SEQ ID NO: 2172310 - RNA, 18 nt, Human
cccugagcaaugucugug

SEQ ID NO: 2172311 - RNA, 20 nt, Human
cccugagcaaugucugugcu

SEQ ID NO: 2172312 - RNA, 21 nt, Human
cccugagcaaugucugugcua

SEQ ID NO: 2172313 - RNA, 14 nt, Human
cccugagcaggauu

SEQ ID NO: 2172314 - RNA, 12 nt, Human
cccugagcucgg

SEQ ID NO: 2172315 - RNA, 21 nt, Human
cccugagccccuuccuugcuc

SEQ ID NO: 2172316 - RNA, 15 nt, Human
cccugagccccuucc

SEQ ID NO: 2172317 - RNA, 17 nt, Human
cccugagccccuuccuu

SEQ ID NO: 2172318 - RNA, 12 nt, Human
cccugagccccu

SEQ ID NO: 2172319 - RNA, 14 nt, Human
cccugcccuccccu

SEQ ID NO: 2172320 - RNA, 13 nt, Human
cccugcccucauc

SEQ ID NO: 2172321 - RNA, 18 nt, Human
cccugcccucaucucucu

SEQ ID NO: 2172322 - RNA, 17 nt, Human
cccugcccuagcuccac

SEQ ID NO: 2172323 - RNA, 10 nt, Human
cccugcccuc

SEQ ID NO: 2172324 - RNA, 16 nt, Human
cccugcccuagcucca

SEQ ID NO: 2172325 - RNA, 14 nt, Human
cccugcccuagcuc

SEQ ID NO: 2172326 - RNA, 19 nt, Human
cccugccccugccccguca

SEQ ID NO: 2172327 - RNA, 18 nt, Human
cccugccccugccccguc

SEQ ID NO: 2172328 - RNA, 17 nt, Human
cccugccccugccccgu

SEQ ID NO: 2172329 - RNA, 13 nt, Human
cccugccccugcc

SEQ ID NO: 2172330 - RNA, 14 nt, Human
cccugcccggcugc

SEQ ID NO: 2172331 - RNA, 17 nt, Human
cccugcccggcugcgga

SEQ ID NO: 2172332 - RNA, 18 nt, Human
cccugccccucccuucaa

SEQ ID NO: 2172333 - RNA, 19 nt, Human
cccugccccucccuucaac

SEQ ID NO: 2172334 - RNA, 12 nt, Human
cccugccccugc

SEQ ID NO: 2172335 - RNA, 21 nt, Human
cccugccccgucaccaucuca

SEQ ID NO: 2172336 - RNA, 23 nt, Human
cccugccccucccuucaaccauu

SEQ ID NO: 2172337 - RNA, 15 nt, Human
cccugccccgucacc

SEQ ID NO: 2172338 - RNA, 17 nt, Human
cccugccccucccuuca

SEQ ID NO: 2172339 - RNA, 16 nt, Human
cccugccccccagccu

SEQ ID NO: 2172340 - RNA, 19 nt, Human
cccugccccccagccucug

SEQ ID NO: 2172341 - RNA, 21 nt, Human
cccugccccccagccucuggc

SEQ ID NO: 2172342 - RNA, 16 nt, Human
cccugccccagcaaga

SEQ ID NO: 2172343 - RNA, 13 nt, Human
cccugccccagcc

SEQ ID NO: 2172344 - RNA, 15 nt, Human
cccugccccagccca

SEQ ID NO: 2172345 - RNA, 12 nt, Human
cccugcccaugu

SEQ ID NO: 2172346 - RNA, 17 nt, Human
cccugccccagcccaag

SEQ ID NO: 2172347 - RNA, 19 nt, Human
cccugccccagcccaaguc

SEQ ID NO: 2172348 - RNA, 20 nt, Human
cccugccccagcccaagucc

SEQ ID NO: 2172349 - RNA, 20 nt, Human
cccugcccccaaauaagaag

SEQ ID NO: 2172350 - RNA, 14 nt, Human
cccugcccccacca

SEQ ID NO: 2172351 - RNA, 16 nt, Human
cccugcccccacuucc

SEQ ID NO: 2172352 - RNA, 17 nt, Human
cccugcccccacuuccu

SEQ ID NO: 2172353 - RNA, 18 nt, Human
cccugcccccacuuccug

SEQ ID NO: 2172354 - RNA, 14 nt, Human
cccugaggagccag

SEQ ID NO: 2172355 - RNA, 14 nt, Human
cccugagcugaggg

SEQ ID NO: 2172356 - RNA, 22 nt, Human
cccugcccaccuggccucugca

SEQ ID NO: 2172357 - RNA, 15 nt, Human
cccugccccccagcc

SEQ ID NO: 2172358 - RNA, 20 nt, Human
cccugccccccagcccuccu

SEQ ID NO: 2172359 - RNA, 14 nt, Human
cccugccccccagc

SEQ ID NO: 2172360 - RNA, 23 nt, Human
cccugcccccaggacugggccac

SEQ ID NO: 2172361 - RNA, 12 nt, Human
cccugcccccca

SEQ ID NO: 2172362 - RNA, 13 nt, Human
cccugcccccagg

SEQ ID NO: 2172363 - RNA, 20 nt, Human
cccugcccccacuuccuguu

SEQ ID NO: 2172364 - RNA, 18 nt, Human
cccugcccccagccccgg

SEQ ID NO: 2172365 - RNA, 14 nt, Human
cccugcccccagga

SEQ ID NO: 2172366 - RNA, 16 nt, Human
cccugcccccaggacu

SEQ ID NO: 2172367 - RNA, 17 nt, Human
cccugcccccaggacug

SEQ ID NO: 2172368 - RNA, 18 nt, Human
cccugcccccaggacugg

SEQ ID NO: 2172369 - RNA, 20 nt, Human
cccugcccccaggacugggc

SEQ ID NO: 2172370 - RNA, 22 nt, Human
cccugcccccaggacugggcca

SEQ ID NO: 2172371 - RNA, 15 nt, Human
cccugcccuccccuc

SEQ ID NO: 2172372 - RNA, 13 nt, Human
cccugcccucgug

SEQ ID NO: 2172373 - RNA, 14 nt, Human
cccugcccucgugg

SEQ ID NO: 2172374 - RNA, 16 nt, Human
cccugcccucguggcc

SEQ ID NO: 2172375 - RNA, 17 nt, Human
cccugcccucguggcca

SEQ ID NO: 2172376 - RNA, 18 nt, Human
cccugcccucguggccag

SEQ ID NO: 2172377 - RNA, 19 nt, Human
cccugcccucguggccagc

SEQ ID NO: 2172378 - RNA, 11 nt, Human
cccugcccugc

SEQ ID NO: 2172379 - RNA, 12 nt, Human
cccugcccugca

SEQ ID NO: 2172380 - RNA, 13 nt, Human
cccugcccugcac

SEQ ID NO: 2172381 - RNA, 20 nt, Human
cccugcccucguggccagcc

SEQ ID NO: 2172382 - RNA, 21 nt, Human
cccugcccucguggccagccc

SEQ ID NO: 2172383 - RNA, 22 nt, Human
cccugcccucguggccagcccg

SEQ ID NO: 2172384 - RNA, 13 nt, Human
cccugcccugcug

SEQ ID NO: 2172385 - RNA, 12 nt, Human
cccugcccuggu

SEQ ID NO: 2172386 - RNA, 11 nt, Human
cccugcccugg

SEQ ID NO: 2172387 - RNA, 13 nt, Human
cccugcccuggga

SEQ ID NO: 2172388 - RNA, 14 nt, Human
cccuggaggugcca

SEQ ID NO: 2172389 - RNA, 15 nt, Human
cccuggaggugccag

SEQ ID NO: 2172390 - RNA, 16 nt, Human
cccuggaggugccagc

SEQ ID NO: 2172391 - RNA, 17 nt, Human
cccuggaggugccagca

SEQ ID NO: 2172392 - RNA, 18 nt, Human
cccuggaggugccagcaa

SEQ ID NO: 2172393 - RNA, 20 nt, Human
cccuggaggugccagcaaag

SEQ ID NO: 2172394 - RNA, 22 nt, Human
cccuggaggugccagcaaagcc

SEQ ID NO: 2172395 - RNA, 13 nt, Human
cccuggagguggc

SEQ ID NO: 2172396 - RNA, 23 nt, Human
cccuggaggugccagcaaagccc

SEQ ID NO: 2172397 - RNA, 18 nt, Human
cccuggagucaugccaag

SEQ ID NO: 2172398 - RNA, 15 nt, Human
cccuggagugcaguu

SEQ ID NO: 2172399 - RNA, 20 nt, Human
cccuggaguguggcugagga

SEQ ID NO: 2172400 - RNA, 21 nt, Human
cccuggaguguggcugaggag

SEQ ID NO: 2172401 - RNA, 15 nt, Human
cccugcccuggucca

SEQ ID NO: 2172402 - RNA, 14 nt, Human
cccugcccuggucc

SEQ ID NO: 2172403 - RNA, 22 nt, Human
cccugcccugguuuccugcccu

SEQ ID NO: 2172404 - RNA, 18 nt, Human
cccugcccugguccaggg

SEQ ID NO: 2172405 - RNA, 23 nt, Human
cccugcccugguuuccugcccug

SEQ ID NO: 2172406 - RNA, 19 nt, Human
cccuggauccaucaggcca

SEQ ID NO: 2172407 - RNA, 20 nt, Human
cccuggccgaguccaagcug

SEQ ID NO: 2172408 - RNA, 15 nt, Human
cccuggccgcccccu

SEQ ID NO: 2172409 - RNA, 22 nt, Human
cccuggcccucaaggccuccca

SEQ ID NO: 2172410 - RNA, 23 nt, Human
cccuggcccucaaggccucccac

SEQ ID NO: 2172411 - RNA, 14 nt, Human
cccuggcccugagg

SEQ ID NO: 2172412 - RNA, 16 nt, Human
cccuggcccugaggug

SEQ ID NO: 2172413 - RNA, 17 nt, Human
cccuggcccugaggugu

SEQ ID NO: 2172414 - RNA, 11 nt, Human
cccuggccucc

SEQ ID NO: 2172415 - RNA, 13 nt, Human
cccuggccucccc

SEQ ID NO: 2172416 - RNA, 14 nt, Human
cccuggccuccccu

SEQ ID NO: 2172417 - RNA, 23 nt, Human
cccuggaucaguccuuugaucag

SEQ ID NO: 2172418 - RNA, 23 nt, Human
cccuggaguguggcugaggaggc

SEQ ID NO: 2172419 - RNA, 13 nt, Human
cccuggaugcagc

SEQ ID NO: 2172420 - RNA, 17 nt, Human
cccuggaugcagccuca

SEQ ID NO: 2172421 - RNA, 21 nt, Human
cccuggaugcagccucacagu

SEQ ID NO: 2172422 - RNA, 19 nt, Human
cccuggcucucagaaggua

SEQ ID NO: 2172423 - RNA, 13 nt, Human
cccuggcucugca

SEQ ID NO: 2172424 - RNA, 14 nt, Human
cccuggcugaagga

SEQ ID NO: 2172425 - RNA, 15 nt, Human
cccuggcugaaggac

SEQ ID NO: 2172426 - RNA, 18 nt, Human
cccuggcugaaggacugu

SEQ ID NO: 2172427 - RNA, 19 nt, Human
cccuggcugaaggacugug

SEQ ID NO: 2172428 - RNA, 19 nt, Human
cccuggcugaccccaaaga

SEQ ID NO: 2172429 - RNA, 23 nt, Human
cccuggcugaccccaaagagccu

SEQ ID NO: 2172430 - RNA, 13 nt, Human
cccuggcugcccu

SEQ ID NO: 2172431 - RNA, 14 nt, Human
cccuggcugcccug

SEQ ID NO: 2172432 - RNA, 15 nt, Human
cccuggcugcccugg

SEQ ID NO: 2172433 - RNA, 16 nt, Human
cccuggcugcccuggc

SEQ ID NO: 2172434 - RNA, 17 nt, Human
cccuggcugcccuggcc

SEQ ID NO: 2172435 - RNA, 18 nt, Human
cccuggcugcccuggccc

SEQ ID NO: 2172436 - RNA, 23 nt, Human
cccuggcucccaugaccauacug

SEQ ID NO: 2172437 - RNA, 15 nt, Human
cccuggcucccauga

SEQ ID NO: 2172438 - RNA, 21 nt, Human
cccuggccuccggcgucagcc

SEQ ID NO: 2172439 - RNA, 14 nt, Human
cccuggcucccaug

SEQ ID NO: 2172440 - RNA, 13 nt, Human
cccuggcucccau

SEQ ID NO: 2172441 - RNA, 20 nt, Human
cccuggcucccacaggcccu

SEQ ID NO: 2172442 - RNA, 19 nt, Human
cccuggccucugugccuuc

SEQ ID NO: 2172443 - RNA, 18 nt, Human
cccuggccucugugccuu

SEQ ID NO: 2172444 - RNA, 15 nt, Human
cccuggccucugugc

SEQ ID NO: 2172445 - RNA, 13 nt, Human
cccuggccucugu

SEQ ID NO: 2172446 - RNA, 20 nt, Human
cccuggccuccggcgucagc

SEQ ID NO: 2172447 - RNA, 19 nt, Human
cccuggccuccccugccac

SEQ ID NO: 2172448 - RNA, 20 nt, Human
cccuggccuccccugccacc

SEQ ID NO: 2172449 - RNA, 21 nt, Human
ccggcccuccuacccugcgcc

SEQ ID NO: 2172450 - RNA, 19 nt, Human
ccggcccugggcucggagg

SEQ ID NO: 2172451 - RNA, 12 nt, Human
ccggcccugggg

SEQ ID NO: 2172452 - RNA, 22 nt, Human
ccggcccugggcucggaggcug

SEQ ID NO: 2172453 - RNA, 24 nt, Human
ccggcccugggcucggaggcugcc

SEQ ID NO: 2172454 - RNA, 13 nt, Human
ccggcccuggggc

SEQ ID NO: 2172455 - RNA, 15 nt, Human
ccggccccugcuggu

SEQ ID NO: 2172456 - RNA, 16 nt, Human
ccggccaccugcggug

SEQ ID NO: 2172457 - RNA, 22 nt, Human
ccggcaguucugggugcucccu

SEQ ID NO: 2172458 - RNA, 17 nt, Human
ccggcaguucugggugc

SEQ ID NO: 2172459 - RNA, 14 nt, Human
ccggcauggcuggg

SEQ ID NO: 2172460 - RNA, 14 nt, Human
ccggcaugggaaag

SEQ ID NO: 2172461 - RNA, 12 nt, Human
ccggccaccucu

SEQ ID NO: 2172462 - RNA, 13 nt, Human
ccggccaccucug

SEQ ID NO: 2172463 - RNA, 14 nt, Human
ccggccaccucugc

SEQ ID NO: 2172464 - RNA, 15 nt, Human
ccggccaccucugcg

SEQ ID NO: 2172465 - RNA, 18 nt, Human
ccggcaggguccuagaaa

SEQ ID NO: 2172466 - RNA, 15 nt, Human
ccggcuccaggcucc

SEQ ID NO: 2172467 - RNA, 22 nt, Human
ccgucgaggggcucucagcuca

SEQ ID NO: 2172468 - RNA, 16 nt, Human
ccguccugccuguggc

SEQ ID NO: 2172469 - RNA, 21 nt, Human
ccgucgaggggcucucagcuc

SEQ ID NO: 2172470 - RNA, 14 nt, Human
ccgucuaccugagg

SEQ ID NO: 2172471 - RNA, 15 nt, Human
ccgucuaccugaggg

SEQ ID NO: 2172472 - RNA, 12 nt, Human
ccggcuccaggc

SEQ ID NO: 2172473 - RNA, 23 nt, Human
ccggccucagcaccccugucucu

SEQ ID NO: 2172474 - RNA, 12 nt, Human
ccggccucucug

SEQ ID NO: 2172475 - RNA, 13 nt, Human
ccggccucucugg

SEQ ID NO: 2172476 - RNA, 15 nt, Human
ccggccucucuggcc

SEQ ID NO: 2172477 - RNA, 16 nt, Human
ccggccucucuggccu

SEQ ID NO: 2172478 - RNA, 13 nt, Human
ccggcuccaggcu

SEQ ID NO: 2172479 - RNA, 14 nt, Human
ccggcuccaggcuc

SEQ ID NO: 2172480 - RNA, 17 nt, Human
ccgucuaccugaggggc

SEQ ID NO: 2172481 - RNA, 12 nt, Human
ccgugaggccag

SEQ ID NO: 2172482 - RNA, 13 nt, Human
ccgugaggccaga

SEQ ID NO: 2172483 - RNA, 14 nt, Human
ccgugaggccagag

SEQ ID NO: 2172484 - RNA, 16 nt, Human
ccgugaggccagagac

SEQ ID NO: 2172485 - RNA, 20 nt, Human
ccuaacgaaguauccuucag

SEQ ID NO: 2172486 - RNA, 15 nt, Human
ccuaacucauacugu

SEQ ID NO: 2172487 - RNA, 18 nt, Human
ccuaacucauacugugcu

SEQ ID NO: 2172488 - RNA, 14 nt, Human
ccgugaggauguca

SEQ ID NO: 2172489 - RNA, 13 nt, Human
ccuaacucauacu

SEQ ID NO: 2172490 - RNA, 17 nt, Human
ccuaagaaucuuuagag

SEQ ID NO: 2172491 - RNA, 20 nt, Human
ccuaagaccggcggccauga

SEQ ID NO: 2172492 - RNA, 17 nt, Human
ccuagcacuuugggagg

SEQ ID NO: 2172493 - RNA, 12 nt, Human
ccuagcagcacc

SEQ ID NO: 2172494 - RNA, 22 nt, Human
ccuaaugacaucaccacaguuu

SEQ ID NO: 2172495 - RNA, 19 nt, Human
ccuagcauacguacacauu

SEQ ID NO: 2172496 - RNA, 23 nt, Human
ccuagcagcaccguucugugcac

SEQ ID NO: 2172497 - RNA, 21 nt, Human
ccuagcagcaccguucugugc

SEQ ID NO: 2172498 - RNA, 20 nt, Human
ccuagcagcaccguucugug

SEQ ID NO: 2172499 - RNA, 17 nt, Human
ccuagccgaccucagcc

SEQ ID NO: 2172500 - RNA, 16 nt, Human
ccuagccgaccucagc

SEQ ID NO: 2172501 - RNA, 15 nt, Human
ccuagccgaccucag

SEQ ID NO: 2172502 - RNA, 14 nt, Human
ccuagccgaccuca

SEQ ID NO: 2172503 - RNA, 13 nt, Human
ccuagcccucuca

SEQ ID NO: 2172504 - RNA, 20 nt, Human
ccuagcccucucacauuuau

SEQ ID NO: 2172505 - RNA, 19 nt, Human
ccuagccgaccucagccuu

SEQ ID NO: 2172506 - RNA, 18 nt, Human
ccuagccgaccucagccu

SEQ ID NO: 2172507 - RNA, 20 nt, Human
ccuagccgaccucagccuuc

SEQ ID NO: 2172508 - RNA, 12 nt, Human
ccuagcagagag

SEQ ID NO: 2172509 - RNA, 20 nt, Human
ccuagccugugccucuggga

SEQ ID NO: 2172510 - RNA, 21 nt, Human
ccuaaucccugggcauugcuu

SEQ ID NO: 2172511 - RNA, 21 nt, Human
ccuaauccaggcagauccagg

SEQ ID NO: 2172512 - RNA, 20 nt, Human
ccuaauccaggcagauccag

SEQ ID NO: 2172513 - RNA, 19 nt, Human
ccuaauccaggcagaucca

SEQ ID NO: 2172514 - RNA, 18 nt, Human
ccuaauccaggcagaucc

SEQ ID NO: 2172515 - RNA, 22 nt, Human
ccuaaggaucucucaggagcac

SEQ ID NO: 2172516 - RNA, 23 nt, Human
ccuaaggaucucucaggagcaca

SEQ ID NO: 2172517 - RNA, 17 nt, Human
ccuaaggacacacuaau

SEQ ID NO: 2172518 - RNA, 16 nt, Human
ccuaaggaucucucag

SEQ ID NO: 2172519 - RNA, 17 nt, Human
ccuaaggaucucucagg

SEQ ID NO: 2172520 - RNA, 19 nt, Human
ccuaaggaucucucaggag

SEQ ID NO: 2172521 - RNA, 22 nt, Human
ccuaaucccugggcauugcuuu

SEQ ID NO: 2172522 - RNA, 24 nt, Human
ccuaaggaucucucaggagcacag

SEQ ID NO: 2172523 - RNA, 20 nt, Human
ccuaaucuauggucgggaga

SEQ ID NO: 2172524 - RNA, 14 nt, Human
ccuaaucuucugaa

SEQ ID NO: 2172525 - RNA, 15 nt, Human
ccuaaggacacacua

SEQ ID NO: 2172526 - RNA, 15 nt, Human
ccgaaggugcuggag

SEQ ID NO: 2172527 - RNA, 23 nt, Human
ccgaaggugcuggaggugggagc

SEQ ID NO: 2172528 - RNA, 13 nt, Human
ccgaagucuuuug

SEQ ID NO: 2172529 - RNA, 21 nt, Human
ccgaaguggacuggccccugg

SEQ ID NO: 2172530 - RNA, 23 nt, Human
ccgaaggugaggagcuugaaacc

SEQ ID NO: 2172531 - RNA, 16 nt, Human
ccgaauagcugggacu

SEQ ID NO: 2172532 - RNA, 17 nt, Human
ccgaauagcugggacua

SEQ ID NO: 2172533 - RNA, 18 nt, Human
ccgaccagacaccuugac

SEQ ID NO: 2172534 - RNA, 15 nt, Human
ccgaccaccugccca

SEQ ID NO: 2172535 - RNA, 15 nt, Human
ccgcagacaggacca

SEQ ID NO: 2172536 - RNA, 13 nt, Human
ccgaccagacacc

SEQ ID NO: 2172537 - RNA, 17 nt, Human
ccgaccagacaccuuga

SEQ ID NO: 2172538 - RNA, 19 nt, Human
ccgaaagggacuuggaagc

SEQ ID NO: 2172539 - RNA, 24 nt, Human
ccgaaacaggcuacucuccucggc

SEQ ID NO: 2172540 - RNA, 14 nt, Human
cccuuccuugcucu

SEQ ID NO: 2172541 - RNA, 17 nt, Human
cccuuccuuuucccugc

SEQ ID NO: 2172542 - RNA, 17 nt, Human
ccgaaaccaaagaagaa

SEQ ID NO: 2172543 - RNA, 18 nt, Human
cccuuccuuuucccugcu

SEQ ID NO: 2172544 - RNA, 16 nt, Human
ccgaaaacguggcugc

SEQ ID NO: 2172545 - RNA, 17 nt, Human
ccgaaaacguggcugcu

SEQ ID NO: 2172546 - RNA, 15 nt, Human
cccuuccucuuucca

SEQ ID NO: 2172547 - RNA, 22 nt, Human
cccugugcagccgcugagcgag

SEQ ID NO: 2172548 - RNA, 22 nt, Human
ccgcccagcugcaccugccagc

SEQ ID NO: 2172549 - RNA, 17 nt, Human
ccgcccagcugcaccug

SEQ ID NO: 2172550 - RNA, 19 nt, Human
ccgcccacuguccugggcg

SEQ ID NO: 2172551 - RNA, 16 nt, Human
ccgcccacuguccugg

SEQ ID NO: 2172552 - RNA, 18 nt, Human
ccgcccacuguccugggc

SEQ ID NO: 2172553 - RNA, 22 nt, Human
ccgcccagagacccaagcugcc

SEQ ID NO: 2172554 - RNA, 23 nt, Human
ccgcccacaggaagccugcaguc

SEQ ID NO: 2172555 - RNA, 13 nt, Human
ccgcccacugucc

SEQ ID NO: 2172556 - RNA, 15 nt, Human
ccgcccacuguccug

SEQ ID NO: 2172557 - RNA, 12 nt, Human
ccgcccaggcuu

SEQ ID NO: 2172558 - RNA, 20 nt, Human
ccgcccaggcuggccagccc

SEQ ID NO: 2172559 - RNA, 22 nt, Human
ccgcccaggcuggccagcccca

SEQ ID NO: 2172560 - RNA, 14 nt, Human
ccgcccaggcuggc

SEQ ID NO: 2172561 - RNA, 16 nt, Human
ccgcccaggcuggcca

SEQ ID NO: 2172562 - RNA, 17 nt, Human
ccgcccaggcuggccag

SEQ ID NO: 2172563 - RNA, 18 nt, Human
ccgcccaggcuggccagc

SEQ ID NO: 2172564 - RNA, 20 nt, Human
ccgcagaccuccccagcccc

SEQ ID NO: 2172565 - RNA, 21 nt, Human
ccgcagaccuccccagccccu

SEQ ID NO: 2172566 - RNA, 16 nt, Human
ccgaccacaccagagc

SEQ ID NO: 2172567 - RNA, 13 nt, Human
ccgcagaccuccc

SEQ ID NO: 2172568 - RNA, 15 nt, Human
ccgcagaccucccca

SEQ ID NO: 2172569 - RNA, 16 nt, Human
ccgcagaccuccccag

SEQ ID NO: 2172570 - RNA, 17 nt, Human
ccgcagaccuccccagc

SEQ ID NO: 2172571 - RNA, 18 nt, Human
ccgcagaccuccccagcc

SEQ ID NO: 2172572 - RNA, 19 nt, Human
ccgcagaccuccccagccc

SEQ ID NO: 2172573 - RNA, 16 nt, Human
ccgcagacaggaccag

SEQ ID NO: 2172574 - RNA, 17 nt, Human
ccgcagacaggaccagg

SEQ ID NO: 2172575 - RNA, 16 nt, Human
cccuguccuccucgga

SEQ ID NO: 2172576 - RNA, 15 nt, Human
cccuguccuccucgg

SEQ ID NO: 2172577 - RNA, 14 nt, Human
cccuguccuccucg

SEQ ID NO: 2172578 - RNA, 18 nt, Human
cccuguccucacugcucc

SEQ ID NO: 2172579 - RNA, 14 nt, Human
cccuguccucacug

SEQ ID NO: 2172580 - RNA, 15 nt, Human
cccuguccucacugc

SEQ ID NO: 2172581 - RNA, 16 nt, Human
cccuguccucacugcu

SEQ ID NO: 2172582 - RNA, 17 nt, Human
cccuguccucacugcuc

SEQ ID NO: 2172583 - RNA, 13 nt, Human
cccuguccucacu

SEQ ID NO: 2172584 - RNA, 13 nt, Human
cccugucccucua

SEQ ID NO: 2172585 - RNA, 24 nt, Human
cccugucccucccaccucugugac

SEQ ID NO: 2172586 - RNA, 16 nt, Human
cccugucgagacacuu

SEQ ID NO: 2172587 - RNA, 20 nt, Human
cccugucgagacacuugccu

SEQ ID NO: 2172588 - RNA, 15 nt, Human
cccugucgagacacu

SEQ ID NO: 2172589 - RNA, 20 nt, Human
cccuguccucucuggcuggg

SEQ ID NO: 2172590 - RNA, 22 nt, Human
cccuguccugauggucagcucc

SEQ ID NO: 2172591 - RNA, 23 nt, Human
cccuguccugauggucagcuccc

SEQ ID NO: 2172592 - RNA, 21 nt, Human
cccuuccucuccacugccuuc

SEQ ID NO: 2172593 - RNA, 14 nt, Human
cccugucuaaaaaa

SEQ ID NO: 2172594 - RNA, 22 nt, Human
cccugugcaaccucuuggccug

SEQ ID NO: 2172595 - RNA, 23 nt, Human
cccugugauggggcccugccucc

SEQ ID NO: 2172596 - RNA, 21 nt, Human
cccugugauggggcccugccu

SEQ ID NO: 2172597 - RNA, 22 nt, Human
cccugugauggggcccugccuc

SEQ ID NO: 2172598 - RNA, 15 nt, Human
ccucccacugggguc

SEQ ID NO: 2172599 - RNA, 13 nt, Human
ccucccacugggg

SEQ ID NO: 2172600 - RNA, 18 nt, Human
ccucccagaacacacucc

SEQ ID NO: 2172601 - RNA, 21 nt, Human
ccucccagaccugccucuucc

SEQ ID NO: 2172602 - RNA, 17 nt, Human
ccucccagaacacacuc

SEQ ID NO: 2172603 - RNA, 19 nt, Human
ccucccaccucugugaccu

SEQ ID NO: 2172604 - RNA, 12 nt, Human
ccucccaccucu

SEQ ID NO: 2172605 - RNA, 13 nt, Human
ccucccaccucug

SEQ ID NO: 2172606 - RNA, 14 nt, Human
ccucccaccucugu

SEQ ID NO: 2172607 - RNA, 15 nt, Human
ccucccaccucugug

SEQ ID NO: 2172608 - RNA, 21 nt, Human
ccucaugcccacccccugccc

SEQ ID NO: 2172609 - RNA, 22 nt, Human
ccucaugcccacccccugcccu

SEQ ID NO: 2172610 - RNA, 23 nt, Human
ccucaugcccacccccugcccug

SEQ ID NO: 2172611 - RNA, 20 nt, Human
ccuccccagcagguggggag

SEQ ID NO: 2172612 - RNA, 17 nt, Human
ccuccccagcagguggg

SEQ ID NO: 2172613 - RNA, 16 nt, Human
ccuccccagcaggugg

SEQ ID NO: 2172614 - RNA, 12 nt, Human
ccuccccagcag

SEQ ID NO: 2172615 - RNA, 13 nt, Human
ccuccccacgccc

SEQ ID NO: 2172616 - RNA, 15 nt, Human
ccuccccacgcccuc

SEQ ID NO: 2172617 - RNA, 17 nt, Human
ccuccccacgcccuccc

SEQ ID NO: 2172618 - RNA, 22 nt, Human
ccuccccacggccgcuccaggg

SEQ ID NO: 2172619 - RNA, 12 nt, Human
ccuccccagcuc

SEQ ID NO: 2172620 - RNA, 22 nt, Human
ccuccccagcauuccagccccu

SEQ ID NO: 2172621 - RNA, 12 nt, Human
ccuccccagccc

SEQ ID NO: 2172622 - RNA, 14 nt, Human
ccuccccagccccu

SEQ ID NO: 2172623 - RNA, 15 nt, Human
ccuccccagccccua

SEQ ID NO: 2172624 - RNA, 16 nt, Human
ccuccccagccccuag

SEQ ID NO: 2172625 - RNA, 17 nt, Human
ccuccccagccccuagc

SEQ ID NO: 2172626 - RNA, 22 nt, Human
ccuccccagccccuagcccagg

SEQ ID NO: 2172627 - RNA, 13 nt, Human
ccucaugcccacc

SEQ ID NO: 2172628 - RNA, 15 nt, Human
ccucaugcaucucca

SEQ ID NO: 2172629 - RNA, 18 nt, Human
ccucaugcaucuccaccu

SEQ ID NO: 2172630 - RNA, 14 nt, Human
ccucaugcccaccc

SEQ ID NO: 2172631 - RNA, 15 nt, Human
ccucaugcccacccc

SEQ ID NO: 2172632 - RNA, 20 nt, Human
ccucaugcccacccccugcc

SEQ ID NO: 2172633 - RNA, 24 nt, Human
ccucaugcccacccccugcccugc

SEQ ID NO: 2172634 - RNA, 13 nt, Human
ccucaggcaggaa

SEQ ID NO: 2172635 - RNA, 13 nt, Human
ccucaugcaucuc

SEQ ID NO: 2172636 - RNA, 11 nt, Human
ccucaggcagg

SEQ ID NO: 2172637 - RNA, 17 nt, Human
ccucccaacucacccca

SEQ ID NO: 2172638 - RNA, 20 nt, Human
ccucccaacucaccccagcc

SEQ ID NO: 2172639 - RNA, 21 nt, Human
ccucccaacucaccccagccc

SEQ ID NO: 2172640 - RNA, 23 nt, Human
ccucccaacucaccccagcccca

SEQ ID NO: 2172641 - RNA, 15 nt, Human
ccucagccuccugag

SEQ ID NO: 2172642 - RNA, 18 nt, Human
ccucagccuccugaguag

SEQ ID NO: 2172643 - RNA, 17 nt, Human
ccuaggaauucccagcc

SEQ ID NO: 2172644 - RNA, 16 nt, Human
ccuaggaauucccagc

SEQ ID NO: 2172645 - RNA, 14 nt, Human
ccucagccuggcca

SEQ ID NO: 2172646 - RNA, 13 nt, Human
ccucagccuggcc

SEQ ID NO: 2172647 - RNA, 12 nt, Human
ccucagccuggc

SEQ ID NO: 2172648 - RNA, 11 nt, Human
ccucagccugg

SEQ ID NO: 2172649 - RNA, 20 nt, Human
ccucaggcaaggucuggccu

SEQ ID NO: 2172650 - RNA, 19 nt, Human
ccucaggaggcaggaccuu

SEQ ID NO: 2172651 - RNA, 18 nt, Human
ccucagccuggccagaca

SEQ ID NO: 2172652 - RNA, 17 nt, Human
ccucagccuggccagac

SEQ ID NO: 2172653 - RNA, 16 nt, Human
ccucagccuggccaga

SEQ ID NO: 2172654 - RNA, 15 nt, Human
ccucagccuggccag

SEQ ID NO: 2172655 - RNA, 15 nt, Human
ccucaggcacuagcc

SEQ ID NO: 2172656 - RNA, 16 nt, Human
ccucaggcacuagccu

SEQ ID NO: 2172657 - RNA, 17 nt, Human
ccucaggcacuagccuu

SEQ ID NO: 2172658 - RNA, 18 nt, Human
ccucaggcacuagccuuu

SEQ ID NO: 2172659 - RNA, 13 nt, Human
ccucaggcagcuc

SEQ ID NO: 2172660 - RNA, 19 nt, Human
ccucaggcacuagccuuug

SEQ ID NO: 2172661 - RNA, 22 nt, Human
ccucaggcacuagccuuuggcu

SEQ ID NO: 2172662 - RNA, 14 nt, Human
ccucaggcagcuca

SEQ ID NO: 2172663 - RNA, 15 nt, Human
ccucaggcagcucaa

SEQ ID NO: 2172664 - RNA, 22 nt, Human
ccuagccuuauccucugaucuc

SEQ ID NO: 2172665 - RNA, 18 nt, Human
ccuagcugcuacaaagaa

SEQ ID NO: 2172666 - RNA, 23 nt, Human
ccuagcugcacagggcagcuggg

SEQ ID NO: 2172667 - RNA, 14 nt, Human
ccuagcugcuacaa

SEQ ID NO: 2172668 - RNA, 15 nt, Human
ccuagcugcuacaaa

SEQ ID NO: 2172669 - RNA, 17 nt, Human
ccuagcugcuacaaaga

SEQ ID NO: 2172670 - RNA, 19 nt, Human
ccuagcugcacagggcagc

SEQ ID NO: 2172671 - RNA, 21 nt, Human
ccuagcugcacagggcagcug

SEQ ID NO: 2172672 - RNA, 22 nt, Human
ccuagcugcacagggcagcugg

SEQ ID NO: 2172673 - RNA, 20 nt, Human
ccuagcuugggaggcuuccc

SEQ ID NO: 2172674 - RNA, 15 nt, Human
ccuagcuuagagccu

SEQ ID NO: 2172675 - RNA, 21 nt, Human
ccuagcuugggaggcuucccc

SEQ ID NO: 2172676 - RNA, 17 nt, Human
ccuagcuuuagacccug

SEQ ID NO: 2172677 - RNA, 23 nt, Human
ccuagcuuuagacccuggguggg

SEQ ID NO: 2172678 - RNA, 18 nt, Human
ccuagcuuuagacccugg

SEQ ID NO: 2172679 - RNA, 20 nt, Human
ccuagcuuuagacccugggu

SEQ ID NO: 2172680 - RNA, 21 nt, Human
ccuagcuuuagacccugggug

SEQ ID NO: 2172681 - RNA, 22 nt, Human
ccuagcuuuagacccugggugg

SEQ ID NO: 2172682 - RNA, 21 nt, Human
ccuagcugugaccucuccccu

SEQ ID NO: 2172683 - RNA, 13 nt, Human
ccuccccaggccg

SEQ ID NO: 2172684 - RNA, 14 nt, Human
ccuccccaggggag

SEQ ID NO: 2172685 - RNA, 12 nt, Human
ccuccccagggg

SEQ ID NO: 2172686 - RNA, 15 nt, Human
ccucccuggguucag

SEQ ID NO: 2172687 - RNA, 13 nt, Human
ccucccuggguuc

SEQ ID NO: 2172688 - RNA, 14 nt, Human
ccucccuggguuca

SEQ ID NO: 2172689 - RNA, 22 nt, Human
ccucccuggcugcccuggcccu

SEQ ID NO: 2172690 - RNA, 23 nt, Human
ccucccuggcugcccuggcccug

SEQ ID NO: 2172691 - RNA, 10 nt, Human
ccucccuggg

SEQ ID NO: 2172692 - RNA, 12 nt, Human
ccucccuggguu

SEQ ID NO: 2172693 - RNA, 14 nt, Human
ccucccuguccucc

SEQ ID NO: 2172694 - RNA, 11 nt, Human
ccucccugucc

SEQ ID NO: 2172695 - RNA, 12 nt, Human
ccucccuguccu

SEQ ID NO: 2172696 - RNA, 12 nt, Human
ccucccugucaa

SEQ ID NO: 2172697 - RNA, 23 nt, Human
ccucccugucaaagcugucacuu

SEQ ID NO: 2172698 - RNA, 21 nt, Human
ccucccuguugaagcucuggu

SEQ ID NO: 2172699 - RNA, 15 nt, Human
ccucccuguccuccu

SEQ ID NO: 2172700 - RNA, 22 nt, Human
ccucccuguugacgaagucucu

SEQ ID NO: 2172701 - RNA, 23 nt, Human
ccucccuguugacgaagucucuu

SEQ ID NO: 2172702 - RNA, 14 nt, Human
ccucccuguuugaa

SEQ ID NO: 2172703 - RNA, 13 nt, Human
ccucccuuagcuc

SEQ ID NO: 2172704 - RNA, 19 nt, Human
ccuccgauccuuccuccca

SEQ ID NO: 2172705 - RNA, 16 nt, Human
ccucccuguccuccuc

SEQ ID NO: 2172706 - RNA, 18 nt, Human
ccucccuguuccccagag

SEQ ID NO: 2172707 - RNA, 20 nt, Human
ccucccuguuccccagagaa

SEQ ID NO: 2172708 - RNA, 19 nt, Human
ccucccuguuccccagaga

SEQ ID NO: 2172709 - RNA, 20 nt, Human
ccucccuggcucccaugacc

SEQ ID NO: 2172710 - RNA, 18 nt, Human
ccucccuggcucccauga

SEQ ID NO: 2172711 - RNA, 16 nt, Human
ccucccuggcucccau

SEQ ID NO: 2172712 - RNA, 15 nt, Human
ccucccuggcuccca

SEQ ID NO: 2172713 - RNA, 12 nt, Human
ccucccuggcug

SEQ ID NO: 2172714 - RNA, 14 nt, Human
ccucccuggcugcc

SEQ ID NO: 2172715 - RNA, 15 nt, Human
ccucccuggcugccc

SEQ ID NO: 2172716 - RNA, 16 nt, Human
ccucccuggcugcccu

SEQ ID NO: 2172717 - RNA, 17 nt, Human
ccucccuggcugcccug

SEQ ID NO: 2172718 - RNA, 18 nt, Human
ccucccuggcugcccugg

SEQ ID NO: 2172719 - RNA, 20 nt, Human
ccucccuggcugcccuggcc

SEQ ID NO: 2172720 - RNA, 21 nt, Human
ccucccuggcugcccuggccc

SEQ ID NO: 2172721 - RNA, 14 nt, Human
ccucccuggcuccc

SEQ ID NO: 2172722 - RNA, 13 nt, Human
ccucccuggcucc

SEQ ID NO: 2172723 - RNA, 12 nt, Human
ccucccuggcuc

SEQ ID NO: 2172724 - RNA, 15 nt, Human
ccucccuggccuguu

SEQ ID NO: 2172725 - RNA, 23 nt, Human
ccucccuggaguguggcugagga

SEQ ID NO: 2172726 - RNA, 23 nt, Human
ccucccugcuguccccucuugcc

SEQ ID NO: 2172727 - RNA, 21 nt, Human
ccucccugcuguccccucuug

SEQ ID NO: 2172728 - RNA, 22 nt, Human
ccucccugcuguccccucuugc

SEQ ID NO: 2172729 - RNA, 14 nt, Human
ccucccuggccugu

SEQ ID NO: 2172730 - RNA, 12 nt, Human
ccucccuggagu

SEQ ID NO: 2172731 - RNA, 13 nt, Human
ccucccuggagug

SEQ ID NO: 2172732 - RNA, 14 nt, Human
ccucccugcugucc

SEQ ID NO: 2172733 - RNA, 15 nt, Human
ccucccugcuguccc

SEQ ID NO: 2172734 - RNA, 19 nt, Human
ccucccugcuguccccucu

SEQ ID NO: 2172735 - RNA, 20 nt, Human
ccucccugcuguccccucuu

SEQ ID NO: 2172736 - RNA, 16 nt, Human
ccuccuacccugcgcc

SEQ ID NO: 2172737 - RNA, 20 nt, Human
ccuccuaccccucccagcug

SEQ ID NO: 2172738 - RNA, 21 nt, Human
ccuccuaccccucccagcuga

SEQ ID NO: 2172739 - RNA, 16 nt, Human
ccuccuaccccuccca

SEQ ID NO: 2172740 - RNA, 17 nt, Human
ccuccuaccccucccag

SEQ ID NO: 2172741 - RNA, 18 nt, Human
ccuccuaccccucccagc

SEQ ID NO: 2172742 - RNA, 19 nt, Human
ccuccuaccccucccagcu

SEQ ID NO: 2172743 - RNA, 15 nt, Human
ccuccuaagagagag

SEQ ID NO: 2172744 - RNA, 15 nt, Human
ccuccuaccccuccc

SEQ ID NO: 2172745 - RNA, 15 nt, Human
ccuccguauuucaga

SEQ ID NO: 2172746 - RNA, 16 nt, Human
ccuccguauuucagac

SEQ ID NO: 2172747 - RNA, 18 nt, Human
ccuccguccaggagccug

SEQ ID NO: 2172748 - RNA, 14 nt, Human
ccuccgugcuuccu

SEQ ID NO: 2172749 - RNA, 16 nt, Human
ccuccguugggcccca

SEQ ID NO: 2172750 - RNA, 16 nt, Human
ccuccgccaggcgaga

SEQ ID NO: 2172751 - RNA, 14 nt, Human
ccuccgccaggcga

SEQ ID NO: 2172752 - RNA, 23 nt, Human
ccuccgccauucucaagcccugc

SEQ ID NO: 2172753 - RNA, 12 nt, Human
ccuccgcccugc

SEQ ID NO: 2172754 - RNA, 13 nt, Human
ccuccgcccugcc

SEQ ID NO: 2172755 - RNA, 14 nt, Human
ccuccgcccugcca

SEQ ID NO: 2172756 - RNA, 15 nt, Human
ccuccgcccugccac

SEQ ID NO: 2172757 - RNA, 16 nt, Human
ccuccgcccugccacu

SEQ ID NO: 2172758 - RNA, 18 nt, Human
ccuccgcccugccacuca

SEQ ID NO: 2172759 - RNA, 16 nt, Human
ccuccgccucccgggu

SEQ ID NO: 2172760 - RNA, 13 nt, Human
ccuccgccucccg

SEQ ID NO: 2172761 - RNA, 18 nt, Human
ccuccgggaccuggugcu

SEQ ID NO: 2172762 - RNA, 23 nt, Human
ccuccggcgucagccuccagccu

SEQ ID NO: 2172763 - RNA, 19 nt, Human
ccucgaagcgcgccacucg

SEQ ID NO: 2172764 - RNA, 18 nt, Human
ccucgaagcgcgccacuc

SEQ ID NO: 2172765 - RNA, 20 nt, Human
ccuccuuucucuucucuguu

SEQ ID NO: 2172766 - RNA, 21 nt, Human
ccuccuuucucuucucuguuc

SEQ ID NO: 2172767 - RNA, 14 nt, Human
ccucgcccuggguc

SEQ ID NO: 2172768 - RNA, 16 nt, Human
ccucgagcagaugaug

SEQ ID NO: 2172769 - RNA, 14 nt, Human
ccucgagggcaggg

SEQ ID NO: 2172770 - RNA, 16 nt, Human
ccucgagggcagggac

SEQ ID NO: 2172771 - RNA, 16 nt, Human
ccucgaacuggcugca

SEQ ID NO: 2172772 - RNA, 15 nt, Human
ccucgaacuggcugc

SEQ ID NO: 2172773 - RNA, 15 nt, Human
ccuccuuucucuucu

SEQ ID NO: 2172774 - RNA, 16 nt, Human
ccuccuuucucuucuc

SEQ ID NO: 2172775 - RNA, 18 nt, Human
ccuccuuugugaggaagc

SEQ ID NO: 2172776 - RNA, 19 nt, Human
ccuccuuugugaggaagcc

SEQ ID NO: 2172777 - RNA, 20 nt, Human
ccuccuuugugaggaagccg

SEQ ID NO: 2172778 - RNA, 18 nt, Human
ccucgggcccagccccca

SEQ ID NO: 2172779 - RNA, 16 nt, Human
ccucgggcccagcccc

SEQ ID NO: 2172780 - RNA, 17 nt, Human
ccucgggcccagccccc

SEQ ID NO: 2172781 - RNA, 17 nt, Human
ccucucggaaggcuggc

SEQ ID NO: 2172782 - RNA, 22 nt, Human
ccucuccuuuguauauuauuuc

SEQ ID NO: 2172783 - RNA, 16 nt, Human
ccucucgagggcaggg

SEQ ID NO: 2172784 - RNA, 21 nt, Human
ccucuccuuguggccugggcc

SEQ ID NO: 2172785 - RNA, 14 nt, Human
ccucuccuuuguau

SEQ ID NO: 2172786 - RNA, 15 nt, Human
ccucuccuuuguaua

SEQ ID NO: 2172787 - RNA, 16 nt, Human
ccucuccuuuguauau

SEQ ID NO: 2172788 - RNA, 18 nt, Human
ccucuccuuuguauauua

SEQ ID NO: 2172789 - RNA, 15 nt, Human
ccucuccuuccugug

SEQ ID NO: 2172790 - RNA, 13 nt, Human
ccucuccuuccug

SEQ ID NO: 2172791 - RNA, 20 nt, Human
ccucggcuuuucucagcugg

SEQ ID NO: 2172792 - RNA, 19 nt, Human
ccucggcuuuucucagcug

SEQ ID NO: 2172793 - RNA, 12 nt, Human
ccucgcugcuuc

SEQ ID NO: 2172794 - RNA, 15 nt, Human
ccucggcuccugcug

SEQ ID NO: 2172795 - RNA, 16 nt, Human
ccucggcuccugcugc

SEQ ID NO: 2172796 - RNA, 17 nt, Human
ccucggcuccugcugca

SEQ ID NO: 2172797 - RNA, 18 nt, Human
ccucggcuccugcugcac

SEQ ID NO: 2172798 - RNA, 19 nt, Human
ccucggcuccugcugcacc

SEQ ID NO: 2172799 - RNA, 20 nt, Human
ccucggcuccugcugcacca

SEQ ID NO: 2172800 - RNA, 22 nt, Human
ccucggcuccugcugcaccaac

SEQ ID NO: 2172801 - RNA, 17 nt, Human
ccucgggaaccucacuc

SEQ ID NO: 2172802 - RNA, 21 nt, Human
ccucgggaaccucacucuugc

SEQ ID NO: 2172803 - RNA, 23 nt, Human
ccucgggaaccucacucuugcca

SEQ ID NO: 2172804 - RNA, 13 nt, Human
ccucgggcccacc

SEQ ID NO: 2172805 - RNA, 14 nt, Human
ccucgggcccaccu

SEQ ID NO: 2172806 - RNA, 15 nt, Human
ccucgggcccaccug

SEQ ID NO: 2172807 - RNA, 16 nt, Human
ccucgggcccaccugg

SEQ ID NO: 2172808 - RNA, 17 nt, Human
ccucgggcccaccuggc

SEQ ID NO: 2172809 - RNA, 19 nt, Human
ccucgggcccaccuggcca

SEQ ID NO: 2172810 - RNA, 20 nt, Human
ccucgggcccaccuggccac

SEQ ID NO: 2172811 - RNA, 21 nt, Human
ccucgggcccaccuggccacc

SEQ ID NO: 2172812 - RNA, 22 nt, Human
ccucgggcccaccuggccaccu

SEQ ID NO: 2172813 - RNA, 13 nt, Human
ccucgggcccagc

SEQ ID NO: 2172814 - RNA, 14 nt, Human
ccucgggcccagcc

SEQ ID NO: 2172815 - RNA, 15 nt, Human
ccucgggcccagccc

SEQ ID NO: 2172816 - RNA, 20 nt, Human
ccucgcugccagcucuguau

SEQ ID NO: 2172817 - RNA, 19 nt, Human
ccucgcugccagcucugua

SEQ ID NO: 2172818 - RNA, 14 nt, Human
ccucgcugccagcu

SEQ ID NO: 2172819 - RNA, 13 nt, Human
ccucgcugccagc

SEQ ID NO: 2172820 - RNA, 12 nt, Human
ccucgccuggcc

SEQ ID NO: 2172821 - RNA, 13 nt, Human
ccucgccuggccu

SEQ ID NO: 2172822 - RNA, 14 nt, Human
ccucgccuggccug

SEQ ID NO: 2172823 - RNA, 15 nt, Human
ccucgccuggccuga

SEQ ID NO: 2172824 - RNA, 16 nt, Human
ccucgccuggccugag

SEQ ID NO: 2172825 - RNA, 18 nt, Human
ccucgccuggccugaggu

SEQ ID NO: 2172826 - RNA, 13 nt, Human
ccucgccugacaa

SEQ ID NO: 2172827 - RNA, 17 nt, Human
ccucgagggcagggacu

SEQ ID NO: 2172828 - RNA, 19 nt, Human
ccucucgguggccagcagg

SEQ ID NO: 2172829 - RNA, 21 nt, Human
ccucucggaaggcuggcuggg

SEQ ID NO: 2172830 - RNA, 16 nt, Human
ccucucugcagguccc

SEQ ID NO: 2172831 - RNA, 17 nt, Human
ccucucugcaggucccu

SEQ ID NO: 2172832 - RNA, 18 nt, Human
ccucucugcaggucccua

SEQ ID NO: 2172833 - RNA, 19 nt, Human
ccucucugcaggucccuaa

SEQ ID NO: 2172834 - RNA, 12 nt, Human
ccucucucacuc

SEQ ID NO: 2172835 - RNA, 13 nt, Human
ccucugccucaau

SEQ ID NO: 2172836 - RNA, 12 nt, Human
ccucugccucaa

SEQ ID NO: 2172837 - RNA, 11 nt, Human
ccucugccuca

SEQ ID NO: 2172838 - RNA, 20 nt, Human
ccucugccucugacacacag

SEQ ID NO: 2172839 - RNA, 14 nt, Human
ccucugcccugcgg

SEQ ID NO: 2172840 - RNA, 13 nt, Human
ccucugcccugcg

SEQ ID NO: 2172841 - RNA, 12 nt, Human
ccucugcccugc

SEQ ID NO: 2172842 - RNA, 11 nt, Human
ccucugcccug

SEQ ID NO: 2172843 - RNA, 21 nt, Human
ccucugccucugacacacagc

SEQ ID NO: 2172844 - RNA, 23 nt, Human
ccucugccucugacacacagcuc

SEQ ID NO: 2172845 - RNA, 11 nt, Human
ccucugccuga

SEQ ID NO: 2172846 - RNA, 20 nt, Human
ccucugccugaagucacaca

SEQ ID NO: 2172847 - RNA, 15 nt, Human
ccugccucuucucua

SEQ ID NO: 2172848 - RNA, 13 nt, Human
ccugccucugccc

SEQ ID NO: 2172849 - RNA, 14 nt, Human
ccugccucuguuug

SEQ ID NO: 2172850 - RNA, 20 nt, Human
ccugccuccugccugccccu

SEQ ID NO: 2172851 - RNA, 20 nt, Human
ccugccucucugcagguccc

SEQ ID NO: 2172852 - RNA, 21 nt, Human
ccugccucucugcaggucccu

SEQ ID NO: 2172853 - RNA, 15 nt, Human
ccugccucuguuuga

SEQ ID NO: 2172854 - RNA, 14 nt, Human
ccugccugagggcc

SEQ ID NO: 2172855 - RNA, 18 nt, Human
ccugccugagggccccuc

SEQ ID NO: 2172856 - RNA, 19 nt, Human
ccugccugagggccccucu

SEQ ID NO: 2172857 - RNA, 20 nt, Human
ccugccugagggccccucug

SEQ ID NO: 2172858 - RNA, 21 nt, Human
ccugccugagggccccucugc

SEQ ID NO: 2172859 - RNA, 22 nt, Human
ccugccugagggccccucugcc

SEQ ID NO: 2172860 - RNA, 12 nt, Human
ccugccuggagc

SEQ ID NO: 2172861 - RNA, 10 nt, Human
ccugcugcau

SEQ ID NO: 2172862 - RNA, 22 nt, Human
ccugcugcaguugccagucacc

SEQ ID NO: 2172863 - RNA, 21 nt, Human
ccugcugccgccucccagccu

SEQ ID NO: 2172864 - RNA, 18 nt, Human
ccugcugccgccucccag

SEQ ID NO: 2172865 - RNA, 15 nt, Human
ccugcugccgccucc

SEQ ID NO: 2172866 - RNA, 14 nt, Human
ccugcugccgccuc

SEQ ID NO: 2172867 - RNA, 11 nt, Human
ccugcugcagu

SEQ ID NO: 2172868 - RNA, 13 nt, Human
ccugccuggagcg

SEQ ID NO: 2172869 - RNA, 15 nt, Human
ccugcugcaggggcu

SEQ ID NO: 2172870 - RNA, 17 nt, Human
ccugcugcaggggcucu

SEQ ID NO: 2172871 - RNA, 20 nt, Human
ccugcugcaggggcucugga

SEQ ID NO: 2172872 - RNA, 21 nt, Human
ccugcugcaggggcucuggag

SEQ ID NO: 2172873 - RNA, 22 nt, Human
ccugcugcaggggcucuggaga

SEQ ID NO: 2172874 - RNA, 23 nt, Human
ccugcugcaggggcucuggagag

SEQ ID NO: 2172875 - RNA, 12 nt, Human
ccugcugcaguu

SEQ ID NO: 2172876 - RNA, 16 nt, Human
ccugcugcaguugcca

SEQ ID NO: 2172877 - RNA, 17 nt, Human
ccugccucucugcaggu

SEQ ID NO: 2172878 - RNA, 23 nt, Human
ccugccuccuuugugaggaagcc

SEQ ID NO: 2172879 - RNA, 21 nt, Human
ccugccuccuuugugaggaag

SEQ ID NO: 2172880 - RNA, 22 nt, Human
ccugccuccuuugugaggaagc

SEQ ID NO: 2172881 - RNA, 13 nt, Human
ccugccuccuuug

SEQ ID NO: 2172882 - RNA, 15 nt, Human
ccugccuccuuugug

SEQ ID NO: 2172883 - RNA, 19 nt, Human
ccugccuccuuugugagga

SEQ ID NO: 2172884 - RNA, 20 nt, Human
ccugccuccuuugugaggaa

SEQ ID NO: 2172885 - RNA, 17 nt, Human
ccucuucuucuucagaa

SEQ ID NO: 2172886 - RNA, 16 nt, Human
ccucuucuucuucaga

SEQ ID NO: 2172887 - RNA, 15 nt, Human
ccucuucuucuucag

SEQ ID NO: 2172888 - RNA, 15 nt, Human
ccucuuggaccucug

SEQ ID NO: 2172889 - RNA, 17 nt, Human
ccucuuggaccucugcu

SEQ ID NO: 2172890 - RNA, 18 nt, Human
ccucuuggaccucugcuc

SEQ ID NO: 2172891 - RNA, 19 nt, Human
ccucuuggaccucugcucu

SEQ ID NO: 2172892 - RNA, 21 nt, Human
ccucuuggaccucugcucuga

SEQ ID NO: 2172893 - RNA, 15 nt, Human
ccucuuggcugccuu

SEQ ID NO: 2172894 - RNA, 13 nt, Human
ccucuuggccuga

SEQ ID NO: 2172895 - RNA, 16 nt, Human
ccucuuugagugaagc

SEQ ID NO: 2172896 - RNA, 11 nt, Human
ccucuuugcuu

SEQ ID NO: 2172897 - RNA, 15 nt, Human
ccucuuggcagucac

SEQ ID NO: 2172898 - RNA, 15 nt, Human
ccucuuugcauggaa

SEQ ID NO: 2172899 - RNA, 19 nt, Human
ccucuuuggucuacacugu

SEQ ID NO: 2172900 - RNA, 17 nt, Human
ccucuuugcuuugcuuu

SEQ ID NO: 2172901 - RNA, 15 nt, Human
ccucuuugcuuugcu

SEQ ID NO: 2172902 - RNA, 14 nt, Human
ccucuuugcuuugc

SEQ ID NO: 2172903 - RNA, 13 nt, Human
ccucuuugcuuug

SEQ ID NO: 2172904 - RNA, 14 nt, Human
ccucuuuggcuccc

SEQ ID NO: 2172905 - RNA, 18 nt, Human
ccucuuuggcuccccugu

SEQ ID NO: 2172906 - RNA, 20 nt, Human
ccucuucugacgugccuuuu

SEQ ID NO: 2172907 - RNA, 17 nt, Human
ccucuucugacgugccu

SEQ ID NO: 2172908 - RNA, 18 nt, Human
ccucuucugacgugccuu

SEQ ID NO: 2172909 - RNA, 15 nt, Human
ccucuucuggcucaa

SEQ ID NO: 2172910 - RNA, 14 nt, Human
ccucuucugcaucu

SEQ ID NO: 2172911 - RNA, 20 nt, Human
ccucuucugcuuaggagaga

SEQ ID NO: 2172912 - RNA, 21 nt, Human
ccucuucugggagggcagcag

SEQ ID NO: 2172913 - RNA, 18 nt, Human
ccucuucugggagggcag

SEQ ID NO: 2172914 - RNA, 17 nt, Human
ccucuucugggagggca

SEQ ID NO: 2172915 - RNA, 13 nt, Human
ccucuucugggag

SEQ ID NO: 2172916 - RNA, 12 nt, Human
ccucuucucuuc

SEQ ID NO: 2172917 - RNA, 14 nt, Human
ccucuucucuuccu

SEQ ID NO: 2172918 - RNA, 16 nt, Human
ccucuucucuuccugu

SEQ ID NO: 2172919 - RNA, 17 nt, Human
ccucuucucuuccugua

SEQ ID NO: 2172920 - RNA, 21 nt, Human
ccucugccugaagucacacag

SEQ ID NO: 2172921 - RNA, 19 nt, Human
ccucugccugucccucuca

SEQ ID NO: 2172922 - RNA, 21 nt, Human
ccucugccugaaccuuccauc

SEQ ID NO: 2172923 - RNA, 19 nt, Human
ccucugccugaaccuucca

SEQ ID NO: 2172924 - RNA, 14 nt, Human
ccucugccucaaug

SEQ ID NO: 2172925 - RNA, 15 nt, Human
ccucugccugucucc

SEQ ID NO: 2172926 - RNA, 22 nt, Human
ccucugccugucccucucaggc

SEQ ID NO: 2172927 - RNA, 13 nt, Human
ccucugcggaccc

SEQ ID NO: 2172928 - RNA, 19 nt, Human
ccucugccugucuccccca

SEQ ID NO: 2172929 - RNA, 16 nt, Human
ccucugcggaccccag

SEQ ID NO: 2172930 - RNA, 17 nt, Human
ccucugcggaccccagc

SEQ ID NO: 2172931 - RNA, 18 nt, Human
ccucugcggaccccagcu

SEQ ID NO: 2172932 - RNA, 20 nt, Human
ccucugcggaccccagcugu

SEQ ID NO: 2172933 - RNA, 11 nt, Human
ccucugcuacg

SEQ ID NO: 2172934 - RNA, 21 nt, Human
ccucugcuacguuccuauugu

SEQ ID NO: 2172935 - RNA, 16 nt, Human
ccugcagagagaagcc

SEQ ID NO: 2172936 - RNA, 13 nt, Human
ccugcagagagaa

SEQ ID NO: 2172937 - RNA, 15 nt, Human
ccugcagagagaagc

SEQ ID NO: 2172938 - RNA, 14 nt, Human
ccugcagagggcac

SEQ ID NO: 2172939 - RNA, 23 nt, Human
ccugcaggcagccaggccacaag

SEQ ID NO: 2172940 - RNA, 18 nt, Human
ccugcaggcagccaggcc

SEQ ID NO: 2172941 - RNA, 19 nt, Human
ccugcaggcagccaggcca

SEQ ID NO: 2172942 - RNA, 20 nt, Human
ccugcaggcagccaggccac

SEQ ID NO: 2172943 - RNA, 21 nt, Human
ccugcaggcagccaggccaca

SEQ ID NO: 2172944 - RNA, 15 nt, Human
ccugcaggcagccag

SEQ ID NO: 2172945 - RNA, 12 nt, Human
ccugcagagggc

SEQ ID NO: 2172946 - RNA, 16 nt, Human
ccugcaggcagccagg

SEQ ID NO: 2172947 - RNA, 17 nt, Human
ccugcaggcagccaggc

SEQ ID NO: 2172948 - RNA, 18 nt, Human
ccugaguuccuagccacc

SEQ ID NO: 2172949 - RNA, 16 nt, Human
ccugcagacucacugu

SEQ ID NO: 2172950 - RNA, 11 nt, Human
ccugcagagag

SEQ ID NO: 2172951 - RNA, 23 nt, Human
ccugaguggaucuccaaggacca

SEQ ID NO: 2172952 - RNA, 16 nt, Human
ccugaguggugccaaa

SEQ ID NO: 2172953 - RNA, 14 nt, Human
ccugaguuccuagc

SEQ ID NO: 2172954 - RNA, 17 nt, Human
ccugcagagcugcgggc

SEQ ID NO: 2172955 - RNA, 14 nt, Human
ccugcagagcugcg

SEQ ID NO: 2172956 - RNA, 13 nt, Human
ccugcagagcugc

SEQ ID NO: 2172957 - RNA, 12 nt, Human
ccugcagagcug

SEQ ID NO: 2172958 - RNA, 14 nt, Human
ccugagugccuggc

SEQ ID NO: 2172959 - RNA, 15 nt, Human
ccugagugccuggcc

SEQ ID NO: 2172960 - RNA, 13 nt, Human
ccugaguggaucu

SEQ ID NO: 2172961 - RNA, 14 nt, Human
ccugaguggaucuc

SEQ ID NO: 2172962 - RNA, 18 nt, Human
ccugaguggaucuccaag

SEQ ID NO: 2172963 - RNA, 14 nt, Human
ccugaguggugcca

SEQ ID NO: 2172964 - RNA, 19 nt, Human
ccugaguggaucuccaagg

SEQ ID NO: 2172965 - RNA, 20 nt, Human
ccugaguggaucuccaagga

SEQ ID NO: 2172966 - RNA, 16 nt, Human
ccugagucuccugugc

SEQ ID NO: 2172967 - RNA, 18 nt, Human
ccugagucuccugugccc

SEQ ID NO: 2172968 - RNA, 23 nt, Human
ccugagucugcuauauuuucaug

SEQ ID NO: 2172969 - RNA, 16 nt, Human
ccugaggggccucuua

SEQ ID NO: 2172970 - RNA, 23 nt, Human
ccugaggggcaucugccccuccc

SEQ ID NO: 2172971 - RNA, 22 nt, Human
ccugaggggcaucugccccucc

SEQ ID NO: 2172972 - RNA, 20 nt, Human
ccugaggggcaucugccccu

SEQ ID NO: 2172973 - RNA, 19 nt, Human
ccugaggggcaucugcccc

SEQ ID NO: 2172974 - RNA, 12 nt, Human
ccugaggggccu

SEQ ID NO: 2172975 - RNA, 18 nt, Human
ccugaggggcaucugccc

SEQ ID NO: 2172976 - RNA, 20 nt, Human
ccugacuccucuaagccacu

SEQ ID NO: 2172977 - RNA, 14 nt, Human
ccugaggcuguggu

SEQ ID NO: 2172978 - RNA, 16 nt, Human
ccugaccugucucacc

SEQ ID NO: 2172979 - RNA, 14 nt, Human
ccugaccugugagc

SEQ ID NO: 2172980 - RNA, 19 nt, Human
ccucuuuggcuccccugua

SEQ ID NO: 2172981 - RNA, 20 nt, Human
ccucuuuggcuccccuguac

SEQ ID NO: 2172982 - RNA, 21 nt, Human
ccugaccugugagcccagcug

SEQ ID NO: 2172983 - RNA, 20 nt, Human
ccugaccugugagcccagcu

SEQ ID NO: 2172984 - RNA, 19 nt, Human
ccugaccugugagcccagc

SEQ ID NO: 2172985 - RNA, 18 nt, Human
ccugaccugugagcccag

SEQ ID NO: 2172986 - RNA, 10 nt, Human
ccugacucaa

SEQ ID NO: 2172987 - RNA, 13 nt, Human
ccugacucauucu

SEQ ID NO: 2172988 - RNA, 22 nt, Human
ccugaccuugaggagucuugug

SEQ ID NO: 2172989 - RNA, 23 nt, Human
ccugaccuugaggagucuugugu

SEQ ID NO: 2172990 - RNA, 21 nt, Human
ccucuuugcuuugcuuucugc

SEQ ID NO: 2172991 - RNA, 21 nt, Human
ccugaccuugaggagucuugu

SEQ ID NO: 2172992 - RNA, 22 nt, Human
ccugaccugugagcccagcugg

SEQ ID NO: 2172993 - RNA, 13 nt, Human
ccugacuccucua

SEQ ID NO: 2172994 - RNA, 15 nt, Human
ccugacuccucuaag

SEQ ID NO: 2172995 - RNA, 18 nt, Human
ccugacucgucugacugu

SEQ ID NO: 2172996 - RNA, 17 nt, Human
ccugaggcugggcuccc

SEQ ID NO: 2172997 - RNA, 19 nt, Human
ccugaggcugggcucccuu

SEQ ID NO: 2172998 - RNA, 21 nt, Human
ccugaggcugggcucccuucc

SEQ ID NO: 2172999 - RNA, 20 nt, Human
caugggaaaugucaacaagu

SEQ ID NO: 2173000 - RNA, 19 nt, Human
caugggaagacgaggcccu

SEQ ID NO: 2173001 - RNA, 20 nt, Human
caugggaagacgaggcccuc

SEQ ID NO: 2173002 - RNA, 19 nt, Human
cauggcuugccacagcucu

SEQ ID NO: 2173003 - RNA, 15 nt, Human
cauggcuugccacag

SEQ ID NO: 2173004 - RNA, 18 nt, Human
cauggcuugccacagcuc

SEQ ID NO: 2173005 - RNA, 18 nt, Human
caugggaaagccaccucu

SEQ ID NO: 2173006 - RNA, 18 nt, Human
caugggaaaggggaaguu

SEQ ID NO: 2173007 - RNA, 14 nt, Human
cauggccgugaacu

SEQ ID NO: 2173008 - RNA, 16 nt, Human
cauggccuaugcacau

SEQ ID NO: 2173009 - RNA, 21 nt, Human
cauggccucuucagaucucua

SEQ ID NO: 2173010 - RNA, 15 nt, Human
cauggcuuccuccug

SEQ ID NO: 2173011 - RNA, 17 nt, Human
cauggcuuccuccugcg

SEQ ID NO: 2173012 - RNA, 20 nt, Human
cauggccuauuauauuaaaa

SEQ ID NO: 2173013 - RNA, 21 nt, Human
cauggccuauuauauuaaaau

SEQ ID NO: 2173014 - RNA, 16 nt, Human
cauggcuuccuccucc

SEQ ID NO: 2173015 - RNA, 18 nt, Human
cauggcuuccuccucccu

SEQ ID NO: 2173016 - RNA, 22 nt, Human
cauggccucuucagaucucuaa

SEQ ID NO: 2173017 - RNA, 17 nt, Human
cauggccuaugcacaua

SEQ ID NO: 2173018 - RNA, 19 nt, Human
cauggccuaugcacauaug

SEQ ID NO: 2173019 - RNA, 16 nt, Human
caugcuccuggcccac

SEQ ID NO: 2173020 - RNA, 14 nt, Human
caugcuccuggccc

SEQ ID NO: 2173021 - RNA, 17 nt, Human
caugcuccuggcccacu

SEQ ID NO: 2173022 - RNA, 20 nt, Human
caugcuccuggcccacugca

SEQ ID NO: 2173023 - RNA, 15 nt, Human
cauggccagguggcc

SEQ ID NO: 2173024 - RNA, 20 nt, Human
caugcaaggggaaaaucuca

SEQ ID NO: 2173025 - RNA, 19 nt, Human
caugcaaggggaaaaucuc

SEQ ID NO: 2173026 - RNA, 12 nt, Human
cauggccccucu

SEQ ID NO: 2173027 - RNA, 13 nt, Human
cauggccccucug

SEQ ID NO: 2173028 - RNA, 16 nt, Human
cauggccccucugacc

SEQ ID NO: 2173029 - RNA, 22 nt, Human
cauggcccucauuaaugacacu

SEQ ID NO: 2173030 - RNA, 15 nt, Human
cauggcccucauuaa

SEQ ID NO: 2173031 - RNA, 15 nt, Human
cauggccccugugag

SEQ ID NO: 2173032 - RNA, 16 nt, Human
cauggccccugugagu

SEQ ID NO: 2173033 - RNA, 17 nt, Human
cauggccccucugaccu

SEQ ID NO: 2173034 - RNA, 18 nt, Human
cauggccccucugaccug

SEQ ID NO: 2173035 - RNA, 14 nt, Human
cauggcccuggggu

SEQ ID NO: 2173036 - RNA, 12 nt, Human
cauggcccuggg

SEQ ID NO: 2173037 - RNA, 23 nt, Human
cauggcccucccaguaccuccug

SEQ ID NO: 2173038 - RNA, 14 nt, Human
cauggcccucccag

SEQ ID NO: 2173039 - RNA, 22 nt, Human
cauggcccucccaguaccuccu

SEQ ID NO: 2173040 - RNA, 14 nt, Human
caugcaaggggaaa

SEQ ID NO: 2173041 - RNA, 22 nt, Human
caugcaaaugcuguauucuucu

SEQ ID NO: 2173042 - RNA, 16 nt, Human
caugcaaaugcuguau

SEQ ID NO: 2173043 - RNA, 14 nt, Human
caugcaaaugcugu

SEQ ID NO: 2173044 - RNA, 16 nt, Human
caugcaaaggcuggga

SEQ ID NO: 2173045 - RNA, 14 nt, Human
caugcaaaggcugg

SEQ ID NO: 2173046 - RNA, 15 nt, Human
caugcaaaggcuggg

SEQ ID NO: 2173047 - RNA, 15 nt, Human
caugcaaggucauuu

SEQ ID NO: 2173048 - RNA, 12 nt, Human
caugcaagguca

SEQ ID NO: 2173049 - RNA, 17 nt, Human
caugacaagccccaggc

SEQ ID NO: 2173050 - RNA, 16 nt, Human
caugacaagccccagg

SEQ ID NO: 2173051 - RNA, 18 nt, Human
caugacaagccccaggca

SEQ ID NO: 2173052 - RNA, 23 nt, Human
caugauggagucagguuuggggu

SEQ ID NO: 2173053 - RNA, 19 nt, Human
caugauggagucagguuug

SEQ ID NO: 2173054 - RNA, 12 nt, Human
caugauggaguc

SEQ ID NO: 2173055 - RNA, 15 nt, Human
caugaugcugggauu

SEQ ID NO: 2173056 - RNA, 19 nt, Human
caugauggcaacagaucug

SEQ ID NO: 2173057 - RNA, 15 nt, Human
caugauggcaacaga

SEQ ID NO: 2173058 - RNA, 19 nt, Human
caugauggagcgcaccugc

SEQ ID NO: 2173059 - RNA, 18 nt, Human
caugauggagcgcaccug

SEQ ID NO: 2173060 - RNA, 16 nt, Human
caugaugcugggauuu

SEQ ID NO: 2173061 - RNA, 15 nt, Human
caugacaagccccag

SEQ ID NO: 2173062 - RNA, 14 nt, Human
caugacaagcccca

SEQ ID NO: 2173063 - RNA, 21 nt, Human
caugacaacuuugccagcuuu

SEQ ID NO: 2173064 - RNA, 19 nt, Human
caugacaacuuugccagcu

SEQ ID NO: 2173065 - RNA, 21 nt, Human
caugaauuuuuuucaucuucu

SEQ ID NO: 2173066 - RNA, 13 nt, Human
caugacaaagacu

SEQ ID NO: 2173067 - RNA, 16 nt, Human
caugaauuugugaagg

SEQ ID NO: 2173068 - RNA, 16 nt, Human
caugaaugcacacuag

SEQ ID NO: 2173069 - RNA, 22 nt, Human
caugaaugguauggaacucucu

SEQ ID NO: 2173070 - RNA, 21 nt, Human
caugaaucccacccacaugug

SEQ ID NO: 2173071 - RNA, 15 nt, Human
caugaaucgcuucuc

SEQ ID NO: 2173072 - RNA, 16 nt, Human
caugaaucgcuucucu

SEQ ID NO: 2173073 - RNA, 17 nt, Human
caugaaucgcuucucuu

SEQ ID NO: 2173074 - RNA, 18 nt, Human
caugaaucgcuucucuuu

SEQ ID NO: 2173075 - RNA, 20 nt, Human
caugaaucgcuucucuuuug

SEQ ID NO: 2173076 - RNA, 15 nt, Human
caugaaucugcaaug

SEQ ID NO: 2173077 - RNA, 21 nt, Human
caugaauauuuaguguucaua

SEQ ID NO: 2173078 - RNA, 20 nt, Human
caucugucaccaauugguua

SEQ ID NO: 2173079 - RNA, 23 nt, Human
caugaaguuuccuuggcuggugc

SEQ ID NO: 2173080 - RNA, 16 nt, Human
caugaauccaguccag

SEQ ID NO: 2173081 - RNA, 14 nt, Human
cauguucugcuuuc

SEQ ID NO: 2173082 - RNA, 13 nt, Human
cauguuaauuuca

SEQ ID NO: 2173083 - RNA, 18 nt, Human
cauguucuuaauucuuag

SEQ ID NO: 2173084 - RNA, 18 nt, Human
cauguuggccaggcuggu

SEQ ID NO: 2173085 - RNA, 17 nt, Human
cauguuggccaggcugg

SEQ ID NO: 2173086 - RNA, 19 nt, Human
cauguuggccaggcugguc

SEQ ID NO: 2173087 - RNA, 19 nt, Human
cauuauauuuauuacugua

SEQ ID NO: 2173088 - RNA, 19 nt, Human
cauuaucacuuuaaagccc

SEQ ID NO: 2173089 - RNA, 20 nt, Human
cauguuggccaggcugcucu

SEQ ID NO: 2173090 - RNA, 12 nt, Human
cauuaucaugug

SEQ ID NO: 2173091 - RNA, 13 nt, Human
cauuaucaugugu

SEQ ID NO: 2173092 - RNA, 14 nt, Human
cauuaucaugugua

SEQ ID NO: 2173093 - RNA, 15 nt, Human
cauuaucauguguaa

SEQ ID NO: 2173094 - RNA, 16 nt, Human
cauuaucauguguaau

SEQ ID NO: 2173095 - RNA, 18 nt, Human
cauuaucauguguaauca

SEQ ID NO: 2173096 - RNA, 22 nt, Human
cauuaucauguguaaucaauaa

SEQ ID NO: 2173097 - RNA, 13 nt, Human
cauuaucccugaa

SEQ ID NO: 2173098 - RNA, 17 nt, Human
cauguuacauaagauaa

SEQ ID NO: 2173099 - RNA, 16 nt, Human
cauguuacauaagaua

SEQ ID NO: 2173100 - RNA, 15 nt, Human
cauguccaagaagcc

SEQ ID NO: 2173101 - RNA, 16 nt, Human
cauguccaagaagccc

SEQ ID NO: 2173102 - RNA, 21 nt, Human
cauguuacauaagauaaaugu

SEQ ID NO: 2173103 - RNA, 17 nt, Human
cauguuaccuccuauaa

SEQ ID NO: 2173104 - RNA, 19 nt, Human
cauguauuggccuggaggu

SEQ ID NO: 2173105 - RNA, 16 nt, Human
cauguucuuaauucuu

SEQ ID NO: 2173106 - RNA, 13 nt, Human
cauguucuuaauu

SEQ ID NO: 2173107 - RNA, 22 nt, Human
cauguauguuuugguaucuguu

SEQ ID NO: 2173108 - RNA, 12 nt, Human
cauguauguuuu

SEQ ID NO: 2173109 - RNA, 21 nt, Human
cauguauguuuugguaucugu

SEQ ID NO: 2173110 - RNA, 17 nt, Human
cauguaugucuuggaca

SEQ ID NO: 2173111 - RNA, 18 nt, Human
cauguaugucuuggacac

SEQ ID NO: 2173112 - RNA, 21 nt, Human
cauguaugucuuggacacugu

SEQ ID NO: 2173113 - RNA, 22 nt, Human
cauguaugucuuggacacugua

SEQ ID NO: 2173114 - RNA, 23 nt, Human
cauguaucuaugcauuuucugga

SEQ ID NO: 2173115 - RNA, 13 nt, Human
cauguaugucuug

SEQ ID NO: 2173116 - RNA, 17 nt, Human
cauguauugcacauugu

SEQ ID NO: 2173117 - RNA, 18 nt, Human
cauguauugcacauugua

SEQ ID NO: 2173118 - RNA, 21 nt, Human
cauguauugcacauuguaaaa

SEQ ID NO: 2173119 - RNA, 15 nt, Human
cauguauuauuucau

SEQ ID NO: 2173120 - RNA, 14 nt, Human
cauguauuggccug

SEQ ID NO: 2173121 - RNA, 15 nt, Human
cauguauuggccugg

SEQ ID NO: 2173122 - RNA, 16 nt, Human
cauguauuggccugga

SEQ ID NO: 2173123 - RNA, 17 nt, Human
cauguauuggccuggag

SEQ ID NO: 2173124 - RNA, 18 nt, Human
cauguauuggccuggagg

SEQ ID NO: 2173125 - RNA, 20 nt, Human
cauucuccuuguguuacuaa

SEQ ID NO: 2173126 - RNA, 13 nt, Human
cauucucugaaga

SEQ ID NO: 2173127 - RNA, 12 nt, Human
cauucucugaag

SEQ ID NO: 2173128 - RNA, 20 nt, Human
cauucucucuccuguccaac

SEQ ID NO: 2173129 - RNA, 18 nt, Human
cauucucucuccugucca

SEQ ID NO: 2173130 - RNA, 16 nt, Human
cauucucucuccuguc

SEQ ID NO: 2173131 - RNA, 15 nt, Human
cauucucucuccugu

SEQ ID NO: 2173132 - RNA, 16 nt, Human
cauucucucuccugua

SEQ ID NO: 2173133 - RNA, 12 nt, Human
cauucucucucc

SEQ ID NO: 2173134 - RNA, 16 nt, Human
cauucugaaggagccc

SEQ ID NO: 2173135 - RNA, 23 nt, Human
cauucucugucucauccaucauc

SEQ ID NO: 2173136 - RNA, 19 nt, Human
cauucucugucucauccau

SEQ ID NO: 2173137 - RNA, 14 nt, Human
cauucucugucuca

SEQ ID NO: 2173138 - RNA, 23 nt, Human
cauuaucgggagcagugucuucc

SEQ ID NO: 2173139 - RNA, 21 nt, Human
cauuaucgggagcagugucuu

SEQ ID NO: 2173140 - RNA, 20 nt, Human
cauuaucgggagcagugucu

SEQ ID NO: 2173141 - RNA, 18 nt, Human
cauuaucgggagcagugu

SEQ ID NO: 2173142 - RNA, 17 nt, Human
cauuaucgggagcagug

SEQ ID NO: 2173143 - RNA, 14 nt, Human
cauuaucccugaau

SEQ ID NO: 2173144 - RNA, 16 nt, Human
cauuaucgggagcagu

SEQ ID NO: 2173145 - RNA, 13 nt, Human
cauuauuaucaac

SEQ ID NO: 2173146 - RNA, 19 nt, Human
cauuauuaguacugcucuu

SEQ ID NO: 2173147 - RNA, 17 nt, Human
cauucuccaccugccag

SEQ ID NO: 2173148 - RNA, 18 nt, Human
cauucuccaccugccagg

SEQ ID NO: 2173149 - RNA, 19 nt, Human
cauucuccaccugccaggg

SEQ ID NO: 2173150 - RNA, 21 nt, Human
cauucuccaccugccagggac

SEQ ID NO: 2173151 - RNA, 21 nt, Human
ccaacuccagaaagugacaag

SEQ ID NO: 2173152 - RNA, 21 nt, Human
ccaacucaccccagccccaaa

SEQ ID NO: 2173153 - RNA, 20 nt, Human
ccaaaucacugaacuuugcu

SEQ ID NO: 2173154 - RNA, 14 nt, Human
ccaacucaccugag

SEQ ID NO: 2173155 - RNA, 16 nt, Human
ccaagcucugcuccuc

SEQ ID NO: 2173156 - RNA, 12 nt, Human
ccaacuccagga

SEQ ID NO: 2173157 - RNA, 14 nt, Human
ccaagcucugcucc

SEQ ID NO: 2173158 - RNA, 15 nt, Human
ccaagcucugcuccu

SEQ ID NO: 2173159 - RNA, 15 nt, Human
ccaaaucaaaauaug

SEQ ID NO: 2173160 - RNA, 23 nt, Human
ccaaagugccacucauuccugua

SEQ ID NO: 2173161 - RNA, 15 nt, Human
ccaaaucagcugcua

SEQ ID NO: 2173162 - RNA, 23 nt, Human
ccaaaucagcugcuacuacuccu

SEQ ID NO: 2173163 - RNA, 16 nt, Human
ccaaaucauaguggcu

SEQ ID NO: 2173164 - RNA, 14 nt, Human
ccaacuauggccug

SEQ ID NO: 2173165 - RNA, 15 nt, Human
ccaacuauggccugu

SEQ ID NO: 2173166 - RNA, 16 nt, Human
ccaacuauggccugug

SEQ ID NO: 2173167 - RNA, 13 nt, Human
ccaacucacccca

SEQ ID NO: 2173168 - RNA, 11 nt, Human
ccaauucuuac

SEQ ID NO: 2173169 - RNA, 20 nt, Human
ccaauuccuugcacauagua

SEQ ID NO: 2173170 - RNA, 12 nt, Human
ccaauuccuugu

SEQ ID NO: 2173171 - RNA, 14 nt, Human
ccaauuccuuguag

SEQ ID NO: 2173172 - RNA, 16 nt, Human
ccaauucagacaggca

SEQ ID NO: 2173173 - RNA, 14 nt, Human
ccaauucagacagg

SEQ ID NO: 2173174 - RNA, 19 nt, Human
ccaauucgaacuuuuucca

SEQ ID NO: 2173175 - RNA, 21 nt, Human
ccaauucaacccuuugcccca

SEQ ID NO: 2173176 - RNA, 15 nt, Human
ccaauuauguuaaac

SEQ ID NO: 2173177 - RNA, 17 nt, Human
ccaauuauguuaaacua

SEQ ID NO: 2173178 - RNA, 21 nt, Human
ccaauggagacugucucaaga

SEQ ID NO: 2173179 - RNA, 14 nt, Human
ccaauuauguuaaa

SEQ ID NO: 2173180 - RNA, 23 nt, Human
ccaauggacuaacuugucuuugg

SEQ ID NO: 2173181 - RNA, 14 nt, Human
ccaaugggagcuca

SEQ ID NO: 2173182 - RNA, 20 nt, Human
ccaaggagggugagugcaag

SEQ ID NO: 2173183 - RNA, 12 nt, Human
ccaaggaggauu

SEQ ID NO: 2173184 - RNA, 18 nt, Human
ccaaugccccacuggcag

SEQ ID NO: 2173185 - RNA, 14 nt, Human
ccaaugcugauguc

SEQ ID NO: 2173186 - RNA, 18 nt, Human
ccaaugcuuuuaucaaac

SEQ ID NO: 2173187 - RNA, 17 nt, Human
ccaaugcugauguccuc

SEQ ID NO: 2173188 - RNA, 17 nt, Human
ccaauggaaccuccuuu

SEQ ID NO: 2173189 - RNA, 18 nt, Human
ccaauggaaccuccuuuc

SEQ ID NO: 2173190 - RNA, 19 nt, Human
ccaauggaaccuccuuucu

SEQ ID NO: 2173191 - RNA, 14 nt, Human
ccaaggagaugaag

SEQ ID NO: 2173192 - RNA, 23 nt, Human
ccaaggagaugaagcaaacacau

SEQ ID NO: 2173193 - RNA, 21 nt, Human
ccaaggaggaaaaacagacaa

SEQ ID NO: 2173194 - RNA, 13 nt, Human
ccaaggaggaaaa

SEQ ID NO: 2173195 - RNA, 22 nt, Human
ccaaggagcugcuauagccugg

SEQ ID NO: 2173196 - RNA, 16 nt, Human
ccaaggagcugcuaua

SEQ ID NO: 2173197 - RNA, 15 nt, Human
ccaaggagcugcuau

SEQ ID NO: 2173198 - RNA, 14 nt, Human
ccaaggagcugcua

SEQ ID NO: 2173199 - RNA, 13 nt, Human
ccaaggagcugcu

SEQ ID NO: 2173200 - RNA, 12 nt, Human
ccaaggagcugc

SEQ ID NO: 2173201 - RNA, 19 nt, Human
ccaaggagaaacagagaca

SEQ ID NO: 2173202 - RNA, 14 nt, Human
ccaaggagacacaa

SEQ ID NO: 2173203 - RNA, 21 nt, Human
ccaaggagaaacagagacagg

SEQ ID NO: 2173204 - RNA, 18 nt, Human
ccaaggagaaacagagac

SEQ ID NO: 2173205 - RNA, 15 nt, Human
ccaaggagaaacaga

SEQ ID NO: 2173206 - RNA, 14 nt, Human
ccaaggagaaacag

SEQ ID NO: 2173207 - RNA, 15 nt, Human
ccaaggacugccgac

SEQ ID NO: 2173208 - RNA, 13 nt, Human
ccaaggacugccg

SEQ ID NO: 2173209 - RNA, 11 nt, Human
ccaaggacugc

SEQ ID NO: 2173210 - RNA, 18 nt, Human
ccaaggaccccucaccuu

SEQ ID NO: 2173211 - RNA, 23 nt, Human
ccaaggacugagggacucugaag

SEQ ID NO: 2173212 - RNA, 22 nt, Human
ccaaggaccccucaccuugcaa

SEQ ID NO: 2173213 - RNA, 15 nt, Human
ccaaggacugaggga

SEQ ID NO: 2173214 - RNA, 18 nt, Human
ccaaggaaaccacagcug

SEQ ID NO: 2173215 - RNA, 19 nt, Human
ccaaggaaaccacagcugc

SEQ ID NO: 2173216 - RNA, 20 nt, Human
ccaaggaaaccacagcugcu

SEQ ID NO: 2173217 - RNA, 21 nt, Human
ccaaggaaaccacagcugcug

SEQ ID NO: 2173218 - RNA, 22 nt, Human
ccaaggaaaccacagcugcugg

SEQ ID NO: 2173219 - RNA, 23 nt, Human
ccaaggaaaccacagcugcugga

SEQ ID NO: 2173220 - RNA, 16 nt, Human
ccaaggaccccucacc

SEQ ID NO: 2173221 - RNA, 15 nt, Human
ccaaggaccccucac

SEQ ID NO: 2173222 - RNA, 14 nt, Human
ccaaggaccccuca

SEQ ID NO: 2173223 - RNA, 14 nt, Human
ccaaggaccagguu

SEQ ID NO: 2173224 - RNA, 13 nt, Human
ccaaggaccaggu

SEQ ID NO: 2173225 - RNA, 14 nt, Human
ccaaagugcuggga

SEQ ID NO: 2173226 - RNA, 16 nt, Human
ccaaagucuuaaaaua

SEQ ID NO: 2173227 - RNA, 13 nt, Human
ccaaaguauuuuu

SEQ ID NO: 2173228 - RNA, 22 nt, Human
ccaaaguacacuguuucaaacu

SEQ ID NO: 2173229 - RNA, 14 nt, Human
ccaaaagcugcuca

SEQ ID NO: 2173230 - RNA, 14 nt, Human
ccaaaagcacuuac

SEQ ID NO: 2173231 - RNA, 14 nt, Human
ccaaaaggcagaag

SEQ ID NO: 2173232 - RNA, 13 nt, Human
ccaaaaaaauacu

SEQ ID NO: 2173233 - RNA, 21 nt, Human
ccaaaagucaaaaggugccug

SEQ ID NO: 2173234 - RNA, 23 nt, Human
ccaaaagauugcugaaauuuuau

SEQ ID NO: 2173235 - RNA, 15 nt, Human
ccaaaagcuuuuuau

SEQ ID NO: 2173236 - RNA, 22 nt, Human
ccaaaagucaaaaggugccugu

SEQ ID NO: 2173237 - RNA, 15 nt, Human
ccaaaaguggccucu

SEQ ID NO: 2173238 - RNA, 21 nt, Human
ccaaaaguggccucuuugucu

SEQ ID NO: 2173239 - RNA, 18 nt, Human
ccaaaaguggccucuuug

SEQ ID NO: 2173240 - RNA, 21 nt, Human
cauuuuuuuucagcagacuau

SEQ ID NO: 2173241 - RNA, 23 nt, Human
cauuuuuuuuaagaaaaaggaug

SEQ ID NO: 2173242 - RNA, 16 nt, Human
cauuuguuggaaugaa

SEQ ID NO: 2173243 - RNA, 14 nt, Human
cauuuguauaaaau

SEQ ID NO: 2173244 - RNA, 16 nt, Human
cauuuguauaaaauaa

SEQ ID NO: 2173245 - RNA, 22 nt, Human
cauuugggguagcuagaggaac

SEQ ID NO: 2173246 - RNA, 17 nt, Human
cauuugggguagcuaga

SEQ ID NO: 2173247 - RNA, 21 nt, Human
cauuuggcagggguggcugcc

SEQ ID NO: 2173248 - RNA, 18 nt, Human
cauuuggcauuuauuugu

SEQ ID NO: 2173249 - RNA, 18 nt, Human
cauuugggagacauguga

SEQ ID NO: 2173250 - RNA, 20 nt, Human
cauuugggagacaugugaca

SEQ ID NO: 2173251 - RNA, 21 nt, Human
cauuuggugguuucagaaaug

SEQ ID NO: 2173252 - RNA, 20 nt, Human
cauuuggucaagauuuugaa

SEQ ID NO: 2173253 - RNA, 20 nt, Human
cauuuaucaaucaguauaau

SEQ ID NO: 2173254 - RNA, 18 nt, Human
cauuuaucaaucaguaua

SEQ ID NO: 2173255 - RNA, 20 nt, Human
cauuuauccaccuccaucuu

SEQ ID NO: 2173256 - RNA, 17 nt, Human
cauuuaucuuucuacag

SEQ ID NO: 2173257 - RNA, 17 nt, Human
cauuuaugagcucuuca

SEQ ID NO: 2173258 - RNA, 16 nt, Human
cauuuaugaagcaagc

SEQ ID NO: 2173259 - RNA, 19 nt, Human
cauuuggcagagcuucuuc

SEQ ID NO: 2173260 - RNA, 15 nt, Human
cauuuaugauuuaau

SEQ ID NO: 2173261 - RNA, 16 nt, Human
cauuuaugauuuaaua

SEQ ID NO: 2173262 - RNA, 23 nt, Human
cauuuaugagcucuucauguuuc

SEQ ID NO: 2173263 - RNA, 20 nt, Human
cauuuaugagcucuucaugu

SEQ ID NO: 2173264 - RNA, 18 nt, Human
cauuggguggguaaauuc

SEQ ID NO: 2173265 - RNA, 19 nt, Human
cauuggguggguaaauuca

SEQ ID NO: 2173266 - RNA, 23 nt, Human
cauuggguuguagccaaagguuc

SEQ ID NO: 2173267 - RNA, 21 nt, Human
cauuggguccugggucuuuca

SEQ ID NO: 2173268 - RNA, 20 nt, Human
cauuggguccugggucuuuc

SEQ ID NO: 2173269 - RNA, 16 nt, Human
cauuuaggugaggaag

SEQ ID NO: 2173270 - RNA, 14 nt, Human
cauugguggacuac

SEQ ID NO: 2173271 - RNA, 20 nt, Human
cauuuaguccaaugucuuuu

SEQ ID NO: 2173272 - RNA, 14 nt, Human
cauuuaguucuuug

SEQ ID NO: 2173273 - RNA, 17 nt, Human
cauuuagucaugugacc

SEQ ID NO: 2173274 - RNA, 20 nt, Human
cauuuaguucuuuguuauuu

SEQ ID NO: 2173275 - RNA, 17 nt, Human
cauuuaguuugauuauu

SEQ ID NO: 2173276 - RNA, 18 nt, Human
cauuuaggugaggaagca

SEQ ID NO: 2173277 - RNA, 14 nt, Human
cauugguucuugua

SEQ ID NO: 2173278 - RNA, 15 nt, Human
cauuuagguuucuga

SEQ ID NO: 2173279 - RNA, 15 nt, Human
cauuuagucauguga

SEQ ID NO: 2173280 - RNA, 18 nt, Human
cauuggacccacaugagg

SEQ ID NO: 2173281 - RNA, 16 nt, Human
cauuggacccuuccau

SEQ ID NO: 2173282 - RNA, 16 nt, Human
cauuggagauguuuag

SEQ ID NO: 2173283 - RNA, 20 nt, Human
cauuggauucugagagcugu

SEQ ID NO: 2173284 - RNA, 15 nt, Human
cauuggauucugaga

SEQ ID NO: 2173285 - RNA, 17 nt, Human
cauuggacccuuccaug

SEQ ID NO: 2173286 - RNA, 18 nt, Human
cauuggaagaccccaccc

SEQ ID NO: 2173287 - RNA, 20 nt, Human
cauuggaagaccccacccaa

SEQ ID NO: 2173288 - RNA, 17 nt, Human
cauuggaagaccccacc

SEQ ID NO: 2173289 - RNA, 16 nt, Human
caguucauguuugcuu

SEQ ID NO: 2173290 - RNA, 21 nt, Human
caguucaguggcagggcucag

SEQ ID NO: 2173291 - RNA, 22 nt, Human
caguucaguggcagggcucagg

SEQ ID NO: 2173292 - RNA, 23 nt, Human
caguucauauguaccauguacau

SEQ ID NO: 2173293 - RNA, 18 nt, Human
caguucaguaccuggagg

SEQ ID NO: 2173294 - RNA, 19 nt, Human
caguucaguaccuggagga

SEQ ID NO: 2173295 - RNA, 20 nt, Human
caguucaguaccuggaggag

SEQ ID NO: 2173296 - RNA, 21 nt, Human
caguucaguaccuggaggagg

SEQ ID NO: 2173297 - RNA, 22 nt, Human
caguucaguaccuggaggagga

SEQ ID NO: 2173298 - RNA, 18 nt, Human
caguucaguggcagggcu

SEQ ID NO: 2173299 - RNA, 19 nt, Human
caguucaguggcagggcuc

SEQ ID NO: 2173300 - RNA, 20 nt, Human
caguucaguggcagggcuca

SEQ ID NO: 2173301 - RNA, 23 nt, Human
caguucaguaauaaacuguguuu

SEQ ID NO: 2173302 - RNA, 15 nt, Human
caguucaguaccugg

SEQ ID NO: 2173303 - RNA, 16 nt, Human
caguucaguaccugga

SEQ ID NO: 2173304 - RNA, 23 nt, Human
caguucaggagucccaaggaaag

SEQ ID NO: 2173305 - RNA, 20 nt, Human
caguucaggagucccaagga

SEQ ID NO: 2173306 - RNA, 17 nt, Human
caguucaggagucccaa

SEQ ID NO: 2173307 - RNA, 17 nt, Human
caguucagcaccacccu

SEQ ID NO: 2173308 - RNA, 15 nt, Human
caguucagcuugggg

SEQ ID NO: 2173309 - RNA, 16 nt, Human
caguucagcaccaccc

SEQ ID NO: 2173310 - RNA, 13 nt, Human
caguucagcacca

SEQ ID NO: 2173311 - RNA, 14 nt, Human
caguucagcuuggg

SEQ ID NO: 2173312 - RNA, 23 nt, Human
caguucagaaucacuucugagaa

SEQ ID NO: 2173313 - RNA, 16 nt, Human
caguucaccugcacuu

SEQ ID NO: 2173314 - RNA, 14 nt, Human
caguucaagaaagc

SEQ ID NO: 2173315 - RNA, 13 nt, Human
caguucacccuga

SEQ ID NO: 2173316 - RNA, 19 nt, Human
caguucaaucucccgcugc

SEQ ID NO: 2173317 - RNA, 22 nt, Human
caguucaaucucccgcugcugc

SEQ ID NO: 2173318 - RNA, 23 nt, Human
caguucaaucucccgcugcugcu

SEQ ID NO: 2173319 - RNA, 20 nt, Human
caguuaugugaaugaucucu

SEQ ID NO: 2173320 - RNA, 18 nt, Human
caguuaugugaaugaucu

SEQ ID NO: 2173321 - RNA, 22 nt, Human
caguuaugauuuuuuuuucaua

SEQ ID NO: 2173322 - RNA, 22 nt, Human
caguuauuauauuuacaaaugg

SEQ ID NO: 2173323 - RNA, 15 nt, Human
caguucauugcacuu

SEQ ID NO: 2173324 - RNA, 21 nt, Human
caguucccagaaggcauauca

SEQ ID NO: 2173325 - RNA, 13 nt, Human
caguucccagaau

SEQ ID NO: 2173326 - RNA, 14 nt, Human
caguucccagaauc

SEQ ID NO: 2173327 - RNA, 23 nt, Human
caguucaguggcagggcucagga

SEQ ID NO: 2173328 - RNA, 18 nt, Human
caguucauguuugcuuca

SEQ ID NO: 2173329 - RNA, 18 nt, Human
caguucauugcacuuuga

SEQ ID NO: 2173330 - RNA, 23 nt, Human
caguucccagaaucaaagcaaug

SEQ ID NO: 2173331 - RNA, 15 nt, Human
caguucccagaauca

SEQ ID NO: 2173332 - RNA, 16 nt, Human
caguucccagaaucaa

SEQ ID NO: 2173333 - RNA, 15 nt, Human
cagugcaacacugaa

SEQ ID NO: 2173334 - RNA, 20 nt, Human
cagugcaaaugucagauaca

SEQ ID NO: 2173335 - RNA, 17 nt, Human
cagugcaacagcacugg

SEQ ID NO: 2173336 - RNA, 21 nt, Human
cagugcccacaggaucagucu

SEQ ID NO: 2173337 - RNA, 16 nt, Human
cagugcccaccaacau

SEQ ID NO: 2173338 - RNA, 19 nt, Human
cagugcaagagacucuggc

SEQ ID NO: 2173339 - RNA, 11 nt, Human
cagugcaagag

SEQ ID NO: 2173340 - RNA, 18 nt, Human
cagugcaagagacucugg

SEQ ID NO: 2173341 - RNA, 18 nt, Human
cagugcccacaggaucag

SEQ ID NO: 2173342 - RNA, 22 nt, Human
cagugcccacaggaucagucug

SEQ ID NO: 2173343 - RNA, 12 nt, Human
cagucugcugcc

SEQ ID NO: 2173344 - RNA, 22 nt, Human
cagugauuuuuuucuuguaauu

SEQ ID NO: 2173345 - RNA, 15 nt, Human
cagugcaaaugucag

SEQ ID NO: 2173346 - RNA, 19 nt, Human
cagugauuuuuuucuugua

SEQ ID NO: 2173347 - RNA, 23 nt, Human
cagucugauucccaagcucugcu

SEQ ID NO: 2173348 - RNA, 22 nt, Human
cagugauuaccagggacugagg

SEQ ID NO: 2173349 - RNA, 13 nt, Human
cagugggugcccc

SEQ ID NO: 2173350 - RNA, 23 nt, Human
cagugggucccacuuccccuccu

SEQ ID NO: 2173351 - RNA, 15 nt, Human
cagugguaagcucug

SEQ ID NO: 2173352 - RNA, 20 nt, Human
cagugguaugaucacggcuc

SEQ ID NO: 2173353 - RNA, 14 nt, Human
cagugggucccacu

SEQ ID NO: 2173354 - RNA, 15 nt, Human
cagugggucccacuu

SEQ ID NO: 2173355 - RNA, 17 nt, Human
cagugggucccacuucc

SEQ ID NO: 2173356 - RNA, 18 nt, Human
cagugggucccacuuccc

SEQ ID NO: 2173357 - RNA, 20 nt, Human
cagugggucccacuuccccu

SEQ ID NO: 2173358 - RNA, 22 nt, Human
cagugggucccacuuccccucc

SEQ ID NO: 2173359 - RNA, 16 nt, Human
cagugggagcugccug

SEQ ID NO: 2173360 - RNA, 21 nt, Human
cagugcccaccaacaucccau

SEQ ID NO: 2173361 - RNA, 17 nt, Human
cagugggagcugccugu

SEQ ID NO: 2173362 - RNA, 18 nt, Human
cagugggagcugccuguu

SEQ ID NO: 2173363 - RNA, 13 nt, Human
caguuacucugaa

SEQ ID NO: 2173364 - RNA, 18 nt, Human
caguuacucagcccuggg

SEQ ID NO: 2173365 - RNA, 17 nt, Human
caguuacucagcccugg

SEQ ID NO: 2173366 - RNA, 16 nt, Human
caguuacucagcccug

SEQ ID NO: 2173367 - RNA, 15 nt, Human
caguuacucagcccu

SEQ ID NO: 2173368 - RNA, 14 nt, Human
caguuacucagccc

SEQ ID NO: 2173369 - RNA, 13 nt, Human
caguuacucagcc

SEQ ID NO: 2173370 - RNA, 20 nt, Human
caguuacucagaauucucua

SEQ ID NO: 2173371 - RNA, 16 nt, Human
caguuacucugaaggg

SEQ ID NO: 2173372 - RNA, 15 nt, Human
caguuacucugaagg

SEQ ID NO: 2173373 - RNA, 19 nt, Human
caguuacucagcccugggc

SEQ ID NO: 2173374 - RNA, 19 nt, Human
caguuaggguugaguuacu

SEQ ID NO: 2173375 - RNA, 21 nt, Human
cagugcaagagacucuggccu

SEQ ID NO: 2173376 - RNA, 16 nt, Human
caguuagcaaacuuug

SEQ ID NO: 2173377 - RNA, 15 nt, Human
caguuagcaaacuuu

SEQ ID NO: 2173378 - RNA, 21 nt, Human
cagugguaugaucacggcuca

SEQ ID NO: 2173379 - RNA, 13 nt, Human
caguggucucaca

SEQ ID NO: 2173380 - RNA, 18 nt, Human
caguggucaaaccgcacu

SEQ ID NO: 2173381 - RNA, 19 nt, Human
cagugguccauggaaugcu

SEQ ID NO: 2173382 - RNA, 20 nt, Human
cagugguccacaucccggga

SEQ ID NO: 2173383 - RNA, 17 nt, Human
cagugguaagcucuggc

SEQ ID NO: 2173384 - RNA, 20 nt, Human
cagugguaagcucuggcuuu

SEQ ID NO: 2173385 - RNA, 23 nt, Human
caguggugaagaaaacuccuuua

SEQ ID NO: 2173386 - RNA, 14 nt, Human
caguggugaagaaa

SEQ ID NO: 2173387 - RNA, 17 nt, Human
caguggugaagaaaacu

SEQ ID NO: 2173388 - RNA, 19 nt, Human
caguggugcgaucuggguu

SEQ ID NO: 2173389 - RNA, 21 nt, Human
caguuauuauauuuacaaaug

SEQ ID NO: 2173390 - RNA, 17 nt, Human
caguuauuauauuuaca

SEQ ID NO: 2173391 - RNA, 20 nt, Human
caguuauggcuauaggugcu

SEQ ID NO: 2173392 - RNA, 19 nt, Human
caguuauggcuauaggugc

SEQ ID NO: 2173393 - RNA, 13 nt, Human
caguuauggcuau

SEQ ID NO: 2173394 - RNA, 21 nt, Human
caguuauaaguagcaggccaa

SEQ ID NO: 2173395 - RNA, 23 nt, Human
cagucuauccacagagaguccca

SEQ ID NO: 2173396 - RNA, 22 nt, Human
cagucuacccagagaagccccu

SEQ ID NO: 2173397 - RNA, 13 nt, Human
cagucuauccaca

SEQ ID NO: 2173398 - RNA, 15 nt, Human
cagucuauccacaga

SEQ ID NO: 2173399 - RNA, 16 nt, Human
cagucuauccacagag

SEQ ID NO: 2173400 - RNA, 17 nt, Human
cagucuauccacagaga

SEQ ID NO: 2173401 - RNA, 22 nt, Human
cagucuauccacagagaguccc

SEQ ID NO: 2173402 - RNA, 22 nt, Human
cagucucggguggcuagucaga

SEQ ID NO: 2173403 - RNA, 15 nt, Human
cagucucggguggcu

SEQ ID NO: 2173404 - RNA, 18 nt, Human
cagucucccuuucccuuc

SEQ ID NO: 2173405 - RNA, 22 nt, Human
cagucucccuucucccaugagg

SEQ ID NO: 2173406 - RNA, 22 nt, Human
cagucucccuuucccuucuugg

SEQ ID NO: 2173407 - RNA, 21 nt, Human
cagucugauucccaagcucug

SEQ ID NO: 2173408 - RNA, 22 nt, Human
cagucugauucccaagcucugc

SEQ ID NO: 2173409 - RNA, 21 nt, Human
cagucucucucucucucuccc

SEQ ID NO: 2173410 - RNA, 23 nt, Human
cagucuacccaccucagccuccu

SEQ ID NO: 2173411 - RNA, 14 nt, Human
cagucuacccagag

SEQ ID NO: 2173412 - RNA, 15 nt, Human
cagucuacccagaga

SEQ ID NO: 2173413 - RNA, 19 nt, Human
cagucuacccagagaagcc

SEQ ID NO: 2173414 - RNA, 21 nt, Human
cagucuacccaccucagccuc

SEQ ID NO: 2173415 - RNA, 18 nt, Human
cagucuaauuuuuauuca

SEQ ID NO: 2173416 - RNA, 13 nt, Human
cagucuaauuuuu

SEQ ID NO: 2173417 - RNA, 17 nt, Human
cagucuaauuuuuauuc

SEQ ID NO: 2173418 - RNA, 17 nt, Human
cagucgugccugugucc

SEQ ID NO: 2173419 - RNA, 15 nt, Human
cagucgugccugugu

SEQ ID NO: 2173420 - RNA, 16 nt, Human
caucuguaacucuaaa

SEQ ID NO: 2173421 - RNA, 17 nt, Human
caucuguaccucugccu

SEQ ID NO: 2173422 - RNA, 20 nt, Human
caucuguauaaguaagaaaa

SEQ ID NO: 2173423 - RNA, 21 nt, Human
caucuguauaaguaagaaaau

SEQ ID NO: 2173424 - RNA, 22 nt, Human
caucuguauaaguaagaaaaua

SEQ ID NO: 2173425 - RNA, 19 nt, Human
caucuguaacucuaaaaga

SEQ ID NO: 2173426 - RNA, 18 nt, Human
caucuguauacccucugu

SEQ ID NO: 2173427 - RNA, 19 nt, Human
caucuguauacccucuguu

SEQ ID NO: 2173428 - RNA, 20 nt, Human
caucuguauacccucuguuu

SEQ ID NO: 2173429 - RNA, 21 nt, Human
caucuguauacccucuguuuc

SEQ ID NO: 2173430 - RNA, 23 nt, Human
caucuggauaggagccugcuggu

SEQ ID NO: 2173431 - RNA, 23 nt, Human
caucuggccguugauguuggcug

SEQ ID NO: 2173432 - RNA, 16 nt, Human
caucuggauaggagcc

SEQ ID NO: 2173433 - RNA, 19 nt, Human
caucuaaccucaucuucuu

SEQ ID NO: 2173434 - RNA, 18 nt, Human
caucuaaccucaucuucu

SEQ ID NO: 2173435 - RNA, 20 nt, Human
caucuggcaacaucuuuauc

SEQ ID NO: 2173436 - RNA, 18 nt, Human
caucuggauaggagccug

SEQ ID NO: 2173437 - RNA, 20 nt, Human
caucuggauaggagccugcu

SEQ ID NO: 2173438 - RNA, 21 nt, Human
caucuggauaggagccugcug

SEQ ID NO: 2173439 - RNA, 22 nt, Human
caucuggauaggagccugcugg

SEQ ID NO: 2173440 - RNA, 22 nt, Human
caucguuuucuucacuguccuc

SEQ ID NO: 2173441 - RNA, 23 nt, Human
caucuaaaaauagacuuaaaucu

SEQ ID NO: 2173442 - RNA, 20 nt, Human
cauccugcagccuccuccug

SEQ ID NO: 2173443 - RNA, 20 nt, Human
cauccugccuuagagccagg

SEQ ID NO: 2173444 - RNA, 21 nt, Human
cauccugccuuagagccaggc

SEQ ID NO: 2173445 - RNA, 15 nt, Human
caucuaaauaccugc

SEQ ID NO: 2173446 - RNA, 15 nt, Human
caucuaaccucaucu

SEQ ID NO: 2173447 - RNA, 18 nt, Human
caucuaaauaccugcccu

SEQ ID NO: 2173448 - RNA, 21 nt, Human
caucuaaacugcccccucugc

SEQ ID NO: 2173449 - RNA, 15 nt, Human
caucuaaacugcccc

SEQ ID NO: 2173450 - RNA, 12 nt, Human
cauccugcaggc

SEQ ID NO: 2173451 - RNA, 22 nt, Human
cauccugacucugcccccugcu

SEQ ID NO: 2173452 - RNA, 17 nt, Human
cauccugacucugcccc

SEQ ID NO: 2173453 - RNA, 19 nt, Human
cauccugacucugcccccu

SEQ ID NO: 2173454 - RNA, 20 nt, Human
cauccugacucugcccccug

SEQ ID NO: 2173455 - RNA, 12 nt, Human
cauccugcagcc

SEQ ID NO: 2173456 - RNA, 19 nt, Human
cauccugaggcuccacuug

SEQ ID NO: 2173457 - RNA, 18 nt, Human
cauccugaggcuccacuu

SEQ ID NO: 2173458 - RNA, 14 nt, Human
caucagcuccagcu

SEQ ID NO: 2173459 - RNA, 13 nt, Human
caucagcugcuga

SEQ ID NO: 2173460 - RNA, 19 nt, Human
cauccauuccucagggaca

SEQ ID NO: 2173461 - RNA, 18 nt, Human
cauccauuccucagggac

SEQ ID NO: 2173462 - RNA, 17 nt, Human
cauccauuccucaggga

SEQ ID NO: 2173463 - RNA, 16 nt, Human
cauccauuccucaggg

SEQ ID NO: 2173464 - RNA, 19 nt, Human
cauccauuucaucuauuuc

SEQ ID NO: 2173465 - RNA, 22 nt, Human
cauccauuuauuuggcaucugu

SEQ ID NO: 2173466 - RNA, 19 nt, Human
caucccaaacccuucagug

SEQ ID NO: 2173467 - RNA, 14 nt, Human
caucagaaggagaa

SEQ ID NO: 2173468 - RNA, 19 nt, Human
caucagcacgauuucuguu

SEQ ID NO: 2173469 - RNA, 11 nt, Human
caucagaagga

SEQ ID NO: 2173470 - RNA, 20 nt, Human
caucagcauaccuuuauugu

SEQ ID NO: 2173471 - RNA, 13 nt, Human
caucagaagauaa

SEQ ID NO: 2173472 - RNA, 13 nt, Human
caucagcauaccu

SEQ ID NO: 2173473 - RNA, 17 nt, Human
caucagcauaccuuuau

SEQ ID NO: 2173474 - RNA, 18 nt, Human
caucagcauaccuuuauu

SEQ ID NO: 2173475 - RNA, 21 nt, Human
caucagcacgauuucuguuua

SEQ ID NO: 2173476 - RNA, 13 nt, Human
caucccacugcuc

SEQ ID NO: 2173477 - RNA, 14 nt, Human
caucccacacccug

SEQ ID NO: 2173478 - RNA, 11 nt, Human
caucccagccc

SEQ ID NO: 2173479 - RNA, 23 nt, Human
cauccauuucaucuauuucugag

SEQ ID NO: 2173480 - RNA, 20 nt, Human
cauccauuucaucuauuucu

SEQ ID NO: 2173481 - RNA, 23 nt, Human
caucccaaaaucauaagauauuu

SEQ ID NO: 2173482 - RNA, 15 nt, Human
caucccacaaguggu

SEQ ID NO: 2173483 - RNA, 13 nt, Human
caucccaacuguc

SEQ ID NO: 2173484 - RNA, 20 nt, Human
caucccaaacccuucagugc

SEQ ID NO: 2173485 - RNA, 12 nt, Human
caucccagcccc

SEQ ID NO: 2173486 - RNA, 22 nt, Human
cauccucuguacagagcccacg

SEQ ID NO: 2173487 - RNA, 14 nt, Human
cauccucuucugcu

SEQ ID NO: 2173488 - RNA, 11 nt, Human
caucccagagg

SEQ ID NO: 2173489 - RNA, 19 nt, Human
caucccacgcacuccauga

SEQ ID NO: 2173490 - RNA, 16 nt, Human
cauccugacucugccc

SEQ ID NO: 2173491 - RNA, 15 nt, Human
cauccucuucugcuu

SEQ ID NO: 2173492 - RNA, 18 nt, Human
cauccucuucugcuuagg

SEQ ID NO: 2173493 - RNA, 17 nt, Human
caucagaaacacccuca

SEQ ID NO: 2173494 - RNA, 17 nt, Human
caucacuuuucagugau

SEQ ID NO: 2173495 - RNA, 11 nt, Human
caucagaaagg

SEQ ID NO: 2173496 - RNA, 19 nt, Human
caucagaaacacccucaca

SEQ ID NO: 2173497 - RNA, 14 nt, Human
caucagaaaggaau

SEQ ID NO: 2173498 - RNA, 19 nt, Human
caucacuuguacaaaauaa

SEQ ID NO: 2173499 - RNA, 15 nt, Human
caucacuuuucagug

SEQ ID NO: 2173500 - RNA, 16 nt, Human
caucacuuuucaguga

SEQ ID NO: 2173501 - RNA, 15 nt, Human
caguuugagacagga

SEQ ID NO: 2173502 - RNA, 18 nt, Human
caguuugagacaggagac

SEQ ID NO: 2173503 - RNA, 16 nt, Human
caguuugagacaggag

SEQ ID NO: 2173504 - RNA, 23 nt, Human
caguuuguuaguaugaggcauuu

SEQ ID NO: 2173505 - RNA, 18 nt, Human
caguuuguuuacacacgu

SEQ ID NO: 2173506 - RNA, 14 nt, Human
caguuuguuuacac

SEQ ID NO: 2173507 - RNA, 16 nt, Human
caguuuguuuacacac

SEQ ID NO: 2173508 - RNA, 16 nt, Human
caguuuuaacuagaau

SEQ ID NO: 2173509 - RNA, 13 nt, Human
caguuuguuuaca

SEQ ID NO: 2173510 - RNA, 21 nt, Human
caguuuguuaguaugaggcau

SEQ ID NO: 2173511 - RNA, 22 nt, Human
caguuucagguguuuaguugca

SEQ ID NO: 2173512 - RNA, 15 nt, Human
caguuucagguguuu

SEQ ID NO: 2173513 - RNA, 17 nt, Human
caguuuccucaucuguc

SEQ ID NO: 2173514 - RNA, 23 nt, Human
caguuucacuuucacauagaugu

SEQ ID NO: 2173515 - RNA, 18 nt, Human
caguuucaauucagugcu

SEQ ID NO: 2173516 - RNA, 13 nt, Human
caguuugaacaaa

SEQ ID NO: 2173517 - RNA, 15 nt, Human
caguuucuuagcuuu

SEQ ID NO: 2173518 - RNA, 18 nt, Human
caguuucuuagcuuuuua

SEQ ID NO: 2173519 - RNA, 14 nt, Human
caguuucugccucu

SEQ ID NO: 2173520 - RNA, 15 nt, Human
caguuucuguccugc

SEQ ID NO: 2173521 - RNA, 19 nt, Human
caguuucuguccugcuggu

SEQ ID NO: 2173522 - RNA, 19 nt, Human
caguuuaucauucaagugu

SEQ ID NO: 2173523 - RNA, 23 nt, Human
caguuguucaauaauaaauauuu

SEQ ID NO: 2173524 - RNA, 14 nt, Human
caguuuaucauuca

SEQ ID NO: 2173525 - RNA, 15 nt, Human
caguuuaucauucaa

SEQ ID NO: 2173526 - RNA, 16 nt, Human
caguuuaucauucaag

SEQ ID NO: 2173527 - RNA, 18 nt, Human
caguuuaucauucaagug

SEQ ID NO: 2173528 - RNA, 18 nt, Human
caguuguuagugugucuu

SEQ ID NO: 2173529 - RNA, 22 nt, Human
caguuguuagugugucuuagug

SEQ ID NO: 2173530 - RNA, 11 nt, Human
caguuuuccuu

SEQ ID NO: 2173531 - RNA, 13 nt, Human
caguuuuccauug

SEQ ID NO: 2173532 - RNA, 18 nt, Human
caguuuuccaugaaaacg

SEQ ID NO: 2173533 - RNA, 17 nt, Human
caguuuuccaugaaaac

SEQ ID NO: 2173534 - RNA, 16 nt, Human
caguuuuccaugaaaa

SEQ ID NO: 2173535 - RNA, 15 nt, Human
caguuuuccaugaaa

SEQ ID NO: 2173536 - RNA, 14 nt, Human
caguuuuccaugaa

SEQ ID NO: 2173537 - RNA, 13 nt, Human
caguuuuccauga

SEQ ID NO: 2173538 - RNA, 12 nt, Human
caguuuuccaug

SEQ ID NO: 2173539 - RNA, 22 nt, Human
caguuuucaagucaaauuaaua

SEQ ID NO: 2173540 - RNA, 12 nt, Human
caguuuucauaa

SEQ ID NO: 2173541 - RNA, 15 nt, Human
caguuuuacucugcu

SEQ ID NO: 2173542 - RNA, 15 nt, Human
caguuuuaucauuuu

SEQ ID NO: 2173543 - RNA, 23 nt, Human
caguuuucaagucaaauuaauaa

SEQ ID NO: 2173544 - RNA, 18 nt, Human
caguuuuauccacagaaa

SEQ ID NO: 2173545 - RNA, 15 nt, Human
cauaauguauaaaga

SEQ ID NO: 2173546 - RNA, 14 nt, Human
cauaaugggguccu

SEQ ID NO: 2173547 - RNA, 14 nt, Human
cauaauguauuguu

SEQ ID NO: 2173548 - RNA, 11 nt, Human
cauaaugugaa

SEQ ID NO: 2173549 - RNA, 22 nt, Human
cauaaugggguccuggccaucc

SEQ ID NO: 2173550 - RNA, 14 nt, Human
cauaaugcuacugu

SEQ ID NO: 2173551 - RNA, 15 nt, Human
cauaaugcuacuguc

SEQ ID NO: 2173552 - RNA, 17 nt, Human
cauaauguuacauuauu

SEQ ID NO: 2173553 - RNA, 17 nt, Human
cauaaugugaaguguua

SEQ ID NO: 2173554 - RNA, 19 nt, Human
cauaaugugaaguguuaau

SEQ ID NO: 2173555 - RNA, 12 nt, Human
cauaaugugaag

SEQ ID NO: 2173556 - RNA, 13 nt, Human
cauaaugugaagu

SEQ ID NO: 2173557 - RNA, 15 nt, Human
cauaaugugaagugu

SEQ ID NO: 2173558 - RNA, 16 nt, Human
cauaaugugaaguguu

SEQ ID NO: 2173559 - RNA, 13 nt, Human
caguuuuccuucu

SEQ ID NO: 2173560 - RNA, 19 nt, Human
caguuuuccaugaaaacgu

SEQ ID NO: 2173561 - RNA, 16 nt, Human
cauaaugcuacugucu

SEQ ID NO: 2173562 - RNA, 23 nt, Human
cauaaugcgugcauaccacuuuu

SEQ ID NO: 2173563 - RNA, 23 nt, Human
cauacaggaagguagaaauaucu

SEQ ID NO: 2173564 - RNA, 16 nt, Human
cauacagggauggugu

SEQ ID NO: 2173565 - RNA, 18 nt, Human
cauacagcauuacaaauu

SEQ ID NO: 2173566 - RNA, 12 nt, Human
cauacagcucua

SEQ ID NO: 2173567 - RNA, 21 nt, Human
cauacaggauuugaacucaga

SEQ ID NO: 2173568 - RNA, 16 nt, Human
cauacaguuugcacuu

SEQ ID NO: 2173569 - RNA, 19 nt, Human
cauacagggaugguguuca

SEQ ID NO: 2173570 - RNA, 17 nt, Human
cauaauuaugacaguua

SEQ ID NO: 2173571 - RNA, 15 nt, Human
cauaauuaugacagu

SEQ ID NO: 2173572 - RNA, 19 nt, Human
cauaauuaugacaguuaua

SEQ ID NO: 2173573 - RNA, 18 nt, Human
cauaauuauuauuuggcc

SEQ ID NO: 2173574 - RNA, 14 nt, Human
cauaauuaugacag

SEQ ID NO: 2173575 - RNA, 15 nt, Human
cauaauuaaaguguc

SEQ ID NO: 2173576 - RNA, 16 nt, Human
cauaauuaaagugucc

SEQ ID NO: 2173577 - RNA, 17 nt, Human
cauaauuaaagugucca

SEQ ID NO: 2173578 - RNA, 18 nt, Human
cauaauuaaaguguccau

SEQ ID NO: 2173579 - RNA, 18 nt, Human
cauaauguuacauuauua

SEQ ID NO: 2173580 - RNA, 14 nt, Human
cauaauuaaagugu

SEQ ID NO: 2173581 - RNA, 18 nt, Human
cauagcagauuuuaauuu

SEQ ID NO: 2173582 - RNA, 16 nt, Human
cauagguauuucaaaa

SEQ ID NO: 2173583 - RNA, 14 nt, Human
cauaggucacuggc

SEQ ID NO: 2173584 - RNA, 15 nt, Human
cauaggucacuggcu

SEQ ID NO: 2173585 - RNA, 16 nt, Human
cauagcagauuuuaau

SEQ ID NO: 2173586 - RNA, 17 nt, Human
cauagcagauuuuaauu

SEQ ID NO: 2173587 - RNA, 23 nt, Human
cauagcagagaaugaaagggccc

SEQ ID NO: 2173588 - RNA, 19 nt, Human
cauagcagcuuauucacaa

SEQ ID NO: 2173589 - RNA, 13 nt, Human
cauauguaaaaua

SEQ ID NO: 2173590 - RNA, 16 nt, Human
cauaggugaucucauu

SEQ ID NO: 2173591 - RNA, 21 nt, Human
cauaggucacuggcucuccaa

SEQ ID NO: 2173592 - RNA, 16 nt, Human
cauaggucacuggcuc

SEQ ID NO: 2173593 - RNA, 17 nt, Human
cauaggucacuggcucu

SEQ ID NO: 2173594 - RNA, 18 nt, Human
cauaggucacuggcucuc

SEQ ID NO: 2173595 - RNA, 19 nt, Human
cauaggucacuggcucucc

SEQ ID NO: 2173596 - RNA, 16 nt, Human
cauagguuuaauaauu

SEQ ID NO: 2173597 - RNA, 13 nt, Human
cauauuaugucuu

SEQ ID NO: 2173598 - RNA, 21 nt, Human
cauauuauuuuauguugcaua

SEQ ID NO: 2173599 - RNA, 14 nt, Human
cauauuaggaaaau

SEQ ID NO: 2173600 - RNA, 20 nt, Human
cauauuaggaaaauaugggu

SEQ ID NO: 2173601 - RNA, 15 nt, Human
cauauguuacacuaa

SEQ ID NO: 2173602 - RNA, 17 nt, Human
cauaugugaauauggac

SEQ ID NO: 2173603 - RNA, 17 nt, Human
cauauguugaauacuuu

SEQ ID NO: 2173604 - RNA, 16 nt, Human
cauauguugaauacuu

SEQ ID NO: 2173605 - RNA, 22 nt, Human
cauauuaccacagacauacuaa

SEQ ID NO: 2173606 - RNA, 19 nt, Human
cauauguugaauacuuuuu

SEQ ID NO: 2173607 - RNA, 18 nt, Human
cauauguugaauacuuuu

SEQ ID NO: 2173608 - RNA, 14 nt, Human
cauauguaaaauaa

SEQ ID NO: 2173609 - RNA, 21 nt, Human
cauauguaccauguacaugaa

SEQ ID NO: 2173610 - RNA, 17 nt, Human
cauauguauuccugauc

SEQ ID NO: 2173611 - RNA, 22 nt, Human
cauagguucacaccauuuuguu

SEQ ID NO: 2173612 - RNA, 15 nt, Human
cauauguaccaugua

SEQ ID NO: 2173613 - RNA, 23 nt, Human
caggaccucaggugagaagcaga

SEQ ID NO: 2173614 - RNA, 16 nt, Human
caggaccucaggugag

SEQ ID NO: 2173615 - RNA, 21 nt, Human
caggacccaucacgccugugc

SEQ ID NO: 2173616 - RNA, 20 nt, Human
caggacccaccaugucugcc

SEQ ID NO: 2173617 - RNA, 16 nt, Human
caggacccagaggaag

SEQ ID NO: 2173618 - RNA, 15 nt, Human
caggacccagaggaa

SEQ ID NO: 2173619 - RNA, 14 nt, Human
caggacccagagga

SEQ ID NO: 2173620 - RNA, 13 nt, Human
caggacccagagg

SEQ ID NO: 2173621 - RNA, 16 nt, Human
caggaccaugggacca

SEQ ID NO: 2173622 - RNA, 22 nt, Human
caggaccaugggaccaggucuu

SEQ ID NO: 2173623 - RNA, 21 nt, Human
caggaccagucaaccugggca

SEQ ID NO: 2173624 - RNA, 13 nt, Human
caggaccagcuca

SEQ ID NO: 2173625 - RNA, 12 nt, Human
caggaccagcuc

SEQ ID NO: 2173626 - RNA, 21 nt, Human
caggaccagggauuuccauga

SEQ ID NO: 2173627 - RNA, 12 nt, Human
caggaccacaaa

SEQ ID NO: 2173628 - RNA, 17 nt, Human
caggacaugcugaagcc

SEQ ID NO: 2173629 - RNA, 18 nt, Human
caggacauuucucuaaga

SEQ ID NO: 2173630 - RNA, 14 nt, Human
caggacauuucucu

SEQ ID NO: 2173631 - RNA, 12 nt, Human
caggacauuucu

SEQ ID NO: 2173632 - RNA, 23 nt, Human
caggacaugcgguagccagcaca

SEQ ID NO: 2173633 - RNA, 13 nt, Human
caggacaugcuga

SEQ ID NO: 2173634 - RNA, 16 nt, Human
caggacaugcugaagc

SEQ ID NO: 2173635 - RNA, 16 nt, Human
caggaccacaaaaaug

SEQ ID NO: 2173636 - RNA, 15 nt, Human
caggaggcugagggg

SEQ ID NO: 2173637 - RNA, 21 nt, Human
caggaggcugaggcaggagga

SEQ ID NO: 2173638 - RNA, 20 nt, Human
caggaggcugaggcaggagg

SEQ ID NO: 2173639 - RNA, 19 nt, Human
caggaggcugaggcaggag

SEQ ID NO: 2173640 - RNA, 18 nt, Human
caggaggcugaggcagga

SEQ ID NO: 2173641 - RNA, 17 nt, Human
caggaggcugaggcagg

SEQ ID NO: 2173642 - RNA, 21 nt, Human
caggaggcugaggcagaagaa

SEQ ID NO: 2173643 - RNA, 20 nt, Human
caggaggcugaggcagaaga

SEQ ID NO: 2173644 - RNA, 18 nt, Human
caggaggcugaggcagaa

SEQ ID NO: 2173645 - RNA, 17 nt, Human
caggaggcugaggcaga

SEQ ID NO: 2173646 - RNA, 16 nt, Human
caggaggcugaggcag

SEQ ID NO: 2173647 - RNA, 15 nt, Human
caggaggcugaggca

SEQ ID NO: 2173648 - RNA, 13 nt, Human
caggaggcugagg

SEQ ID NO: 2173649 - RNA, 12 nt, Human
caggaggcugag

SEQ ID NO: 2173650 - RNA, 20 nt, Human
caggaggccccuggcccagc

SEQ ID NO: 2173651 - RNA, 19 nt, Human
caggaggccggggccgggu

SEQ ID NO: 2173652 - RNA, 14 nt, Human
caggcaaugcuggc

SEQ ID NO: 2173653 - RNA, 15 nt, Human
caggcaaugcuggcu

SEQ ID NO: 2173654 - RNA, 16 nt, Human
caggcaaugcuggcug

SEQ ID NO: 2173655 - RNA, 17 nt, Human
caggcaaugcuggcugu

SEQ ID NO: 2173656 - RNA, 19 nt, Human
caggaggacugccccgugc

SEQ ID NO: 2173657 - RNA, 19 nt, Human
caggaggacaauucaugaa

SEQ ID NO: 2173658 - RNA, 22 nt, Human
caggaggacaauucaugaacuu

SEQ ID NO: 2173659 - RNA, 23 nt, Human
caggaggaaucaugucaggccug

SEQ ID NO: 2173660 - RNA, 13 nt, Human
caggaggacaauu

SEQ ID NO: 2173661 - RNA, 15 nt, Human
caggaggacaauuca

SEQ ID NO: 2173662 - RNA, 16 nt, Human
caggaggacaauucau

SEQ ID NO: 2173663 - RNA, 22 nt, Human
caggaggauugcuugagcccag

SEQ ID NO: 2173664 - RNA, 15 nt, Human
caggaggaggugcca

SEQ ID NO: 2173665 - RNA, 19 nt, Human
caggaggaggugccaacag

SEQ ID NO: 2173666 - RNA, 23 nt, Human
caggaggagacuagauuuaugaa

SEQ ID NO: 2173667 - RNA, 23 nt, Human
caggaggacugccccgugcagac

SEQ ID NO: 2173668 - RNA, 21 nt, Human
caggaggacugccccgugcag

SEQ ID NO: 2173669 - RNA, 19 nt, Human
caggaggaucacuugaguc

SEQ ID NO: 2173670 - RNA, 14 nt, Human
caggaggccccugg

SEQ ID NO: 2173671 - RNA, 18 nt, Human
caggaggccaggccggcg

SEQ ID NO: 2173672 - RNA, 16 nt, Human
caggaggccccuggcc

SEQ ID NO: 2173673 - RNA, 17 nt, Human
caggaggccccuggccc

SEQ ID NO: 2173674 - RNA, 18 nt, Human
caggaggccccuggccca

SEQ ID NO: 2173675 - RNA, 19 nt, Human
caggaggccccuggcccag

SEQ ID NO: 2173676 - RNA, 22 nt, Human
caggaggccagccuugaccauu

SEQ ID NO: 2173677 - RNA, 18 nt, Human
caggaggccagccuugac

SEQ ID NO: 2173678 - RNA, 19 nt, Human
caggaggccagccuugacc

SEQ ID NO: 2173679 - RNA, 14 nt, Human
caggccaggccagc

SEQ ID NO: 2173680 - RNA, 14 nt, Human
caggccaggccacc

SEQ ID NO: 2173681 - RNA, 16 nt, Human
caggccaggccaccag

SEQ ID NO: 2173682 - RNA, 18 nt, Human
caggccaggccaccagga

SEQ ID NO: 2173683 - RNA, 22 nt, Human
caggcacugagauaccagcgag

SEQ ID NO: 2173684 - RNA, 23 nt, Human
caggcacuagccuuuggcucugg

SEQ ID NO: 2173685 - RNA, 20 nt, Human
caggcacucaaugcagccag

SEQ ID NO: 2173686 - RNA, 11 nt, Human
caggccaggcc

SEQ ID NO: 2173687 - RNA, 12 nt, Human
caggccaggccc

SEQ ID NO: 2173688 - RNA, 21 nt, Human
caggcacgaacccaccugcug

SEQ ID NO: 2173689 - RNA, 20 nt, Human
caggcacgaacccaccugcu

SEQ ID NO: 2173690 - RNA, 16 nt, Human
caggcacuagccuuug

SEQ ID NO: 2173691 - RNA, 22 nt, Human
caggcacuagccuuuggcucug

SEQ ID NO: 2173692 - RNA, 22 nt, Human
caggcacgaacccaccugcuga

SEQ ID NO: 2173693 - RNA, 19 nt, Human
caggcacgaacccaccugc

SEQ ID NO: 2173694 - RNA, 17 nt, Human
caggcacgaacccaccu

SEQ ID NO: 2173695 - RNA, 16 nt, Human
caggcacgaacccacc

SEQ ID NO: 2173696 - RNA, 19 nt, Human
caggcaccuuaguggcuuu

SEQ ID NO: 2173697 - RNA, 15 nt, Human
caggcaccucacaga

SEQ ID NO: 2173698 - RNA, 16 nt, Human
caggcaccucacagaa

SEQ ID NO: 2173699 - RNA, 20 nt, Human
caggcaccucacagaaauga

SEQ ID NO: 2173700 - RNA, 17 nt, Human
caggcaccgagaauguu

SEQ ID NO: 2173701 - RNA, 16 nt, Human
caggcaccgagaaugu

SEQ ID NO: 2173702 - RNA, 13 nt, Human
caggcaccgagaa

SEQ ID NO: 2173703 - RNA, 13 nt, Human
caggcacccuucu

SEQ ID NO: 2173704 - RNA, 16 nt, Human
caggcacccuucuuuc

SEQ ID NO: 2173705 - RNA, 21 nt, Human
caggcacccuucuuuccucuu

SEQ ID NO: 2173706 - RNA, 23 nt, Human
caggcacccuucuuuccucuucc

SEQ ID NO: 2173707 - RNA, 21 nt, Human
caggaggcuuggaaagcauca

SEQ ID NO: 2173708 - RNA, 18 nt, Human
caggcacccccuggagag

SEQ ID NO: 2173709 - RNA, 21 nt, Human
caggcacccccuggagagaag

SEQ ID NO: 2173710 - RNA, 19 nt, Human
cagggagaccgagcgcuuu

SEQ ID NO: 2173711 - RNA, 22 nt, Human
cagggagaccgagcgcuuucug

SEQ ID NO: 2173712 - RNA, 19 nt, Human
cagggagacccguccauuu

SEQ ID NO: 2173713 - RNA, 12 nt, Human
cagggagacaga

SEQ ID NO: 2173714 - RNA, 18 nt, Human
caggcuacucuccucggc

SEQ ID NO: 2173715 - RNA, 18 nt, Human
caggcugggcaaggaggc

SEQ ID NO: 2173716 - RNA, 13 nt, Human
cagggagaagcuc

SEQ ID NO: 2173717 - RNA, 15 nt, Human
caggcuacucuccuc

SEQ ID NO: 2173718 - RNA, 16 nt, Human
caggcuacucuccucg

SEQ ID NO: 2173719 - RNA, 22 nt, Human
caggcugggagagccuuccagg

SEQ ID NO: 2173720 - RNA, 23 nt, Human
caggcugggagagccuuccaggg

SEQ ID NO: 2173721 - RNA, 21 nt, Human
cagggagcaggcggugggcac

SEQ ID NO: 2173722 - RNA, 17 nt, Human
cagggagaggccaugau

SEQ ID NO: 2173723 - RNA, 16 nt, Human
cagggagaggccauga

SEQ ID NO: 2173724 - RNA, 23 nt, Human
cagggagaggagugacugagcuu

SEQ ID NO: 2173725 - RNA, 19 nt, Human
cagggagcauuuuccucca

SEQ ID NO: 2173726 - RNA, 15 nt, Human
cagggagcauggcug

SEQ ID NO: 2173727 - RNA, 15 nt, Human
cagggcuacccuccc

SEQ ID NO: 2173728 - RNA, 17 nt, Human
cagggcuaagagcuagc

SEQ ID NO: 2173729 - RNA, 17 nt, Human
cagggcuacccuccccc

SEQ ID NO: 2173730 - RNA, 14 nt, Human
cagggcuacccuga

SEQ ID NO: 2173731 - RNA, 18 nt, Human
cagggcuacccugagcug

SEQ ID NO: 2173732 - RNA, 16 nt, Human
cagggcuacccugagc

SEQ ID NO: 2173733 - RNA, 13 nt, Human
cagggcucugccc

SEQ ID NO: 2173734 - RNA, 19 nt, Human
cagggcucugccccagagg

SEQ ID NO: 2173735 - RNA, 20 nt, Human
cagggcucugccccagaggc

SEQ ID NO: 2173736 - RNA, 21 nt, Human
cagggcucucuuuccuucuug

SEQ ID NO: 2173737 - RNA, 22 nt, Human
cagggcucucuuuccuucuugc

SEQ ID NO: 2173738 - RNA, 24 nt, Human
cagggcucucuuuccuucuugccu

SEQ ID NO: 2173739 - RNA, 12 nt, Human
cagggcucugac

SEQ ID NO: 2173740 - RNA, 15 nt, Human
cagggcucugaccag

SEQ ID NO: 2173741 - RNA, 15 nt, Human
cagggcucugcccca

SEQ ID NO: 2173742 - RNA, 13 nt, Human
cagggcuccuggg

SEQ ID NO: 2173743 - RNA, 23 nt, Human
cagggcuccugccuucuguccug

SEQ ID NO: 2173744 - RNA, 12 nt, Human
cagggcuccugg

SEQ ID NO: 2173745 - RNA, 20 nt, Human
cagggcuccugccuucuguc

SEQ ID NO: 2173746 - RNA, 22 nt, Human
cagggcuccugccuucuguccu

SEQ ID NO: 2173747 - RNA, 20 nt, Human
cagggcucucuuuccuucuu

SEQ ID NO: 2173748 - RNA, 14 nt, Human
cagggcucagccug

SEQ ID NO: 2173749 - RNA, 13 nt, Human
cagggcucagccu

SEQ ID NO: 2173750 - RNA, 12 nt, Human
cagggcucagcc

SEQ ID NO: 2173751 - RNA, 11 nt, Human
cagggcuccug

SEQ ID NO: 2173752 - RNA, 12 nt, Human
cagggcuccugc

SEQ ID NO: 2173753 - RNA, 14 nt, Human
cagggcuccugcac

SEQ ID NO: 2173754 - RNA, 19 nt, Human
cagggcucacgugggaacc

SEQ ID NO: 2173755 - RNA, 13 nt, Human
cagggcuccugcc

SEQ ID NO: 2173756 - RNA, 24 nt, Human
cagggcuacccugagcugaggcag

SEQ ID NO: 2173757 - RNA, 23 nt, Human
cagggcuacccugagcugaggca

SEQ ID NO: 2173758 - RNA, 22 nt, Human
cagggcuacccugagcugaggc

SEQ ID NO: 2173759 - RNA, 19 nt, Human
cagggcuacccugagcuga

SEQ ID NO: 2173760 - RNA, 14 nt, Human
cagggcuagugacu

SEQ ID NO: 2173761 - RNA, 15 nt, Human
cagggcuagugacuu

SEQ ID NO: 2173762 - RNA, 18 nt, Human
cagggcuagugacuugug

SEQ ID NO: 2173763 - RNA, 19 nt, Human
cagggagcauggcugugag

SEQ ID NO: 2173764 - RNA, 19 nt, Human
cagggcuauagcucaggac

SEQ ID NO: 2173765 - RNA, 17 nt, Human
caggggaaaaucagccu

SEQ ID NO: 2173766 - RNA, 14 nt, Human
caggggaaaagagg

SEQ ID NO: 2173767 - RNA, 16 nt, Human
caggggaaaagaggag

SEQ ID NO: 2173768 - RNA, 22 nt, Human
caggccuuaucuccaagaccag

SEQ ID NO: 2173769 - RNA, 17 nt, Human
caggccuuaucuccaag

SEQ ID NO: 2173770 - RNA, 16 nt, Human
caggccuuaucuccaa

SEQ ID NO: 2173771 - RNA, 12 nt, Human
caggccugugug

SEQ ID NO: 2173772 - RNA, 16 nt, Human
caggcgauccaccugu

SEQ ID NO: 2173773 - RNA, 15 nt, Human
caggcgaggccugga

SEQ ID NO: 2173774 - RNA, 11 nt, Human
caggccuugcg

SEQ ID NO: 2173775 - RNA, 19 nt, Human
caggcgauccaccugucuc

SEQ ID NO: 2173776 - RNA, 13 nt, Human
caggcguucagcu

SEQ ID NO: 2173777 - RNA, 21 nt, Human
caggcgugagccaccgugccu

SEQ ID NO: 2173778 - RNA, 21 nt, Human
caggcugggagagccuuccag

SEQ ID NO: 2173779 - RNA, 14 nt, Human
caggcuacucuccu

SEQ ID NO: 2173780 - RNA, 20 nt, Human
caggcuacacugacacuggu

SEQ ID NO: 2173781 - RNA, 19 nt, Human
caggcuaaggcguggagcu

SEQ ID NO: 2173782 - RNA, 13 nt, Human
caggcuacacuga

SEQ ID NO: 2173783 - RNA, 23 nt, Human
caggcuaaacauccaauauuuuc

SEQ ID NO: 2173784 - RNA, 22 nt, Human
caggcguucagcucacuguucu

SEQ ID NO: 2173785 - RNA, 22 nt, Human
caggcguagaucaccagaauaa

SEQ ID NO: 2173786 - RNA, 19 nt, Human
caggcguucagcucacugu

SEQ ID NO: 2173787 - RNA, 11 nt, Human
caggcuacugu

SEQ ID NO: 2173788 - RNA, 15 nt, Human
caggccguggcugcc

SEQ ID NO: 2173789 - RNA, 22 nt, Human
caggccguccucccgggcccuc

SEQ ID NO: 2173790 - RNA, 22 nt, Human
caggccggugugggcugugucg

SEQ ID NO: 2173791 - RNA, 20 nt, Human
caggccgggguggagcaugg

SEQ ID NO: 2173792 - RNA, 18 nt, Human
caggccguccucccgggc

SEQ ID NO: 2173793 - RNA, 19 nt, Human
caggccggugugggcugug

SEQ ID NO: 2173794 - RNA, 19 nt, Human
caggccgggguggagcaug

SEQ ID NO: 2173795 - RNA, 17 nt, Human
caggccguggcugccca

SEQ ID NO: 2173796 - RNA, 19 nt, Human
caggccguggcugcccaca

SEQ ID NO: 2173797 - RNA, 12 nt, Human
caggccuccuac

SEQ ID NO: 2173798 - RNA, 18 nt, Human
caggccugggucuguguc

SEQ ID NO: 2173799 - RNA, 16 nt, Human
caggccugggucugug

SEQ ID NO: 2173800 - RNA, 19 nt, Human
caggccucuuggcagucac

SEQ ID NO: 2173801 - RNA, 20 nt, Human
caggccugggucugugucuc

SEQ ID NO: 2173802 - RNA, 19 nt, Human
caggccugggucugugucu

SEQ ID NO: 2173803 - RNA, 15 nt, Human
caggccugaaagagg

SEQ ID NO: 2173804 - RNA, 20 nt, Human
caggccugaaagaggcugag

SEQ ID NO: 2173805 - RNA, 22 nt, Human
caggccucuguguccuucccug

SEQ ID NO: 2173806 - RNA, 12 nt, Human
caggccucuugg

SEQ ID NO: 2173807 - RNA, 15 nt, Human
caggccucuuggcag

SEQ ID NO: 2173808 - RNA, 18 nt, Human
caggccucuuggcaguca

SEQ ID NO: 2173809 - RNA, 12 nt, Human
caggccucugug

SEQ ID NO: 2173810 - RNA, 13 nt, Human
caggccucugugu

SEQ ID NO: 2173811 - RNA, 14 nt, Human
caggccucuguguc

SEQ ID NO: 2173812 - RNA, 15 nt, Human
caggccucugugucc

SEQ ID NO: 2173813 - RNA, 17 nt, Human
caggccucuguguccuu

SEQ ID NO: 2173814 - RNA, 14 nt, Human
caggccuccuacag

SEQ ID NO: 2173815 - RNA, 20 nt, Human
caggccggcgagcccugugg

SEQ ID NO: 2173816 - RNA, 19 nt, Human
cagcgcuggguccacccca

SEQ ID NO: 2173817 - RNA, 20 nt, Human
cagcgcuggccgggaccccg

SEQ ID NO: 2173818 - RNA, 22 nt, Human
cagcggagguguggagccgagg

SEQ ID NO: 2173819 - RNA, 13 nt, Human
cagcggccccucc

SEQ ID NO: 2173820 - RNA, 15 nt, Human
cagcggccccuccca

SEQ ID NO: 2173821 - RNA, 16 nt, Human
cagcggccccucccac

SEQ ID NO: 2173822 - RNA, 12 nt, Human
cagcuaaagcaa

SEQ ID NO: 2173823 - RNA, 15 nt, Human
cagcggccccugcau

SEQ ID NO: 2173824 - RNA, 16 nt, Human
cagcggccccugcauc

SEQ ID NO: 2173825 - RNA, 20 nt, Human
cagcguuugaggggcuggcc

SEQ ID NO: 2173826 - RNA, 22 nt, Human
cagcguuugaggggcuggccuu

SEQ ID NO: 2173827 - RNA, 17 nt, Human
cagcggccccucccaca

SEQ ID NO: 2173828 - RNA, 18 nt, Human
cagcggccccucccacac

SEQ ID NO: 2173829 - RNA, 19 nt, Human
cagcggccccucccacaca

SEQ ID NO: 2173830 - RNA, 14 nt, Human
cagcggccccugca

SEQ ID NO: 2173831 - RNA, 22 nt, Human
cagcuaaagcccaaccuccuga

SEQ ID NO: 2173832 - RNA, 17 nt, Human
cagcuaacaauugugaa

SEQ ID NO: 2173833 - RNA, 15 nt, Human
cagcuaacacacagc

SEQ ID NO: 2173834 - RNA, 18 nt, Human
cagcuaaagcccaaccuc

SEQ ID NO: 2173835 - RNA, 19 nt, Human
cagcuaaagcaauaugcau

SEQ ID NO: 2173836 - RNA, 15 nt, Human
cagcuaacauggaag

SEQ ID NO: 2173837 - RNA, 16 nt, Human
cagcuaacacacagcu

SEQ ID NO: 2173838 - RNA, 17 nt, Human
cagcuaacacacagcuc

SEQ ID NO: 2173839 - RNA, 18 nt, Human
cagcuaacacacagcucc

SEQ ID NO: 2173840 - RNA, 20 nt, Human
cagcuaacacacagcuccca

SEQ ID NO: 2173841 - RNA, 16 nt, Human
cagccugcuccagcug

SEQ ID NO: 2173842 - RNA, 15 nt, Human
cagccugcuccagcu

SEQ ID NO: 2173843 - RNA, 22 nt, Human
cagcgccuuucccaacucuagc

SEQ ID NO: 2173844 - RNA, 14 nt, Human
cagcgccuuuccca

SEQ ID NO: 2173845 - RNA, 19 nt, Human
cagccugcuccagcuguuc

SEQ ID NO: 2173846 - RNA, 17 nt, Human
cagccugcuccagcugu

SEQ ID NO: 2173847 - RNA, 14 nt, Human
cagcugccucacuu

SEQ ID NO: 2173848 - RNA, 18 nt, Human
cagcugagcgccaggaug

SEQ ID NO: 2173849 - RNA, 16 nt, Human
cagcugagcgccagga

SEQ ID NO: 2173850 - RNA, 14 nt, Human
cagcugagcgccag

SEQ ID NO: 2173851 - RNA, 21 nt, Human
cagcugacuuuucuguccgag

SEQ ID NO: 2173852 - RNA, 21 nt, Human
cagcugagagacuuuuaauca

SEQ ID NO: 2173853 - RNA, 17 nt, Human
cagcugagagaaaauaa

SEQ ID NO: 2173854 - RNA, 22 nt, Human
cagcugagcacauucuggcuca

SEQ ID NO: 2173855 - RNA, 17 nt, Human
cagcugucccugucacc

SEQ ID NO: 2173856 - RNA, 16 nt, Human
cagcugucccugucac

SEQ ID NO: 2173857 - RNA, 15 nt, Human
cagcugucccuguca

SEQ ID NO: 2173858 - RNA, 14 nt, Human
cagcugucccuguc

SEQ ID NO: 2173859 - RNA, 13 nt, Human
cagcugucccugu

SEQ ID NO: 2173860 - RNA, 12 nt, Human
cagcugucccug

SEQ ID NO: 2173861 - RNA, 14 nt, Human
cagcuuauugucua

SEQ ID NO: 2173862 - RNA, 17 nt, Human
cagcugccucacuuccu

SEQ ID NO: 2173863 - RNA, 20 nt, Human
cagcuguaugauucccagcc

SEQ ID NO: 2173864 - RNA, 18 nt, Human
cagcugucccugucacca

SEQ ID NO: 2173865 - RNA, 13 nt, Human
cagcuucaccaga

SEQ ID NO: 2173866 - RNA, 14 nt, Human
cagcuucaccagag

SEQ ID NO: 2173867 - RNA, 20 nt, Human
cagcuuauugucuagugaaa

SEQ ID NO: 2173868 - RNA, 20 nt, Human
caggaaacuccacaucugcc

SEQ ID NO: 2173869 - RNA, 21 nt, Human
caggaaacuccacaucugccu

SEQ ID NO: 2173870 - RNA, 22 nt, Human
caggaaacuccacaucugccuu

SEQ ID NO: 2173871 - RNA, 23 nt, Human
caggaaacuccacaucugccuua

SEQ ID NO: 2173872 - RNA, 16 nt, Human
cagcuucaccagagca

SEQ ID NO: 2173873 - RNA, 19 nt, Human
caggaaacuccacaucugc

SEQ ID NO: 2173874 - RNA, 19 nt, Human
caggaaaggcuccaggagc

SEQ ID NO: 2173875 - RNA, 20 nt, Human
caggaaaggcuccaggagca

SEQ ID NO: 2173876 - RNA, 16 nt, Human
caggaaaggcuccagg

SEQ ID NO: 2173877 - RNA, 17 nt, Human
caggaaaggcuccagga

SEQ ID NO: 2173878 - RNA, 16 nt, Human
caggaaagagaacuuc

SEQ ID NO: 2173879 - RNA, 20 nt, Human
caggaaagagaacuuccaga

SEQ ID NO: 2173880 - RNA, 13 nt, Human
cagacuccugagg

SEQ ID NO: 2173881 - RNA, 14 nt, Human
cagacuccugagga

SEQ ID NO: 2173882 - RNA, 20 nt, Human
cagacucccauuccugaaga

SEQ ID NO: 2173883 - RNA, 19 nt, Human
cagacucccauuccugaag

SEQ ID NO: 2173884 - RNA, 18 nt, Human
cagacaggguucauugaa

SEQ ID NO: 2173885 - RNA, 19 nt, Human
cagacaguguuuucuggga

SEQ ID NO: 2173886 - RNA, 22 nt, Human
cagacucgauucauauugaaua

SEQ ID NO: 2173887 - RNA, 21 nt, Human
cagacuccugugcaacuuucc

SEQ ID NO: 2173888 - RNA, 16 nt, Human
cagacuccugaggaca

SEQ ID NO: 2173889 - RNA, 20 nt, Human
cagacuccugaggacagcug

SEQ ID NO: 2173890 - RNA, 17 nt, Human
cagacucuacagaggcc

SEQ ID NO: 2173891 - RNA, 22 nt, Human
cagacaggcaagcaccuccugc

SEQ ID NO: 2173892 - RNA, 23 nt, Human
cagacaggcaagcaccuccugcc

SEQ ID NO: 2173893 - RNA, 22 nt, Human
cagacaggcucuuagcagcuuc

SEQ ID NO: 2173894 - RNA, 18 nt, Human
cagacaggcucuuagcag

SEQ ID NO: 2173895 - RNA, 20 nt, Human
cagacaggcucuuagcagcu

SEQ ID NO: 2173896 - RNA, 20 nt, Human
cagacaggccccgugaggca

SEQ ID NO: 2173897 - RNA, 14 nt, Human
cagacaggcucuua

SEQ ID NO: 2173898 - RNA, 15 nt, Human
cagacaggccccgug

SEQ ID NO: 2173899 - RNA, 18 nt, Human
cagacaggcaaauaaaag

SEQ ID NO: 2173900 - RNA, 20 nt, Human
cagacugaacuuaccgugag

SEQ ID NO: 2173901 - RNA, 20 nt, Human
cagacugacaaauguguauc

SEQ ID NO: 2173902 - RNA, 23 nt, Human
cagacucuuuuuguaccugguga

SEQ ID NO: 2173903 - RNA, 14 nt, Human
cagacucuggucuu

SEQ ID NO: 2173904 - RNA, 12 nt, Human
cagacucucugu

SEQ ID NO: 2173905 - RNA, 17 nt, Human
cagacucucugugaacc

SEQ ID NO: 2173906 - RNA, 23 nt, Human
cagacucuacagaggccaugggc

SEQ ID NO: 2173907 - RNA, 21 nt, Human
cagacuccugaggacagcugu

SEQ ID NO: 2173908 - RNA, 18 nt, Human
cagacucuacagaggcca

SEQ ID NO: 2173909 - RNA, 19 nt, Human
cagacucuacagaggccau

SEQ ID NO: 2173910 - RNA, 20 nt, Human
cagacucuacagaggccaug

SEQ ID NO: 2173911 - RNA, 21 nt, Human
cagacucuacagaggccaugg

SEQ ID NO: 2173912 - RNA, 18 nt, Human
cagacugcgauuuguccc

SEQ ID NO: 2173913 - RNA, 13 nt, Human
cagacugcuggga

SEQ ID NO: 2173914 - RNA, 16 nt, Human
cagacugcugggacug

SEQ ID NO: 2173915 - RNA, 15 nt, Human
cagacugcugggacu

SEQ ID NO: 2173916 - RNA, 23 nt, Human
cagacugcugggacuggccaggu

SEQ ID NO: 2173917 - RNA, 20 nt, Human
cagacugcugggacuggcca

SEQ ID NO: 2173918 - RNA, 20 nt, Human
cagacugcuuccaauuuucu

SEQ ID NO: 2173919 - RNA, 14 nt, Human
cagacugcuuccaa

SEQ ID NO: 2173920 - RNA, 13 nt, Human
cagacuggaagca

SEQ ID NO: 2173921 - RNA, 14 nt, Human
cagacuggaagcac

SEQ ID NO: 2173922 - RNA, 16 nt, Human
cagacuggaagcacag

SEQ ID NO: 2173923 - RNA, 17 nt, Human
cagacuggaagcacagc

SEQ ID NO: 2173924 - RNA, 18 nt, Human
cagacuggaagcacagcu

SEQ ID NO: 2173925 - RNA, 17 nt, Human
cagacuggugagcagac

SEQ ID NO: 2173926 - RNA, 15 nt, Human
cagacuggugagcag

SEQ ID NO: 2173927 - RNA, 18 nt, Human
cagacuggguuucuagcc

SEQ ID NO: 2173928 - RNA, 20 nt, Human
cagacuggguuucuagccca

SEQ ID NO: 2173929 - RNA, 12 nt, Human
cagacuggaggg

SEQ ID NO: 2173930 - RNA, 15 nt, Human
cagacuggguuucua

SEQ ID NO: 2173931 - RNA, 16 nt, Human
cagacuggcuggcugc

SEQ ID NO: 2173932 - RNA, 11 nt, Human
cagacuggagg

SEQ ID NO: 2173933 - RNA, 18 nt, Human
cagacugcauguaguugg

SEQ ID NO: 2173934 - RNA, 23 nt, Human
cagacuggcacaguuuucugaga

SEQ ID NO: 2173935 - RNA, 22 nt, Human
cagacuggcacaguuuucugag

SEQ ID NO: 2173936 - RNA, 20 nt, Human
cagacuggaagcacagcuuc

SEQ ID NO: 2173937 - RNA, 21 nt, Human
cagacuggaagcacagcuuca

SEQ ID NO: 2173938 - RNA, 18 nt, Human
cagacuggcacaguuuuc

SEQ ID NO: 2173939 - RNA, 17 nt, Human
cagacuggcacaguuuu

SEQ ID NO: 2173940 - RNA, 14 nt, Human
cagacagacacaca

SEQ ID NO: 2173941 - RNA, 15 nt, Human
cagacagacacacac

SEQ ID NO: 2173942 - RNA, 16 nt, Human
cagacagcagcucagg

SEQ ID NO: 2173943 - RNA, 15 nt, Human
cagacagcagcucag

SEQ ID NO: 2173944 - RNA, 13 nt, Human
cagacagcagcuc

SEQ ID NO: 2173945 - RNA, 21 nt, Human
cagacagcaacggggaggcca

SEQ ID NO: 2173946 - RNA, 21 nt, Human
cagacagauggaaaagggaga

SEQ ID NO: 2173947 - RNA, 19 nt, Human
cagacagaggaugagcucu

SEQ ID NO: 2173948 - RNA, 16 nt, Human
cagacagacacacaca

SEQ ID NO: 2173949 - RNA, 19 nt, Human
cagacagacaucucugcac

SEQ ID NO: 2173950 - RNA, 14 nt, Human
cagacagaggauga

SEQ ID NO: 2173951 - RNA, 12 nt, Human
cagacagaggau

SEQ ID NO: 2173952 - RNA, 19 nt, Human
cagacagcagcucaggcac

SEQ ID NO: 2173953 - RNA, 18 nt, Human
cagacagcagcucaggca

SEQ ID NO: 2173954 - RNA, 17 nt, Human
cagacagcagcucaggc

SEQ ID NO: 2173955 - RNA, 14 nt, Human
cagacagcccucca

SEQ ID NO: 2173956 - RNA, 12 nt, Human
cagacagccugu

SEQ ID NO: 2173957 - RNA, 13 nt, Human
cagacagccugua

SEQ ID NO: 2173958 - RNA, 14 nt, Human
cagacagccuguau

SEQ ID NO: 2173959 - RNA, 16 nt, Human
cagacagccuguaucu

SEQ ID NO: 2173960 - RNA, 13 nt, Human
cagacagcugccu

SEQ ID NO: 2173961 - RNA, 14 nt, Human
cagacagcugccug

SEQ ID NO: 2173962 - RNA, 20 nt, Human
cagacaggaaagggaaggcc

SEQ ID NO: 2173963 - RNA, 15 nt, Human
cagacaggaaaggga

SEQ ID NO: 2173964 - RNA, 19 nt, Human
cagacagcucccucugccu

SEQ ID NO: 2173965 - RNA, 17 nt, Human
cagacagcucccucugc

SEQ ID NO: 2173966 - RNA, 12 nt, Human
cagacagcuccc

SEQ ID NO: 2173967 - RNA, 11 nt, Human
cagacagcucc

SEQ ID NO: 2173968 - RNA, 21 nt, Human
cagacagcuccacccuggccg

SEQ ID NO: 2173969 - RNA, 13 nt, Human
cagacaggaccag

SEQ ID NO: 2173970 - RNA, 15 nt, Human
cagacaggaccaggg

SEQ ID NO: 2173971 - RNA, 16 nt, Human
cagacaggaccaggga

SEQ ID NO: 2173972 - RNA, 15 nt, Human
cagacagcugccugg

SEQ ID NO: 2173973 - RNA, 16 nt, Human
cagacagcugccuggg

SEQ ID NO: 2173974 - RNA, 17 nt, Human
cagacagcugccuggga

SEQ ID NO: 2173975 - RNA, 18 nt, Human
cagacagcugccugggau

SEQ ID NO: 2173976 - RNA, 11 nt, Human
cagacaggcaa

SEQ ID NO: 2173977 - RNA, 23 nt, Human
cagacaggaaagggaaggcccca

SEQ ID NO: 2173978 - RNA, 21 nt, Human
cagacaggagaaaugcaucca

SEQ ID NO: 2173979 - RNA, 12 nt, Human
cagacaggagga

SEQ ID NO: 2173980 - RNA, 13 nt, Human
cagacaggagaaa

SEQ ID NO: 2173981 - RNA, 17 nt, Human
cagacaggaccagggau

SEQ ID NO: 2173982 - RNA, 24 nt, Human
cagacaggaccagggauuuccaug

SEQ ID NO: 2173983 - RNA, 13 nt, Human
cagacaggcaagc

SEQ ID NO: 2173984 - RNA, 18 nt, Human
cagacaggcaagcaccuc

SEQ ID NO: 2173985 - RNA, 20 nt, Human
cagacaggcaagcaccuccu

SEQ ID NO: 2173986 - RNA, 21 nt, Human
cagacaggcaagcaccuccug

SEQ ID NO: 2173987 - RNA, 14 nt, Human
cagacuuaccagga

SEQ ID NO: 2173988 - RNA, 23 nt, Human
cagacuguuagaaaauggacacu

SEQ ID NO: 2173989 - RNA, 24 nt, Human
cagacuguuagaaaauggacacug

SEQ ID NO: 2173990 - RNA, 18 nt, Human
cagacuuaccaggaagca

SEQ ID NO: 2173991 - RNA, 14 nt, Human
cagacuucacacug

SEQ ID NO: 2173992 - RNA, 20 nt, Human
cagacuggugagcagacugg

SEQ ID NO: 2173993 - RNA, 21 nt, Human
cagacuguguaaaaagagagc

SEQ ID NO: 2173994 - RNA, 23 nt, Human
cagacugguugaguucagguagc

SEQ ID NO: 2173995 - RNA, 22 nt, Human
cagacuguguaaaaagagagcu

SEQ ID NO: 2173996 - RNA, 12 nt, Human
cagacuguguau

SEQ ID NO: 2173997 - RNA, 14 nt, Human
cagacuguguauuc

SEQ ID NO: 2173998 - RNA, 23 nt, Human
cagacuguguauucauugaaguc

SEQ ID NO: 2173999 - RNA, 15 nt, Human
cagccaggccccagg

SEQ ID NO: 2174000 - RNA, 12 nt, Human
cagccaggcggg

SEQ ID NO: 2174001 - RNA, 13 nt, Human
cagccaggcgggc

SEQ ID NO: 2174002 - RNA, 18 nt, Human
cagccaggccacuggccc

SEQ ID NO: 2174003 - RNA, 16 nt, Human
cagccagcccagccca

SEQ ID NO: 2174004 - RNA, 15 nt, Human
cagccagcccagccc

SEQ ID NO: 2174005 - RNA, 14 nt, Human
cagccagcccagcc

SEQ ID NO: 2174006 - RNA, 13 nt, Human
cagccagcccagc

SEQ ID NO: 2174007 - RNA, 19 nt, Human
cagccagcccagcccagcu

SEQ ID NO: 2174008 - RNA, 17 nt, Human
cagccagcccagcccag

SEQ ID NO: 2174009 - RNA, 20 nt, Human
cagccagcccagcccagcug

SEQ ID NO: 2174010 - RNA, 12 nt, Human
cagccagcccag

SEQ ID NO: 2174011 - RNA, 11 nt, Human
cagccagccca

SEQ ID NO: 2174012 - RNA, 20 nt, Human
cagccagacuggcacaguuu

SEQ ID NO: 2174013 - RNA, 18 nt, Human
cagccagacuggcacagu

SEQ ID NO: 2174014 - RNA, 15 nt, Human
cagccagacuggcac

SEQ ID NO: 2174015 - RNA, 19 nt, Human
cagcacuaaagcaguggac

SEQ ID NO: 2174016 - RNA, 17 nt, Human
cagcacuaaagcagugg

SEQ ID NO: 2174017 - RNA, 14 nt, Human
cagcacuaaagcag

SEQ ID NO: 2174018 - RNA, 10 nt, Human
cagcacuaac

SEQ ID NO: 2174019 - RNA, 20 nt, Human
cagcacuaaagcaguggaca

SEQ ID NO: 2174020 - RNA, 11 nt, Human
cagcacuacuc

SEQ ID NO: 2174021 - RNA, 14 nt, Human
cagcacuacucugu

SEQ ID NO: 2174022 - RNA, 15 nt, Human
cagcacucacacagg

SEQ ID NO: 2174023 - RNA, 20 nt, Human
cagccagaccuauuccuccu

SEQ ID NO: 2174024 - RNA, 22 nt, Human
cagccagaccuauuccuccugg

SEQ ID NO: 2174025 - RNA, 14 nt, Human
cagccagacuggca

SEQ ID NO: 2174026 - RNA, 18 nt, Human
cagcacgggggccaagga

SEQ ID NO: 2174027 - RNA, 17 nt, Human
cagcacguguggccugu

SEQ ID NO: 2174028 - RNA, 13 nt, Human
cagcaccugucuc

SEQ ID NO: 2174029 - RNA, 12 nt, Human
cagcaccuggca

SEQ ID NO: 2174030 - RNA, 15 nt, Human
cagcacgauuucugu

SEQ ID NO: 2174031 - RNA, 14 nt, Human
cagcacgauuucug

SEQ ID NO: 2174032 - RNA, 12 nt, Human
cagccaggcugc

SEQ ID NO: 2174033 - RNA, 22 nt, Human
cagccaggcucugugcugaccc

SEQ ID NO: 2174034 - RNA, 23 nt, Human
cagccaggcucugugcugacccu

SEQ ID NO: 2174035 - RNA, 15 nt, Human
cagccaggcucugug

SEQ ID NO: 2174036 - RNA, 16 nt, Human
cagccaggcucugugc

SEQ ID NO: 2174037 - RNA, 17 nt, Human
cagccaggcucugugcu

SEQ ID NO: 2174038 - RNA, 18 nt, Human
cagccaggcucugugcug

SEQ ID NO: 2174039 - RNA, 14 nt, Human
cagccaggcucugu

SEQ ID NO: 2174040 - RNA, 19 nt, Human
cagccaggcgggcucaagg

SEQ ID NO: 2174041 - RNA, 20 nt, Human
cagccaggcgggcucaagga

SEQ ID NO: 2174042 - RNA, 14 nt, Human
cagccaggcgggcu

SEQ ID NO: 2174043 - RNA, 15 nt, Human
cagccaggcgggcuc

SEQ ID NO: 2174044 - RNA, 16 nt, Human
cagccaggcgggcuca

SEQ ID NO: 2174045 - RNA, 18 nt, Human
cagccaggcgggcucaag

SEQ ID NO: 2174046 - RNA, 16 nt, Human
cagccaggcugccaag

SEQ ID NO: 2174047 - RNA, 13 nt, Human
cagccaggcugcc

SEQ ID NO: 2174048 - RNA, 22 nt, Human
cagccaggcugccaaggccaga

SEQ ID NO: 2174049 - RNA, 16 nt, Human
cagcaccccugucucu

SEQ ID NO: 2174050 - RNA, 13 nt, Human
cagcaccccuucc

SEQ ID NO: 2174051 - RNA, 14 nt, Human
cagcaccccuucca

SEQ ID NO: 2174052 - RNA, 15 nt, Human
cagcaccccuuccau

SEQ ID NO: 2174053 - RNA, 16 nt, Human
cagcaccccuuccaug

SEQ ID NO: 2174054 - RNA, 18 nt, Human
cagcacccagcaacucca

SEQ ID NO: 2174055 - RNA, 21 nt, Human
cagcaccauccgccagggccc

SEQ ID NO: 2174056 - RNA, 20 nt, Human
cagcaccauccgccagggcc

SEQ ID NO: 2174057 - RNA, 19 nt, Human
cagcaccaucucuccuccu

SEQ ID NO: 2174058 - RNA, 24 nt, Human
cagauuuccagucuccaccaggaa

SEQ ID NO: 2174059 - RNA, 19 nt, Human
cagauuucacucuccuugg

SEQ ID NO: 2174060 - RNA, 16 nt, Human
cagauuuccagucucc

SEQ ID NO: 2174061 - RNA, 19 nt, Human
cagauuugaacucuucaau

SEQ ID NO: 2174062 - RNA, 22 nt, Human
cagcaccacccuagucccuucc

SEQ ID NO: 2174063 - RNA, 17 nt, Human
cagcaccaucucuccuc

SEQ ID NO: 2174064 - RNA, 20 nt, Human
cagauuuagugaaagcuaga

SEQ ID NO: 2174065 - RNA, 17 nt, Human
cagauuuagugaaagcu

SEQ ID NO: 2174066 - RNA, 22 nt, Human
cagauuuagugaaagcuagaga

SEQ ID NO: 2174067 - RNA, 20 nt, Human
cagauuucacucuccuuggu

SEQ ID NO: 2174068 - RNA, 13 nt, Human
cagauuuacacug

SEQ ID NO: 2174069 - RNA, 14 nt, Human
cagauuuacacugg

SEQ ID NO: 2174070 - RNA, 17 nt, Human
cagauuuacacugggag

SEQ ID NO: 2174071 - RNA, 18 nt, Human
cagauuuacacugggaga

SEQ ID NO: 2174072 - RNA, 13 nt, Human
cagauuuaugcau

SEQ ID NO: 2174073 - RNA, 19 nt, Human
cagauugcaacaggcuggg

SEQ ID NO: 2174074 - RNA, 20 nt, Human
cagauugcaacaggcugggc

SEQ ID NO: 2174075 - RNA, 21 nt, Human
cagauuggcucacacugagaa

SEQ ID NO: 2174076 - RNA, 22 nt, Human
cagauuggcucacacugagaau

SEQ ID NO: 2174077 - RNA, 14 nt, Human
cagauuguuaucua

SEQ ID NO: 2174078 - RNA, 18 nt, Human
cagauugcaacaggcugg

SEQ ID NO: 2174079 - RNA, 22 nt, Human
cagauauaaaagacugaccaau

SEQ ID NO: 2174080 - RNA, 19 nt, Human
cagauauauuaagugacug

SEQ ID NO: 2174081 - RNA, 22 nt, Human
cagauauaaauggcugguuuuu

SEQ ID NO: 2174082 - RNA, 20 nt, Human
cagauauauaucauauuggu

SEQ ID NO: 2174083 - RNA, 18 nt, Human
cagauauaaauggcuggu

SEQ ID NO: 2174084 - RNA, 20 nt, Human
cagauauaaauggcugguuu

SEQ ID NO: 2174085 - RNA, 23 nt, Human
cagauauaaauggcugguuuuua

SEQ ID NO: 2174086 - RNA, 19 nt, Human
cagaggggcuuucuggaga

SEQ ID NO: 2174087 - RNA, 19 nt, Human
cagauagauauaugcucug

SEQ ID NO: 2174088 - RNA, 19 nt, Human
cagauacuuggggggcuga

SEQ ID NO: 2174089 - RNA, 14 nt, Human
cagaggggguggcc

SEQ ID NO: 2174090 - RNA, 16 nt, Human
cagaggggguggccuc

SEQ ID NO: 2174091 - RNA, 18 nt, Human
cagauauauuuuucacag

SEQ ID NO: 2174092 - RNA, 16 nt, Human
cagauauauuuuucac

SEQ ID NO: 2174093 - RNA, 15 nt, Human
cagauaugauaugua

SEQ ID NO: 2174094 - RNA, 15 nt, Human
cagauauauuuuuca

SEQ ID NO: 2174095 - RNA, 14 nt, Human
cagauauauuuuuc

SEQ ID NO: 2174096 - RNA, 13 nt, Human
cagauauauuuuu

SEQ ID NO: 2174097 - RNA, 18 nt, Human
cagauaugauauguaaac

SEQ ID NO: 2174098 - RNA, 19 nt, Human
cagauauauuuuucacagu

SEQ ID NO: 2174099 - RNA, 23 nt, Human
cagauccagggacagaggcccca

SEQ ID NO: 2174100 - RNA, 15 nt, Human
cagauccagggacag

SEQ ID NO: 2174101 - RNA, 14 nt, Human
cagauccagggaca

SEQ ID NO: 2174102 - RNA, 13 nt, Human
cagauccagggac

SEQ ID NO: 2174103 - RNA, 13 nt, Human
cagauccaggacu

SEQ ID NO: 2174104 - RNA, 12 nt, Human
cagauccaggac

SEQ ID NO: 2174105 - RNA, 22 nt, Human
cagaucccagaaggaccuccug

SEQ ID NO: 2174106 - RNA, 15 nt, Human
cagauccagggacug

SEQ ID NO: 2174107 - RNA, 14 nt, Human
cagaucccagcuca

SEQ ID NO: 2174108 - RNA, 12 nt, Human
cagaucccagcu

SEQ ID NO: 2174109 - RNA, 15 nt, Human
cagaucccagcucac

SEQ ID NO: 2174110 - RNA, 14 nt, Human
cagauccccaagcc

SEQ ID NO: 2174111 - RNA, 20 nt, Human
cagagagggggccaccuccc

SEQ ID NO: 2174112 - RNA, 22 nt, Human
cagagagggggccaccucccca

SEQ ID NO: 2174113 - RNA, 13 nt, Human
cagagaggguggg

SEQ ID NO: 2174114 - RNA, 17 nt, Human
cagagaggguggugacc

SEQ ID NO: 2174115 - RNA, 20 nt, Human
cagagaggguggugaccucu

SEQ ID NO: 2174116 - RNA, 22 nt, Human
cagagaggguggugaccucugc

SEQ ID NO: 2174117 - RNA, 15 nt, Human
cagagagggggccac

SEQ ID NO: 2174118 - RNA, 16 nt, Human
cagagagggcaggcau

SEQ ID NO: 2174119 - RNA, 18 nt, Human
cagagagggcaggcauga

SEQ ID NO: 2174120 - RNA, 12 nt, Human
cagagagggcag

SEQ ID NO: 2174121 - RNA, 13 nt, Human
cagagagggcagg

SEQ ID NO: 2174122 - RNA, 14 nt, Human
cagagagggcaggc

SEQ ID NO: 2174123 - RNA, 15 nt, Human
cagagagggcaggca

SEQ ID NO: 2174124 - RNA, 12 nt, Human
cagagagggugg

SEQ ID NO: 2174125 - RNA, 21 nt, Human
cagagagagaagugccccugc

SEQ ID NO: 2174126 - RNA, 20 nt, Human
cagagagagaagugccccug

SEQ ID NO: 2174127 - RNA, 19 nt, Human
cagagagagaagugccccu

SEQ ID NO: 2174128 - RNA, 23 nt, Human
cagagagagaagugccccugcug

SEQ ID NO: 2174129 - RNA, 22 nt, Human
cagagagagaagugccccugcu

SEQ ID NO: 2174130 - RNA, 12 nt, Human
cagagagaagcc

SEQ ID NO: 2174131 - RNA, 14 nt, Human
cagagagaagccug

SEQ ID NO: 2174132 - RNA, 15 nt, Human
cagagacuugggaca

SEQ ID NO: 2174133 - RNA, 18 nt, Human
cagagacuugggacauug

SEQ ID NO: 2174134 - RNA, 20 nt, Human
cagagacuugggacauugcc

SEQ ID NO: 2174135 - RNA, 14 nt, Human
cagagacugcugug

SEQ ID NO: 2174136 - RNA, 23 nt, Human
cagagacuccugcaggcagccag

SEQ ID NO: 2174137 - RNA, 12 nt, Human
cagagcucacaa

SEQ ID NO: 2174138 - RNA, 22 nt, Human
cagagagucccacugccucagg

SEQ ID NO: 2174139 - RNA, 17 nt, Human
cagagcuacuugggcca

SEQ ID NO: 2174140 - RNA, 14 nt, Human
cagagcucuccagc

SEQ ID NO: 2174141 - RNA, 15 nt, Human
cagagcucuccagcu

SEQ ID NO: 2174142 - RNA, 20 nt, Human
cagagcucuccagcuccaag

SEQ ID NO: 2174143 - RNA, 17 nt, Human
cagagcucuccagcucc

SEQ ID NO: 2174144 - RNA, 14 nt, Human
cagagcugacacag

SEQ ID NO: 2174145 - RNA, 15 nt, Human
cagagcugacacagg

SEQ ID NO: 2174146 - RNA, 13 nt, Human
cagagcugccacc

SEQ ID NO: 2174147 - RNA, 21 nt, Human
cagagaggucaagcccaggag

SEQ ID NO: 2174148 - RNA, 12 nt, Human
cagagaguccca

SEQ ID NO: 2174149 - RNA, 14 nt, Human
cagagagucccacu

SEQ ID NO: 2174150 - RNA, 18 nt, Human
cagagagucccacugccu

SEQ ID NO: 2174151 - RNA, 20 nt, Human
cagagagucccacugccuca

SEQ ID NO: 2174152 - RNA, 20 nt, Human
cagagagguuaaggugggua

SEQ ID NO: 2174153 - RNA, 19 nt, Human
cagagaggucaagcccagg

SEQ ID NO: 2174154 - RNA, 18 nt, Human
cagagagggugacaagau

SEQ ID NO: 2174155 - RNA, 21 nt, Human
cagagagggcaggcaugaagu

SEQ ID NO: 2174156 - RNA, 17 nt, Human
cagagagggugacaaga

SEQ ID NO: 2174157 - RNA, 23 nt, Human
cagagagggugggagugggccca

SEQ ID NO: 2174158 - RNA, 23 nt, Human
cagagaggguggugaccucugcc

SEQ ID NO: 2174159 - RNA, 18 nt, Human
cagaggggcuuucuggag

SEQ ID NO: 2174160 - RNA, 13 nt, Human
cagaggggguggc

SEQ ID NO: 2174161 - RNA, 17 nt, Human
cagaggaaagcaaagga

SEQ ID NO: 2174162 - RNA, 19 nt, Human
cagaggaaagcaaaggaga

SEQ ID NO: 2174163 - RNA, 23 nt, Human
cagagcuucuuccaggugcccag

SEQ ID NO: 2174164 - RNA, 20 nt, Human
cagagcuucuuccaggugcc

SEQ ID NO: 2174165 - RNA, 15 nt, Human
cagagcuuggacugg

SEQ ID NO: 2174166 - RNA, 16 nt, Human
cagagcuuggacugga

SEQ ID NO: 2174167 - RNA, 19 nt, Human
cagagcuuggacuggaugc

SEQ ID NO: 2174168 - RNA, 19 nt, Human
cagagcugacacaggauga

SEQ ID NO: 2174169 - RNA, 23 nt, Human
cagagcuucccugacucauucug

SEQ ID NO: 2174170 - RNA, 15 nt, Human
auuacaggcuugagc

SEQ ID NO: 2174171 - RNA, 13 nt, Human
auuacagguguga

SEQ ID NO: 2174172 - RNA, 19 nt, Human
auuacaggcuccugccacc

SEQ ID NO: 2174173 - RNA, 17 nt, Human
auuacaggcuccugcca

SEQ ID NO: 2174174 - RNA, 12 nt, Human
auuacagagagg

SEQ ID NO: 2174175 - RNA, 20 nt, Human
auuacacuguauuuguaucu

SEQ ID NO: 2174176 - RNA, 21 nt, Human
auuaauuuuuuuauuguuuaa

SEQ ID NO: 2174177 - RNA, 17 nt, Human
auuacagagaggagaaa

SEQ ID NO: 2174178 - RNA, 15 nt, Human
auuacagagaggaga

SEQ ID NO: 2174179 - RNA, 16 nt, Human
auuacaggcuccugcc

SEQ ID NO: 2174180 - RNA, 15 nt, Human
auuacaggcuccugc

SEQ ID NO: 2174181 - RNA, 22 nt, Human
auuacaagcgugagccacugca

SEQ ID NO: 2174182 - RNA, 18 nt, Human
auuaauuuuuuuauuguu

SEQ ID NO: 2174183 - RNA, 19 nt, Human
auuaauuuuuuuauuguuu

SEQ ID NO: 2174184 - RNA, 16 nt, Human
auuaauuuuuuuauug

SEQ ID NO: 2174185 - RNA, 17 nt, Human
auuaauuuuuuuauugu

SEQ ID NO: 2174186 - RNA, 21 nt, Human
auuacaccagccucgucuuca

SEQ ID NO: 2174187 - RNA, 17 nt, Human
auuacacaaaacaaaug

SEQ ID NO: 2174188 - RNA, 18 nt, Human
auuacacaaaacaaaugc

SEQ ID NO: 2174189 - RNA, 14 nt, Human
auuacacccaaaga

SEQ ID NO: 2174190 - RNA, 18 nt, Human
auuacacuguauuuguau

SEQ ID NO: 2174191 - RNA, 19 nt, Human
auuacacuguauuuguauc

SEQ ID NO: 2174192 - RNA, 13 nt, Human
auuacacaaaaca

SEQ ID NO: 2174193 - RNA, 14 nt, Human
auuacacaaaacaa

SEQ ID NO: 2174194 - RNA, 18 nt, Human
auuaaugccuuuaaagua

SEQ ID NO: 2174195 - RNA, 21 nt, Human
auuaaugccuuuaaaguauga

SEQ ID NO: 2174196 - RNA, 15 nt, Human
auuaauggaaauguu

SEQ ID NO: 2174197 - RNA, 20 nt, Human
auuaaugccauuaucccuga

SEQ ID NO: 2174198 - RNA, 15 nt, Human
auuaaugccuuuaaa

SEQ ID NO: 2174199 - RNA, 16 nt, Human
auuaaugccuuuaaag

SEQ ID NO: 2174200 - RNA, 17 nt, Human
auuaaugccuuuaaagu

SEQ ID NO: 2174201 - RNA, 13 nt, Human
auuaaugcacuuu

SEQ ID NO: 2174202 - RNA, 14 nt, Human
auuaaugcacuuuc

SEQ ID NO: 2174203 - RNA, 15 nt, Human
auuaaugcacuuucu

SEQ ID NO: 2174204 - RNA, 16 nt, Human
auuaaugcacuuucua

SEQ ID NO: 2174205 - RNA, 12 nt, Human
auuaaugcacuu

SEQ ID NO: 2174206 - RNA, 20 nt, Human
auuaauuggcagcagauuuu

SEQ ID NO: 2174207 - RNA, 21 nt, Human
auuaauuggcagcagauuuua

SEQ ID NO: 2174208 - RNA, 18 nt, Human
auuaauuguuuugcacuu

SEQ ID NO: 2174209 - RNA, 19 nt, Human
auuaauuguuuugcacuuu

SEQ ID NO: 2174210 - RNA, 20 nt, Human
auuaauuguuuugcacuuuu

SEQ ID NO: 2174211 - RNA, 11 nt, Human
auuaacacugc

SEQ ID NO: 2174212 - RNA, 20 nt, Human
auuaacaaauuauguuacau

SEQ ID NO: 2174213 - RNA, 18 nt, Human
auuaacaacaauaacacu

SEQ ID NO: 2174214 - RNA, 22 nt, Human
auuaacaguuuuccaugaaaac

SEQ ID NO: 2174215 - RNA, 21 nt, Human
auuaacaguuuuccaugaaaa

SEQ ID NO: 2174216 - RNA, 19 nt, Human
auuaacaguuuuccaugaa

SEQ ID NO: 2174217 - RNA, 18 nt, Human
auuaacaguuuuccauga

SEQ ID NO: 2174218 - RNA, 16 nt, Human
auuaacaguuuuccau

SEQ ID NO: 2174219 - RNA, 14 nt, Human
auuaacaguuuucc

SEQ ID NO: 2174220 - RNA, 12 nt, Human
auuaacaguuuu

SEQ ID NO: 2174221 - RNA, 18 nt, Human
auuaacauaggugaaagu

SEQ ID NO: 2174222 - RNA, 23 nt, Human
auuaacaguuuuccaugaaaacg

SEQ ID NO: 2174223 - RNA, 21 nt, Human
auuaacaugaauauuuagugu

SEQ ID NO: 2174224 - RNA, 14 nt, Human
auuaacaaauuaug

SEQ ID NO: 2174225 - RNA, 13 nt, Human
auucauauugaau

SEQ ID NO: 2174226 - RNA, 14 nt, Human
auucauauugaaua

SEQ ID NO: 2174227 - RNA, 17 nt, Human
auucauauugaauauaa

SEQ ID NO: 2174228 - RNA, 17 nt, Human
auucauggccuggggga

SEQ ID NO: 2174229 - RNA, 14 nt, Human
auucauauuuacuu

SEQ ID NO: 2174230 - RNA, 18 nt, Human
auucauuccauucuggaa

SEQ ID NO: 2174231 - RNA, 19 nt, Human
auucauuccauucuggaag

SEQ ID NO: 2174232 - RNA, 19 nt, Human
auucauuauuuuuccacuu

SEQ ID NO: 2174233 - RNA, 20 nt, Human
auucauuauuuuuccacuuu

SEQ ID NO: 2174234 - RNA, 17 nt, Human
auucauuccauucugga

SEQ ID NO: 2174235 - RNA, 12 nt, Human
auucauuccauu

SEQ ID NO: 2174236 - RNA, 15 nt, Human
auucauguuucuuaa

SEQ ID NO: 2174237 - RNA, 13 nt, Human
auucauguuucuu

SEQ ID NO: 2174238 - RNA, 12 nt, Human
auucauguuucu

SEQ ID NO: 2174239 - RNA, 12 nt, Human
auucauguaaac

SEQ ID NO: 2174240 - RNA, 14 nt, Human
auucauuacagcuu

SEQ ID NO: 2174241 - RNA, 19 nt, Human
auucauaguaacuucuuau

SEQ ID NO: 2174242 - RNA, 12 nt, Human
auucaauaaagu

SEQ ID NO: 2174243 - RNA, 13 nt, Human
auucaauaaagua

SEQ ID NO: 2174244 - RNA, 14 nt, Human
auucaauaaaguau

SEQ ID NO: 2174245 - RNA, 17 nt, Human
auucaauaaaguauuua

SEQ ID NO: 2174246 - RNA, 16 nt, Human
auucaaguuauuguac

SEQ ID NO: 2174247 - RNA, 16 nt, Human
auucaaguguacagug

SEQ ID NO: 2174248 - RNA, 21 nt, Human
auucaagucuaugaugcuguu

SEQ ID NO: 2174249 - RNA, 14 nt, Human
auucaaguuauugu

SEQ ID NO: 2174250 - RNA, 15 nt, Human
auucaaguuauugua

SEQ ID NO: 2174251 - RNA, 20 nt, Human
auucaaguguaaaauauuuu

SEQ ID NO: 2174252 - RNA, 21 nt, Human
auucaaguguaaaauauuuug

SEQ ID NO: 2174253 - RNA, 15 nt, Human
auucaagguggccaa

SEQ ID NO: 2174254 - RNA, 21 nt, Human
auucaaggcauuucuaucaca

SEQ ID NO: 2174255 - RNA, 12 nt, Human
auucaaguauua

SEQ ID NO: 2174256 - RNA, 20 nt, Human
auucaaguauuagggguaau

SEQ ID NO: 2174257 - RNA, 23 nt, Human
auuaugugccagauuuaugcaua

SEQ ID NO: 2174258 - RNA, 13 nt, Human
auuaugugccaga

SEQ ID NO: 2174259 - RNA, 21 nt, Human
auuaugugccagauuuaugca

SEQ ID NO: 2174260 - RNA, 17 nt, Human
auuauguauguuuacau

SEQ ID NO: 2174261 - RNA, 17 nt, Human
auuauguccacugugua

SEQ ID NO: 2174262 - RNA, 19 nt, Human
auuauguccacuguguaua

SEQ ID NO: 2174263 - RNA, 15 nt, Human
auuauguauguuuac

SEQ ID NO: 2174264 - RNA, 16 nt, Human
auuauguauguuuaca

SEQ ID NO: 2174265 - RNA, 13 nt, Human
auuagaugugauu

SEQ ID NO: 2174266 - RNA, 14 nt, Human
auuagaugugauuu

SEQ ID NO: 2174267 - RNA, 15 nt, Human
auuagaugugauuua

SEQ ID NO: 2174268 - RNA, 21 nt, Human
auuagaugugauuuaauagug

SEQ ID NO: 2174269 - RNA, 22 nt, Human
auuagaugugauuuaauagugu

SEQ ID NO: 2174270 - RNA, 15 nt, Human
auuagagucagccuu

SEQ ID NO: 2174271 - RNA, 16 nt, Human
auuagagugucuuucc

SEQ ID NO: 2174272 - RNA, 23 nt, Human
auuagagugucuuuccacggagc

SEQ ID NO: 2174273 - RNA, 17 nt, Human
auuagagugucuuucca

SEQ ID NO: 2174274 - RNA, 19 nt, Human
auuagagggaggagaauga

SEQ ID NO: 2174275 - RNA, 21 nt, Human
auuagagggaggagaaugagc

SEQ ID NO: 2174276 - RNA, 13 nt, Human
auuagagggaggu

SEQ ID NO: 2174277 - RNA, 22 nt, Human
auuagagggagguguuuaaaga

SEQ ID NO: 2174278 - RNA, 13 nt, Human
auuagauguucuc

SEQ ID NO: 2174279 - RNA, 14 nt, Human
auuagauguucucu

SEQ ID NO: 2174280 - RNA, 16 nt, Human
auuagauguucucuau

SEQ ID NO: 2174281 - RNA, 20 nt, Human
auucgcccaaagccagacag

SEQ ID NO: 2174282 - RNA, 21 nt, Human
auucgcccaaagccagacagc

SEQ ID NO: 2174283 - RNA, 19 nt, Human
auucgcccaaagccagaca

SEQ ID NO: 2174284 - RNA, 17 nt, Human
auucgagacagaaccuu

SEQ ID NO: 2174285 - RNA, 16 nt, Human
auucgagacagaaccu

SEQ ID NO: 2174286 - RNA, 18 nt, Human
auuccuuuuguguacagu

SEQ ID NO: 2174287 - RNA, 20 nt, Human
auuccuuugaagaggaaaau

SEQ ID NO: 2174288 - RNA, 18 nt, Human
auuccuuuguguuucuau

SEQ ID NO: 2174289 - RNA, 16 nt, Human
auucgaccugauuuac

SEQ ID NO: 2174290 - RNA, 15 nt, Human
auucgaaccaggaaa

SEQ ID NO: 2174291 - RNA, 18 nt, Human
auucgaccugauuuacag

SEQ ID NO: 2174292 - RNA, 20 nt, Human
auucgaccugauuuacaguu

SEQ ID NO: 2174293 - RNA, 21 nt, Human
auucgaccugauuuacaguuu

SEQ ID NO: 2174294 - RNA, 11 nt, Human
auucauuucaa

SEQ ID NO: 2174295 - RNA, 17 nt, Human
auuccuuucuaucauuu

SEQ ID NO: 2174296 - RNA, 16 nt, Human
auuccuuucuaucauu

SEQ ID NO: 2174297 - RNA, 15 nt, Human
auuccuuucucaucc

SEQ ID NO: 2174298 - RNA, 17 nt, Human
auuccuuucucauccca

SEQ ID NO: 2174299 - RNA, 16 nt, Human
auuccuuugaagagga

SEQ ID NO: 2174300 - RNA, 18 nt, Human
auuccuuugaagaggaaa

SEQ ID NO: 2174301 - RNA, 17 nt, Human
auucauuuaaaaugauu

SEQ ID NO: 2174302 - RNA, 13 nt, Human
auucauuuaaaau

SEQ ID NO: 2174303 - RNA, 14 nt, Human
auucauuuaaaaug

SEQ ID NO: 2174304 - RNA, 15 nt, Human
auucauuuaaaauga

SEQ ID NO: 2174305 - RNA, 16 nt, Human
auucauuuaaaaugau

SEQ ID NO: 2174306 - RNA, 19 nt, Human
auucauuguauaaaaauag

SEQ ID NO: 2174307 - RNA, 15 nt, Human
auucauugaagucag

SEQ ID NO: 2174308 - RNA, 20 nt, Human
auucauugaagucagaugug

SEQ ID NO: 2174309 - RNA, 16 nt, Human
auucauuguauaaaaa

SEQ ID NO: 2174310 - RNA, 10 nt, Human
auucauuuaa

SEQ ID NO: 2174311 - RNA, 14 nt, Human
auucauucuuagcu

SEQ ID NO: 2174312 - RNA, 19 nt, Human
auucauucuuagcucuuaa

SEQ ID NO: 2174313 - RNA, 14 nt, Human
auucucuuauccaa

SEQ ID NO: 2174314 - RNA, 12 nt, Human
auucucuuaucc

SEQ ID NO: 2174315 - RNA, 19 nt, Human
auucucuccaaaaaugcac

SEQ ID NO: 2174316 - RNA, 15 nt, Human
auucucuccaaaaau

SEQ ID NO: 2174317 - RNA, 14 nt, Human
auucucuccaaaaa

SEQ ID NO: 2174318 - RNA, 23 nt, Human
auucucuaguuugauuaaauucu

SEQ ID NO: 2174319 - RNA, 23 nt, Human
auucguggugaucaauuaaaugu

SEQ ID NO: 2174320 - RNA, 21 nt, Human
auucgugcagcauaugaggau

SEQ ID NO: 2174321 - RNA, 23 nt, Human
auucgguguggugcagugugaaa

SEQ ID NO: 2174322 - RNA, 21 nt, Human
auucggugugcaccaggguug

SEQ ID NO: 2174323 - RNA, 21 nt, Human
auucgguauccccccaucuug

SEQ ID NO: 2174324 - RNA, 20 nt, Human
auucucuaguuugauuaaau

SEQ ID NO: 2174325 - RNA, 13 nt, Human
auucguucugugg

SEQ ID NO: 2174326 - RNA, 22 nt, Human
auucuuuccauuaugauucuuu

SEQ ID NO: 2174327 - RNA, 21 nt, Human
auucuuuccauuaugauucuu

SEQ ID NO: 2174328 - RNA, 17 nt, Human
auucuuuccauuaugau

SEQ ID NO: 2174329 - RNA, 16 nt, Human
auucuuuccauuauga

SEQ ID NO: 2174330 - RNA, 19 nt, Human
auucuuucaagugaaucua

SEQ ID NO: 2174331 - RNA, 23 nt, Human
auucuuuauacaacagugcuaaa

SEQ ID NO: 2174332 - RNA, 15 nt, Human
auucucuuauccaac

SEQ ID NO: 2174333 - RNA, 17 nt, Human
auucuuuaaauuucauc

SEQ ID NO: 2174334 - RNA, 13 nt, Human
auucuuuauacaa

SEQ ID NO: 2174335 - RNA, 18 nt, Human
auucuuuauacaacagug

SEQ ID NO: 2174336 - RNA, 19 nt, Human
auucuuuauacaacagugc

SEQ ID NO: 2174337 - RNA, 21 nt, Human
auucuuuauacaacagugcua

SEQ ID NO: 2174338 - RNA, 17 nt, Human
auucuuuaucuugacau

SEQ ID NO: 2174339 - RNA, 12 nt, Human
auugaggccugc

SEQ ID NO: 2174340 - RNA, 21 nt, Human
auugaggccugcccucaggga

SEQ ID NO: 2174341 - RNA, 22 nt, Human
auugaggacacugauauggguc

SEQ ID NO: 2174342 - RNA, 20 nt, Human
auuuucuauuguuacucugg

SEQ ID NO: 2174343 - RNA, 23 nt, Human
auuuuaguuucuguucuguggaa

SEQ ID NO: 2174344 - RNA, 19 nt, Human
auuuucuauaauuuaaaua

SEQ ID NO: 2174345 - RNA, 18 nt, Human
auuuucuauaauuuaaau

SEQ ID NO: 2174346 - RNA, 17 nt, Human
auuuucuauaauuuaaa

SEQ ID NO: 2174347 - RNA, 17 nt, Human
auuuugaaaaauuccua

SEQ ID NO: 2174348 - RNA, 20 nt, Human
auuuucuuuuuaauaaaaag

SEQ ID NO: 2174349 - RNA, 20 nt, Human
auuuucugguagauagaaau

SEQ ID NO: 2174350 - RNA, 17 nt, Human
auuuucugguagauaga

SEQ ID NO: 2174351 - RNA, 18 nt, Human
auuuucugguagauagaa

SEQ ID NO: 2174352 - RNA, 15 nt, Human
auuuugaaaaacugc

SEQ ID NO: 2174353 - RNA, 13 nt, Human
auuuugaaaaacu

SEQ ID NO: 2174354 - RNA, 22 nt, Human
auuuucuggaauacaugaaaua

SEQ ID NO: 2174355 - RNA, 19 nt, Human
auuuucuggaauacaugaa

SEQ ID NO: 2174356 - RNA, 18 nt, Human
auuuucuggaauacauga

SEQ ID NO: 2174357 - RNA, 22 nt, Human
auuuucucuguguuuguuccua

SEQ ID NO: 2174358 - RNA, 18 nt, Human
auuuucucuguguuuguu

SEQ ID NO: 2174359 - RNA, 12 nt, Human
auuuucugcaag

SEQ ID NO: 2174360 - RNA, 16 nt, Human
auuuucugcaagccug

SEQ ID NO: 2174361 - RNA, 16 nt, Human
auuuucuauuguuacu

SEQ ID NO: 2174362 - RNA, 23 nt, Human
auuuucucccaggaagcuuugau

SEQ ID NO: 2174363 - RNA, 15 nt, Human
auuuucucccaggaa

SEQ ID NO: 2174364 - RNA, 17 nt, Human
auuuucucccaggaagc

SEQ ID NO: 2174365 - RNA, 12 nt, Human
auuuguuaaugg

SEQ ID NO: 2174366 - RNA, 17 nt, Human
auuuguuauuuguacag

SEQ ID NO: 2174367 - RNA, 18 nt, Human
auuuguuauuuguacagu

SEQ ID NO: 2174368 - RNA, 19 nt, Human
auuuguuauuuguacaguu

SEQ ID NO: 2174369 - RNA, 17 nt, Human
auuuguuauuuugcaac

SEQ ID NO: 2174370 - RNA, 19 nt, Human
auuuguucuauagcuuuuc

SEQ ID NO: 2174371 - RNA, 16 nt, Human
auuuguuauuuugcaa

SEQ ID NO: 2174372 - RNA, 17 nt, Human
auuuguuauuuucagua

SEQ ID NO: 2174373 - RNA, 21 nt, Human
auuuguucauagacccucuca

SEQ ID NO: 2174374 - RNA, 16 nt, Human
auuuguugaaauuaug

SEQ ID NO: 2174375 - RNA, 18 nt, Human
auuuguugaaauuaugua

SEQ ID NO: 2174376 - RNA, 23 nt, Human
auuuuagguguugauuuucuguu

SEQ ID NO: 2174377 - RNA, 22 nt, Human
auuuguucauagacccucucaa

SEQ ID NO: 2174378 - RNA, 14 nt, Human
auuuguugaaauua

SEQ ID NO: 2174379 - RNA, 18 nt, Human
auuuuaguuacagcugug

SEQ ID NO: 2174380 - RNA, 14 nt, Human
auuuuaguuucugu

SEQ ID NO: 2174381 - RNA, 15 nt, Human
auuuuaguuucuguu

SEQ ID NO: 2174382 - RNA, 16 nt, Human
auuuuaguuucuguuc

SEQ ID NO: 2174383 - RNA, 18 nt, Human
auuuuaguuucuguucug

SEQ ID NO: 2174384 - RNA, 19 nt, Human
auuuuaguuucuguucugu

SEQ ID NO: 2174385 - RNA, 21 nt, Human
auuuuaguuucuguucugugg

SEQ ID NO: 2174386 - RNA, 23 nt, Human
auuuuagugacagcucugccugu

SEQ ID NO: 2174387 - RNA, 23 nt, Human
auuuuagucacacguggucuuuc

SEQ ID NO: 2174388 - RNA, 14 nt, Human
auuuuagucacuuu

SEQ ID NO: 2174389 - RNA, 15 nt, Human
auuuuagucacuuuu

SEQ ID NO: 2174390 - RNA, 14 nt, Human
auuugugugugugc

SEQ ID NO: 2174391 - RNA, 12 nt, Human
auuugugugugu

SEQ ID NO: 2174392 - RNA, 20 nt, Human
auuugugugugugcaagugu

SEQ ID NO: 2174393 - RNA, 15 nt, Human
auuugugugugugca

SEQ ID NO: 2174394 - RNA, 15 nt, Human
auuugcagagacagg

SEQ ID NO: 2174395 - RNA, 16 nt, Human
auuugcacccuccgcc

SEQ ID NO: 2174396 - RNA, 22 nt, Human
auuugcagagacaggaccugac

SEQ ID NO: 2174397 - RNA, 19 nt, Human
auuugcagagacaggaccu

SEQ ID NO: 2174398 - RNA, 21 nt, Human
auuugcacuggaguucuaugc

SEQ ID NO: 2174399 - RNA, 18 nt, Human
auuuguuaaauauuuaca

SEQ ID NO: 2174400 - RNA, 17 nt, Human
auuuguuaaauauuuac

SEQ ID NO: 2174401 - RNA, 16 nt, Human
auuuguuaaauauuua

SEQ ID NO: 2174402 - RNA, 15 nt, Human
auuuguuaaauauuu

SEQ ID NO: 2174403 - RNA, 21 nt, Human
auuuguguuuuaauuuaaaca

SEQ ID NO: 2174404 - RNA, 14 nt, Human
auuuguuauaauga

SEQ ID NO: 2174405 - RNA, 13 nt, Human
auuuguguuuuaa

SEQ ID NO: 2174406 - RNA, 20 nt, Human
auuuguguuuuaauuuaaac

SEQ ID NO: 2174407 - RNA, 22 nt, Human
auuuugaaaaauuccuauugug

SEQ ID NO: 2174408 - RNA, 18 nt, Human
auuuugaaaaauuccuau

SEQ ID NO: 2174409 - RNA, 19 nt, Human
auuuugaaaaauuccuauu

SEQ ID NO: 2174410 - RNA, 20 nt, Human
auuuugaaaucaugaagaua

SEQ ID NO: 2174411 - RNA, 18 nt, Human
caaacaugugguuaaugc

SEQ ID NO: 2174412 - RNA, 13 nt, Human
caaaccagaagca

SEQ ID NO: 2174413 - RNA, 20 nt, Human
caaacaugggguuggcuggg

SEQ ID NO: 2174414 - RNA, 23 nt, Human
caaacaugggguuggcugggccc

SEQ ID NO: 2174415 - RNA, 22 nt, Human
caaacaugaaguguguuuccuu

SEQ ID NO: 2174416 - RNA, 21 nt, Human
caaacaugacccuaaaucuug

SEQ ID NO: 2174417 - RNA, 14 nt, Human
caaaccaucauuga

SEQ ID NO: 2174418 - RNA, 16 nt, Human
caaaccaucauugaaa

SEQ ID NO: 2174419 - RNA, 17 nt, Human
caaaccaucauugaaau

SEQ ID NO: 2174420 - RNA, 17 nt, Human
caaaccaguaucgcuca

SEQ ID NO: 2174421 - RNA, 15 nt, Human
caaaccauaaacuuc

SEQ ID NO: 2174422 - RNA, 12 nt, Human
auuuuuaucuuu

SEQ ID NO: 2174423 - RNA, 15 nt, Human
auuuuuaucuuucgu

SEQ ID NO: 2174424 - RNA, 19 nt, Human
auuuuuaucuuucgugaua

SEQ ID NO: 2174425 - RNA, 14 nt, Human
auuuuuauggaauu

SEQ ID NO: 2174426 - RNA, 12 nt, Human
auuuuuauggaa

SEQ ID NO: 2174427 - RNA, 15 nt, Human
auuuuuauggaauuu

SEQ ID NO: 2174428 - RNA, 19 nt, Human
auuuuuaaaauuuuaauau

SEQ ID NO: 2174429 - RNA, 19 nt, Human
auuuuuauauuugaaauau

SEQ ID NO: 2174430 - RNA, 22 nt, Human
auuuuguuuuugucuuaaaaag

SEQ ID NO: 2174431 - RNA, 17 nt, Human
auuuuuaaaacccauuu

SEQ ID NO: 2174432 - RNA, 16 nt, Human
auuuuuaaaacccauu

SEQ ID NO: 2174433 - RNA, 22 nt, Human
auuuuuaaaaugcaacaugugu

SEQ ID NO: 2174434 - RNA, 16 nt, Human
auuuuuaaaauauuua

SEQ ID NO: 2174435 - RNA, 17 nt, Human
auuuuuaaaauauuuau

SEQ ID NO: 2174436 - RNA, 13 nt, Human
auuuuuuucuacc

SEQ ID NO: 2174437 - RNA, 20 nt, Human
auuuuuuucuaccuugaggu

SEQ ID NO: 2174438 - RNA, 14 nt, Human
auuuuuuucugauu

SEQ ID NO: 2174439 - RNA, 15 nt, Human
auuuuuuucugauug

SEQ ID NO: 2174440 - RNA, 15 nt, Human
auuuuuuucugaauu

SEQ ID NO: 2174441 - RNA, 14 nt, Human
auuuuuauuucaaa

SEQ ID NO: 2174442 - RNA, 14 nt, Human
auuuuuauuuauau

SEQ ID NO: 2174443 - RNA, 13 nt, Human
auuuuuauucaua

SEQ ID NO: 2174444 - RNA, 14 nt, Human
auuuuuauucauaa

SEQ ID NO: 2174445 - RNA, 22 nt, Human
auuuuuuucacuggaguuacau

SEQ ID NO: 2174446 - RNA, 15 nt, Human
auuuuuauucauaag

SEQ ID NO: 2174447 - RNA, 16 nt, Human
auuuuuauuuuucuaa

SEQ ID NO: 2174448 - RNA, 16 nt, Human
auuuuuauuaaauuau

SEQ ID NO: 2174449 - RNA, 15 nt, Human
auuuuuauuauuugu

SEQ ID NO: 2174450 - RNA, 12 nt, Human
auuuuuauucau

SEQ ID NO: 2174451 - RNA, 18 nt, Human
auuuuuuuuaaguauuua

SEQ ID NO: 2174452 - RNA, 20 nt, Human
auuuuuuuucuguuauauaa

SEQ ID NO: 2174453 - RNA, 19 nt, Human
auuuuuuuucuguuauaua

SEQ ID NO: 2174454 - RNA, 18 nt, Human
auuuuuuuucuguuauau

SEQ ID NO: 2174455 - RNA, 20 nt, Human
auuuuuuuucauguuuuaac

SEQ ID NO: 2174456 - RNA, 16 nt, Human
auuuuuuuucauguuu

SEQ ID NO: 2174457 - RNA, 15 nt, Human
auuuuuuuucauguu

SEQ ID NO: 2174458 - RNA, 14 nt, Human
auuuuuuuucaugu

SEQ ID NO: 2174459 - RNA, 17 nt, Human
auuuuuuuucuguuaua

SEQ ID NO: 2174460 - RNA, 15 nt, Human
auuuuuuuucuguua

SEQ ID NO: 2174461 - RNA, 15 nt, Human
auuuuuuuuguuuca

SEQ ID NO: 2174462 - RNA, 16 nt, Human
auuuuuuuuucauaca

SEQ ID NO: 2174463 - RNA, 14 nt, Human
auuuuuuuuucaua

SEQ ID NO: 2174464 - RNA, 14 nt, Human
caaaagcacccuug

SEQ ID NO: 2174465 - RNA, 16 nt, Human
caaaagcaagacuguu

SEQ ID NO: 2174466 - RNA, 23 nt, Human
caaaagcaagacuguugcucaaa

SEQ ID NO: 2174467 - RNA, 15 nt, Human
caaaagcaaaugaga

SEQ ID NO: 2174468 - RNA, 14 nt, Human
caaaagcaagacug

SEQ ID NO: 2174469 - RNA, 22 nt, Human
caaaagauugcugaaauuuuau

SEQ ID NO: 2174470 - RNA, 21 nt, Human
auuuuuuuuucauacacuuau

SEQ ID NO: 2174471 - RNA, 20 nt, Human
auuuuuuuuucauacacuua

SEQ ID NO: 2174472 - RNA, 19 nt, Human
auuuuuuuuucauacacuu

SEQ ID NO: 2174473 - RNA, 22 nt, Human
caaaaggguuuaaacugauuca

SEQ ID NO: 2174474 - RNA, 20 nt, Human
caaaaggguuuaaacugauu

SEQ ID NO: 2174475 - RNA, 19 nt, Human
caaaagcccauucauucca

SEQ ID NO: 2174476 - RNA, 15 nt, Human
caaaagcccauucau

SEQ ID NO: 2174477 - RNA, 21 nt, Human
caaaagguauuuuaaucacca

SEQ ID NO: 2174478 - RNA, 13 nt, Human
caaaagcauguga

SEQ ID NO: 2174479 - RNA, 19 nt, Human
caaaagcaucuaugugaga

SEQ ID NO: 2174480 - RNA, 21 nt, Human
caaacaugaaguguguuuccu

SEQ ID NO: 2174481 - RNA, 14 nt, Human
caaacaugaagugu

SEQ ID NO: 2174482 - RNA, 12 nt, Human
caaacaugaagu

SEQ ID NO: 2174483 - RNA, 23 nt, Human
caaaaggugccugugaggcaggg

SEQ ID NO: 2174484 - RNA, 17 nt, Human
caaacaucacucugcug

SEQ ID NO: 2174485 - RNA, 18 nt, Human
caaacauccuaucaacaa

SEQ ID NO: 2174486 - RNA, 18 nt, Human
caaacaucacucugcugc

SEQ ID NO: 2174487 - RNA, 21 nt, Human
caaacaucacucugcugcuua

SEQ ID NO: 2174488 - RNA, 22 nt, Human
caaaaggugccugugaggcagg

SEQ ID NO: 2174489 - RNA, 18 nt, Human
caaaaggugccugugagg

SEQ ID NO: 2174490 - RNA, 15 nt, Human
caaaaggugccugug

SEQ ID NO: 2174491 - RNA, 13 nt, Human
caaaaggugccug

SEQ ID NO: 2174492 - RNA, 19 nt, Human
caaaagguucacuaaagca

SEQ ID NO: 2174493 - RNA, 20 nt, Human
caaaagguuaauaaaguaau

SEQ ID NO: 2174494 - RNA, 13 nt, Human
auuucuuaaacaa

SEQ ID NO: 2174495 - RNA, 21 nt, Human
auuucuuaaacaaauguauga

SEQ ID NO: 2174496 - RNA, 23 nt, Human
auuucugagaagguccuuaauga

SEQ ID NO: 2174497 - RNA, 16 nt, Human
auuucugcagguucuu

SEQ ID NO: 2174498 - RNA, 13 nt, Human
auuucugcauaug

SEQ ID NO: 2174499 - RNA, 21 nt, Human
auuucuguuuagauaauacac

SEQ ID NO: 2174500 - RNA, 20 nt, Human
auuucucuuacugcaaaugu

SEQ ID NO: 2174501 - RNA, 20 nt, Human
auuucugaaaugaccucaag

SEQ ID NO: 2174502 - RNA, 18 nt, Human
auuucugaaguggacucu

SEQ ID NO: 2174503 - RNA, 17 nt, Human
auuucugagaagguccu

SEQ ID NO: 2174504 - RNA, 11 nt, Human
auuucugagaa

SEQ ID NO: 2174505 - RNA, 23 nt, Human
auuucugaguuucauucuccugc

SEQ ID NO: 2174506 - RNA, 19 nt, Human
auuucuguuuagauaauac

SEQ ID NO: 2174507 - RNA, 20 nt, Human
auuucuguuuagauaauaca

SEQ ID NO: 2174508 - RNA, 21 nt, Human
auuucagguuuuguaaagaug

SEQ ID NO: 2174509 - RNA, 20 nt, Human
auuucagguuuuguaaagau

SEQ ID NO: 2174510 - RNA, 22 nt, Human
auuucaggggucgucaccaccu

SEQ ID NO: 2174511 - RNA, 19 nt, Human
auuucaggggucgucacca

SEQ ID NO: 2174512 - RNA, 14 nt, Human
auuucagugccaau

SEQ ID NO: 2174513 - RNA, 20 nt, Human
auuucuccuuugauaaaaua

SEQ ID NO: 2174514 - RNA, 21 nt, Human
auuucuccuuugauaaaauaa

SEQ ID NO: 2174515 - RNA, 19 nt, Human
auuucucugauuugcaaaa

SEQ ID NO: 2174516 - RNA, 18 nt, Human
auuucucuuacugcaaau

SEQ ID NO: 2174517 - RNA, 15 nt, Human
auuugcacaaguuuu

SEQ ID NO: 2174518 - RNA, 21 nt, Human
auuucacauuaauauuugcug

SEQ ID NO: 2174519 - RNA, 22 nt, Human
auuucacauuaauauuugcuga

SEQ ID NO: 2174520 - RNA, 21 nt, Human
auuucaccccucccuuucucc

SEQ ID NO: 2174521 - RNA, 14 nt, Human
auuucaccuguaaa

SEQ ID NO: 2174522 - RNA, 15 nt, Human
auuucaccccucccu

SEQ ID NO: 2174523 - RNA, 20 nt, Human
auuucaccccucccuuucuc

SEQ ID NO: 2174524 - RNA, 12 nt, Human
auuucacucucc

SEQ ID NO: 2174525 - RNA, 19 nt, Human
auuucaccuguaaaccuga

SEQ ID NO: 2174526 - RNA, 18 nt, Human
auuucaccuguaaaccug

SEQ ID NO: 2174527 - RNA, 16 nt, Human
auuucaccuguaaacc

SEQ ID NO: 2174528 - RNA, 15 nt, Human
auuucaccuguaaac

SEQ ID NO: 2174529 - RNA, 22 nt, Human
auuucaggauacucugucagau

SEQ ID NO: 2174530 - RNA, 19 nt, Human
auuucaggauacucuguca

SEQ ID NO: 2174531 - RNA, 15 nt, Human
auuucaggagggauu

SEQ ID NO: 2174532 - RNA, 22 nt, Human
auuucacuauuuuuauuuauau

SEQ ID NO: 2174533 - RNA, 15 nt, Human
auuucaggagcagcc

SEQ ID NO: 2174534 - RNA, 14 nt, Human
auuucacuauuuuu

SEQ ID NO: 2174535 - RNA, 20 nt, Human
auuucacgucgucuucugua

SEQ ID NO: 2174536 - RNA, 16 nt, Human
auuucagcagcugcag

SEQ ID NO: 2174537 - RNA, 14 nt, Human
auuucacucuccuu

SEQ ID NO: 2174538 - RNA, 21 nt, Human
auuucaauuuccaagagcuga

SEQ ID NO: 2174539 - RNA, 16 nt, Human
auuuaucucuauuuaa

SEQ ID NO: 2174540 - RNA, 14 nt, Human
auuuaucucuauuu

SEQ ID NO: 2174541 - RNA, 13 nt, Human
auuucacauuaau

SEQ ID NO: 2174542 - RNA, 23 nt, Human
auuucacaguguguuugugauug

SEQ ID NO: 2174543 - RNA, 13 nt, Human
auuucacaacaga

SEQ ID NO: 2174544 - RNA, 15 nt, Human
auuucacaacagauc

SEQ ID NO: 2174545 - RNA, 20 nt, Human
auuucacaacagaucaauuu

SEQ ID NO: 2174546 - RNA, 23 nt, Human
auuuaucagugacagaguucacu

SEQ ID NO: 2174547 - RNA, 18 nt, Human
auuuauauauuuauaacu

SEQ ID NO: 2174548 - RNA, 17 nt, Human
auuuauauauuuauaac

SEQ ID NO: 2174549 - RNA, 16 nt, Human
auuuauauauuuauaa

SEQ ID NO: 2174550 - RNA, 15 nt, Human
auuuauauauuuaua

SEQ ID NO: 2174551 - RNA, 19 nt, Human
auuuauauauuuauaacuc

SEQ ID NO: 2174552 - RNA, 15 nt, Human
auuuauauauuggua

SEQ ID NO: 2174553 - RNA, 18 nt, Human
auuuauccugaaauuuca

SEQ ID NO: 2174554 - RNA, 20 nt, Human
auuuauccugaaauuucaga

SEQ ID NO: 2174555 - RNA, 19 nt, Human
auuuauccugaaauuucag

SEQ ID NO: 2174556 - RNA, 21 nt, Human
auuuauccugaaauuucagau

SEQ ID NO: 2174557 - RNA, 19 nt, Human
auuuaagugcguguguaga

SEQ ID NO: 2174558 - RNA, 14 nt, Human
auuuaagugcgugu

SEQ ID NO: 2174559 - RNA, 21 nt, Human
auuuaagccucauauuuaaag

SEQ ID NO: 2174560 - RNA, 18 nt, Human
auuuaagcuuaugucaga

SEQ ID NO: 2174561 - RNA, 17 nt, Human
auuuaagccucauauuu

SEQ ID NO: 2174562 - RNA, 19 nt, Human
auuuaagccucauauuuaa

SEQ ID NO: 2174563 - RNA, 15 nt, Human
auuuaagauaguuuu

SEQ ID NO: 2174564 - RNA, 11 nt, Human
auuuaagcauu

SEQ ID NO: 2174565 - RNA, 15 nt, Human
auuuaagauaauuau

SEQ ID NO: 2174566 - RNA, 15 nt, Human
auuuaagcauuguuu

SEQ ID NO: 2174567 - RNA, 14 nt, Human
auuuaagcauuguu

SEQ ID NO: 2174568 - RNA, 13 nt, Human
auuuaagcauugu

SEQ ID NO: 2174569 - RNA, 12 nt, Human
auuuaagcauug

SEQ ID NO: 2174570 - RNA, 19 nt, Human
auuuaaguucauauuccau

SEQ ID NO: 2174571 - RNA, 20 nt, Human
auuuaagugcguguguagag

SEQ ID NO: 2174572 - RNA, 21 nt, Human
auuuaagugcguguguagagu

SEQ ID NO: 2174573 - RNA, 22 nt, Human
auuuaagugcguguguagaguu

SEQ ID NO: 2174574 - RNA, 16 nt, Human
auuuaauaaaaaaaca

SEQ ID NO: 2174575 - RNA, 19 nt, Human
auuuaauaaaauaauucua

SEQ ID NO: 2174576 - RNA, 21 nt, Human
auuuaauaaaauaauucuaaa

SEQ ID NO: 2174577 - RNA, 22 nt, Human
auuuaauaaaauaauucuaaag

SEQ ID NO: 2174578 - RNA, 13 nt, Human
auuuaauacagca

SEQ ID NO: 2174579 - RNA, 15 nt, Human
auuuaauacagcagu

SEQ ID NO: 2174580 - RNA, 15 nt, Human
auuuauauaaauuuu

SEQ ID NO: 2174581 - RNA, 15 nt, Human
auuuaauucucuuga

SEQ ID NO: 2174582 - RNA, 22 nt, Human
auuuauaguuuguacaugcauu

SEQ ID NO: 2174583 - RNA, 19 nt, Human
auuuauauacaaccugcuu

SEQ ID NO: 2174584 - RNA, 15 nt, Human
auuuauauagauuau

SEQ ID NO: 2174585 - RNA, 14 nt, Human
auuuauauauuuau

SEQ ID NO: 2174586 - RNA, 14 nt, Human
auuuauauauugaa

SEQ ID NO: 2174587 - RNA, 14 nt, Human
auuuauauauguau

SEQ ID NO: 2174588 - RNA, 15 nt, Human
auuuauauauguauu

SEQ ID NO: 2174589 - RNA, 13 nt, Human
auuuaauucucuu

SEQ ID NO: 2174590 - RNA, 16 nt, Human
auuuaauucucuugaa

SEQ ID NO: 2174591 - RNA, 17 nt, Human
auuuaauucauguuucu

SEQ ID NO: 2174592 - RNA, 15 nt, Human
auuuaauucauguuu

SEQ ID NO: 2174593 - RNA, 23 nt, Human
auuuaauuagugcuaagugugaa

SEQ ID NO: 2174594 - RNA, 20 nt, Human
auuuaauuagugcuaagugu

SEQ ID NO: 2174595 - RNA, 22 nt, Human
auuuaauaguguuaaucaauuu

SEQ ID NO: 2174596 - RNA, 23 nt, Human
auuuaauaguguuaaucaauuua

SEQ ID NO: 2174597 - RNA, 21 nt, Human
auuuaauuagugcuaagugug

SEQ ID NO: 2174598 - RNA, 22 nt, Human
auuuaauuagugcuaaguguga

SEQ ID NO: 2174599 - RNA, 14 nt, Human
auuuaauaguguua

SEQ ID NO: 2174600 - RNA, 15 nt, Human
auuuaauaguguuaa

SEQ ID NO: 2174601 - RNA, 17 nt, Human
auuuaauaguguuaauc

SEQ ID NO: 2174602 - RNA, 18 nt, Human
auuuaauaguguuaauca

SEQ ID NO: 2174603 - RNA, 19 nt, Human
auuuaauaguguuaaucaa

SEQ ID NO: 2174604 - RNA, 20 nt, Human
auuuaauaguguuaaucaau

SEQ ID NO: 2174605 - RNA, 21 nt, Human
auuuaauaguguuaaucaauu

SEQ ID NO: 2174606 - RNA, 15 nt, Human
auuuaagacacugaa

SEQ ID NO: 2174607 - RNA, 16 nt, Human
auuuaagacacugaaa

SEQ ID NO: 2174608 - RNA, 16 nt, Human
auuuaagagacaguca

SEQ ID NO: 2174609 - RNA, 20 nt, Human
auuuaacuuguuuccaaugu

SEQ ID NO: 2174610 - RNA, 23 nt, Human
auuuaacuugaggguaauaaacu

SEQ ID NO: 2174611 - RNA, 17 nt, Human
auuuaacuuguuuccaa

SEQ ID NO: 2174612 - RNA, 18 nt, Human
auuuaacuugaggguaau

SEQ ID NO: 2174613 - RNA, 20 nt, Human
auuuaacuugaggguaauaa

SEQ ID NO: 2174614 - RNA, 21 nt, Human
auuuaacuugaggguaauaaa

SEQ ID NO: 2174615 - RNA, 22 nt, Human
auuuaacuugaggguaauaaac

SEQ ID NO: 2174616 - RNA, 22 nt, Human
auugaggggauuaauaugaaaa

SEQ ID NO: 2174617 - RNA, 17 nt, Human
auugaggggauuaauau

SEQ ID NO: 2174618 - RNA, 22 nt, Human
auugauaagagggcacacacug

SEQ ID NO: 2174619 - RNA, 23 nt, Human
auugauaagagggcacacacugu

SEQ ID NO: 2174620 - RNA, 20 nt, Human
cacgcuucuucuuuugagca

SEQ ID NO: 2174621 - RNA, 19 nt, Human
cacgcuugcguaugucugu

SEQ ID NO: 2174622 - RNA, 14 nt, Human
cacgcuuucuagcu

SEQ ID NO: 2174623 - RNA, 14 nt, Human
cacgcuuuccugaa

SEQ ID NO: 2174624 - RNA, 22 nt, Human
cacgcugugggcaggugggagc

SEQ ID NO: 2174625 - RNA, 18 nt, Human
cacgcugugggcaggugg

SEQ ID NO: 2174626 - RNA, 16 nt, Human
cacgcugugggcaggu

SEQ ID NO: 2174627 - RNA, 23 nt, Human
cacgcugucuccagacccccacc

SEQ ID NO: 2174628 - RNA, 20 nt, Human
cacgcugucuccagaccccc

SEQ ID NO: 2174629 - RNA, 19 nt, Human
cacgcugucuccagacccc

SEQ ID NO: 2174630 - RNA, 18 nt, Human
cacgcugucuccagaccc

SEQ ID NO: 2174631 - RNA, 21 nt, Human
cacgcuggagugcagugagcc

SEQ ID NO: 2174632 - RNA, 17 nt, Human
cacgcugucuccagacc

SEQ ID NO: 2174633 - RNA, 16 nt, Human
cacgcugucuccagac

SEQ ID NO: 2174634 - RNA, 15 nt, Human
cacgcugucuccaga

SEQ ID NO: 2174635 - RNA, 14 nt, Human
cacgcugucuccag

SEQ ID NO: 2174636 - RNA, 13 nt, Human
cacgcugucucca

SEQ ID NO: 2174637 - RNA, 16 nt, Human
cacgcuggagugcagu

SEQ ID NO: 2174638 - RNA, 17 nt, Human
cacgcuggagugcagug

SEQ ID NO: 2174639 - RNA, 18 nt, Human
cacgcuggagugcaguga

SEQ ID NO: 2174640 - RNA, 20 nt, Human
cacgcuggagugcagugagc

SEQ ID NO: 2174641 - RNA, 15 nt, Human
cacgcuggagugcag

SEQ ID NO: 2174642 - RNA, 21 nt, Human
cacuacugcuaccacaacuau

SEQ ID NO: 2174643 - RNA, 15 nt, Human
cacuacauucauuua

SEQ ID NO: 2174644 - RNA, 15 nt, Human
cacuacauucuguua

SEQ ID NO: 2174645 - RNA, 17 nt, Human
cacuagaacucuccauc

SEQ ID NO: 2174646 - RNA, 15 nt, Human
cacuagaacucucca

SEQ ID NO: 2174647 - RNA, 16 nt, Human
cacuagacccacugga

SEQ ID NO: 2174648 - RNA, 19 nt, Human
cacuccaccacccaaaagu

SEQ ID NO: 2174649 - RNA, 11 nt, Human
cacuccaccac

SEQ ID NO: 2174650 - RNA, 10 nt, Human
cacuccacca

SEQ ID NO: 2174651 - RNA, 19 nt, Human
cacuagcccaaugaaauga

SEQ ID NO: 2174652 - RNA, 14 nt, Human
cacuccagaccccu

SEQ ID NO: 2174653 - RNA, 16 nt, Human
cacuccagaccccugg

SEQ ID NO: 2174654 - RNA, 22 nt, Human
cacuccaauuaaggauuuuaug

SEQ ID NO: 2174655 - RNA, 21 nt, Human
cacuccaauuaaggauuuuau

SEQ ID NO: 2174656 - RNA, 16 nt, Human
cacuagcccaaugaaa

SEQ ID NO: 2174657 - RNA, 20 nt, Human
cacuagccagacacucugcu

SEQ ID NO: 2174658 - RNA, 16 nt, Human
cacuagccagacacuc

SEQ ID NO: 2174659 - RNA, 14 nt, Human
cacggaaguuuuca

SEQ ID NO: 2174660 - RNA, 17 nt, Human
cacgcuuucuagcuguu

SEQ ID NO: 2174661 - RNA, 15 nt, Human
cacggaaguuuucaa

SEQ ID NO: 2174662 - RNA, 18 nt, Human
cacggacguuuccaucag

SEQ ID NO: 2174663 - RNA, 15 nt, Human
cacggagccacuccu

SEQ ID NO: 2174664 - RNA, 17 nt, Human
cacggacguuuccauca

SEQ ID NO: 2174665 - RNA, 22 nt, Human
cacggaagagccuugcggaagg

SEQ ID NO: 2174666 - RNA, 16 nt, Human
cacggaagagccuugc

SEQ ID NO: 2174667 - RNA, 14 nt, Human
cacuacauucuguu

SEQ ID NO: 2174668 - RNA, 13 nt, Human
cacuacauucugu

SEQ ID NO: 2174669 - RNA, 23 nt, Human
cacggagccacuccucugacuca

SEQ ID NO: 2174670 - RNA, 21 nt, Human
cacggagccacuccucugacu

SEQ ID NO: 2174671 - RNA, 21 nt, Human
cacuacauuauaaaugucucu

SEQ ID NO: 2174672 - RNA, 19 nt, Human
cacggagccacuccucuga

SEQ ID NO: 2174673 - RNA, 18 nt, Human
cacggagccacuccucug

SEQ ID NO: 2174674 - RNA, 17 nt, Human
cacggagccacuccucu

SEQ ID NO: 2174675 - RNA, 16 nt, Human
cacggagccacuccuc

SEQ ID NO: 2174676 - RNA, 18 nt, Human
cacuccaccacccaaaag

SEQ ID NO: 2174677 - RNA, 13 nt, Human
cacuccagugcca

SEQ ID NO: 2174678 - RNA, 15 nt, Human
cacuccaccacccaa

SEQ ID NO: 2174679 - RNA, 14 nt, Human
cacuccaccaccca

SEQ ID NO: 2174680 - RNA, 17 nt, Human
cacuccagaccccuggc

SEQ ID NO: 2174681 - RNA, 13 nt, Human
cacucccaagucu

SEQ ID NO: 2174682 - RNA, 23 nt, Human
cacuccaugcuuagucacugccu

SEQ ID NO: 2174683 - RNA, 16 nt, Human
cacuccagugccagca

SEQ ID NO: 2174684 - RNA, 17 nt, Human
cacuccagugccagcaa

SEQ ID NO: 2174685 - RNA, 21 nt, Human
cacuccaugcuuagucacugc

SEQ ID NO: 2174686 - RNA, 22 nt, Human
cacuccaugcuuagucacugcc

SEQ ID NO: 2174687 - RNA, 21 nt, Human
cacuccagugagacagcucug

SEQ ID NO: 2174688 - RNA, 16 nt, Human
cacuccagugagacag

SEQ ID NO: 2174689 - RNA, 13 nt, Human
cacugaagcuggg

SEQ ID NO: 2174690 - RNA, 12 nt, Human
cacucccaagcc

SEQ ID NO: 2174691 - RNA, 17 nt, Human
cacugaagcugggauuc

SEQ ID NO: 2174692 - RNA, 18 nt, Human
cacugaaggccuggccca

SEQ ID NO: 2174693 - RNA, 19 nt, Human
cacugaaguagugugcagu

SEQ ID NO: 2174694 - RNA, 23 nt, Human
cacugaagaagcaccaaucauga

SEQ ID NO: 2174695 - RNA, 22 nt, Human
cacugaaguuaacagagacaga

SEQ ID NO: 2174696 - RNA, 19 nt, Human
cacugaaguuaacagagac

SEQ ID NO: 2174697 - RNA, 20 nt, Human
caccugcggugcuaucuccc

SEQ ID NO: 2174698 - RNA, 16 nt, Human
caccugcggugcuauc

SEQ ID NO: 2174699 - RNA, 14 nt, Human
caccugcccugccc

SEQ ID NO: 2174700 - RNA, 17 nt, Human
caccugcggugcuaucu

SEQ ID NO: 2174701 - RNA, 19 nt, Human
caccugcggugcuaucucc

SEQ ID NO: 2174702 - RNA, 22 nt, Human
cacccugauuuaggagaagcca

SEQ ID NO: 2174703 - RNA, 12 nt, Human
cacccugccuua

SEQ ID NO: 2174704 - RNA, 13 nt, Human
cacccugccuuau

SEQ ID NO: 2174705 - RNA, 23 nt, Human
cacccugaaugguuccaugccug

SEQ ID NO: 2174706 - RNA, 12 nt, Human
cacccugagccc

SEQ ID NO: 2174707 - RNA, 17 nt, Human
cacccugagccccuucc

SEQ ID NO: 2174708 - RNA, 18 nt, Human
cacccugagccccuuccu

SEQ ID NO: 2174709 - RNA, 21 nt, Human
cacccuggaggauuucaucuc

SEQ ID NO: 2174710 - RNA, 21 nt, Human
cacccuggauugaucggagcc

SEQ ID NO: 2174711 - RNA, 11 nt, Human
cacccuggaau

SEQ ID NO: 2174712 - RNA, 22 nt, Human
cacccuggccgaguccaagcug

SEQ ID NO: 2174713 - RNA, 21 nt, Human
cacccuggccgaguccaagcu

SEQ ID NO: 2174714 - RNA, 12 nt, Human
cacccugcucuc

SEQ ID NO: 2174715 - RNA, 12 nt, Human
cacccugcuaca

SEQ ID NO: 2174716 - RNA, 18 nt, Human
cacccugccuuaucuugc

SEQ ID NO: 2174717 - RNA, 19 nt, Human
cacccugccuuaucuugca

SEQ ID NO: 2174718 - RNA, 12 nt, Human
cacccuccuuuc

SEQ ID NO: 2174719 - RNA, 20 nt, Human
cacccuccugucuucccagg

SEQ ID NO: 2174720 - RNA, 21 nt, Human
cacccuccugucuucccaggg

SEQ ID NO: 2174721 - RNA, 23 nt, Human
cacccucgaagcgcgccacucgc

SEQ ID NO: 2174722 - RNA, 19 nt, Human
cacccucgaagcgcgccac

SEQ ID NO: 2174723 - RNA, 24 nt, Human
cacccucgaagcgcgccacucgcu

SEQ ID NO: 2174724 - RNA, 16 nt, Human
cacccucgaagcgcgc

SEQ ID NO: 2174725 - RNA, 22 nt, Human
cacccuccugucuucccagggu

SEQ ID NO: 2174726 - RNA, 19 nt, Human
caccuauaaaacaggucaa

SEQ ID NO: 2174727 - RNA, 16 nt, Human
caccuauaaaacaggu

SEQ ID NO: 2174728 - RNA, 14 nt, Human
caccuauaaaacag

SEQ ID NO: 2174729 - RNA, 23 nt, Human
caccuaguggcuguccagugccc

SEQ ID NO: 2174730 - RNA, 18 nt, Human
caccuaguggcuguccag

SEQ ID NO: 2174731 - RNA, 19 nt, Human
caccuaguggcuguccagu

SEQ ID NO: 2174732 - RNA, 21 nt, Human
caccuaguggcuguccagugc

SEQ ID NO: 2174733 - RNA, 22 nt, Human
caccuaguggcuguccagugcc

SEQ ID NO: 2174734 - RNA, 23 nt, Human
cacccuguccaaacugccuaagc

SEQ ID NO: 2174735 - RNA, 15 nt, Human
cacccugucccccag

SEQ ID NO: 2174736 - RNA, 15 nt, Human
caccuaguccaguga

SEQ ID NO: 2174737 - RNA, 14 nt, Human
caccuaguggcugu

SEQ ID NO: 2174738 - RNA, 15 nt, Human
caccuaguggcuguc

SEQ ID NO: 2174739 - RNA, 16 nt, Human
caccuaguggcugucc

SEQ ID NO: 2174740 - RNA, 17 nt, Human
caccuaguggcugucca

SEQ ID NO: 2174741 - RNA, 20 nt, Human
cacccuguccaaacugccua

SEQ ID NO: 2174742 - RNA, 23 nt, Human
cacccuguacuguucugugucuu

SEQ ID NO: 2174743 - RNA, 17 nt, Human
cacccuggggagaaagu

SEQ ID NO: 2174744 - RNA, 22 nt, Human
cacccugggcccugggcuggaa

SEQ ID NO: 2174745 - RNA, 13 nt, Human
cacccuggggccu

SEQ ID NO: 2174746 - RNA, 12 nt, Human
cacccugggccc

SEQ ID NO: 2174747 - RNA, 14 nt, Human
cacccugggcccug

SEQ ID NO: 2174748 - RNA, 17 nt, Human
cacccugggcccugggc

SEQ ID NO: 2174749 - RNA, 21 nt, Human
cacccugggcccugggcugga

SEQ ID NO: 2174750 - RNA, 16 nt, Human
cacccuggugggccaa

SEQ ID NO: 2174751 - RNA, 16 nt, Human
cacccuguacuguucu

SEQ ID NO: 2174752 - RNA, 17 nt, Human
cacccuguacuguucug

SEQ ID NO: 2174753 - RNA, 21 nt, Human
cacccuguacuguucuguguc

SEQ ID NO: 2174754 - RNA, 15 nt, Human
cacccuggugggcca

SEQ ID NO: 2174755 - RNA, 21 nt, Human
cacccuggggccuggaccugc

SEQ ID NO: 2174756 - RNA, 22 nt, Human
cacccuggggccuggaccugcc

SEQ ID NO: 2174757 - RNA, 14 nt, Human
cacccuggggccug

SEQ ID NO: 2174758 - RNA, 15 nt, Human
cacccuggggccugg

SEQ ID NO: 2174759 - RNA, 19 nt, Human
cacccuggggccuggaccu

SEQ ID NO: 2174760 - RNA, 20 nt, Human
cacccuggggccuggaccug

SEQ ID NO: 2174761 - RNA, 20 nt, Human
caccugccagccuggcuucu

SEQ ID NO: 2174762 - RNA, 17 nt, Human
caccugccagccuggcu

SEQ ID NO: 2174763 - RNA, 16 nt, Human
caccugccagccuggc

SEQ ID NO: 2174764 - RNA, 15 nt, Human
caccugccagccugg

SEQ ID NO: 2174765 - RNA, 14 nt, Human
caccugccagccug

SEQ ID NO: 2174766 - RNA, 13 nt, Human
caccugccagccu

SEQ ID NO: 2174767 - RNA, 16 nt, Human
caccuauagucccagc

SEQ ID NO: 2174768 - RNA, 18 nt, Human
caccuaucucgugggaga

SEQ ID NO: 2174769 - RNA, 20 nt, Human
caccuaucucgugggagagc

SEQ ID NO: 2174770 - RNA, 11 nt, Human
caccugccagg

SEQ ID NO: 2174771 - RNA, 12 nt, Human
caccugccaggg

SEQ ID NO: 2174772 - RNA, 22 nt, Human
caccugccagccuggcuucugg

SEQ ID NO: 2174773 - RNA, 13 nt, Human
caccugcccugcc

SEQ ID NO: 2174774 - RNA, 12 nt, Human
caccugcccugc

SEQ ID NO: 2174775 - RNA, 18 nt, Human
caccugccccucaacucu

SEQ ID NO: 2174776 - RNA, 21 nt, Human
caccugccccucaacucuccu

SEQ ID NO: 2174777 - RNA, 23 nt, Human
cacaucuugcucugcugacagac

SEQ ID NO: 2174778 - RNA, 13 nt, Human
cacaucuuggcac

SEQ ID NO: 2174779 - RNA, 15 nt, Human
cacaucuuuaucugu

SEQ ID NO: 2174780 - RNA, 22 nt, Human
cacaucuuuaucuguucuugcu

SEQ ID NO: 2174781 - RNA, 21 nt, Human
cacaucuuucacacuuccacc

SEQ ID NO: 2174782 - RNA, 19 nt, Human
cacaucuuucacacuucca

SEQ ID NO: 2174783 - RNA, 18 nt, Human
cacaucuuucacacuucc

SEQ ID NO: 2174784 - RNA, 12 nt, Human
cacaucuuucac

SEQ ID NO: 2174785 - RNA, 18 nt, Human
cacaugaaaccuuauuuu

SEQ ID NO: 2174786 - RNA, 14 nt, Human
cacaucuuuccugu

SEQ ID NO: 2174787 - RNA, 15 nt, Human
cacaucuuuccuguc

SEQ ID NO: 2174788 - RNA, 12 nt, Human
cacauuguuuua

SEQ ID NO: 2174789 - RNA, 17 nt, Human
cacauuuauucugcuca

SEQ ID NO: 2174790 - RNA, 15 nt, Human
cacauuguuuuaaaa

SEQ ID NO: 2174791 - RNA, 16 nt, Human
cacauuguuuuaaaaa

SEQ ID NO: 2174792 - RNA, 18 nt, Human
cacauuguuuuaaaaaga

SEQ ID NO: 2174793 - RNA, 23 nt, Human
cacauuguuuuaaaaagaaacaa

SEQ ID NO: 2174794 - RNA, 19 nt, Human
cacauuuaagagacaguca

SEQ ID NO: 2174795 - RNA, 18 nt, Human
cacauuuauucugcucac

SEQ ID NO: 2174796 - RNA, 17 nt, Human
caccagccccagugccc

SEQ ID NO: 2174797 - RNA, 17 nt, Human
caccaggagucccuggu

SEQ ID NO: 2174798 - RNA, 19 nt, Human
caccaggagaaccacuaca

SEQ ID NO: 2174799 - RNA, 17 nt, Human
caccaggagaaccacua

SEQ ID NO: 2174800 - RNA, 16 nt, Human
caccaggagaaccacu

SEQ ID NO: 2174801 - RNA, 21 nt, Human
caccaggaauguuaaagucag

SEQ ID NO: 2174802 - RNA, 17 nt, Human
caccaggaauguuaaag

SEQ ID NO: 2174803 - RNA, 12 nt, Human
caccaggaaugu

SEQ ID NO: 2174804 - RNA, 11 nt, Human
caccaggaagg

SEQ ID NO: 2174805 - RNA, 19 nt, Human
caccagcccggccugcucc

SEQ ID NO: 2174806 - RNA, 19 nt, Human
caccagcccuuagcaggga

SEQ ID NO: 2174807 - RNA, 16 nt, Human
caccagccccugcccc

SEQ ID NO: 2174808 - RNA, 17 nt, Human
caccagccccugcccca

SEQ ID NO: 2174809 - RNA, 19 nt, Human
caccagccccugccccagc

SEQ ID NO: 2174810 - RNA, 21 nt, Human
caccagccccugccccagccc

SEQ ID NO: 2174811 - RNA, 15 nt, Human
caccagcccggccug

SEQ ID NO: 2174812 - RNA, 16 nt, Human
caccagcccggccugc

SEQ ID NO: 2174813 - RNA, 17 nt, Human
caccagcccggccugcu

SEQ ID NO: 2174814 - RNA, 18 nt, Human
caccagcccggccugcuc

SEQ ID NO: 2174815 - RNA, 18 nt, Human
caccagccccagugccca

SEQ ID NO: 2174816 - RNA, 21 nt, Human
caccagccccagugcccacag

SEQ ID NO: 2174817 - RNA, 22 nt, Human
caccagccccagugcccacagg

SEQ ID NO: 2174818 - RNA, 13 nt, Human
caccagccccugc

SEQ ID NO: 2174819 - RNA, 14 nt, Human
caccagccccugcc

SEQ ID NO: 2174820 - RNA, 15 nt, Human
caccagccccugccc

SEQ ID NO: 2174821 - RNA, 16 nt, Human
cacauuuaagagacag

SEQ ID NO: 2174822 - RNA, 10 nt, Human
cacccagccc

SEQ ID NO: 2174823 - RNA, 11 nt, Human
cacccagccca

SEQ ID NO: 2174824 - RNA, 18 nt, Human
cacccagcaacuccaacu

SEQ ID NO: 2174825 - RNA, 12 nt, Human
cacccagcccac

SEQ ID NO: 2174826 - RNA, 20 nt, Human
cacccaggcuggagugcaau

SEQ ID NO: 2174827 - RNA, 20 nt, Human
cacccaggcuggaguacagu

SEQ ID NO: 2174828 - RNA, 23 nt, Human
caccaggaauguuaaagucagug

SEQ ID NO: 2174829 - RNA, 15 nt, Human
caccaggauggcccu

SEQ ID NO: 2174830 - RNA, 13 nt, Human
caccaggauggcc

SEQ ID NO: 2174831 - RNA, 21 nt, Human
caccaggauggcccuucccac

SEQ ID NO: 2174832 - RNA, 20 nt, Human
caccaggcaccucacagaaa

SEQ ID NO: 2174833 - RNA, 22 nt, Human
caccaggcaccucacagaaaug

SEQ ID NO: 2174834 - RNA, 23 nt, Human
caccaggcaccucacagaaauga

SEQ ID NO: 2174835 - RNA, 22 nt, Human
caccaggcacgaacccaccugc

SEQ ID NO: 2174836 - RNA, 21 nt, Human
caccaggcacgaacccaccug

SEQ ID NO: 2174837 - RNA, 20 nt, Human
caccaggcacgaacccaccu

SEQ ID NO: 2174838 - RNA, 19 nt, Human
caccaggcacgaacccacc

SEQ ID NO: 2174839 - RNA, 24 nt, Human
caccaggcacgaacccaccugcug

SEQ ID NO: 2174840 - RNA, 23 nt, Human
caccaggcacgaacccaccugcu

SEQ ID NO: 2174841 - RNA, 22 nt, Human
cacccagacagcucccucugcc

SEQ ID NO: 2174842 - RNA, 16 nt, Human
cacccagacagcuccc

SEQ ID NO: 2174843 - RNA, 14 nt, Human
cacccagacagcuc

SEQ ID NO: 2174844 - RNA, 21 nt, Human
cacccacucuccucugccuca

SEQ ID NO: 2174845 - RNA, 21 nt, Human
cacccagaugggggaaagcac

SEQ ID NO: 2174846 - RNA, 14 nt, Human
cacccaugaagaca

SEQ ID NO: 2174847 - RNA, 15 nt, Human
cacccaugaagacag

SEQ ID NO: 2174848 - RNA, 23 nt, Human
cacccauccuaucagccugucuc

SEQ ID NO: 2174849 - RNA, 22 nt, Human
cacccauccuaccaaugcaugc

SEQ ID NO: 2174850 - RNA, 23 nt, Human
cacccauccuaccaaugcaugca

SEQ ID NO: 2174851 - RNA, 18 nt, Human
cacccaucuguuuuuugu

SEQ ID NO: 2174852 - RNA, 13 nt, Human
cacccaucuguuu

SEQ ID NO: 2174853 - RNA, 17 nt, Human
cacccagucuguucccc

SEQ ID NO: 2174854 - RNA, 17 nt, Human
cacccagugagcacucc

SEQ ID NO: 2174855 - RNA, 20 nt, Human
cacccagugagcacucccaa

SEQ ID NO: 2174856 - RNA, 23 nt, Human
cacccagugagcacucccaaguc

SEQ ID NO: 2174857 - RNA, 13 nt, Human
cacaucuugcucu

SEQ ID NO: 2174858 - RNA, 14 nt, Human
cacaucuugcucug

SEQ ID NO: 2174859 - RNA, 21 nt, Human
cacauccacacacgcaggaac

SEQ ID NO: 2174860 - RNA, 21 nt, Human
cacauccauuucaucuauuuc

SEQ ID NO: 2174861 - RNA, 23 nt, Human
cacauccauuucaucuauuucug

SEQ ID NO: 2174862 - RNA, 22 nt, Human
cacaucuucccuagaggguucc

SEQ ID NO: 2174863 - RNA, 20 nt, Human
cacaucuugaucugcucagc

SEQ ID NO: 2174864 - RNA, 15 nt, Human
cacaucuugcucugc

SEQ ID NO: 2174865 - RNA, 20 nt, Human
cacaucuugcucugcugaca

SEQ ID NO: 2174866 - RNA, 21 nt, Human
cacaucuugcucugcugacag

SEQ ID NO: 2174867 - RNA, 22 nt, Human
cacaucuugcucugcugacaga

SEQ ID NO: 2174868 - RNA, 17 nt, Human
cacaucagucacaaguu

SEQ ID NO: 2174869 - RNA, 23 nt, Human
cacaucagcuugcccuguuaaaa

SEQ ID NO: 2174870 - RNA, 13 nt, Human
cacaucagcuugc

SEQ ID NO: 2174871 - RNA, 17 nt, Human
caagauuuucuacuuuu

SEQ ID NO: 2174872 - RNA, 14 nt, Human
caagcaaaaucaug

SEQ ID NO: 2174873 - RNA, 22 nt, Human
caagcaaaaucauggaaugguu

SEQ ID NO: 2174874 - RNA, 23 nt, Human
caagcaaaaucauggaaugguua

SEQ ID NO: 2174875 - RNA, 15 nt, Human
caagcaaaugugaau

SEQ ID NO: 2174876 - RNA, 17 nt, Human
caagcaaaugugaauca

SEQ ID NO: 2174877 - RNA, 19 nt, Human
caagcaaaugugaaucauu

SEQ ID NO: 2174878 - RNA, 19 nt, Human
caagcaaccuggguccaaa

SEQ ID NO: 2174879 - RNA, 22 nt, Human
caagcaaccuggguccaaauaa

SEQ ID NO: 2174880 - RNA, 18 nt, Human
caagcaagaaacacuggg

SEQ ID NO: 2174881 - RNA, 19 nt, Human
caagcaaaggugaagagac

SEQ ID NO: 2174882 - RNA, 16 nt, Human
caagcaaccugggucc

SEQ ID NO: 2174883 - RNA, 17 nt, Human
caagcaaccugggucca

SEQ ID NO: 2174884 - RNA, 13 nt, Human
caagcaagaaaca

SEQ ID NO: 2174885 - RNA, 12 nt, Human
caagcaagcucc

SEQ ID NO: 2174886 - RNA, 23 nt, Human
caagcaagcucccaagggauggu

SEQ ID NO: 2174887 - RNA, 14 nt, Human
caagcaaguauuag

SEQ ID NO: 2174888 - RNA, 16 nt, Human
caagcaaaaggagaga

SEQ ID NO: 2174889 - RNA, 22 nt, Human
caagauuuugaaugcuuccuga

SEQ ID NO: 2174890 - RNA, 21 nt, Human
caagauuuuccuuuuuuauac

SEQ ID NO: 2174891 - RNA, 22 nt, Human
caagauuuuccuuuuuuauaca

SEQ ID NO: 2174892 - RNA, 18 nt, Human
caagauuuuccacaagau

SEQ ID NO: 2174893 - RNA, 12 nt, Human
caagauuuuccu

SEQ ID NO: 2174894 - RNA, 15 nt, Human
caagauuuuccuuuu

SEQ ID NO: 2174895 - RNA, 16 nt, Human
caagauuuuccuuuuu

SEQ ID NO: 2174896 - RNA, 17 nt, Human
caagauuuuccuuuuuu

SEQ ID NO: 2174897 - RNA, 19 nt, Human
caagauuuuccuuuuuuau

SEQ ID NO: 2174898 - RNA, 14 nt, Human
caagaucuuucagg

SEQ ID NO: 2174899 - RNA, 13 nt, Human
caagaucuuucag

SEQ ID NO: 2174900 - RNA, 12 nt, Human
caagaucuuuca

SEQ ID NO: 2174901 - RNA, 20 nt, Human
caagaucugugcagccccgc

SEQ ID NO: 2174902 - RNA, 22 nt, Human
caagauccugucuuuaaggaaa

SEQ ID NO: 2174903 - RNA, 16 nt, Human
caagaucgcgccacug

SEQ ID NO: 2174904 - RNA, 15 nt, Human
caagaucugugcagc

SEQ ID NO: 2174905 - RNA, 19 nt, Human
caagaugagagaacuggag

SEQ ID NO: 2174906 - RNA, 15 nt, Human
caagaucuuucagga

SEQ ID NO: 2174907 - RNA, 18 nt, Human
caagaugaaggagaggca

SEQ ID NO: 2174908 - RNA, 19 nt, Human
caagaccaccacuucgaaa

SEQ ID NO: 2174909 - RNA, 23 nt, Human
caagauauuuuaaaaucugucac

SEQ ID NO: 2174910 - RNA, 21 nt, Human
caagauauuuuaaaaucuguc

SEQ ID NO: 2174911 - RNA, 19 nt, Human
caagauccugucuuuaagg

SEQ ID NO: 2174912 - RNA, 18 nt, Human
caagaucauguaccccaa

SEQ ID NO: 2174913 - RNA, 16 nt, Human
caagauauuuauauau

SEQ ID NO: 2174914 - RNA, 16 nt, Human
caagaccacguuucua

SEQ ID NO: 2174915 - RNA, 14 nt, Human
caagaccacguuuc

SEQ ID NO: 2174916 - RNA, 14 nt, Human
caagcaccuccugc

SEQ ID NO: 2174917 - RNA, 18 nt, Human
caagcaccuagccucgcu

SEQ ID NO: 2174918 - RNA, 17 nt, Human
caagcacagugccugca

SEQ ID NO: 2174919 - RNA, 13 nt, Human
caagcacaguggu

SEQ ID NO: 2174920 - RNA, 15 nt, Human
caagcacaguggugg

SEQ ID NO: 2174921 - RNA, 17 nt, Human
caagcacagcagccugg

SEQ ID NO: 2174922 - RNA, 14 nt, Human
caagcacagcagcc

SEQ ID NO: 2174923 - RNA, 13 nt, Human
caagcacagcagc

SEQ ID NO: 2174924 - RNA, 12 nt, Human
caagcacagcag

SEQ ID NO: 2174925 - RNA, 20 nt, Human
caagcacaucugcauuuuca

SEQ ID NO: 2174926 - RNA, 17 nt, Human
caagcacaucugcauuu

SEQ ID NO: 2174927 - RNA, 16 nt, Human
caagcacagugguggc

SEQ ID NO: 2174928 - RNA, 19 nt, Human
caagcacagugguggcagg

SEQ ID NO: 2174929 - RNA, 20 nt, Human
caagcacagugguggcaggg

SEQ ID NO: 2174930 - RNA, 21 nt, Human
caagcacagugguggcagggc

SEQ ID NO: 2174931 - RNA, 13 nt, Human
caagcaccuccug

SEQ ID NO: 2174932 - RNA, 18 nt, Human
caagaauagaugcugacu

SEQ ID NO: 2174933 - RNA, 23 nt, Human
caagaauaaucacgcuuuccuga

SEQ ID NO: 2174934 - RNA, 22 nt, Human
caagaauaaucacgcuuuccug

SEQ ID NO: 2174935 - RNA, 21 nt, Human
caagaauaaucacgcuuuccu

SEQ ID NO: 2174936 - RNA, 20 nt, Human
caagaauaaucacgcuuucc

SEQ ID NO: 2174937 - RNA, 22 nt, Human
caagaagcuuuaauauuuaaau

SEQ ID NO: 2174938 - RNA, 15 nt, Human
caagaagccuuuccu

SEQ ID NO: 2174939 - RNA, 21 nt, Human
caagaagcgugagacgccacc

SEQ ID NO: 2174940 - RNA, 18 nt, Human
caagaagcccaggaaagg

SEQ ID NO: 2174941 - RNA, 17 nt, Human
caagaaggaugauucaa

SEQ ID NO: 2174942 - RNA, 19 nt, Human
caagaaucagugcaaagau

SEQ ID NO: 2174943 - RNA, 18 nt, Human
caagaaucagugcaaaga

SEQ ID NO: 2174944 - RNA, 23 nt, Human
caagaaucagucuauccacagag

SEQ ID NO: 2174945 - RNA, 18 nt, Human
caagacauugucaauaaa

SEQ ID NO: 2174946 - RNA, 17 nt, Human
caagacauugucaauaa

SEQ ID NO: 2174947 - RNA, 14 nt, Human
caagacauugucaa

SEQ ID NO: 2174948 - RNA, 13 nt, Human
caagacauuguca

SEQ ID NO: 2174949 - RNA, 11 nt, Human
caagacauugu

SEQ ID NO: 2174950 - RNA, 15 nt, Human
caagacauuaaaucu

SEQ ID NO: 2174951 - RNA, 17 nt, Human
caagacaugucuguucu

SEQ ID NO: 2174952 - RNA, 15 nt, Human
caagacaugucuguu

SEQ ID NO: 2174953 - RNA, 14 nt, Human
caagacaugucugu

SEQ ID NO: 2174954 - RNA, 17 nt, Human
caacuccaguagcuugg

SEQ ID NO: 2174955 - RNA, 20 nt, Human
caacucccugccccccagcc

SEQ ID NO: 2174956 - RNA, 19 nt, Human
caacucccugccccccagc

SEQ ID NO: 2174957 - RNA, 21 nt, Human
caacucccugccccccagccc

SEQ ID NO: 2174958 - RNA, 19 nt, Human
caacuccuagggccacuga

SEQ ID NO: 2174959 - RNA, 15 nt, Human
caagaagcccaggaa

SEQ ID NO: 2174960 - RNA, 14 nt, Human
caacuauggccugu

SEQ ID NO: 2174961 - RNA, 17 nt, Human
caacuauggaucagaau

SEQ ID NO: 2174962 - RNA, 16 nt, Human
caacuauggaucagaa

SEQ ID NO: 2174963 - RNA, 12 nt, Human
caacuccagaaa

SEQ ID NO: 2174964 - RNA, 15 nt, Human
caacuauuuuuccaa

SEQ ID NO: 2174965 - RNA, 14 nt, Human
caacccccacccca

SEQ ID NO: 2174966 - RNA, 13 nt, Human
caacccccacccc

SEQ ID NO: 2174967 - RNA, 12 nt, Human
caacccccaccc

SEQ ID NO: 2174968 - RNA, 11 nt, Human
caacccccacc

SEQ ID NO: 2174969 - RNA, 13 nt, Human
caaccccaggcug

SEQ ID NO: 2174970 - RNA, 13 nt, Human
caaccccaguucu

SEQ ID NO: 2174971 - RNA, 14 nt, Human
caaccccaguucug

SEQ ID NO: 2174972 - RNA, 17 nt, Human
caaccccaguucugcuc

SEQ ID NO: 2174973 - RNA, 19 nt, Human
caaccccaguucugcuccu

SEQ ID NO: 2174974 - RNA, 20 nt, Human
caaccccaguucugcuccuc

SEQ ID NO: 2174975 - RNA, 22 nt, Human
caaccccaguucugcuccucuc

SEQ ID NO: 2174976 - RNA, 23 nt, Human
caacccccaccccacacuuguuc

SEQ ID NO: 2174977 - RNA, 13 nt, Human
caacccccagcac

SEQ ID NO: 2174978 - RNA, 15 nt, Human
caacccccagcaccc

SEQ ID NO: 2174979 - RNA, 18 nt, Human
caacccccaccccacacu

SEQ ID NO: 2174980 - RNA, 17 nt, Human
caacccccaccccacac

SEQ ID NO: 2174981 - RNA, 14 nt, Human
caacccccagccug

SEQ ID NO: 2174982 - RNA, 15 nt, Human
caaccccagccgcuc

SEQ ID NO: 2174983 - RNA, 23 nt, Human
caaccccagccgcucggaggccc

SEQ ID NO: 2174984 - RNA, 19 nt, Human
caacuauauuaucaugcaa

SEQ ID NO: 2174985 - RNA, 18 nt, Human
caacuauauuaucaugca

SEQ ID NO: 2174986 - RNA, 19 nt, Human
caacuauaagcccacuguu

SEQ ID NO: 2174987 - RNA, 13 nt, Human
caacuauggccug

SEQ ID NO: 2174988 - RNA, 19 nt, Human
caacuauauuguuugcuaa

SEQ ID NO: 2174989 - RNA, 19 nt, Human
caacuaucucauuuccaag

SEQ ID NO: 2174990 - RNA, 22 nt, Human
caaccccuguggagcccgcacc

SEQ ID NO: 2174991 - RNA, 20 nt, Human
caacccccagcacccgggcu

SEQ ID NO: 2174992 - RNA, 16 nt, Human
caaccccuguggagcc

SEQ ID NO: 2174993 - RNA, 17 nt, Human
caacuaggcuucagcau

SEQ ID NO: 2174994 - RNA, 21 nt, Human
caaccccuguggagcccgcac

SEQ ID NO: 2174995 - RNA, 17 nt, Human
caaccccuucgcuccug

SEQ ID NO: 2174996 - RNA, 14 nt, Human
caaccccuucgcuc

SEQ ID NO: 2174997 - RNA, 16 nt, Human
caaccccuucgcuccu

SEQ ID NO: 2174998 - RNA, 15 nt, Human
caaggccauccuucc

SEQ ID NO: 2174999 - RNA, 22 nt, Human
caaggccagaguggccuggcca

SEQ ID NO: 2175000 - RNA, 21 nt, Human
caaggccagaguggccuggcc

SEQ ID NO: 2175001 - RNA, 20 nt, Human
caaggccagaguggccuggc

SEQ ID NO: 2175002 - RNA, 19 nt, Human
caaggccagaguggccugg

SEQ ID NO: 2175003 - RNA, 18 nt, Human
caaggccagaguggccug

SEQ ID NO: 2175004 - RNA, 16 nt, Human
caaggcaaggcaggug

SEQ ID NO: 2175005 - RNA, 18 nt, Human
caaggcaaggcaggugcc

SEQ ID NO: 2175006 - RNA, 17 nt, Human
caaggccagaguggccu

SEQ ID NO: 2175007 - RNA, 14 nt, Human
caaggcaaggcagg

SEQ ID NO: 2175008 - RNA, 15 nt, Human
caaggcaaggcaggu

SEQ ID NO: 2175009 - RNA, 14 nt, Human
caaggcaaggcugu

SEQ ID NO: 2175010 - RNA, 19 nt, Human
caaggauugcuacuguccu

SEQ ID NO: 2175011 - RNA, 22 nt, Human
caagcuccuccucccugcaucu

SEQ ID NO: 2175012 - RNA, 20 nt, Human
caaggauugcuacuguccua

SEQ ID NO: 2175013 - RNA, 17 nt, Human
caaggccauccuucccu

SEQ ID NO: 2175014 - RNA, 23 nt, Human
caaggccauccuucccugucugc

SEQ ID NO: 2175015 - RNA, 17 nt, Human
caaggccaucugggcuc

SEQ ID NO: 2175016 - RNA, 14 nt, Human
caaggccaucuggg

SEQ ID NO: 2175017 - RNA, 12 nt, Human
caaggccccaga

SEQ ID NO: 2175018 - RNA, 15 nt, Human
caaggccccagagac

SEQ ID NO: 2175019 - RNA, 14 nt, Human
caaggccccagaga

SEQ ID NO: 2175020 - RNA, 21 nt, Human
caaggccccagagacucagag

SEQ ID NO: 2175021 - RNA, 22 nt, Human
caaggcccccgggccgacggag

SEQ ID NO: 2175022 - RNA, 17 nt, Human
caaggccccagagacuc

SEQ ID NO: 2175023 - RNA, 16 nt, Human
caaggccccagagacu

SEQ ID NO: 2175024 - RNA, 21 nt, Human
caagguuuaggcugguggccc

SEQ ID NO: 2175025 - RNA, 23 nt, Human
caagguuuaggcugguggcccag

SEQ ID NO: 2175026 - RNA, 22 nt, Human
caagguuuaggcugguggccca

SEQ ID NO: 2175027 - RNA, 24 nt, Human
caagguuuaggcugguggcccagg

SEQ ID NO: 2175028 - RNA, 19 nt, Human
caagguuuuauaaggcuga

SEQ ID NO: 2175029 - RNA, 22 nt, Human
caaguaagaagacaugaaccaa

SEQ ID NO: 2175030 - RNA, 13 nt, Human
caaguaagaagac

SEQ ID NO: 2175031 - RNA, 13 nt, Human
caaguaaacauuc

SEQ ID NO: 2175032 - RNA, 16 nt, Human
caaguaagaagacaug

SEQ ID NO: 2175033 - RNA, 14 nt, Human
caaguaagaagaca

SEQ ID NO: 2175034 - RNA, 18 nt, Human
caaguaagaagacaugaa

SEQ ID NO: 2175035 - RNA, 13 nt, Human
caaguauuauacc

SEQ ID NO: 2175036 - RNA, 22 nt, Human
caaguauuauaccuuuuuuaga

SEQ ID NO: 2175037 - RNA, 17 nt, Human
caaguauuauaccuuuu

SEQ ID NO: 2175038 - RNA, 21 nt, Human
caagcuccaucuccacuccag

SEQ ID NO: 2175039 - RNA, 13 nt, Human
caagcucccaagg

SEQ ID NO: 2175040 - RNA, 18 nt, Human
caagcucccaagggaugg

SEQ ID NO: 2175041 - RNA, 22 nt, Human
caagcucccaagggauggugcc

SEQ ID NO: 2175042 - RNA, 17 nt, Human
caagcuccaucuccacu

SEQ ID NO: 2175043 - RNA, 19 nt, Human
caagcuccaagcucccagg

SEQ ID NO: 2175044 - RNA, 21 nt, Human
caagcuccaagcucccaggca

SEQ ID NO: 2175045 - RNA, 17 nt, Human
caagcuccaagcuccca

SEQ ID NO: 2175046 - RNA, 18 nt, Human
caagcuccaagcucccag

SEQ ID NO: 2175047 - RNA, 15 nt, Human
caagcucugcuccuc

SEQ ID NO: 2175048 - RNA, 20 nt, Human
caagcuccgccucccggguu

SEQ ID NO: 2175049 - RNA, 14 nt, Human
caagcucccaggcc

SEQ ID NO: 2175050 - RNA, 16 nt, Human
caagcucugcuccucu

SEQ ID NO: 2175051 - RNA, 17 nt, Human
caagcuccuccucccug

SEQ ID NO: 2175052 - RNA, 16 nt, Human
caagcuccuccucccu

SEQ ID NO: 2175053 - RNA, 15 nt, Human
caagcuccuccuccc

SEQ ID NO: 2175054 - RNA, 14 nt, Human
caagcuccuccucc

SEQ ID NO: 2175055 - RNA, 23 nt, Human
caagcuccuccucccugcaucug

SEQ ID NO: 2175056 - RNA, 12 nt, Human
caagcucccagg

SEQ ID NO: 2175057 - RNA, 14 nt, Human
caagcucccaggca

SEQ ID NO: 2175058 - RNA, 15 nt, Human
caagcucccaggcau

SEQ ID NO: 2175059 - RNA, 17 nt, Human
caagcucccaggcauuc

SEQ ID NO: 2175060 - RNA, 19 nt, Human
caaguuauugacaaacucu

SEQ ID NO: 2175061 - RNA, 12 nt, Human
caaguuauugua

SEQ ID NO: 2175062 - RNA, 20 nt, Human
caaguuauuguacagcuguu

SEQ ID NO: 2175063 - RNA, 22 nt, Human
caaguauuugggaagugaagac

SEQ ID NO: 2175064 - RNA, 19 nt, Human
caaguauuugggaagugaa

SEQ ID NO: 2175065 - RNA, 12 nt, Human
caaguucaaucu

SEQ ID NO: 2175066 - RNA, 17 nt, Human
caaguucaaucuguuuu

SEQ ID NO: 2175067 - RNA, 21 nt, Human
caaguuccucuagugcccucc

SEQ ID NO: 2175068 - RNA, 18 nt, Human
caaguuccaaguugcuaa

SEQ ID NO: 2175069 - RNA, 21 nt, Human
caauuucaaaaaaauaaaaua

SEQ ID NO: 2175070 - RNA, 20 nt, Human
caauuucaaaaaaauaaaau

SEQ ID NO: 2175071 - RNA, 17 nt, Human
caauuuauucaagaaaa

SEQ ID NO: 2175072 - RNA, 14 nt, Human
caauuuauucaaga

SEQ ID NO: 2175073 - RNA, 17 nt, Human
caauugucauuuauaaa

SEQ ID NO: 2175074 - RNA, 13 nt, Human
caauuuauuaugg

SEQ ID NO: 2175075 - RNA, 21 nt, Human
caauugugagccaccacgucc

SEQ ID NO: 2175076 - RNA, 18 nt, Human
caauugugagccaccacg

SEQ ID NO: 2175077 - RNA, 15 nt, Human
caauugucauuuaua

SEQ ID NO: 2175078 - RNA, 16 nt, Human
caauugucauuuauaa

SEQ ID NO: 2175079 - RNA, 20 nt, Human
caauuuauuauggcacauca

SEQ ID NO: 2175080 - RNA, 15 nt, Human
cacaagcuggaagca

SEQ ID NO: 2175081 - RNA, 13 nt, Human
cacaagcuggaag

SEQ ID NO: 2175082 - RNA, 14 nt, Human
cacaagcuggaagc

SEQ ID NO: 2175083 - RNA, 16 nt, Human
cacaagcuggaagcac

SEQ ID NO: 2175084 - RNA, 11 nt, Human
caauuucaagu

SEQ ID NO: 2175085 - RNA, 14 nt, Human
caauuucagacucc

SEQ ID NO: 2175086 - RNA, 22 nt, Human
cacaaggauagaugcuggccca

SEQ ID NO: 2175087 - RNA, 21 nt, Human
cacaaggauagaugcuggccc

SEQ ID NO: 2175088 - RNA, 18 nt, Human
cacaaggauagaugcugg

SEQ ID NO: 2175089 - RNA, 17 nt, Human
cacaaggauagaugcug

SEQ ID NO: 2175090 - RNA, 22 nt, Human
cacaaggacuuccuguccagcu

SEQ ID NO: 2175091 - RNA, 16 nt, Human
cacaaggacuuccugu

SEQ ID NO: 2175092 - RNA, 14 nt, Human
cacaaggacuuccu

SEQ ID NO: 2175093 - RNA, 12 nt, Human
cacaaggacuuc

SEQ ID NO: 2175094 - RNA, 11 nt, Human
caauauuuucc

SEQ ID NO: 2175095 - RNA, 13 nt, Human
caauauuuuccau

SEQ ID NO: 2175096 - RNA, 15 nt, Human
caauauuuuccauga

SEQ ID NO: 2175097 - RNA, 15 nt, Human
caauauuuguagaag

SEQ ID NO: 2175098 - RNA, 14 nt, Human
caauauuuguagaa

SEQ ID NO: 2175099 - RNA, 13 nt, Human
caauauuuguaga

SEQ ID NO: 2175100 - RNA, 16 nt, Human
caauauuuuccaugaa

SEQ ID NO: 2175101 - RNA, 19 nt, Human
caauauuuuccaugaaaau

SEQ ID NO: 2175102 - RNA, 20 nt, Human
caauauuuuccaugaaaaug

SEQ ID NO: 2175103 - RNA, 22 nt, Human
caauauuuuccaugaaaaugca

SEQ ID NO: 2175104 - RNA, 16 nt, Human
caauauuuucuuuaau

SEQ ID NO: 2175105 - RNA, 20 nt, Human
caauauuuucuuuaaugcuu

SEQ ID NO: 2175106 - RNA, 19 nt, Human
caauauuuucuuuaaugcu

SEQ ID NO: 2175107 - RNA, 14 nt, Human
caauauuuuuagau

SEQ ID NO: 2175108 - RNA, 17 nt, Human
caauauuguacaguuuu

SEQ ID NO: 2175109 - RNA, 18 nt, Human
caauauuguacaguuuuu

SEQ ID NO: 2175110 - RNA, 14 nt, Human
caauauuguuucua

SEQ ID NO: 2175111 - RNA, 16 nt, Human
caauauugucauuccu

SEQ ID NO: 2175112 - RNA, 12 nt, Human
caauauuuauua

SEQ ID NO: 2175113 - RNA, 13 nt, Human
caauauuuaaaca

SEQ ID NO: 2175114 - RNA, 14 nt, Human
caauauuuaaacau

SEQ ID NO: 2175115 - RNA, 14 nt, Human
caauauuuauuauu

SEQ ID NO: 2175116 - RNA, 13 nt, Human
caauauuuauuau

SEQ ID NO: 2175117 - RNA, 14 nt, Human
caauauuuccucau

SEQ ID NO: 2175118 - RNA, 19 nt, Human
caauauuuccucaugugau

SEQ ID NO: 2175119 - RNA, 17 nt, Human
caauauuuccucaugug

SEQ ID NO: 2175120 - RNA, 15 nt, Human
caauauuguacaguu

SEQ ID NO: 2175121 - RNA, 16 nt, Human
caauauuguacaguuu

SEQ ID NO: 2175122 - RNA, 12 nt, Human
caaugcuggcug

SEQ ID NO: 2175123 - RNA, 12 nt, Human
caauuggaggaa

SEQ ID NO: 2175124 - RNA, 22 nt, Human
caauugggauggcgcuaggcau

SEQ ID NO: 2175125 - RNA, 16 nt, Human
caauugguuaaucuuu

SEQ ID NO: 2175126 - RNA, 19 nt, Human
caauuguaaaacugaggca

SEQ ID NO: 2175127 - RNA, 14 nt, Human
caauugucauuuau

SEQ ID NO: 2175128 - RNA, 14 nt, Human
caauuguaaauuga

SEQ ID NO: 2175129 - RNA, 13 nt, Human
caauugucuuuuu

SEQ ID NO: 2175130 - RNA, 13 nt, Human
caauggcagccuu

SEQ ID NO: 2175131 - RNA, 21 nt, Human
caaugcugauuuggugaccaa

SEQ ID NO: 2175132 - RNA, 16 nt, Human
caaugcugauuuggug

SEQ ID NO: 2175133 - RNA, 14 nt, Human
caaugcugauuugg

SEQ ID NO: 2175134 - RNA, 13 nt, Human
caaugcugauguc

SEQ ID NO: 2175135 - RNA, 20 nt, Human
caaugcugauguccucacca

SEQ ID NO: 2175136 - RNA, 14 nt, Human
caauggcagccuug

SEQ ID NO: 2175137 - RNA, 15 nt, Human
caauggcagccuugg

SEQ ID NO: 2175138 - RNA, 18 nt, Human
caaucaaaggaaaauagu

SEQ ID NO: 2175139 - RNA, 12 nt, Human
caauauuuuucu

SEQ ID NO: 2175140 - RNA, 17 nt, Human
caaucaaagcacuugga

SEQ ID NO: 2175141 - RNA, 14 nt, Human
caaucaaaucugcu

SEQ ID NO: 2175142 - RNA, 15 nt, Human
caaucaacucuaaua

SEQ ID NO: 2175143 - RNA, 20 nt, Human
caaugccauccucaaacacu

SEQ ID NO: 2175144 - RNA, 20 nt, Human
caaugcccguaaugcuuaga

SEQ ID NO: 2175145 - RNA, 14 nt, Human
caaugccaucaucu

SEQ ID NO: 2175146 - RNA, 16 nt, Human
caaugccauccucaaa

SEQ ID NO: 2175147 - RNA, 18 nt, Human
caaugccauccucaaaca

SEQ ID NO: 2175148 - RNA, 13 nt, Human
caaugccaucauc

SEQ ID NO: 2175149 - RNA, 18 nt, Human
caaucagcuccuuccugg

SEQ ID NO: 2175150 - RNA, 16 nt, Human
caaucagcuccuuccu

SEQ ID NO: 2175151 - RNA, 15 nt, Human
caaucagcuccuucc

SEQ ID NO: 2175152 - RNA, 17 nt, Human
caaucagccuaguugau

SEQ ID NO: 2175153 - RNA, 22 nt, Human
auuucgugggucuguuuuccuu

SEQ ID NO: 2175154 - RNA, 21 nt, Human
auuucuaaaaaacagaggcca

SEQ ID NO: 2175155 - RNA, 13 nt, Human
auuucuuacaggc

SEQ ID NO: 2175156 - RNA, 20 nt, Human
auuucuuacuaaacauuuug

SEQ ID NO: 2175157 - RNA, 21 nt, Human
auuucgccguugaagaggaag

SEQ ID NO: 2175158 - RNA, 19 nt, Human
auuuccuuuuuuguuauua

SEQ ID NO: 2175159 - RNA, 20 nt, Human
auuucuaaaaaacagaggcc

SEQ ID NO: 2175160 - RNA, 14 nt, Human
auuucuaaaaaaca

SEQ ID NO: 2175161 - RNA, 20 nt, Human
auuucgugggucuguuuucc

SEQ ID NO: 2175162 - RNA, 21 nt, Human
auuucgucuguuuauaaacau

SEQ ID NO: 2175163 - RNA, 20 nt, Human
auuuccuauguaacugcauu

SEQ ID NO: 2175164 - RNA, 19 nt, Human
auuuccuauuuuuggaaga

SEQ ID NO: 2175165 - RNA, 22 nt, Human
auuuccucaacguugcucccca

SEQ ID NO: 2175166 - RNA, 24 nt, Human
auuuccucaacguugcuccccauc

SEQ ID NO: 2175167 - RNA, 20 nt, Human
auuuccuccgucaccucaga

SEQ ID NO: 2175168 - RNA, 11 nt, Human
auuuccucuau

SEQ ID NO: 2175169 - RNA, 16 nt, Human
auuuccuccacaaauu

SEQ ID NO: 2175170 - RNA, 21 nt, Human
auuuccucaugugaucacaau

SEQ ID NO: 2175171 - RNA, 22 nt, Human
auuuccucaugugaucacaauu

SEQ ID NO: 2175172 - RNA, 22 nt, Human
auuuccucuauugauguacagu

SEQ ID NO: 2175173 - RNA, 18 nt, Human
auuuccucuauugaugua

SEQ ID NO: 2175174 - RNA, 19 nt, Human
auuuccucuauugauguac

SEQ ID NO: 2175175 - RNA, 13 nt, Human
auuuccugcccuu

SEQ ID NO: 2175176 - RNA, 20 nt, Human
auuuccugcccuuccucagu

SEQ ID NO: 2175177 - RNA, 23 nt, Human
auuuccuugaauguggcuugaga

SEQ ID NO: 2175178 - RNA, 18 nt, Human
auuuccuuuggagcuuuu

SEQ ID NO: 2175179 - RNA, 13 nt, Human
auuuccuuuauaa

SEQ ID NO: 2175180 - RNA, 21 nt, Human
auuuccuaaauauauuuuaag

SEQ ID NO: 2175181 - RNA, 18 nt, Human
auuuccuaucaccuauuu

SEQ ID NO: 2175182 - RNA, 22 nt, Human
auuuccuaguucuguagaaaug

SEQ ID NO: 2175183 - RNA, 18 nt, Human
auuuccuaguucuguaga

SEQ ID NO: 2175184 - RNA, 20 nt, Human
auuuccuaguucuguagaaa

SEQ ID NO: 2175185 - RNA, 15 nt, Human
auuuccuaguucugu

SEQ ID NO: 2175186 - RNA, 19 nt, Human
auuuccuaauuuugagaaa

SEQ ID NO: 2175187 - RNA, 14 nt, Human
auuuccuaaauaua

SEQ ID NO: 2175188 - RNA, 17 nt, Human
auuuccguuaaaauacc

SEQ ID NO: 2175189 - RNA, 14 nt, Human
auuucccaaagcag

SEQ ID NO: 2175190 - RNA, 16 nt, Human
auuucccaaagcagug

SEQ ID NO: 2175191 - RNA, 14 nt, Human
auuucaaaacucau

SEQ ID NO: 2175192 - RNA, 18 nt, Human
auuucaucugcucuccuu

SEQ ID NO: 2175193 - RNA, 19 nt, Human
auuucaucugcucuccuuc

SEQ ID NO: 2175194 - RNA, 19 nt, Human
auuucaaaaaaauaaaaua

SEQ ID NO: 2175195 - RNA, 20 nt, Human
auuucaaaaaaauaaaauaa

SEQ ID NO: 2175196 - RNA, 14 nt, Human
auuucaaaaauaua

SEQ ID NO: 2175197 - RNA, 15 nt, Human
auuucaaaaauauaa

SEQ ID NO: 2175198 - RNA, 17 nt, Human
auuucaaaaauauaacu

SEQ ID NO: 2175199 - RNA, 18 nt, Human
auuucaaaaauauaacuu

SEQ ID NO: 2175200 - RNA, 20 nt, Human
auuucaucugcucuccuucc

SEQ ID NO: 2175201 - RNA, 21 nt, Human
auuucaucugcucuccuuccu

SEQ ID NO: 2175202 - RNA, 14 nt, Human
auuucaugaaaauu

SEQ ID NO: 2175203 - RNA, 19 nt, Human
auuucaaaaauauaacuua

SEQ ID NO: 2175204 - RNA, 15 nt, Human
auuucaugauuucau

SEQ ID NO: 2175205 - RNA, 18 nt, Human
auuucaugcuaucucugu

SEQ ID NO: 2175206 - RNA, 17 nt, Human
auuuccauuauuuauau

SEQ ID NO: 2175207 - RNA, 15 nt, Human
auuuccauuauuuau

SEQ ID NO: 2175208 - RNA, 15 nt, Human
auuuccauuccagaa

SEQ ID NO: 2175209 - RNA, 16 nt, Human
auuuccauuccagaau

SEQ ID NO: 2175210 - RNA, 17 nt, Human
auuuccauuccagaaua

SEQ ID NO: 2175211 - RNA, 15 nt, Human
auuuccauauggauu

SEQ ID NO: 2175212 - RNA, 17 nt, Human
auuuccauauggauuuu

SEQ ID NO: 2175213 - RNA, 14 nt, Human
auuucauuccuaac

SEQ ID NO: 2175214 - RNA, 14 nt, Human
auuucaugugucaa

SEQ ID NO: 2175215 - RNA, 22 nt, Human
auuucaugugucaacuucaaca

SEQ ID NO: 2175216 - RNA, 22 nt, Human
auuuauuguuuauuuaucagug

SEQ ID NO: 2175217 - RNA, 21 nt, Human
auuuauuguuuauuuaucagu

SEQ ID NO: 2175218 - RNA, 20 nt, Human
auuuauuguuuauuuaucag

SEQ ID NO: 2175219 - RNA, 19 nt, Human
auuuauuguuuauuuauca

SEQ ID NO: 2175220 - RNA, 21 nt, Human
auuuauuuuaauaauguuuca

SEQ ID NO: 2175221 - RNA, 20 nt, Human
auuuauuuuccuccccagca

SEQ ID NO: 2175222 - RNA, 13 nt, Human
auuuauuuuccuc

SEQ ID NO: 2175223 - RNA, 17 nt, Human
auuuauuuuccucccca

SEQ ID NO: 2175224 - RNA, 14 nt, Human
auuuauuuuuuaca

SEQ ID NO: 2175225 - RNA, 18 nt, Human
auuuauuuuuuacauuau

SEQ ID NO: 2175226 - RNA, 21 nt, Human
auuuauuuuucucaugaaucu

SEQ ID NO: 2175227 - RNA, 19 nt, Human
auuuauuuuuuacauuauu

SEQ ID NO: 2175228 - RNA, 17 nt, Human
auuuauuuuugcauggc

SEQ ID NO: 2175229 - RNA, 14 nt, Human
auuuauugcuuuau

SEQ ID NO: 2175230 - RNA, 12 nt, Human
auuuauugcuuu

SEQ ID NO: 2175231 - RNA, 13 nt, Human
auuuauugcuuua

SEQ ID NO: 2175232 - RNA, 20 nt, Human
auuuauugcuugauacuuuu

SEQ ID NO: 2175233 - RNA, 19 nt, Human
auuuauugcuugauacuuu

SEQ ID NO: 2175234 - RNA, 14 nt, Human
auuuauuaccucug

SEQ ID NO: 2175235 - RNA, 15 nt, Human
auuuauuaccucuga

SEQ ID NO: 2175236 - RNA, 19 nt, Human
auuuauuacuguaagaaaa

SEQ ID NO: 2175237 - RNA, 20 nt, Human
auuuauuacuguaagaaaau

SEQ ID NO: 2175238 - RNA, 19 nt, Human
auuuacagaugaauguauu

SEQ ID NO: 2175239 - RNA, 21 nt, Human
auuuacagccucacuugaaug

SEQ ID NO: 2175240 - RNA, 20 nt, Human
auuuacagugaaaauguaag

SEQ ID NO: 2175241 - RNA, 15 nt, Human
auuuacauaugaaau

SEQ ID NO: 2175242 - RNA, 14 nt, Human
auuuacauaugaaa

SEQ ID NO: 2175243 - RNA, 15 nt, Human
auuuacaguuucaaa

SEQ ID NO: 2175244 - RNA, 24 nt, Human
auuuacaguuucaaaaacuguauu

SEQ ID NO: 2175245 - RNA, 21 nt, Human
auuuacagugaaaauguaagc

SEQ ID NO: 2175246 - RNA, 22 nt, Human
auuuacagugaaaauguaagcu

SEQ ID NO: 2175247 - RNA, 23 nt, Human
auuuacagugaaaauguaagcug

SEQ ID NO: 2175248 - RNA, 13 nt, Human
auuuacaguuuca

SEQ ID NO: 2175249 - RNA, 17 nt, Human
auuuaaaugucuaaugu

SEQ ID NO: 2175250 - RNA, 14 nt, Human
auuuacacugggag

SEQ ID NO: 2175251 - RNA, 16 nt, Human
auuuaaauauuaaaua

SEQ ID NO: 2175252 - RNA, 23 nt, Human
auuuaaauauaauucuguaaaug

SEQ ID NO: 2175253 - RNA, 18 nt, Human
auuuaaauauaauucugu

SEQ ID NO: 2175254 - RNA, 19 nt, Human
auuuaaauauaauucugua

SEQ ID NO: 2175255 - RNA, 20 nt, Human
auuuaaauauaauucuguaa

SEQ ID NO: 2175256 - RNA, 22 nt, Human
auuuaaauauaauucuguaaau

SEQ ID NO: 2175257 - RNA, 13 nt, Human
auuuaaauauaau

SEQ ID NO: 2175258 - RNA, 15 nt, Human
auuuaaauauaauuc

SEQ ID NO: 2175259 - RNA, 21 nt, Human
auuuaaaauguguuucuuaca

SEQ ID NO: 2175260 - RNA, 21 nt, Human
auuuaaauacagucuuccauu

SEQ ID NO: 2175261 - RNA, 15 nt, Human
auuuaaaauugugau

SEQ ID NO: 2175262 - RNA, 13 nt, Human
auuuaaaaugauu

SEQ ID NO: 2175263 - RNA, 14 nt, Human
auuuaaaaugauua

SEQ ID NO: 2175264 - RNA, 16 nt, Human
auuuaaaaugauuaga

SEQ ID NO: 2175265 - RNA, 17 nt, Human
auuuaccacagcagcug

SEQ ID NO: 2175266 - RNA, 18 nt, Human
auuuaccacagcagcuga

SEQ ID NO: 2175267 - RNA, 22 nt, Human
auuuacauguauuauuucauua

SEQ ID NO: 2175268 - RNA, 15 nt, Human
auuuaccacagcagc

SEQ ID NO: 2175269 - RNA, 22 nt, Human
auuuaccacuuguguuuugcaa

SEQ ID NO: 2175270 - RNA, 21 nt, Human
auuuacauaugaaauuuaaua

SEQ ID NO: 2175271 - RNA, 16 nt, Human
auuuacauaugaaauu

SEQ ID NO: 2175272 - RNA, 18 nt, Human
auuuacaugaauugcauu

SEQ ID NO: 2175273 - RNA, 21 nt, Human
auuuacaugaauugcauuuua

SEQ ID NO: 2175274 - RNA, 20 nt, Human
auuuacaugaauugcauuuu

SEQ ID NO: 2175275 - RNA, 16 nt, Human
auuuacauguauuauu

SEQ ID NO: 2175276 - RNA, 19 nt, Human
auuuacauguauuauuuca

SEQ ID NO: 2175277 - RNA, 15 nt, Human
auuuaccacuugugu

SEQ ID NO: 2175278 - RNA, 22 nt, Human
auuuacucauucauuuauucau

SEQ ID NO: 2175279 - RNA, 13 nt, Human
auuuacugagcuu

SEQ ID NO: 2175280 - RNA, 20 nt, Human
auuuacugagcuucucugug

SEQ ID NO: 2175281 - RNA, 23 nt, Human
auuuacuaagccacaagaaauuu

SEQ ID NO: 2175282 - RNA, 21 nt, Human
auuuacuaagccacaagaaau

SEQ ID NO: 2175283 - RNA, 22 nt, Human
auuuacuaagccacaagaaauu

SEQ ID NO: 2175284 - RNA, 15 nt, Human
auuuacuacuuuugc

SEQ ID NO: 2175285 - RNA, 21 nt, Human
auuuaccacagcagcugaaca

SEQ ID NO: 2175286 - RNA, 15 nt, Human
auuuacuaagccaca

SEQ ID NO: 2175287 - RNA, 14 nt, Human
auuuaaaaaaaauc

SEQ ID NO: 2175288 - RNA, 19 nt, Human
auuuaaaaaaaaaagagga

SEQ ID NO: 2175289 - RNA, 18 nt, Human
auuguuuugguuugcuac

SEQ ID NO: 2175290 - RNA, 18 nt, Human
auuuaaaagauucauuuu

SEQ ID NO: 2175291 - RNA, 19 nt, Human
auuuaaaagauucauuuuu

SEQ ID NO: 2175292 - RNA, 15 nt, Human
auuuaaaagggaagu

SEQ ID NO: 2175293 - RNA, 19 nt, Human
auuuaaaagggaagucuag

SEQ ID NO: 2175294 - RNA, 21 nt, Human
auuuaaaagggaagucuagag

SEQ ID NO: 2175295 - RNA, 19 nt, Human
auuguuuucaguguacaug

SEQ ID NO: 2175296 - RNA, 18 nt, Human
auuguuuucaguguacau

SEQ ID NO: 2175297 - RNA, 17 nt, Human
auuuaaaaaaaaaccug

SEQ ID NO: 2175298 - RNA, 18 nt, Human
auuguuuuaucaugacau

SEQ ID NO: 2175299 - RNA, 20 nt, Human
auuguuuugagcuuuccaug

SEQ ID NO: 2175300 - RNA, 15 nt, Human
auuguuuugcacuuu

SEQ ID NO: 2175301 - RNA, 18 nt, Human
auuguuuugccaacauug

SEQ ID NO: 2175302 - RNA, 17 nt, Human
auuguauaaaaauagaa

SEQ ID NO: 2175303 - RNA, 13 nt, Human
auuguuuuaucau

SEQ ID NO: 2175304 - RNA, 10 nt, Human
auuguuuuca

SEQ ID NO: 2175305 - RNA, 15 nt, Human
auuguauaaaaauag

SEQ ID NO: 2175306 - RNA, 14 nt, Human
auuguauaaaaaua

SEQ ID NO: 2175307 - RNA, 17 nt, Human
auuguuuucaguguaca

SEQ ID NO: 2175308 - RNA, 18 nt, Human
auuguacucaauggauuu

SEQ ID NO: 2175309 - RNA, 22 nt, Human
auuguacucaauggauuugaug

SEQ ID NO: 2175310 - RNA, 15 nt, Human
auuguagcauuucuu

SEQ ID NO: 2175311 - RNA, 14 nt, Human
auuguaguuaauga

SEQ ID NO: 2175312 - RNA, 16 nt, Human
auuguagcauuucuug

SEQ ID NO: 2175313 - RNA, 18 nt, Human
auuguagcauuucuugau

SEQ ID NO: 2175314 - RNA, 16 nt, Human
auuguaguccuguaau

SEQ ID NO: 2175315 - RNA, 17 nt, Human
auuguagagccagaggu

SEQ ID NO: 2175316 - RNA, 18 nt, Human
auuguagagccagagguc

SEQ ID NO: 2175317 - RNA, 14 nt, Human
auuuauugcuugau

SEQ ID NO: 2175318 - RNA, 16 nt, Human
auuuaguucuuuguua

SEQ ID NO: 2175319 - RNA, 12 nt, Human
auuuaguucuuu

SEQ ID NO: 2175320 - RNA, 16 nt, Human
auuuaguuauaguuuc

SEQ ID NO: 2175321 - RNA, 13 nt, Human
auuuaguuauuga

SEQ ID NO: 2175322 - RNA, 17 nt, Human
auuuaguucuuuguuau

SEQ ID NO: 2175323 - RNA, 23 nt, Human
auuuauaaaaauaaaaaacacug

SEQ ID NO: 2175324 - RNA, 17 nt, Human
auuuaguguucauaaau

SEQ ID NO: 2175325 - RNA, 20 nt, Human
auuuacuugccauuacucaa

SEQ ID NO: 2175326 - RNA, 21 nt, Human
auuuaguguuuuuaccucugu

SEQ ID NO: 2175327 - RNA, 13 nt, Human
auuuaguuauagu

SEQ ID NO: 2175328 - RNA, 14 nt, Human
auuuaguuauaguu

SEQ ID NO: 2175329 - RNA, 20 nt, Human
auuuacuucuuauacauuug

SEQ ID NO: 2175330 - RNA, 19 nt, Human
auuuacuucuuauacauuu

SEQ ID NO: 2175331 - RNA, 15 nt, Human
auuuacuuugaauuu

SEQ ID NO: 2175332 - RNA, 22 nt, Human
auuuacuugccauuacucaauu

SEQ ID NO: 2175333 - RNA, 16 nt, Human
auuuaguguucauaaa

SEQ ID NO: 2175334 - RNA, 18 nt, Human
auuuauguagaugugcau

SEQ ID NO: 2175335 - RNA, 14 nt, Human
auuuauguagaugu

SEQ ID NO: 2175336 - RNA, 12 nt, Human
auuuauguagau

SEQ ID NO: 2175337 - RNA, 12 nt, Human
auuuauguaaac

SEQ ID NO: 2175338 - RNA, 21 nt, Human
auuuauguagaugugcauuuu

SEQ ID NO: 2175339 - RNA, 20 nt, Human
auuuauguagaugugcauuu

SEQ ID NO: 2175340 - RNA, 22 nt, Human
auuuaugucuauuuaagccuca

SEQ ID NO: 2175341 - RNA, 22 nt, Human
auuuaugugugaggagcugcug

SEQ ID NO: 2175342 - RNA, 19 nt, Human
auuuaugugugaggagcug

SEQ ID NO: 2175343 - RNA, 18 nt, Human
auuuaugugugaggagcu

SEQ ID NO: 2175344 - RNA, 13 nt, Human
auuuaugugugag

SEQ ID NO: 2175345 - RNA, 18 nt, Human
auuuauuaauugcuuuga

SEQ ID NO: 2175346 - RNA, 17 nt, Human
auuuauuaauugcuuug

SEQ ID NO: 2175347 - RNA, 16 nt, Human
auuuauuaauugcuuu

SEQ ID NO: 2175348 - RNA, 13 nt, Human
auuuauguuugca

SEQ ID NO: 2175349 - RNA, 13 nt, Human
auuuauaacucau

SEQ ID NO: 2175350 - RNA, 15 nt, Human
auuuauaaaugcuau

SEQ ID NO: 2175351 - RNA, 16 nt, Human
auuuauaaaugcuauu

SEQ ID NO: 2175352 - RNA, 22 nt, Human
auuuauaaauauauuuaagaua

SEQ ID NO: 2175353 - RNA, 13 nt, Human
auuuauaaaugcu

SEQ ID NO: 2175354 - RNA, 14 nt, Human
auuuauaaaugcua

SEQ ID NO: 2175355 - RNA, 23 nt, Human
auuuauguaaacugcauuagaaa

SEQ ID NO: 2175356 - RNA, 14 nt, Human
auuuauaacucauc

SEQ ID NO: 2175357 - RNA, 17 nt, Human
auuuauaaaugcuauuu

SEQ ID NO: 2175358 - RNA, 18 nt, Human
auuuauggucaacacuua

SEQ ID NO: 2175359 - RNA, 15 nt, Human
auuuauaaacuuuuu

SEQ ID NO: 2175360 - RNA, 21 nt, Human
auuuauaaagcuaaaauaacc

SEQ ID NO: 2175361 - RNA, 17 nt, Human
auuuauaaagcuaaaau

SEQ ID NO: 2175362 - RNA, 15 nt, Human
auuuauaaaacuucu

SEQ ID NO: 2175363 - RNA, 14 nt, Human
auuuauaaaacuuc

SEQ ID NO: 2175364 - RNA, 21 nt, Human
auuuauaaaacuucucaagau

SEQ ID NO: 2175365 - RNA, 20 nt, Human
auuugguuuggccaucucug

SEQ ID NO: 2175366 - RNA, 22 nt, Human
auuugguuuggccaucucugga

SEQ ID NO: 2175367 - RNA, 15 nt, Human
auuugguucuaauag

SEQ ID NO: 2175368 - RNA, 18 nt, Human
auuugguucuaggccggg

SEQ ID NO: 2175369 - RNA, 21 nt, Human
auuugguucauuaauucuaua

SEQ ID NO: 2175370 - RNA, 16 nt, Human
auuugguucauuaauu

SEQ ID NO: 2175371 - RNA, 19 nt, Human
auuuggcaaugccaucauc

SEQ ID NO: 2175372 - RNA, 21 nt, Human
auuuggugguuucagaaaugu

SEQ ID NO: 2175373 - RNA, 13 nt, Human
auuuguacaaaaa

SEQ ID NO: 2175374 - RNA, 23 nt, Human
auuuguaauugcuuacauuuuua

SEQ ID NO: 2175375 - RNA, 21 nt, Human
auuuguacauaguuauuuauu

SEQ ID NO: 2175376 - RNA, 13 nt, Human
auuuguacaguuc

SEQ ID NO: 2175377 - RNA, 15 nt, Human
auuuguacaguucag

SEQ ID NO: 2175378 - RNA, 15 nt, Human
auuuguaauugcuua

SEQ ID NO: 2175379 - RNA, 19 nt, Human
auuuguaauugcuuacauu

SEQ ID NO: 2175380 - RNA, 20 nt, Human
auuuguaauugcuuacauuu

SEQ ID NO: 2175381 - RNA, 20 nt, Human
auuugauaguauugugcaua

SEQ ID NO: 2175382 - RNA, 14 nt, Human
auuugauaucacag

SEQ ID NO: 2175383 - RNA, 23 nt, Human
auuugaucguuccaguucccacu

SEQ ID NO: 2175384 - RNA, 15 nt, Human
auuugauaucacagu

SEQ ID NO: 2175385 - RNA, 17 nt, Human
auuugaucguuccaguu

SEQ ID NO: 2175386 - RNA, 21 nt, Human
auuugagauguauuucaacuu

SEQ ID NO: 2175387 - RNA, 18 nt, Human
auuugagagaaauaugaa

SEQ ID NO: 2175388 - RNA, 21 nt, Human
auuugaggucuguucuuucca

SEQ ID NO: 2175389 - RNA, 14 nt, Human
auuugaugcuaaau

SEQ ID NO: 2175390 - RNA, 16 nt, Human
auuugaugcuggagag

SEQ ID NO: 2175391 - RNA, 15 nt, Human
auuugaugccaggac

SEQ ID NO: 2175392 - RNA, 17 nt, Human
auuugaugcuggagagg

SEQ ID NO: 2175393 - RNA, 19 nt, Human
auuugaugcuggagagguu

SEQ ID NO: 2175394 - RNA, 16 nt, Human
auuugaugcuguuuga

SEQ ID NO: 2175395 - RNA, 23 nt, Human
auuugaugcuguuugacaaaguu

SEQ ID NO: 2175396 - RNA, 11 nt, Human
auuuggagacu

SEQ ID NO: 2175397 - RNA, 17 nt, Human
auuuggagacucugugg

SEQ ID NO: 2175398 - RNA, 21 nt, Human
auuuggaguguuccccuucca

SEQ ID NO: 2175399 - RNA, 14 nt, Human
auuugagaauauaa

SEQ ID NO: 2175400 - RNA, 21 nt, Human
auuugagaauauaaaaaacuu

SEQ ID NO: 2175401 - RNA, 17 nt, Human
auuugagagaaauauga

SEQ ID NO: 2175402 - RNA, 17 nt, Human
auuugagaaaugcauau

SEQ ID NO: 2175403 - RNA, 14 nt, Human
auuugagaaaugca

SEQ ID NO: 2175404 - RNA, 16 nt, Human
auuugagaaaugcaua

SEQ ID NO: 2175405 - RNA, 12 nt, Human
auuugagaaaug

SEQ ID NO: 2175406 - RNA, 19 nt, Human
auuugaauguuaagcagau

SEQ ID NO: 2175407 - RNA, 15 nt, Human
auuugagcagggcuc

SEQ ID NO: 2175408 - RNA, 16 nt, Human
auuugagcagggcuca

SEQ ID NO: 2175409 - RNA, 18 nt, Human
auuugaggucuguucuuu

SEQ ID NO: 2175410 - RNA, 17 nt, Human
auuugaggucuguucuu

SEQ ID NO: 2175411 - RNA, 13 nt, Human
auuucuucacugu

SEQ ID NO: 2175412 - RNA, 15 nt, Human
auuucuuaucaccac

SEQ ID NO: 2175413 - RNA, 18 nt, Human
auuucuuaucaccacagu

SEQ ID NO: 2175414 - RNA, 11 nt, Human
auuucuuauag

SEQ ID NO: 2175415 - RNA, 14 nt, Human
auuucuuauauaug

SEQ ID NO: 2175416 - RNA, 21 nt, Human
auuucuuauauaugugaacau

SEQ ID NO: 2175417 - RNA, 19 nt, Human
auuucuuaucaccacagua

SEQ ID NO: 2175418 - RNA, 21 nt, Human
auuucuugaguuuuguuuuaa

SEQ ID NO: 2175419 - RNA, 16 nt, Human
auuucuuccacaagag

SEQ ID NO: 2175420 - RNA, 20 nt, Human
auuucuugagguaaaagcau

SEQ ID NO: 2175421 - RNA, 16 nt, Human
auuucuugggcccucc

SEQ ID NO: 2175422 - RNA, 14 nt, Human
auuucuugggcccu

SEQ ID NO: 2175423 - RNA, 19 nt, Human
auuucuugguaagaagccg

SEQ ID NO: 2175424 - RNA, 18 nt, Human
auuucuugggcccuccug

SEQ ID NO: 2175425 - RNA, 17 nt, Human
auuucuugggcccuccu

SEQ ID NO: 2175426 - RNA, 20 nt, Human
auuucuugguaagaagccgg

SEQ ID NO: 2175427 - RNA, 20 nt, Human
auuucuugggcccuccugaa

SEQ ID NO: 2175428 - RNA, 13 nt, Human
auuucuugugccu

SEQ ID NO: 2175429 - RNA, 23 nt, Human
auuugaauguaugcuucauacag

SEQ ID NO: 2175430 - RNA, 13 nt, Human
auuucuuuccaga

SEQ ID NO: 2175431 - RNA, 14 nt, Human
auuucuuuccagag

SEQ ID NO: 2175432 - RNA, 13 nt, Human
auuugaauguuaa

SEQ ID NO: 2175433 - RNA, 18 nt, Human
auuugaauguuaagcaga

SEQ ID NO: 2175434 - RNA, 15 nt, Human
auuucuuugccuguu

SEQ ID NO: 2175435 - RNA, 18 nt, Human
auugaaucuauuuaagua

SEQ ID NO: 2175436 - RNA, 17 nt, Human
auuggcucacacugaga

SEQ ID NO: 2175437 - RNA, 14 nt, Human
auuggaagaaauuc

SEQ ID NO: 2175438 - RNA, 18 nt, Human
auuggaagaaauuccugu

SEQ ID NO: 2175439 - RNA, 19 nt, Human
auuggaagaaauuccugua

SEQ ID NO: 2175440 - RNA, 16 nt, Human
auuggaagaccccacc

SEQ ID NO: 2175441 - RNA, 16 nt, Human
auuggaacagaauguu

SEQ ID NO: 2175442 - RNA, 18 nt, Human
auuggaaugggcagcuca

SEQ ID NO: 2175443 - RNA, 15 nt, Human
auuggacccuuccau

SEQ ID NO: 2175444 - RNA, 23 nt, Human
auugccuuuagugaucacagcag

SEQ ID NO: 2175445 - RNA, 16 nt, Human
auugcauauauacaua

SEQ ID NO: 2175446 - RNA, 22 nt, Human
auugcauauaacuuauauugua

SEQ ID NO: 2175447 - RNA, 18 nt, Human
auugcauauaacuuauau

SEQ ID NO: 2175448 - RNA, 16 nt, Human
auugcauauaacuuau

SEQ ID NO: 2175449 - RNA, 13 nt, Human
auugcacucuaaa

SEQ ID NO: 2175450 - RNA, 15 nt, Human
auugcaucucccaga

SEQ ID NO: 2175451 - RNA, 21 nt, Human
auugcaucuggguagcuguaa

SEQ ID NO: 2175452 - RNA, 20 nt, Human
auugcaucuggguagcugua

SEQ ID NO: 2175453 - RNA, 23 nt, Human
auugcaucucccagauaauguga

SEQ ID NO: 2175454 - RNA, 22 nt, Human
auugcaucucccagauaaugug

SEQ ID NO: 2175455 - RNA, 17 nt, Human
auugccugcagagagaa

SEQ ID NO: 2175456 - RNA, 18 nt, Human
auugccuuaacuggagcc

SEQ ID NO: 2175457 - RNA, 18 nt, Human
auugcaugugacucugaa

SEQ ID NO: 2175458 - RNA, 16 nt, Human
auugccugcagagaga

SEQ ID NO: 2175459 - RNA, 11 nt, Human
auugcauugac

SEQ ID NO: 2175460 - RNA, 14 nt, Human
auugcaugugacuc

SEQ ID NO: 2175461 - RNA, 13 nt, Human
auugcaugugacu

SEQ ID NO: 2175462 - RNA, 23 nt, Human
auugcauuaaauauaauaugcac

SEQ ID NO: 2175463 - RNA, 17 nt, Human
auugcaugugacucuga

SEQ ID NO: 2175464 - RNA, 15 nt, Human
auugcaugugacucu

SEQ ID NO: 2175465 - RNA, 15 nt, Human
auugcaucuguauaa

SEQ ID NO: 2175466 - RNA, 19 nt, Human
auugcaucuguauaaguaa

SEQ ID NO: 2175467 - RNA, 22 nt, Human
auugcaucuggguagcuguaag

SEQ ID NO: 2175468 - RNA, 13 nt, Human
auugcaucuguau

SEQ ID NO: 2175469 - RNA, 14 nt, Human
auugcaucuguaua

SEQ ID NO: 2175470 - RNA, 19 nt, Human
auuggcuauuuaaagacaa

SEQ ID NO: 2175471 - RNA, 13 nt, Human
auuggcucacacu

SEQ ID NO: 2175472 - RNA, 15 nt, Human
auuggcucacacuga

SEQ ID NO: 2175473 - RNA, 16 nt, Human
auuggcucacacugag

SEQ ID NO: 2175474 - RNA, 23 nt, Human
auuggcuagagguucaaagauau

SEQ ID NO: 2175475 - RNA, 17 nt, Human
auuggcuauuuaaaacu

SEQ ID NO: 2175476 - RNA, 18 nt, Human
auuggcuauuuaaaacuu

SEQ ID NO: 2175477 - RNA, 18 nt, Human
auuggagaguaaaaacug

SEQ ID NO: 2175478 - RNA, 18 nt, Human
auuggcagcaggugcugc

SEQ ID NO: 2175479 - RNA, 17 nt, Human
auuggagccaccaugcc

SEQ ID NO: 2175480 - RNA, 19 nt, Human
auuggcagcaggugcugcu

SEQ ID NO: 2175481 - RNA, 22 nt, Human
auuggcagcaggugcugcuacc

SEQ ID NO: 2175482 - RNA, 15 nt, Human
auuggcagcagauuu

SEQ ID NO: 2175483 - RNA, 22 nt, Human
auuggagaaguaauccuaggga

SEQ ID NO: 2175484 - RNA, 17 nt, Human
auuggagauagggaaag

SEQ ID NO: 2175485 - RNA, 16 nt, Human
auuggagcucguggaa

SEQ ID NO: 2175486 - RNA, 17 nt, Human
auuggagcucgugggac

SEQ ID NO: 2175487 - RNA, 22 nt, Human
auuggccauucuauuguggcaa

SEQ ID NO: 2175488 - RNA, 17 nt, Human
auuggcauguguauguu

SEQ ID NO: 2175489 - RNA, 11 nt, Human
auuggccugga

SEQ ID NO: 2175490 - RNA, 12 nt, Human
auuggccuggag

SEQ ID NO: 2175491 - RNA, 14 nt, Human
auuggcauguguau

SEQ ID NO: 2175492 - RNA, 19 nt, Human
auuggcuagagguucaaag

SEQ ID NO: 2175493 - RNA, 22 nt, Human
auuggcuagagguucaaagaua

SEQ ID NO: 2175494 - RNA, 20 nt, Human
auuggcuagagguucaaaga

SEQ ID NO: 2175495 - RNA, 14 nt, Human
auugaacccaggag

SEQ ID NO: 2175496 - RNA, 16 nt, Human
auugaaauuuauacac

SEQ ID NO: 2175497 - RNA, 15 nt, Human
auugaacccaggagg

SEQ ID NO: 2175498 - RNA, 20 nt, Human
auugaacacaaacuguaaau

SEQ ID NO: 2175499 - RNA, 19 nt, Human
auugaacacaaacuguaaa

SEQ ID NO: 2175500 - RNA, 18 nt, Human
auugaacacaaacuguaa

SEQ ID NO: 2175501 - RNA, 17 nt, Human
auugaacacaaacugua

SEQ ID NO: 2175502 - RNA, 16 nt, Human
auugaacacaaacugu

SEQ ID NO: 2175503 - RNA, 15 nt, Human
auugaacacaaacug

SEQ ID NO: 2175504 - RNA, 17 nt, Human
auuccuaccucccugca

SEQ ID NO: 2175505 - RNA, 17 nt, Human
auuccuauauaguuuau

SEQ ID NO: 2175506 - RNA, 21 nt, Human
auuccuauacgcagcgugcuu

SEQ ID NO: 2175507 - RNA, 22 nt, Human
auugaacaaguuguuucauuga

SEQ ID NO: 2175508 - RNA, 14 nt, Human
auugaacacaaacu

SEQ ID NO: 2175509 - RNA, 21 nt, Human
auugaaauuguacauauuugu

SEQ ID NO: 2175510 - RNA, 17 nt, Human
auugaaauuguacauau

SEQ ID NO: 2175511 - RNA, 14 nt, Human
auugaaauuuauac

SEQ ID NO: 2175512 - RNA, 17 nt, Human
auuccuauugugauuug

SEQ ID NO: 2175513 - RNA, 14 nt, Human
auuccuauugugau

SEQ ID NO: 2175514 - RNA, 13 nt, Human
auugaaauucuga

SEQ ID NO: 2175515 - RNA, 17 nt, Human
auugaaauucugagaaa

SEQ ID NO: 2175516 - RNA, 16 nt, Human
auugaaauuguacaua

SEQ ID NO: 2175517 - RNA, 10 nt, Human
auugaaucua

SEQ ID NO: 2175518 - RNA, 14 nt, Human
auugaaucauguag

SEQ ID NO: 2175519 - RNA, 20 nt, Human
auugaaucauguaguaucaa

SEQ ID NO: 2175520 - RNA, 14 nt, Human
auugaaucuauuua

SEQ ID NO: 2175521 - RNA, 16 nt, Human
auugaaucuauuuaag

SEQ ID NO: 2175522 - RNA, 13 nt, Human
auugaauuaucuu

SEQ ID NO: 2175523 - RNA, 14 nt, Human
auugaaucugauug

SEQ ID NO: 2175524 - RNA, 23 nt, Human
auugaaucugauuggacauuuuc

SEQ ID NO: 2175525 - RNA, 16 nt, Human
auugaauguuuccaac

SEQ ID NO: 2175526 - RNA, 23 nt, Human
auugaauucuugguugaggaaac

SEQ ID NO: 2175527 - RNA, 22 nt, Human
auugaauucuugguugaggaaa

SEQ ID NO: 2175528 - RNA, 20 nt, Human
auugaauucuugguugagga

SEQ ID NO: 2175529 - RNA, 21 nt, Human
auugaauuaucuugguugaaa

SEQ ID NO: 2175530 - RNA, 23 nt, Human
auugaauauaauauauuugugua

SEQ ID NO: 2175531 - RNA, 20 nt, Human
auugaaucaguauaaacaaa

SEQ ID NO: 2175532 - RNA, 13 nt, Human
auugaaucaugua

SEQ ID NO: 2175533 - RNA, 13 nt, Human
auugaaucaguau

SEQ ID NO: 2175534 - RNA, 19 nt, Human
auugaauaaaguugaagcu

SEQ ID NO: 2175535 - RNA, 14 nt, Human
auugaauaauggua

SEQ ID NO: 2175536 - RNA, 22 nt, Human
auugaauaaugguaccagauaa

SEQ ID NO: 2175537 - RNA, 16 nt, Human
auugaaguaaugaauu

SEQ ID NO: 2175538 - RNA, 19 nt, Human
auugaaguauuuugcugga

SEQ ID NO: 2175539 - RNA, 16 nt, Human
auugaagucagaugug

SEQ ID NO: 2175540 - RNA, 18 nt, Human
auugaagucagauguggu

SEQ ID NO: 2175541 - RNA, 15 nt, Human
auugaaguaaugaau

SEQ ID NO: 2175542 - RNA, 14 nt, Human
auugaaguaaugaa

SEQ ID NO: 2175543 - RNA, 19 nt, Human
auugcacuccagccugggc

SEQ ID NO: 2175544 - RNA, 20 nt, Human
auugcacucuaaaagguuca

SEQ ID NO: 2175545 - RNA, 18 nt, Human
auugcacuccagccuggg

SEQ ID NO: 2175546 - RNA, 16 nt, Human
auugcacuccagccug

SEQ ID NO: 2175547 - RNA, 17 nt, Human
auugcacuccagccugg

SEQ ID NO: 2175548 - RNA, 15 nt, Human
auugcacuccagccu

SEQ ID NO: 2175549 - RNA, 23 nt, Human
auugcacguggccucuugagcag

SEQ ID NO: 2175550 - RNA, 15 nt, Human
auugcacauuguaaa

SEQ ID NO: 2175551 - RNA, 19 nt, Human
auugcaaaauagcauuugu

SEQ ID NO: 2175552 - RNA, 15 nt, Human
auugcacguggccuc

SEQ ID NO: 2175553 - RNA, 16 nt, Human
auugcacguggccucu

SEQ ID NO: 2175554 - RNA, 17 nt, Human
auugcacguggccucuu

SEQ ID NO: 2175555 - RNA, 19 nt, Human
auugcacguggccucuuga

SEQ ID NO: 2175556 - RNA, 17 nt, Human
auugcaacaggcugggc

SEQ ID NO: 2175557 - RNA, 18 nt, Human
auugcaacaggcugggcu

SEQ ID NO: 2175558 - RNA, 12 nt, Human
auugcaccacug

SEQ ID NO: 2175559 - RNA, 19 nt, Human
auugcaacaggcugggcuu

SEQ ID NO: 2175560 - RNA, 16 nt, Human
auugauggggaaggag

SEQ ID NO: 2175561 - RNA, 21 nt, Human
auugauguacagucugucaug

SEQ ID NO: 2175562 - RNA, 12 nt, Human
auugauguguuu

SEQ ID NO: 2175563 - RNA, 13 nt, Human
auugacaaacucu

SEQ ID NO: 2175564 - RNA, 14 nt, Human
auugacaaacucuc

SEQ ID NO: 2175565 - RNA, 13 nt, Human
auugauggggaag

SEQ ID NO: 2175566 - RNA, 22 nt, Human
auugauguacagucugucauga

SEQ ID NO: 2175567 - RNA, 19 nt, Human
auugauguguuuauuuaua

SEQ ID NO: 2175568 - RNA, 21 nt, Human
auugauuucugccuuccuugc

SEQ ID NO: 2175569 - RNA, 16 nt, Human
auugauuugaagaaca

SEQ ID NO: 2175570 - RNA, 14 nt, Human
auugauuugaagaa

SEQ ID NO: 2175571 - RNA, 20 nt, Human
auugauuucugccuuccuug

SEQ ID NO: 2175572 - RNA, 12 nt, Human
auugauuugcau

SEQ ID NO: 2175573 - RNA, 15 nt, Human
auugauuugcauuga

SEQ ID NO: 2175574 - RNA, 13 nt, Human
auugauuugcauu

SEQ ID NO: 2175575 - RNA, 20 nt, Human
auugauuugcauugaacaca

SEQ ID NO: 2175576 - RNA, 16 nt, Human
auugauuugcauugaa

SEQ ID NO: 2175577 - RNA, 15 nt, Human
auugcaaaauagcau

SEQ ID NO: 2175578 - RNA, 23 nt, Human
uuuucuguugaaguuuacaauca

SEQ ID NO: 2175579 - RNA, 12 nt, Human
uuuucuguuaua

SEQ ID NO: 2175580 - RNA, 13 nt, Human
uuuucuguucuuu

SEQ ID NO: 2175581 - RNA, 21 nt, Human
uuuucuuaaccagaucauugu

SEQ ID NO: 2175582 - RNA, 23 nt, Human
uuuucuuaaauaauaaagaucau

SEQ ID NO: 2175583 - RNA, 14 nt, Human
uuuucuuaaauaau

SEQ ID NO: 2175584 - RNA, 12 nt, Human
uuuucugcccug

SEQ ID NO: 2175585 - RNA, 13 nt, Human
uuuucugcccugg

SEQ ID NO: 2175586 - RNA, 15 nt, Human
uuuucugcccuggcu

SEQ ID NO: 2175587 - RNA, 16 nt, Human
uuuucugcccuggcug

SEQ ID NO: 2175588 - RNA, 16 nt, Human
uuuucugcuuuugaaa

SEQ ID NO: 2175589 - RNA, 17 nt, Human
uuuucuggaauacauga

SEQ ID NO: 2175590 - RNA, 21 nt, Human
uuuucuggaauacaugaaaua

SEQ ID NO: 2175591 - RNA, 13 nt, Human
uuuucugcacuga

SEQ ID NO: 2175592 - RNA, 16 nt, Human
uuuucugcacugagca

SEQ ID NO: 2175593 - RNA, 20 nt, Human
uuuucugcacugagcagagu

SEQ ID NO: 2175594 - RNA, 23 nt, Human
uuuucugauuguaacguugcugu

SEQ ID NO: 2175595 - RNA, 16 nt, Human
uuuucugcaagccugc

SEQ ID NO: 2175596 - RNA, 17 nt, Human
uuuucucuuucucuccu

SEQ ID NO: 2175597 - RNA, 14 nt, Human
uuuucugauuguaa

SEQ ID NO: 2175598 - RNA, 21 nt, Human
uuuucugauuguaacguugcu

SEQ ID NO: 2175599 - RNA, 17 nt, Human
auguuggccaggcuggu

SEQ ID NO: 2175600 - RNA, 12 nt, Human
uuuucuuaacca

SEQ ID NO: 2175601 - RNA, 12 nt, Human
auguuggcuggg

SEQ ID NO: 2175602 - RNA, 19 nt, Human
auguugggaaacuuggcuc

SEQ ID NO: 2175603 - RNA, 20 nt, Human
auguugggaaacuuggcucg

SEQ ID NO: 2175604 - RNA, 12 nt, Human
auguugggacug

SEQ ID NO: 2175605 - RNA, 14 nt, Human
auguugguguucca

SEQ ID NO: 2175606 - RNA, 13 nt, Human
auguuggcuggga

SEQ ID NO: 2175607 - RNA, 18 nt, Human
auguuggucauuuuaugu

SEQ ID NO: 2175608 - RNA, 17 nt, Human
auguuuaacuuaaucaa

SEQ ID NO: 2175609 - RNA, 19 nt, Human
auguuuaacuuaaucaauu

SEQ ID NO: 2175610 - RNA, 16 nt, Human
auguuuacaaauggac

SEQ ID NO: 2175611 - RNA, 16 nt, Human
auguuuacacucuuug

SEQ ID NO: 2175612 - RNA, 18 nt, Human
auguuuacacucuuugua

SEQ ID NO: 2175613 - RNA, 19 nt, Human
auguuuacacucuuuguaa

SEQ ID NO: 2175614 - RNA, 21 nt, Human
auguuuacacucuuuguaaga

SEQ ID NO: 2175615 - RNA, 22 nt, Human
auguuuuuuagaucaaauacuu

SEQ ID NO: 2175616 - RNA, 22 nt, Human
auguuuuuuaaaauauuuaucu

SEQ ID NO: 2175617 - RNA, 19 nt, Human
auguuuuuuagaucaaaua

SEQ ID NO: 2175618 - RNA, 15 nt, Human
auguuuuuuuuuaaa

SEQ ID NO: 2175619 - RNA, 20 nt, Human
auuaaaaaaaaagaucuguu

SEQ ID NO: 2175620 - RNA, 14 nt, Human
auuaaaaaaaaaga

SEQ ID NO: 2175621 - RNA, 14 nt, Human
auuaaaaaaaacaa

SEQ ID NO: 2175622 - RNA, 15 nt, Human
auuaaaaaaaacaaa

SEQ ID NO: 2175623 - RNA, 19 nt, Human
auuaaaaaaaacaaaaaga

SEQ ID NO: 2175624 - RNA, 20 nt, Human
auuaaaaaaaacaaaaagaa

SEQ ID NO: 2175625 - RNA, 23 nt, Human
auuaaaaaaaacaaaaagaacaa

SEQ ID NO: 2175626 - RNA, 12 nt, Human
auuaaaaaacaa

SEQ ID NO: 2175627 - RNA, 22 nt, Human
auuaaaaaugaaauuauuuaua

SEQ ID NO: 2175628 - RNA, 23 nt, Human
auuaaaaaucucaaauuucuaaa

SEQ ID NO: 2175629 - RNA, 21 nt, Human
auuaaaacaauauuguuucua

SEQ ID NO: 2175630 - RNA, 20 nt, Human
auuaaaacaauauuguuucu

SEQ ID NO: 2175631 - RNA, 18 nt, Human
auuaaaacaauauuguuu

SEQ ID NO: 2175632 - RNA, 14 nt, Human
auuaaaacaauauu

SEQ ID NO: 2175633 - RNA, 19 nt, Human
auuaaaacacaacaucuuu

SEQ ID NO: 2175634 - RNA, 22 nt, Human
auguuuuucugccagggagcuu

SEQ ID NO: 2175635 - RNA, 21 nt, Human
auguuuuucugccagggagcu

SEQ ID NO: 2175636 - RNA, 15 nt, Human
auguuuuucaugaaa

SEQ ID NO: 2175637 - RNA, 23 nt, Human
auguuuuuaaaaguuucaaugug

SEQ ID NO: 2175638 - RNA, 18 nt, Human
auguuuauuccugauaau

SEQ ID NO: 2175639 - RNA, 22 nt, Human
auguuuuuaaaaguuucaaugu

SEQ ID NO: 2175640 - RNA, 14 nt, Human
auguuuauuccuga

SEQ ID NO: 2175641 - RNA, 14 nt, Human
auguuuauuccuug

SEQ ID NO: 2175642 - RNA, 17 nt, Human
uuuucuacuuuuuuuaa

SEQ ID NO: 2175643 - RNA, 18 nt, Human
uuuucuagcccgaauaca

SEQ ID NO: 2175644 - RNA, 13 nt, Human
uuuucuagacuuu

SEQ ID NO: 2175645 - RNA, 14 nt, Human
uuuucuagacuuuc

SEQ ID NO: 2175646 - RNA, 12 nt, Human
uuuuccaggcug

SEQ ID NO: 2175647 - RNA, 20 nt, Human
uuuuccagcuggaugagaau

SEQ ID NO: 2175648 - RNA, 13 nt, Human
uuuuccagcuccu

SEQ ID NO: 2175649 - RNA, 16 nt, Human
uuuucuauaauuuaaa

SEQ ID NO: 2175650 - RNA, 18 nt, Human
uuuucuagacuuucuguu

SEQ ID NO: 2175651 - RNA, 21 nt, Human
uuuucuagcccgaauacaaac

SEQ ID NO: 2175652 - RNA, 22 nt, Human
uuuucucuuucuccuuagucuu

SEQ ID NO: 2175653 - RNA, 15 nt, Human
uuuucucuuucucuc

SEQ ID NO: 2175654 - RNA, 14 nt, Human
uuuucucuuucucc

SEQ ID NO: 2175655 - RNA, 12 nt, Human
uuuucucuuucu

SEQ ID NO: 2175656 - RNA, 22 nt, Human
uuuucucuugggcugagacugg

SEQ ID NO: 2175657 - RNA, 21 nt, Human
uuuucucugguaauauugacu

SEQ ID NO: 2175658 - RNA, 14 nt, Human
uuuucucugguaau

SEQ ID NO: 2175659 - RNA, 16 nt, Human
uuuucucugguaauau

SEQ ID NO: 2175660 - RNA, 14 nt, Human
uuuucaguguacau

SEQ ID NO: 2175661 - RNA, 19 nt, Human
uuuuccaaagagugauagu

SEQ ID NO: 2175662 - RNA, 11 nt, Human
uuuuccaaaug

SEQ ID NO: 2175663 - RNA, 18 nt, Human
uuuuccaagugugcauau

SEQ ID NO: 2175664 - RNA, 22 nt, Human
uuuuccaaauguaauaaacuuu

SEQ ID NO: 2175665 - RNA, 15 nt, Human
uuuuccacccuggaa

SEQ ID NO: 2175666 - RNA, 22 nt, Human
uuuuccacaagauucccagaga

SEQ ID NO: 2175667 - RNA, 15 nt, Human
uuuuccaaugucugc

SEQ ID NO: 2175668 - RNA, 14 nt, Human
uuuuccaaugucug

SEQ ID NO: 2175669 - RNA, 15 nt, Human
uuuuccacuacugcu

SEQ ID NO: 2175670 - RNA, 13 nt, Human
uuuuccacuacug

SEQ ID NO: 2175671 - RNA, 13 nt, Human
uuuuccacuuugu

SEQ ID NO: 2175672 - RNA, 11 nt, Human
uuuuauugugu

SEQ ID NO: 2175673 - RNA, 10 nt, Human
uuuuauuguu

SEQ ID NO: 2175674 - RNA, 22 nt, Human
uuuuauuguaacagacauuguu

SEQ ID NO: 2175675 - RNA, 20 nt, Human
uuuuauuguauaaacuauca

SEQ ID NO: 2175676 - RNA, 17 nt, Human
uuuuauuguuuaaagca

SEQ ID NO: 2175677 - RNA, 20 nt, Human
uuuucaggcuagauguaugu

SEQ ID NO: 2175678 - RNA, 23 nt, Human
uuuucaguagggcuacaaaaccu

SEQ ID NO: 2175679 - RNA, 23 nt, Human
uuuucaguauuuuggagaaauua

SEQ ID NO: 2175680 - RNA, 15 nt, Human
uuuucagucauauaa

SEQ ID NO: 2175681 - RNA, 23 nt, Human
uuuucagucauauaaaagcuaug

SEQ ID NO: 2175682 - RNA, 16 nt, Human
uuuucaguauuuugga

SEQ ID NO: 2175683 - RNA, 12 nt, Human
uuuucagcuucu

SEQ ID NO: 2175684 - RNA, 15 nt, Human
uuuucagcuucugcu

SEQ ID NO: 2175685 - RNA, 20 nt, Human
uuuucagcuucugcugggcu

SEQ ID NO: 2175686 - RNA, 17 nt, Human
uuuucagcuucugcugg

SEQ ID NO: 2175687 - RNA, 19 nt, Human
uuuuauugaaucuauuuaa

SEQ ID NO: 2175688 - RNA, 16 nt, Human
uuuuauugacacagaa

SEQ ID NO: 2175689 - RNA, 19 nt, Human
uuuuauugagaauuuuaaa

SEQ ID NO: 2175690 - RNA, 18 nt, Human
uuuuauugacacagaaaa

SEQ ID NO: 2175691 - RNA, 16 nt, Human
uuuuauuguaacagac

SEQ ID NO: 2175692 - RNA, 19 nt, Human
uuuuauuguaacagacauu

SEQ ID NO: 2175693 - RNA, 20 nt, Human
uuuuauuguaacagacauug

SEQ ID NO: 2175694 - RNA, 21 nt, Human
uuuuauuguaacagacauugu

SEQ ID NO: 2175695 - RNA, 15 nt, Human
uuuuauuccuguaug

SEQ ID NO: 2175696 - RNA, 18 nt, Human
uuuuauuccuguauguug

SEQ ID NO: 2175697 - RNA, 15 nt, Human
uuuuauuccacaucu

SEQ ID NO: 2175698 - RNA, 13 nt, Human
uuuuauuccacau

SEQ ID NO: 2175699 - RNA, 11 nt, Human
uuuuauuaaug

SEQ ID NO: 2175700 - RNA, 13 nt, Human
uuuuauuaaugca

SEQ ID NO: 2175701 - RNA, 12 nt, Human
uuuuauuaaauu

SEQ ID NO: 2175702 - RNA, 21 nt, Human
uuuuauggcuuuugugcauua

SEQ ID NO: 2175703 - RNA, 19 nt, Human
uuuuauuaauaaacauucu

SEQ ID NO: 2175704 - RNA, 22 nt, Human
uuuuauuaauaaacauucuauc

SEQ ID NO: 2175705 - RNA, 12 nt, Human
uuuuauuaauaa

SEQ ID NO: 2175706 - RNA, 23 nt, Human
uuuuagacaaauacucaugugua

SEQ ID NO: 2175707 - RNA, 18 nt, Human
uuuuagugauuuuaauaa

SEQ ID NO: 2175708 - RNA, 13 nt, Human
uuuuagucacuuu

SEQ ID NO: 2175709 - RNA, 14 nt, Human
uuuuagucacuuuu

SEQ ID NO: 2175710 - RNA, 15 nt, Human
uuuuaguagagacag

SEQ ID NO: 2175711 - RNA, 21 nt, Human
uuuuagacagucucacuuugu

SEQ ID NO: 2175712 - RNA, 21 nt, Human
uuuuagacaaauacucaugug

SEQ ID NO: 2175713 - RNA, 22 nt, Human
uuuuagacaaauacucaugugu

SEQ ID NO: 2175714 - RNA, 16 nt, Human
uuuuaguucuuuggaa

SEQ ID NO: 2175715 - RNA, 18 nt, Human
uuuuaguuaaauuucugg

SEQ ID NO: 2175716 - RNA, 22 nt, Human
uuuuauggcacuaguauuucua

SEQ ID NO: 2175717 - RNA, 19 nt, Human
uuuuauggcuuuugugcau

SEQ ID NO: 2175718 - RNA, 18 nt, Human
uuuuauggcuuuugugca

SEQ ID NO: 2175719 - RNA, 17 nt, Human
auguugcuuaggaugug

SEQ ID NO: 2175720 - RNA, 19 nt, Human
auguugcuggacugucaua

SEQ ID NO: 2175721 - RNA, 17 nt, Human
auguuggaagagaaagc

SEQ ID NO: 2175722 - RNA, 15 nt, Human
auguugcuggacugu

SEQ ID NO: 2175723 - RNA, 11 nt, Human
auguugcugcc

SEQ ID NO: 2175724 - RNA, 13 nt, Human
auguugcugccaa

SEQ ID NO: 2175725 - RNA, 20 nt, Human
auguugcugaggagugagga

SEQ ID NO: 2175726 - RNA, 19 nt, Human
auguugcucagucucccuu

SEQ ID NO: 2175727 - RNA, 20 nt, Human
auguugcucagucucccuuu

SEQ ID NO: 2175728 - RNA, 19 nt, Human
auguugaaaagucaaacug

SEQ ID NO: 2175729 - RNA, 21 nt, Human
uuuuagacccuauugcugcuu

SEQ ID NO: 2175730 - RNA, 17 nt, Human
uuuuagaguugauacua

SEQ ID NO: 2175731 - RNA, 18 nt, Human
uuuuagacaaauacucau

SEQ ID NO: 2175732 - RNA, 20 nt, Human
uuuuagacaaauacucaugu

SEQ ID NO: 2175733 - RNA, 20 nt, Human
auguuggauuuauaaaugcu

SEQ ID NO: 2175734 - RNA, 21 nt, Human
auguuggauuuauaaaugcua

SEQ ID NO: 2175735 - RNA, 16 nt, Human
auguuggauuuauaaa

SEQ ID NO: 2175736 - RNA, 18 nt, Human
auguuggauuuauaaaug

SEQ ID NO: 2175737 - RNA, 18 nt, Human
auguugaaagaucaaaag

SEQ ID NO: 2175738 - RNA, 13 nt, Human
auguugcccaggc

SEQ ID NO: 2175739 - RNA, 14 nt, Human
auguugcccaggca

SEQ ID NO: 2175740 - RNA, 15 nt, Human
auguugcccaggcag

SEQ ID NO: 2175741 - RNA, 22 nt, Human
auguucaacuggagacacuauu

SEQ ID NO: 2175742 - RNA, 14 nt, Human
auguucacuuuuga

SEQ ID NO: 2175743 - RNA, 18 nt, Human
auguucacuuuugacaaa

SEQ ID NO: 2175744 - RNA, 14 nt, Human
auguucaacuggag

SEQ ID NO: 2175745 - RNA, 22 nt, Human
auguuauuuguuauuuucagua

SEQ ID NO: 2175746 - RNA, 20 nt, Human
auguuauuuuuuaauuauua

SEQ ID NO: 2175747 - RNA, 12 nt, Human
auguugaaagau

SEQ ID NO: 2175748 - RNA, 16 nt, Human
auguugaaaagucaaa

SEQ ID NO: 2175749 - RNA, 20 nt, Human
auguuaaaucccauucauaa

SEQ ID NO: 2175750 - RNA, 12 nt, Human
auguuaaauuug

SEQ ID NO: 2175751 - RNA, 14 nt, Human
auguuaaauuugua

SEQ ID NO: 2175752 - RNA, 15 nt, Human
auguuaaauuuguaa

SEQ ID NO: 2175753 - RNA, 16 nt, Human
auguuaaauuuguaag

SEQ ID NO: 2175754 - RNA, 17 nt, Human
auguuaaauuuguaagu

SEQ ID NO: 2175755 - RNA, 18 nt, Human
auguuaaauuuguaaguu

SEQ ID NO: 2175756 - RNA, 20 nt, Human
auguuaaauuuguaaguuuc

SEQ ID NO: 2175757 - RNA, 23 nt, Human
auguuaaauuuguaaguuucagg

SEQ ID NO: 2175758 - RNA, 22 nt, Human
auguuaaauuuguaaguuucag

SEQ ID NO: 2175759 - RNA, 12 nt, Human
auguuaacacau

SEQ ID NO: 2175760 - RNA, 13 nt, Human
auguuaacacauu

SEQ ID NO: 2175761 - RNA, 15 nt, Human
auguuaacacauuuu

SEQ ID NO: 2175762 - RNA, 16 nt, Human
auguuaacacauuuug

SEQ ID NO: 2175763 - RNA, 18 nt, Human
auguuaacacauuuugua

SEQ ID NO: 2175764 - RNA, 18 nt, Human
auguuaaaucccauucau

SEQ ID NO: 2175765 - RNA, 22 nt, Human
auguuaaauaaauuguauauuc

SEQ ID NO: 2175766 - RNA, 19 nt, Human
auguuaaauaaauuguaua

SEQ ID NO: 2175767 - RNA, 20 nt, Human
auguuaaauaaauuguauau

SEQ ID NO: 2175768 - RNA, 14 nt, Human
auguuaaauaaauu

SEQ ID NO: 2175769 - RNA, 16 nt, Human
auguuaaauaaauugu

SEQ ID NO: 2175770 - RNA, 17 nt, Human
auguuaaauaaauugua

SEQ ID NO: 2175771 - RNA, 18 nt, Human
auguuaaauaaauuguau

SEQ ID NO: 2175772 - RNA, 21 nt, Human
auguuaaccucagugucauuu

SEQ ID NO: 2175773 - RNA, 18 nt, Human
auguuaaccucaguguca

SEQ ID NO: 2175774 - RNA, 23 nt, Human
auguuaaccagaauaaaguucug

SEQ ID NO: 2175775 - RNA, 20 nt, Human
auguuaacacauuuuguaua

SEQ ID NO: 2175776 - RNA, 21 nt, Human
auguuaacacauuuuguauaa

SEQ ID NO: 2175777 - RNA, 22 nt, Human
auguuaacacauuuuguauaau

SEQ ID NO: 2175778 - RNA, 23 nt, Human
auguuaacacauuuuguauaauu

SEQ ID NO: 2175779 - RNA, 12 nt, Human
auguuaagcaga

SEQ ID NO: 2175780 - RNA, 19 nt, Human
auguuacauaagauaaaug

SEQ ID NO: 2175781 - RNA, 13 nt, Human
auguuaagcagau

SEQ ID NO: 2175782 - RNA, 17 nt, Human
auguuaugcauaaaguc

SEQ ID NO: 2175783 - RNA, 21 nt, Human
auguuaccuccuauaaacuua

SEQ ID NO: 2175784 - RNA, 14 nt, Human
auguuacauuguuu

SEQ ID NO: 2175785 - RNA, 17 nt, Human
auguuacacuaagggug

SEQ ID NO: 2175786 - RNA, 20 nt, Human
auguuacaucuguuuuaaau

SEQ ID NO: 2175787 - RNA, 17 nt, Human
auguuacaucacagugu

SEQ ID NO: 2175788 - RNA, 14 nt, Human
auguuacauuauua

SEQ ID NO: 2175789 - RNA, 20 nt, Human
auguuacauaagauaaaugu

SEQ ID NO: 2175790 - RNA, 21 nt, Human
auguuauuuucuguugaaguu

SEQ ID NO: 2175791 - RNA, 18 nt, Human
auguuauuuucuguugaa

SEQ ID NO: 2175792 - RNA, 17 nt, Human
auguuauuuuuuaauua

SEQ ID NO: 2175793 - RNA, 19 nt, Human
auguuauuuuuuaauuauu

SEQ ID NO: 2175794 - RNA, 12 nt, Human
auguuauuuaua

SEQ ID NO: 2175795 - RNA, 18 nt, Human
auguuauuuauauauugg

SEQ ID NO: 2175796 - RNA, 20 nt, Human
auguuauuuguuauuuucag

SEQ ID NO: 2175797 - RNA, 20 nt, Human
auguuauuuauauauuggua

SEQ ID NO: 2175798 - RNA, 15 nt, Human
auguuauugcauaau

SEQ ID NO: 2175799 - RNA, 23 nt, Human
auguuauuuaacagcugaauuau

SEQ ID NO: 2175800 - RNA, 13 nt, Human
auguuauuuaaca

SEQ ID NO: 2175801 - RNA, 18 nt, Human
auguuaugcauaaaguca

SEQ ID NO: 2175802 - RNA, 13 nt, Human
auguuauguaaaa

SEQ ID NO: 2175803 - RNA, 18 nt, Human
auguuaugcccagcguuu

SEQ ID NO: 2175804 - RNA, 21 nt, Human
auguuauguaaaaggccaaac

SEQ ID NO: 2175805 - RNA, 14 nt, Human
auguuauguaaaag

SEQ ID NO: 2175806 - RNA, 19 nt, Human
auguguguuuaaauaaagu

SEQ ID NO: 2175807 - RNA, 15 nt, Human
auguguguuuuaaaa

SEQ ID NO: 2175808 - RNA, 23 nt, Human
auguguguccacgacugucucca

SEQ ID NO: 2175809 - RNA, 12 nt, Human
auguguguuuaa

SEQ ID NO: 2175810 - RNA, 15 nt, Human
auguguguuuaaaua

SEQ ID NO: 2175811 - RNA, 16 nt, Human
auguguguuuaaauaa

SEQ ID NO: 2175812 - RNA, 17 nt, Human
auguguguuuaaauaaa

SEQ ID NO: 2175813 - RNA, 21 nt, Human
auguuaaacuuacuuaguguu

SEQ ID NO: 2175814 - RNA, 14 nt, Human
auguguuuucugaa

SEQ ID NO: 2175815 - RNA, 15 nt, Human
auguguuuucugaau

SEQ ID NO: 2175816 - RNA, 13 nt, Human
auguuaaauaaau

SEQ ID NO: 2175817 - RNA, 18 nt, Human
auguguuugguucugggg

SEQ ID NO: 2175818 - RNA, 12 nt, Human
auguguuugugu

SEQ ID NO: 2175819 - RNA, 16 nt, Human
auguguuugugugugu

SEQ ID NO: 2175820 - RNA, 15 nt, Human
auguguuugaacuuc

SEQ ID NO: 2175821 - RNA, 12 nt, Human
auguguuuccau

SEQ ID NO: 2175822 - RNA, 15 nt, Human
auguguggcagauuu

SEQ ID NO: 2175823 - RNA, 19 nt, Human
auguggaaagugaauuuga

SEQ ID NO: 2175824 - RNA, 10 nt, Human
auguguguau

SEQ ID NO: 2175825 - RNA, 17 nt, Human
auguguguaagugugug

SEQ ID NO: 2175826 - RNA, 19 nt, Human
auguguguagacaaauauu

SEQ ID NO: 2175827 - RNA, 14 nt, Human
auguguggccugca

SEQ ID NO: 2175828 - RNA, 17 nt, Human
auguggaaagugaauuu

SEQ ID NO: 2175829 - RNA, 16 nt, Human
auguggaaagugaauu

SEQ ID NO: 2175830 - RNA, 15 nt, Human
auguggaaagugaau

SEQ ID NO: 2175831 - RNA, 13 nt, Human
auguggaaaacag

SEQ ID NO: 2175832 - RNA, 23 nt, Human
auguggaaaagccaagaggcugc

SEQ ID NO: 2175833 - RNA, 15 nt, Human
augugcuuuucucca

SEQ ID NO: 2175834 - RNA, 16 nt, Human
augugcuuuucuccaa

SEQ ID NO: 2175835 - RNA, 17 nt, Human
augugcuuuucuccaau

SEQ ID NO: 2175836 - RNA, 20 nt, Human
augugcuguguaaaguuagu

SEQ ID NO: 2175837 - RNA, 13 nt, Human
augugcuuuucuc

SEQ ID NO: 2175838 - RNA, 20 nt, Human
auguguguaugggugugugu

SEQ ID NO: 2175839 - RNA, 22 nt, Human
auguguguauauguaugugugu

SEQ ID NO: 2175840 - RNA, 18 nt, Human
auguguguauauguaugu

SEQ ID NO: 2175841 - RNA, 17 nt, Human
auguguguauauguaug

SEQ ID NO: 2175842 - RNA, 16 nt, Human
auguguguauauguau

SEQ ID NO: 2175843 - RNA, 12 nt, Human
auguguguauau

SEQ ID NO: 2175844 - RNA, 14 nt, Human
auguguguauaugu

SEQ ID NO: 2175845 - RNA, 20 nt, Human
auguguguagacaaauauuu

SEQ ID NO: 2175846 - RNA, 23 nt, Human
auguguguguguuguguguggga

SEQ ID NO: 2175847 - RNA, 22 nt, Human
auguguguguguuguguguggg

SEQ ID NO: 2175848 - RNA, 22 nt, Human
auguguguccacgacugucucc

SEQ ID NO: 2175849 - RNA, 21 nt, Human
auguguguccacgacugucuc

SEQ ID NO: 2175850 - RNA, 18 nt, Human
uuuuaaaaaacugcugac

SEQ ID NO: 2175851 - RNA, 16 nt, Human
uuuguuuuuuuccaac

SEQ ID NO: 2175852 - RNA, 22 nt, Human
uuuguuuuuuuccaacuguguu

SEQ ID NO: 2175853 - RNA, 13 nt, Human
uuuguuuuuuggu

SEQ ID NO: 2175854 - RNA, 21 nt, Human
uuuuaaaaaacugcugacugu

SEQ ID NO: 2175855 - RNA, 22 nt, Human
augugcacccaugggcucugac

SEQ ID NO: 2175856 - RNA, 13 nt, Human
uuuuaaaaaaaua

SEQ ID NO: 2175857 - RNA, 18 nt, Human
uuuuaaaaaaauaaaaca

SEQ ID NO: 2175858 - RNA, 19 nt, Human
uuuuaaaaaaauaaaacau

SEQ ID NO: 2175859 - RNA, 20 nt, Human
uuuuaaaaaaauaaaacauu

SEQ ID NO: 2175860 - RNA, 17 nt, Human
augugcagguuuguuac

SEQ ID NO: 2175861 - RNA, 22 nt, Human
augugcacugucacuuugcucu

SEQ ID NO: 2175862 - RNA, 21 nt, Human
uuuuaaaaaaauaaaacauuu

SEQ ID NO: 2175863 - RNA, 22 nt, Human
uuuuaaaaaaauaaaacauuuu

SEQ ID NO: 2175864 - RNA, 15 nt, Human
augugcacugucacu

SEQ ID NO: 2175865 - RNA, 18 nt, Human
augugcacugucacuuug

SEQ ID NO: 2175866 - RNA, 14 nt, Human
uuuguuuuuaugaa

SEQ ID NO: 2175867 - RNA, 13 nt, Human
uuuguuuuuaauu

SEQ ID NO: 2175868 - RNA, 12 nt, Human
uuuguuuuucau

SEQ ID NO: 2175869 - RNA, 18 nt, Human
uuuguuuugcuuuuucug

SEQ ID NO: 2175870 - RNA, 12 nt, Human
uuuguuuugcac

SEQ ID NO: 2175871 - RNA, 14 nt, Human
uuuguuuucauggu

SEQ ID NO: 2175872 - RNA, 13 nt, Human
uuuguuuucuuug

SEQ ID NO: 2175873 - RNA, 21 nt, Human
augugcauuuuugugaaauga

SEQ ID NO: 2175874 - RNA, 20 nt, Human
augugcauuuuugugaaaug

SEQ ID NO: 2175875 - RNA, 19 nt, Human
augugcagguuuguuacau

SEQ ID NO: 2175876 - RNA, 20 nt, Human
augugcauucuuuuaaaaga

SEQ ID NO: 2175877 - RNA, 19 nt, Human
augugcauucuuuuaaaag

SEQ ID NO: 2175878 - RNA, 23 nt, Human
augugcaguguagcccacacuug

SEQ ID NO: 2175879 - RNA, 13 nt, Human
augugccaaggug

SEQ ID NO: 2175880 - RNA, 15 nt, Human
augugccaagguggg

SEQ ID NO: 2175881 - RNA, 21 nt, Human
augugccagggcaaugaugaa

SEQ ID NO: 2175882 - RNA, 20 nt, Human
augugccagggcaaugauga

SEQ ID NO: 2175883 - RNA, 21 nt, Human
augugccagguuuuuggucug

SEQ ID NO: 2175884 - RNA, 20 nt, Human
augugcuaguaauuggaaag

SEQ ID NO: 2175885 - RNA, 11 nt, Human
augugcugugu

SEQ ID NO: 2175886 - RNA, 18 nt, Human
augugcugcgugccugug

SEQ ID NO: 2175887 - RNA, 13 nt, Human
augugcuguguaa

SEQ ID NO: 2175888 - RNA, 14 nt, Human
augugcuguguaaa

SEQ ID NO: 2175889 - RNA, 15 nt, Human
augugcuguguaaag

SEQ ID NO: 2175890 - RNA, 16 nt, Human
augugcuguguaaagu

SEQ ID NO: 2175891 - RNA, 17 nt, Human
augugcuguguaaaguu

SEQ ID NO: 2175892 - RNA, 18 nt, Human
augugcuguguaaaguua

SEQ ID NO: 2175893 - RNA, 19 nt, Human
augugcuguguaaaguuag

SEQ ID NO: 2175894 - RNA, 18 nt, Human
augugcuauacugcauac

SEQ ID NO: 2175895 - RNA, 19 nt, Human
augugcuauacugcauacu

SEQ ID NO: 2175896 - RNA, 21 nt, Human
augugcuaguaauuggaaagg

SEQ ID NO: 2175897 - RNA, 16 nt, Human
uuugacuguuuuuacc

SEQ ID NO: 2175898 - RNA, 19 nt, Human
uuugacuguuuuuacccau

SEQ ID NO: 2175899 - RNA, 21 nt, Human
uuugagaaacaacaauuucua

SEQ ID NO: 2175900 - RNA, 13 nt, Human
uuugagaaaugca

SEQ ID NO: 2175901 - RNA, 18 nt, Human
uuugaccucugcagcaau

SEQ ID NO: 2175902 - RNA, 23 nt, Human
uuugaccuguugggagugaggau

SEQ ID NO: 2175903 - RNA, 13 nt, Human
uuugaccuuuuau

SEQ ID NO: 2175904 - RNA, 20 nt, Human
uuugacuguuuuuacccaua

SEQ ID NO: 2175905 - RNA, 16 nt, Human
uuugagaccagccugg

SEQ ID NO: 2175906 - RNA, 20 nt, Human
uuugagacaguuucuuagcu

SEQ ID NO: 2175907 - RNA, 22 nt, Human
uuugagacaguuucuuagcuuu

SEQ ID NO: 2175908 - RNA, 19 nt, Human
uuugagaccagccugggca

SEQ ID NO: 2175909 - RNA, 21 nt, Human
uuugagagaaauaugaagaac

SEQ ID NO: 2175910 - RNA, 18 nt, Human
uuugagaagaaaacaucu

SEQ ID NO: 2175911 - RNA, 15 nt, Human
uuugagacaguuucu

SEQ ID NO: 2175912 - RNA, 14 nt, Human
uuugagaagaaaac

SEQ ID NO: 2175913 - RNA, 16 nt, Human
uuugagacaguuucuu

SEQ ID NO: 2175914 - RNA, 17 nt, Human
uuugagacaguuucuua

SEQ ID NO: 2175915 - RNA, 18 nt, Human
uuugagacaguuucuuag

SEQ ID NO: 2175916 - RNA, 19 nt, Human
uuugagacaguuucuuagc

SEQ ID NO: 2175917 - RNA, 13 nt, Human
uuugagacaggag

SEQ ID NO: 2175918 - RNA, 16 nt, Human
uuugagaaauuaagua

SEQ ID NO: 2175919 - RNA, 13 nt, Human
uuugagacagagu

SEQ ID NO: 2175920 - RNA, 10 nt, Human
uuugagacgg

SEQ ID NO: 2175921 - RNA, 14 nt, Human
uuugagaguucuaa

SEQ ID NO: 2175922 - RNA, 15 nt, Human
uuugaugaguuguga

SEQ ID NO: 2175923 - RNA, 14 nt, Human
uuugauccaagcug

SEQ ID NO: 2175924 - RNA, 13 nt, Human
uuugagaguucua

SEQ ID NO: 2175925 - RNA, 15 nt, Human
uuugauccaagcugg

SEQ ID NO: 2175926 - RNA, 14 nt, Human
uuugauuauuguau

SEQ ID NO: 2175927 - RNA, 18 nt, Human
uuugauuaauccagaaua

SEQ ID NO: 2175928 - RNA, 16 nt, Human
uuugauuauuguauuu

SEQ ID NO: 2175929 - RNA, 16 nt, Human
uuugaugccaagaaag

SEQ ID NO: 2175930 - RNA, 16 nt, Human
uuugaugcuggagagg

SEQ ID NO: 2175931 - RNA, 18 nt, Human
uuugaugcuggagagguu

SEQ ID NO: 2175932 - RNA, 15 nt, Human
uuugauucagacagc

SEQ ID NO: 2175933 - RNA, 22 nt, Human
uuucccugcuuaaugaaaagcu

SEQ ID NO: 2175934 - RNA, 12 nt, Human
uuucccugugcu

SEQ ID NO: 2175935 - RNA, 16 nt, Human
uuucccuucaguaccc

SEQ ID NO: 2175936 - RNA, 14 nt, Human
uuucccugacuccu

SEQ ID NO: 2175937 - RNA, 13 nt, Human
uuucccugugcug

SEQ ID NO: 2175938 - RNA, 13 nt, Human
uuucccugaccuc

SEQ ID NO: 2175939 - RNA, 16 nt, Human
uuucccugccucucau

SEQ ID NO: 2175940 - RNA, 14 nt, Human
uuucccucgcuggg

SEQ ID NO: 2175941 - RNA, 23 nt, Human
uuucccucccuuccucuuuccau

SEQ ID NO: 2175942 - RNA, 19 nt, Human
uuucccuccacuccuuccu

SEQ ID NO: 2175943 - RNA, 15 nt, Human
uuucccuugaggaaa

SEQ ID NO: 2175944 - RNA, 14 nt, Human
uuucccuuaucaaa

SEQ ID NO: 2175945 - RNA, 19 nt, Human
uuucccuucaguacccucu

SEQ ID NO: 2175946 - RNA, 20 nt, Human
uuucccuucaguacccucuc

SEQ ID NO: 2175947 - RNA, 20 nt, Human
uuugacaacguuucagcgac

SEQ ID NO: 2175948 - RNA, 15 nt, Human
uuugacaacaaauua

SEQ ID NO: 2175949 - RNA, 16 nt, Human
uuugaauuuucugugu

SEQ ID NO: 2175950 - RNA, 15 nt, Human
uuugacacuauaucu

SEQ ID NO: 2175951 - RNA, 17 nt, Human
uuugacacuauaucugu

SEQ ID NO: 2175952 - RNA, 18 nt, Human
uuugacacuauaucugua

SEQ ID NO: 2175953 - RNA, 18 nt, Human
uuugacaaagguaaauca

SEQ ID NO: 2175954 - RNA, 14 nt, Human
uuugacaaggggca

SEQ ID NO: 2175955 - RNA, 21 nt, Human
uuugaccucugcagcaauaaa

SEQ ID NO: 2175956 - RNA, 19 nt, Human
uuugaccucugcagcaaua

SEQ ID NO: 2175957 - RNA, 22 nt, Human
uuugcuaacuagcuuggaaacu

SEQ ID NO: 2175958 - RNA, 19 nt, Human
uuugcugggcaguuuuucu

SEQ ID NO: 2175959 - RNA, 18 nt, Human
uuuggauugacucugcau

SEQ ID NO: 2175960 - RNA, 20 nt, Human
uuuggauucuuauguagcag

SEQ ID NO: 2175961 - RNA, 18 nt, Human
uuuggauucuuauguagc

SEQ ID NO: 2175962 - RNA, 19 nt, Human
uuugcuguacuagagaucu

SEQ ID NO: 2175963 - RNA, 22 nt, Human
uuuggauuggaugaauuccaaa

SEQ ID NO: 2175964 - RNA, 16 nt, Human
uuuggauuugacauug

SEQ ID NO: 2175965 - RNA, 14 nt, Human
uuuggauuguauau

SEQ ID NO: 2175966 - RNA, 20 nt, Human
uuuggauuggggucccucua

SEQ ID NO: 2175967 - RNA, 22 nt, Human
uuugcuggggccgaaagaacag

SEQ ID NO: 2175968 - RNA, 19 nt, Human
uuugcuggggccgaaagaa

SEQ ID NO: 2175969 - RNA, 20 nt, Human
uuugcuggagcucugcccau

SEQ ID NO: 2175970 - RNA, 19 nt, Human
uuugcuaagcauuccaacu

SEQ ID NO: 2175971 - RNA, 15 nt, Human
uuugauucugugugu

SEQ ID NO: 2175972 - RNA, 21 nt, Human
uuugauucuccuucagcccuc

SEQ ID NO: 2175973 - RNA, 15 nt, Human
uuugauugauuugaa

SEQ ID NO: 2175974 - RNA, 21 nt, Human
uuugauugagaguaacuuaag

SEQ ID NO: 2175975 - RNA, 22 nt, Human
uuugauugagaguaacuuaagu

SEQ ID NO: 2175976 - RNA, 18 nt, Human
uuugauucagacagcugc

SEQ ID NO: 2175977 - RNA, 12 nt, Human
uuugauuuaugc

SEQ ID NO: 2175978 - RNA, 14 nt, Human
uuugauuuaauguu

SEQ ID NO: 2175979 - RNA, 13 nt, Human
uuugauuucuauu

SEQ ID NO: 2175980 - RNA, 14 nt, Human
uuugauuucauuaa

SEQ ID NO: 2175981 - RNA, 12 nt, Human
uuugccugugcc

SEQ ID NO: 2175982 - RNA, 14 nt, Human
uuugccuguucagu

SEQ ID NO: 2175983 - RNA, 15 nt, Human
uuugccuguucaguu

SEQ ID NO: 2175984 - RNA, 16 nt, Human
uuugccuguucaguua

SEQ ID NO: 2175985 - RNA, 12 nt, Human
uuugcaaaauuu

SEQ ID NO: 2175986 - RNA, 15 nt, Human
uuugcaaaggagcuc

SEQ ID NO: 2175987 - RNA, 19 nt, Human
uuugcaaacuuuauuuuca

SEQ ID NO: 2175988 - RNA, 21 nt, Human
uuugccuugggcugcuccuca

SEQ ID NO: 2175989 - RNA, 19 nt, Human
uuugccuguucaguuacag

SEQ ID NO: 2175990 - RNA, 20 nt, Human
uuugccuguucaguuacaga

SEQ ID NO: 2175991 - RNA, 23 nt, Human
uuugccuguucaguuacagaaag

SEQ ID NO: 2175992 - RNA, 19 nt, Human
uuugccuuuugcaaacuuu

SEQ ID NO: 2175993 - RNA, 22 nt, Human
uuugccuguucaguuacagaaa

SEQ ID NO: 2175994 - RNA, 12 nt, Human
uuugccuuuugc

SEQ ID NO: 2175995 - RNA, 14 nt, Human
auguauaauauuuu

SEQ ID NO: 2175996 - RNA, 23 nt, Human
auguauaauauuuuuaauuaaau

SEQ ID NO: 2175997 - RNA, 21 nt, Human
auguauaauucaaagcaccaa

SEQ ID NO: 2175998 - RNA, 17 nt, Human
auguauauaaacaugcu

SEQ ID NO: 2175999 - RNA, 21 nt, Human
uuugggguacccacugcucug

SEQ ID NO: 2176000 - RNA, 13 nt, Human
uuuggggaagaac

SEQ ID NO: 2176001 - RNA, 17 nt, Human
uuuggguaccuauuuuc

SEQ ID NO: 2176002 - RNA, 20 nt, Human
uuugggguagcuagaggaac

SEQ ID NO: 2176003 - RNA, 22 nt, Human
uuugggguacccacugcucugg

SEQ ID NO: 2176004 - RNA, 17 nt, Human
uuugggaggcugaggcg

SEQ ID NO: 2176005 - RNA, 22 nt, Human
uuugggauaggaaaaaugagua

SEQ ID NO: 2176006 - RNA, 22 nt, Human
uuuggcugaaauucuccuggag

SEQ ID NO: 2176007 - RNA, 13 nt, Human
uuuggcugugucu

SEQ ID NO: 2176008 - RNA, 14 nt, Human
uuuggcugugucua

SEQ ID NO: 2176009 - RNA, 15 nt, Human
uuuggcugugucuaa

SEQ ID NO: 2176010 - RNA, 17 nt, Human
uuuggcugugucuaaac

SEQ ID NO: 2176011 - RNA, 19 nt, Human
uuuggcugugucuaaacug

SEQ ID NO: 2176012 - RNA, 14 nt, Human
uuuggcuuccauga

SEQ ID NO: 2176013 - RNA, 14 nt, Human
uuugggcugcccug

SEQ ID NO: 2176014 - RNA, 15 nt, Human
uuugggccccucucc

SEQ ID NO: 2176015 - RNA, 12 nt, Human
uuugggcccagg

SEQ ID NO: 2176016 - RNA, 14 nt, Human
uuugggcccaggga

SEQ ID NO: 2176017 - RNA, 15 nt, Human
uuugggcccagggac

SEQ ID NO: 2176018 - RNA, 20 nt, Human
uuugggcagaagggagaagg

SEQ ID NO: 2176019 - RNA, 12 nt, Human
uuuggcugcuga

SEQ ID NO: 2176020 - RNA, 13 nt, Human
uuuggcugcugaa

SEQ ID NO: 2176021 - RNA, 23 nt, Human
uuuggcucuccucagaagaaaga

SEQ ID NO: 2176022 - RNA, 20 nt, Human
uuuggcugaaauucuccugg

SEQ ID NO: 2176023 - RNA, 21 nt, Human
uuuggcugaaauucuccugga

SEQ ID NO: 2176024 - RNA, 18 nt, Human
uuuggcaaacucuccacc

SEQ ID NO: 2176025 - RNA, 14 nt, Human
uuuggauuugacau

SEQ ID NO: 2176026 - RNA, 19 nt, Human
uuuggcaaacgcuaaagag

SEQ ID NO: 2176027 - RNA, 16 nt, Human
auguauauacauuuau

SEQ ID NO: 2176028 - RNA, 20 nt, Human
auguauauacccacacacau

SEQ ID NO: 2176029 - RNA, 16 nt, Human
auguauauguguucau

SEQ ID NO: 2176030 - RNA, 19 nt, Human
auguauauuuuauaucaau

SEQ ID NO: 2176031 - RNA, 12 nt, Human
auguaucaauga

SEQ ID NO: 2176032 - RNA, 19 nt, Human
auguauauuuaaaagaaag

SEQ ID NO: 2176033 - RNA, 14 nt, Human
augucaucauacau

SEQ ID NO: 2176034 - RNA, 15 nt, Human
augucaucauacaug

SEQ ID NO: 2176035 - RNA, 21 nt, Human
augucauguguacaaaaguuu

SEQ ID NO: 2176036 - RNA, 17 nt, Human
augucauauauuacuag

SEQ ID NO: 2176037 - RNA, 20 nt, Human
augucauuaaaauaaauaaa

SEQ ID NO: 2176038 - RNA, 18 nt, Human
augucauugaguaauaua

SEQ ID NO: 2176039 - RNA, 17 nt, Human
augucauuaaaauaaau

SEQ ID NO: 2176040 - RNA, 13 nt, Human
augucauuaaaug

SEQ ID NO: 2176041 - RNA, 18 nt, Human
augucauuucauuuccua

SEQ ID NO: 2176042 - RNA, 15 nt, Human
augucauuucauuuc

SEQ ID NO: 2176043 - RNA, 16 nt, Human
augucccuuucuuggc

SEQ ID NO: 2176044 - RNA, 16 nt, Human
auguccuaaggacaca

SEQ ID NO: 2176045 - RNA, 20 nt, Human
augucccuuucuuggccagu

SEQ ID NO: 2176046 - RNA, 17 nt, Human
auguccuaaggacacac

SEQ ID NO: 2176047 - RNA, 18 nt, Human
auguccuaaggacacacu

SEQ ID NO: 2176048 - RNA, 19 nt, Human
auguccuaaggacacacua

SEQ ID NO: 2176049 - RNA, 20 nt, Human
auguccuaaggacacacuaa

SEQ ID NO: 2176050 - RNA, 13 nt, Human
augucauuuccuu

SEQ ID NO: 2176051 - RNA, 14 nt, Human
augucccuugcugu

SEQ ID NO: 2176052 - RNA, 19 nt, Human
auguccuccagaagccucu

SEQ ID NO: 2176053 - RNA, 18 nt, Human
auguccuccagaagccuc

SEQ ID NO: 2176054 - RNA, 16 nt, Human
auguccuccagaagcc

SEQ ID NO: 2176055 - RNA, 17 nt, Human
auguccucaccacaugc

SEQ ID NO: 2176056 - RNA, 15 nt, Human
auguccucaccacau

SEQ ID NO: 2176057 - RNA, 19 nt, Human
auguccuauauuggcuaaa

SEQ ID NO: 2176058 - RNA, 21 nt, Human
auguccuaaggacacacuaau

SEQ ID NO: 2176059 - RNA, 16 nt, Human
auguccaagaagccca

SEQ ID NO: 2176060 - RNA, 17 nt, Human
auguccaagaagcccag

SEQ ID NO: 2176061 - RNA, 13 nt, Human
augugacauuuau

SEQ ID NO: 2176062 - RNA, 14 nt, Human
augugacauuuaua

SEQ ID NO: 2176063 - RNA, 19 nt, Human
augugacauuuauauauug

SEQ ID NO: 2176064 - RNA, 19 nt, Human
augugacaugcgggcuggg

SEQ ID NO: 2176065 - RNA, 17 nt, Human
augucuaaaugcugaaa

SEQ ID NO: 2176066 - RNA, 11 nt, Human
augugacacau

SEQ ID NO: 2176067 - RNA, 16 nt, Human
augugacagguaaacu

SEQ ID NO: 2176068 - RNA, 21 nt, Human
augugacaauuuuguacaaau

SEQ ID NO: 2176069 - RNA, 20 nt, Human
augugacaauuuuguacaaa

SEQ ID NO: 2176070 - RNA, 18 nt, Human
augugacaauuuuguaca

SEQ ID NO: 2176071 - RNA, 11 nt, Human
augucuaaaga

SEQ ID NO: 2176072 - RNA, 13 nt, Human
augucuaaagagc

SEQ ID NO: 2176073 - RNA, 22 nt, Human
augucgugaccaacuagacauu

SEQ ID NO: 2176074 - RNA, 22 nt, Human
auguccuccagaagccucuggc

SEQ ID NO: 2176075 - RNA, 20 nt, Human
auguccuccagaagccucug

SEQ ID NO: 2176076 - RNA, 23 nt, Human
auguccuccagaagccucuggcu

SEQ ID NO: 2176077 - RNA, 15 nt, Human
augucgccucugcau

SEQ ID NO: 2176078 - RNA, 17 nt, Human
auguccuccuuguucua

SEQ ID NO: 2176079 - RNA, 13 nt, Human
augucggccucua

SEQ ID NO: 2176080 - RNA, 19 nt, Human
augucgugaccaacuagac

SEQ ID NO: 2176081 - RNA, 20 nt, Human
augucgugaccaacuagaca

SEQ ID NO: 2176082 - RNA, 21 nt, Human
augucgugaccaacuagacau

SEQ ID NO: 2176083 - RNA, 23 nt, Human
augucgucaaagcugaaauggac

SEQ ID NO: 2176084 - RNA, 17 nt, Human
augugagagguuugacu

SEQ ID NO: 2176085 - RNA, 20 nt, Human
augugauaaggaucagaaca

SEQ ID NO: 2176086 - RNA, 21 nt, Human
augugauaaguucuuaugcca

SEQ ID NO: 2176087 - RNA, 21 nt, Human
augugauacccauagcuucca

SEQ ID NO: 2176088 - RNA, 13 nt, Human
augugauauauaa

SEQ ID NO: 2176089 - RNA, 15 nt, Human
augugauauauaagu

SEQ ID NO: 2176090 - RNA, 15 nt, Human
augugagagaaagug

SEQ ID NO: 2176091 - RNA, 16 nt, Human
augugagagguuugac

SEQ ID NO: 2176092 - RNA, 14 nt, Human
augugagagaaagu

SEQ ID NO: 2176093 - RNA, 18 nt, Human
augugacuuugcaucagc

SEQ ID NO: 2176094 - RNA, 14 nt, Human
augugagacugguu

SEQ ID NO: 2176095 - RNA, 13 nt, Human
augugagaccauu

SEQ ID NO: 2176096 - RNA, 15 nt, Human
uuuguuuuaaaauua

SEQ ID NO: 2176097 - RNA, 16 nt, Human
uuuguuucugaaaggg

SEQ ID NO: 2176098 - RNA, 15 nt, Human
uuuguuucuaccucc

SEQ ID NO: 2176099 - RNA, 18 nt, Human
uuuguuucucccccuggg

SEQ ID NO: 2176100 - RNA, 15 nt, Human
uuuguuuccuuuguu

SEQ ID NO: 2176101 - RNA, 14 nt, Human
uuuguuuccuuugu

SEQ ID NO: 2176102 - RNA, 14 nt, Human
uuuguuucugaaag

SEQ ID NO: 2176103 - RNA, 20 nt, Human
uuugugauucaaucuguaaa

SEQ ID NO: 2176104 - RNA, 17 nt, Human
uuugugauuuagaacug

SEQ ID NO: 2176105 - RNA, 22 nt, Human
uuugugcauuaucuagauacug

SEQ ID NO: 2176106 - RNA, 13 nt, Human
uuuguuucauauu

SEQ ID NO: 2176107 - RNA, 13 nt, Human
uuugugccagccg

SEQ ID NO: 2176108 - RNA, 22 nt, Human
uuugugcugaauguugggacug

SEQ ID NO: 2176109 - RNA, 23 nt, Human
uuugugcuaucagacuguaggau

SEQ ID NO: 2176110 - RNA, 14 nt, Human
uuugucuuaaaaag

SEQ ID NO: 2176111 - RNA, 13 nt, Human
uuugucuuaaaaa

SEQ ID NO: 2176112 - RNA, 23 nt, Human
uuugucuuaaaaaguggaaaaau

SEQ ID NO: 2176113 - RNA, 16 nt, Human
uuugugauacaaugcu

SEQ ID NO: 2176114 - RNA, 15 nt, Human
uuugugauucaaucu

SEQ ID NO: 2176115 - RNA, 19 nt, Human
uuugugauauggagcccug

SEQ ID NO: 2176116 - RNA, 20 nt, Human
uuugugauauggagcccugu

SEQ ID NO: 2176117 - RNA, 19 nt, Human
uuugugcauuaucuagaua

SEQ ID NO: 2176118 - RNA, 15 nt, Human
uuugugauacaaugc

SEQ ID NO: 2176119 - RNA, 20 nt, Human
uuugucuuauauauauuucu

SEQ ID NO: 2176120 - RNA, 14 nt, Human
uuugucuuauauau

SEQ ID NO: 2176121 - RNA, 19 nt, Human
uuugucuuauauauauuuc

SEQ ID NO: 2176122 - RNA, 22 nt, Human
uuugugauacaaugcugugccc

SEQ ID NO: 2176123 - RNA, 18 nt, Human
uuuguacaguuugcugua

SEQ ID NO: 2176124 - RNA, 19 nt, Human
uuuguacauaguuauuuau

SEQ ID NO: 2176125 - RNA, 17 nt, Human
uuuguaguguuggagaa

SEQ ID NO: 2176126 - RNA, 18 nt, Human
uuuguacagacguaugcu

SEQ ID NO: 2176127 - RNA, 10 nt, Human
uuuguacaga

SEQ ID NO: 2176128 - RNA, 21 nt, Human
uuuguacaauugaacuuaaau

SEQ ID NO: 2176129 - RNA, 22 nt, Human
uuuguacagacguaugcuuauu

SEQ ID NO: 2176130 - RNA, 19 nt, Human
uuuguacagacguaugcuu

SEQ ID NO: 2176131 - RNA, 17 nt, Human
uuuguacaguuugcugu

SEQ ID NO: 2176132 - RNA, 14 nt, Human
uuuguacagacaac

SEQ ID NO: 2176133 - RNA, 21 nt, Human
uuuguaaguuucaggugacau

SEQ ID NO: 2176134 - RNA, 21 nt, Human
uuuguaaguuuaugucuaaag

SEQ ID NO: 2176135 - RNA, 14 nt, Human
uuuguaaguuucag

SEQ ID NO: 2176136 - RNA, 23 nt, Human
uuuguacaaaaaaaaaguuuuau

SEQ ID NO: 2176137 - RNA, 16 nt, Human
uuuguaauuuuuuuau

SEQ ID NO: 2176138 - RNA, 13 nt, Human
uuuguaaguuuau

SEQ ID NO: 2176139 - RNA, 22 nt, Human
uuuguaaguuagguaacuguau

SEQ ID NO: 2176140 - RNA, 15 nt, Human
uuuguaagaugcugg

SEQ ID NO: 2176141 - RNA, 23 nt, Human
uuuguaagaguguagaagcauuc

SEQ ID NO: 2176142 - RNA, 22 nt, Human
uuuguaagaguguagaagcauu

SEQ ID NO: 2176143 - RNA, 14 nt, Human
uuuguaagaugcug

SEQ ID NO: 2176144 - RNA, 12 nt, Human
uuuguaagagug

SEQ ID NO: 2176145 - RNA, 16 nt, Human
uuuguaagaguguaga

SEQ ID NO: 2176146 - RNA, 17 nt, Human
uuuguaagaguguagaa

SEQ ID NO: 2176147 - RNA, 18 nt, Human
uuuguaagaguguagaag

SEQ ID NO: 2176148 - RNA, 19 nt, Human
uuuguaagaguguagaagc

SEQ ID NO: 2176149 - RNA, 21 nt, Human
uuuguaagaguguagaagcau

SEQ ID NO: 2176150 - RNA, 15 nt, Human
augugaugagaggaa

SEQ ID NO: 2176151 - RNA, 19 nt, Human
augugaugaauacuguauu

SEQ ID NO: 2176152 - RNA, 17 nt, Human
augugaugaauacugua

SEQ ID NO: 2176153 - RNA, 18 nt, Human
augugauccuuuuggagu

SEQ ID NO: 2176154 - RNA, 16 nt, Human
augugauccuuuuaug

SEQ ID NO: 2176155 - RNA, 17 nt, Human
augugauccuuuuaugu

SEQ ID NO: 2176156 - RNA, 18 nt, Human
augugauccuuuuauguu

SEQ ID NO: 2176157 - RNA, 21 nt, Human
augugauccuuuuauguuauu

SEQ ID NO: 2176158 - RNA, 23 nt, Human
augugauccuuuuauguuauuua

SEQ ID NO: 2176159 - RNA, 16 nt, Human
augugauauauaagug

SEQ ID NO: 2176160 - RNA, 17 nt, Human
augugauauauaagugu

SEQ ID NO: 2176161 - RNA, 19 nt, Human
augugauauauaaguguac

SEQ ID NO: 2176162 - RNA, 21 nt, Human
augugauauauaaguguacau

SEQ ID NO: 2176163 - RNA, 22 nt, Human
augugauauauaaguguacaua

SEQ ID NO: 2176164 - RNA, 23 nt, Human
augugauauauaaguguacauau

SEQ ID NO: 2176165 - RNA, 14 nt, Human
auucacuugcauuu

SEQ ID NO: 2176166 - RNA, 12 nt, Human
auucagaaaaaa

SEQ ID NO: 2176167 - RNA, 16 nt, Human
auucacuuauauguuc

SEQ ID NO: 2176168 - RNA, 20 nt, Human
auucacugcccccagcucuu

SEQ ID NO: 2176169 - RNA, 15 nt, Human
auucacugcccccag

SEQ ID NO: 2176170 - RNA, 21 nt, Human
auucacucccacacccaagaa

SEQ ID NO: 2176171 - RNA, 19 nt, Human
auucacucuuccagaaucc

SEQ ID NO: 2176172 - RNA, 19 nt, Human
auucagcacugauuucaca

SEQ ID NO: 2176173 - RNA, 20 nt, Human
auucagcacugauuucacaa

SEQ ID NO: 2176174 - RNA, 21 nt, Human
auucagcacugauuucacaac

SEQ ID NO: 2176175 - RNA, 14 nt, Human
auucagccuggcuu

SEQ ID NO: 2176176 - RNA, 14 nt, Human
auucagcacugauu

SEQ ID NO: 2176177 - RNA, 17 nt, Human
auucagcacugauuuca

SEQ ID NO: 2176178 - RNA, 14 nt, Human
auucagauuuuaaa

SEQ ID NO: 2176179 - RNA, 19 nt, Human
auucagauuuuaaaaaguc

SEQ ID NO: 2176180 - RNA, 17 nt, Human
auucagauuguuaucua

SEQ ID NO: 2176181 - RNA, 19 nt, Human
auucagugcuucuuaaaga

SEQ ID NO: 2176182 - RNA, 17 nt, Human
auucaguucccagaauc

SEQ ID NO: 2176183 - RNA, 19 nt, Human
auucaguucccagaaucaa

SEQ ID NO: 2176184 - RNA, 16 nt, Human
auucaguucccagaau

SEQ ID NO: 2176185 - RNA, 19 nt, Human
auucaguguuaaaugugau

SEQ ID NO: 2176186 - RNA, 14 nt, Human
auucagugucacug

SEQ ID NO: 2176187 - RNA, 22 nt, Human
auucagugcuguggccugggca

SEQ ID NO: 2176188 - RNA, 21 nt, Human
auucagugcuguggccugggc

SEQ ID NO: 2176189 - RNA, 17 nt, Human
auucagugcuucuuaaa

SEQ ID NO: 2176190 - RNA, 14 nt, Human
auucagugcuucuu

SEQ ID NO: 2176191 - RNA, 19 nt, Human
auucaguggcgagaaauaa

SEQ ID NO: 2176192 - RNA, 20 nt, Human
auucagugcuguggccuggg

SEQ ID NO: 2176193 - RNA, 17 nt, Human
auucagugcuguggccu

SEQ ID NO: 2176194 - RNA, 15 nt, Human
auucagugauuacug

SEQ ID NO: 2176195 - RNA, 19 nt, Human
auucagugauuacugucaa

SEQ ID NO: 2176196 - RNA, 17 nt, Human
auucagugauuacuguc

SEQ ID NO: 2176197 - RNA, 16 nt, Human
auucaggcugcuuggg

SEQ ID NO: 2176198 - RNA, 13 nt, Human
auucaggcugcuu

SEQ ID NO: 2176199 - RNA, 11 nt, Human
auucaggcugc

SEQ ID NO: 2176200 - RNA, 22 nt, Human
auucaggacuuaacggcuccag

SEQ ID NO: 2176201 - RNA, 21 nt, Human
auucaggagaguagaacagau

SEQ ID NO: 2176202 - RNA, 22 nt, Human
auucaggagaguagaacagaua

SEQ ID NO: 2176203 - RNA, 21 nt, Human
auucagugagggucuucuuac

SEQ ID NO: 2176204 - RNA, 16 nt, Human
auucagugagggucuu

SEQ ID NO: 2176205 - RNA, 17 nt, Human
auucagguauguugccu

SEQ ID NO: 2176206 - RNA, 18 nt, Human
auucagguauguugccuu

SEQ ID NO: 2176207 - RNA, 13 nt, Human
auucagguauguu

SEQ ID NO: 2176208 - RNA, 18 nt, Human
auuccuacaaagauguuu

SEQ ID NO: 2176209 - RNA, 20 nt, Human
auuccuaaacuaucuuuuuu

SEQ ID NO: 2176210 - RNA, 20 nt, Human
auuccuaacacagcaugugu

SEQ ID NO: 2176211 - RNA, 15 nt, Human
auuccccauucuucc

SEQ ID NO: 2176212 - RNA, 13 nt, Human
auuccccauugcc

SEQ ID NO: 2176213 - RNA, 17 nt, Human
auuccccauugccuccu

SEQ ID NO: 2176214 - RNA, 20 nt, Human
auuccccauugccuccuccu

SEQ ID NO: 2176215 - RNA, 15 nt, Human
auuccuaaacuaucu

SEQ ID NO: 2176216 - RNA, 17 nt, Human
auuccuaaacuaucuuu

SEQ ID NO: 2176217 - RNA, 19 nt, Human
auuccuaaacuaucuuuuu

SEQ ID NO: 2176218 - RNA, 22 nt, Human
auuccccagguggcugacccag

SEQ ID NO: 2176219 - RNA, 21 nt, Human
auuccccagguggcugaccca

SEQ ID NO: 2176220 - RNA, 14 nt, Human
auucccaccaaggu

SEQ ID NO: 2176221 - RNA, 15 nt, Human
auucccaccaagguc

SEQ ID NO: 2176222 - RNA, 14 nt, Human
auuccccauucuuc

SEQ ID NO: 2176223 - RNA, 22 nt, Human
auuccccaggaggccagccuug

SEQ ID NO: 2176224 - RNA, 18 nt, Human
auuccagagacaucagca

SEQ ID NO: 2176225 - RNA, 18 nt, Human
auucccacaccuccacag

SEQ ID NO: 2176226 - RNA, 19 nt, Human
auucccacaccuccacagu

SEQ ID NO: 2176227 - RNA, 20 nt, Human
auuccccaggaggccagccu

SEQ ID NO: 2176228 - RNA, 18 nt, Human
auucccaagcucugcucc

SEQ ID NO: 2176229 - RNA, 19 nt, Human
auucccaagcucugcuccu

SEQ ID NO: 2176230 - RNA, 17 nt, Human
auucccaagcucugcuc

SEQ ID NO: 2176231 - RNA, 18 nt, Human
auuccagagaguggcucc

SEQ ID NO: 2176232 - RNA, 23 nt, Human
auuccagacugcuuccaauuuuc

SEQ ID NO: 2176233 - RNA, 18 nt, Human
auuccagaccugaagaau

SEQ ID NO: 2176234 - RNA, 17 nt, Human
auuccagaccugaagaa

SEQ ID NO: 2176235 - RNA, 23 nt, Human
auuccagaaugcuguacaucuau

SEQ ID NO: 2176236 - RNA, 20 nt, Human
auuccagaaugcuguacauc

SEQ ID NO: 2176237 - RNA, 18 nt, Human
auuccagaauaucuggga

SEQ ID NO: 2176238 - RNA, 14 nt, Human
auuccagaaugcug

SEQ ID NO: 2176239 - RNA, 19 nt, Human
auuccagaaugcuguacau

SEQ ID NO: 2176240 - RNA, 15 nt, Human
auuccagaaugcugu

SEQ ID NO: 2176241 - RNA, 12 nt, Human
auuccacagcug

SEQ ID NO: 2176242 - RNA, 18 nt, Human
auuccaauaugaugacuc

SEQ ID NO: 2176243 - RNA, 17 nt, Human
auuccaauaugaugacu

SEQ ID NO: 2176244 - RNA, 16 nt, Human
auuccagaauaucugg

SEQ ID NO: 2176245 - RNA, 17 nt, Human
auuccaagugauugaaa

SEQ ID NO: 2176246 - RNA, 13 nt, Human
auuaguuuugauu

SEQ ID NO: 2176247 - RNA, 21 nt, Human
auuauaacugaaggagaaggu

SEQ ID NO: 2176248 - RNA, 15 nt, Human
auuauaaauuauguu

SEQ ID NO: 2176249 - RNA, 15 nt, Human
auuauaacuuaaaau

SEQ ID NO: 2176250 - RNA, 22 nt, Human
auuauaacuuaaaaaaaugaca

SEQ ID NO: 2176251 - RNA, 15 nt, Human
auuauaacuuaaaaa

SEQ ID NO: 2176252 - RNA, 19 nt, Human
auuauaucaauuuccucau

SEQ ID NO: 2176253 - RNA, 16 nt, Human
auuauaucuaauuauu

SEQ ID NO: 2176254 - RNA, 20 nt, Human
auuauauggcuugaguuuaa

SEQ ID NO: 2176255 - RNA, 14 nt, Human
auuauucaguguca

SEQ ID NO: 2176256 - RNA, 13 nt, Human
auuauucaguguc

SEQ ID NO: 2176257 - RNA, 22 nt, Human
auucaaacuggggccuccagaa

SEQ ID NO: 2176258 - RNA, 19 nt, Human
auucaaagcaccaaaauaa

SEQ ID NO: 2176259 - RNA, 17 nt, Human
auucaaagcucuauuaa

SEQ ID NO: 2176260 - RNA, 19 nt, Human
auucaaacuggggccucca

SEQ ID NO: 2176261 - RNA, 17 nt, Human
auucaaacuggggccuc

SEQ ID NO: 2176262 - RNA, 22 nt, Human
auucaaacagucucaggaaauc

SEQ ID NO: 2176263 - RNA, 14 nt, Human
auucacccagacag

SEQ ID NO: 2176264 - RNA, 19 nt, Human
auucacccagacagcuccc

SEQ ID NO: 2176265 - RNA, 22 nt, Human
auucacccccuuuccuggacac

SEQ ID NO: 2176266 - RNA, 19 nt, Human
auucaccugccccaacucu

SEQ ID NO: 2176267 - RNA, 13 nt, Human
auucaccugagca

SEQ ID NO: 2176268 - RNA, 16 nt, Human
auucacccccuuuccu

SEQ ID NO: 2176269 - RNA, 16 nt, Human
auucacccccaaacag

SEQ ID NO: 2176270 - RNA, 23 nt, Human
auucaccuuccagugucucggag

SEQ ID NO: 2176271 - RNA, 15 nt, Human
auucacucuuccaga

SEQ ID NO: 2176272 - RNA, 12 nt, Human
auucacucccac

SEQ ID NO: 2176273 - RNA, 13 nt, Human
auucacucccaca

SEQ ID NO: 2176274 - RNA, 20 nt, Human
auucacuauuggcugggagu

SEQ ID NO: 2176275 - RNA, 14 nt, Human
auucacuauuggcu

SEQ ID NO: 2176276 - RNA, 21 nt, Human
auucacucauacaucuggccg

SEQ ID NO: 2176277 - RNA, 12 nt, Human
auuauugcauua

SEQ ID NO: 2176278 - RNA, 15 nt, Human
auuauucagugucac

SEQ ID NO: 2176279 - RNA, 13 nt, Human
auuauugcuguug

SEQ ID NO: 2176280 - RNA, 14 nt, Human
auuauuggaauuaa

SEQ ID NO: 2176281 - RNA, 18 nt, Human
auuauuggaauuaaccug

SEQ ID NO: 2176282 - RNA, 23 nt, Human
auuauuguguguuauuuaaauga

SEQ ID NO: 2176283 - RNA, 18 nt, Human
auuauuguugcauuaaaa

SEQ ID NO: 2176284 - RNA, 13 nt, Human
auuauuguauuua

SEQ ID NO: 2176285 - RNA, 16 nt, Human
auuauuguauuuauuc

SEQ ID NO: 2176286 - RNA, 19 nt, Human
auuauugugauuucccgug

SEQ ID NO: 2176287 - RNA, 11 nt, Human
auuauuuaaac

SEQ ID NO: 2176288 - RNA, 12 nt, Human
auuauuuaaaca

SEQ ID NO: 2176289 - RNA, 13 nt, Human
auuauuuuuucag

SEQ ID NO: 2176290 - RNA, 14 nt, Human
auuauuuuuucaga

SEQ ID NO: 2176291 - RNA, 15 nt, Human
auuauuuuuucagac

SEQ ID NO: 2176292 - RNA, 16 nt, Human
auuauuuuuucagacc

SEQ ID NO: 2176293 - RNA, 21 nt, Human
auuauuuuuucagaccgaaaa

SEQ ID NO: 2176294 - RNA, 19 nt, Human
auuauuuuuccacuuuguu

SEQ ID NO: 2176295 - RNA, 22 nt, Human
auuauuuuuccacuuuguucuu

SEQ ID NO: 2176296 - RNA, 12 nt, Human
auuauuuaauaa

SEQ ID NO: 2176297 - RNA, 13 nt, Human
auuauuuaauaaa

SEQ ID NO: 2176298 - RNA, 21 nt, Human
auuauuuaauaaaaaaacaau

SEQ ID NO: 2176299 - RNA, 17 nt, Human
auucaaaaaguguuuau

SEQ ID NO: 2176300 - RNA, 14 nt, Human
auucaaaaaguguu

SEQ ID NO: 2176301 - RNA, 16 nt, Human
auucaaaaaguguuua

SEQ ID NO: 2176302 - RNA, 17 nt, Human
auuauuuuuucagaccg

SEQ ID NO: 2176303 - RNA, 19 nt, Human
auuauuuuuucagaccgaa

SEQ ID NO: 2176304 - RNA, 15 nt, Human
auucagccuggcuuc

SEQ ID NO: 2176305 - RNA, 19 nt, Human
uuuuuauuuguuugugcau

SEQ ID NO: 2176306 - RNA, 12 nt, Human
uuuuuauuucug

SEQ ID NO: 2176307 - RNA, 17 nt, Human
uuuuuauauuugaaaua

SEQ ID NO: 2176308 - RNA, 16 nt, Human
uuuuucaauauuuauu

SEQ ID NO: 2176309 - RNA, 19 nt, Human
uuuuucaaagauguguugc

SEQ ID NO: 2176310 - RNA, 23 nt, Human
uuuuugaaggcagaaagcaaaau

SEQ ID NO: 2176311 - RNA, 22 nt, Human
uuuuugaaggcagaaagcaaaa

SEQ ID NO: 2176312 - RNA, 12 nt, Human
uuuuucaauuaa

SEQ ID NO: 2176313 - RNA, 11 nt, Human
uuuuugaagug

SEQ ID NO: 2176314 - RNA, 12 nt, Human
uuuuugaagugu

SEQ ID NO: 2176315 - RNA, 14 nt, Human
uuuuugaaguguag

SEQ ID NO: 2176316 - RNA, 24 nt, Human
uuuuugaaguguaggcagacacag

SEQ ID NO: 2176317 - RNA, 15 nt, Human
uuuuugaagcuguau

SEQ ID NO: 2176318 - RNA, 21 nt, Human
uuuuuggagaagguuaucaaa

SEQ ID NO: 2176319 - RNA, 22 nt, Human
uuuuuggagggguuuaugcuca

SEQ ID NO: 2176320 - RNA, 15 nt, Human
uuuuuggaggugcuu

SEQ ID NO: 2176321 - RNA, 22 nt, Human
uuuuuggaagaggacuccuuaa

SEQ ID NO: 2176322 - RNA, 18 nt, Human
uuuuugcaggagcaguau

SEQ ID NO: 2176323 - RNA, 22 nt, Human
uuuuugcaccccaugcuguuga

SEQ ID NO: 2176324 - RNA, 23 nt, Human
uuuuugcaccccaugcuguugau

SEQ ID NO: 2176325 - RNA, 20 nt, Human
uuuuugcacauguuuccucu

SEQ ID NO: 2176326 - RNA, 19 nt, Human
uuuuugcaccccaugcugu

SEQ ID NO: 2176327 - RNA, 20 nt, Human
uuuuugcaccccaugcuguu

SEQ ID NO: 2176328 - RNA, 21 nt, Human
uuuuugcauggcacuugcauc

SEQ ID NO: 2176329 - RNA, 14 nt, Human
uuuuugccuucauu

SEQ ID NO: 2176330 - RNA, 17 nt, Human
uuuuugcauuuaaaaca

SEQ ID NO: 2176331 - RNA, 14 nt, Human
uuuuugauagcuuu

SEQ ID NO: 2176332 - RNA, 21 nt, Human
uuuuugauaaaguuucucaga

SEQ ID NO: 2176333 - RNA, 18 nt, Human
uuuuugcaagugaagguu

SEQ ID NO: 2176334 - RNA, 15 nt, Human
uuuuugcaagugaag

SEQ ID NO: 2176335 - RNA, 20 nt, Human
uuuuugaggcuaugaauaua

SEQ ID NO: 2176336 - RNA, 12 nt, Human
uuuuuguauguu

SEQ ID NO: 2176337 - RNA, 11 nt, Human
uuuuuguauuu

SEQ ID NO: 2176338 - RNA, 15 nt, Human
auuaagccuuccaca

SEQ ID NO: 2176339 - RNA, 16 nt, Human
auuaagcccucuucca

SEQ ID NO: 2176340 - RNA, 17 nt, Human
auuaagcccucuuccau

SEQ ID NO: 2176341 - RNA, 13 nt, Human
auuaaggaagaca

SEQ ID NO: 2176342 - RNA, 20 nt, Human
auuaaggauuuuaugcuuua

SEQ ID NO: 2176343 - RNA, 17 nt, Human
auuaaggauuuuaugcu

SEQ ID NO: 2176344 - RNA, 15 nt, Human
auuaaggauuuuaug

SEQ ID NO: 2176345 - RNA, 19 nt, Human
auuaaguacuauguaucaa

SEQ ID NO: 2176346 - RNA, 17 nt, Human
auuaaguaucugacauc

SEQ ID NO: 2176347 - RNA, 18 nt, Human
auuaaguacuauguauca

SEQ ID NO: 2176348 - RNA, 16 nt, Human
uuuuuggggauaugcu

SEQ ID NO: 2176349 - RNA, 12 nt, Human
uuuuuggggaua

SEQ ID NO: 2176350 - RNA, 22 nt, Human
uuuuugggaaaagaaaagucaa

SEQ ID NO: 2176351 - RNA, 20 nt, Human
uuuuuggcuuuagacacugg

SEQ ID NO: 2176352 - RNA, 20 nt, Human
uuuuuggaggugcuuaagca

SEQ ID NO: 2176353 - RNA, 14 nt, Human
uuuuuguaaagugu

SEQ ID NO: 2176354 - RNA, 16 nt, Human
uuuuuguagccuuccu

SEQ ID NO: 2176355 - RNA, 18 nt, Human
uuuuugguugucaauauu

SEQ ID NO: 2176356 - RNA, 10 nt, Human
uuuuuguaaa

SEQ ID NO: 2176357 - RNA, 16 nt, Human
uuuuuguaaagugugg

SEQ ID NO: 2176358 - RNA, 14 nt, Human
uuuuguuccccucc

SEQ ID NO: 2176359 - RNA, 16 nt, Human
uuuuguuaccuuuaug

SEQ ID NO: 2176360 - RNA, 15 nt, Human
uuuuguuccccuccu

SEQ ID NO: 2176361 - RNA, 19 nt, Human
uuuuguuccccuccuccac

SEQ ID NO: 2176362 - RNA, 19 nt, Human
uuuuguucuuaauugcacu

SEQ ID NO: 2176363 - RNA, 23 nt, Human
uuuuguucgcauggucacacacu

SEQ ID NO: 2176364 - RNA, 16 nt, Human
uuuuguuuuugucuua

SEQ ID NO: 2176365 - RNA, 16 nt, Human
uuuuguuuuaaaauua

SEQ ID NO: 2176366 - RNA, 15 nt, Human
uuuuguuuuggcuga

SEQ ID NO: 2176367 - RNA, 15 nt, Human
uuuuguuuucauuau

SEQ ID NO: 2176368 - RNA, 12 nt, Human
uuuuuaauuuug

SEQ ID NO: 2176369 - RNA, 18 nt, Human
uuuuuaauuuuguauuuu

SEQ ID NO: 2176370 - RNA, 18 nt, Human
uuuuuacaaguuuuaaau

SEQ ID NO: 2176371 - RNA, 16 nt, Human
uuuuuaauuuauuuau

SEQ ID NO: 2176372 - RNA, 21 nt, Human
uuuuuaauuuauuauugaaau

SEQ ID NO: 2176373 - RNA, 23 nt, Human
uuuuuaauuuacaaaaauauaaa

SEQ ID NO: 2176374 - RNA, 18 nt, Human
uuuuuaauuguuguuucu

SEQ ID NO: 2176375 - RNA, 20 nt, Human
uuuuuaauuguuguuucuuu

SEQ ID NO: 2176376 - RNA, 17 nt, Human
uuuuguuuuucauucag

SEQ ID NO: 2176377 - RNA, 12 nt, Human
uuuuuaauuauu

SEQ ID NO: 2176378 - RNA, 19 nt, Human
uuuuuaauucaccaaagua

SEQ ID NO: 2176379 - RNA, 21 nt, Human
uuuuuaaugugcuguguaaag

SEQ ID NO: 2176380 - RNA, 14 nt, Human
uuuuuauauauaca

SEQ ID NO: 2176381 - RNA, 19 nt, Human
uuuuuacaaguuuuaaaua

SEQ ID NO: 2176382 - RNA, 13 nt, Human
uuuuuacaauaaa

SEQ ID NO: 2176383 - RNA, 15 nt, Human
uuuuuauauuuaguu

SEQ ID NO: 2176384 - RNA, 21 nt, Human
uuuugugaaguuuaauugacu

SEQ ID NO: 2176385 - RNA, 14 nt, Human
uuuugugaacuuuu

SEQ ID NO: 2176386 - RNA, 19 nt, Human
uuuugugaauggauuggau

SEQ ID NO: 2176387 - RNA, 14 nt, Human
uuuugugaagacug

SEQ ID NO: 2176388 - RNA, 23 nt, Human
uuuugugaauggauuggauuauu

SEQ ID NO: 2176389 - RNA, 23 nt, Human
uuuugugacuauauagagauguu

SEQ ID NO: 2176390 - RNA, 24 nt, Human
uuuugugaaaugaaaacauguaau

SEQ ID NO: 2176391 - RNA, 22 nt, Human
uuuugugaaaugaaaacaugua

SEQ ID NO: 2176392 - RNA, 20 nt, Human
uuuuggagaagguuaucaaa

SEQ ID NO: 2176393 - RNA, 13 nt, Human
uuuuggaggugcu

SEQ ID NO: 2176394 - RNA, 15 nt, Human
uuuuggaggugcuua

SEQ ID NO: 2176395 - RNA, 14 nt, Human
uuuugugaagcaaa

SEQ ID NO: 2176396 - RNA, 13 nt, Human
uuuuguguacagu

SEQ ID NO: 2176397 - RNA, 21 nt, Human
uuuuguggucauuaagcauug

SEQ ID NO: 2176398 - RNA, 13 nt, Human
uuuugugagaugu

SEQ ID NO: 2176399 - RNA, 23 nt, Human
uuuugugcauuaucuagauacug

SEQ ID NO: 2176400 - RNA, 18 nt, Human
auuaaacagauuuuuaca

SEQ ID NO: 2176401 - RNA, 20 nt, Human
auuaaaaugauuguaaaaua

SEQ ID NO: 2176402 - RNA, 13 nt, Human
auuaaaaugaaua

SEQ ID NO: 2176403 - RNA, 15 nt, Human
auuaaaaucuuaaac

SEQ ID NO: 2176404 - RNA, 18 nt, Human
auuaaaaugauuguaaaa

SEQ ID NO: 2176405 - RNA, 19 nt, Human
auuaaaaugauuguaaaau

SEQ ID NO: 2176406 - RNA, 13 nt, Human
auuaaaaucuuaa

SEQ ID NO: 2176407 - RNA, 12 nt, Human
auuaaaaucuua

SEQ ID NO: 2176408 - RNA, 11 nt, Human
auuaaaaucuu

SEQ ID NO: 2176409 - RNA, 22 nt, Human
auuaaaauauggcuauaaauau

SEQ ID NO: 2176410 - RNA, 16 nt, Human
auuaaaauccucaauc

SEQ ID NO: 2176411 - RNA, 14 nt, Human
auuaaaauccucaa

SEQ ID NO: 2176412 - RNA, 18 nt, Human
uuuugcuguuuccuuuua

SEQ ID NO: 2176413 - RNA, 21 nt, Human
uuuugcuguuguuucuaaaca

SEQ ID NO: 2176414 - RNA, 17 nt, Human
uuuugcuuuuucugacu

SEQ ID NO: 2176415 - RNA, 21 nt, Human
uuuugcuuuuggcaaaacucu

SEQ ID NO: 2176416 - RNA, 21 nt, Human
uuuugcuuucgaacugcuagu

SEQ ID NO: 2176417 - RNA, 20 nt, Human
uuuugcuuuuucugacucca

SEQ ID NO: 2176418 - RNA, 13 nt, Human
auuagagaagaga

SEQ ID NO: 2176419 - RNA, 22 nt, Human
auuagacuguaggaagaguagc

SEQ ID NO: 2176420 - RNA, 13 nt, Human
auuagacuccucc

SEQ ID NO: 2176421 - RNA, 16 nt, Human
auuagacuccuccucc

SEQ ID NO: 2176422 - RNA, 15 nt, Human
auuagacuccuccuc

SEQ ID NO: 2176423 - RNA, 14 nt, Human
auuacuucugcuac

SEQ ID NO: 2176424 - RNA, 12 nt, Human
auuacuucugcu

SEQ ID NO: 2176425 - RNA, 13 nt, Human
auuacuucugcua

SEQ ID NO: 2176426 - RNA, 18 nt, Human
auuacugucugguuuuaa

SEQ ID NO: 2176427 - RNA, 14 nt, Human
auuaaucaucuaua

SEQ ID NO: 2176428 - RNA, 19 nt, Human
auuaaucaucuauaaagaa

SEQ ID NO: 2176429 - RNA, 15 nt, Human
auuaaucaugaaugu

SEQ ID NO: 2176430 - RNA, 20 nt, Human
auuacuguuugucuucuccc

SEQ ID NO: 2176431 - RNA, 13 nt, Human
auuacuguuuguc

SEQ ID NO: 2176432 - RNA, 15 nt, Human
auuacugguccaaaa

SEQ ID NO: 2176433 - RNA, 15 nt, Human
auuacuguaagaaaa

SEQ ID NO: 2176434 - RNA, 16 nt, Human
auuacuguaagaaaau

SEQ ID NO: 2176435 - RNA, 14 nt, Human
auuaauauuuuaau

SEQ ID NO: 2176436 - RNA, 19 nt, Human
auuaauauucauuguauaa

SEQ ID NO: 2176437 - RNA, 17 nt, Human
auuaauauucauuguau

SEQ ID NO: 2176438 - RNA, 20 nt, Human
auuaagcccucuuccaucau

SEQ ID NO: 2176439 - RNA, 17 nt, Human
auuaauauuccucaguu

SEQ ID NO: 2176440 - RNA, 16 nt, Human
auuaauauucauugua

SEQ ID NO: 2176441 - RNA, 24 nt, Human
auuaagucugugagauucauucau

SEQ ID NO: 2176442 - RNA, 13 nt, Human
auuaaguuaucuu

SEQ ID NO: 2176443 - RNA, 16 nt, Human
auuaaucacuauuguu

SEQ ID NO: 2176444 - RNA, 13 nt, Human
auuaaucacuauu

SEQ ID NO: 2176445 - RNA, 23 nt, Human
auuaaucaaucaucugugugaaa

SEQ ID NO: 2176446 - RNA, 21 nt, Human
uugugucaaugggcaaugaca

SEQ ID NO: 2176447 - RNA, 23 nt, Human
uuguguauuuacgcuuugauuca

SEQ ID NO: 2176448 - RNA, 22 nt, Human
uuguguauuuacgcuuugauuc

SEQ ID NO: 2176449 - RNA, 20 nt, Human
uuguguauuuacgcuuugau

SEQ ID NO: 2176450 - RNA, 19 nt, Human
uugugucauguuuaagaaa

SEQ ID NO: 2176451 - RNA, 21 nt, Human
uuguguaucguaaccagccag

SEQ ID NO: 2176452 - RNA, 18 nt, Human
uugugucccaugaucccu

SEQ ID NO: 2176453 - RNA, 21 nt, Human
uuguguauuuaacagggaggg

SEQ ID NO: 2176454 - RNA, 19 nt, Human
uuguguauuuacgcuuuga

SEQ ID NO: 2176455 - RNA, 13 nt, Human
uuguguauuuaac

SEQ ID NO: 2176456 - RNA, 14 nt, Human
uuguguauuuaaca

SEQ ID NO: 2176457 - RNA, 20 nt, Human
uuguguauccauuaucaugu

SEQ ID NO: 2176458 - RNA, 21 nt, Human
uuguguauccauuaucaugug

SEQ ID NO: 2176459 - RNA, 22 nt, Human
uuguguauccauuaucaugugu

SEQ ID NO: 2176460 - RNA, 23 nt, Human
uuguguauccauuaucaugugua

SEQ ID NO: 2176461 - RNA, 20 nt, Human
uuguguaucguaaccagcca

SEQ ID NO: 2176462 - RNA, 13 nt, Human
uugugucugcagg

SEQ ID NO: 2176463 - RNA, 13 nt, Human
uugugucuguaca

SEQ ID NO: 2176464 - RNA, 14 nt, Human
uugugucuguacac

SEQ ID NO: 2176465 - RNA, 15 nt, Human
uugugucuguacacg

SEQ ID NO: 2176466 - RNA, 20 nt, Human
uuguucaauaauaaauauuu

SEQ ID NO: 2176467 - RNA, 15 nt, Human
uuguucaauuagaau

SEQ ID NO: 2176468 - RNA, 13 nt, Human
uuguucaauuaga

SEQ ID NO: 2176469 - RNA, 17 nt, Human
uugugucugcaggauug

SEQ ID NO: 2176470 - RNA, 15 nt, Human
uugugucuuuugcau

SEQ ID NO: 2176471 - RNA, 22 nt, Human
uuguucaauaauaaauauuuuu

SEQ ID NO: 2176472 - RNA, 13 nt, Human
uuguucacacucu

SEQ ID NO: 2176473 - RNA, 15 nt, Human
uuguguacagugugu

SEQ ID NO: 2176474 - RNA, 19 nt, Human
uuguguaauagaaaacuga

SEQ ID NO: 2176475 - RNA, 21 nt, Human
uuguguaauagaaaacugaaa

SEQ ID NO: 2176476 - RNA, 15 nt, Human
uuguguacaguuauu

SEQ ID NO: 2176477 - RNA, 14 nt, Human
uugugauucugccu

SEQ ID NO: 2176478 - RNA, 23 nt, Human
uugugauuucccguggccccagc

SEQ ID NO: 2176479 - RNA, 23 nt, Human
uugugauucaaucuguaaacugu

SEQ ID NO: 2176480 - RNA, 19 nt, Human
uugugauucaaucuguaaa

SEQ ID NO: 2176481 - RNA, 17 nt, Human
uugugauuauuucacuu

SEQ ID NO: 2176482 - RNA, 18 nt, Human
uugugauuauuucacuuu

SEQ ID NO: 2176483 - RNA, 22 nt, Human
uugugauuauuucacuuuagau

SEQ ID NO: 2176484 - RNA, 23 nt, Human
uugugauuauuucacuuuagaug

SEQ ID NO: 2176485 - RNA, 23 nt, Human
uugugaucagaccauaauguuac

SEQ ID NO: 2176486 - RNA, 17 nt, Human
uugugauauggagcccu

SEQ ID NO: 2176487 - RNA, 19 nt, Human
uugugauagcacuuucuac

SEQ ID NO: 2176488 - RNA, 16 nt, Human
uugugauagcacuuuc

SEQ ID NO: 2176489 - RNA, 20 nt, Human
uugugauagcuaacauuuua

SEQ ID NO: 2176490 - RNA, 21 nt, Human
uugugauagcacuuucuacaa

SEQ ID NO: 2176491 - RNA, 16 nt, Human
uugugauauggagccc

SEQ ID NO: 2176492 - RNA, 18 nt, Human
uugugaugucccaacuug

SEQ ID NO: 2176493 - RNA, 22 nt, Human
uugugaugucccaacuuguaaa

SEQ ID NO: 2176494 - RNA, 12 nt, Human
uugugauguguc

SEQ ID NO: 2176495 - RNA, 18 nt, Human
uugugaugugaguugcac

SEQ ID NO: 2176496 - RNA, 16 nt, Human
uugugaccugaaguuc

SEQ ID NO: 2176497 - RNA, 16 nt, Human
uugugaccaaguuaua

SEQ ID NO: 2176498 - RNA, 16 nt, Human
uugugaggaaagucau

SEQ ID NO: 2176499 - RNA, 17 nt, Human
uugugaggaaagucauu

SEQ ID NO: 2176500 - RNA, 13 nt, Human
uugugaggaagcc

SEQ ID NO: 2176501 - RNA, 19 nt, Human
uugugacagauuauacaga

SEQ ID NO: 2176502 - RNA, 15 nt, Human
uugugaauggauugg

SEQ ID NO: 2176503 - RNA, 13 nt, Human
uugugaauggauu

SEQ ID NO: 2176504 - RNA, 14 nt, Human
uugugaauggauug

SEQ ID NO: 2176505 - RNA, 21 nt, Human
uugugaauggauuggauuauu

SEQ ID NO: 2176506 - RNA, 20 nt, Human
uugugauacaaugcugugcc

SEQ ID NO: 2176507 - RNA, 15 nt, Human
uugugauagcacuuu

SEQ ID NO: 2176508 - RNA, 22 nt, Human
uugugaggaaagucauuggcuu

SEQ ID NO: 2176509 - RNA, 17 nt, Human
uugugaggaagccgcug

SEQ ID NO: 2176510 - RNA, 18 nt, Human
uugugaggaagccgcugg

SEQ ID NO: 2176511 - RNA, 11 nt, Human
uuguccccagu

SEQ ID NO: 2176512 - RNA, 15 nt, Human
uuguccccacacucc

SEQ ID NO: 2176513 - RNA, 17 nt, Human
uuguccccacacuccua

SEQ ID NO: 2176514 - RNA, 15 nt, Human
uuguccccgacccuu

SEQ ID NO: 2176515 - RNA, 16 nt, Human
uuguccccgacccuug

SEQ ID NO: 2176516 - RNA, 20 nt, Human
uugucccacucaagccaagc

SEQ ID NO: 2176517 - RNA, 13 nt, Human
uuguccagcgccu

SEQ ID NO: 2176518 - RNA, 23 nt, Human
uugucccauuucuaaaggccucu

SEQ ID NO: 2176519 - RNA, 21 nt, Human
uugucccagaggcugccccac

SEQ ID NO: 2176520 - RNA, 23 nt, Human
uuguccccaaauccgaaccuccu

SEQ ID NO: 2176521 - RNA, 11 nt, Human
uuguccccaca

SEQ ID NO: 2176522 - RNA, 12 nt, Human
uuguccccacac

SEQ ID NO: 2176523 - RNA, 19 nt, Human
uugucccacuaucugggug

SEQ ID NO: 2176524 - RNA, 19 nt, Human
uuguccagcugagcgccag

SEQ ID NO: 2176525 - RNA, 13 nt, Human
uuguccauugucc

SEQ ID NO: 2176526 - RNA, 18 nt, Human
uuguccccaccgcagaca

SEQ ID NO: 2176527 - RNA, 20 nt, Human
uuguccccaccgcagacagg

SEQ ID NO: 2176528 - RNA, 16 nt, Human
augagucccaguggga

SEQ ID NO: 2176529 - RNA, 18 nt, Human
augaguuggcugggaaua

SEQ ID NO: 2176530 - RNA, 23 nt, Human
augaguccccuguuuguuucuga

SEQ ID NO: 2176531 - RNA, 15 nt, Human
augagucccaguggg

SEQ ID NO: 2176532 - RNA, 19 nt, Human
augagucaaugugcagugu

SEQ ID NO: 2176533 - RNA, 16 nt, Human
augagucaaugugcag

SEQ ID NO: 2176534 - RNA, 17 nt, Human
augagucaaugugcagu

SEQ ID NO: 2176535 - RNA, 13 nt, Human
augaguccccugu

SEQ ID NO: 2176536 - RNA, 23 nt, Human
augaguuguuuucagacucagac

SEQ ID NO: 2176537 - RNA, 22 nt, Human
augaguuguuuucagacucaga

SEQ ID NO: 2176538 - RNA, 20 nt, Human
augaguuguuuucagacuca

SEQ ID NO: 2176539 - RNA, 19 nt, Human
augaguuguuuucagacuc

SEQ ID NO: 2176540 - RNA, 15 nt, Human
augaguuucauagcu

SEQ ID NO: 2176541 - RNA, 20 nt, Human
augaguuucauagcuaagaa

SEQ ID NO: 2176542 - RNA, 22 nt, Human
augaguuugcccugguuucacu

SEQ ID NO: 2176543 - RNA, 15 nt, Human
augaguuugcccugg

SEQ ID NO: 2176544 - RNA, 14 nt, Human
augaguuugcuuau

SEQ ID NO: 2176545 - RNA, 20 nt, Human
uugucaauaaaauccauaca

SEQ ID NO: 2176546 - RNA, 17 nt, Human
uugucacacacuuuggc

SEQ ID NO: 2176547 - RNA, 20 nt, Human
uugucaagucucugcuggcc

SEQ ID NO: 2176548 - RNA, 14 nt, Human
uugucaauauuaaa

SEQ ID NO: 2176549 - RNA, 18 nt, Human
uugucaauauuaaauaca

SEQ ID NO: 2176550 - RNA, 19 nt, Human
uugucaauauuaaauacag

SEQ ID NO: 2176551 - RNA, 19 nt, Human
uugucaauauuuaaacaug

SEQ ID NO: 2176552 - RNA, 23 nt, Human
uugucacaauccuaacacauuau

SEQ ID NO: 2176553 - RNA, 20 nt, Human
uugucagacuuuaaagaaua

SEQ ID NO: 2176554 - RNA, 18 nt, Human
uugucagacuuuaaagaa

SEQ ID NO: 2176555 - RNA, 14 nt, Human
uugucagacuuuaa

SEQ ID NO: 2176556 - RNA, 12 nt, Human
uugucagacuuu

SEQ ID NO: 2176557 - RNA, 12 nt, Human
uugucagcuacu

SEQ ID NO: 2176558 - RNA, 18 nt, Human
uugucagauaugauaugu

SEQ ID NO: 2176559 - RNA, 15 nt, Human
uugucagagcuggga

SEQ ID NO: 2176560 - RNA, 13 nt, Human
uugucagagcugg

SEQ ID NO: 2176561 - RNA, 15 nt, Human
uugucaguaucugua

SEQ ID NO: 2176562 - RNA, 15 nt, Human
uugucagugacagua

SEQ ID NO: 2176563 - RNA, 21 nt, Human
uugucauauaagauucauauu

SEQ ID NO: 2176564 - RNA, 21 nt, Human
uuguccaacccgaggcccgca

SEQ ID NO: 2176565 - RNA, 19 nt, Human
uuguccaauuguugacagu

SEQ ID NO: 2176566 - RNA, 22 nt, Human
uuguccaauuguugacaguucu

SEQ ID NO: 2176567 - RNA, 14 nt, Human
uuguccacccaccu

SEQ ID NO: 2176568 - RNA, 22 nt, Human
uuguagccuuccuccacauccu

SEQ ID NO: 2176569 - RNA, 16 nt, Human
uuguagccuuccucca

SEQ ID NO: 2176570 - RNA, 14 nt, Human
uuguacaaaauaaa

SEQ ID NO: 2176571 - RNA, 16 nt, Human
uuguagcauuucuuga

SEQ ID NO: 2176572 - RNA, 12 nt, Human
uuguacaaaaua

SEQ ID NO: 2176573 - RNA, 16 nt, Human
uuguacaaaaaaaaag

SEQ ID NO: 2176574 - RNA, 22 nt, Human
uuguacaaaaaaaaaguuuuau

SEQ ID NO: 2176575 - RNA, 23 nt, Human
uuguaauuuuuuuaauuuacaaa

SEQ ID NO: 2176576 - RNA, 15 nt, Human
augagguacugagag

SEQ ID NO: 2176577 - RNA, 18 nt, Human
augagguacugagaguga

SEQ ID NO: 2176578 - RNA, 17 nt, Human
augagguacugagagug

SEQ ID NO: 2176579 - RNA, 22 nt, Human
augaggucagagccugcaguua

SEQ ID NO: 2176580 - RNA, 22 nt, Human
augagguucaacuguugauugc

SEQ ID NO: 2176581 - RNA, 18 nt, Human
augagguugcuuacuaag

SEQ ID NO: 2176582 - RNA, 15 nt, Human
augaguaaaggagua

SEQ ID NO: 2176583 - RNA, 19 nt, Human
augaggucagagccugcag

SEQ ID NO: 2176584 - RNA, 20 nt, Human
augaggucagagccugcagu

SEQ ID NO: 2176585 - RNA, 15 nt, Human
augaggucagagccu

SEQ ID NO: 2176586 - RNA, 21 nt, Human
augagguacaaccuguucugc

SEQ ID NO: 2176587 - RNA, 16 nt, Human
augaggucagagccug

SEQ ID NO: 2176588 - RNA, 18 nt, Human
augaggucagagccugca

SEQ ID NO: 2176589 - RNA, 19 nt, Human
augcaaaaauuagccgggc

SEQ ID NO: 2176590 - RNA, 23 nt, Human
augcaaaagguucacuaaagcag

SEQ ID NO: 2176591 - RNA, 12 nt, Human
augcaaaaagaa

SEQ ID NO: 2176592 - RNA, 15 nt, Human
augcaaagaggcaag

SEQ ID NO: 2176593 - RNA, 14 nt, Human
augcaaagaggcaa

SEQ ID NO: 2176594 - RNA, 20 nt, Human
augcaaaaguucugacuuga

SEQ ID NO: 2176595 - RNA, 21 nt, Human
augcaaaaguucugacuugac

SEQ ID NO: 2176596 - RNA, 21 nt, Human
augcaaaauaauaccugucca

SEQ ID NO: 2176597 - RNA, 21 nt, Human
augauuuuuuuuucauacacu

SEQ ID NO: 2176598 - RNA, 17 nt, Human
augauuuuuuuuucaua

SEQ ID NO: 2176599 - RNA, 22 nt, Human
augauuuuuagaugagauuguu

SEQ ID NO: 2176600 - RNA, 15 nt, Human
augauuuuugucauc

SEQ ID NO: 2176601 - RNA, 20 nt, Human
augauuuccaaagagaaaaa

SEQ ID NO: 2176602 - RNA, 13 nt, Human
augauuuccuuga

SEQ ID NO: 2176603 - RNA, 16 nt, Human
augauuuccuugaaug

SEQ ID NO: 2176604 - RNA, 15 nt, Human
augauuuccuugaau

SEQ ID NO: 2176605 - RNA, 20 nt, Human
augauuuccuugaauguggc

SEQ ID NO: 2176606 - RNA, 19 nt, Human
augauuuccuugaaugugg

SEQ ID NO: 2176607 - RNA, 18 nt, Human
augauuuccuugaaugug

SEQ ID NO: 2176608 - RNA, 17 nt, Human
augauuuccuugaaugu

SEQ ID NO: 2176609 - RNA, 20 nt, Human
augauuuauaguuuguacau

SEQ ID NO: 2176610 - RNA, 14 nt, Human
augauuuauaguuu

SEQ ID NO: 2176611 - RNA, 15 nt, Human
augauuuauaguuug

SEQ ID NO: 2176612 - RNA, 14 nt, Human
augauuucauuuca

SEQ ID NO: 2176613 - RNA, 13 nt, Human
augauuucauuca

SEQ ID NO: 2176614 - RNA, 22 nt, Human
augauuuaauaaaauaauucua

SEQ ID NO: 2176615 - RNA, 13 nt, Human
augauuuauaguu

SEQ ID NO: 2176616 - RNA, 18 nt, Human
augauuuaauaaaauaau

SEQ ID NO: 2176617 - RNA, 19 nt, Human
augauuuaauaaaauaauu

SEQ ID NO: 2176618 - RNA, 16 nt, Human
augauuuaaaagggaa

SEQ ID NO: 2176619 - RNA, 13 nt, Human
augauuuaauaaa

SEQ ID NO: 2176620 - RNA, 14 nt, Human
augauuuaauaaaa

SEQ ID NO: 2176621 - RNA, 16 nt, Human
augauuuaauaaaaua

SEQ ID NO: 2176622 - RNA, 22 nt, Human
augauugugcacauacuugaga

SEQ ID NO: 2176623 - RNA, 15 nt, Human
augauuguaaaauag

SEQ ID NO: 2176624 - RNA, 18 nt, Human
augauuguaaaauagcuu

SEQ ID NO: 2176625 - RNA, 13 nt, Human
augauuuaaaaca

SEQ ID NO: 2176626 - RNA, 14 nt, Human
augauuuaaaacau

SEQ ID NO: 2176627 - RNA, 18 nt, Human
augauuuaaaacauguaa

SEQ ID NO: 2176628 - RNA, 14 nt, Human
uuguucuucuuaaa

SEQ ID NO: 2176629 - RNA, 17 nt, Human
uuguucuuaauugcacu

SEQ ID NO: 2176630 - RNA, 19 nt, Human
uuguucuugguuuguaaau

SEQ ID NO: 2176631 - RNA, 17 nt, Human
uuguucuugguuuguaa

SEQ ID NO: 2176632 - RNA, 14 nt, Human
augcacucagcucu

SEQ ID NO: 2176633 - RNA, 13 nt, Human
augcacugugaag

SEQ ID NO: 2176634 - RNA, 12 nt, Human
augcacugugaa

SEQ ID NO: 2176635 - RNA, 22 nt, Human
augcacgugugcacacacacca

SEQ ID NO: 2176636 - RNA, 14 nt, Human
augcacgaccuugg

SEQ ID NO: 2176637 - RNA, 16 nt, Human
augcacgaccuuggga

SEQ ID NO: 2176638 - RNA, 13 nt, Human
augcacuaugagg

SEQ ID NO: 2176639 - RNA, 16 nt, Human
augcacuaugaggaau

SEQ ID NO: 2176640 - RNA, 21 nt, Human
augcacuuuguucuggcucuu

SEQ ID NO: 2176641 - RNA, 19 nt, Human
augcacugugaaggacccu

SEQ ID NO: 2176642 - RNA, 18 nt, Human
augcacugugaaggaccc

SEQ ID NO: 2176643 - RNA, 20 nt, Human
augcacugugaaggacccuu

SEQ ID NO: 2176644 - RNA, 21 nt, Human
augcacuguucccccugugca

SEQ ID NO: 2176645 - RNA, 16 nt, Human
augcaaagaggcaaga

SEQ ID NO: 2176646 - RNA, 21 nt, Human
augcaccuugugucuguacac

SEQ ID NO: 2176647 - RNA, 14 nt, Human
augcaaagcacuga

SEQ ID NO: 2176648 - RNA, 13 nt, Human
augcaaagcacug

SEQ ID NO: 2176649 - RNA, 12 nt, Human
augcaaagcacu

SEQ ID NO: 2176650 - RNA, 18 nt, Human
augcagagguccacaaca

SEQ ID NO: 2176651 - RNA, 17 nt, Human
augcagagguccacaac

SEQ ID NO: 2176652 - RNA, 16 nt, Human
augcagagagccauuu

SEQ ID NO: 2176653 - RNA, 19 nt, Human
augcagagagccauuuugu

SEQ ID NO: 2176654 - RNA, 20 nt, Human
augcagagagccauuuugug

SEQ ID NO: 2176655 - RNA, 21 nt, Human
augcagagagccauuuuguga

SEQ ID NO: 2176656 - RNA, 22 nt, Human
augcagagagccauuuugugaa

SEQ ID NO: 2176657 - RNA, 23 nt, Human
augcagagagccauuuugugaau

SEQ ID NO: 2176658 - RNA, 21 nt, Human
augcagagcgccgugaguucu

SEQ ID NO: 2176659 - RNA, 23 nt, Human
augcagagcgccgugaguucuca

SEQ ID NO: 2176660 - RNA, 18 nt, Human
uuuaaaaaaauuccaagu

SEQ ID NO: 2176661 - RNA, 20 nt, Human
augcagaauguuuuuaaaau

SEQ ID NO: 2176662 - RNA, 22 nt, Human
augcagacaugagugcgugcuc

SEQ ID NO: 2176663 - RNA, 13 nt, Human
augcagagagcca

SEQ ID NO: 2176664 - RNA, 14 nt, Human
augcagagagccau

SEQ ID NO: 2176665 - RNA, 13 nt, Human
augcagaaggaag

SEQ ID NO: 2176666 - RNA, 14 nt, Human
augcagaauacuuu

SEQ ID NO: 2176667 - RNA, 23 nt, Human
augcacuuuguucuggcucuucc

SEQ ID NO: 2176668 - RNA, 22 nt, Human
augcacuguucccccugugcag

SEQ ID NO: 2176669 - RNA, 17 nt, Human
uuuaagacguguuugug

SEQ ID NO: 2176670 - RNA, 19 nt, Human
uuuaagacguguuuguguu

SEQ ID NO: 2176671 - RNA, 14 nt, Human
uuuaagacuguaau

SEQ ID NO: 2176672 - RNA, 12 nt, Human
uuuaagagaaau

SEQ ID NO: 2176673 - RNA, 11 nt, Human
uuuaagcuguu

SEQ ID NO: 2176674 - RNA, 14 nt, Human
uuuaagaggcaggg

SEQ ID NO: 2176675 - RNA, 14 nt, Human
uuuaagagacagcc

SEQ ID NO: 2176676 - RNA, 12 nt, Human
uuuaagcuguuu

SEQ ID NO: 2176677 - RNA, 13 nt, Human
uuuaagcuguuuc

SEQ ID NO: 2176678 - RNA, 22 nt, Human
uuuaagcuuauuuaauuaaaaa

SEQ ID NO: 2176679 - RNA, 18 nt, Human
uuuaagcuguuuccauag

SEQ ID NO: 2176680 - RNA, 21 nt, Human
uuuaagcuguuacugucuuca

SEQ ID NO: 2176681 - RNA, 12 nt, Human
uuuaaggaauau

SEQ ID NO: 2176682 - RNA, 14 nt, Human
uuuaagcuguaaaa

SEQ ID NO: 2176683 - RNA, 11 nt, Human
uuuaaggaaaa

SEQ ID NO: 2176684 - RNA, 12 nt, Human
uuuaaggaaaca

SEQ ID NO: 2176685 - RNA, 19 nt, Human
uuuaaggaugcuuguacau

SEQ ID NO: 2176686 - RNA, 17 nt, Human
uuuaaggguuuguggaa

SEQ ID NO: 2176687 - RNA, 20 nt, Human
uuuaaggguuuguggaaaau

SEQ ID NO: 2176688 - RNA, 16 nt, Human
uuuaaugaaagacugu

SEQ ID NO: 2176689 - RNA, 22 nt, Human
uuuaaggguuuguggaaaauga

SEQ ID NO: 2176690 - RNA, 18 nt, Human
uuuaaggcuaaaacuuaa

SEQ ID NO: 2176691 - RNA, 22 nt, Human
uuuaaggaugcuuguacauaau

SEQ ID NO: 2176692 - RNA, 21 nt, Human
uuuaaggaugcuuguacauaa

SEQ ID NO: 2176693 - RNA, 20 nt, Human
uuuaaggaugcuuguacaua

SEQ ID NO: 2176694 - RNA, 21 nt, Human
uuuaaauauaugcuaagucuu

SEQ ID NO: 2176695 - RNA, 16 nt, Human
uuuaaauguaaaacau

SEQ ID NO: 2176696 - RNA, 14 nt, Human
uuuaaauggacaga

SEQ ID NO: 2176697 - RNA, 18 nt, Human
uuuaaauguaaagauauu

SEQ ID NO: 2176698 - RNA, 15 nt, Human
uuuaaauguaaagau

SEQ ID NO: 2176699 - RNA, 11 nt, Human
uuuaaaugcac

SEQ ID NO: 2176700 - RNA, 18 nt, Human
uuuaaaugcauaaaugca

SEQ ID NO: 2176701 - RNA, 14 nt, Human
uuuaaaugaagaaa

SEQ ID NO: 2176702 - RNA, 14 nt, Human
uuuaaaucugugau

SEQ ID NO: 2176703 - RNA, 23 nt, Human
uuuaaaaauacagauagauauau

SEQ ID NO: 2176704 - RNA, 15 nt, Human
uuuaaaaagucuuca

SEQ ID NO: 2176705 - RNA, 21 nt, Human
uuuaaaaacuauuuaacuuga

SEQ ID NO: 2176706 - RNA, 15 nt, Human
uuuaaaaaccuugua

SEQ ID NO: 2176707 - RNA, 14 nt, Human
uuuaaaaacuauuu

SEQ ID NO: 2176708 - RNA, 23 nt, Human
uuuaaaaacuauuuaacuugagc

SEQ ID NO: 2176709 - RNA, 21 nt, Human
uuuaaaaagaaacaagaugcu

SEQ ID NO: 2176710 - RNA, 21 nt, Human
uuuaaaaaaauaaaacauuuu

SEQ ID NO: 2176711 - RNA, 16 nt, Human
uuuaaaaaaauuuaag

SEQ ID NO: 2176712 - RNA, 17 nt, Human
uuuaaaaaaauuuaagu

SEQ ID NO: 2176713 - RNA, 18 nt, Human
uuuaaaaaaauuuaagug

SEQ ID NO: 2176714 - RNA, 17 nt, Human
augcagagucagcagaa

SEQ ID NO: 2176715 - RNA, 16 nt, Human
augcagagucagcaga

SEQ ID NO: 2176716 - RNA, 15 nt, Human
augcagagucagcag

SEQ ID NO: 2176717 - RNA, 23 nt, Human
augcagagguaaaagugugagca

SEQ ID NO: 2176718 - RNA, 16 nt, Human
augcagaguugacaug

SEQ ID NO: 2176719 - RNA, 19 nt, Human
augcagaguugacaugaga

SEQ ID NO: 2176720 - RNA, 21 nt, Human
uuuaaaaaauuaaucugggcc

SEQ ID NO: 2176721 - RNA, 14 nt, Human
augcucagaccagc

SEQ ID NO: 2176722 - RNA, 12 nt, Human
augcucagacca

SEQ ID NO: 2176723 - RNA, 15 nt, Human
augcucacagucuca

SEQ ID NO: 2176724 - RNA, 20 nt, Human
augcucaaguuuuucagaaa

SEQ ID NO: 2176725 - RNA, 15 nt, Human
augcucaaguuuuuc

SEQ ID NO: 2176726 - RNA, 16 nt, Human
augcucaaguuuuuca

SEQ ID NO: 2176727 - RNA, 21 nt, Human
uuuaucagugacagaguucac

SEQ ID NO: 2176728 - RNA, 14 nt, Human
augcucaaguuuuu

SEQ ID NO: 2176729 - RNA, 18 nt, Human
uuuaucagugacagaguu

SEQ ID NO: 2176730 - RNA, 13 nt, Human
uuuaucagugaca

SEQ ID NO: 2176731 - RNA, 14 nt, Human
uuuaucagaauucu

SEQ ID NO: 2176732 - RNA, 22 nt, Human
uuuaucacauguauguuuuggu

SEQ ID NO: 2176733 - RNA, 17 nt, Human
augcucagaccagcucu

SEQ ID NO: 2176734 - RNA, 13 nt, Human
augcucagcccug

SEQ ID NO: 2176735 - RNA, 18 nt, Human
augcucagcccugacugg

SEQ ID NO: 2176736 - RNA, 21 nt, Human
augcucauaacggaucagaaa

SEQ ID NO: 2176737 - RNA, 13 nt, Human
augcucaucugcu

SEQ ID NO: 2176738 - RNA, 16 nt, Human
augcucauaacggauc

SEQ ID NO: 2176739 - RNA, 22 nt, Human
augcucccuccccugcccuggu

SEQ ID NO: 2176740 - RNA, 20 nt, Human
augcucccuccccugcccug

SEQ ID NO: 2176741 - RNA, 19 nt, Human
augcucccuccccugcccu

SEQ ID NO: 2176742 - RNA, 18 nt, Human
augcucccuccccugccc

SEQ ID NO: 2176743 - RNA, 17 nt, Human
augcucccuccccugcc

SEQ ID NO: 2176744 - RNA, 16 nt, Human
augcucccuccccugc

SEQ ID NO: 2176745 - RNA, 14 nt, Human
augcucaucugcug

SEQ ID NO: 2176746 - RNA, 16 nt, Human
augcucaucugcuggu

SEQ ID NO: 2176747 - RNA, 19 nt, Human
augcuccuggcccacugca

SEQ ID NO: 2176748 - RNA, 22 nt, Human
augcuggacggcauuccugcuu

SEQ ID NO: 2176749 - RNA, 21 nt, Human
augcuggacggcauuccugcu

SEQ ID NO: 2176750 - RNA, 12 nt, Human
augcuggagaag

SEQ ID NO: 2176751 - RNA, 15 nt, Human
augcuccaaaugcug

SEQ ID NO: 2176752 - RNA, 14 nt, Human
augcuccuggccca

SEQ ID NO: 2176753 - RNA, 23 nt, Human
augcuggagccuguguaacagcu

SEQ ID NO: 2176754 - RNA, 17 nt, Human
augcuggaugucugcca

SEQ ID NO: 2176755 - RNA, 19 nt, Human
augcuggaugcuccuucca

SEQ ID NO: 2176756 - RNA, 18 nt, Human
augcuggagccuguguaa

SEQ ID NO: 2176757 - RNA, 22 nt, Human
augcuggagccuguguaacagc

SEQ ID NO: 2176758 - RNA, 18 nt, Human
augcuggcuguuggcugg

SEQ ID NO: 2176759 - RNA, 14 nt, Human
augcuggagaagag

SEQ ID NO: 2176760 - RNA, 15 nt, Human
augcuggagaagaga

SEQ ID NO: 2176761 - RNA, 16 nt, Human
augcuggagaagagag

SEQ ID NO: 2176762 - RNA, 17 nt, Human
augcuggagaagagagg

SEQ ID NO: 2176763 - RNA, 18 nt, Human
augcuggagaagagagga

SEQ ID NO: 2176764 - RNA, 19 nt, Human
augcuggagaagagaggag

SEQ ID NO: 2176765 - RNA, 23 nt, Human
augcuggagaagagaggagagga

SEQ ID NO: 2176766 - RNA, 12 nt, Human
augcuggagagg

SEQ ID NO: 2176767 - RNA, 13 nt, Human
augcuggagaggu

SEQ ID NO: 2176768 - RNA, 14 nt, Human
augcuggagagguu

SEQ ID NO: 2176769 - RNA, 15 nt, Human
augcuggagagguua

SEQ ID NO: 2176770 - RNA, 11 nt, Human
augcuggagcc

SEQ ID NO: 2176771 - RNA, 12 nt, Human
augcuggagccu

SEQ ID NO: 2176772 - RNA, 13 nt, Human
augcuggagccug

SEQ ID NO: 2176773 - RNA, 14 nt, Human
augcuggagccugu

SEQ ID NO: 2176774 - RNA, 16 nt, Human
augcuggagccugugu

SEQ ID NO: 2176775 - RNA, 14 nt, Human
augcuguugccuca

SEQ ID NO: 2176776 - RNA, 23 nt, Human
augcuguugauugcuaaauguaa

SEQ ID NO: 2176777 - RNA, 21 nt, Human
augcuguugauugcuaaaugu

SEQ ID NO: 2176778 - RNA, 22 nt, Human
augcuguugauugcuaaaugua

SEQ ID NO: 2176779 - RNA, 16 nt, Human
augcuguugauugcua

SEQ ID NO: 2176780 - RNA, 17 nt, Human
augcuguugauugcuaa

SEQ ID NO: 2176781 - RNA, 18 nt, Human
augcuguugauugcuaaa

SEQ ID NO: 2176782 - RNA, 19 nt, Human
augcuguugauugcuaaau

SEQ ID NO: 2176783 - RNA, 18 nt, Human
augcuguugccucaucua

SEQ ID NO: 2176784 - RNA, 17 nt, Human
augcuguugccucaucu

SEQ ID NO: 2176785 - RNA, 16 nt, Human
augcuguugccucauc

SEQ ID NO: 2176786 - RNA, 15 nt, Human
augcuguugccucau

SEQ ID NO: 2176787 - RNA, 22 nt, Human
augcugucaacuaugauauggu

SEQ ID NO: 2176788 - RNA, 20 nt, Human
augcugucaacuaugauaug

SEQ ID NO: 2176789 - RNA, 11 nt, Human
augcuguugau

SEQ ID NO: 2176790 - RNA, 12 nt, Human
augcuguugauu

SEQ ID NO: 2176791 - RNA, 15 nt, Human
augcuguugauugcu

SEQ ID NO: 2176792 - RNA, 23 nt, Human
augcuguauuuuaaaagaaugau

SEQ ID NO: 2176793 - RNA, 19 nt, Human
augcuggcuguuggcuggg

SEQ ID NO: 2176794 - RNA, 20 nt, Human
augcuggcuguuggcugggg

SEQ ID NO: 2176795 - RNA, 19 nt, Human
augcuguauuuuaaaagaa

SEQ ID NO: 2176796 - RNA, 22 nt, Human
augcuguauuuuaaaagaauga

SEQ ID NO: 2176797 - RNA, 20 nt, Human
augcuucucacugccaugcc

SEQ ID NO: 2176798 - RNA, 16 nt, Human
augcuucucacugcca

SEQ ID NO: 2176799 - RNA, 21 nt, Human
augcuucuguuuuauaauuuu

SEQ ID NO: 2176800 - RNA, 17 nt, Human
augcuucugacuucaua

SEQ ID NO: 2176801 - RNA, 16 nt, Human
auggaagauuuuaaau

SEQ ID NO: 2176802 - RNA, 17 nt, Human
auggaagauuuuaaauu

SEQ ID NO: 2176803 - RNA, 14 nt, Human
augcuucugggaga

SEQ ID NO: 2176804 - RNA, 14 nt, Human
auggaaggggcuga

SEQ ID NO: 2176805 - RNA, 17 nt, Human
auggaagacagcucuua

SEQ ID NO: 2176806 - RNA, 18 nt, Human
auggaagacagcucuuau

SEQ ID NO: 2176807 - RNA, 22 nt, Human
uuucaccuguuuuuaagcuguu

SEQ ID NO: 2176808 - RNA, 18 nt, Human
uuucaccuguaaaccuga

SEQ ID NO: 2176809 - RNA, 17 nt, Human
uuucaccuguaaaccug

SEQ ID NO: 2176810 - RNA, 14 nt, Human
uuucaccuguaaac

SEQ ID NO: 2176811 - RNA, 21 nt, Human
uuucacauucuuauaaauaug

SEQ ID NO: 2176812 - RNA, 15 nt, Human
uuucacauucuuaua

SEQ ID NO: 2176813 - RNA, 16 nt, Human
uuucacauucuuauaa

SEQ ID NO: 2176814 - RNA, 13 nt, Human
uuucaccuguaaa

SEQ ID NO: 2176815 - RNA, 13 nt, Human
uuucacauucuua

SEQ ID NO: 2176816 - RNA, 15 nt, Human
uuucacgggagauuu

SEQ ID NO: 2176817 - RNA, 18 nt, Human
uuucacggaaguuuucaa

SEQ ID NO: 2176818 - RNA, 19 nt, Human
uuucacggaaguuuucaau

SEQ ID NO: 2176819 - RNA, 23 nt, Human
uuucacggaaguuuucaaugaug

SEQ ID NO: 2176820 - RNA, 22 nt, Human
uuucacggugccagguuuucug

SEQ ID NO: 2176821 - RNA, 23 nt, Human
uuucaccuguuuuuaagcuguuu

SEQ ID NO: 2176822 - RNA, 14 nt, Human
uuucacggaaguuu

SEQ ID NO: 2176823 - RNA, 21 nt, Human
uuucagaaagaaguggggaca

SEQ ID NO: 2176824 - RNA, 19 nt, Human
uuucacuauuuuuauuuau

SEQ ID NO: 2176825 - RNA, 16 nt, Human
uuucacuauuuccuuu

SEQ ID NO: 2176826 - RNA, 15 nt, Human
uuucacuauuuccuu

SEQ ID NO: 2176827 - RNA, 16 nt, Human
uuucagaaauaugugg

SEQ ID NO: 2176828 - RNA, 15 nt, Human
auggaaugcuugaaa

SEQ ID NO: 2176829 - RNA, 15 nt, Human
auggaagcuuccagu

SEQ ID NO: 2176830 - RNA, 22 nt, Human
auggaagcuuccaguccaaucu

SEQ ID NO: 2176831 - RNA, 16 nt, Human
auggaaugcuugaaaa

SEQ ID NO: 2176832 - RNA, 20 nt, Human
auggaaugcuugaaaaaugu

SEQ ID NO: 2176833 - RNA, 16 nt, Human
auggaaugguuauaaa

SEQ ID NO: 2176834 - RNA, 18 nt, Human
auggaaugguuauaaaag

SEQ ID NO: 2176835 - RNA, 21 nt, Human
auggaaugcuguguuaaauaa

SEQ ID NO: 2176836 - RNA, 17 nt, Human
auggaaugcuguguuaa

SEQ ID NO: 2176837 - RNA, 16 nt, Human
auggaauugauuugca

SEQ ID NO: 2176838 - RNA, 15 nt, Human
auggaauugauuugc

SEQ ID NO: 2176839 - RNA, 14 nt, Human
auggaauugauuug

SEQ ID NO: 2176840 - RNA, 13 nt, Human
auggaauugauuu

SEQ ID NO: 2176841 - RNA, 20 nt, Human
auggaaugguuauaaaagug

SEQ ID NO: 2176842 - RNA, 19 nt, Human
auggaaugguuauaaaagu

SEQ ID NO: 2176843 - RNA, 15 nt, Human
uuucacauuaauauu

SEQ ID NO: 2176844 - RNA, 14 nt, Human
uuucacaugaacau

SEQ ID NO: 2176845 - RNA, 20 nt, Human
uuucaaacuccugacuuugu

SEQ ID NO: 2176846 - RNA, 15 nt, Human
uuucaaacuuuacua

SEQ ID NO: 2176847 - RNA, 12 nt, Human
uuucaaacuuua

SEQ ID NO: 2176848 - RNA, 19 nt, Human
uuucaaacauauauaacaa

SEQ ID NO: 2176849 - RNA, 16 nt, Human
uuucaucucuuguaua

SEQ ID NO: 2176850 - RNA, 18 nt, Human
uuucaucuauuucugaga

SEQ ID NO: 2176851 - RNA, 13 nt, Human
uuucaucuauuuc

SEQ ID NO: 2176852 - RNA, 16 nt, Human
uuucaucuauuucuga

SEQ ID NO: 2176853 - RNA, 11 nt, Human
uuucaucugcu

SEQ ID NO: 2176854 - RNA, 15 nt, Human
uuucaucugcucucc

SEQ ID NO: 2176855 - RNA, 16 nt, Human
uuucaucugcucuccu

SEQ ID NO: 2176856 - RNA, 17 nt, Human
uuucaucugcucuccuu

SEQ ID NO: 2176857 - RNA, 18 nt, Human
uuucaucugcucuccuuc

SEQ ID NO: 2176858 - RNA, 19 nt, Human
uuucaucugcucuccuucc

SEQ ID NO: 2176859 - RNA, 20 nt, Human
uuucaucugcucuccuuccu

SEQ ID NO: 2176860 - RNA, 20 nt, Human
uuucagaaauaugugguuuc

SEQ ID NO: 2176861 - RNA, 20 nt, Human
uuucauccacuagugcaaau

SEQ ID NO: 2176862 - RNA, 21 nt, Human
uuucauccacuagugcaaauc

SEQ ID NO: 2176863 - RNA, 23 nt, Human
uuucaucccuaugggauucagug

SEQ ID NO: 2176864 - RNA, 12 nt, Human
uuucagaaaugu

SEQ ID NO: 2176865 - RNA, 11 nt, Human
uuucagaaaug

SEQ ID NO: 2176866 - RNA, 22 nt, Human
uuucauggggugaugcugggcu

SEQ ID NO: 2176867 - RNA, 18 nt, Human
uuucauggacacuuugaa

SEQ ID NO: 2176868 - RNA, 13 nt, Human
uuucauggacacu

SEQ ID NO: 2176869 - RNA, 20 nt, Human
uuucauggugaaaauguacu

SEQ ID NO: 2176870 - RNA, 21 nt, Human
uuucauggugaaaauguacug

SEQ ID NO: 2176871 - RNA, 22 nt, Human
uuucauggugaaaauguacuga

SEQ ID NO: 2176872 - RNA, 18 nt, Human
uuucauguacaagaugaa

SEQ ID NO: 2176873 - RNA, 12 nt, Human
uuucauguacaa

SEQ ID NO: 2176874 - RNA, 19 nt, Human
uuucauguaaacugugcac

SEQ ID NO: 2176875 - RNA, 18 nt, Human
uuucauguaaacugugca

SEQ ID NO: 2176876 - RNA, 13 nt, Human
uuuccauuauuua

SEQ ID NO: 2176877 - RNA, 17 nt, Human
uuuccauguugcugcca

SEQ ID NO: 2176878 - RNA, 14 nt, Human
uuuccauguugcug

SEQ ID NO: 2176879 - RNA, 19 nt, Human
uuuccaugcguguuucuga

SEQ ID NO: 2176880 - RNA, 13 nt, Human
uuuccauguaucu

SEQ ID NO: 2176881 - RNA, 21 nt, Human
uuuccauuauuuauauuaguu

SEQ ID NO: 2176882 - RNA, 13 nt, Human
uuuccauuccaga

SEQ ID NO: 2176883 - RNA, 14 nt, Human
uuuccauuccagaa

SEQ ID NO: 2176884 - RNA, 21 nt, Human
uuuccauugguuuaccuguga

SEQ ID NO: 2176885 - RNA, 14 nt, Human
uuuccauuguuuga

SEQ ID NO: 2176886 - RNA, 15 nt, Human
uuucccaauuaggaa

SEQ ID NO: 2176887 - RNA, 12 nt, Human
uuucccaacucu

SEQ ID NO: 2176888 - RNA, 20 nt, Human
uuucccuaagccaagggccu

SEQ ID NO: 2176889 - RNA, 15 nt, Human
uuucccaauucacau

SEQ ID NO: 2176890 - RNA, 12 nt, Human
uuucccaauuca

SEQ ID NO: 2176891 - RNA, 16 nt, Human
uuucccuauuagagaa

SEQ ID NO: 2176892 - RNA, 14 nt, Human
uuuacuguuuguua

SEQ ID NO: 2176893 - RNA, 14 nt, Human
uuuacuuaaagauu

SEQ ID NO: 2176894 - RNA, 15 nt, Human
uuuacuuaaagauuu

SEQ ID NO: 2176895 - RNA, 16 nt, Human
uuuacuuaaagauuua

SEQ ID NO: 2176896 - RNA, 11 nt, Human
uuuacuuaaac

SEQ ID NO: 2176897 - RNA, 20 nt, Human
uuuacugucaaaauaauuuu

SEQ ID NO: 2176898 - RNA, 17 nt, Human
uuuacugugaaacuggc

SEQ ID NO: 2176899 - RNA, 22 nt, Human
uuuacugccaaagggaaauauc

SEQ ID NO: 2176900 - RNA, 11 nt, Human
uuuacugccac

SEQ ID NO: 2176901 - RNA, 12 nt, Human
uuuacugccacu

SEQ ID NO: 2176902 - RNA, 14 nt, Human
uuuacugaagccuu

SEQ ID NO: 2176903 - RNA, 13 nt, Human
uuuacugaacaau

SEQ ID NO: 2176904 - RNA, 18 nt, Human
uuuacuccccuugagcug

SEQ ID NO: 2176905 - RNA, 13 nt, Human
uuuacuccccuug

SEQ ID NO: 2176906 - RNA, 12 nt, Human
uuuacuccccuu

SEQ ID NO: 2176907 - RNA, 13 nt, Human
uuuacuccagugg

SEQ ID NO: 2176908 - RNA, 21 nt, Human
uuuacuccaguggugaagaaa

SEQ ID NO: 2176909 - RNA, 14 nt, Human
uuuacugagcuucu

SEQ ID NO: 2176910 - RNA, 17 nt, Human
uuuacugagcuucucug

SEQ ID NO: 2176911 - RNA, 18 nt, Human
uuuacugagcuucucugu

SEQ ID NO: 2176912 - RNA, 21 nt, Human
uuuacugagcuucucugugaa

SEQ ID NO: 2176913 - RNA, 16 nt, Human
uuuacugcagcuuugu

SEQ ID NO: 2176914 - RNA, 16 nt, Human
augcguguuucugacu

SEQ ID NO: 2176915 - RNA, 16 nt, Human
augcgugugugugugu

SEQ ID NO: 2176916 - RNA, 12 nt, Human
augcuaaaccuu

SEQ ID NO: 2176917 - RNA, 17 nt, Human
augcguguuucugacuc

SEQ ID NO: 2176918 - RNA, 14 nt, Human
augcuaaaccuuag

SEQ ID NO: 2176919 - RNA, 20 nt, Human
augcuaaaccuuaguacuga

SEQ ID NO: 2176920 - RNA, 22 nt, Human
augcuaaaccuuaguacugagu

SEQ ID NO: 2176921 - RNA, 23 nt, Human
augcuaccuugugacccagcacu

SEQ ID NO: 2176922 - RNA, 14 nt, Human
augcuacgugugau

SEQ ID NO: 2176923 - RNA, 15 nt, Human
augcuacgugugauu

SEQ ID NO: 2176924 - RNA, 16 nt, Human
augcuacgugugauuu

SEQ ID NO: 2176925 - RNA, 17 nt, Human
augcuacgugugauuuu

SEQ ID NO: 2176926 - RNA, 19 nt, Human
augcuacgugugauuuuuc

SEQ ID NO: 2176927 - RNA, 20 nt, Human
augcuacgugugauuuuucu

SEQ ID NO: 2176928 - RNA, 22 nt, Human
augcuacgugugauuuuucugg

SEQ ID NO: 2176929 - RNA, 20 nt, Human
uuuacccuucuuuucugacu

SEQ ID NO: 2176930 - RNA, 21 nt, Human
augcuacuacaaaaaaguugu

SEQ ID NO: 2176931 - RNA, 14 nt, Human
augcuacugucuca

SEQ ID NO: 2176932 - RNA, 23 nt, Human
augcuacugucucacugaaacau

SEQ ID NO: 2176933 - RNA, 20 nt, Human
augcuacugucucacugaaa

SEQ ID NO: 2176934 - RNA, 19 nt, Human
uuuaccuaccacagugucu

SEQ ID NO: 2176935 - RNA, 13 nt, Human
uuuacccuuggcu

SEQ ID NO: 2176936 - RNA, 18 nt, Human
uuuaccguuucuucccug

SEQ ID NO: 2176937 - RNA, 18 nt, Human
uuuaccuaccacaguguc

SEQ ID NO: 2176938 - RNA, 15 nt, Human
uuuaccuauguaaca

SEQ ID NO: 2176939 - RNA, 22 nt, Human
uuuaccugaagucuuuguacag

SEQ ID NO: 2176940 - RNA, 18 nt, Human
uuuaccugaagucuuugu

SEQ ID NO: 2176941 - RNA, 13 nt, Human
uuuaguggcuuca

SEQ ID NO: 2176942 - RNA, 13 nt, Human
uuuaguuauaguu

SEQ ID NO: 2176943 - RNA, 20 nt, Human
uuuagggcuguaaaaugcau

SEQ ID NO: 2176944 - RNA, 16 nt, Human
uuuagggccaggcagg

SEQ ID NO: 2176945 - RNA, 19 nt, Human
uuuagugaucacagcagcu

SEQ ID NO: 2176946 - RNA, 17 nt, Human
uuuauauguacaugaga

SEQ ID NO: 2176947 - RNA, 19 nt, Human
uuuaucacauguauguuuu

SEQ ID NO: 2176948 - RNA, 23 nt, Human
uuuauauggaugauucagaaauu

SEQ ID NO: 2176949 - RNA, 17 nt, Human
uuuaguuaaauuucugg

SEQ ID NO: 2176950 - RNA, 16 nt, Human
uuuaguuacagcugug

SEQ ID NO: 2176951 - RNA, 14 nt, Human
uuuauauguacaug

SEQ ID NO: 2176952 - RNA, 13 nt, Human
uuuauauguacau

SEQ ID NO: 2176953 - RNA, 21 nt, Human
uuuauaugcuucuguuuuaua

SEQ ID NO: 2176954 - RNA, 15 nt, Human
uuuacuucuuauaca

SEQ ID NO: 2176955 - RNA, 14 nt, Human
uuuacuucuuauac

SEQ ID NO: 2176956 - RNA, 13 nt, Human
uuuacuucuuaua

SEQ ID NO: 2176957 - RNA, 23 nt, Human
uuuacuuaaagauuuaucaaauc

SEQ ID NO: 2176958 - RNA, 20 nt, Human
uuuacuuaaagauuuaucaa

SEQ ID NO: 2176959 - RNA, 22 nt, Human
uuuacuuaaagauuuaucaaau

SEQ ID NO: 2176960 - RNA, 16 nt, Human
uuuacuuaucuuaugc

SEQ ID NO: 2176961 - RNA, 17 nt, Human
uuuacuuaucuuaugcc

SEQ ID NO: 2176962 - RNA, 13 nt, Human
uuuagggcagcuu

SEQ ID NO: 2176963 - RNA, 15 nt, Human
uuuagggcagcuugc

SEQ ID NO: 2176964 - RNA, 14 nt, Human
uuuagggccaggca

SEQ ID NO: 2176965 - RNA, 21 nt, Human
uuuagggagagucauauuuug

SEQ ID NO: 2176966 - RNA, 19 nt, Human
uuuagggagagucauauuu

SEQ ID NO: 2176967 - RNA, 19 nt, Human
uuuaggcagggauuugagg

SEQ ID NO: 2176968 - RNA, 18 nt, Human
uuuaggcugguggcccag

SEQ ID NO: 2176969 - RNA, 23 nt, Human
uuuagggacucaauuucucccca

SEQ ID NO: 2176970 - RNA, 20 nt, Human
uuuaggagggaguuaucuaa

SEQ ID NO: 2176971 - RNA, 17 nt, Human
uuuaggauaaaauaaug

SEQ ID NO: 2176972 - RNA, 23 nt, Human
uuuaaugaaagacuguacaaagu

SEQ ID NO: 2176973 - RNA, 21 nt, Human
uuuaaugaaagacuguacaaa

SEQ ID NO: 2176974 - RNA, 22 nt, Human
augccagagacggaagccuuuu

SEQ ID NO: 2176975 - RNA, 17 nt, Human
augccacugccuucgcu

SEQ ID NO: 2176976 - RNA, 18 nt, Human
augccacugccuucgcuu

SEQ ID NO: 2176977 - RNA, 19 nt, Human
augccagcucagucccauc

SEQ ID NO: 2176978 - RNA, 12 nt, Human
augccaggacac

SEQ ID NO: 2176979 - RNA, 18 nt, Human
augccagcucagucccau

SEQ ID NO: 2176980 - RNA, 16 nt, Human
augccagcuacuuccu

SEQ ID NO: 2176981 - RNA, 18 nt, Human
augccagguucuauuugg

SEQ ID NO: 2176982 - RNA, 19 nt, Human
augccagguucuauuugga

SEQ ID NO: 2176983 - RNA, 22 nt, Human
augccaguaacgcgucuuccug

SEQ ID NO: 2176984 - RNA, 20 nt, Human
augccagguucuauuuggaa

SEQ ID NO: 2176985 - RNA, 21 nt, Human
augccagguucuauuuggaau

SEQ ID NO: 2176986 - RNA, 23 nt, Human
augccaguaacgcgucuuccuga

SEQ ID NO: 2176987 - RNA, 20 nt, Human
augccaguaggcucaacuag

SEQ ID NO: 2176988 - RNA, 16 nt, Human
augcccagcucagagg

SEQ ID NO: 2176989 - RNA, 15 nt, Human
augcccagcguuuga

SEQ ID NO: 2176990 - RNA, 21 nt, Human
augcccagggccacucugccu

SEQ ID NO: 2176991 - RNA, 17 nt, Human
augcccagccccuucug

SEQ ID NO: 2176992 - RNA, 18 nt, Human
augccccgucccccucug

SEQ ID NO: 2176993 - RNA, 21 nt, Human
augccccgucccccucuggcu

SEQ ID NO: 2176994 - RNA, 17 nt, Human
augccaucugugggcac

SEQ ID NO: 2176995 - RNA, 23 nt, Human
augccauccucaaacacugcagg

SEQ ID NO: 2176996 - RNA, 15 nt, Human
augcccagccccuuc

SEQ ID NO: 2176997 - RNA, 16 nt, Human
augcccagccccuucu

SEQ ID NO: 2176998 - RNA, 21 nt, Human
augccaugaggaacaaggcaa

SEQ ID NO: 2176999 - RNA, 16 nt, Human
augccaucaucuccug

SEQ ID NO: 2177000 - RNA, 12 nt, Human
augccauccuca

SEQ ID NO: 2177001 - RNA, 21 nt, Human
augccauccucaaacacugca

SEQ ID NO: 2177002 - RNA, 15 nt, Human
augccaucaucuccu

SEQ ID NO: 2177003 - RNA, 14 nt, Human
augccaucaucucc

SEQ ID NO: 2177004 - RNA, 17 nt, Human
augcccagggccacucu

SEQ ID NO: 2177005 - RNA, 17 nt, Human
augcccggcuaauuuuu

SEQ ID NO: 2177006 - RNA, 20 nt, Human
augccccuguacuccagccu

SEQ ID NO: 2177007 - RNA, 16 nt, Human
augccccuggcuggga

SEQ ID NO: 2177008 - RNA, 13 nt, Human
augcccuccucuc

SEQ ID NO: 2177009 - RNA, 16 nt, Human
augccucuccuuugua

SEQ ID NO: 2177010 - RNA, 14 nt, Human
augcccucagggga

SEQ ID NO: 2177011 - RNA, 13 nt, Human
augccucucucag

SEQ ID NO: 2177012 - RNA, 14 nt, Human
augccucucucagg

SEQ ID NO: 2177013 - RNA, 15 nt, Human
augccucucucaggc

SEQ ID NO: 2177014 - RNA, 14 nt, Human
augccuuuucccaa

SEQ ID NO: 2177015 - RNA, 20 nt, Human
augccuuuucccaacuccag

SEQ ID NO: 2177016 - RNA, 22 nt, Human
augccuuuucccaacuccagaa

SEQ ID NO: 2177017 - RNA, 13 nt, Human
augcgcaggcugg

SEQ ID NO: 2177018 - RNA, 19 nt, Human
augcgagugcucauuucag

SEQ ID NO: 2177019 - RNA, 17 nt, Human
augccucuccuuuguau

SEQ ID NO: 2177020 - RNA, 20 nt, Human
augccucuccuuuguauauu

SEQ ID NO: 2177021 - RNA, 21 nt, Human
augccucuccuuuguauauua

SEQ ID NO: 2177022 - RNA, 22 nt, Human
augcgcaggcuggcccugcccu

SEQ ID NO: 2177023 - RNA, 20 nt, Human
augcgcaggcuggcccugcc

SEQ ID NO: 2177024 - RNA, 18 nt, Human
augcgcaggcuggcccug

SEQ ID NO: 2177025 - RNA, 14 nt, Human
augcgcaggcuggc

SEQ ID NO: 2177026 - RNA, 18 nt, Human
augcuacaggauuugaaa

SEQ ID NO: 2177027 - RNA, 12 nt, Human
augcgugugugu

SEQ ID NO: 2177028 - RNA, 20 nt, Human
augcgugcauaccacuuuug

SEQ ID NO: 2177029 - RNA, 22 nt, Human
augcgugcauaccacuuuuguu

SEQ ID NO: 2177030 - RNA, 10 nt, Human
uugagaaacc

SEQ ID NO: 2177031 - RNA, 22 nt, Human
uugagaaaccuuauuguaccuc

SEQ ID NO: 2177032 - RNA, 16 nt, Human
uugacuuuuugcauuu

SEQ ID NO: 2177033 - RNA, 17 nt, Human
uugacuuuuugcauuua

SEQ ID NO: 2177034 - RNA, 17 nt, Human
uugaccauucuccaccu

SEQ ID NO: 2177035 - RNA, 12 nt, Human
uugacuuuuuau

SEQ ID NO: 2177036 - RNA, 22 nt, Human
uugaccagcagaucccagcuca

SEQ ID NO: 2177037 - RNA, 21 nt, Human
uugaccagcagaucccagcuc

SEQ ID NO: 2177038 - RNA, 11 nt, Human
uugaccaggcc

SEQ ID NO: 2177039 - RNA, 22 nt, Human
uugaccaagcaggaagcucaga

SEQ ID NO: 2177040 - RNA, 20 nt, Human
uugaccaagcaggaagcuca

SEQ ID NO: 2177041 - RNA, 18 nt, Human
uugaccaagcaggaagcu

SEQ ID NO: 2177042 - RNA, 16 nt, Human
uugaccaagcaggaag

SEQ ID NO: 2177043 - RNA, 18 nt, Human
uugacauugcguuugacc

SEQ ID NO: 2177044 - RNA, 22 nt, Human
uugacauguggaaagugaauuu

SEQ ID NO: 2177045 - RNA, 14 nt, Human
uugacauguggaaa

SEQ ID NO: 2177046 - RNA, 13 nt, Human
uugacauguacag

SEQ ID NO: 2177047 - RNA, 14 nt, Human
uugacauguacaga

SEQ ID NO: 2177048 - RNA, 18 nt, Human
uugacauguacagagaac

SEQ ID NO: 2177049 - RNA, 14 nt, Human
uugacauugcguuu

SEQ ID NO: 2177050 - RNA, 16 nt, Human
uugagcagggcucagc

SEQ ID NO: 2177051 - RNA, 13 nt, Human
uugagccagcaga

SEQ ID NO: 2177052 - RNA, 14 nt, Human
uugagccagcagac

SEQ ID NO: 2177053 - RNA, 19 nt, Human
uugagcaguggcuggucca

SEQ ID NO: 2177054 - RNA, 12 nt, Human
uugagcagggcu

SEQ ID NO: 2177055 - RNA, 18 nt, Human
uugagcaacuuucuuaca

SEQ ID NO: 2177056 - RNA, 18 nt, Human
uugagcagggauccuggu

SEQ ID NO: 2177057 - RNA, 22 nt, Human
uugagacacugguuuacacuuu

SEQ ID NO: 2177058 - RNA, 18 nt, Human
uugagaaugguuacaaag

SEQ ID NO: 2177059 - RNA, 22 nt, Human
uugagaauugugcucaaaauuu

SEQ ID NO: 2177060 - RNA, 23 nt, Human
uugagaaucccaaauuugauuga

SEQ ID NO: 2177061 - RNA, 20 nt, Human
uugagaaacaaauaauuugu

SEQ ID NO: 2177062 - RNA, 19 nt, Human
uugagaaagagcacuuaag

SEQ ID NO: 2177063 - RNA, 23 nt, Human
uugagaaaccuuauuguaccucu

SEQ ID NO: 2177064 - RNA, 16 nt, Human
uugagaaguuuuguac

SEQ ID NO: 2177065 - RNA, 18 nt, Human
uugagaaguuuuguacag

SEQ ID NO: 2177066 - RNA, 19 nt, Human
uugagaaguuuuguacaga

SEQ ID NO: 2177067 - RNA, 13 nt, Human
uugagaauuuuaa

SEQ ID NO: 2177068 - RNA, 20 nt, Human
uugagacacugguuuacacu

SEQ ID NO: 2177069 - RNA, 22 nt, Human
uugagacacggagcccagcccu

SEQ ID NO: 2177070 - RNA, 10 nt, Human
uugagacaga

SEQ ID NO: 2177071 - RNA, 11 nt, Human
uugagacagag

SEQ ID NO: 2177072 - RNA, 21 nt, Human
aucccuuccuuuuagccuagu

SEQ ID NO: 2177073 - RNA, 19 nt, Human
aucccuuccuuuuagccua

SEQ ID NO: 2177074 - RNA, 14 nt, Human
aucccuugaccagg

SEQ ID NO: 2177075 - RNA, 18 nt, Human
aucccuugaccaggccug

SEQ ID NO: 2177076 - RNA, 14 nt, Human
aucccuuuauuacc

SEQ ID NO: 2177077 - RNA, 13 nt, Human
aucccuuuauuac

SEQ ID NO: 2177078 - RNA, 13 nt, Human
uugacacaggucu

SEQ ID NO: 2177079 - RNA, 22 nt, Human
uugacacaggucuuuccuaagg

SEQ ID NO: 2177080 - RNA, 19 nt, Human
uugacacaggucuuuccua

SEQ ID NO: 2177081 - RNA, 12 nt, Human
uugacaccugcu

SEQ ID NO: 2177082 - RNA, 18 nt, Human
uugacacaaguggaccuu

SEQ ID NO: 2177083 - RNA, 16 nt, Human
uugacacagaaaaugu

SEQ ID NO: 2177084 - RNA, 17 nt, Human
uugacacaaguggaccu

SEQ ID NO: 2177085 - RNA, 14 nt, Human
uugacacaagugga

SEQ ID NO: 2177086 - RNA, 22 nt, Human
aucccuugaccaggccugggcc

SEQ ID NO: 2177087 - RNA, 18 nt, Human
aucccuuuuugaagugua

SEQ ID NO: 2177088 - RNA, 22 nt, Human
aucccuuuauuacccccuccuu

SEQ ID NO: 2177089 - RNA, 18 nt, Human
uugacaauaauuucaggu

SEQ ID NO: 2177090 - RNA, 14 nt, Human
auccgaaucucuuu

SEQ ID NO: 2177091 - RNA, 16 nt, Human
auccgaaccuccucug

SEQ ID NO: 2177092 - RNA, 20 nt, Human
auccgaaccuccucugugaa

SEQ ID NO: 2177093 - RNA, 19 nt, Human
auccgaaccuccucuguga

SEQ ID NO: 2177094 - RNA, 19 nt, Human
uugacaggauuauuggaaa

SEQ ID NO: 2177095 - RNA, 23 nt, Human
uugacacuagcccaaugaaauga

SEQ ID NO: 2177096 - RNA, 22 nt, Human
uugacaccagcuguucuguccc

SEQ ID NO: 2177097 - RNA, 14 nt, Human
uugacacuauaucu

SEQ ID NO: 2177098 - RNA, 18 nt, Human
uugacacuauaucuguau

SEQ ID NO: 2177099 - RNA, 19 nt, Human
uugacacuauaucuguaua

SEQ ID NO: 2177100 - RNA, 22 nt, Human
uugacacuauaucuguauauaa

SEQ ID NO: 2177101 - RNA, 10 nt, Human
uugacagggc

SEQ ID NO: 2177102 - RNA, 12 nt, Human
uugacagggcac

SEQ ID NO: 2177103 - RNA, 13 nt, Human
uugacaucaacug

SEQ ID NO: 2177104 - RNA, 16 nt, Human
uugacaucaacugcau

SEQ ID NO: 2177105 - RNA, 19 nt, Human
uugacagcuuugcugcuga

SEQ ID NO: 2177106 - RNA, 23 nt, Human
uugacaugagauuuauaagguuu

SEQ ID NO: 2177107 - RNA, 13 nt, Human
uugacaugggaca

SEQ ID NO: 2177108 - RNA, 16 nt, Human
aucuaauuauuuugca

SEQ ID NO: 2177109 - RNA, 14 nt, Human
aucuaauauuaaaa

SEQ ID NO: 2177110 - RNA, 20 nt, Human
aucuaauauguaacaagcca

SEQ ID NO: 2177111 - RNA, 23 nt, Human
aucuaauauguaacaagccaccc

SEQ ID NO: 2177112 - RNA, 14 nt, Human
aucuacccaaagga

SEQ ID NO: 2177113 - RNA, 15 nt, Human
aucuacccaaaggau

SEQ ID NO: 2177114 - RNA, 21 nt, Human
aucuacccaaaggauacugua

SEQ ID NO: 2177115 - RNA, 17 nt, Human
aucuaccccuuacuuau

SEQ ID NO: 2177116 - RNA, 21 nt, Human
aucuaccucacuauucaagua

SEQ ID NO: 2177117 - RNA, 18 nt, Human
aucuagauacuguaucau

SEQ ID NO: 2177118 - RNA, 19 nt, Human
aucuacuaauuccacaccu

SEQ ID NO: 2177119 - RNA, 15 nt, Human
aucuacuaauuccac

SEQ ID NO: 2177120 - RNA, 22 nt, Human
aucuaccuuccagucaggauga

SEQ ID NO: 2177121 - RNA, 15 nt, Human
aucuaccuucuguag

SEQ ID NO: 2177122 - RNA, 17 nt, Human
aucuaccuucuguaguu

SEQ ID NO: 2177123 - RNA, 21 nt, Human
aucuaccuucuguaguuuuau

SEQ ID NO: 2177124 - RNA, 17 nt, Human
uugauacuuguucaaaa

SEQ ID NO: 2177125 - RNA, 16 nt, Human
uugauacuuguucaaa

SEQ ID NO: 2177126 - RNA, 18 nt, Human
uugagccagcagacauug

SEQ ID NO: 2177127 - RNA, 13 nt, Human
uugauagcaaagc

SEQ ID NO: 2177128 - RNA, 18 nt, Human
uugauagcacagacccug

SEQ ID NO: 2177129 - RNA, 17 nt, Human
uugauacuacaguuugu

SEQ ID NO: 2177130 - RNA, 15 nt, Human
uugauacuacaguuu

SEQ ID NO: 2177131 - RNA, 19 nt, Human
uugaguggaugauguuucg

SEQ ID NO: 2177132 - RNA, 17 nt, Human
uugaguggaugauguuu

SEQ ID NO: 2177133 - RNA, 15 nt, Human
uugagugcucugauc

SEQ ID NO: 2177134 - RNA, 14 nt, Human
uugagugcucugau

SEQ ID NO: 2177135 - RNA, 17 nt, Human
uugaguguuuuaagaua

SEQ ID NO: 2177136 - RNA, 17 nt, Human
uugagccagcagacauu

SEQ ID NO: 2177137 - RNA, 23 nt, Human
uugagugggguuaucucuguguu

SEQ ID NO: 2177138 - RNA, 21 nt, Human
uugagugcugucuccauguuu

SEQ ID NO: 2177139 - RNA, 11 nt, Human
uugagugccuu

SEQ ID NO: 2177140 - RNA, 22 nt, Human
aucuauuuuggauuguauauug

SEQ ID NO: 2177141 - RNA, 19 nt, Human
aucuaggaagacuuuggaa

SEQ ID NO: 2177142 - RNA, 17 nt, Human
aucuaggaagacuuugg

SEQ ID NO: 2177143 - RNA, 18 nt, Human
aucuaggaagacuuugga

SEQ ID NO: 2177144 - RNA, 15 nt, Human
aucuagcaaucacaa

SEQ ID NO: 2177145 - RNA, 18 nt, Human
aucuagcaaauguuaugc

SEQ ID NO: 2177146 - RNA, 22 nt, Human
aucuagcaaucacaacacuggc

SEQ ID NO: 2177147 - RNA, 14 nt, Human
aucuagcaaauguu

SEQ ID NO: 2177148 - RNA, 19 nt, Human
aucuagauuauggagcuuu

SEQ ID NO: 2177149 - RNA, 13 nt, Human
aucuacucccaag

SEQ ID NO: 2177150 - RNA, 16 nt, Human
aucuacucagaaauuu

SEQ ID NO: 2177151 - RNA, 18 nt, Human
aucuacucccaaguaugg

SEQ ID NO: 2177152 - RNA, 16 nt, Human
aucuagauaucgacuu

SEQ ID NO: 2177153 - RNA, 19 nt, Human
aucuagauacuguaucaug

SEQ ID NO: 2177154 - RNA, 14 nt, Human
aucucaaaaaauaa

SEQ ID NO: 2177155 - RNA, 23 nt, Human
aucuauuuuuggcagucugaauu

SEQ ID NO: 2177156 - RNA, 19 nt, Human
aucuauuuuuggcagucug

SEQ ID NO: 2177157 - RNA, 15 nt, Human
aucucaaaacugcac

SEQ ID NO: 2177158 - RNA, 20 nt, Human
aucucaaaacugcacuguca

SEQ ID NO: 2177159 - RNA, 19 nt, Human
aucucaaaacugcacuguc

SEQ ID NO: 2177160 - RNA, 21 nt, Human
aucucaaauaacuaaaaggua

SEQ ID NO: 2177161 - RNA, 14 nt, Human
aucucaaauaacua

SEQ ID NO: 2177162 - RNA, 23 nt, Human
aucucaaauaacuaaaagguaug

SEQ ID NO: 2177163 - RNA, 14 nt, Human
aucucaaauuucua

SEQ ID NO: 2177164 - RNA, 22 nt, Human
uugccaagcuccaagccccauc

SEQ ID NO: 2177165 - RNA, 15 nt, Human
uugccaagcucagga

SEQ ID NO: 2177166 - RNA, 23 nt, Human
uugccaaccuguaauaaauauga

SEQ ID NO: 2177167 - RNA, 22 nt, Human
uugccaaccuuauagggaugag

SEQ ID NO: 2177168 - RNA, 16 nt, Human
uugccaaauauguccu

SEQ ID NO: 2177169 - RNA, 17 nt, Human
uugccaaauauguccug

SEQ ID NO: 2177170 - RNA, 18 nt, Human
uugccaaauauguccugg

SEQ ID NO: 2177171 - RNA, 13 nt, Human
uugccaacauugc

SEQ ID NO: 2177172 - RNA, 16 nt, Human
uugccaacauugccua

SEQ ID NO: 2177173 - RNA, 18 nt, Human
uugccaaccuguaauaaa

SEQ ID NO: 2177174 - RNA, 19 nt, Human
uugccaaccuguaauaaau

SEQ ID NO: 2177175 - RNA, 21 nt, Human
uugccaaccuguaauaaauau

SEQ ID NO: 2177176 - RNA, 22 nt, Human
uugccaaccuguaauaaauaug

SEQ ID NO: 2177177 - RNA, 17 nt, Human
uugcaccuaccucacag

SEQ ID NO: 2177178 - RNA, 14 nt, Human
uugcaccugcucuc

SEQ ID NO: 2177179 - RNA, 14 nt, Human
uugcaugauguauu

SEQ ID NO: 2177180 - RNA, 12 nt, Human
uugcaugaggcu

SEQ ID NO: 2177181 - RNA, 14 nt, Human
uugcaugaggcuag

SEQ ID NO: 2177182 - RNA, 15 nt, Human
uugcaugauguauuu

SEQ ID NO: 2177183 - RNA, 19 nt, Human
uugcauggcacuugcaucu

SEQ ID NO: 2177184 - RNA, 19 nt, Human
uugcauggcaucaccucca

SEQ ID NO: 2177185 - RNA, 19 nt, Human
uugcauggcuccagaaaug

SEQ ID NO: 2177186 - RNA, 20 nt, Human
uugcauggcuccagaaaugu

SEQ ID NO: 2177187 - RNA, 17 nt, Human
uugcaugggcuaaugaa

SEQ ID NO: 2177188 - RNA, 18 nt, Human
uugcaugggcuaaugaag

SEQ ID NO: 2177189 - RNA, 22 nt, Human
uugcaugggcuaaugaagauca

SEQ ID NO: 2177190 - RNA, 14 nt, Human
uugcaauaauacuu

SEQ ID NO: 2177191 - RNA, 20 nt, Human
uugcaauaauacuucucaaa

SEQ ID NO: 2177192 - RNA, 14 nt, Human
uugcaauggcagcc

SEQ ID NO: 2177193 - RNA, 20 nt, Human
uugauguuuguggccucaga

SEQ ID NO: 2177194 - RNA, 22 nt, Human
uugcaacuucaugucaacuucu

SEQ ID NO: 2177195 - RNA, 15 nt, Human
uugcaagugaagguu

SEQ ID NO: 2177196 - RNA, 13 nt, Human
uugcaauaauacu

SEQ ID NO: 2177197 - RNA, 18 nt, Human
uugcaagugaagguuuac

SEQ ID NO: 2177198 - RNA, 21 nt, Human
uugcaccacugcacuccagcc

SEQ ID NO: 2177199 - RNA, 12 nt, Human
uugcacccagcc

SEQ ID NO: 2177200 - RNA, 13 nt, Human
uugcacccagccc

SEQ ID NO: 2177201 - RNA, 15 nt, Human
uugcacccagcccug

SEQ ID NO: 2177202 - RNA, 20 nt, Human
uugcaauccacaaucugaca

SEQ ID NO: 2177203 - RNA, 21 nt, Human
uugcaccccaaagcuuuccug

SEQ ID NO: 2177204 - RNA, 16 nt, Human
uugcacccagcccugg

SEQ ID NO: 2177205 - RNA, 19 nt, Human
uugcacccagcccuggucu

SEQ ID NO: 2177206 - RNA, 22 nt, Human
uugcaccccaaagcuuuccugc

SEQ ID NO: 2177207 - RNA, 19 nt, Human
uugcaccccaugcuguuga

SEQ ID NO: 2177208 - RNA, 13 nt, Human
uugcaccccucac

SEQ ID NO: 2177209 - RNA, 22 nt, Human
uugcaccccucacucuggccuc

SEQ ID NO: 2177210 - RNA, 24 nt, Human
uugcaccccucacucuggccucag

SEQ ID NO: 2177211 - RNA, 12 nt, Human
uugcaccccucc

SEQ ID NO: 2177212 - RNA, 13 nt, Human
uugcaccccuccc

SEQ ID NO: 2177213 - RNA, 14 nt, Human
uugcaccccuccca

SEQ ID NO: 2177214 - RNA, 15 nt, Human
uugcaccccucccau

SEQ ID NO: 2177215 - RNA, 16 nt, Human
uugcaccccucccauu

SEQ ID NO: 2177216 - RNA, 16 nt, Human
uugcacccgccucucc

SEQ ID NO: 2177217 - RNA, 16 nt, Human
uugccaccaggagaac

SEQ ID NO: 2177218 - RNA, 15 nt, Human
uugccaccaggagaa

SEQ ID NO: 2177219 - RNA, 14 nt, Human
uugccaccaggaga

SEQ ID NO: 2177220 - RNA, 13 nt, Human
uugccaccaggag

SEQ ID NO: 2177221 - RNA, 19 nt, Human
uugccacaggccucccugu

SEQ ID NO: 2177222 - RNA, 11 nt, Human
uugccacaggc

SEQ ID NO: 2177223 - RNA, 15 nt, Human
uugccacaggccucc

SEQ ID NO: 2177224 - RNA, 16 nt, Human
uugccacaggccuccc

SEQ ID NO: 2177225 - RNA, 21 nt, Human
uugccaaugaggucugaaaug

SEQ ID NO: 2177226 - RNA, 13 nt, Human
uugccacagcucu

SEQ ID NO: 2177227 - RNA, 15 nt, Human
uugccacaacccugu

SEQ ID NO: 2177228 - RNA, 18 nt, Human
uugccacaggacacaguc

SEQ ID NO: 2177229 - RNA, 13 nt, Human
uugcccaggcagg

SEQ ID NO: 2177230 - RNA, 14 nt, Human
uugcccaggcaggu

SEQ ID NO: 2177231 - RNA, 16 nt, Human
uugcccaggcaggucu

SEQ ID NO: 2177232 - RNA, 18 nt, Human
uugcccaggcaggucuug

SEQ ID NO: 2177233 - RNA, 11 nt, Human
uugcccaggcu

SEQ ID NO: 2177234 - RNA, 12 nt, Human
uugcccaggcug

SEQ ID NO: 2177235 - RNA, 14 nt, Human
uugcccaggcuggc

SEQ ID NO: 2177236 - RNA, 23 nt, Human
uugcccaggcuggcgugcagugg

SEQ ID NO: 2177237 - RNA, 20 nt, Human
uugcccagggcucagccugg

SEQ ID NO: 2177238 - RNA, 19 nt, Human
uugcccagggcucagccug

SEQ ID NO: 2177239 - RNA, 18 nt, Human
uugcccagggcucagccu

SEQ ID NO: 2177240 - RNA, 17 nt, Human
uugcccagggcucagcc

SEQ ID NO: 2177241 - RNA, 18 nt, Human
uugcccaggcuggucuca

SEQ ID NO: 2177242 - RNA, 19 nt, Human
uugccaccccacccucccu

SEQ ID NO: 2177243 - RNA, 18 nt, Human
uugccacaggccucccug

SEQ ID NO: 2177244 - RNA, 12 nt, Human
uugccaccccac

SEQ ID NO: 2177245 - RNA, 17 nt, Human
uugccaccccacccucc

SEQ ID NO: 2177246 - RNA, 18 nt, Human
uugccaccccacccuccc

SEQ ID NO: 2177247 - RNA, 14 nt, Human
uugccccaaccccc

SEQ ID NO: 2177248 - RNA, 15 nt, Human
uugccccaaccccca

SEQ ID NO: 2177249 - RNA, 14 nt, Human
uugcccauccaucu

SEQ ID NO: 2177250 - RNA, 15 nt, Human
uugcccauccaucug

SEQ ID NO: 2177251 - RNA, 15 nt, Human
uugcccccagggcac

SEQ ID NO: 2177252 - RNA, 22 nt, Human
uugcccccagggcacuucacag

SEQ ID NO: 2177253 - RNA, 16 nt, Human
uugccccaacccccag

SEQ ID NO: 2177254 - RNA, 17 nt, Human
uugccccaacccccagc

SEQ ID NO: 2177255 - RNA, 21 nt, Human
uugccccaacccccagcaccc

SEQ ID NO: 2177256 - RNA, 13 nt, Human
aucugagaaucuu

SEQ ID NO: 2177257 - RNA, 22 nt, Human
aucugagaaaagcuuugaaccc

SEQ ID NO: 2177258 - RNA, 14 nt, Human
aucugagaaucuuu

SEQ ID NO: 2177259 - RNA, 16 nt, Human
aucugagaaucuuuau

SEQ ID NO: 2177260 - RNA, 21 nt, Human
aucugacccagugcccccacu

SEQ ID NO: 2177261 - RNA, 20 nt, Human
aucugacccagugcccccac

SEQ ID NO: 2177262 - RNA, 18 nt, Human
aucugagaaaagcuuuga

SEQ ID NO: 2177263 - RNA, 13 nt, Human
aucugaaggagau

SEQ ID NO: 2177264 - RNA, 18 nt, Human
aucugacucacaagaaga

SEQ ID NO: 2177265 - RNA, 19 nt, Human
uugauguuuguggccucag

SEQ ID NO: 2177266 - RNA, 18 nt, Human
uugauguuuguggccuca

SEQ ID NO: 2177267 - RNA, 17 nt, Human
uugauguuuguggccuc

SEQ ID NO: 2177268 - RNA, 16 nt, Human
uugauguuuguggccu

SEQ ID NO: 2177269 - RNA, 15 nt, Human
uugauguuuguggcc

SEQ ID NO: 2177270 - RNA, 13 nt, Human
uugauguuugugg

SEQ ID NO: 2177271 - RNA, 16 nt, Human
uugauguuggcuggga

SEQ ID NO: 2177272 - RNA, 13 nt, Human
uugauguuggcug

SEQ ID NO: 2177273 - RNA, 14 nt, Human
uugauguuaacaca

SEQ ID NO: 2177274 - RNA, 16 nt, Human
uugauguuaacacauu

SEQ ID NO: 2177275 - RNA, 23 nt, Human
uugauguucuuucacccuuuucu

SEQ ID NO: 2177276 - RNA, 14 nt, Human
uugcaagaaucagu

SEQ ID NO: 2177277 - RNA, 18 nt, Human
uugcaacuuuguauaaaa

SEQ ID NO: 2177278 - RNA, 16 nt, Human
uugcaacuuuguauaa

SEQ ID NO: 2177279 - RNA, 17 nt, Human
uugcaacuuuguauaaa

SEQ ID NO: 2177280 - RNA, 21 nt, Human
uugauuaaauucuugcaaagu

SEQ ID NO: 2177281 - RNA, 20 nt, Human
uugauuaaauucuugcaaag

SEQ ID NO: 2177282 - RNA, 16 nt, Human
uugauuaaauucuugc

SEQ ID NO: 2177283 - RNA, 15 nt, Human
uugauuaaauucuug

SEQ ID NO: 2177284 - RNA, 19 nt, Human
aucucuuuuugcuuucgaa

SEQ ID NO: 2177285 - RNA, 15 nt, Human
aucucuuugaauuuu

SEQ ID NO: 2177286 - RNA, 21 nt, Human
aucucuuugaauuuucugugu

SEQ ID NO: 2177287 - RNA, 21 nt, Human
aucugaagagcuauuauauaa

SEQ ID NO: 2177288 - RNA, 22 nt, Human
aucucuuuugaauccaugcuug

SEQ ID NO: 2177289 - RNA, 22 nt, Human
aucucuuuguucuaaagaugga

SEQ ID NO: 2177290 - RNA, 15 nt, Human
aucucuugaggccag

SEQ ID NO: 2177291 - RNA, 16 nt, Human
aucucuuguuuaaauu

SEQ ID NO: 2177292 - RNA, 13 nt, Human
aucugacccagug

SEQ ID NO: 2177293 - RNA, 15 nt, Human
aucugaaggagauuu

SEQ ID NO: 2177294 - RNA, 18 nt, Human
aucugacccagugccccc

SEQ ID NO: 2177295 - RNA, 14 nt, Human
aucugacccagugc

SEQ ID NO: 2177296 - RNA, 23 nt, Human
aucucaccccaucccacacccug

SEQ ID NO: 2177297 - RNA, 22 nt, Human
aucucaccccaucccacacccu

SEQ ID NO: 2177298 - RNA, 16 nt, Human
aucucaccccauccca

SEQ ID NO: 2177299 - RNA, 14 nt, Human
aucucaccccaucc

SEQ ID NO: 2177300 - RNA, 13 nt, Human
aucucaccccauc

SEQ ID NO: 2177301 - RNA, 17 nt, Human
aucucaaauuucuaaau

SEQ ID NO: 2177302 - RNA, 16 nt, Human
aucucaaauuucuaaa

SEQ ID NO: 2177303 - RNA, 19 nt, Human
aucucaaauucucaaccua

SEQ ID NO: 2177304 - RNA, 23 nt, Human
aucucacacaugagcaucaggcc

SEQ ID NO: 2177305 - RNA, 23 nt, Human
aucuugggggacagggcuggccc

SEQ ID NO: 2177306 - RNA, 12 nt, Human
aucuugguaaau

SEQ ID NO: 2177307 - RNA, 16 nt, Human
aucuuggggggguggc

SEQ ID NO: 2177308 - RNA, 22 nt, Human
aucuuggggacaucucuuugaa

SEQ ID NO: 2177309 - RNA, 23 nt, Human
aucuuggggacaucucuuugaau

SEQ ID NO: 2177310 - RNA, 20 nt, Human
aucuuggggggguggccgcu

SEQ ID NO: 2177311 - RNA, 23 nt, Human
aucuuggggggguggccgcugag

SEQ ID NO: 2177312 - RNA, 23 nt, Human
aucuuggcacauuuaagagacag

SEQ ID NO: 2177313 - RNA, 15 nt, Human
aucuuggcucacugc

SEQ ID NO: 2177314 - RNA, 13 nt, Human
aucuugggacugg

SEQ ID NO: 2177315 - RNA, 17 nt, Human
aucuugggacuggguuu

SEQ ID NO: 2177316 - RNA, 18 nt, Human
aucuugggacuggguuug

SEQ ID NO: 2177317 - RNA, 17 nt, Human
aucuuggggacaucucu

SEQ ID NO: 2177318 - RNA, 15 nt, Human
aucuugcucugcuga

SEQ ID NO: 2177319 - RNA, 16 nt, Human
aucuugcucugcugac

SEQ ID NO: 2177320 - RNA, 21 nt, Human
aucuuggacugacauuuagcg

SEQ ID NO: 2177321 - RNA, 19 nt, Human
aucuuggacugacauuuag

SEQ ID NO: 2177322 - RNA, 16 nt, Human
aucuuggacugacauu

SEQ ID NO: 2177323 - RNA, 14 nt, Human
aucuuggacugaca

SEQ ID NO: 2177324 - RNA, 12 nt, Human
aucuuaauuuug

SEQ ID NO: 2177325 - RNA, 13 nt, Human
aucuuaauuuugg

SEQ ID NO: 2177326 - RNA, 14 nt, Human
aucuugcucugcug

SEQ ID NO: 2177327 - RNA, 16 nt, Human
aucuuaauuauuguac

SEQ ID NO: 2177328 - RNA, 16 nt, Human
aucuuauaauuuaaaa

SEQ ID NO: 2177329 - RNA, 19 nt, Human
aucuuaaaguguguuucua

SEQ ID NO: 2177330 - RNA, 16 nt, Human
aucuuaaggggcagcu

SEQ ID NO: 2177331 - RNA, 15 nt, Human
aucuuauaauuuaaa

SEQ ID NO: 2177332 - RNA, 12 nt, Human
aucugugaugau

SEQ ID NO: 2177333 - RNA, 22 nt, Human
aucugugcaaauccuugauacu

SEQ ID NO: 2177334 - RNA, 17 nt, Human
aucugugcccagagaug

SEQ ID NO: 2177335 - RNA, 14 nt, Human
aucugugcccagag

SEQ ID NO: 2177336 - RNA, 16 nt, Human
aucugugcacugccca

SEQ ID NO: 2177337 - RNA, 18 nt, Human
aucugucacaccagccau

SEQ ID NO: 2177338 - RNA, 17 nt, Human
aucugugauaauuuucu

SEQ ID NO: 2177339 - RNA, 23 nt, Human
aucugugccccaugccuguccag

SEQ ID NO: 2177340 - RNA, 15 nt, Human
aucugugccccaugc

SEQ ID NO: 2177341 - RNA, 13 nt, Human
aucugugccccau

SEQ ID NO: 2177342 - RNA, 12 nt, Human
aucugugcccca

SEQ ID NO: 2177343 - RNA, 19 nt, Human
aucugugcgugaaacacac

SEQ ID NO: 2177344 - RNA, 18 nt, Human
aucugugcgugaaacaca

SEQ ID NO: 2177345 - RNA, 19 nt, Human
aucugugcucaggacucag

SEQ ID NO: 2177346 - RNA, 17 nt, Human
aucugugcgugaaacac

SEQ ID NO: 2177347 - RNA, 16 nt, Human
aucugugcgugaaaca

SEQ ID NO: 2177348 - RNA, 21 nt, Human
aucugugcccagagaugggac

SEQ ID NO: 2177349 - RNA, 19 nt, Human
aucugugggcauggucaaa

SEQ ID NO: 2177350 - RNA, 18 nt, Human
aucugugcuuuccagcuc

SEQ ID NO: 2177351 - RNA, 19 nt, Human
aucugugcuuuccagcuca

SEQ ID NO: 2177352 - RNA, 15 nt, Human
aucugugcuuuccag

SEQ ID NO: 2177353 - RNA, 16 nt, Human
aucugugcuuuccagc

SEQ ID NO: 2177354 - RNA, 17 nt, Human
aucugugcuuuccagcu

SEQ ID NO: 2177355 - RNA, 22 nt, Human
aucugugggcauggucaaaggc

SEQ ID NO: 2177356 - RNA, 15 nt, Human
aucuguguacaaaga

SEQ ID NO: 2177357 - RNA, 16 nt, Human
aucuguguacaaagaa

SEQ ID NO: 2177358 - RNA, 17 nt, Human
aucuguguacaaagaaa

SEQ ID NO: 2177359 - RNA, 22 nt, Human
aucuguguacaaagaaauaaca

SEQ ID NO: 2177360 - RNA, 18 nt, Human
aucuguguacaaagaaau

SEQ ID NO: 2177361 - RNA, 12 nt, Human
aucugugucuug

SEQ ID NO: 2177362 - RNA, 14 nt, Human
aucugugucuuguu

SEQ ID NO: 2177363 - RNA, 13 nt, Human
aucugugucuugu

SEQ ID NO: 2177364 - RNA, 19 nt, Human
uugcccggauucugggagg

SEQ ID NO: 2177365 - RNA, 12 nt, Human
uugcccucccau

SEQ ID NO: 2177366 - RNA, 15 nt, Human
uugcccucccauccc

SEQ ID NO: 2177367 - RNA, 12 nt, Human
uugcccugaccu

SEQ ID NO: 2177368 - RNA, 13 nt, Human
uugcccugaccuc

SEQ ID NO: 2177369 - RNA, 15 nt, Human
uugcccugaccuccc

SEQ ID NO: 2177370 - RNA, 23 nt, Human
aucugucaagugggaucugucac

SEQ ID NO: 2177371 - RNA, 17 nt, Human
aucugucacaccagcca

SEQ ID NO: 2177372 - RNA, 19 nt, Human
uugccccccaccccagccu

SEQ ID NO: 2177373 - RNA, 16 nt, Human
uugccccccaccccag

SEQ ID NO: 2177374 - RNA, 13 nt, Human
uugccccccaccc

SEQ ID NO: 2177375 - RNA, 12 nt, Human
uugccccccacc

SEQ ID NO: 2177376 - RNA, 13 nt, Human
uugccccugagac

SEQ ID NO: 2177377 - RNA, 17 nt, Human
uugcccggauucuggga

SEQ ID NO: 2177378 - RNA, 22 nt, Human
uugccccggccccggccccagc

SEQ ID NO: 2177379 - RNA, 23 nt, Human
uugccccggccccggccccagcc

SEQ ID NO: 2177380 - RNA, 12 nt, Human
aucugucauuug

SEQ ID NO: 2177381 - RNA, 17 nt, Human
aucugucauuugagcag

SEQ ID NO: 2177382 - RNA, 22 nt, Human
aucugucauuugagcagggcuc

SEQ ID NO: 2177383 - RNA, 22 nt, Human
aucugugaggggcucucucaug

SEQ ID NO: 2177384 - RNA, 21 nt, Human
aucugugaggggcucucucau

SEQ ID NO: 2177385 - RNA, 16 nt, Human
uugcuuuguaugcacu

SEQ ID NO: 2177386 - RNA, 20 nt, Human
uugcuuugugauuuuuguaa

SEQ ID NO: 2177387 - RNA, 21 nt, Human
uuggaaaaauccagaaagaaa

SEQ ID NO: 2177388 - RNA, 14 nt, Human
uuggaaaagaauac

SEQ ID NO: 2177389 - RNA, 13 nt, Human
uuggaaaaaguga

SEQ ID NO: 2177390 - RNA, 17 nt, Human
uuggaaaaagugaugga

SEQ ID NO: 2177391 - RNA, 17 nt, Human
uuggaaaauaaauuauu

SEQ ID NO: 2177392 - RNA, 12 nt, Human
uuggaaaauaaa

SEQ ID NO: 2177393 - RNA, 15 nt, Human
uuggaaaauaaauca

SEQ ID NO: 2177394 - RNA, 14 nt, Human
uuggacugacauuu

SEQ ID NO: 2177395 - RNA, 17 nt, Human
uuggacucuugcucuuu

SEQ ID NO: 2177396 - RNA, 15 nt, Human
uuggacucuugcucu

SEQ ID NO: 2177397 - RNA, 16 nt, Human
uuggacucuugcucuu

SEQ ID NO: 2177398 - RNA, 15 nt, Human
uuggacugacauuua

SEQ ID NO: 2177399 - RNA, 15 nt, Human
uuggacuggaugcau

SEQ ID NO: 2177400 - RNA, 13 nt, Human
uuggacuugagga

SEQ ID NO: 2177401 - RNA, 22 nt, Human
uuggaaaagaauacagaaagau

SEQ ID NO: 2177402 - RNA, 19 nt, Human
uuggaaaagaauacagaaa

SEQ ID NO: 2177403 - RNA, 15 nt, Human
uuggaaaaugcauug

SEQ ID NO: 2177404 - RNA, 15 nt, Human
uuggagaagaacuga

SEQ ID NO: 2177405 - RNA, 17 nt, Human
uuggagaagaacugaaa

SEQ ID NO: 2177406 - RNA, 22 nt, Human
uuggagaagaacugaaaucaua

SEQ ID NO: 2177407 - RNA, 18 nt, Human
uuggagaguuuccugaaa

SEQ ID NO: 2177408 - RNA, 13 nt, Human
uuggagccugcag

SEQ ID NO: 2177409 - RNA, 15 nt, Human
uuggagccugcagag

SEQ ID NO: 2177410 - RNA, 11 nt, Human
uuggagccugc

SEQ ID NO: 2177411 - RNA, 20 nt, Human
uuggagauaaucuagaacac

SEQ ID NO: 2177412 - RNA, 14 nt, Human
uuggagaucaagga

SEQ ID NO: 2177413 - RNA, 13 nt, Human
uuggagaauuuag

SEQ ID NO: 2177414 - RNA, 15 nt, Human
uuggagaaauuauuu

SEQ ID NO: 2177415 - RNA, 18 nt, Human
uuggagaagguuaucaaa

SEQ ID NO: 2177416 - RNA, 20 nt, Human
uuggagaagcccgugugaga

SEQ ID NO: 2177417 - RNA, 14 nt, Human
uuggagaaauuauu

SEQ ID NO: 2177418 - RNA, 21 nt, Human
uuggagaguuuccugaaacaa

SEQ ID NO: 2177419 - RNA, 18 nt, Human
uuggagaauuuagguuuu

SEQ ID NO: 2177420 - RNA, 18 nt, Human
uuggagacacaacuauuu

SEQ ID NO: 2177421 - RNA, 14 nt, Human
uugcucuggcugag

SEQ ID NO: 2177422 - RNA, 19 nt, Human
uugcucuuaaguuguggag

SEQ ID NO: 2177423 - RNA, 14 nt, Human
uugcucugggugga

SEQ ID NO: 2177424 - RNA, 23 nt, Human
uugcucuguaaucucguuucaaa

SEQ ID NO: 2177425 - RNA, 23 nt, Human
aucuuguuuuuccacuacugcua

SEQ ID NO: 2177426 - RNA, 15 nt, Human
aucuuguuuuuccac

SEQ ID NO: 2177427 - RNA, 15 nt, Human
aucuuuaaaauacac

SEQ ID NO: 2177428 - RNA, 12 nt, Human
aucuuuaaaaua

SEQ ID NO: 2177429 - RNA, 14 nt, Human
uugcugaaagaucu

SEQ ID NO: 2177430 - RNA, 22 nt, Human
uugcuuagucacuuauuucaua

SEQ ID NO: 2177431 - RNA, 16 nt, Human
uugcucuuucuacucu

SEQ ID NO: 2177432 - RNA, 17 nt, Human
uugcugaaaaugguauu

SEQ ID NO: 2177433 - RNA, 18 nt, Human
uugcucuugaugccuggc

SEQ ID NO: 2177434 - RNA, 14 nt, Human
uugcucuugaugcc

SEQ ID NO: 2177435 - RNA, 17 nt, Human
uugcucuugaugccugg

SEQ ID NO: 2177436 - RNA, 23 nt, Human
uugcuuauuguuccaagacauug

SEQ ID NO: 2177437 - RNA, 22 nt, Human
uugcuuauuguuccaagacauu

SEQ ID NO: 2177438 - RNA, 12 nt, Human
uugcuucacuca

SEQ ID NO: 2177439 - RNA, 14 nt, Human
uugcuucauaaaug

SEQ ID NO: 2177440 - RNA, 20 nt, Human
uugcuuauuguuccaagaca

SEQ ID NO: 2177441 - RNA, 18 nt, Human
uugcuuauuguuccaaga

SEQ ID NO: 2177442 - RNA, 16 nt, Human
uugcuuauuguuccaa

SEQ ID NO: 2177443 - RNA, 15 nt, Human
uugcuuauuguucca

SEQ ID NO: 2177444 - RNA, 13 nt, Human
uugcuuaugacau

SEQ ID NO: 2177445 - RNA, 20 nt, Human
uugcuucauaaaugaagcag

SEQ ID NO: 2177446 - RNA, 15 nt, Human
uugcuucauaaauga

SEQ ID NO: 2177447 - RNA, 17 nt, Human
uugcuucauaaaugaag

SEQ ID NO: 2177448 - RNA, 15 nt, Human
uugcuuuauuccaga

SEQ ID NO: 2177449 - RNA, 14 nt, Human
uugcuuugaagcag

SEQ ID NO: 2177450 - RNA, 15 nt, Human
uugcuuucugcucag

SEQ ID NO: 2177451 - RNA, 15 nt, Human
uugcuuugaagcagu

SEQ ID NO: 2177452 - RNA, 11 nt, Human
uugcuuugagc

SEQ ID NO: 2177453 - RNA, 16 nt, Human
uugcuuugaagcaguu

SEQ ID NO: 2177454 - RNA, 22 nt, Human
uugcuuugaagcaguuguguca

SEQ ID NO: 2177455 - RNA, 13 nt, Human
uugcuuucugaaa

SEQ ID NO: 2177456 - RNA, 20 nt, Human
uugcuuuaugccuucuuauu

SEQ ID NO: 2177457 - RNA, 16 nt, Human
uugcuuuauaaauaaa

SEQ ID NO: 2177458 - RNA, 15 nt, Human
uugcuuucugaaauu

SEQ ID NO: 2177459 - RNA, 14 nt, Human
uugcuuucugaaau

SEQ ID NO: 2177460 - RNA, 20 nt, Human
uugcuuucugcucagcuucu

SEQ ID NO: 2177461 - RNA, 13 nt, Human
uugcuuuguaugc

SEQ ID NO: 2177462 - RNA, 14 nt, Human
uugcuuugcccagc

SEQ ID NO: 2177463 - RNA, 13 nt, Human
uugcuuugcccug

SEQ ID NO: 2177464 - RNA, 15 nt, Human
uugcuuugugauuuu

SEQ ID NO: 2177465 - RNA, 15 nt, Human
augaagcaaacacau

SEQ ID NO: 2177466 - RNA, 22 nt, Human
augaagauucuccugugcuaga

SEQ ID NO: 2177467 - RNA, 13 nt, Human
augaagcagcuuu

SEQ ID NO: 2177468 - RNA, 15 nt, Human
augaagcagcuuuaa

SEQ ID NO: 2177469 - RNA, 15 nt, Human
augaagcaaugcuuc

SEQ ID NO: 2177470 - RNA, 21 nt, Human
augaaucccacccacauguga

SEQ ID NO: 2177471 - RNA, 15 nt, Human
augaaucgcuucucu

SEQ ID NO: 2177472 - RNA, 18 nt, Human
augaaucccacccacaug

SEQ ID NO: 2177473 - RNA, 22 nt, Human
augaagcagcuuuaaacaaauu

SEQ ID NO: 2177474 - RNA, 17 nt, Human
augaaucgcuucucuuu

SEQ ID NO: 2177475 - RNA, 20 nt, Human
augaaucgcuucucuuuuga

SEQ ID NO: 2177476 - RNA, 14 nt, Human
augaaucuaagcag

SEQ ID NO: 2177477 - RNA, 16 nt, Human
augaaucuaagcagca

SEQ ID NO: 2177478 - RNA, 11 nt, Human
augaaucuaug

SEQ ID NO: 2177479 - RNA, 14 nt, Human
augaaucuaugcca

SEQ ID NO: 2177480 - RNA, 21 nt, Human
augaaucuaugccaaagauca

SEQ ID NO: 2177481 - RNA, 16 nt, Human
augaaucuauuauacu

SEQ ID NO: 2177482 - RNA, 16 nt, Human
augaauguaucaggaa

SEQ ID NO: 2177483 - RNA, 16 nt, Human
augaauguaugugcac

SEQ ID NO: 2177484 - RNA, 17 nt, Human
augaauguaugugcacu

SEQ ID NO: 2177485 - RNA, 18 nt, Human
augaauguaugugcacug

SEQ ID NO: 2177486 - RNA, 15 nt, Human
augaauguaucagga

SEQ ID NO: 2177487 - RNA, 16 nt, Human
augaaucuuuuccacu

SEQ ID NO: 2177488 - RNA, 14 nt, Human
augaaugaaugaau

SEQ ID NO: 2177489 - RNA, 20 nt, Human
augaauguauuuauuuggga

SEQ ID NO: 2177490 - RNA, 19 nt, Human
augaauguaugugcacugu

SEQ ID NO: 2177491 - RNA, 17 nt, Human
augaauguauuuauuug

SEQ ID NO: 2177492 - RNA, 15 nt, Human
augaauguauuuauu

SEQ ID NO: 2177493 - RNA, 17 nt, Human
augaaugaaacauuuug

SEQ ID NO: 2177494 - RNA, 23 nt, Human
augaaucuauuauacuguauuaa

SEQ ID NO: 2177495 - RNA, 18 nt, Human
augaaucuauuauacugu

SEQ ID NO: 2177496 - RNA, 14 nt, Human
augaagcaaacaca

SEQ ID NO: 2177497 - RNA, 19 nt, Human
augaagauucuccugugcu

SEQ ID NO: 2177498 - RNA, 22 nt, Human
augaagauguuucaaaaaaucu

SEQ ID NO: 2177499 - RNA, 21 nt, Human
augaagaugucuaauaguuau

SEQ ID NO: 2177500 - RNA, 14 nt, Human
augaagcaaugcuu

SEQ ID NO: 2177501 - RNA, 22 nt, Human
augaagaaaagugggccagugu

SEQ ID NO: 2177502 - RNA, 21 nt, Human
augaagaaaagugggccagug

SEQ ID NO: 2177503 - RNA, 19 nt, Human
augaagaaaaucacuuagg

SEQ ID NO: 2177504 - RNA, 14 nt, Human
augaagaaagugga

SEQ ID NO: 2177505 - RNA, 14 nt, Human
augaagaacugagg

SEQ ID NO: 2177506 - RNA, 17 nt, Human
augaaccuucuggccuc

SEQ ID NO: 2177507 - RNA, 14 nt, Human
augaaccuucuggc

SEQ ID NO: 2177508 - RNA, 23 nt, Human
augaaccucaagcugcaucuaga

SEQ ID NO: 2177509 - RNA, 17 nt, Human
augaaccgcugaauaug

SEQ ID NO: 2177510 - RNA, 13 nt, Human
augaaccuggagg

SEQ ID NO: 2177511 - RNA, 16 nt, Human
augaacacuuaauaaa

SEQ ID NO: 2177512 - RNA, 21 nt, Human
augaacccaggacgcuucuga

SEQ ID NO: 2177513 - RNA, 22 nt, Human
augaacccaggacgcuucugaa

SEQ ID NO: 2177514 - RNA, 19 nt, Human
augaagaaaagugggccag

SEQ ID NO: 2177515 - RNA, 22 nt, Human
augaagaaaaaauacauuuuau

SEQ ID NO: 2177516 - RNA, 20 nt, Human
augaagaaaaaauacauuuu

SEQ ID NO: 2177517 - RNA, 19 nt, Human
augaagaaaaaauacauuu

SEQ ID NO: 2177518 - RNA, 17 nt, Human
augaagaaaaaauacau

SEQ ID NO: 2177519 - RNA, 15 nt, Human
augaagaaaaaauac

SEQ ID NO: 2177520 - RNA, 17 nt, Human
augaaccuggagggcua

SEQ ID NO: 2177521 - RNA, 17 nt, Human
augaacuuucucuucau

SEQ ID NO: 2177522 - RNA, 18 nt, Human
augaacuuguaaaggaau

SEQ ID NO: 2177523 - RNA, 14 nt, Human
augaaauaaagaaa

SEQ ID NO: 2177524 - RNA, 20 nt, Human
augaaauaacuccuucuugu

SEQ ID NO: 2177525 - RNA, 22 nt, Human
augaaauaacuccuucuuguag

SEQ ID NO: 2177526 - RNA, 16 nt, Human
uuggaggccuuuagau

SEQ ID NO: 2177527 - RNA, 15 nt, Human
uuggaggccagccag

SEQ ID NO: 2177528 - RNA, 21 nt, Human
uuggagcuuuuuucuuuaaga

SEQ ID NO: 2177529 - RNA, 14 nt, Human
uuggagcuucaugg

SEQ ID NO: 2177530 - RNA, 18 nt, Human
uuggagccugcagagcug

SEQ ID NO: 2177531 - RNA, 14 nt, Human
uuggagccugcagg

SEQ ID NO: 2177532 - RNA, 14 nt, Human
uuggagcugagccu

SEQ ID NO: 2177533 - RNA, 16 nt, Human
uuggccaucucuggau

SEQ ID NO: 2177534 - RNA, 16 nt, Human
uuggcccaagcucuug

SEQ ID NO: 2177535 - RNA, 23 nt, Human
augaaccacaucuugcucugcug

SEQ ID NO: 2177536 - RNA, 22 nt, Human
augaaccacaucuugcucugcu

SEQ ID NO: 2177537 - RNA, 15 nt, Human
augaacacacugugu

SEQ ID NO: 2177538 - RNA, 22 nt, Human
augaacacacuguguccuggug

SEQ ID NO: 2177539 - RNA, 13 nt, Human
augaacacacugu

SEQ ID NO: 2177540 - RNA, 15 nt, Human
augaacaaauugaac

SEQ ID NO: 2177541 - RNA, 18 nt, Human
augaacaaauugaacucu

SEQ ID NO: 2177542 - RNA, 19 nt, Human
augaaauaucagacuagug

SEQ ID NO: 2177543 - RNA, 15 nt, Human
augaaauaucuguau

SEQ ID NO: 2177544 - RNA, 13 nt, Human
augaaauaucaga

SEQ ID NO: 2177545 - RNA, 13 nt, Human
augaaauaugcau

SEQ ID NO: 2177546 - RNA, 15 nt, Human
augaaauaugcaucu

SEQ ID NO: 2177547 - RNA, 22 nt, Human
augaaauacuguuugagguuuu

SEQ ID NO: 2177548 - RNA, 17 nt, Human
augaaauacuauuuaaa

SEQ ID NO: 2177549 - RNA, 19 nt, Human
augaaauacacaaguaaac

SEQ ID NO: 2177550 - RNA, 20 nt, Human
augaaauacacaaguaaaca

SEQ ID NO: 2177551 - RNA, 20 nt, Human
augaaauuuuccaaugucug

SEQ ID NO: 2177552 - RNA, 21 nt, Human
augaaauuuaauauagcuauu

SEQ ID NO: 2177553 - RNA, 22 nt, Human
augaaauuuucuagacuuucug

SEQ ID NO: 2177554 - RNA, 19 nt, Human
augaaauuuucuagacuuu

SEQ ID NO: 2177555 - RNA, 21 nt, Human
augaaauuuucuagacuuucu

SEQ ID NO: 2177556 - RNA, 23 nt, Human
augaaauuuucuagacuuucugu

SEQ ID NO: 2177557 - RNA, 13 nt, Human
uugguguugacau

SEQ ID NO: 2177558 - RNA, 16 nt, Human
uugguguguggagaug

SEQ ID NO: 2177559 - RNA, 18 nt, Human
uugguuugcagaugacaa

SEQ ID NO: 2177560 - RNA, 20 nt, Human
uugguuuggccaucucugga

SEQ ID NO: 2177561 - RNA, 14 nt, Human
uugguuuguaaauu

SEQ ID NO: 2177562 - RNA, 12 nt, Human
uuggugguuuuu

SEQ ID NO: 2177563 - RNA, 20 nt, Human
uugguguaaagccaacaccc

SEQ ID NO: 2177564 - RNA, 17 nt, Human
uuggugucgggcaugac

SEQ ID NO: 2177565 - RNA, 18 nt, Human
uuggugucgggcaugaca

SEQ ID NO: 2177566 - RNA, 19 nt, Human
uuggugucgggcaugacac

SEQ ID NO: 2177567 - RNA, 14 nt, Human
uuggguggagaagc

SEQ ID NO: 2177568 - RNA, 15 nt, Human
uuggguggagaagcc

SEQ ID NO: 2177569 - RNA, 16 nt, Human
uuggguggagaagcca

SEQ ID NO: 2177570 - RNA, 17 nt, Human
uuggguggagaagccau

SEQ ID NO: 2177571 - RNA, 18 nt, Human
uuggguggagaagccauu

SEQ ID NO: 2177572 - RNA, 19 nt, Human
uuggguggagaagccauug

SEQ ID NO: 2177573 - RNA, 16 nt, Human
uugggguuuuuuaaua

SEQ ID NO: 2177574 - RNA, 14 nt, Human
uuggguccuggguc

SEQ ID NO: 2177575 - RNA, 19 nt, Human
uuggugguuucagaaaugu

SEQ ID NO: 2177576 - RNA, 18 nt, Human
uuggugguuucagaaaug

SEQ ID NO: 2177577 - RNA, 19 nt, Human
uugggucaccccuccagga

SEQ ID NO: 2177578 - RNA, 14 nt, Human
uuggguaggcggga

SEQ ID NO: 2177579 - RNA, 18 nt, Human
uuggguaccuauuuucau

SEQ ID NO: 2177580 - RNA, 20 nt, Human
uugggguggguauaaaagau

SEQ ID NO: 2177581 - RNA, 15 nt, Human
uugggguuguguugu

SEQ ID NO: 2177582 - RNA, 16 nt, Human
uugggguuguguuguc

SEQ ID NO: 2177583 - RNA, 18 nt, Human
uugggguggguauaaaag

SEQ ID NO: 2177584 - RNA, 16 nt, Human
augaaugucaguguga

SEQ ID NO: 2177585 - RNA, 18 nt, Human
augaaugucagugugacu

SEQ ID NO: 2177586 - RNA, 13 nt, Human
uugguuuugacug

SEQ ID NO: 2177587 - RNA, 13 nt, Human
uuguaaauuguca

SEQ ID NO: 2177588 - RNA, 14 nt, Human
uuguaacagacauu

SEQ ID NO: 2177589 - RNA, 15 nt, Human
uuguaacagacauug

SEQ ID NO: 2177590 - RNA, 19 nt, Human
uuguaaauuuaugugaugg

SEQ ID NO: 2177591 - RNA, 15 nt, Human
uugguuuugacugga

SEQ ID NO: 2177592 - RNA, 15 nt, Human
uuguaagaguguaga

SEQ ID NO: 2177593 - RNA, 20 nt, Human
uuguaagaguggaaccaaca

SEQ ID NO: 2177594 - RNA, 22 nt, Human
uuguaagacaaagguuuuccuc

SEQ ID NO: 2177595 - RNA, 16 nt, Human
uuguaagacaauccau

SEQ ID NO: 2177596 - RNA, 19 nt, Human
uuguaagacaauccaugua

SEQ ID NO: 2177597 - RNA, 17 nt, Human
uuguaagaaauacugua

SEQ ID NO: 2177598 - RNA, 21 nt, Human
uuguaagacaaagguuuuccu

SEQ ID NO: 2177599 - RNA, 18 nt, Human
uuguaagacaaagguuuu

SEQ ID NO: 2177600 - RNA, 22 nt, Human
uuguaacccagauuuugcugua

SEQ ID NO: 2177601 - RNA, 14 nt, Human
uuguaaccucagcu

SEQ ID NO: 2177602 - RNA, 15 nt, Human
uuguaaccucagcuc

SEQ ID NO: 2177603 - RNA, 16 nt, Human
uuguaacccagauuuu

SEQ ID NO: 2177604 - RNA, 16 nt, Human
uuguaacagacauugu

SEQ ID NO: 2177605 - RNA, 17 nt, Human
uuguaacagacauuguu

SEQ ID NO: 2177606 - RNA, 15 nt, Human
uuguaacguugcugu

SEQ ID NO: 2177607 - RNA, 16 nt, Human
uuguaacguugcugug

SEQ ID NO: 2177608 - RNA, 19 nt, Human
uuguaacguugcuguggga

SEQ ID NO: 2177609 - RNA, 16 nt, Human
uuguaaccucagcucu

SEQ ID NO: 2177610 - RNA, 18 nt, Human
uuguaaccucagcucugg

SEQ ID NO: 2177611 - RNA, 19 nt, Human
uuguaaccucagcucuggg

SEQ ID NO: 2177612 - RNA, 20 nt, Human
uuguaaccucagcucuggga

SEQ ID NO: 2177613 - RNA, 20 nt, Human
uuguaaucguuaugugugua

SEQ ID NO: 2177614 - RNA, 15 nt, Human
uuguaaucguuaugu

SEQ ID NO: 2177615 - RNA, 14 nt, Human
uuguaaucacuguu

SEQ ID NO: 2177616 - RNA, 12 nt, Human
uuguaaugaaaa

SEQ ID NO: 2177617 - RNA, 12 nt, Human
uuguaauuauug

SEQ ID NO: 2177618 - RNA, 14 nt, Human
uuguaauucuaaau

SEQ ID NO: 2177619 - RNA, 17 nt, Human
uuguaauucuaaaugaa

SEQ ID NO: 2177620 - RNA, 14 nt, Human
uuguaauuauugug

SEQ ID NO: 2177621 - RNA, 18 nt, Human
uuguaauuauugugauuu

SEQ ID NO: 2177622 - RNA, 23 nt, Human
uuguaauuuaaacaggcccagca

SEQ ID NO: 2177623 - RNA, 21 nt, Human
uuguaauuuaaacaggcccag

SEQ ID NO: 2177624 - RNA, 22 nt, Human
uuguaauuuaaacaggcccagc

SEQ ID NO: 2177625 - RNA, 23 nt, Human
uuguaauucuaaaugaauguuua

SEQ ID NO: 2177626 - RNA, 19 nt, Human
uuguaauugcuuacauuuu

SEQ ID NO: 2177627 - RNA, 17 nt, Human
uuguaauugcuuacauu

SEQ ID NO: 2177628 - RNA, 18 nt, Human
uuguaauugcuuacauuu

SEQ ID NO: 2177629 - RNA, 13 nt, Human
uuguaagaugcug

SEQ ID NO: 2177630 - RNA, 15 nt, Human
uuguaagaugcuggg

SEQ ID NO: 2177631 - RNA, 17 nt, Human
uuguaagaguguagaag

SEQ ID NO: 2177632 - RNA, 19 nt, Human
uuguaagaguguagaagca

SEQ ID NO: 2177633 - RNA, 21 nt, Human
uuguaagaguguagaagcauu

SEQ ID NO: 2177634 - RNA, 22 nt, Human
uuguaagaguguagaagcauuc

SEQ ID NO: 2177635 - RNA, 13 nt, Human
uuguaaguuucag

SEQ ID NO: 2177636 - RNA, 17 nt, Human
uuguaagaugcuggguu

SEQ ID NO: 2177637 - RNA, 16 nt, Human
uuguaaguuucaggug

SEQ ID NO: 2177638 - RNA, 17 nt, Human
uuguaaguuucagguga

SEQ ID NO: 2177639 - RNA, 18 nt, Human
uuguaaguuucaggugac

SEQ ID NO: 2177640 - RNA, 19 nt, Human
uuguaaguuucaggugaca

SEQ ID NO: 2177641 - RNA, 22 nt, Human
uuguaaguuucaggugacaugu

SEQ ID NO: 2177642 - RNA, 21 nt, Human
uucauggggugaugcugggcu

SEQ ID NO: 2177643 - RNA, 13 nt, Human
auaugugaacauu

SEQ ID NO: 2177644 - RNA, 17 nt, Human
uucauggcagaaggcaa

SEQ ID NO: 2177645 - RNA, 18 nt, Human
uucauguaaacugugcac

SEQ ID NO: 2177646 - RNA, 17 nt, Human
uucauguaaacugugca

SEQ ID NO: 2177647 - RNA, 14 nt, Human
uucauguaaacugu

SEQ ID NO: 2177648 - RNA, 19 nt, Human
uucauggugaaaauguacu

SEQ ID NO: 2177649 - RNA, 19 nt, Human
uucauguaaacaaaauuua

SEQ ID NO: 2177650 - RNA, 17 nt, Human
uucauguacaagaugaa

SEQ ID NO: 2177651 - RNA, 22 nt, Human
uucaugucaacuucuggcuccu

SEQ ID NO: 2177652 - RNA, 21 nt, Human
uucauguacaagaugaaggag

SEQ ID NO: 2177653 - RNA, 18 nt, Human
uucauguaauccucaaga

SEQ ID NO: 2177654 - RNA, 19 nt, Human
uucauguaaacugugcacc

SEQ ID NO: 2177655 - RNA, 14 nt, Human
auaugucagggcgu

SEQ ID NO: 2177656 - RNA, 11 nt, Human
auauguccugg

SEQ ID NO: 2177657 - RNA, 16 nt, Human
auaugugaacauuuau

SEQ ID NO: 2177658 - RNA, 14 nt, Human
auaugucaagccau

SEQ ID NO: 2177659 - RNA, 14 nt, Human
auauguauuguaaa

SEQ ID NO: 2177660 - RNA, 21 nt, Human
auauguauuguaaacaugugu

SEQ ID NO: 2177661 - RNA, 16 nt, Human
auaugcaaugugaagc

SEQ ID NO: 2177662 - RNA, 13 nt, Human
auaugcacacauu

SEQ ID NO: 2177663 - RNA, 15 nt, Human
auauguaugugugua

SEQ ID NO: 2177664 - RNA, 16 nt, Human
auauguauguguguau

SEQ ID NO: 2177665 - RNA, 16 nt, Human
auauguauuaauauuc

SEQ ID NO: 2177666 - RNA, 19 nt, Human
auaugcacacagugcuuuc

SEQ ID NO: 2177667 - RNA, 15 nt, Human
auaugcacaauagca

SEQ ID NO: 2177668 - RNA, 20 nt, Human
auaugauuuaaaacauguaa

SEQ ID NO: 2177669 - RNA, 15 nt, Human
auaugauuuaaaaca

SEQ ID NO: 2177670 - RNA, 16 nt, Human
auaugauuuaaaacau

SEQ ID NO: 2177671 - RNA, 23 nt, Human
auaugcaaagcacugacuucuaa

SEQ ID NO: 2177672 - RNA, 13 nt, Human
auaugauuuaaaa

SEQ ID NO: 2177673 - RNA, 15 nt, Human
auaugauucugcuuu

SEQ ID NO: 2177674 - RNA, 16 nt, Human
auaugcaaagcacuga

SEQ ID NO: 2177675 - RNA, 19 nt, Human
auaucuucugauuuguccc

SEQ ID NO: 2177676 - RNA, 15 nt, Human
auaucuugaaaugaa

SEQ ID NO: 2177677 - RNA, 20 nt, Human
auaugauuuaaaucagccgu

SEQ ID NO: 2177678 - RNA, 12 nt, Human
auaucugcuguc

SEQ ID NO: 2177679 - RNA, 13 nt, Human
auaucugcugucc

SEQ ID NO: 2177680 - RNA, 18 nt, Human
auaucugcuguccagaca

SEQ ID NO: 2177681 - RNA, 23 nt, Human
auaucugccuuuauuguguuugu

SEQ ID NO: 2177682 - RNA, 11 nt, Human
auaucugcugu

SEQ ID NO: 2177683 - RNA, 17 nt, Human
auaucugggauucuacu

SEQ ID NO: 2177684 - RNA, 21 nt, Human
auaucugggauucuacuuuaa

SEQ ID NO: 2177685 - RNA, 13 nt, Human
auaucugcuucag

SEQ ID NO: 2177686 - RNA, 16 nt, Human
auaucugcuucagugg

SEQ ID NO: 2177687 - RNA, 15 nt, Human
auaucuggacaagcc

SEQ ID NO: 2177688 - RNA, 20 nt, Human
auaucuguauuuaauuuuga

SEQ ID NO: 2177689 - RNA, 15 nt, Human
auaucuguauauaaa

SEQ ID NO: 2177690 - RNA, 18 nt, Human
auaucuguauuuaauuuu

SEQ ID NO: 2177691 - RNA, 24 nt, Human
auaucuguauuuaauuuugacacu

SEQ ID NO: 2177692 - RNA, 14 nt, Human
auaucuaucuuaua

SEQ ID NO: 2177693 - RNA, 13 nt, Human
auaucuaucuuau

SEQ ID NO: 2177694 - RNA, 21 nt, Human
auaucuaucuuauauaguuua

SEQ ID NO: 2177695 - RNA, 20 nt, Human
auaucuaucuuauauaguuu

SEQ ID NO: 2177696 - RNA, 22 nt, Human
auaucugaaaauguauguguaa

SEQ ID NO: 2177697 - RNA, 14 nt, Human
auaucugccuuuau

SEQ ID NO: 2177698 - RNA, 16 nt, Human
auaucugccuuuauug

SEQ ID NO: 2177699 - RNA, 18 nt, Human
auaucugccuuuauugug

SEQ ID NO: 2177700 - RNA, 20 nt, Human
auaucugccuuuauuguguu

SEQ ID NO: 2177701 - RNA, 15 nt, Human
auaucugaaauguga

SEQ ID NO: 2177702 - RNA, 14 nt, Human
auauccuuugccuc

SEQ ID NO: 2177703 - RNA, 15 nt, Human
auauauucccaauag

SEQ ID NO: 2177704 - RNA, 17 nt, Human
auaucgacuuguuuuug

SEQ ID NO: 2177705 - RNA, 13 nt, Human
auaucuaaauuga

SEQ ID NO: 2177706 - RNA, 14 nt, Human
auaucuaaauugaa

SEQ ID NO: 2177707 - RNA, 18 nt, Human
auauauucagccuggcuu

SEQ ID NO: 2177708 - RNA, 20 nt, Human
auaucuaauuauuuugcagu

SEQ ID NO: 2177709 - RNA, 17 nt, Human
auaucuaaauugaauaa

SEQ ID NO: 2177710 - RNA, 18 nt, Human
auaucuaaauugaauaau

SEQ ID NO: 2177711 - RNA, 14 nt, Human
auaucuaaauuuag

SEQ ID NO: 2177712 - RNA, 22 nt, Human
auaucuaaauugaauaauggua

SEQ ID NO: 2177713 - RNA, 18 nt, Human
uucaucauccuaagcuau

SEQ ID NO: 2177714 - RNA, 21 nt, Human
uucaucauccuaagcuauuca

SEQ ID NO: 2177715 - RNA, 16 nt, Human
uucauccaauccucac

SEQ ID NO: 2177716 - RNA, 22 nt, Human
uucauccaauccucacugggug

SEQ ID NO: 2177717 - RNA, 21 nt, Human
uucauccaauccucacugggu

SEQ ID NO: 2177718 - RNA, 20 nt, Human
uucauccaauccucacuggg

SEQ ID NO: 2177719 - RNA, 18 nt, Human
uucauccaauccucacug

SEQ ID NO: 2177720 - RNA, 18 nt, Human
auauauguuuuugaaggc

SEQ ID NO: 2177721 - RNA, 15 nt, Human
uucauccacuagugc

SEQ ID NO: 2177722 - RNA, 16 nt, Human
auauauuaaaaauaua

SEQ ID NO: 2177723 - RNA, 17 nt, Human
auauauuaaaaauauaa

SEQ ID NO: 2177724 - RNA, 18 nt, Human
auauauuaaaaauauaaa

SEQ ID NO: 2177725 - RNA, 22 nt, Human
auauauuaaaaauauaaaacug

SEQ ID NO: 2177726 - RNA, 16 nt, Human
uucaguauaauuuaac

SEQ ID NO: 2177727 - RNA, 17 nt, Human
uucaguaccuggaggag

SEQ ID NO: 2177728 - RNA, 15 nt, Human
uucaguaccuggagg

SEQ ID NO: 2177729 - RNA, 16 nt, Human
uucaguaccuggagga

SEQ ID NO: 2177730 - RNA, 23 nt, Human
uucaguaccuggaggaggagcag

SEQ ID NO: 2177731 - RNA, 23 nt, Human
uucaguauaauuuaacuucagag

SEQ ID NO: 2177732 - RNA, 20 nt, Human
uucaguauaauuuaacuuca

SEQ ID NO: 2177733 - RNA, 19 nt, Human
uucaguauguugucaaaga

SEQ ID NO: 2177734 - RNA, 17 nt, Human
uucaguauuuuggagaa

SEQ ID NO: 2177735 - RNA, 16 nt, Human
uucauagacccucuca

SEQ ID NO: 2177736 - RNA, 17 nt, Human
uucaguauguugucaaa

SEQ ID NO: 2177737 - RNA, 14 nt, Human
uucauacucuagau

SEQ ID NO: 2177738 - RNA, 17 nt, Human
uucauacucuagauuuu

SEQ ID NO: 2177739 - RNA, 19 nt, Human
uucauaccuacauguauuu

SEQ ID NO: 2177740 - RNA, 16 nt, Human
uucauaccuacaugua

SEQ ID NO: 2177741 - RNA, 21 nt, Human
uucauauuuacuucuuauaca

SEQ ID NO: 2177742 - RNA, 16 nt, Human
uucauauuuacuucuu

SEQ ID NO: 2177743 - RNA, 19 nt, Human
uucauagggucucuucagg

SEQ ID NO: 2177744 - RNA, 14 nt, Human
uucauagauuuccu

SEQ ID NO: 2177745 - RNA, 19 nt, Human
uucauagcuaagaaauaaa

SEQ ID NO: 2177746 - RNA, 13 nt, Human
uucauagcccagu

SEQ ID NO: 2177747 - RNA, 17 nt, Human
uucauagacccucucaa

SEQ ID NO: 2177748 - RNA, 13 nt, Human
uucagggucauag

SEQ ID NO: 2177749 - RNA, 22 nt, Human
uucagggggguugugaggccug

SEQ ID NO: 2177750 - RNA, 22 nt, Human
uucagggggccaggugcacaga

SEQ ID NO: 2177751 - RNA, 23 nt, Human
uucaggggcugcccgcucccagu

SEQ ID NO: 2177752 - RNA, 21 nt, Human
uucagggggguugugaggccu

SEQ ID NO: 2177753 - RNA, 13 nt, Human
uucagggggccag

SEQ ID NO: 2177754 - RNA, 22 nt, Human
uucaggggcugcccgcucccag

SEQ ID NO: 2177755 - RNA, 23 nt, Human
uucaggggacucagcccugaggu

SEQ ID NO: 2177756 - RNA, 21 nt, Human
uucaggggagucccgucagga

SEQ ID NO: 2177757 - RNA, 14 nt, Human
uucaguaauaacuc

SEQ ID NO: 2177758 - RNA, 21 nt, Human
uucaguacccucucagcucca

SEQ ID NO: 2177759 - RNA, 22 nt, Human
uucaguacccucucagcuccag

SEQ ID NO: 2177760 - RNA, 16 nt, Human
uucaggguccugagau

SEQ ID NO: 2177761 - RNA, 15 nt, Human
uucagggugaugcca

SEQ ID NO: 2177762 - RNA, 20 nt, Human
uucaguaauaaacuguguuu

SEQ ID NO: 2177763 - RNA, 23 nt, Human
uucagccuagccgaccucagccu

SEQ ID NO: 2177764 - RNA, 12 nt, Human
uucagccucugg

SEQ ID NO: 2177765 - RNA, 15 nt, Human
uucagccucuuucug

SEQ ID NO: 2177766 - RNA, 22 nt, Human
uucagccuagccgaccucagcc

SEQ ID NO: 2177767 - RNA, 21 nt, Human
uucagccuagccgaccucagc

SEQ ID NO: 2177768 - RNA, 20 nt, Human
uucagccuagccgaccucag

SEQ ID NO: 2177769 - RNA, 23 nt, Human
uucagcccuaaaucuagacucaa

SEQ ID NO: 2177770 - RNA, 20 nt, Human
uucaggggacucagcccuga

SEQ ID NO: 2177771 - RNA, 19 nt, Human
uucaggggacucagcccug

SEQ ID NO: 2177772 - RNA, 17 nt, Human
uucaggggacucagccc

SEQ ID NO: 2177773 - RNA, 16 nt, Human
uucaggggacucagcc

SEQ ID NO: 2177774 - RNA, 18 nt, Human
uucagggcagggcucuga

SEQ ID NO: 2177775 - RNA, 22 nt, Human
uucagggaauuucaggaacuag

SEQ ID NO: 2177776 - RNA, 13 nt, Human
auauaaacacuau

SEQ ID NO: 2177777 - RNA, 15 nt, Human
auauaaacacuauau

SEQ ID NO: 2177778 - RNA, 14 nt, Human
auauaaaccuaaaa

SEQ ID NO: 2177779 - RNA, 19 nt, Human
auauaaaccuaaaaaagau

SEQ ID NO: 2177780 - RNA, 13 nt, Human
auauaaaauauuu

SEQ ID NO: 2177781 - RNA, 16 nt, Human
auaguuuuauuaauaa

SEQ ID NO: 2177782 - RNA, 23 nt, Human
auaguuuuacuuuuaaacugugu

SEQ ID NO: 2177783 - RNA, 21 nt, Human
auauaaaaggcaaauguguac

SEQ ID NO: 2177784 - RNA, 23 nt, Human
auauaaaaggcaaauguguacau

SEQ ID NO: 2177785 - RNA, 15 nt, Human
auauaaaauaaauau

SEQ ID NO: 2177786 - RNA, 16 nt, Human
auauaaaauaaauaua

SEQ ID NO: 2177787 - RNA, 14 nt, Human
auauaaaauaugaa

SEQ ID NO: 2177788 - RNA, 18 nt, Human
auauaaaauaaauauaua

SEQ ID NO: 2177789 - RNA, 21 nt, Human
auauaaaauaaauauauauaa

SEQ ID NO: 2177790 - RNA, 24 nt, Human
auauaaaauaaauauauauaaacc

SEQ ID NO: 2177791 - RNA, 17 nt, Human
auauaaauauauauaaa

SEQ ID NO: 2177792 - RNA, 20 nt, Human
auauaaaccuaaaaaagaua

SEQ ID NO: 2177793 - RNA, 21 nt, Human
auauaaaccuaaaaaagauau

SEQ ID NO: 2177794 - RNA, 16 nt, Human
auauaaauauuagaaa

SEQ ID NO: 2177795 - RNA, 22 nt, Human
auauaaauauuagaaacagcuu

SEQ ID NO: 2177796 - RNA, 23 nt, Human
auauaaauauauauauauauaaa

SEQ ID NO: 2177797 - RNA, 20 nt, Human
auauaaauauauauaaauau

SEQ ID NO: 2177798 - RNA, 21 nt, Human
auauaaauauauauaaauaua

SEQ ID NO: 2177799 - RNA, 17 nt, Human
auauaaaugguuaaaag

SEQ ID NO: 2177800 - RNA, 23 nt, Human
auauaaauggcugguuuuuagaa

SEQ ID NO: 2177801 - RNA, 22 nt, Human
auauaaaugcaauauuaaugcc

SEQ ID NO: 2177802 - RNA, 14 nt, Human
auaguuucagauau

SEQ ID NO: 2177803 - RNA, 21 nt, Human
auaguuucagauauauaucau

SEQ ID NO: 2177804 - RNA, 17 nt, Human
auaguccagcuuuguuc

SEQ ID NO: 2177805 - RNA, 22 nt, Human
auaguuuuacuuuuaaacugug

SEQ ID NO: 2177806 - RNA, 21 nt, Human
auaguuuuacuuuuaaacugu

SEQ ID NO: 2177807 - RNA, 15 nt, Human
auaguuuuacuuuua

SEQ ID NO: 2177808 - RNA, 13 nt, Human
auaguuuguacau

SEQ ID NO: 2177809 - RNA, 15 nt, Human
auaguuuguacaugc

SEQ ID NO: 2177810 - RNA, 16 nt, Human
auagggucucuucagg

SEQ ID NO: 2177811 - RNA, 22 nt, Human
auagggccuggucccugggagg

SEQ ID NO: 2177812 - RNA, 21 nt, Human
auagggucucuucagguucuu

SEQ ID NO: 2177813 - RNA, 21 nt, Human
auagucaagaaaaauuauugu

SEQ ID NO: 2177814 - RNA, 14 nt, Human
auagucacaagagc

SEQ ID NO: 2177815 - RNA, 22 nt, Human
auagucauguaagcugaaaaua

SEQ ID NO: 2177816 - RNA, 19 nt, Human
auagucaauguuucuuuua

SEQ ID NO: 2177817 - RNA, 22 nt, Human
auagucaagaaaaauuauugua

SEQ ID NO: 2177818 - RNA, 17 nt, Human
auagucaaauuguguga

SEQ ID NO: 2177819 - RNA, 18 nt, Human
auagucaaauugugugaa

SEQ ID NO: 2177820 - RNA, 18 nt, Human
auauaaauggcugguuuu

SEQ ID NO: 2177821 - RNA, 22 nt, Human
auauaaaugcuuuuaaaaaucu

SEQ ID NO: 2177822 - RNA, 15 nt, Human
auauaaauggcuggu

SEQ ID NO: 2177823 - RNA, 17 nt, Human
auauaaauuuuuuuugu

SEQ ID NO: 2177824 - RNA, 22 nt, Human
auauaaauuuuuuuuguuucau

SEQ ID NO: 2177825 - RNA, 12 nt, Human
auauaacaaugc

SEQ ID NO: 2177826 - RNA, 15 nt, Human
auauaacaaugcugu

SEQ ID NO: 2177827 - RNA, 23 nt, Human
auauaaggaaagcaauaaaugaa

SEQ ID NO: 2177828 - RNA, 14 nt, Human
auauaagaauaaaa

SEQ ID NO: 2177829 - RNA, 17 nt, Human
auauaacaaugcuguau

SEQ ID NO: 2177830 - RNA, 19 nt, Human
auauaagcuuguauuccuu

SEQ ID NO: 2177831 - RNA, 16 nt, Human
auauauacaguaacuu

SEQ ID NO: 2177832 - RNA, 10 nt, Human
auauauaaaa

SEQ ID NO: 2177833 - RNA, 18 nt, Human
auauauacaguaacuuua

SEQ ID NO: 2177834 - RNA, 19 nt, Human
auauauaaaaagaaaagau

SEQ ID NO: 2177835 - RNA, 19 nt, Human
auauauaacaaugcuguau

SEQ ID NO: 2177836 - RNA, 17 nt, Human
auauauaacaaugcugu

SEQ ID NO: 2177837 - RNA, 18 nt, Human
auauauaacaaugcugua

SEQ ID NO: 2177838 - RNA, 23 nt, Human
auauagguuuuguuugcuaucuu

SEQ ID NO: 2177839 - RNA, 16 nt, Human
auauaguuuacuauuu

SEQ ID NO: 2177840 - RNA, 12 nt, Human
auauaguuuuac

SEQ ID NO: 2177841 - RNA, 23 nt, Human
auauaguuuuacuuuuaaacugu

SEQ ID NO: 2177842 - RNA, 18 nt, Human
auauaguuuuacuuuuaa

SEQ ID NO: 2177843 - RNA, 16 nt, Human
auauaguuuuacuuuu

SEQ ID NO: 2177844 - RNA, 13 nt, Human
auauaguuuuacu

SEQ ID NO: 2177845 - RNA, 14 nt, Human
auauagguuuuguu

SEQ ID NO: 2177846 - RNA, 22 nt, Human
auauagguugugcaaauuaaca

SEQ ID NO: 2177847 - RNA, 15 nt, Human
auauagguugugcaa

SEQ ID NO: 2177848 - RNA, 16 nt, Human
auauagguugugcaaa

SEQ ID NO: 2177849 - RNA, 18 nt, Human
auauagguuuuguuugcu

SEQ ID NO: 2177850 - RNA, 19 nt, Human
auauagguuuuguuugcua

SEQ ID NO: 2177851 - RNA, 20 nt, Human
auauagguuuuguuugcuau

SEQ ID NO: 2177852 - RNA, 21 nt, Human
auauagguuuuguuugcuauc

SEQ ID NO: 2177853 - RNA, 23 nt, Human
uucagaaguuuggcaauaguuug

SEQ ID NO: 2177854 - RNA, 15 nt, Human
uucagaaucacuucu

SEQ ID NO: 2177855 - RNA, 20 nt, Human
uucagaaguuuggcaauagu

SEQ ID NO: 2177856 - RNA, 12 nt, Human
uucagaagagau

SEQ ID NO: 2177857 - RNA, 21 nt, Human
uucagaagugagcuuugcugc

SEQ ID NO: 2177858 - RNA, 16 nt, Human
uucagaaggggagggg

SEQ ID NO: 2177859 - RNA, 22 nt, Human
uucagaagugagcuuugcugcu

SEQ ID NO: 2177860 - RNA, 23 nt, Human
uucagaagugagcuuugcugcua

SEQ ID NO: 2177861 - RNA, 15 nt, Human
uucagaaagaagugg

SEQ ID NO: 2177862 - RNA, 13 nt, Human
uucagaaagcauu

SEQ ID NO: 2177863 - RNA, 19 nt, Human
uucagaaagcauuacauuu

SEQ ID NO: 2177864 - RNA, 18 nt, Human
uucacuguauaaauagga

SEQ ID NO: 2177865 - RNA, 19 nt, Human
uucacuguauaaauaggag

SEQ ID NO: 2177866 - RNA, 21 nt, Human
uucagaaaauauuauguguuu

SEQ ID NO: 2177867 - RNA, 13 nt, Human
uucacuggcccaa

SEQ ID NO: 2177868 - RNA, 20 nt, Human
uucacuguaagacucauucc

SEQ ID NO: 2177869 - RNA, 22 nt, Human
uucacuguagaaugauuucaug

SEQ ID NO: 2177870 - RNA, 15 nt, Human
uucacuguagaauga

SEQ ID NO: 2177871 - RNA, 20 nt, Human
uucacuggccacaguuguuu

SEQ ID NO: 2177872 - RNA, 17 nt, Human
uucacuggaguuacauu

SEQ ID NO: 2177873 - RNA, 19 nt, Human
uucacuggaguuacauuaa

SEQ ID NO: 2177874 - RNA, 13 nt, Human
uucagaaaauauu

SEQ ID NO: 2177875 - RNA, 13 nt, Human
uucacuguauaaa

SEQ ID NO: 2177876 - RNA, 15 nt, Human
uucacuguauaaaua

SEQ ID NO: 2177877 - RNA, 16 nt, Human
uucacuguauaaauag

SEQ ID NO: 2177878 - RNA, 14 nt, Human
uucagaaaauauua

SEQ ID NO: 2177879 - RNA, 20 nt, Human
uucagaaaauauuauguguu

SEQ ID NO: 2177880 - RNA, 14 nt, Human
auauauacauauau

SEQ ID NO: 2177881 - RNA, 20 nt, Human
auauauacaguaacuuuaug

SEQ ID NO: 2177882 - RNA, 21 nt, Human
auauauacaguaacuuuaugu

SEQ ID NO: 2177883 - RNA, 23 nt, Human
auauauacaguaacuuuaugugu

SEQ ID NO: 2177884 - RNA, 22 nt, Human
auauauacauagcaugacauuu

SEQ ID NO: 2177885 - RNA, 13 nt, Human
auauauagaaucu

SEQ ID NO: 2177886 - RNA, 11 nt, Human
auauauauaaa

SEQ ID NO: 2177887 - RNA, 12 nt, Human
auauauauaaac

SEQ ID NO: 2177888 - RNA, 13 nt, Human
auauauauaaacc

SEQ ID NO: 2177889 - RNA, 14 nt, Human
auauauauaaaccu

SEQ ID NO: 2177890 - RNA, 13 nt, Human
uucacugccccca

SEQ ID NO: 2177891 - RNA, 16 nt, Human
uucacugccuuugcuc

SEQ ID NO: 2177892 - RNA, 12 nt, Human
uucacugcugca

SEQ ID NO: 2177893 - RNA, 13 nt, Human
uucacugcuggcu

SEQ ID NO: 2177894 - RNA, 15 nt, Human
uucacugcuggcugc

SEQ ID NO: 2177895 - RNA, 16 nt, Human
uucacugcuggcugcc

SEQ ID NO: 2177896 - RNA, 17 nt, Human
uucacugcuggcugccu

SEQ ID NO: 2177897 - RNA, 18 nt, Human
uucacugcuggcugccuu

SEQ ID NO: 2177898 - RNA, 19 nt, Human
uucacugcuggcugccuua

SEQ ID NO: 2177899 - RNA, 13 nt, Human
uucacugcugcaa

SEQ ID NO: 2177900 - RNA, 19 nt, Human
uucacugcugcaaggccuu

SEQ ID NO: 2177901 - RNA, 23 nt, Human
uucacugcugcaaggccuuucug

SEQ ID NO: 2177902 - RNA, 16 nt, Human
uucacuggaguuacau

SEQ ID NO: 2177903 - RNA, 23 nt, Human
uucagcaccuacaguguacaguc

SEQ ID NO: 2177904 - RNA, 22 nt, Human
uucagcaccuacaguguacagu

SEQ ID NO: 2177905 - RNA, 16 nt, Human
uucagcaccacccuag

SEQ ID NO: 2177906 - RNA, 14 nt, Human
uucagccaagaauu

SEQ ID NO: 2177907 - RNA, 13 nt, Human
uucagcacugucc

SEQ ID NO: 2177908 - RNA, 19 nt, Human
uucagccaagaauucuuaa

SEQ ID NO: 2177909 - RNA, 23 nt, Human
uucagccccuccucugccaccuc

SEQ ID NO: 2177910 - RNA, 20 nt, Human
uucagccccuccucugccac

SEQ ID NO: 2177911 - RNA, 19 nt, Human
uucagccccuccucugcca

SEQ ID NO: 2177912 - RNA, 18 nt, Human
uucagccccuccucugcc

SEQ ID NO: 2177913 - RNA, 17 nt, Human
uucagccccuccucugc

SEQ ID NO: 2177914 - RNA, 16 nt, Human
uucagccccuccucug

SEQ ID NO: 2177915 - RNA, 15 nt, Human
uucagccccuccucu

SEQ ID NO: 2177916 - RNA, 14 nt, Human
uucagccccuccuc

SEQ ID NO: 2177917 - RNA, 12 nt, Human
uucagcccucac

SEQ ID NO: 2177918 - RNA, 16 nt, Human
uucagcccucaccccu

SEQ ID NO: 2177919 - RNA, 12 nt, Human
uucagccaggag

SEQ ID NO: 2177920 - RNA, 13 nt, Human
uucagccaggagc

SEQ ID NO: 2177921 - RNA, 18 nt, Human
uucagccaccagccccug

SEQ ID NO: 2177922 - RNA, 11 nt, Human
uucagccaagg

SEQ ID NO: 2177923 - RNA, 13 nt, Human
uucagccccuccu

SEQ ID NO: 2177924 - RNA, 20 nt, Human
uucagcccauauuucaucgu

SEQ ID NO: 2177925 - RNA, 13 nt, Human
uucagcccaucuc

SEQ ID NO: 2177926 - RNA, 17 nt, Human
uucagccaggagcuggg

SEQ ID NO: 2177927 - RNA, 21 nt, Human
uucagccaucaacaagaguug

SEQ ID NO: 2177928 - RNA, 19 nt, Human
uucagaaucacuucugaga

SEQ ID NO: 2177929 - RNA, 21 nt, Human
uucagaaucacuucugagaac

SEQ ID NO: 2177930 - RNA, 21 nt, Human
uucagacaagcaacagguuuu

SEQ ID NO: 2177931 - RNA, 20 nt, Human
uucagacaagcaacagguuu

SEQ ID NO: 2177932 - RNA, 15 nt, Human
uucagacaagcaaca

SEQ ID NO: 2177933 - RNA, 17 nt, Human
uucagaucagugcuuga

SEQ ID NO: 2177934 - RNA, 16 nt, Human
uucagaucauggcauc

SEQ ID NO: 2177935 - RNA, 17 nt, Human
uucagaucucuaacuuc

SEQ ID NO: 2177936 - RNA, 19 nt, Human
uucagaugcuucugggaga

SEQ ID NO: 2177937 - RNA, 20 nt, Human
uucagaaagcauuacauuuc

SEQ ID NO: 2177938 - RNA, 15 nt, Human
uucagaugcuucugg

SEQ ID NO: 2177939 - RNA, 20 nt, Human
uucagaugucuucugccugu

SEQ ID NO: 2177940 - RNA, 23 nt, Human
uucagaugucuucugccuguuau

SEQ ID NO: 2177941 - RNA, 14 nt, Human
uucagaugucuucu

SEQ ID NO: 2177942 - RNA, 17 nt, Human
uucagaugucuucugcc

SEQ ID NO: 2177943 - RNA, 18 nt, Human
uucagaugucuucugccu

SEQ ID NO: 2177944 - RNA, 19 nt, Human
uucagaugucuucugccug

SEQ ID NO: 2177945 - RNA, 13 nt, Human
uucagcaagacaa

SEQ ID NO: 2177946 - RNA, 20 nt, Human
uucagcaaacucuuuuccca

SEQ ID NO: 2177947 - RNA, 22 nt, Human
auagcuucaccccaaucccagc

SEQ ID NO: 2177948 - RNA, 19 nt, Human
auagcuugcgcauucucau

SEQ ID NO: 2177949 - RNA, 23 nt, Human
auagcuugcgcauucucauggag

SEQ ID NO: 2177950 - RNA, 14 nt, Human
auagcuuguauagu

SEQ ID NO: 2177951 - RNA, 17 nt, Human
auagcuuguauagugua

SEQ ID NO: 2177952 - RNA, 20 nt, Human
auagcuuguauaguguaaaa

SEQ ID NO: 2177953 - RNA, 21 nt, Human
auagcuucaccccaaucccag

SEQ ID NO: 2177954 - RNA, 22 nt, Human
auagcuuacaagccagcuggag

SEQ ID NO: 2177955 - RNA, 24 nt, Human
uucaccauuuggcaaugccaucau

SEQ ID NO: 2177956 - RNA, 22 nt, Human
uucaccauguuggccaggcugg

SEQ ID NO: 2177957 - RNA, 22 nt, Human
uucaccauguuggccaggcugc

SEQ ID NO: 2177958 - RNA, 23 nt, Human
auagcuuuauuuuuuaaguauuu

SEQ ID NO: 2177959 - RNA, 22 nt, Human
auagcuuuauuuuuuaaguauu

SEQ ID NO: 2177960 - RNA, 21 nt, Human
auaggaauugacccacaagaa

SEQ ID NO: 2177961 - RNA, 21 nt, Human
auagcuuuauuuuuuaaguau

SEQ ID NO: 2177962 - RNA, 19 nt, Human
auagcuuuauuuuuuaagu

SEQ ID NO: 2177963 - RNA, 18 nt, Human
auagcuuuauuuuuuaag

SEQ ID NO: 2177964 - RNA, 10 nt, Human
auagcuuuau

SEQ ID NO: 2177965 - RNA, 19 nt, Human
auaggaacuuaaauaaugu

SEQ ID NO: 2177966 - RNA, 22 nt, Human
auaggccaaacuggcaaacuuc

SEQ ID NO: 2177967 - RNA, 17 nt, Human
auaggcagacuggguuu

SEQ ID NO: 2177968 - RNA, 20 nt, Human
auaggcagacuggguuucua

SEQ ID NO: 2177969 - RNA, 21 nt, Human
auaggcuggagaagcucaccc

SEQ ID NO: 2177970 - RNA, 16 nt, Human
auaggcuggagaagcu

SEQ ID NO: 2177971 - RNA, 18 nt, Human
auaggcuggagaagcuca

SEQ ID NO: 2177972 - RNA, 13 nt, Human
auaggcuggagaa

SEQ ID NO: 2177973 - RNA, 14 nt, Human
auaggcuggagaag

SEQ ID NO: 2177974 - RNA, 15 nt, Human
auagggagaaaccaa

SEQ ID NO: 2177975 - RNA, 14 nt, Human
auagggucuaacuc

SEQ ID NO: 2177976 - RNA, 14 nt, Human
auagggcugagcuc

SEQ ID NO: 2177977 - RNA, 17 nt, Human
auagggcugagcucucu

SEQ ID NO: 2177978 - RNA, 23 nt, Human
auaggaucauuuguuggaaugaa

SEQ ID NO: 2177979 - RNA, 18 nt, Human
auaggaaugugaaagcac

SEQ ID NO: 2177980 - RNA, 22 nt, Human
auaggcaccuaccaccacgccc

SEQ ID NO: 2177981 - RNA, 17 nt, Human
auaggcacaggaaacca

SEQ ID NO: 2177982 - RNA, 19 nt, Human
uucaauaaaguaucuacau

SEQ ID NO: 2177983 - RNA, 14 nt, Human
uucaauaaaguauc

SEQ ID NO: 2177984 - RNA, 14 nt, Human
uucaauaaaguauu

SEQ ID NO: 2177985 - RNA, 18 nt, Human
uucaauaaaguauuuaau

SEQ ID NO: 2177986 - RNA, 19 nt, Human
uucaauaaaguauuuaauu

SEQ ID NO: 2177987 - RNA, 12 nt, Human
uucaauaaagua

SEQ ID NO: 2177988 - RNA, 13 nt, Human
uucaauaaaguau

SEQ ID NO: 2177989 - RNA, 20 nt, Human
uucaauaaagcauuuauaaa

SEQ ID NO: 2177990 - RNA, 23 nt, Human
uucacagcucuguguugccaugu

SEQ ID NO: 2177991 - RNA, 15 nt, Human
uucacagcucugugu

SEQ ID NO: 2177992 - RNA, 17 nt, Human
uucacagcuccucccac

SEQ ID NO: 2177993 - RNA, 21 nt, Human
uucaauaaaguauuuaauuag

SEQ ID NO: 2177994 - RNA, 13 nt, Human
uucacagcuccuc

SEQ ID NO: 2177995 - RNA, 15 nt, Human
uucacagcuccuccc

SEQ ID NO: 2177996 - RNA, 17 nt, Human
uucacauagaugucccu

SEQ ID NO: 2177997 - RNA, 19 nt, Human
uucacauagagaucauccu

SEQ ID NO: 2177998 - RNA, 17 nt, Human
uucacauacccuccccc

SEQ ID NO: 2177999 - RNA, 17 nt, Human
uucacauagagaucauc

SEQ ID NO: 2178000 - RNA, 22 nt, Human
uucacaguguuucgacagcuga

SEQ ID NO: 2178001 - RNA, 18 nt, Human
uucacauaagcucagaau

SEQ ID NO: 2178002 - RNA, 20 nt, Human
uucacauaagcucagaaucc

SEQ ID NO: 2178003 - RNA, 15 nt, Human
uucacauacccuccc

SEQ ID NO: 2178004 - RNA, 19 nt, Human
uucacauaaaauagauuuu

SEQ ID NO: 2178005 - RNA, 12 nt, Human
uucacaguguuu

SEQ ID NO: 2178006 - RNA, 19 nt, Human
uucacaggcgaggccugga

SEQ ID NO: 2178007 - RNA, 10 nt, Human
uucacaggcg

SEQ ID NO: 2178008 - RNA, 18 nt, Human
uucacauccuguguuucu

SEQ ID NO: 2178009 - RNA, 15 nt, Human
uucacauagcugucu

SEQ ID NO: 2178010 - RNA, 19 nt, Human
uucacauuguauucagagu

SEQ ID NO: 2178011 - RNA, 17 nt, Human
uucacauauugauuucc

SEQ ID NO: 2178012 - RNA, 22 nt, Human
uucaccacaugugcacaugcac

SEQ ID NO: 2178013 - RNA, 19 nt, Human
uucacauuuuccuuuucaa

SEQ ID NO: 2178014 - RNA, 18 nt, Human
uucaccagauuugcuaau

SEQ ID NO: 2178015 - RNA, 19 nt, Human
uucaccagaggaaucacuc

SEQ ID NO: 2178016 - RNA, 17 nt, Human
uucacauuuuuguauuu

SEQ ID NO: 2178017 - RNA, 18 nt, Human
uucacauagcugucuaga

SEQ ID NO: 2178018 - RNA, 12 nt, Human
uucaccagagca

SEQ ID NO: 2178019 - RNA, 15 nt, Human
uucaaacauauauaa

SEQ ID NO: 2178020 - RNA, 21 nt, Human
uucaaacuggggccuccagaa

SEQ ID NO: 2178021 - RNA, 16 nt, Human
uucaaacuggggccuc

SEQ ID NO: 2178022 - RNA, 15 nt, Human
uucaaacuggggccu

SEQ ID NO: 2178023 - RNA, 18 nt, Human
uucaaaaugucuguagcu

SEQ ID NO: 2178024 - RNA, 14 nt, Human
uucaaaaugucugu

SEQ ID NO: 2178025 - RNA, 16 nt, Human
uucaaaauggagggaa

SEQ ID NO: 2178026 - RNA, 16 nt, Human
uucaaaauauguucuu

SEQ ID NO: 2178027 - RNA, 20 nt, Human
uucaaaaugcuuuuuauuau

SEQ ID NO: 2178028 - RNA, 17 nt, Human
uucaaaaugcuuuuuau

SEQ ID NO: 2178029 - RNA, 21 nt, Human
uuauuuccuaguucuguagaa

SEQ ID NO: 2178030 - RNA, 14 nt, Human
uuauuucucugauu

SEQ ID NO: 2178031 - RNA, 22 nt, Human
uuauuucucagacuuuggaaaa

SEQ ID NO: 2178032 - RNA, 19 nt, Human
uuauuucuaggaagaauuu

SEQ ID NO: 2178033 - RNA, 15 nt, Human
uuauuuuuuucugau

SEQ ID NO: 2178034 - RNA, 16 nt, Human
uuauuuuuuucugauu

SEQ ID NO: 2178035 - RNA, 22 nt, Human
uuauuucugcauauguugaaua

SEQ ID NO: 2178036 - RNA, 20 nt, Human
uuauuucugcauauguugaa

SEQ ID NO: 2178037 - RNA, 15 nt, Human
uuauuucugcauaug

SEQ ID NO: 2178038 - RNA, 13 nt, Human
uuauuucugcaua

SEQ ID NO: 2178039 - RNA, 12 nt, Human
uuauuucugcau

SEQ ID NO: 2178040 - RNA, 16 nt, Human
uuauuucucugauuug

SEQ ID NO: 2178041 - RNA, 14 nt, Human
uucaaaaaaacacu

SEQ ID NO: 2178042 - RNA, 17 nt, Human
uucaaaaaaacacuagu

SEQ ID NO: 2178043 - RNA, 16 nt, Human
uucaaaaaacuuguaa

SEQ ID NO: 2178044 - RNA, 21 nt, Human
uucaaaaagucuacgcucucc

SEQ ID NO: 2178045 - RNA, 15 nt, Human
uucaaaaacuguauu

SEQ ID NO: 2178046 - RNA, 18 nt, Human
uucaaaaaaacacuaguu

SEQ ID NO: 2178047 - RNA, 18 nt, Human
uucaaaaaaauaaaauaa

SEQ ID NO: 2178048 - RNA, 17 nt, Human
uucaaaaacacaguguu

SEQ ID NO: 2178049 - RNA, 23 nt, Human
uucaaaaacacaguguuuuugua

SEQ ID NO: 2178050 - RNA, 15 nt, Human
uucaaaaauauaacu

SEQ ID NO: 2178051 - RNA, 13 nt, Human
uucaaaaaguguu

SEQ ID NO: 2178052 - RNA, 14 nt, Human
uucaaaaaguguuu

SEQ ID NO: 2178053 - RNA, 17 nt, Human
uucaaaaaguguuuauu

SEQ ID NO: 2178054 - RNA, 16 nt, Human
uucaaggccauccuuc

SEQ ID NO: 2178055 - RNA, 17 nt, Human
uucaaggccauccuucc

SEQ ID NO: 2178056 - RNA, 20 nt, Human
uucaaggcaucaugcagagu

SEQ ID NO: 2178057 - RNA, 22 nt, Human
uucaagugauucucaugccuca

SEQ ID NO: 2178058 - RNA, 20 nt, Human
uucaagugauucucaugccu

SEQ ID NO: 2178059 - RNA, 18 nt, Human
uucaauaaagcauuuaua

SEQ ID NO: 2178060 - RNA, 16 nt, Human
uucaauaaagcauuua

SEQ ID NO: 2178061 - RNA, 14 nt, Human
uucaaguucaaucc

SEQ ID NO: 2178062 - RNA, 20 nt, Human
uucaaguuauuguacagcug

SEQ ID NO: 2178063 - RNA, 17 nt, Human
uucaaguuagcucagga

SEQ ID NO: 2178064 - RNA, 14 nt, Human
uucaaguuauugua

SEQ ID NO: 2178065 - RNA, 17 nt, Human
uucaaguuauuguacag

SEQ ID NO: 2178066 - RNA, 23 nt, Human
uucaaguuccaaguugcuaauac

SEQ ID NO: 2178067 - RNA, 17 nt, Human
uucaaguuaaauuuuau

SEQ ID NO: 2178068 - RNA, 16 nt, Human
uucaaguuagcucagg

SEQ ID NO: 2178069 - RNA, 13 nt, Human
uucaaguuaaagu

SEQ ID NO: 2178070 - RNA, 22 nt, Human
uucaaguggggcucgccaugcc

SEQ ID NO: 2178071 - RNA, 19 nt, Human
uucaaguguaaaauauuuu

SEQ ID NO: 2178072 - RNA, 20 nt, Human
uucaagugauucuccugccu

SEQ ID NO: 2178073 - RNA, 22 nt, Human
uucaagugcaugcucucugcag

SEQ ID NO: 2178074 - RNA, 18 nt, Human
uucaaguggggcucgcca

SEQ ID NO: 2178075 - RNA, 19 nt, Human
uucaagaaaaguaagcccu

SEQ ID NO: 2178076 - RNA, 23 nt, Human
uucaagaaacugaggaauuuucu

SEQ ID NO: 2178077 - RNA, 22 nt, Human
uucaagaaagcuucaaacugca

SEQ ID NO: 2178078 - RNA, 15 nt, Human
uucaaggauccugag

SEQ ID NO: 2178079 - RNA, 12 nt, Human
uucaagaaacug

SEQ ID NO: 2178080 - RNA, 20 nt, Human
uucaagaaacugaggaauuu

SEQ ID NO: 2178081 - RNA, 13 nt, Human
uucaagaaacuga

SEQ ID NO: 2178082 - RNA, 22 nt, Human
uucaagaaaacaacuucaauau

SEQ ID NO: 2178083 - RNA, 12 nt, Human
uucaacuuuucc

SEQ ID NO: 2178084 - RNA, 16 nt, Human
uucaaggauccugagc

SEQ ID NO: 2178085 - RNA, 18 nt, Human
uucaaggauccugagcca

SEQ ID NO: 2178086 - RNA, 19 nt, Human
uucaaggauccugagccag

SEQ ID NO: 2178087 - RNA, 21 nt, Human
uucaaggauccugagccagau

SEQ ID NO: 2178088 - RNA, 20 nt, Human
auagcggguuacuuucacau

SEQ ID NO: 2178089 - RNA, 15 nt, Human
auagcuaacauuuua

SEQ ID NO: 2178090 - RNA, 22 nt, Human
auagcuaacauuuuaaauaaaa

SEQ ID NO: 2178091 - RNA, 23 nt, Human
auagcuaacauuuuaaauaaaag

SEQ ID NO: 2178092 - RNA, 17 nt, Human
auagcuacuaauuuuaa

SEQ ID NO: 2178093 - RNA, 14 nt, Human
auagcuacuaauuu

SEQ ID NO: 2178094 - RNA, 17 nt, Human
auaagauaaaugugcug

SEQ ID NO: 2178095 - RNA, 13 nt, Human
auaagauaaaugu

SEQ ID NO: 2178096 - RNA, 18 nt, Human
auagccugccucuucucu

SEQ ID NO: 2178097 - RNA, 16 nt, Human
auaagaguagaaacug

SEQ ID NO: 2178098 - RNA, 16 nt, Human
auaagauauuuuucau

SEQ ID NO: 2178099 - RNA, 15 nt, Human
auaagauauuuuuca

SEQ ID NO: 2178100 - RNA, 16 nt, Human
auaacuucaagcaaac

SEQ ID NO: 2178101 - RNA, 19 nt, Human
auaacuucuuaaaaguugu

SEQ ID NO: 2178102 - RNA, 16 nt, Human
auaacuucuuaaaagu

SEQ ID NO: 2178103 - RNA, 17 nt, Human
auaacuucuuaaaaguu

SEQ ID NO: 2178104 - RNA, 21 nt, Human
auaagaggcugauaauuccag

SEQ ID NO: 2178105 - RNA, 17 nt, Human
auaagagggcacacacu

SEQ ID NO: 2178106 - RNA, 19 nt, Human
auaagagggcacacacugu

SEQ ID NO: 2178107 - RNA, 20 nt, Human
auaagagagucauaaaccuu

SEQ ID NO: 2178108 - RNA, 13 nt, Human
auaacuugucuaa

SEQ ID NO: 2178109 - RNA, 12 nt, Human
auaacuuugcuu

SEQ ID NO: 2178110 - RNA, 14 nt, Human
auaacuuugcuugc

SEQ ID NO: 2178111 - RNA, 21 nt, Human
auaacuuugcuugcaguagau

SEQ ID NO: 2178112 - RNA, 22 nt, Human
auagcucaguuuauccaaggug

SEQ ID NO: 2178113 - RNA, 20 nt, Human
auagcuccugcuccacagcc

SEQ ID NO: 2178114 - RNA, 23 nt, Human
auagcuccccgcuucugccugca

SEQ ID NO: 2178115 - RNA, 21 nt, Human
auagcugagauuccugguucg

SEQ ID NO: 2178116 - RNA, 17 nt, Human
auagcugagauuccugg

SEQ ID NO: 2178117 - RNA, 15 nt, Human
auagcucuuucaggg

SEQ ID NO: 2178118 - RNA, 20 nt, Human
auagcucuuuggcagucuau

SEQ ID NO: 2178119 - RNA, 12 nt, Human
auagcugggacu

SEQ ID NO: 2178120 - RNA, 20 nt, Human
auagcucaggugucccugca

SEQ ID NO: 2178121 - RNA, 21 nt, Human
auagcucaggugucccugcac

SEQ ID NO: 2178122 - RNA, 18 nt, Human
auagcuauuuuuauggaa

SEQ ID NO: 2178123 - RNA, 12 nt, Human
auagcuauuuuu

SEQ ID NO: 2178124 - RNA, 18 nt, Human
auagcuauuacugucugg

SEQ ID NO: 2178125 - RNA, 22 nt, Human
auagcuauuacugucugguuuu

SEQ ID NO: 2178126 - RNA, 13 nt, Human
auagcucaguuua

SEQ ID NO: 2178127 - RNA, 20 nt, Human
auagcuauuuuuauggaauu

SEQ ID NO: 2178128 - RNA, 20 nt, Human
auagcuccccgcuucugccu

SEQ ID NO: 2178129 - RNA, 22 nt, Human
auagcucaggugucccugcacu

SEQ ID NO: 2178130 - RNA, 15 nt, Human
auagcuacaggaagc

SEQ ID NO: 2178131 - RNA, 21 nt, Human
auagcuaagaaauaaaacugu

SEQ ID NO: 2178132 - RNA, 23 nt, Human
auagcuauauccauguacuguag

SEQ ID NO: 2178133 - RNA, 14 nt, Human
auagcuauuacugu

SEQ ID NO: 2178134 - RNA, 22 nt, Human
auagcuauauccauguacugua

SEQ ID NO: 2178135 - RNA, 20 nt, Human
auagcuauauccauguacug

SEQ ID NO: 2178136 - RNA, 19 nt, Human
auagcuauauccauguacu

SEQ ID NO: 2178137 - RNA, 17 nt, Human
auagcuauauccaugua

SEQ ID NO: 2178138 - RNA, 16 nt, Human
auagcuauauccaugu

SEQ ID NO: 2178139 - RNA, 14 nt, Human
auagcuauauccau

SEQ ID NO: 2178140 - RNA, 19 nt, Human
auagcucaggugucccugc

SEQ ID NO: 2178141 - RNA, 16 nt, Human
auagcuacaggaagca

SEQ ID NO: 2178142 - RNA, 18 nt, Human
auagcuacuaauuuuaaa

SEQ ID NO: 2178143 - RNA, 22 nt, Human
uuauuguuccaagacauuguca

SEQ ID NO: 2178144 - RNA, 19 nt, Human
uuauuguuccaagacauug

SEQ ID NO: 2178145 - RNA, 18 nt, Human
uuauuguuccaagacauu

SEQ ID NO: 2178146 - RNA, 17 nt, Human
uuauuguuccaagacau

SEQ ID NO: 2178147 - RNA, 23 nt, Human
uuauuguuccaagacauugucaa

SEQ ID NO: 2178148 - RNA, 12 nt, Human
uuauuguuuaaa

SEQ ID NO: 2178149 - RNA, 13 nt, Human
uuauuuaaaagau

SEQ ID NO: 2178150 - RNA, 17 nt, Human
uuauuuaaaagauucau

SEQ ID NO: 2178151 - RNA, 18 nt, Human
uuauuuaaaagauucauu

SEQ ID NO: 2178152 - RNA, 22 nt, Human
uuauuguuuaaagcaacugucu

SEQ ID NO: 2178153 - RNA, 14 nt, Human
uuauuuaaaagauu

SEQ ID NO: 2178154 - RNA, 15 nt, Human
uuauuuaaaagauuc

SEQ ID NO: 2178155 - RNA, 16 nt, Human
uuauuuaaaagauuca

SEQ ID NO: 2178156 - RNA, 14 nt, Human
uuauuuaaauuuua

SEQ ID NO: 2178157 - RNA, 20 nt, Human
uuauuuaaacucuguugcaa

SEQ ID NO: 2178158 - RNA, 12 nt, Human
uuauuuaaauga

SEQ ID NO: 2178159 - RNA, 13 nt, Human
uuauuuaacagcu

SEQ ID NO: 2178160 - RNA, 20 nt, Human
uuauuuaaaugucuaaugua

SEQ ID NO: 2178161 - RNA, 15 nt, Human
uuauuuaaaugucua

SEQ ID NO: 2178162 - RNA, 16 nt, Human
uuauuuaaaugucuaa

SEQ ID NO: 2178163 - RNA, 23 nt, Human
uuauuuaacagcugaauuaucua

SEQ ID NO: 2178164 - RNA, 10 nt, Human
uuauuuaaua

SEQ ID NO: 2178165 - RNA, 12 nt, Human
uuauuuaauaac

SEQ ID NO: 2178166 - RNA, 13 nt, Human
uuauuuaauaaca

SEQ ID NO: 2178167 - RNA, 14 nt, Human
uuauuuaauaacaa

SEQ ID NO: 2178168 - RNA, 14 nt, Human
uuauuuaauaacau

SEQ ID NO: 2178169 - RNA, 15 nt, Human
uuauuuaauaacauu

SEQ ID NO: 2178170 - RNA, 22 nt, Human
uuauuuaaugaaagacuguaca

SEQ ID NO: 2178171 - RNA, 18 nt, Human
uuauuuaaugaaagacug

SEQ ID NO: 2178172 - RNA, 16 nt, Human
uuauuguuccaagaca

SEQ ID NO: 2178173 - RNA, 13 nt, Human
uuauuguuccaag

SEQ ID NO: 2178174 - RNA, 20 nt, Human
uuauuguguuuuuaauuuau

SEQ ID NO: 2178175 - RNA, 20 nt, Human
uuauuguguuugucauuagc

SEQ ID NO: 2178176 - RNA, 22 nt, Human
uuauuguguuugucauuagccu

SEQ ID NO: 2178177 - RNA, 17 nt, Human
uuauuguuuaaaaucau

SEQ ID NO: 2178178 - RNA, 22 nt, Human
auagcuguauugaaucauguag

SEQ ID NO: 2178179 - RNA, 19 nt, Human
uuauuguguuugucauuag

SEQ ID NO: 2178180 - RNA, 23 nt, Human
auagcuguacaaauauaagaaua

SEQ ID NO: 2178181 - RNA, 18 nt, Human
auagcuguacaaauauaa

SEQ ID NO: 2178182 - RNA, 13 nt, Human
auagcuguauuga

SEQ ID NO: 2178183 - RNA, 15 nt, Human
auagcuguauugaau

SEQ ID NO: 2178184 - RNA, 16 nt, Human
auagcuguauugaauc

SEQ ID NO: 2178185 - RNA, 17 nt, Human
auagcuguauugaauca

SEQ ID NO: 2178186 - RNA, 18 nt, Human
auagcuguauugaaucau

SEQ ID NO: 2178187 - RNA, 17 nt, Human
auagcugggacuacagg

SEQ ID NO: 2178188 - RNA, 22 nt, Human
auagcuggucuuauuuguaaag

SEQ ID NO: 2178189 - RNA, 23 nt, Human
auagcuggucuuauuuguaaagc

SEQ ID NO: 2178190 - RNA, 15 nt, Human
auagcuguacaaaua

SEQ ID NO: 2178191 - RNA, 17 nt, Human
auagcuguacaaauaua

SEQ ID NO: 2178192 - RNA, 21 nt, Human
uuauuuagggaacugcuugac

SEQ ID NO: 2178193 - RNA, 18 nt, Human
uuauuuagggaacugcuu

SEQ ID NO: 2178194 - RNA, 17 nt, Human
uuauuuagggaacugcu

SEQ ID NO: 2178195 - RNA, 18 nt, Human
uuauuuagacucaucuua

SEQ ID NO: 2178196 - RNA, 16 nt, Human
uuauuuaguuccuuga

SEQ ID NO: 2178197 - RNA, 15 nt, Human
uuauuuaguauuuau

SEQ ID NO: 2178198 - RNA, 17 nt, Human
uuauuuauaaucacuuu

SEQ ID NO: 2178199 - RNA, 16 nt, Human
uuauuuaggcuuugua

SEQ ID NO: 2178200 - RNA, 15 nt, Human
uuauuuauacacugu

SEQ ID NO: 2178201 - RNA, 17 nt, Human
uuauuuacugagcuucu

SEQ ID NO: 2178202 - RNA, 21 nt, Human
uuauuuacugagcuucucugu

SEQ ID NO: 2178203 - RNA, 17 nt, Human
uuauuuacuaauuuucu

SEQ ID NO: 2178204 - RNA, 14 nt, Human
uuauuuaauuaaaa

SEQ ID NO: 2178205 - RNA, 16 nt, Human
uuauuuaauguuaugu

SEQ ID NO: 2178206 - RNA, 19 nt, Human
uuauuuaauaacauuaccu

SEQ ID NO: 2178207 - RNA, 20 nt, Human
uuauuuacagaugaauguau

SEQ ID NO: 2178208 - RNA, 15 nt, Human
uuauuuacagaugaa

SEQ ID NO: 2178209 - RNA, 22 nt, Human
uuauuuacugagcuucucugug

SEQ ID NO: 2178210 - RNA, 15 nt, Human
uuauuuacugcuagu

SEQ ID NO: 2178211 - RNA, 14 nt, Human
uuauuuagacaaga

SEQ ID NO: 2178212 - RNA, 15 nt, Human
uuauuuagacaagag

SEQ ID NO: 2178213 - RNA, 16 nt, Human
uuauuuagacaagaga

SEQ ID NO: 2178214 - RNA, 17 nt, Human
uuauuuagcaccaggga

SEQ ID NO: 2178215 - RNA, 18 nt, Human
uuauuuagacaagagaug

SEQ ID NO: 2178216 - RNA, 17 nt, Human
uuauuuagacucaucuu

SEQ ID NO: 2178217 - RNA, 23 nt, Human
uuauuuagacucaucuuacugua

SEQ ID NO: 2178218 - RNA, 17 nt, Human
uuauuucagaaauguac

SEQ ID NO: 2178219 - RNA, 15 nt, Human
uuauuucagaaaugu

SEQ ID NO: 2178220 - RNA, 11 nt, Human
uuauuucagaa

SEQ ID NO: 2178221 - RNA, 20 nt, Human
uuauuucacuuuagaugcug

SEQ ID NO: 2178222 - RNA, 21 nt, Human
uuauuucacuuuagaugcuga

SEQ ID NO: 2178223 - RNA, 23 nt, Human
uuauuucaaaauauacauucaaa

SEQ ID NO: 2178224 - RNA, 15 nt, Human
uuauuuauuuaugga

SEQ ID NO: 2178225 - RNA, 14 nt, Human
uuauuuauuuaaua

SEQ ID NO: 2178226 - RNA, 20 nt, Human
uuauuucaucauauuauaca

SEQ ID NO: 2178227 - RNA, 15 nt, Human
uuauuucaugaaaau

SEQ ID NO: 2178228 - RNA, 18 nt, Human
uuauuucauaaacaacuu

SEQ ID NO: 2178229 - RNA, 17 nt, Human
uuauuuccaaauaaaau

SEQ ID NO: 2178230 - RNA, 19 nt, Human
uuauuuccaaauaaaauga

SEQ ID NO: 2178231 - RNA, 18 nt, Human
uuauuuccuaguucugua

SEQ ID NO: 2178232 - RNA, 19 nt, Human
uuauuuccuaguucuguag

SEQ ID NO: 2178233 - RNA, 15 nt, Human
uuauuuauuaagaug

SEQ ID NO: 2178234 - RNA, 14 nt, Human
uuauuuauuaagau

SEQ ID NO: 2178235 - RNA, 17 nt, Human
uuauuuauucagcuuca

SEQ ID NO: 2178236 - RNA, 22 nt, Human
uuauuuauucagcuucauuugu

SEQ ID NO: 2178237 - RNA, 13 nt, Human
uuauuuauuaaga

SEQ ID NO: 2178238 - RNA, 15 nt, Human
uuauuuauuggagau

SEQ ID NO: 2178239 - RNA, 15 nt, Human
uuauuuauuuaaaug

SEQ ID NO: 2178240 - RNA, 13 nt, Human
uuauuuauuuaau

SEQ ID NO: 2178241 - RNA, 18 nt, Human
uuauuuaucagugacaga

SEQ ID NO: 2178242 - RNA, 14 nt, Human
uuauuuaucaguga

SEQ ID NO: 2178243 - RNA, 14 nt, Human
uuauuuaugccucu

SEQ ID NO: 2178244 - RNA, 20 nt, Human
uuauuuaugccucuguauuu

SEQ ID NO: 2178245 - RNA, 20 nt, Human
uuccuuuugaacgccccccc

SEQ ID NO: 2178246 - RNA, 18 nt, Human
uuccuuuucuaacucucc

SEQ ID NO: 2178247 - RNA, 16 nt, Human
uuccuuuucccugcuu

SEQ ID NO: 2178248 - RNA, 17 nt, Human
uuccuuuucccugcuuc

SEQ ID NO: 2178249 - RNA, 15 nt, Human
uuccuuuuguguaca

SEQ ID NO: 2178250 - RNA, 17 nt, Human
uuccuuuuguguacagu

SEQ ID NO: 2178251 - RNA, 23 nt, Human
uuccuuuugaacgccccccccca

SEQ ID NO: 2178252 - RNA, 13 nt, Human
uucuaggccuggg

SEQ ID NO: 2178253 - RNA, 21 nt, Human
uuccuuuuuuaaaaaugcaaa

SEQ ID NO: 2178254 - RNA, 15 nt, Human
uuccuuuuuuauaca

SEQ ID NO: 2178255 - RNA, 15 nt, Human
uucuaguuucccaca

SEQ ID NO: 2178256 - RNA, 22 nt, Human
uucuaguuucccacaauauaaa

SEQ ID NO: 2178257 - RNA, 15 nt, Human
uucuagguucuaaaa

SEQ ID NO: 2178258 - RNA, 23 nt, Human
uucuagguggcaaggcugugcuc

SEQ ID NO: 2178259 - RNA, 15 nt, Human
uucuagggaaaugaa

SEQ ID NO: 2178260 - RNA, 18 nt, Human
uucuagguggcaaggcug

SEQ ID NO: 2178261 - RNA, 23 nt, Human
uucuaggcuacaauuuucuccca

SEQ ID NO: 2178262 - RNA, 22 nt, Human
uucuaggcuacaauuuucuccc

SEQ ID NO: 2178263 - RNA, 13 nt, Human
uucuauaaggcca

SEQ ID NO: 2178264 - RNA, 21 nt, Human
uucuauaaggccauaaaacag

SEQ ID NO: 2178265 - RNA, 14 nt, Human
uucuauaaggccau

SEQ ID NO: 2178266 - RNA, 13 nt, Human
uucuaguuuuguc

SEQ ID NO: 2178267 - RNA, 14 nt, Human
uucuaguuuucagu

SEQ ID NO: 2178268 - RNA, 19 nt, Human
uucuaguuuucaguuugua

SEQ ID NO: 2178269 - RNA, 14 nt, Human
uucuaguuugcauu

SEQ ID NO: 2178270 - RNA, 15 nt, Human
uucuaguuugcauuc

SEQ ID NO: 2178271 - RNA, 14 nt, Human
uucucaacuccaaa

SEQ ID NO: 2178272 - RNA, 18 nt, Human
uucucaacuccaaacuga

SEQ ID NO: 2178273 - RNA, 14 nt, Human
uucucaagcccugc

SEQ ID NO: 2178274 - RNA, 15 nt, Human
uucucaagcccugca

SEQ ID NO: 2178275 - RNA, 11 nt, Human
uucucaagugc

SEQ ID NO: 2178276 - RNA, 15 nt, Human
uucucaagugccuua

SEQ ID NO: 2178277 - RNA, 22 nt, Human
uucucaagauacugcuacugua

SEQ ID NO: 2178278 - RNA, 15 nt, Human
uucucaaccuaccac

SEQ ID NO: 2178279 - RNA, 22 nt, Human
uucucaacaaagcacaguguua

SEQ ID NO: 2178280 - RNA, 14 nt, Human
uucucaaccuacca

SEQ ID NO: 2178281 - RNA, 23 nt, Human
uucuauaaggccauaaaacaggu

SEQ ID NO: 2178282 - RNA, 23 nt, Human
uucuaguuuucaguuuguauaua

SEQ ID NO: 2178283 - RNA, 17 nt, Human
uucucaagugccuuaau

SEQ ID NO: 2178284 - RNA, 12 nt, Human
aucagaaggaga

SEQ ID NO: 2178285 - RNA, 14 nt, Human
aucagaagauaacu

SEQ ID NO: 2178286 - RNA, 17 nt, Human
aucagaagauaacuuga

SEQ ID NO: 2178287 - RNA, 22 nt, Human
aucagagaugcaccaccaagcc

SEQ ID NO: 2178288 - RNA, 14 nt, Human
aucagaggccuaua

SEQ ID NO: 2178289 - RNA, 15 nt, Human
aucagaggccuauaa

SEQ ID NO: 2178290 - RNA, 21 nt, Human
aucagagcagcagugaaaaca

SEQ ID NO: 2178291 - RNA, 14 nt, Human
aucagaacagcaga

SEQ ID NO: 2178292 - RNA, 13 nt, Human
aucagaacagcag

SEQ ID NO: 2178293 - RNA, 23 nt, Human
aucagaacucaaauggggccaga

SEQ ID NO: 2178294 - RNA, 22 nt, Human
aucagaacucaaauggggccag

SEQ ID NO: 2178295 - RNA, 23 nt, Human
aucagaagaccacaaaaauugac

SEQ ID NO: 2178296 - RNA, 22 nt, Human
aucagaagaccacaaaaauuga

SEQ ID NO: 2178297 - RNA, 13 nt, Human
aucagaagauaac

SEQ ID NO: 2178298 - RNA, 20 nt, Human
uucucauaggaaaaguacau

SEQ ID NO: 2178299 - RNA, 22 nt, Human
uucucauagcauuaacuaaucu

SEQ ID NO: 2178300 - RNA, 21 nt, Human
uucucauagcauuaacuaauc

SEQ ID NO: 2178301 - RNA, 18 nt, Human
uucucauagcauuaacua

SEQ ID NO: 2178302 - RNA, 17 nt, Human
uucucauagcauuaacu

SEQ ID NO: 2178303 - RNA, 14 nt, Human
uucucauagcauua

SEQ ID NO: 2178304 - RNA, 13 nt, Human
uucucauagcauu

SEQ ID NO: 2178305 - RNA, 17 nt, Human
uucucaucccacgcacu

SEQ ID NO: 2178306 - RNA, 16 nt, Human
uucucaucacuccccu

SEQ ID NO: 2178307 - RNA, 17 nt, Human
uucucaucacuccccuc

SEQ ID NO: 2178308 - RNA, 22 nt, Human
uucucauaggaaaaguacauuu

SEQ ID NO: 2178309 - RNA, 24 nt, Human
uucucauaggaaaaguacauuuaa

SEQ ID NO: 2178310 - RNA, 15 nt, Human
uucucaucacucccc

SEQ ID NO: 2178311 - RNA, 14 nt, Human
aucagaaauacaga

SEQ ID NO: 2178312 - RNA, 15 nt, Human
aucagaaauacagau

SEQ ID NO: 2178313 - RNA, 19 nt, Human
aucagaaauacagauuuug

SEQ ID NO: 2178314 - RNA, 23 nt, Human
aucagaaauacagauuuugauag

SEQ ID NO: 2178315 - RNA, 22 nt, Human
uucucagaaucucaaauaacua

SEQ ID NO: 2178316 - RNA, 19 nt, Human
uucucagaaucucaaauaa

SEQ ID NO: 2178317 - RNA, 14 nt, Human
uucucacacccacc

SEQ ID NO: 2178318 - RNA, 15 nt, Human
uucucacacccaccg

SEQ ID NO: 2178319 - RNA, 18 nt, Human
uucucacacccaccgucc

SEQ ID NO: 2178320 - RNA, 22 nt, Human
uucucacacccaccguccgccc

SEQ ID NO: 2178321 - RNA, 22 nt, Human
uucucagucaguaauugccaaa

SEQ ID NO: 2178322 - RNA, 23 nt, Human
uucucagaaucucaaauaacuaa

SEQ ID NO: 2178323 - RNA, 23 nt, Human
uucucagacuuuggaaaaugcau

SEQ ID NO: 2178324 - RNA, 15 nt, Human
uucucaguuuucaua

SEQ ID NO: 2178325 - RNA, 22 nt, Human
uucucagacuuuggaaaaugca

SEQ ID NO: 2178326 - RNA, 14 nt, Human
uucucaguuuucau

SEQ ID NO: 2178327 - RNA, 17 nt, Human
aucaguguccucuugcu

SEQ ID NO: 2178328 - RNA, 19 nt, Human
aucaguguaccauuugccu

SEQ ID NO: 2178329 - RNA, 16 nt, Human
aucagugucuuuccac

SEQ ID NO: 2178330 - RNA, 19 nt, Human
aucagugguuauuuaggga

SEQ ID NO: 2178331 - RNA, 22 nt, Human
aucaguggcauggcuccagucu

SEQ ID NO: 2178332 - RNA, 13 nt, Human
aucaguggagcca

SEQ ID NO: 2178333 - RNA, 14 nt, Human
aucaguccuuugau

SEQ ID NO: 2178334 - RNA, 19 nt, Human
aucagucuauccacagaga

SEQ ID NO: 2178335 - RNA, 21 nt, Human
aucaguccucuuucaaaggua

SEQ ID NO: 2178336 - RNA, 21 nt, Human
aucagucccuauguauuugca

SEQ ID NO: 2178337 - RNA, 13 nt, Human
aucaguccccucc

SEQ ID NO: 2178338 - RNA, 15 nt, Human
aucaguccccuccca

SEQ ID NO: 2178339 - RNA, 16 nt, Human
aucaguccccucccau

SEQ ID NO: 2178340 - RNA, 17 nt, Human
aucaguccccucccauc

SEQ ID NO: 2178341 - RNA, 22 nt, Human
aucaguccccucccaucuggga

SEQ ID NO: 2178342 - RNA, 23 nt, Human
aucaguccccucccaucugggag

SEQ ID NO: 2178343 - RNA, 16 nt, Human
aucagucccuauguau

SEQ ID NO: 2178344 - RNA, 15 nt, Human
aucauagaaauguaa

SEQ ID NO: 2178345 - RNA, 12 nt, Human
aucauagaaaug

SEQ ID NO: 2178346 - RNA, 17 nt, Human
aucauacacuuccuucu

SEQ ID NO: 2178347 - RNA, 20 nt, Human
aucagugugucuaaauuuga

SEQ ID NO: 2178348 - RNA, 17 nt, Human
aucauaagauauuuuuc

SEQ ID NO: 2178349 - RNA, 15 nt, Human
aucagugugcccccc

SEQ ID NO: 2178350 - RNA, 22 nt, Human
aucagugugccccccauccugg

SEQ ID NO: 2178351 - RNA, 19 nt, Human
aucagugugucuaaauuug

SEQ ID NO: 2178352 - RNA, 14 nt, Human
aucagugucucaca

SEQ ID NO: 2178353 - RNA, 15 nt, Human
aucagugucucacac

SEQ ID NO: 2178354 - RNA, 13 nt, Human
aucagugugcccc

SEQ ID NO: 2178355 - RNA, 14 nt, Human
aucagugugccccc

SEQ ID NO: 2178356 - RNA, 18 nt, Human
aucagaucauuucaaaac

SEQ ID NO: 2178357 - RNA, 17 nt, Human
aucagaggccuauaaug

SEQ ID NO: 2178358 - RNA, 17 nt, Human
aucagaguugcugcaaa

SEQ ID NO: 2178359 - RNA, 23 nt, Human
aucagaugaacucuuagaaauga

SEQ ID NO: 2178360 - RNA, 22 nt, Human
aucagaucauuucaaaacucau

SEQ ID NO: 2178361 - RNA, 22 nt, Human
aucagaugaacucuuagaaaug

SEQ ID NO: 2178362 - RNA, 16 nt, Human
aucagcacgauuucug

SEQ ID NO: 2178363 - RNA, 15 nt, Human
aucagcacgauuucu

SEQ ID NO: 2178364 - RNA, 18 nt, Human
aucagcacgauuucuguu

SEQ ID NO: 2178365 - RNA, 17 nt, Human
aucagcacgauuucugu

SEQ ID NO: 2178366 - RNA, 18 nt, Human
aucaguauaaacaaaguu

SEQ ID NO: 2178367 - RNA, 14 nt, Human
aucaguauaauucu

SEQ ID NO: 2178368 - RNA, 16 nt, Human
aucaguauaaacaaag

SEQ ID NO: 2178369 - RNA, 16 nt, Human
aucaguauaauucugu

SEQ ID NO: 2178370 - RNA, 21 nt, Human
aucaguauaauucuguacuga

SEQ ID NO: 2178371 - RNA, 22 nt, Human
aucaguauaauucuguacugau

SEQ ID NO: 2178372 - RNA, 13 nt, Human
aucagucaauauu

SEQ ID NO: 2178373 - RNA, 19 nt, Human
aucagucauaacuaaauaa

SEQ ID NO: 2178374 - RNA, 22 nt, Human
aucaguauugaagcauuuuaua

SEQ ID NO: 2178375 - RNA, 15 nt, Human
aucaguauugaagca

SEQ ID NO: 2178376 - RNA, 22 nt, Human
aucauucauucuuagcucuuaa

SEQ ID NO: 2178377 - RNA, 14 nt, Human
aucauugaaaucuu

SEQ ID NO: 2178378 - RNA, 15 nt, Human
aucauugaaaucuuu

SEQ ID NO: 2178379 - RNA, 22 nt, Human
aucauuaaagccugaguuugcu

SEQ ID NO: 2178380 - RNA, 16 nt, Human
aucauuauguaauguc

SEQ ID NO: 2178381 - RNA, 16 nt, Human
aucauguuugcucucc

SEQ ID NO: 2178382 - RNA, 12 nt, Human
aucauguuugcu

SEQ ID NO: 2178383 - RNA, 13 nt, Human
aucauguuugcuc

SEQ ID NO: 2178384 - RNA, 14 nt, Human
aucauguuugcucu

SEQ ID NO: 2178385 - RNA, 15 nt, Human
aucauguuugcucuc

SEQ ID NO: 2178386 - RNA, 14 nt, Human
aucauucauuuucu

SEQ ID NO: 2178387 - RNA, 12 nt, Human
aucauucaagug

SEQ ID NO: 2178388 - RNA, 15 nt, Human
aucaucaguauugaa

SEQ ID NO: 2178389 - RNA, 19 nt, Human
aucaucaaggcacugccug

SEQ ID NO: 2178390 - RNA, 20 nt, Human
aucaucagcauaccuuuauu

SEQ ID NO: 2178391 - RNA, 22 nt, Human
aucaucagcauaccuuuauugu

SEQ ID NO: 2178392 - RNA, 17 nt, Human
aucaucaguauugaagc

SEQ ID NO: 2178393 - RNA, 23 nt, Human
aucauguuuacagaggacaguau

SEQ ID NO: 2178394 - RNA, 18 nt, Human
aucauguuuacagaggac

SEQ ID NO: 2178395 - RNA, 12 nt, Human
aucauaguacag

SEQ ID NO: 2178396 - RNA, 18 nt, Human
aucauagguauuucaaaa

SEQ ID NO: 2178397 - RNA, 16 nt, Human
aucauagguauuucaa

SEQ ID NO: 2178398 - RNA, 17 nt, Human
aucauagguauuucaaa

SEQ ID NO: 2178399 - RNA, 21 nt, Human
aucauaggaagggaccaaggc

SEQ ID NO: 2178400 - RNA, 22 nt, Human
aucauaggaagggaccaaggca

SEQ ID NO: 2178401 - RNA, 16 nt, Human
aucauauuauacagac

SEQ ID NO: 2178402 - RNA, 15 nt, Human
aucauauuauacaga

SEQ ID NO: 2178403 - RNA, 21 nt, Human
aucauauugguauucacuaau

SEQ ID NO: 2178404 - RNA, 18 nt, Human
aucaucaaggcacugccu

SEQ ID NO: 2178405 - RNA, 13 nt, Human
aucaucaaggcac

SEQ ID NO: 2178406 - RNA, 19 nt, Human
uucugaaaauuaacacugc

SEQ ID NO: 2178407 - RNA, 15 nt, Human
uucugaaagggacgc

SEQ ID NO: 2178408 - RNA, 15 nt, Human
uucucuuaauuuaau

SEQ ID NO: 2178409 - RNA, 23 nt, Human
uucucuuacugcaaaugucauca

SEQ ID NO: 2178410 - RNA, 14 nt, Human
uucucuuacugcaa

SEQ ID NO: 2178411 - RNA, 16 nt, Human
uucucuuacugcaaau

SEQ ID NO: 2178412 - RNA, 15 nt, Human
uucugaaaauauaac

SEQ ID NO: 2178413 - RNA, 13 nt, Human
uucucuucacuca

SEQ ID NO: 2178414 - RNA, 12 nt, Human
uucucugugaac

SEQ ID NO: 2178415 - RNA, 20 nt, Human
uucucugugaacgauuuaga

SEQ ID NO: 2178416 - RNA, 24 nt, Human
uucucuguguuuguuccuacagcc

SEQ ID NO: 2178417 - RNA, 18 nt, Human
uucucuguguuuguuccu

SEQ ID NO: 2178418 - RNA, 19 nt, Human
uucucuguguuuguuccua

SEQ ID NO: 2178419 - RNA, 17 nt, Human
uucucugucucaugugu

SEQ ID NO: 2178420 - RNA, 17 nt, Human
uucucugucucauccau

SEQ ID NO: 2178421 - RNA, 20 nt, Human
aucauugaaaucuuuuugcu

SEQ ID NO: 2178422 - RNA, 13 nt, Human
uucucugucucau

SEQ ID NO: 2178423 - RNA, 19 nt, Human
aucauugaaaucuuuuugc

SEQ ID NO: 2178424 - RNA, 12 nt, Human
uucugaagaaga

SEQ ID NO: 2178425 - RNA, 13 nt, Human
uucugaagaagau

SEQ ID NO: 2178426 - RNA, 21 nt, Human
uucugcauuuugcuauuguaa

SEQ ID NO: 2178427 - RNA, 17 nt, Human
uucugcauuuugcuauu

SEQ ID NO: 2178428 - RNA, 18 nt, Human
uucugcauuuugcuauug

SEQ ID NO: 2178429 - RNA, 23 nt, Human
uucugcauuuuauucuggaugga

SEQ ID NO: 2178430 - RNA, 14 nt, Human
uucugaagaagaug

SEQ ID NO: 2178431 - RNA, 23 nt, Human
uucugcaucagcugcugaaacaa

SEQ ID NO: 2178432 - RNA, 22 nt, Human
uucugggagacacccaaagggu

SEQ ID NO: 2178433 - RNA, 16 nt, Human
uucugggaggaagcag

SEQ ID NO: 2178434 - RNA, 14 nt, Human
uucuggguggccuc

SEQ ID NO: 2178435 - RNA, 13 nt, Human
uucugggugucca

SEQ ID NO: 2178436 - RNA, 18 nt, Human
uucuggguggccucggga

SEQ ID NO: 2178437 - RNA, 19 nt, Human
uucuggguggggcaguggg

SEQ ID NO: 2178438 - RNA, 15 nt, Human
uucugguacucuccu

SEQ ID NO: 2178439 - RNA, 18 nt, Human
uucugguagauagaaaua

SEQ ID NO: 2178440 - RNA, 17 nt, Human
uucugguagauagaaau

SEQ ID NO: 2178441 - RNA, 18 nt, Human
uucugguacucuccuaga

SEQ ID NO: 2178442 - RNA, 19 nt, Human
uucugguagauagaaauaa

SEQ ID NO: 2178443 - RNA, 19 nt, Human
uucuggugaggccuugcuc

SEQ ID NO: 2178444 - RNA, 21 nt, Human
uucuggucucuaggcugggga

SEQ ID NO: 2178445 - RNA, 17 nt, Human
uucuguaccaaaguguu

SEQ ID NO: 2178446 - RNA, 22 nt, Human
uucuguacauagccuauauuua

SEQ ID NO: 2178447 - RNA, 22 nt, Human
uucuguacaugcauugagcucu

SEQ ID NO: 2178448 - RNA, 15 nt, Human
uucuguacauagccu

SEQ ID NO: 2178449 - RNA, 16 nt, Human
uucuguacauagccua

SEQ ID NO: 2178450 - RNA, 18 nt, Human
uucuguacauagccuaua

SEQ ID NO: 2178451 - RNA, 19 nt, Human
uucuguacauagccuauau

SEQ ID NO: 2178452 - RNA, 19 nt, Human
uucuggugggguguguucc

SEQ ID NO: 2178453 - RNA, 12 nt, Human
uucuggugugaa

SEQ ID NO: 2178454 - RNA, 18 nt, Human
uucugccggcccuggggc

SEQ ID NO: 2178455 - RNA, 17 nt, Human
uucugccggcccugggg

SEQ ID NO: 2178456 - RNA, 16 nt, Human
uucugccgugugcccu

SEQ ID NO: 2178457 - RNA, 13 nt, Human
uucugccucucaa

SEQ ID NO: 2178458 - RNA, 16 nt, Human
uucugccgcagcccug

SEQ ID NO: 2178459 - RNA, 14 nt, Human
uucugccacuuccc

SEQ ID NO: 2178460 - RNA, 17 nt, Human
uucugccacuucccagg

SEQ ID NO: 2178461 - RNA, 23 nt, Human
uucugccgcagcccugcagaggg

SEQ ID NO: 2178462 - RNA, 10 nt, Human
uucugggaca

SEQ ID NO: 2178463 - RNA, 14 nt, Human
uucugccucugagg

SEQ ID NO: 2178464 - RNA, 11 nt, Human
uucugggacac

SEQ ID NO: 2178465 - RNA, 22 nt, Human
uucugggacacaguucaauucu

SEQ ID NO: 2178466 - RNA, 23 nt, Human
aucccaggggaccacaccucccu

SEQ ID NO: 2178467 - RNA, 20 nt, Human
aucccaggggaccacaccuc

SEQ ID NO: 2178468 - RNA, 17 nt, Human
aucccaggggcccaagg

SEQ ID NO: 2178469 - RNA, 19 nt, Human
aucccaggggcccaaggcg

SEQ ID NO: 2178470 - RNA, 19 nt, Human
aucccaggggaccacaccu

SEQ ID NO: 2178471 - RNA, 12 nt, Human
aucccaggggac

SEQ ID NO: 2178472 - RNA, 19 nt, Human
aucccaggcuucacccuga

SEQ ID NO: 2178473 - RNA, 16 nt, Human
aucccauaugccuggg

SEQ ID NO: 2178474 - RNA, 17 nt, Human
aucccauaugccugggc

SEQ ID NO: 2178475 - RNA, 17 nt, Human
aucccucaucugucccu

SEQ ID NO: 2178476 - RNA, 13 nt, Human
aucccucaucugu

SEQ ID NO: 2178477 - RNA, 15 nt, Human
aucccuccccaguuc

SEQ ID NO: 2178478 - RNA, 16 nt, Human
aucccuccccaguuca

SEQ ID NO: 2178479 - RNA, 22 nt, Human
aucccucccccccaugcacugu

SEQ ID NO: 2178480 - RNA, 21 nt, Human
aucccucccccccaugcacug

SEQ ID NO: 2178481 - RNA, 19 nt, Human
aucccucccccccaugcac

SEQ ID NO: 2178482 - RNA, 18 nt, Human
aucccucccccccaugca

SEQ ID NO: 2178483 - RNA, 11 nt, Human
aucccucaucu

SEQ ID NO: 2178484 - RNA, 17 nt, Human
aucccucuacagagcuu

SEQ ID NO: 2178485 - RNA, 18 nt, Human
aucccugggcauugcuuu

SEQ ID NO: 2178486 - RNA, 17 nt, Human
aucccugggcauugcuu

SEQ ID NO: 2178487 - RNA, 16 nt, Human
aucccugggcauugcu

SEQ ID NO: 2178488 - RNA, 14 nt, Human
aucccucuccuccc

SEQ ID NO: 2178489 - RNA, 14 nt, Human
aucccucucuggau

SEQ ID NO: 2178490 - RNA, 16 nt, Human
aucccucucuggauug

SEQ ID NO: 2178491 - RNA, 11 nt, Human
aucccucucca

SEQ ID NO: 2178492 - RNA, 12 nt, Human
aucccucuccau

SEQ ID NO: 2178493 - RNA, 22 nt, Human
aucccucuccauaaccccaccc

SEQ ID NO: 2178494 - RNA, 23 nt, Human
aucccucuacagagcuucccuga

SEQ ID NO: 2178495 - RNA, 22 nt, Human
aucccucuacagagcuucccug

SEQ ID NO: 2178496 - RNA, 21 nt, Human
aucccucuacagagcuucccu

SEQ ID NO: 2178497 - RNA, 20 nt, Human
aucccucuacagagcuuccc

SEQ ID NO: 2178498 - RNA, 13 nt, Human
aucccuguuuaau

SEQ ID NO: 2178499 - RNA, 19 nt, Human
aucccuguuacccagagaa

SEQ ID NO: 2178500 - RNA, 14 nt, Human
aucccuguuuaaua

SEQ ID NO: 2178501 - RNA, 15 nt, Human
aucccuguuuaauau

SEQ ID NO: 2178502 - RNA, 16 nt, Human
aucccuguuuaauauu

SEQ ID NO: 2178503 - RNA, 22 nt, Human
aucccuguuuaauauuuaaaca

SEQ ID NO: 2178504 - RNA, 23 nt, Human
aucccuguuuaauauuuaaacag

SEQ ID NO: 2178505 - RNA, 17 nt, Human
aucccuguuuaauauuu

SEQ ID NO: 2178506 - RNA, 18 nt, Human
aucccuguuuaauauuua

SEQ ID NO: 2178507 - RNA, 20 nt, Human
aucccuguuuaauauuuaaa

SEQ ID NO: 2178508 - RNA, 21 nt, Human
aucccuguuuaauauuuaaac

SEQ ID NO: 2178509 - RNA, 18 nt, Human
aucccuguuacccagaga

SEQ ID NO: 2178510 - RNA, 18 nt, Human
aucccuguguugucucua

SEQ ID NO: 2178511 - RNA, 20 nt, Human
auccauguuaguuuuuacuu

SEQ ID NO: 2178512 - RNA, 19 nt, Human
auccauguuaguuuuuacu

SEQ ID NO: 2178513 - RNA, 16 nt, Human
auccauguuuguaaaa

SEQ ID NO: 2178514 - RNA, 14 nt, Human
auccauuaucaugu

SEQ ID NO: 2178515 - RNA, 15 nt, Human
auccauuaucaugug

SEQ ID NO: 2178516 - RNA, 18 nt, Human
auccauuccucagggaca

SEQ ID NO: 2178517 - RNA, 14 nt, Human
auccauuccucagg

SEQ ID NO: 2178518 - RNA, 22 nt, Human
auccauuccucagggacagaga

SEQ ID NO: 2178519 - RNA, 16 nt, Human
auccauuaucaugugu

SEQ ID NO: 2178520 - RNA, 17 nt, Human
auccauuaucaugugua

SEQ ID NO: 2178521 - RNA, 18 nt, Human
auccauuaucauguguaa

SEQ ID NO: 2178522 - RNA, 18 nt, Human
auccauguuaguuuuuac

SEQ ID NO: 2178523 - RNA, 20 nt, Human
auccauguacuguaguuuuu

SEQ ID NO: 2178524 - RNA, 22 nt, Human
auccauguacuguaguuuuucu

SEQ ID NO: 2178525 - RNA, 18 nt, Human
auccauguacuguaguuu

SEQ ID NO: 2178526 - RNA, 14 nt, Human
auccauguacugua

SEQ ID NO: 2178527 - RNA, 12 nt, Human
auccauguacug

SEQ ID NO: 2178528 - RNA, 19 nt, Human
auccauguaagguaucagu

SEQ ID NO: 2178529 - RNA, 17 nt, Human
aucccaggauguacaag

SEQ ID NO: 2178530 - RNA, 21 nt, Human
aucccaagaucugugcagccc

SEQ ID NO: 2178531 - RNA, 23 nt, Human
aucccaggaucgcaagagccaug

SEQ ID NO: 2178532 - RNA, 23 nt, Human
aucccaacugucuuuuuuucccu

SEQ ID NO: 2178533 - RNA, 17 nt, Human
aucccaacugucuuuuu

SEQ ID NO: 2178534 - RNA, 17 nt, Human
aucccaagacccagggc

SEQ ID NO: 2178535 - RNA, 19 nt, Human
aucccaagaucugugcagc

SEQ ID NO: 2178536 - RNA, 15 nt, Human
aucccaacugucuuu

SEQ ID NO: 2178537 - RNA, 15 nt, Human
auccagguucagcuu

SEQ ID NO: 2178538 - RNA, 16 nt, Human
auccagguucagcuug

SEQ ID NO: 2178539 - RNA, 17 nt, Human
auccaggguggugguga

SEQ ID NO: 2178540 - RNA, 14 nt, Human
aucauuuuaauuau

SEQ ID NO: 2178541 - RNA, 15 nt, Human
aucauuuuaauuauu

SEQ ID NO: 2178542 - RNA, 14 nt, Human
auccagguaaucca

SEQ ID NO: 2178543 - RNA, 22 nt, Human
aucauuucuugggcccuccuga

SEQ ID NO: 2178544 - RNA, 19 nt, Human
aucauuucuugggcccucc

SEQ ID NO: 2178545 - RNA, 18 nt, Human
aucauuucuugggcccuc

SEQ ID NO: 2178546 - RNA, 15 nt, Human
aucauuucuugggcc

SEQ ID NO: 2178547 - RNA, 14 nt, Human
uucuguacugauuu

SEQ ID NO: 2178548 - RNA, 20 nt, Human
uucuguacugauuuuuguaa

SEQ ID NO: 2178549 - RNA, 18 nt, Human
uucuguacucaaauguag

SEQ ID NO: 2178550 - RNA, 17 nt, Human
aucauuugaacaacuag

SEQ ID NO: 2178551 - RNA, 12 nt, Human
aucauuuguuca

SEQ ID NO: 2178552 - RNA, 15 nt, Human
aucauuugcccuuaa

SEQ ID NO: 2178553 - RNA, 18 nt, Human
aucauuugcccuuaagga

SEQ ID NO: 2178554 - RNA, 19 nt, Human
aucauuuguucaaagcugu

SEQ ID NO: 2178555 - RNA, 18 nt, Human
aucauuuguuggaaugaa

SEQ ID NO: 2178556 - RNA, 13 nt, Human
aucauuugcuuuu

SEQ ID NO: 2178557 - RNA, 21 nt, Human
uuccucuauugauguacaguc

SEQ ID NO: 2178558 - RNA, 23 nt, Human
uuccucuagugcccuccacagcc

SEQ ID NO: 2178559 - RNA, 17 nt, Human
uuccucuagaagccaag

SEQ ID NO: 2178560 - RNA, 17 nt, Human
uuccucuauugauguac

SEQ ID NO: 2178561 - RNA, 17 nt, Human
uuccucuaguucuuugu

SEQ ID NO: 2178562 - RNA, 16 nt, Human
uuccucuuccccuugc

SEQ ID NO: 2178563 - RNA, 13 nt, Human
uuccucuucccca

SEQ ID NO: 2178564 - RNA, 20 nt, Human
uuccucuucuauuuuguaaa

SEQ ID NO: 2178565 - RNA, 18 nt, Human
uuccucuuccccuugccc

SEQ ID NO: 2178566 - RNA, 19 nt, Human
uuccucuuccccuugcccu

SEQ ID NO: 2178567 - RNA, 12 nt, Human
uuccucugggaa

SEQ ID NO: 2178568 - RNA, 21 nt, Human
uuccucuguuucuccuucuga

SEQ ID NO: 2178569 - RNA, 19 nt, Human
uuccucuagugcccuccac

SEQ ID NO: 2178570 - RNA, 15 nt, Human
uuccucuagaagcca

SEQ ID NO: 2178571 - RNA, 14 nt, Human
uuccucgcccuggg

SEQ ID NO: 2178572 - RNA, 15 nt, Human
uuccuccuuccaugg

SEQ ID NO: 2178573 - RNA, 18 nt, Human
uuccucgcagagaggcca

SEQ ID NO: 2178574 - RNA, 17 nt, Human
uuccuccuguguacagg

SEQ ID NO: 2178575 - RNA, 23 nt, Human
uuccuccugggcccucucugcuc

SEQ ID NO: 2178576 - RNA, 14 nt, Human
uuccuccuggcaga

SEQ ID NO: 2178577 - RNA, 13 nt, Human
uuccuccugugua

SEQ ID NO: 2178578 - RNA, 22 nt, Human
uuccuaauaaaguucuguacuc

SEQ ID NO: 2178579 - RNA, 14 nt, Human
uuccuccuggaaau

SEQ ID NO: 2178580 - RNA, 21 nt, Human
uuccuccugggcccucucugc

SEQ ID NO: 2178581 - RNA, 15 nt, Human
uuccuccugggcccu

SEQ ID NO: 2178582 - RNA, 14 nt, Human
uuccuccugggccc

SEQ ID NO: 2178583 - RNA, 11 nt, Human
uuccuccuggg

SEQ ID NO: 2178584 - RNA, 15 nt, Human
uuccuaauaaaguuc

SEQ ID NO: 2178585 - RNA, 19 nt, Human
uuccuaauaaaguucugua

SEQ ID NO: 2178586 - RNA, 16 nt, Human
uuccuaauaaaguucu

SEQ ID NO: 2178587 - RNA, 24 nt, Human
auauuuucaaauuguaucuagugc

SEQ ID NO: 2178588 - RNA, 13 nt, Human
uuccuaagugauu

SEQ ID NO: 2178589 - RNA, 17 nt, Human
auauuuucaaauuguau

SEQ ID NO: 2178590 - RNA, 20 nt, Human
auauuuuaugugagagaaag

SEQ ID NO: 2178591 - RNA, 15 nt, Human
auauuuuauuauaua

SEQ ID NO: 2178592 - RNA, 13 nt, Human
uuccuaauccucu

SEQ ID NO: 2178593 - RNA, 15 nt, Human
uuccuaauccucuag

SEQ ID NO: 2178594 - RNA, 15 nt, Human
auauuuuaugugaga

SEQ ID NO: 2178595 - RNA, 14 nt, Human
auauuuuauaauuu

SEQ ID NO: 2178596 - RNA, 12 nt, Human
auauuuuaaaua

SEQ ID NO: 2178597 - RNA, 14 nt, Human
auauuuuaagacga

SEQ ID NO: 2178598 - RNA, 20 nt, Human
uuccuguucuuaagacguga

SEQ ID NO: 2178599 - RNA, 15 nt, Human
uuccuguucugaacu

SEQ ID NO: 2178600 - RNA, 13 nt, Human
uuccuguucugaa

SEQ ID NO: 2178601 - RNA, 15 nt, Human
uuccuucagcuucca

SEQ ID NO: 2178602 - RNA, 19 nt, Human
uuccuguuggauuuguuua

SEQ ID NO: 2178603 - RNA, 20 nt, Human
uuccuguuggauuuguuuaa

SEQ ID NO: 2178604 - RNA, 11 nt, Human
uuccuucagug

SEQ ID NO: 2178605 - RNA, 14 nt, Human
uuccuucagugccu

SEQ ID NO: 2178606 - RNA, 22 nt, Human
uuccuucagugcaucugggaag

SEQ ID NO: 2178607 - RNA, 21 nt, Human
auauuuucaccauuugauuau

SEQ ID NO: 2178608 - RNA, 22 nt, Human
uuccuucagggugaugccaggu

SEQ ID NO: 2178609 - RNA, 23 nt, Human
auauuuucaugacuuuuccaugu

SEQ ID NO: 2178610 - RNA, 19 nt, Human
auauuuucaacgcagcccu

SEQ ID NO: 2178611 - RNA, 20 nt, Human
auauuuucaacgcagcccug

SEQ ID NO: 2178612 - RNA, 15 nt, Human
uuccuucagugccuu

SEQ ID NO: 2178613 - RNA, 14 nt, Human
uuccuucaggguga

SEQ ID NO: 2178614 - RNA, 15 nt, Human
uuccuucagggugau

SEQ ID NO: 2178615 - RNA, 15 nt, Human
uuccugguacccagc

SEQ ID NO: 2178616 - RNA, 11 nt, Human
uuccucuuucc

SEQ ID NO: 2178617 - RNA, 17 nt, Human
uuccuguucccaugaga

SEQ ID NO: 2178618 - RNA, 22 nt, Human
uuccuguguguccaaaacugcc

SEQ ID NO: 2178619 - RNA, 23 nt, Human
uuccuguuagguauuagaaagug

SEQ ID NO: 2178620 - RNA, 21 nt, Human
uuccuguguguccaaaacugc

SEQ ID NO: 2178621 - RNA, 20 nt, Human
uuccuggugccaauuucaag

SEQ ID NO: 2178622 - RNA, 19 nt, Human
uuccuggugccaauuucaa

SEQ ID NO: 2178623 - RNA, 16 nt, Human
uuccugguacccagcc

SEQ ID NO: 2178624 - RNA, 17 nt, Human
uuccugguacccagcca

SEQ ID NO: 2178625 - RNA, 18 nt, Human
uuccugguacccagccau

SEQ ID NO: 2178626 - RNA, 14 nt, Human
uuccuggucuguag

SEQ ID NO: 2178627 - RNA, 19 nt, Human
uuccugguacccagccauc

SEQ ID NO: 2178628 - RNA, 21 nt, Human
uuccugguacccagccaucug

SEQ ID NO: 2178629 - RNA, 18 nt, Human
auauuuucuuuaaugcuu

SEQ ID NO: 2178630 - RNA, 21 nt, Human
auauuuucuuuaaaagacaaa

SEQ ID NO: 2178631 - RNA, 12 nt, Human
auauuuugaauc

SEQ ID NO: 2178632 - RNA, 13 nt, Human
auauuuugaauca

SEQ ID NO: 2178633 - RNA, 19 nt, Human
auauuuugaaucaauaaua

SEQ ID NO: 2178634 - RNA, 14 nt, Human
auauuuugaaucaa

SEQ ID NO: 2178635 - RNA, 13 nt, Human
auauuuugauuau

SEQ ID NO: 2178636 - RNA, 17 nt, Human
auauuuugauuauugua

SEQ ID NO: 2178637 - RNA, 19 nt, Human
auauuuugauuauuguauu

SEQ ID NO: 2178638 - RNA, 21 nt, Human
auauuuugcacaguuagcaaa

SEQ ID NO: 2178639 - RNA, 19 nt, Human
auauuuugggaaucuuuuc

SEQ ID NO: 2178640 - RNA, 19 nt, Human
aucaagagcugcccuccuu

SEQ ID NO: 2178641 - RNA, 20 nt, Human
aucaagagcugcccuccuug

SEQ ID NO: 2178642 - RNA, 22 nt, Human
aucaagaugagagaacuggagg

SEQ ID NO: 2178643 - RNA, 15 nt, Human
aucaagagcugcccu

SEQ ID NO: 2178644 - RNA, 16 nt, Human
aucaagagcugcccuc

SEQ ID NO: 2178645 - RNA, 17 nt, Human
aucaagagcugcccucc

SEQ ID NO: 2178646 - RNA, 15 nt, Human
aucaagacuggaagg

SEQ ID NO: 2178647 - RNA, 15 nt, Human
aucaagaaaguguug

SEQ ID NO: 2178648 - RNA, 23 nt, Human
aucaagaauggggaucacagaga

SEQ ID NO: 2178649 - RNA, 21 nt, Human
auauuuuguauauaucugcuu

SEQ ID NO: 2178650 - RNA, 13 nt, Human
auauuuuguauau

SEQ ID NO: 2178651 - RNA, 14 nt, Human
auauuuuguauaua

SEQ ID NO: 2178652 - RNA, 12 nt, Human
aucaagaaaguc

SEQ ID NO: 2178653 - RNA, 13 nt, Human
aucaaucaaaccc

SEQ ID NO: 2178654 - RNA, 18 nt, Human
aucaauauugucauuccu

SEQ ID NO: 2178655 - RNA, 20 nt, Human
aucaauauugucauuccugu

SEQ ID NO: 2178656 - RNA, 13 nt, Human
aucaaucaacuua

SEQ ID NO: 2178657 - RNA, 22 nt, Human
aucaauauugucauuccuguau

SEQ ID NO: 2178658 - RNA, 19 nt, Human
aucaauacacuaguuguuu

SEQ ID NO: 2178659 - RNA, 16 nt, Human
aucaauaauauauuuu

SEQ ID NO: 2178660 - RNA, 18 nt, Human
aucaauaauauauuuucu

SEQ ID NO: 2178661 - RNA, 20 nt, Human
aucaauaauauauuuucugu

SEQ ID NO: 2178662 - RNA, 21 nt, Human
aucaauaauauauuuucuguu

SEQ ID NO: 2178663 - RNA, 12 nt, Human
aucaauacacua

SEQ ID NO: 2178664 - RNA, 17 nt, Human
aucaauacacuaguugu

SEQ ID NO: 2178665 - RNA, 18 nt, Human
aucaagaugucagacugg

SEQ ID NO: 2178666 - RNA, 13 nt, Human
aucaaguauuaua

SEQ ID NO: 2178667 - RNA, 18 nt, Human
aucaaguauuauaccuuu

SEQ ID NO: 2178668 - RNA, 14 nt, Human
aucaaguauuauac

SEQ ID NO: 2178669 - RNA, 15 nt, Human
uuccuuuggagcuuu

SEQ ID NO: 2178670 - RNA, 21 nt, Human
aucacugucuuuccuagaugg

SEQ ID NO: 2178671 - RNA, 18 nt, Human
aucacuggcaaugaaaaa

SEQ ID NO: 2178672 - RNA, 16 nt, Human
aucacuggcaaugaaa

SEQ ID NO: 2178673 - RNA, 23 nt, Human
aucacuggcaaugaaaaauucuc

SEQ ID NO: 2178674 - RNA, 22 nt, Human
aucacuggcaaugaaaaauucu

SEQ ID NO: 2178675 - RNA, 19 nt, Human
aucacugucuuuccuagau

SEQ ID NO: 2178676 - RNA, 18 nt, Human
aucacugucuuuccuaga

SEQ ID NO: 2178677 - RNA, 16 nt, Human
aucacugucuuuccua

SEQ ID NO: 2178678 - RNA, 15 nt, Human
aucacugucuuuccu

SEQ ID NO: 2178679 - RNA, 14 nt, Human
aucacugucuuucc

SEQ ID NO: 2178680 - RNA, 12 nt, Human
aucacugucuuu

SEQ ID NO: 2178681 - RNA, 22 nt, Human
aucacugguugcacuuaugauu

SEQ ID NO: 2178682 - RNA, 12 nt, Human
uuccuuuuauca

SEQ ID NO: 2178683 - RNA, 14 nt, Human
uuccuuuucccugc

SEQ ID NO: 2178684 - RNA, 15 nt, Human
uuccuuuucccugcu

SEQ ID NO: 2178685 - RNA, 20 nt, Human
uuccuuuuagccuaguucau

SEQ ID NO: 2178686 - RNA, 21 nt, Human
uuccuuuguuuuuuuuuccug

SEQ ID NO: 2178687 - RNA, 12 nt, Human
uuccuuuuaauu

SEQ ID NO: 2178688 - RNA, 21 nt, Human
uuccuuuuaaaacacuuccau

SEQ ID NO: 2178689 - RNA, 22 nt, Human
uuccuuuuaaaacacuuccaua

SEQ ID NO: 2178690 - RNA, 20 nt, Human
uuccuuuuaaaacacuucca

SEQ ID NO: 2178691 - RNA, 18 nt, Human
uuccuuuguguuucuauu

SEQ ID NO: 2178692 - RNA, 14 nt, Human
aucacguaaagcua

SEQ ID NO: 2178693 - RNA, 21 nt, Human
aucacguaaagcuagaaauga

SEQ ID NO: 2178694 - RNA, 20 nt, Human
aucacuaauacuaauucauu

SEQ ID NO: 2178695 - RNA, 14 nt, Human
aucacuacugcagu

SEQ ID NO: 2178696 - RNA, 22 nt, Human
aucacggucgccaccuggcauu

SEQ ID NO: 2178697 - RNA, 13 nt, Human
aucacuacugcag

SEQ ID NO: 2178698 - RNA, 22 nt, Human
aucacggcucacugcagccuca

SEQ ID NO: 2178699 - RNA, 22 nt, Human
aucacaacgugcauugugcuuc

SEQ ID NO: 2178700 - RNA, 20 nt, Human
aucaaucaucugugugaaaa

SEQ ID NO: 2178701 - RNA, 14 nt, Human
aucaaucacagcuu

SEQ ID NO: 2178702 - RNA, 20 nt, Human
aucaaucacagcuuguauuu

SEQ ID NO: 2178703 - RNA, 19 nt, Human
aucaaucaucugugugaaa

SEQ ID NO: 2178704 - RNA, 22 nt, Human
aucaaucaucugugugaaaaug

SEQ ID NO: 2178705 - RNA, 16 nt, Human
aucacaacaagaaauu

SEQ ID NO: 2178706 - RNA, 17 nt, Human
aucacaacacuggcuga

SEQ ID NO: 2178707 - RNA, 15 nt, Human
aucacaacgugcauu

SEQ ID NO: 2178708 - RNA, 17 nt, Human
aucacaacgugcauugu

SEQ ID NO: 2178709 - RNA, 18 nt, Human
aucacaacgugcauugug

SEQ ID NO: 2178710 - RNA, 21 nt, Human
aucacaacgugcauugugcuu

SEQ ID NO: 2178711 - RNA, 14 nt, Human
auauucuuauguau

SEQ ID NO: 2178712 - RNA, 16 nt, Human
auauucuguuggccag

SEQ ID NO: 2178713 - RNA, 22 nt, Human
auauucucacgggcaguagcug

SEQ ID NO: 2178714 - RNA, 21 nt, Human
auauuccugcagccuggaggc

SEQ ID NO: 2178715 - RNA, 18 nt, Human
auauuccauauauuagca

SEQ ID NO: 2178716 - RNA, 15 nt, Human
auauucauuuggaaa

SEQ ID NO: 2178717 - RNA, 13 nt, Human
auauucauuugga

SEQ ID NO: 2178718 - RNA, 13 nt, Human
auauucauuucaa

SEQ ID NO: 2178719 - RNA, 18 nt, Human
auauuccccuaucucuag

SEQ ID NO: 2178720 - RNA, 19 nt, Human
auauuccaugaauguauca

SEQ ID NO: 2178721 - RNA, 16 nt, Human
auauuccaugaaugua

SEQ ID NO: 2178722 - RNA, 15 nt, Human
auauuccaugaaugu

SEQ ID NO: 2178723 - RNA, 23 nt, Human
auauucccuagaaacuuccaaau

SEQ ID NO: 2178724 - RNA, 17 nt, Human
auauucccuagaaacuu

SEQ ID NO: 2178725 - RNA, 23 nt, Human
auauuccugaaugaaauaucaga

SEQ ID NO: 2178726 - RNA, 22 nt, Human
auauuccugaaugaaauaucag

SEQ ID NO: 2178727 - RNA, 18 nt, Human
auauuccugaaugaaaua

SEQ ID NO: 2178728 - RNA, 17 nt, Human
auauuccugaaugaaau

SEQ ID NO: 2178729 - RNA, 15 nt, Human
auauuccugaaugaa

SEQ ID NO: 2178730 - RNA, 18 nt, Human
auauugaauauaauauau

SEQ ID NO: 2178731 - RNA, 21 nt, Human
auauugaauauaauauauuug

SEQ ID NO: 2178732 - RNA, 13 nt, Human
auauugaugugug

SEQ ID NO: 2178733 - RNA, 19 nt, Human
auauugauuuccguuaaaa

SEQ ID NO: 2178734 - RNA, 22 nt, Human
auauugauuuccguuaaaauac

SEQ ID NO: 2178735 - RNA, 21 nt, Human
auauugauuuccguuaaaaua

SEQ ID NO: 2178736 - RNA, 23 nt, Human
auauucuuauguaugugaaaguu

SEQ ID NO: 2178737 - RNA, 16 nt, Human
auauugaaaaaauaga

SEQ ID NO: 2178738 - RNA, 15 nt, Human
auauugauccagaaa

SEQ ID NO: 2178739 - RNA, 22 nt, Human
auauugauccagaaagaaaacu

SEQ ID NO: 2178740 - RNA, 20 nt, Human
auauguuuuaagaggcaggg

SEQ ID NO: 2178741 - RNA, 21 nt, Human
auauguuuugugggaacagau

SEQ ID NO: 2178742 - RNA, 14 nt, Human
auauguuuuuuaga

SEQ ID NO: 2178743 - RNA, 17 nt, Human
auauguuuuuuagauca

SEQ ID NO: 2178744 - RNA, 18 nt, Human
auauguuuuaagaggcag

SEQ ID NO: 2178745 - RNA, 13 nt, Human
uucauguuucuua

SEQ ID NO: 2178746 - RNA, 12 nt, Human
uucauguuucuu

SEQ ID NO: 2178747 - RNA, 22 nt, Human
uucauguugcacacccacucag

SEQ ID NO: 2178748 - RNA, 18 nt, Human
uucauguuuuaacaaaaa

SEQ ID NO: 2178749 - RNA, 16 nt, Human
uucauguuuugugacu

SEQ ID NO: 2178750 - RNA, 17 nt, Human
uucauguuuugugacua

SEQ ID NO: 2178751 - RNA, 18 nt, Human
uucauguuuugugacuau

SEQ ID NO: 2178752 - RNA, 17 nt, Human
uucauguuuuaacaaaa

SEQ ID NO: 2178753 - RNA, 15 nt, Human
uucauguuuuaacaa

SEQ ID NO: 2178754 - RNA, 14 nt, Human
uucauguuugcuuc

SEQ ID NO: 2178755 - RNA, 23 nt, Human
auauuaaauauguuagcaaagag

SEQ ID NO: 2178756 - RNA, 19 nt, Human
auauuaaauacagacacua

SEQ ID NO: 2178757 - RNA, 20 nt, Human
auauuaaauacagacacuaa

SEQ ID NO: 2178758 - RNA, 14 nt, Human
auauuaaaggaguu

SEQ ID NO: 2178759 - RNA, 12 nt, Human
auauuaaauaca

SEQ ID NO: 2178760 - RNA, 13 nt, Human
auauuaaauacag

SEQ ID NO: 2178761 - RNA, 17 nt, Human
auauuaaauacagacac

SEQ ID NO: 2178762 - RNA, 13 nt, Human
auauuaaaucugc

SEQ ID NO: 2178763 - RNA, 12 nt, Human
auauuaaaucug

SEQ ID NO: 2178764 - RNA, 22 nt, Human
auauuaaggaagacaaugugaa

SEQ ID NO: 2178765 - RNA, 24 nt, Human
auauuaagaaagacuaucuaaaug

SEQ ID NO: 2178766 - RNA, 23 nt, Human
auauucauuguauaaaaauagaa

SEQ ID NO: 2178767 - RNA, 21 nt, Human
auauucauuguauaaaaauag

SEQ ID NO: 2178768 - RNA, 19 nt, Human
auauuaauauauaucugcu

SEQ ID NO: 2178769 - RNA, 15 nt, Human
auauuaaugccuuua

SEQ ID NO: 2178770 - RNA, 14 nt, Human
auauuaauauuccu

SEQ ID NO: 2178771 - RNA, 14 nt, Human
auauuaaugccuuu

SEQ ID NO: 2178772 - RNA, 15 nt, Human
auauuugaaucuugu

SEQ ID NO: 2178773 - RNA, 16 nt, Human
auauuugaaucuuguc

SEQ ID NO: 2178774 - RNA, 20 nt, Human
auauuuguaaauuuauguga

SEQ ID NO: 2178775 - RNA, 12 nt, Human
auauuuguacau

SEQ ID NO: 2178776 - RNA, 13 nt, Human
auauuuguacaua

SEQ ID NO: 2178777 - RNA, 11 nt, Human
auauuuguaca

SEQ ID NO: 2178778 - RNA, 13 nt, Human
auauuuguacaaa

SEQ ID NO: 2178779 - RNA, 14 nt, Human
auauuuguacaaaa

SEQ ID NO: 2178780 - RNA, 11 nt, Human
auauuugaauc

SEQ ID NO: 2178781 - RNA, 13 nt, Human
auauuugaaucuu

SEQ ID NO: 2178782 - RNA, 14 nt, Human
auauuugaaucuug

SEQ ID NO: 2178783 - RNA, 23 nt, Human
auauuugaaauauugacuuuuua

SEQ ID NO: 2178784 - RNA, 14 nt, Human
auauuugaaauauu

SEQ ID NO: 2178785 - RNA, 19 nt, Human
auauuugaaauauugacuu

SEQ ID NO: 2178786 - RNA, 14 nt, Human
auauuuguggaaua

SEQ ID NO: 2178787 - RNA, 17 nt, Human
auauuuguguauuuaac

SEQ ID NO: 2178788 - RNA, 22 nt, Human
auauuugugauagcacuuucua

SEQ ID NO: 2178789 - RNA, 21 nt, Human
auauuugugauagcacuuucu

SEQ ID NO: 2178790 - RNA, 20 nt, Human
auauuugugauagcacuuuc

SEQ ID NO: 2178791 - RNA, 12 nt, Human
auauuuguagaa

SEQ ID NO: 2178792 - RNA, 18 nt, Human
auauuuguauaguugcuu

SEQ ID NO: 2178793 - RNA, 22 nt, Human
auauuuguaucacaaaucuuaa

SEQ ID NO: 2178794 - RNA, 22 nt, Human
auauuuguuaaauauuuacaua

SEQ ID NO: 2178795 - RNA, 21 nt, Human
auauuuguuaaauauuuacau

SEQ ID NO: 2178796 - RNA, 13 nt, Human
auauuuguuaaau

SEQ ID NO: 2178797 - RNA, 15 nt, Human
auauuuguuauguag

SEQ ID NO: 2178798 - RNA, 14 nt, Human
auauuuuaaaauga

SEQ ID NO: 2178799 - RNA, 16 nt, Human
auauuuuaaaaugaga

SEQ ID NO: 2178800 - RNA, 12 nt, Human
auauuuuaacuu

SEQ ID NO: 2178801 - RNA, 15 nt, Human
auauuucgaaagcug

SEQ ID NO: 2178802 - RNA, 22 nt, Human
auauuuaaaggcccuaucuguu

SEQ ID NO: 2178803 - RNA, 23 nt, Human
auauuuaaacaugguuacaauca

SEQ ID NO: 2178804 - RNA, 21 nt, Human
auauuuaaacaugguuacaau

SEQ ID NO: 2178805 - RNA, 14 nt, Human
auauuuaaagacag

SEQ ID NO: 2178806 - RNA, 15 nt, Human
auauuuaaaagaaag

SEQ ID NO: 2178807 - RNA, 12 nt, Human
auauuuaaacag

SEQ ID NO: 2178808 - RNA, 14 nt, Human
auauuuaaacagca

SEQ ID NO: 2178809 - RNA, 18 nt, Human
auauuuaaacagcagugu

SEQ ID NO: 2178810 - RNA, 15 nt, Human
auauuucugauauaa

SEQ ID NO: 2178811 - RNA, 13 nt, Human
auauuugaaauau

SEQ ID NO: 2178812 - RNA, 20 nt, Human
auauuguuauuauauaauua

SEQ ID NO: 2178813 - RNA, 21 nt, Human
auauuguguuuguguauuuac

SEQ ID NO: 2178814 - RNA, 17 nt, Human
auauuguguuuguguau

SEQ ID NO: 2178815 - RNA, 20 nt, Human
auauuguuuucaguguacau

SEQ ID NO: 2178816 - RNA, 22 nt, Human
auauugcugagagaaauaugga

SEQ ID NO: 2178817 - RNA, 17 nt, Human
auauuguguugugaaug

SEQ ID NO: 2178818 - RNA, 13 nt, Human
auauuguguuugu

SEQ ID NO: 2178819 - RNA, 18 nt, Human
auauuguguugugaaugu

SEQ ID NO: 2178820 - RNA, 17 nt, Human
auauugcugauggugca

SEQ ID NO: 2178821 - RNA, 21 nt, Human
auauugcugauggugcaauga

SEQ ID NO: 2178822 - RNA, 16 nt, Human
auauugcauaugcaua

SEQ ID NO: 2178823 - RNA, 16 nt, Human
auauugccgcacuagg

SEQ ID NO: 2178824 - RNA, 19 nt, Human
auauugcacaugucuuaau

SEQ ID NO: 2178825 - RNA, 20 nt, Human
auauugcacaugucuuaaug

SEQ ID NO: 2178826 - RNA, 21 nt, Human
auauugcacaugucuuaauga

SEQ ID NO: 2178827 - RNA, 16 nt, Human
auauugauuucugccu

SEQ ID NO: 2178828 - RNA, 22 nt, Human
auauugauuucugccuuccuug

SEQ ID NO: 2178829 - RNA, 13 nt, Human
auauugcacaugu

SEQ ID NO: 2178830 - RNA, 15 nt, Human
auauugcacaugucu

SEQ ID NO: 2178831 - RNA, 16 nt, Human
auauugcacaugucuu

SEQ ID NO: 2178832 - RNA, 17 nt, Human
auauugcacaugucuua

SEQ ID NO: 2178833 - RNA, 12 nt, Human
ugugcccaaguu

SEQ ID NO: 2178834 - RNA, 22 nt, Human
ugugccauuuuaaaaaaaaagg

SEQ ID NO: 2178835 - RNA, 17 nt, Human
ugugcccacaucccagg

SEQ ID NO: 2178836 - RNA, 20 nt, Human
ugugcccacaucccaggcuu

SEQ ID NO: 2178837 - RNA, 21 nt, Human
ugugcccacaucccaggcuuc

SEQ ID NO: 2178838 - RNA, 23 nt, Human
ugugcccacccuccacucuccuc

SEQ ID NO: 2178839 - RNA, 14 nt, Human
ugugcccacccucc

SEQ ID NO: 2178840 - RNA, 12 nt, Human
ugugccaugugc

SEQ ID NO: 2178841 - RNA, 16 nt, Human
ugugccaugugccagg

SEQ ID NO: 2178842 - RNA, 20 nt, Human
ugugccagguuuuuggucug

SEQ ID NO: 2178843 - RNA, 20 nt, Human
ugugccagauuuaugcauau

SEQ ID NO: 2178844 - RNA, 18 nt, Human
ugugccauagaguuuaac

SEQ ID NO: 2178845 - RNA, 20 nt, Human
ugugccauagaguuuaacac

SEQ ID NO: 2178846 - RNA, 21 nt, Human
ugugccauagaguuuaacaca

SEQ ID NO: 2178847 - RNA, 21 nt, Human
ugugccagggcaaugaugaau

SEQ ID NO: 2178848 - RNA, 18 nt, Human
ugugccagggcaaugaug

SEQ ID NO: 2178849 - RNA, 16 nt, Human
ugugccauagucacau

SEQ ID NO: 2178850 - RNA, 18 nt, Human
ugugccauagucacaugg

SEQ ID NO: 2178851 - RNA, 21 nt, Human
ugugccauagucacauggccu

SEQ ID NO: 2178852 - RNA, 22 nt, Human
ugugccauagaguuuaacacaa

SEQ ID NO: 2178853 - RNA, 17 nt, Human
ugugauuugacuguuuu

SEQ ID NO: 2178854 - RNA, 22 nt, Human
ugugauuugacuguuuuuaccc

SEQ ID NO: 2178855 - RNA, 23 nt, Human
ugugauuugacuguuuuuaccca

SEQ ID NO: 2178856 - RNA, 23 nt, Human
ugugauuucccguggccccagcc

SEQ ID NO: 2178857 - RNA, 24 nt, Human
ugugauuucccguggccccagccu

SEQ ID NO: 2178858 - RNA, 23 nt, Human
ugugauuuccuacuaaccuguuc

SEQ ID NO: 2178859 - RNA, 12 nt, Human
ugugauuugacu

SEQ ID NO: 2178860 - RNA, 13 nt, Human
ugugauuugacug

SEQ ID NO: 2178861 - RNA, 14 nt, Human
ugugauuugacugu

SEQ ID NO: 2178862 - RNA, 15 nt, Human
ugugauuugacuguu

SEQ ID NO: 2178863 - RNA, 22 nt, Human
ugugcauuuuugugaaaugaaa

SEQ ID NO: 2178864 - RNA, 16 nt, Human
ugugccaauauguauu

SEQ ID NO: 2178865 - RNA, 21 nt, Human
ugugcauuuuugugaaaugaa

SEQ ID NO: 2178866 - RNA, 17 nt, Human
ugugccaauauguauug

SEQ ID NO: 2178867 - RNA, 20 nt, Human
ugugccacccaccagggcga

SEQ ID NO: 2178868 - RNA, 16 nt, Human
ugugccacccaccagg

SEQ ID NO: 2178869 - RNA, 18 nt, Human
ugugccaauauguauugu

SEQ ID NO: 2178870 - RNA, 18 nt, Human
ugugccagauuuaugcau

SEQ ID NO: 2178871 - RNA, 12 nt, Human
ugugccacccug

SEQ ID NO: 2178872 - RNA, 14 nt, Human
ugugccacccuggg

SEQ ID NO: 2178873 - RNA, 15 nt, Human
ugugccacccugggc

SEQ ID NO: 2178874 - RNA, 16 nt, Human
ugugccacccugggcu

SEQ ID NO: 2178875 - RNA, 17 nt, Human
ugugccacccugggcuc

SEQ ID NO: 2178876 - RNA, 21 nt, Human
ugugccacccugggcucugug

SEQ ID NO: 2178877 - RNA, 22 nt, Human
ugugccacccugggcucugugg

SEQ ID NO: 2178878 - RNA, 23 nt, Human
ugugccacucaccgaagccacuu

SEQ ID NO: 2178879 - RNA, 14 nt, Human
ugugauugugccua

SEQ ID NO: 2178880 - RNA, 14 nt, Human
ugugauuguggaau

SEQ ID NO: 2178881 - RNA, 16 nt, Human
ugugauguauucuagc

SEQ ID NO: 2178882 - RNA, 19 nt, Human
ugugaugguucguucuguu

SEQ ID NO: 2178883 - RNA, 22 nt, Human
ugugaugguucguucuguuuac

SEQ ID NO: 2178884 - RNA, 14 nt, Human
ugugauguauucua

SEQ ID NO: 2178885 - RNA, 18 nt, Human
ugugaugacaacuggaau

SEQ ID NO: 2178886 - RNA, 17 nt, Human
ugugauuguggaaugga

SEQ ID NO: 2178887 - RNA, 23 nt, Human
ugugaugguucguucuguuuaca

SEQ ID NO: 2178888 - RNA, 15 nt, Human
ugugauuuaauagug

SEQ ID NO: 2178889 - RNA, 16 nt, Human
ugugauuuaauagugu

SEQ ID NO: 2178890 - RNA, 17 nt, Human
ugugauuuaauaguguu

SEQ ID NO: 2178891 - RNA, 19 nt, Human
ugugauuuaauaguguuaa

SEQ ID NO: 2178892 - RNA, 20 nt, Human
ugugauuuaauaguguuaau

SEQ ID NO: 2178893 - RNA, 22 nt, Human
ugugauuuaauaguguuaauca

SEQ ID NO: 2178894 - RNA, 17 nt, Human
ugugauuuagaacugua

SEQ ID NO: 2178895 - RNA, 18 nt, Human
ugugauuuagaacuguau

SEQ ID NO: 2178896 - RNA, 23 nt, Human
ugugauuuagaacuguaugucag

SEQ ID NO: 2178897 - RNA, 15 nt, Human
ugugauuucccgugg

SEQ ID NO: 2178898 - RNA, 19 nt, Human
ugugauuucccguggcccc

SEQ ID NO: 2178899 - RNA, 20 nt, Human
ugugauuucccguggcccca

SEQ ID NO: 2178900 - RNA, 22 nt, Human
ugugauuucccguggccccagc

SEQ ID NO: 2178901 - RNA, 15 nt, Human
ugugaugaacuuucu

SEQ ID NO: 2178902 - RNA, 14 nt, Human
ugugaugaauacug

SEQ ID NO: 2178903 - RNA, 18 nt, Human
ugugaugaauacuguauu

SEQ ID NO: 2178904 - RNA, 16 nt, Human
ugugaugaauacugua

SEQ ID NO: 2178905 - RNA, 18 nt, Human
ugugaugagaggaaauca

SEQ ID NO: 2178906 - RNA, 18 nt, Human
ugugauggggcccugccu

SEQ ID NO: 2178907 - RNA, 19 nt, Human
ugugauggggcccugccuc

SEQ ID NO: 2178908 - RNA, 20 nt, Human
ugugauggggcccugccucc

SEQ ID NO: 2178909 - RNA, 23 nt, Human
ugugaucccaagugccagucuug

SEQ ID NO: 2178910 - RNA, 18 nt, Human
ugugaucccaagugccag

SEQ ID NO: 2178911 - RNA, 13 nt, Human
ugugaucgucuga

SEQ ID NO: 2178912 - RNA, 17 nt, Human
ugugauccuuuuauguu

SEQ ID NO: 2178913 - RNA, 21 nt, Human
ugugauccuuuuauguuauuu

SEQ ID NO: 2178914 - RNA, 20 nt, Human
ugugaucuaucaauagucaa

SEQ ID NO: 2178915 - RNA, 20 nt, Human
agugaacaaauuuacagaga

SEQ ID NO: 2178916 - RNA, 16 nt, Human
agugaacaaauuuaca

SEQ ID NO: 2178917 - RNA, 16 nt, Human
agugaaagcuagagau

SEQ ID NO: 2178918 - RNA, 15 nt, Human
agugaaagaaaauaa

SEQ ID NO: 2178919 - RNA, 19 nt, Human
uguggagggcacauuccuu

SEQ ID NO: 2178920 - RNA, 12 nt, Human
uguggagugggg

SEQ ID NO: 2178921 - RNA, 16 nt, Human
uguggaguggggcagu

SEQ ID NO: 2178922 - RNA, 18 nt, Human
uguggaguggggcaguag

SEQ ID NO: 2178923 - RNA, 17 nt, Human
uguggaguucaucuuga

SEQ ID NO: 2178924 - RNA, 21 nt, Human
uguggagguacacucuuauag

SEQ ID NO: 2178925 - RNA, 21 nt, Human
uguggaggaaggauuguaaaa

SEQ ID NO: 2178926 - RNA, 13 nt, Human
uguggagggcaca

SEQ ID NO: 2178927 - RNA, 20 nt, Human
uguggaggaguccaggccau

SEQ ID NO: 2178928 - RNA, 21 nt, Human
ugugcugggagcuccacucug

SEQ ID NO: 2178929 - RNA, 14 nt, Human
uguggcaggcagcg

SEQ ID NO: 2178930 - RNA, 21 nt, Human
uguggaguucaucuugaauug

SEQ ID NO: 2178931 - RNA, 23 nt, Human
uguggcaguuuggcaaacucucc

SEQ ID NO: 2178932 - RNA, 23 nt, Human
uguggcaggcagcgccaagcaac

SEQ ID NO: 2178933 - RNA, 11 nt, Human
uguggcagugg

SEQ ID NO: 2178934 - RNA, 12 nt, Human
uguggcaguggu

SEQ ID NO: 2178935 - RNA, 15 nt, Human
uguggcagugguuuu

SEQ ID NO: 2178936 - RNA, 16 nt, Human
uguggcagugguuuug

SEQ ID NO: 2178937 - RNA, 16 nt, Human
ugugcccccagacgca

SEQ ID NO: 2178938 - RNA, 22 nt, Human
ugugcccccagacgcacguggg

SEQ ID NO: 2178939 - RNA, 19 nt, Human
ugugccccaugccugucca

SEQ ID NO: 2178940 - RNA, 15 nt, Human
ugugccccaugccug

SEQ ID NO: 2178941 - RNA, 23 nt, Human
ugugccccaugccuguccagccu

SEQ ID NO: 2178942 - RNA, 22 nt, Human
ugugcccaugggcacugcuggg

SEQ ID NO: 2178943 - RNA, 14 nt, Human
ugugccccaugccu

SEQ ID NO: 2178944 - RNA, 20 nt, Human
ugugcccaugggcacugcug

SEQ ID NO: 2178945 - RNA, 21 nt, Human
ugugcccaugggcacugcugg

SEQ ID NO: 2178946 - RNA, 14 nt, Human
ugugcccaugggca

SEQ ID NO: 2178947 - RNA, 18 nt, Human
ugugcccaugggcacugc

SEQ ID NO: 2178948 - RNA, 19 nt, Human
ugugcccaugggcacugcu

SEQ ID NO: 2178949 - RNA, 19 nt, Human
ugugcccagcccggaccuu

SEQ ID NO: 2178950 - RNA, 21 nt, Human
ugugcccccauguaagcaccc

SEQ ID NO: 2178951 - RNA, 18 nt, Human
ugugcuggaauucuaaca

SEQ ID NO: 2178952 - RNA, 13 nt, Human
ugugcuggagaug

SEQ ID NO: 2178953 - RNA, 18 nt, Human
ugugcuggagauguuuua

SEQ ID NO: 2178954 - RNA, 21 nt, Human
ugugcuggauggagcccaggc

SEQ ID NO: 2178955 - RNA, 10 nt, Human
ugugcuggga

SEQ ID NO: 2178956 - RNA, 12 nt, Human
ugugcugggagc

SEQ ID NO: 2178957 - RNA, 17 nt, Human
ugugcugggagcuccac

SEQ ID NO: 2178958 - RNA, 13 nt, Human
ugugcuggagcca

SEQ ID NO: 2178959 - RNA, 14 nt, Human
ugugcuggagccac

SEQ ID NO: 2178960 - RNA, 15 nt, Human
ugugcuggagccacu

SEQ ID NO: 2178961 - RNA, 19 nt, Human
ugugcuggagccacuaacu

SEQ ID NO: 2178962 - RNA, 20 nt, Human
ugugcuggagccacuaacua

SEQ ID NO: 2178963 - RNA, 15 nt, Human
ugugcuggaggacug

SEQ ID NO: 2178964 - RNA, 19 nt, Human
ugugcuggauggagcccag

SEQ ID NO: 2178965 - RNA, 20 nt, Human
ugugcuggauggagcccagg

SEQ ID NO: 2178966 - RNA, 12 nt, Human
agugagggccug

SEQ ID NO: 2178967 - RNA, 20 nt, Human
agugagggcuugucauuacc

SEQ ID NO: 2178968 - RNA, 18 nt, Human
agugaggggaaaccaggg

SEQ ID NO: 2178969 - RNA, 15 nt, Human
agugagggucagaga

SEQ ID NO: 2178970 - RNA, 13 nt, Human
agugagggucaga

SEQ ID NO: 2178971 - RNA, 22 nt, Human
agugagggguaaaagcugaucu

SEQ ID NO: 2178972 - RNA, 24 nt, Human
agugagggguaaaagcugaucugg

SEQ ID NO: 2178973 - RNA, 14 nt, Human
agugaggugcccag

SEQ ID NO: 2178974 - RNA, 20 nt, Human
agugaggguuucugagcugc

SEQ ID NO: 2178975 - RNA, 21 nt, Human
agugaggguuucugagcugcu

SEQ ID NO: 2178976 - RNA, 23 nt, Human
agugagggucagagaggagucag

SEQ ID NO: 2178977 - RNA, 17 nt, Human
agugaggguuucugagc

SEQ ID NO: 2178978 - RNA, 22 nt, Human
agugagggucagagaggaguca

SEQ ID NO: 2178979 - RNA, 16 nt, Human
agugagggucagagag

SEQ ID NO: 2178980 - RNA, 15 nt, Human
agugagucgaggaca

SEQ ID NO: 2178981 - RNA, 21 nt, Human
agugaguugauagcacagacc

SEQ ID NO: 2178982 - RNA, 14 nt, Human
agugagggauuauc

SEQ ID NO: 2178983 - RNA, 19 nt, Human
agugagggagggcugucau

SEQ ID NO: 2178984 - RNA, 20 nt, Human
uguggccagggugagagcug

SEQ ID NO: 2178985 - RNA, 21 nt, Human
agugaggcucugcccuugguu

SEQ ID NO: 2178986 - RNA, 19 nt, Human
agugaggcucugcccuugg

SEQ ID NO: 2178987 - RNA, 20 nt, Human
agugaggcucugcccuuggu

SEQ ID NO: 2178988 - RNA, 18 nt, Human
uguggccaaguucuuagu

SEQ ID NO: 2178989 - RNA, 19 nt, Human
uguggccaaggagcugcua

SEQ ID NO: 2178990 - RNA, 18 nt, Human
uguggccaaggagcugcu

SEQ ID NO: 2178991 - RNA, 17 nt, Human
uguggccaaggagcugc

SEQ ID NO: 2178992 - RNA, 15 nt, Human
uguggccaaggagcu

SEQ ID NO: 2178993 - RNA, 21 nt, Human
uguggccaaggagcugcuaua

SEQ ID NO: 2178994 - RNA, 20 nt, Human
uguggccaaggagcugcuau

SEQ ID NO: 2178995 - RNA, 19 nt, Human
uguggccagggugagagcu

SEQ ID NO: 2178996 - RNA, 21 nt, Human
uguggcaucuuugccuugggc

SEQ ID NO: 2178997 - RNA, 17 nt, Human
uguggcaucuuugccuu

SEQ ID NO: 2178998 - RNA, 16 nt, Human
uguggccaaaggaggg

SEQ ID NO: 2178999 - RNA, 24 nt, Human
uguggccaaaggagggucaggaag

SEQ ID NO: 2179000 - RNA, 14 nt, Human
uguggccaaggagc

SEQ ID NO: 2179001 - RNA, 15 nt, Human
agugaggcucugccc

SEQ ID NO: 2179002 - RNA, 14 nt, Human
agugaggcucugcc

SEQ ID NO: 2179003 - RNA, 16 nt, Human
agugaggcucugcccu

SEQ ID NO: 2179004 - RNA, 17 nt, Human
agugaggcucugcccuu

SEQ ID NO: 2179005 - RNA, 17 nt, Human
agucuugacgaguguga

SEQ ID NO: 2179006 - RNA, 16 nt, Human
agucuugcagcaggau

SEQ ID NO: 2179007 - RNA, 21 nt, Human
agucuugcuaccucagucagu

SEQ ID NO: 2179008 - RNA, 15 nt, Human
agucuuggcggcagc

SEQ ID NO: 2179009 - RNA, 14 nt, Human
agucuuccaaacca

SEQ ID NO: 2179010 - RNA, 19 nt, Human
agucuucacucucugaaga

SEQ ID NO: 2179011 - RNA, 15 nt, Human
agucucuucuccacu

SEQ ID NO: 2179012 - RNA, 16 nt, Human
agucucuucuccacug

SEQ ID NO: 2179013 - RNA, 12 nt, Human
agucucuucaga

SEQ ID NO: 2179014 - RNA, 15 nt, Human
agucuuaucaagcag

SEQ ID NO: 2179015 - RNA, 16 nt, Human
agucuuaucaagcagc

SEQ ID NO: 2179016 - RNA, 17 nt, Human
agucucuucuccacugg

SEQ ID NO: 2179017 - RNA, 23 nt, Human
agucuucaagcagauuggagaaa

SEQ ID NO: 2179018 - RNA, 17 nt, Human
agucuucacucucugaa

SEQ ID NO: 2179019 - RNA, 16 nt, Human
agucuucacucucuga

SEQ ID NO: 2179020 - RNA, 20 nt, Human
agucuuucuuagugccugug

SEQ ID NO: 2179021 - RNA, 15 nt, Human
agucuuggcucacug

SEQ ID NO: 2179022 - RNA, 21 nt, Human
agucuuggcggcagcagccau

SEQ ID NO: 2179023 - RNA, 22 nt, Human
agucuuggcggcagcagccauc

SEQ ID NO: 2179024 - RNA, 17 nt, Human
agucuuggggcaggaug

SEQ ID NO: 2179025 - RNA, 16 nt, Human
agucuuguauuaaguu

SEQ ID NO: 2179026 - RNA, 18 nt, Human
agucuuguauuaaguugu

SEQ ID NO: 2179027 - RNA, 24 nt, Human
agugaaacugcuuguuuccuagca

SEQ ID NO: 2179028 - RNA, 21 nt, Human
agugaaacugcuuguuuccua

SEQ ID NO: 2179029 - RNA, 13 nt, Human
agugaaacugcuu

SEQ ID NO: 2179030 - RNA, 14 nt, Human
agucuuuguacaga

SEQ ID NO: 2179031 - RNA, 16 nt, Human
agucucuaucauuaaa

SEQ ID NO: 2179032 - RNA, 17 nt, Human
agucucuaucauuaaag

SEQ ID NO: 2179033 - RNA, 18 nt, Human
agucucuaucauuaaagu

SEQ ID NO: 2179034 - RNA, 19 nt, Human
agucucuaucauuaaaguu

SEQ ID NO: 2179035 - RNA, 22 nt, Human
agucucucuggggccacacaga

SEQ ID NO: 2179036 - RNA, 20 nt, Human
agucucuaucauuaaaguuc

SEQ ID NO: 2179037 - RNA, 21 nt, Human
agucucuaucauuaaaguucu

SEQ ID NO: 2179038 - RNA, 19 nt, Human
agucucucucucucucucc

SEQ ID NO: 2179039 - RNA, 20 nt, Human
agucucucucucucucuccc

SEQ ID NO: 2179040 - RNA, 13 nt, Human
agucucuucucca

SEQ ID NO: 2179041 - RNA, 14 nt, Human
agucucuucuccac

SEQ ID NO: 2179042 - RNA, 17 nt, Human
agucucaggagcauggg

SEQ ID NO: 2179043 - RNA, 13 nt, Human
agucucaggagca

SEQ ID NO: 2179044 - RNA, 19 nt, Human
agucucaguggcuucaucu

SEQ ID NO: 2179045 - RNA, 10 nt, Human
agucucaguu

SEQ ID NO: 2179046 - RNA, 18 nt, Human
agucucaguuuguguguc

SEQ ID NO: 2179047 - RNA, 20 nt, Human
agucucaguuugugugucuu

SEQ ID NO: 2179048 - RNA, 21 nt, Human
agucucaguuugugugucuua

SEQ ID NO: 2179049 - RNA, 15 nt, Human
agucucuaucauuaa

SEQ ID NO: 2179050 - RNA, 15 nt, Human
ugugacugaauuucu

SEQ ID NO: 2179051 - RNA, 16 nt, Human
ugugacugaauuucuu

SEQ ID NO: 2179052 - RNA, 16 nt, Human
ugugagagguuugacu

SEQ ID NO: 2179053 - RNA, 15 nt, Human
ugugagagguuugac

SEQ ID NO: 2179054 - RNA, 20 nt, Human
ugugacuauauagagauguu

SEQ ID NO: 2179055 - RNA, 23 nt, Human
ugugacucuuuuuagggccaggc

SEQ ID NO: 2179056 - RNA, 19 nt, Human
ugugagaugcuagaacucc

SEQ ID NO: 2179057 - RNA, 15 nt, Human
ugugagaugcuagaa

SEQ ID NO: 2179058 - RNA, 22 nt, Human
agucucaggaaaucaaauaugc

SEQ ID NO: 2179059 - RNA, 18 nt, Human
ugugaccuuaguguuucu

SEQ ID NO: 2179060 - RNA, 19 nt, Human
ugugaccuuaguguuucug

SEQ ID NO: 2179061 - RNA, 15 nt, Human
ugugacuaauuguau

SEQ ID NO: 2179062 - RNA, 17 nt, Human
ugugacuaauuguauaa

SEQ ID NO: 2179063 - RNA, 18 nt, Human
ugugacuaauuguauaac

SEQ ID NO: 2179064 - RNA, 19 nt, Human
ugugacuaauuguauaaca

SEQ ID NO: 2179065 - RNA, 22 nt, Human
ugugacuaauuguauaacaggu

SEQ ID NO: 2179066 - RNA, 23 nt, Human
ugugacuaauuguauaacagguu

SEQ ID NO: 2179067 - RNA, 18 nt, Human
ugugacuauauagagaug

SEQ ID NO: 2179068 - RNA, 22 nt, Human
ugugacuauauagagauguuuu

SEQ ID NO: 2179069 - RNA, 18 nt, Human
ugugaacuuuauuaaaua

SEQ ID NO: 2179070 - RNA, 14 nt, Human
ugugacccucugaa

SEQ ID NO: 2179071 - RNA, 16 nt, Human
ugugacccucugaaug

SEQ ID NO: 2179072 - RNA, 13 nt, Human
ugugaccucaggc

SEQ ID NO: 2179073 - RNA, 14 nt, Human
ugugaccucaggca

SEQ ID NO: 2179074 - RNA, 14 nt, Human
ugugaagagaacca

SEQ ID NO: 2179075 - RNA, 14 nt, Human
ugugaccugagggc

SEQ ID NO: 2179076 - RNA, 16 nt, Human
ugugaccugaaguuca

SEQ ID NO: 2179077 - RNA, 13 nt, Human
ugugaccugaggg

SEQ ID NO: 2179078 - RNA, 20 nt, Human
ugugaccucaggcacuagcc

SEQ ID NO: 2179079 - RNA, 21 nt, Human
ugugaccucaggcacuagccu

SEQ ID NO: 2179080 - RNA, 14 nt, Human
ugugaccugaaguu

SEQ ID NO: 2179081 - RNA, 15 nt, Human
ugugaccugaaguuc

SEQ ID NO: 2179082 - RNA, 15 nt, Human
ugugaccuuaguguu

SEQ ID NO: 2179083 - RNA, 16 nt, Human
ugugaccuuaguguuu

SEQ ID NO: 2179084 - RNA, 19 nt, Human
ugugaaccaccacacccag

SEQ ID NO: 2179085 - RNA, 15 nt, Human
ugugaacagcggcug

SEQ ID NO: 2179086 - RNA, 20 nt, Human
ugugaaccaccacacccagc

SEQ ID NO: 2179087 - RNA, 21 nt, Human
ugugaaccaccacacccagcc

SEQ ID NO: 2179088 - RNA, 20 nt, Human
ugugaacuuggggaacaagg

SEQ ID NO: 2179089 - RNA, 20 nt, Human
ugugaacaaaagaugcucuu

SEQ ID NO: 2179090 - RNA, 19 nt, Human
ugugaacuggacccuguug

SEQ ID NO: 2179091 - RNA, 21 nt, Human
ugugaacuggacccuguugcu

SEQ ID NO: 2179092 - RNA, 22 nt, Human
ugugaacuggacccuguugcua

SEQ ID NO: 2179093 - RNA, 14 nt, Human
ugugaaaugcuggc

SEQ ID NO: 2179094 - RNA, 12 nt, Human
ugugaaauuauu

SEQ ID NO: 2179095 - RNA, 15 nt, Human
ugucuuguguuucuu

SEQ ID NO: 2179096 - RNA, 21 nt, Human
ugugaaagucagaugcccaga

SEQ ID NO: 2179097 - RNA, 19 nt, Human
ugucuuggcuuucauguua

SEQ ID NO: 2179098 - RNA, 22 nt, Human
ugugaaagucagaugcccagag

SEQ ID NO: 2179099 - RNA, 20 nt, Human
ugugaaauaaaacuggcuuu

SEQ ID NO: 2179100 - RNA, 20 nt, Human
ugugaaaggaagcuccacug

SEQ ID NO: 2179101 - RNA, 21 nt, Human
ugugaaauaguucaaagccaa

SEQ ID NO: 2179102 - RNA, 14 nt, Human
ugugaaaugaaaac

SEQ ID NO: 2179103 - RNA, 21 nt, Human
ugugaaauaaaacuggcuuug

SEQ ID NO: 2179104 - RNA, 15 nt, Human
ugugaaaggaaagag

SEQ ID NO: 2179105 - RNA, 16 nt, Human
ugucuuguacaugugu

SEQ ID NO: 2179106 - RNA, 17 nt, Human
ugucuuguacaugugua

SEQ ID NO: 2179107 - RNA, 20 nt, Human
ugucuuguacauguguagcc

SEQ ID NO: 2179108 - RNA, 22 nt, Human
ugucuuguacauguguagccug

SEQ ID NO: 2179109 - RNA, 18 nt, Human
ugugaaaggaaagaggcu

SEQ ID NO: 2179110 - RNA, 21 nt, Human
ugugaaaggaaagagggaggu

SEQ ID NO: 2179111 - RNA, 21 nt, Human
ugucagaaaccaguuauguga

SEQ ID NO: 2179112 - RNA, 21 nt, Human
ugucagaacuagaauuugauu

SEQ ID NO: 2179113 - RNA, 16 nt, Human
ugucagaaaccaguua

SEQ ID NO: 2179114 - RNA, 18 nt, Human
agucacguggaggagcag

SEQ ID NO: 2179115 - RNA, 21 nt, Human
agucacguggaggagcagugc

SEQ ID NO: 2179116 - RNA, 18 nt, Human
ugucacuuugcucugggu

SEQ ID NO: 2179117 - RNA, 11 nt, Human
ugucagagcug

SEQ ID NO: 2179118 - RNA, 23 nt, Human
ugucagacuuuaaagaauaauau

SEQ ID NO: 2179119 - RNA, 14 nt, Human
ugucagacuuuaaa

SEQ ID NO: 2179120 - RNA, 13 nt, Human
ugucagacuggcu

SEQ ID NO: 2179121 - RNA, 12 nt, Human
ugucagacuuua

SEQ ID NO: 2179122 - RNA, 20 nt, Human
ugucagaccuauuugacaua

SEQ ID NO: 2179123 - RNA, 23 nt, Human
ugucagacauccauguuuguaaa

SEQ ID NO: 2179124 - RNA, 13 nt, Human
ugucuuguacaug

SEQ ID NO: 2179125 - RNA, 21 nt, Human
ugucuugggcagagcuggcuc

SEQ ID NO: 2179126 - RNA, 22 nt, Human
ugucuugggcagagcuggcucu

SEQ ID NO: 2179127 - RNA, 19 nt, Human
ugucuuggacacuguacaa

SEQ ID NO: 2179128 - RNA, 12 nt, Human
ugucuugggcag

SEQ ID NO: 2179129 - RNA, 13 nt, Human
ugucuugggcaga

SEQ ID NO: 2179130 - RNA, 16 nt, Human
ugucuugggcagagcu

SEQ ID NO: 2179131 - RNA, 14 nt, Human
uguggugucugugu

SEQ ID NO: 2179132 - RNA, 23 nt, Human
uguggugugucccccucugucca

SEQ ID NO: 2179133 - RNA, 16 nt, Human
uguggucccaacagga

SEQ ID NO: 2179134 - RNA, 13 nt, Human
uguggucccaccc

SEQ ID NO: 2179135 - RNA, 15 nt, Human
uguggucccacccca

SEQ ID NO: 2179136 - RNA, 21 nt, Human
ugugguguuuccugcaggcca

SEQ ID NO: 2179137 - RNA, 14 nt, Human
uguguaacagcucc

SEQ ID NO: 2179138 - RNA, 20 nt, Human
ugugguguuuccuggcacug

SEQ ID NO: 2179139 - RNA, 15 nt, Human
uguguaacagcuccu

SEQ ID NO: 2179140 - RNA, 14 nt, Human
ugugguguuuccug

SEQ ID NO: 2179141 - RNA, 16 nt, Human
ugugguguuuccuggc

SEQ ID NO: 2179142 - RNA, 20 nt, Human
agugcuguggccugggcaag

SEQ ID NO: 2179143 - RNA, 18 nt, Human
agugcuguggccugggca

SEQ ID NO: 2179144 - RNA, 17 nt, Human
agugcuguggccugggc

SEQ ID NO: 2179145 - RNA, 16 nt, Human
agugcuguggccuggg

SEQ ID NO: 2179146 - RNA, 14 nt, Human
agugcuguggccug

SEQ ID NO: 2179147 - RNA, 16 nt, Human
agugcugugaaaaaaa

SEQ ID NO: 2179148 - RNA, 14 nt, Human
agugcugugaaaaa

SEQ ID NO: 2179149 - RNA, 13 nt, Human
agugcugugaaaa

SEQ ID NO: 2179150 - RNA, 12 nt, Human
agugcugugaaa

SEQ ID NO: 2179151 - RNA, 21 nt, Human
uguggguuucuaaagcugcca

SEQ ID NO: 2179152 - RNA, 13 nt, Human
ugugggugggaga

SEQ ID NO: 2179153 - RNA, 17 nt, Human
uguggguggauauaaau

SEQ ID NO: 2179154 - RNA, 20 nt, Human
uguggguggauauaaauaua

SEQ ID NO: 2179155 - RNA, 22 nt, Human
uguggguggauauaaauauaua

SEQ ID NO: 2179156 - RNA, 23 nt, Human
uguggguuucuaaagcugccagc

SEQ ID NO: 2179157 - RNA, 20 nt, Human
uguggucacaggaaguagag

SEQ ID NO: 2179158 - RNA, 20 nt, Human
agugcugggauuacaggugu

SEQ ID NO: 2179159 - RNA, 19 nt, Human
agugcugcauuuaaaagau

SEQ ID NO: 2179160 - RNA, 17 nt, Human
agugcugcauuuaaaag

SEQ ID NO: 2179161 - RNA, 16 nt, Human
agugcugcauuuaaaa

SEQ ID NO: 2179162 - RNA, 12 nt, Human
agugcuguaaaa

SEQ ID NO: 2179163 - RNA, 12 nt, Human
agugcuguauaa

SEQ ID NO: 2179164 - RNA, 13 nt, Human
agugcuguauaaa

SEQ ID NO: 2179165 - RNA, 21 nt, Human
agugcugggauuacaggugug

SEQ ID NO: 2179166 - RNA, 14 nt, Human
agugcuguauaaaa

SEQ ID NO: 2179167 - RNA, 15 nt, Human
agugcuguauaaaau

SEQ ID NO: 2179168 - RNA, 16 nt, Human
agugcuguauaaaauc

SEQ ID NO: 2179169 - RNA, 17 nt, Human
agugcuguauaaaauca

SEQ ID NO: 2179170 - RNA, 19 nt, Human
agugcuguauaaaaucagc

SEQ ID NO: 2179171 - RNA, 22 nt, Human
agugcuguauaaaaucagccaa

SEQ ID NO: 2179172 - RNA, 19 nt, Human
agugcugucugaucugugc

SEQ ID NO: 2179173 - RNA, 20 nt, Human
agugcugucugaucugugcu

SEQ ID NO: 2179174 - RNA, 21 nt, Human
agugcugucugaucugugcuu

SEQ ID NO: 2179175 - RNA, 22 nt, Human
agugcugucugaucugugcuuu

SEQ ID NO: 2179176 - RNA, 12 nt, Human
agugcugagacc

SEQ ID NO: 2179177 - RNA, 13 nt, Human
agugcugcauuua

SEQ ID NO: 2179178 - RNA, 12 nt, Human
agugcugcauuu

SEQ ID NO: 2179179 - RNA, 16 nt, Human
agugcugaacagugga

SEQ ID NO: 2179180 - RNA, 22 nt, Human
agugaggguuucugagcugcuc

SEQ ID NO: 2179181 - RNA, 15 nt, Human
agugaggugcccagc

SEQ ID NO: 2179182 - RNA, 22 nt, Human
agugaguugauagcacagaccc

SEQ ID NO: 2179183 - RNA, 23 nt, Human
agugaguugauagcacagacccu

SEQ ID NO: 2179184 - RNA, 20 nt, Human
uguguucgcgugugugggug

SEQ ID NO: 2179185 - RNA, 24 nt, Human
uguguuccuggcaauaguguguuc

SEQ ID NO: 2179186 - RNA, 16 nt, Human
uguguuccuggcaaua

SEQ ID NO: 2179187 - RNA, 15 nt, Human
uguguuccuggcaau

SEQ ID NO: 2179188 - RNA, 10 nt, Human
uguguuccug

SEQ ID NO: 2179189 - RNA, 11 nt, Human
uguguuccugg

SEQ ID NO: 2179190 - RNA, 19 nt, Human
uguguucccauuucagcug

SEQ ID NO: 2179191 - RNA, 15 nt, Human
uguguuccccaaagg

SEQ ID NO: 2179192 - RNA, 13 nt, Human
uguguguuucacu

SEQ ID NO: 2179193 - RNA, 15 nt, Human
uguguguuucacuuu

SEQ ID NO: 2179194 - RNA, 17 nt, Human
uguguucccauuucagc

SEQ ID NO: 2179195 - RNA, 19 nt, Human
uguguuaaguauguguaaa

SEQ ID NO: 2179196 - RNA, 17 nt, Human
uguguucugauuagaaa

SEQ ID NO: 2179197 - RNA, 18 nt, Human
uguuaaauaaauuguaua

SEQ ID NO: 2179198 - RNA, 20 nt, Human
uguuaaauaaauuguauauu

SEQ ID NO: 2179199 - RNA, 13 nt, Human
uguuaaauaaauu

SEQ ID NO: 2179200 - RNA, 14 nt, Human
uguuaaauaaauug

SEQ ID NO: 2179201 - RNA, 16 nt, Human
uguuaaauaaauugua

SEQ ID NO: 2179202 - RNA, 24 nt, Human
uguuaaaucccauucauaacuuuc

SEQ ID NO: 2179203 - RNA, 16 nt, Human
uguuaaauauuuacau

SEQ ID NO: 2179204 - RNA, 22 nt, Human
uguuaaauaucaguagaaacuc

SEQ ID NO: 2179205 - RNA, 19 nt, Human
uguuaaaugaaauuguaaa

SEQ ID NO: 2179206 - RNA, 14 nt, Human
uguuaaaugaaacc

SEQ ID NO: 2179207 - RNA, 18 nt, Human
uguuaaaugaaauuguaa

SEQ ID NO: 2179208 - RNA, 18 nt, Human
uguuaaauugcuguguau

SEQ ID NO: 2179209 - RNA, 14 nt, Human
uguuaaauuuguaa

SEQ ID NO: 2179210 - RNA, 15 nt, Human
uguuaaauuuguaag

SEQ ID NO: 2179211 - RNA, 16 nt, Human
uguuaaauuuguaagu

SEQ ID NO: 2179212 - RNA, 17 nt, Human
uguuaaauuuguaaguu

SEQ ID NO: 2179213 - RNA, 18 nt, Human
uguuaaauuuguaaguuu

SEQ ID NO: 2179214 - RNA, 19 nt, Human
uguuaaauuuguaaguuuc

SEQ ID NO: 2179215 - RNA, 21 nt, Human
uguuaaauuuguaaguuucag

SEQ ID NO: 2179216 - RNA, 23 nt, Human
uguuaaggaaacucuuaucucag

SEQ ID NO: 2179217 - RNA, 20 nt, Human
uguuaagggaagaauuccag

SEQ ID NO: 2179218 - RNA, 21 nt, Human
uguuaaggaaacucuuaucuc

SEQ ID NO: 2179219 - RNA, 22 nt, Human
uguuaaggaaacucuuaucuca

SEQ ID NO: 2179220 - RNA, 14 nt, Human
uguuaaggaaacuc

SEQ ID NO: 2179221 - RNA, 15 nt, Human
uguuaaggaaacucu

SEQ ID NO: 2179222 - RNA, 16 nt, Human
uguuaaggaaacucuu

SEQ ID NO: 2179223 - RNA, 17 nt, Human
uguuaaggaaacucuua

SEQ ID NO: 2179224 - RNA, 20 nt, Human
uguuaaggaaacucuuaucu

SEQ ID NO: 2179225 - RNA, 17 nt, Human
uguuaaguauuuucaua

SEQ ID NO: 2179226 - RNA, 15 nt, Human
uguuaaguauuuuca

SEQ ID NO: 2179227 - RNA, 12 nt, Human
uguuaauuauac

SEQ ID NO: 2179228 - RNA, 15 nt, Human
uguuaauucagcacu

SEQ ID NO: 2179229 - RNA, 20 nt, Human
uguuaauucagcacugauuu

SEQ ID NO: 2179230 - RNA, 22 nt, Human
uguuaauucagcacugauuuca

SEQ ID NO: 2179231 - RNA, 15 nt, Human
uguuaaguaugugua

SEQ ID NO: 2179232 - RNA, 16 nt, Human
uguuaaguauguguaa

SEQ ID NO: 2179233 - RNA, 16 nt, Human
uguguaauagaaaacu

SEQ ID NO: 2179234 - RNA, 13 nt, Human
uguguaaguagau

SEQ ID NO: 2179235 - RNA, 17 nt, Human
ugugucucuugguccug

SEQ ID NO: 2179236 - RNA, 20 nt, Human
ugugucucuugguccugcug

SEQ ID NO: 2179237 - RNA, 21 nt, Human
ugugucuugcaauggcagccu

SEQ ID NO: 2179238 - RNA, 18 nt, Human
uguguaauagaaaacuga

SEQ ID NO: 2179239 - RNA, 21 nt, Human
ugugucucuugguccugcugc

SEQ ID NO: 2179240 - RNA, 13 nt, Human
uguguguguaugu

SEQ ID NO: 2179241 - RNA, 14 nt, Human
uguguguguaugcu

SEQ ID NO: 2179242 - RNA, 13 nt, Human
ugugugugguuuu

SEQ ID NO: 2179243 - RNA, 19 nt, Human
ugugugugggcugugagug

SEQ ID NO: 2179244 - RNA, 16 nt, Human
ugugucuuuugcauga

SEQ ID NO: 2179245 - RNA, 20 nt, Human
ugugugugguuuuuuuucua

SEQ ID NO: 2179246 - RNA, 14 nt, Human
uguguguguauguu

SEQ ID NO: 2179247 - RNA, 13 nt, Human
ugugugugugaau

SEQ ID NO: 2179248 - RNA, 19 nt, Human
uguguguuuauugucaaag

SEQ ID NO: 2179249 - RNA, 23 nt, Human
uguguguuuauugucaaaguggu

SEQ ID NO: 2179250 - RNA, 14 nt, Human
uguguguguaugug

SEQ ID NO: 2179251 - RNA, 20 nt, Human
ugugugugggaguguguaau

SEQ ID NO: 2179252 - RNA, 12 nt, Human
ugugugugggag

SEQ ID NO: 2179253 - RNA, 20 nt, Human
ugugugaaagguacuucaaa

SEQ ID NO: 2179254 - RNA, 18 nt, Human
ugugucuuucacagcucc

SEQ ID NO: 2179255 - RNA, 22 nt, Human
ugugucuuucacagcuccuccc

SEQ ID NO: 2179256 - RNA, 22 nt, Human
ugugugaaaggaagcuccacug

SEQ ID NO: 2179257 - RNA, 14 nt, Human
ugugucuuuugcau

SEQ ID NO: 2179258 - RNA, 14 nt, Human
uguucccucugcuc

SEQ ID NO: 2179259 - RNA, 22 nt, Human
uguucccagugacacuucagag

SEQ ID NO: 2179260 - RNA, 16 nt, Human
uguucccucugcuccu

SEQ ID NO: 2179261 - RNA, 18 nt, Human
uguucccucugcuccugg

SEQ ID NO: 2179262 - RNA, 19 nt, Human
uguucccucugcuccugga

SEQ ID NO: 2179263 - RNA, 15 nt, Human
uguuccuacagcccc

SEQ ID NO: 2179264 - RNA, 22 nt, Human
uguuccgaaaccaaagaagaaa

SEQ ID NO: 2179265 - RNA, 19 nt, Human
uguuccuacagccccuuuu

SEQ ID NO: 2179266 - RNA, 21 nt, Human
uguuccgugguuaaacucgcu

SEQ ID NO: 2179267 - RNA, 17 nt, Human
uguucccaccugcugga

SEQ ID NO: 2179268 - RNA, 21 nt, Human
uguucccaccaggcugcucag

SEQ ID NO: 2179269 - RNA, 20 nt, Human
uguucccaccaggcugcuca

SEQ ID NO: 2179270 - RNA, 14 nt, Human
uguuccagcucuuu

SEQ ID NO: 2179271 - RNA, 18 nt, Human
uguuccaguaaucuaaua

SEQ ID NO: 2179272 - RNA, 17 nt, Human
uguuccagccugcccuc

SEQ ID NO: 2179273 - RNA, 16 nt, Human
uguucugggacacagu

SEQ ID NO: 2179274 - RNA, 16 nt, Human
uguuccuagaguagag

SEQ ID NO: 2179275 - RNA, 14 nt, Human
uguuccuagaguag

SEQ ID NO: 2179276 - RNA, 15 nt, Human
uguuccuacgggcuu

SEQ ID NO: 2179277 - RNA, 21 nt, Human
uguucuggugaggccuugcuc

SEQ ID NO: 2179278 - RNA, 20 nt, Human
uguucuggugaggccuugcu

SEQ ID NO: 2179279 - RNA, 18 nt, Human
uguuccuagugaaagagg

SEQ ID NO: 2179280 - RNA, 14 nt, Human
uguuccuagugaaa

SEQ ID NO: 2179281 - RNA, 19 nt, Human
agugugugcacaugugugc

SEQ ID NO: 2179282 - RNA, 18 nt, Human
agugugugcacaugugug

SEQ ID NO: 2179283 - RNA, 17 nt, Human
agugugugcaaguaugu

SEQ ID NO: 2179284 - RNA, 21 nt, Human
agugugugauuuuuugcauuc

SEQ ID NO: 2179285 - RNA, 15 nt, Human
uguuauaaucuuuca

SEQ ID NO: 2179286 - RNA, 21 nt, Human
aguguguccaagugugugugc

SEQ ID NO: 2179287 - RNA, 18 nt, Human
aguguguccaagugugug

SEQ ID NO: 2179288 - RNA, 21 nt, Human
aguguguauuguucccaguga

SEQ ID NO: 2179289 - RNA, 19 nt, Human
aguguguauuguucccagu

SEQ ID NO: 2179290 - RNA, 14 nt, Human
agugugucuaaauu

SEQ ID NO: 2179291 - RNA, 20 nt, Human
agugugucuuagugugugca

SEQ ID NO: 2179292 - RNA, 20 nt, Human
uguuccacaaguuaaauaaa

SEQ ID NO: 2179293 - RNA, 14 nt, Human
uguuccagcaguuu

SEQ ID NO: 2179294 - RNA, 18 nt, Human
uguuccagauucaaucga

SEQ ID NO: 2179295 - RNA, 18 nt, Human
uguuauagguuguuggau

SEQ ID NO: 2179296 - RNA, 13 nt, Human
uguuauauaaaug

SEQ ID NO: 2179297 - RNA, 14 nt, Human
uguuauauaaaugg

SEQ ID NO: 2179298 - RNA, 16 nt, Human
uguugauugcuaaaug

SEQ ID NO: 2179299 - RNA, 17 nt, Human
uguugauugcuaaaugu

SEQ ID NO: 2179300 - RNA, 18 nt, Human
uguugauugcuaaaugua

SEQ ID NO: 2179301 - RNA, 19 nt, Human
uguugauugcuaaauguaa

SEQ ID NO: 2179302 - RNA, 13 nt, Human
uguucuguuuaau

SEQ ID NO: 2179303 - RNA, 19 nt, Human
uguucuguuuaauacucau

SEQ ID NO: 2179304 - RNA, 15 nt, Human
uguucugugauauaa

SEQ ID NO: 2179305 - RNA, 18 nt, Human
uguucugugauauaagug

SEQ ID NO: 2179306 - RNA, 23 nt, Human
uguucugugaugaggggaggggg

SEQ ID NO: 2179307 - RNA, 13 nt, Human
uguucuguggaaa

SEQ ID NO: 2179308 - RNA, 17 nt, Human
uguucuguggaaagugu

SEQ ID NO: 2179309 - RNA, 18 nt, Human
uguucuguggaaagugua

SEQ ID NO: 2179310 - RNA, 19 nt, Human
uguucuguggaaaguguaa

SEQ ID NO: 2179311 - RNA, 20 nt, Human
uguucuguggaaaguguaaa

SEQ ID NO: 2179312 - RNA, 13 nt, Human
uguucugugucuu

SEQ ID NO: 2179313 - RNA, 21 nt, Human
uguucuguggaaaguguaaag

SEQ ID NO: 2179314 - RNA, 22 nt, Human
uguucuguggaaaguguaaagc

SEQ ID NO: 2179315 - RNA, 14 nt, Human
uguucugugucuuu

SEQ ID NO: 2179316 - RNA, 17 nt, Human
uguugcaaguacugcug

SEQ ID NO: 2179317 - RNA, 19 nt, Human
uguugcaaguacugcugua

SEQ ID NO: 2179318 - RNA, 17 nt, Human
uguugcaagugcaauaa

SEQ ID NO: 2179319 - RNA, 19 nt, Human
uguugauuucuuuccagag

SEQ ID NO: 2179320 - RNA, 20 nt, Human
uguugauuucuuuccagagg

SEQ ID NO: 2179321 - RNA, 14 nt, Human
uguugauuuucugu

SEQ ID NO: 2179322 - RNA, 18 nt, Human
uguugauuuucuguugua

SEQ ID NO: 2179323 - RNA, 15 nt, Human
uguugauuuucuguu

SEQ ID NO: 2179324 - RNA, 13 nt, Human
uguugcccaggca

SEQ ID NO: 2179325 - RNA, 12 nt, Human
uguugcccaggc

SEQ ID NO: 2179326 - RNA, 15 nt, Human
uguugcccaggcagg

SEQ ID NO: 2179327 - RNA, 16 nt, Human
uguugcccaggcaggu

SEQ ID NO: 2179328 - RNA, 17 nt, Human
uguugcccaggcagguc

SEQ ID NO: 2179329 - RNA, 18 nt, Human
uguugcccaggcaggucu

SEQ ID NO: 2179330 - RNA, 23 nt, Human
agugugguguuuccugcaggcca

SEQ ID NO: 2179331 - RNA, 22 nt, Human
agugugccccccauccuggccc

SEQ ID NO: 2179332 - RNA, 23 nt, Human
agugugccccccauccuggccca

SEQ ID NO: 2179333 - RNA, 17 nt, Human
agugugguguuuccugg

SEQ ID NO: 2179334 - RNA, 16 nt, Human
aguguguauuguuccc

SEQ ID NO: 2179335 - RNA, 15 nt, Human
aguguguauuguucc

SEQ ID NO: 2179336 - RNA, 22 nt, Human
aguguguauuaaaaaaaacaaa

SEQ ID NO: 2179337 - RNA, 23 nt, Human
aguguguauuaaaaaaaacaaaa

SEQ ID NO: 2179338 - RNA, 20 nt, Human
agugugguguuuccuggcac

SEQ ID NO: 2179339 - RNA, 20 nt, Human
aguguguauuaaaaaaaaca

SEQ ID NO: 2179340 - RNA, 19 nt, Human
agugugguguuuccuggca

SEQ ID NO: 2179341 - RNA, 22 nt, Human
agugugcacuaaggggcccggc

SEQ ID NO: 2179342 - RNA, 17 nt, Human
agugugcacuaaggggc

SEQ ID NO: 2179343 - RNA, 21 nt, Human
agugugcaguucuaguuugca

SEQ ID NO: 2179344 - RNA, 15 nt, Human
agugugcauauugua

SEQ ID NO: 2179345 - RNA, 16 nt, Human
agugugcauauuguac

SEQ ID NO: 2179346 - RNA, 14 nt, Human
agugugcaaaauau

SEQ ID NO: 2179347 - RNA, 23 nt, Human
agugugauugggaauaaauaugc

SEQ ID NO: 2179348 - RNA, 12 nt, Human
agugugcaaaau

SEQ ID NO: 2179349 - RNA, 19 nt, Human
agugugauugggaauaaau

SEQ ID NO: 2179350 - RNA, 20 nt, Human
agugugauugggaauaaaua

SEQ ID NO: 2179351 - RNA, 21 nt, Human
agugugauugggaauaaauau

SEQ ID NO: 2179352 - RNA, 22 nt, Human
agugugauugggaauaaauaug

SEQ ID NO: 2179353 - RNA, 16 nt, Human
agugugguguuuccug

SEQ ID NO: 2179354 - RNA, 17 nt, Human
agugugcauauuguaca

SEQ ID NO: 2179355 - RNA, 18 nt, Human
agugugcauauuguacac

SEQ ID NO: 2179356 - RNA, 19 nt, Human
agugugcauauuguacacu

SEQ ID NO: 2179357 - RNA, 13 nt, Human
agugugcccccca

SEQ ID NO: 2179358 - RNA, 17 nt, Human
agugugccccccauccu

SEQ ID NO: 2179359 - RNA, 19 nt, Human
agugugccccccauccugg

SEQ ID NO: 2179360 - RNA, 20 nt, Human
agugugccccccauccuggc

SEQ ID NO: 2179361 - RNA, 17 nt, Human
aguguacuuaacuauuc

SEQ ID NO: 2179362 - RNA, 19 nt, Human
aguguacccccgcccaggc

SEQ ID NO: 2179363 - RNA, 20 nt, Human
aguguacccccgcccaggcu

SEQ ID NO: 2179364 - RNA, 22 nt, Human
aguguacccccgcccaggcugg

SEQ ID NO: 2179365 - RNA, 23 nt, Human
aguguacccccgcccaggcuggc

SEQ ID NO: 2179366 - RNA, 18 nt, Human
agugugauugggaauaaa

SEQ ID NO: 2179367 - RNA, 17 nt, Human
aguguagaagcauuccu

SEQ ID NO: 2179368 - RNA, 18 nt, Human
aguguagaagcauuccuu

SEQ ID NO: 2179369 - RNA, 19 nt, Human
aguguagaagcauuccuuc

SEQ ID NO: 2179370 - RNA, 20 nt, Human
aguguagaagcauuccuucu

SEQ ID NO: 2179371 - RNA, 12 nt, Human
aguguagaagca

SEQ ID NO: 2179372 - RNA, 13 nt, Human
aguguagaagcau

SEQ ID NO: 2179373 - RNA, 14 nt, Human
aguguagaagcauu

SEQ ID NO: 2179374 - RNA, 15 nt, Human
aguguagaagcauuc

SEQ ID NO: 2179375 - RNA, 16 nt, Human
aguguagaagcauucc

SEQ ID NO: 2179376 - RNA, 17 nt, Human
aguguaacagcugaggu

SEQ ID NO: 2179377 - RNA, 16 nt, Human
aguguaacagcugagg

SEQ ID NO: 2179378 - RNA, 15 nt, Human
aguguaacagcugag

SEQ ID NO: 2179379 - RNA, 14 nt, Human
aguguaacagcuga

SEQ ID NO: 2179380 - RNA, 13 nt, Human
aguguaacagcug

SEQ ID NO: 2179381 - RNA, 21 nt, Human
aguguaaauccuuuuucuuua

SEQ ID NO: 2179382 - RNA, 14 nt, Human
aguguaaauccuuu

SEQ ID NO: 2179383 - RNA, 21 nt, Human
aguguaaauaguuacuccagu

SEQ ID NO: 2179384 - RNA, 13 nt, Human
aguguaaagcauu

SEQ ID NO: 2179385 - RNA, 14 nt, Human
aguguaaagcauuc

SEQ ID NO: 2179386 - RNA, 16 nt, Human
aguguaaagcauucca

SEQ ID NO: 2179387 - RNA, 17 nt, Human
aguguaaagcauuccaa

SEQ ID NO: 2179388 - RNA, 18 nt, Human
aguguaaagcauuccaac

SEQ ID NO: 2179389 - RNA, 20 nt, Human
aguguaaagcauuccaacaa

SEQ ID NO: 2179390 - RNA, 22 nt, Human
aguguaaagcauuccaacaaag

SEQ ID NO: 2179391 - RNA, 15 nt, Human
aguggugugaucuca

SEQ ID NO: 2179392 - RNA, 14 nt, Human
aguguaaaauauuu

SEQ ID NO: 2179393 - RNA, 18 nt, Human
aguguaaaauauuuugaa

SEQ ID NO: 2179394 - RNA, 21 nt, Human
aguguaaaauauuuugaauca

SEQ ID NO: 2179395 - RNA, 14 nt, Human
uguuacaaauugua

SEQ ID NO: 2179396 - RNA, 18 nt, Human
uguuacaaaguuguaugu

SEQ ID NO: 2179397 - RNA, 22 nt, Human
aguggacaccaggagucccugg

SEQ ID NO: 2179398 - RNA, 20 nt, Human
aguggacaccaggagucccu

SEQ ID NO: 2179399 - RNA, 13 nt, Human
aguggacaggagu

SEQ ID NO: 2179400 - RNA, 17 nt, Human
aguggaauaguauccuc

SEQ ID NO: 2179401 - RNA, 19 nt, Human
aguggaauaguauccucca

SEQ ID NO: 2179402 - RNA, 20 nt, Human
aguggaauaguauccuccag

SEQ ID NO: 2179403 - RNA, 21 nt, Human
aguggaauaguauccuccagg

SEQ ID NO: 2179404 - RNA, 22 nt, Human
aguggaauaguauccuccaggu

SEQ ID NO: 2179405 - RNA, 23 nt, Human
aguggaauaguauccuccagguu

SEQ ID NO: 2179406 - RNA, 22 nt, Human
aguggaaugcuuccuagaaguu

SEQ ID NO: 2179407 - RNA, 17 nt, Human
aguggugcgaucugggu

SEQ ID NO: 2179408 - RNA, 15 nt, Human
aguggaccaggacag

SEQ ID NO: 2179409 - RNA, 14 nt, Human
aguggaccaggaca

SEQ ID NO: 2179410 - RNA, 13 nt, Human
aguggaccaggac

SEQ ID NO: 2179411 - RNA, 20 nt, Human
aguggacauuguuggcagca

SEQ ID NO: 2179412 - RNA, 19 nt, Human
aguggaccaggacaggacc

SEQ ID NO: 2179413 - RNA, 16 nt, Human
aguggaccaggacagg

SEQ ID NO: 2179414 - RNA, 20 nt, Human
aguggaccaggacaggacca

SEQ ID NO: 2179415 - RNA, 13 nt, Human
aguggugcucagu

SEQ ID NO: 2179416 - RNA, 15 nt, Human
aguggugcucaguug

SEQ ID NO: 2179417 - RNA, 16 nt, Human
aguggugcucaguugu

SEQ ID NO: 2179418 - RNA, 17 nt, Human
aguggugcucaguugua

SEQ ID NO: 2179419 - RNA, 20 nt, Human
aguggugcucaguuguagaa

SEQ ID NO: 2179420 - RNA, 22 nt, Human
aguggugcucaguuguagaaug

SEQ ID NO: 2179421 - RNA, 11 nt, Human
agugguggcag

SEQ ID NO: 2179422 - RNA, 13 nt, Human
agugguggcaggg

SEQ ID NO: 2179423 - RNA, 14 nt, Human
agugguggcagggc

SEQ ID NO: 2179424 - RNA, 15 nt, Human
agugguggcagggcc

SEQ ID NO: 2179425 - RNA, 16 nt, Human
agugguggcagggccu

SEQ ID NO: 2179426 - RNA, 18 nt, Human
agugguggcagggccuag

SEQ ID NO: 2179427 - RNA, 19 nt, Human
aguggugguaacccuggug

SEQ ID NO: 2179428 - RNA, 18 nt, Human
aguggugguaacccuggu

SEQ ID NO: 2179429 - RNA, 20 nt, Human
aguggugguaacccuggugg

SEQ ID NO: 2179430 - RNA, 21 nt, Human
agugguggugaacagaacaaa

SEQ ID NO: 2179431 - RNA, 18 nt, Human
aguggugguuuucuguuc

SEQ ID NO: 2179432 - RNA, 17 nt, Human
aguggugguuuucuguu

SEQ ID NO: 2179433 - RNA, 23 nt, Human
aguggugguuuucuguucuuucu

SEQ ID NO: 2179434 - RNA, 21 nt, Human
aguggugguuuucuguucuuu

SEQ ID NO: 2179435 - RNA, 20 nt, Human
aguggugguuuucuguucuu

SEQ ID NO: 2179436 - RNA, 19 nt, Human
aguggugguuuucuguucu

SEQ ID NO: 2179437 - RNA, 21 nt, Human
uguuugacgggaaacaaaacu

SEQ ID NO: 2179438 - RNA, 21 nt, Human
uguuugacaaagaaacccaag

SEQ ID NO: 2179439 - RNA, 22 nt, Human
uguuugaaucccacgcuucucu

SEQ ID NO: 2179440 - RNA, 17 nt, Human
uguuugaagccugcccu

SEQ ID NO: 2179441 - RNA, 22 nt, Human
uguuugacaaagaaacccaagu

SEQ ID NO: 2179442 - RNA, 22 nt, Human
uguuugacaaaguuacugauuc

SEQ ID NO: 2179443 - RNA, 14 nt, Human
uguuugagaaauua

SEQ ID NO: 2179444 - RNA, 13 nt, Human
uguuugagcucag

SEQ ID NO: 2179445 - RNA, 18 nt, Human
uguuugaaacaaagaagg

SEQ ID NO: 2179446 - RNA, 13 nt, Human
uguuugaaaucuu

SEQ ID NO: 2179447 - RNA, 15 nt, Human
uguuucuuuucacau

SEQ ID NO: 2179448 - RNA, 13 nt, Human
uguuucuuuugua

SEQ ID NO: 2179449 - RNA, 14 nt, Human
uguuucuuuuguau

SEQ ID NO: 2179450 - RNA, 20 nt, Human
uguuucuuuuguauguaaau

SEQ ID NO: 2179451 - RNA, 21 nt, Human
uguuucuuuuguauguaaaug

SEQ ID NO: 2179452 - RNA, 23 nt, Human
uguuugagcucagacccccacuc

SEQ ID NO: 2179453 - RNA, 14 nt, Human
uguuugagcucaga

SEQ ID NO: 2179454 - RNA, 22 nt, Human
uguuugagguuuuuaagccuua

SEQ ID NO: 2179455 - RNA, 18 nt, Human
uguuugagcucugcagcc

SEQ ID NO: 2179456 - RNA, 22 nt, Human
uguuugaggauauauuuucacu

SEQ ID NO: 2179457 - RNA, 19 nt, Human
uguuugaugcauuaaaaga

SEQ ID NO: 2179458 - RNA, 16 nt, Human
uguuugaugcauuaaa

SEQ ID NO: 2179459 - RNA, 13 nt, Human
uguuugaugcauu

SEQ ID NO: 2179460 - RNA, 17 nt, Human
uguuugauucagacagc

SEQ ID NO: 2179461 - RNA, 22 nt, Human
uguuugauucagacagcugccu

SEQ ID NO: 2179462 - RNA, 15 nt, Human
uguuuauuuaucagu

SEQ ID NO: 2179463 - RNA, 12 nt, Human
uguuucuguuau

SEQ ID NO: 2179464 - RNA, 13 nt, Human
uguuucuguuauu

SEQ ID NO: 2179465 - RNA, 23 nt, Human
uguuuauuuauaagcagauuuaa

SEQ ID NO: 2179466 - RNA, 22 nt, Human
uguuuauuuauaagcagauuua

SEQ ID NO: 2179467 - RNA, 14 nt, Human
uguuuauuuauaga

SEQ ID NO: 2179468 - RNA, 24 nt, Human
uguuuauuuauagaguguacuuaa

SEQ ID NO: 2179469 - RNA, 19 nt, Human
uguuucuuccaaagcacau

SEQ ID NO: 2179470 - RNA, 17 nt, Human
uguuucuuccaaagcac

SEQ ID NO: 2179471 - RNA, 17 nt, Human
uguuucuguucaccuuc

SEQ ID NO: 2179472 - RNA, 14 nt, Human
uguuucuguuauua

SEQ ID NO: 2179473 - RNA, 15 nt, Human
uguuucuguuauuaa

SEQ ID NO: 2179474 - RNA, 19 nt, Human
uguuucuguuauuaacaaa

SEQ ID NO: 2179475 - RNA, 18 nt, Human
uguuucuuccaaagcaca

SEQ ID NO: 2179476 - RNA, 13 nt, Human
uguuucuuucuag

SEQ ID NO: 2179477 - RNA, 18 nt, Human
uguuucuuuguaaugaaa

SEQ ID NO: 2179478 - RNA, 19 nt, Human
uguuucuuuguaaugaaaa

SEQ ID NO: 2179479 - RNA, 19 nt, Human
uguugcccaggcaggucuu

SEQ ID NO: 2179480 - RNA, 22 nt, Human
uguugcacacccacucagcucc

SEQ ID NO: 2179481 - RNA, 21 nt, Human
uguugcacacccacucagcuc

SEQ ID NO: 2179482 - RNA, 20 nt, Human
uguugcacacccacucagcu

SEQ ID NO: 2179483 - RNA, 19 nt, Human
uguugccuugcauaauggu

SEQ ID NO: 2179484 - RNA, 11 nt, Human
uguugcuaagc

SEQ ID NO: 2179485 - RNA, 18 nt, Human
uguugccuuuaugguuuc

SEQ ID NO: 2179486 - RNA, 19 nt, Human
uguugcucaaaaaaugagc

SEQ ID NO: 2179487 - RNA, 22 nt, Human
uguugcuaagccccagcaagca

SEQ ID NO: 2179488 - RNA, 12 nt, Human
uguugcuaagcc

SEQ ID NO: 2179489 - RNA, 21 nt, Human
uguugcuaagccccagcaagc

SEQ ID NO: 2179490 - RNA, 14 nt, Human
uguugcucagucuc

SEQ ID NO: 2179491 - RNA, 21 nt, Human
uguugcucaaaucuauucaga

SEQ ID NO: 2179492 - RNA, 11 nt, Human
uguugcugaau

SEQ ID NO: 2179493 - RNA, 14 nt, Human
uguuuaguugcaga

SEQ ID NO: 2179494 - RNA, 23 nt, Human
uguugcucaaaucuauucagaca

SEQ ID NO: 2179495 - RNA, 13 nt, Human
uguugcugaauag

SEQ ID NO: 2179496 - RNA, 14 nt, Human
uguuuauauaaaug

SEQ ID NO: 2179497 - RNA, 16 nt, Human
uguuuauauaaaugcu

SEQ ID NO: 2179498 - RNA, 20 nt, Human
uguuuauauaaaugcuuuua

SEQ ID NO: 2179499 - RNA, 15 nt, Human
uguuuauacagcuca

SEQ ID NO: 2179500 - RNA, 16 nt, Human
uguuuauaccuuugcc

SEQ ID NO: 2179501 - RNA, 21 nt, Human
uguuuauagcaaacuuggaau

SEQ ID NO: 2179502 - RNA, 16 nt, Human
uguuuauaaacauugu

SEQ ID NO: 2179503 - RNA, 13 nt, Human
uguuuaugugugu

SEQ ID NO: 2179504 - RNA, 16 nt, Human
uguuuaugugugugug

SEQ ID NO: 2179505 - RNA, 19 nt, Human
uguuuauuaacaaauuaug

SEQ ID NO: 2179506 - RNA, 16 nt, Human
uguuuauuaacaaauu

SEQ ID NO: 2179507 - RNA, 14 nt, Human
uguuuauuaacaaa

SEQ ID NO: 2179508 - RNA, 13 nt, Human
uguuuauuaacaa

SEQ ID NO: 2179509 - RNA, 17 nt, Human
uguuuauugucaaagug

SEQ ID NO: 2179510 - RNA, 19 nt, Human
uguuuauugucaaaguggu

SEQ ID NO: 2179511 - RNA, 11 nt, Human
uguuuucuucu

SEQ ID NO: 2179512 - RNA, 17 nt, Human
uguuuucuuuugguaaa

SEQ ID NO: 2179513 - RNA, 16 nt, Human
uguuuucccugaccuc

SEQ ID NO: 2179514 - RNA, 17 nt, Human
uguuuucugaauaacau

SEQ ID NO: 2179515 - RNA, 12 nt, Human
uguuuucugaau

SEQ ID NO: 2179516 - RNA, 23 nt, Human
uguuuucugagcccgggcugccu

SEQ ID NO: 2179517 - RNA, 17 nt, Human
uguuuugaaggcaaaau

SEQ ID NO: 2179518 - RNA, 19 nt, Human
uguuuugaaugguguugua

SEQ ID NO: 2179519 - RNA, 22 nt, Human
uguuuugaaugguguuguaugc

SEQ ID NO: 2179520 - RNA, 17 nt, Human
uguuuugacggaugauu

SEQ ID NO: 2179521 - RNA, 16 nt, Human
uguuuugagcuuucca

SEQ ID NO: 2179522 - RNA, 18 nt, Human
uguuuugagcuuuccaug

SEQ ID NO: 2179523 - RNA, 19 nt, Human
uguuuugagcuuuccaugu

SEQ ID NO: 2179524 - RNA, 12 nt, Human
uguuuugauaaa

SEQ ID NO: 2179525 - RNA, 20 nt, Human
uguuuucauggugaaaaugu

SEQ ID NO: 2179526 - RNA, 15 nt, Human
uguuuucauaauaaa

SEQ ID NO: 2179527 - RNA, 14 nt, Human
uguuuuauuccugu

SEQ ID NO: 2179528 - RNA, 15 nt, Human
uguuuuauuccugua

SEQ ID NO: 2179529 - RNA, 19 nt, Human
uguuuucauuaucucaaaa

SEQ ID NO: 2179530 - RNA, 12 nt, Human
uguuuucccuga

SEQ ID NO: 2179531 - RNA, 18 nt, Human
uguuuuccauuguuugaa

SEQ ID NO: 2179532 - RNA, 23 nt, Human
uguuuucccgagcaaagucuaaa

SEQ ID NO: 2179533 - RNA, 22 nt, Human
uguuuucccgagcaaagucuaa

SEQ ID NO: 2179534 - RNA, 15 nt, Human
uguuuuccagcuccu

SEQ ID NO: 2179535 - RNA, 17 nt, Human
uguuuuccagcuccuca

SEQ ID NO: 2179536 - RNA, 20 nt, Human
uguuuuccaugaguccccug

SEQ ID NO: 2179537 - RNA, 23 nt, Human
uguuugcuuauuguuccaagaca

SEQ ID NO: 2179538 - RNA, 18 nt, Human
uguuugcuucauaaauga

SEQ ID NO: 2179539 - RNA, 21 nt, Human
uguuugcuuauuguuccaaga

SEQ ID NO: 2179540 - RNA, 20 nt, Human
uguuugcuuauuguuccaag

SEQ ID NO: 2179541 - RNA, 18 nt, Human
uguuuggaauauugucca

SEQ ID NO: 2179542 - RNA, 18 nt, Human
uguuugcuuauuguucca

SEQ ID NO: 2179543 - RNA, 16 nt, Human
uguuugcuuauuguuc

SEQ ID NO: 2179544 - RNA, 15 nt, Human
uguuugcuuauuguu

SEQ ID NO: 2179545 - RNA, 24 nt, Human
uguuugcucucccgguucuuccag

SEQ ID NO: 2179546 - RNA, 23 nt, Human
uguuugcacguuaugguguuucu

SEQ ID NO: 2179547 - RNA, 21 nt, Human
uguuugaugcauuaaaagaaa

SEQ ID NO: 2179548 - RNA, 22 nt, Human
uguuugcacguuaugguguuuc

SEQ ID NO: 2179549 - RNA, 23 nt, Human
uguuuuaucaugacauguuauau

SEQ ID NO: 2179550 - RNA, 12 nt, Human
uguuuuaucaug

SEQ ID NO: 2179551 - RNA, 18 nt, Human
uguuuuaugacuucauua

SEQ ID NO: 2179552 - RNA, 13 nt, Human
uguuuggagacag

SEQ ID NO: 2179553 - RNA, 21 nt, Human
uguuuuauuuuaauucaguug

SEQ ID NO: 2179554 - RNA, 20 nt, Human
aguucugcuccucuccaggc

SEQ ID NO: 2179555 - RNA, 21 nt, Human
aguucugcuccucuccaggca

SEQ ID NO: 2179556 - RNA, 16 nt, Human
aguucugcuccucucc

SEQ ID NO: 2179557 - RNA, 17 nt, Human
aguucugcuccucucca

SEQ ID NO: 2179558 - RNA, 18 nt, Human
aguucugcuccucuccag

SEQ ID NO: 2179559 - RNA, 19 nt, Human
aguucugcuccucuccagg

SEQ ID NO: 2179560 - RNA, 12 nt, Human
aguucugcuccu

SEQ ID NO: 2179561 - RNA, 14 nt, Human
aguucugcuccucu

SEQ ID NO: 2179562 - RNA, 15 nt, Human
aguucugcuccucuc

SEQ ID NO: 2179563 - RNA, 16 nt, Human
aguucuuaguugcugu

SEQ ID NO: 2179564 - RNA, 23 nt, Human
aguucuguacucaaauguagcca

SEQ ID NO: 2179565 - RNA, 12 nt, Human
aguucuguagaa

SEQ ID NO: 2179566 - RNA, 17 nt, Human
aguucugggugcucccu

SEQ ID NO: 2179567 - RNA, 14 nt, Human
aguucuguaaaaua

SEQ ID NO: 2179568 - RNA, 19 nt, Human
aguucugggugcucccuac

SEQ ID NO: 2179569 - RNA, 12 nt, Human
aguucugggugc

SEQ ID NO: 2179570 - RNA, 12 nt, Human
aguucugcucua

SEQ ID NO: 2179571 - RNA, 11 nt, Human
aguucugggca

SEQ ID NO: 2179572 - RNA, 14 nt, Human
aguucugguuccua

SEQ ID NO: 2179573 - RNA, 22 nt, Human
aguucugaguguuuuuacuaca

SEQ ID NO: 2179574 - RNA, 21 nt, Human
aguucugcagauaaacaguag

SEQ ID NO: 2179575 - RNA, 15 nt, Human
aguucugaguguuuu

SEQ ID NO: 2179576 - RNA, 14 nt, Human
aguucugaguguuu

SEQ ID NO: 2179577 - RNA, 13 nt, Human
aguucugaagaau

SEQ ID NO: 2179578 - RNA, 14 nt, Human
aguucugacuugac

SEQ ID NO: 2179579 - RNA, 16 nt, Human
aguucugcagauaaac

SEQ ID NO: 2179580 - RNA, 20 nt, Human
uguuuugauguuuguggccu

SEQ ID NO: 2179581 - RNA, 18 nt, Human
uguuuugauaaaguagua

SEQ ID NO: 2179582 - RNA, 20 nt, Human
uguuuugauaaaguaguaaa

SEQ ID NO: 2179583 - RNA, 12 nt, Human
uguuuugcacuu

SEQ ID NO: 2179584 - RNA, 13 nt, Human
uguuuugcacuuu

SEQ ID NO: 2179585 - RNA, 14 nt, Human
uguuuugcaagcca

SEQ ID NO: 2179586 - RNA, 14 nt, Human
uguuuugcacuuuu

SEQ ID NO: 2179587 - RNA, 16 nt, Human
uguuuugccaacauug

SEQ ID NO: 2179588 - RNA, 13 nt, Human
uuaacagggaggg

SEQ ID NO: 2179589 - RNA, 22 nt, Human
uuaacagggucucuagugcugu

SEQ ID NO: 2179590 - RNA, 15 nt, Human
uuaacagucauuuaa

SEQ ID NO: 2179591 - RNA, 16 nt, Human
uuaacaguuuuccaug

SEQ ID NO: 2179592 - RNA, 14 nt, Human
uuaacaguuuucca

SEQ ID NO: 2179593 - RNA, 13 nt, Human
uuaacaguuuucc

SEQ ID NO: 2179594 - RNA, 16 nt, Human
uuaacagucauuuaaa

SEQ ID NO: 2179595 - RNA, 17 nt, Human
uuaacagucauuuaaaa

SEQ ID NO: 2179596 - RNA, 14 nt, Human
uuaacaacuugucu

SEQ ID NO: 2179597 - RNA, 22 nt, Human
uuaacaacaauaacacugucuc

SEQ ID NO: 2179598 - RNA, 21 nt, Human
uuaacaguuuuccaugaaaac

SEQ ID NO: 2179599 - RNA, 20 nt, Human
uuaacaguuuuccaugaaaa

SEQ ID NO: 2179600 - RNA, 19 nt, Human
uuaacaguuuuccaugaaa

SEQ ID NO: 2179601 - RNA, 17 nt, Human
uuaacaguuuuccauga

SEQ ID NO: 2179602 - RNA, 16 nt, Human
aguuucaauucagugc

SEQ ID NO: 2179603 - RNA, 17 nt, Human
aguuucaauucagugcu

SEQ ID NO: 2179604 - RNA, 15 nt, Human
aguuucacugacuua

SEQ ID NO: 2179605 - RNA, 12 nt, Human
aguuucagagaa

SEQ ID NO: 2179606 - RNA, 17 nt, Human
aguuucacugccauaua

SEQ ID NO: 2179607 - RNA, 18 nt, Human
aguuucagagaaguucug

SEQ ID NO: 2179608 - RNA, 14 nt, Human
aguuucagauauau

SEQ ID NO: 2179609 - RNA, 15 nt, Human
aguuucagauauaua

SEQ ID NO: 2179610 - RNA, 17 nt, Human
aguuucagauauauauc

SEQ ID NO: 2179611 - RNA, 23 nt, Human
aguuucagauauauaucauauug

SEQ ID NO: 2179612 - RNA, 15 nt, Human
uuaaauuucuaccgc

SEQ ID NO: 2179613 - RNA, 16 nt, Human
uuaaauugcuguguau

SEQ ID NO: 2179614 - RNA, 20 nt, Human
uuaaauucuugcaaaguauc

SEQ ID NO: 2179615 - RNA, 16 nt, Human
uuaaauaauaaagauc

SEQ ID NO: 2179616 - RNA, 15 nt, Human
uuaaauuuuaauuua

SEQ ID NO: 2179617 - RNA, 21 nt, Human
uuaaauuuguaaguuucaggu

SEQ ID NO: 2179618 - RNA, 16 nt, Human
uuaaauuuuaauuuau

SEQ ID NO: 2179619 - RNA, 13 nt, Human
uuaaauuuguaag

SEQ ID NO: 2179620 - RNA, 14 nt, Human
uuaaauuuguaagu

SEQ ID NO: 2179621 - RNA, 15 nt, Human
uuaaauuuguaaguu

SEQ ID NO: 2179622 - RNA, 17 nt, Human
uuaaauuuguaaguuuc

SEQ ID NO: 2179623 - RNA, 22 nt, Human
uuaacaaacaucacucugcugc

SEQ ID NO: 2179624 - RNA, 23 nt, Human
uuaacaaacaucacucugcugcu

SEQ ID NO: 2179625 - RNA, 21 nt, Human
uuaacaacaauaacacugucu

SEQ ID NO: 2179626 - RNA, 15 nt, Human
uuaacaaaagcaaga

SEQ ID NO: 2179627 - RNA, 12 nt, Human
uuaaaauuuauu

SEQ ID NO: 2179628 - RNA, 18 nt, Human
uuaaaauugugauguguc

SEQ ID NO: 2179629 - RNA, 13 nt, Human
uuaaaauugugau

SEQ ID NO: 2179630 - RNA, 23 nt, Human
uuaaaaagggcagggcaucuccu

SEQ ID NO: 2179631 - RNA, 13 nt, Human
uuaaaauguucac

SEQ ID NO: 2179632 - RNA, 16 nt, Human
uuaaaaacuauuuaac

SEQ ID NO: 2179633 - RNA, 17 nt, Human
uuaaaaagaaacaagau

SEQ ID NO: 2179634 - RNA, 20 nt, Human
uuaaaaagaaacaagaugcu

SEQ ID NO: 2179635 - RNA, 17 nt, Human
aguuuaguaaggcugug

SEQ ID NO: 2179636 - RNA, 16 nt, Human
aguuuauacucaccuu

SEQ ID NO: 2179637 - RNA, 16 nt, Human
uuaaaaaauguccaug

SEQ ID NO: 2179638 - RNA, 13 nt, Human
uuaaaaaaugucc

SEQ ID NO: 2179639 - RNA, 12 nt, Human
uuaaaaaauguc

SEQ ID NO: 2179640 - RNA, 15 nt, Human
uuaaaggcuguggua

SEQ ID NO: 2179641 - RNA, 15 nt, Human
uuaaaggcuucucuc

SEQ ID NO: 2179642 - RNA, 16 nt, Human
uuaaaggcuucucucu

SEQ ID NO: 2179643 - RNA, 17 nt, Human
uuaaaggauguuggugu

SEQ ID NO: 2179644 - RNA, 18 nt, Human
uuaaaggcaccaucuaau

SEQ ID NO: 2179645 - RNA, 20 nt, Human
uuaaaggaagguucuggugu

SEQ ID NO: 2179646 - RNA, 17 nt, Human
uuaaaggaaaaaauguu

SEQ ID NO: 2179647 - RNA, 12 nt, Human
uuaaaggaguua

SEQ ID NO: 2179648 - RNA, 22 nt, Human
uuaaaggaagguucugguguga

SEQ ID NO: 2179649 - RNA, 15 nt, Human
uuaaaauuuauugcu

SEQ ID NO: 2179650 - RNA, 12 nt, Human
uuaaaggaaaaa

SEQ ID NO: 2179651 - RNA, 16 nt, Human
uuaaaggaaaaaaugu

SEQ ID NO: 2179652 - RNA, 20 nt, Human
uuaaauaaaugucauuaaaa

SEQ ID NO: 2179653 - RNA, 18 nt, Human
uuaaauaaaugucauuaa

SEQ ID NO: 2179654 - RNA, 13 nt, Human
uuaaauaaauugu

SEQ ID NO: 2179655 - RNA, 15 nt, Human
uuaaauaaauuguau

SEQ ID NO: 2179656 - RNA, 17 nt, Human
uuaaauaaauuguauau

SEQ ID NO: 2179657 - RNA, 21 nt, Human
uuaaauaaaugucauuaaaau

SEQ ID NO: 2179658 - RNA, 18 nt, Human
uuaaauaaauuguauauu

SEQ ID NO: 2179659 - RNA, 20 nt, Human
uuaaauaaauuguauauuca

SEQ ID NO: 2179660 - RNA, 21 nt, Human
uuaaaggggcagaaaaacucu

SEQ ID NO: 2179661 - RNA, 19 nt, Human
uuaaaggguguacuuauau

SEQ ID NO: 2179662 - RNA, 15 nt, Human
uuaaaggugucuucc

SEQ ID NO: 2179663 - RNA, 20 nt, Human
uuaaaggcuucucucucacc

SEQ ID NO: 2179664 - RNA, 17 nt, Human
uuaaaggcuucucucuc

SEQ ID NO: 2179665 - RNA, 19 nt, Human
uuaaaggcuucucucucac

SEQ ID NO: 2179666 - RNA, 20 nt, Human
aguucuuaguugcuguaugu

SEQ ID NO: 2179667 - RNA, 21 nt, Human
aguucuuaguugcuguauguc

SEQ ID NO: 2179668 - RNA, 22 nt, Human
aguucuuaaggauugugauauu

SEQ ID NO: 2179669 - RNA, 15 nt, Human
aguucuucgggaaga

SEQ ID NO: 2179670 - RNA, 16 nt, Human
aguugcagauucauuu

SEQ ID NO: 2179671 - RNA, 22 nt, Human
aguugcagacucaguuugucag

SEQ ID NO: 2179672 - RNA, 18 nt, Human
aguugcagacucaguuug

SEQ ID NO: 2179673 - RNA, 17 nt, Human
aguugcagacucaguuu

SEQ ID NO: 2179674 - RNA, 16 nt, Human
aguugcagacucaguu

SEQ ID NO: 2179675 - RNA, 11 nt, Human
aguugcagaaa

SEQ ID NO: 2179676 - RNA, 20 nt, Human
aguugcacuuggccucugga

SEQ ID NO: 2179677 - RNA, 20 nt, Human
aguugcacggcugcugaggc

SEQ ID NO: 2179678 - RNA, 15 nt, Human
aguugcacugauauu

SEQ ID NO: 2179679 - RNA, 17 nt, Human
aguucuucgggaagaga

SEQ ID NO: 2179680 - RNA, 17 nt, Human
aguugcacagcuaugaa

SEQ ID NO: 2179681 - RNA, 15 nt, Human
aguugcacggcugcu

SEQ ID NO: 2179682 - RNA, 16 nt, Human
aguugcacggcugcug

SEQ ID NO: 2179683 - RNA, 17 nt, Human
aguugcacggcugcuga

SEQ ID NO: 2179684 - RNA, 23 nt, Human
aguugcagacucaguuugucaga

SEQ ID NO: 2179685 - RNA, 20 nt, Human
aguugcguggacucugcaca

SEQ ID NO: 2179686 - RNA, 15 nt, Human
aguugggagcacugg

SEQ ID NO: 2179687 - RNA, 13 nt, Human
aguugggagcacu

SEQ ID NO: 2179688 - RNA, 21 nt, Human
aguuggguggaugccuggugg

SEQ ID NO: 2179689 - RNA, 23 nt, Human
aguugggaacuucagauggaccu

SEQ ID NO: 2179690 - RNA, 13 nt, Human
aguuggcuucuaa

SEQ ID NO: 2179691 - RNA, 17 nt, Human
aguuggguggaugccug

SEQ ID NO: 2179692 - RNA, 21 nt, Human
aguugcuccgccucugcuggc

SEQ ID NO: 2179693 - RNA, 16 nt, Human
aguugcguggacucug

SEQ ID NO: 2179694 - RNA, 17 nt, Human
aguugcugcaaaccuga

SEQ ID NO: 2179695 - RNA, 16 nt, Human
aguugcugcaaaccug

SEQ ID NO: 2179696 - RNA, 16 nt, Human
aguuggccagagagcc

SEQ ID NO: 2179697 - RNA, 18 nt, Human
aguuggcuaggggagcag

SEQ ID NO: 2179698 - RNA, 18 nt, Human
aguuggcuggaugaaauu

SEQ ID NO: 2179699 - RNA, 16 nt, Human
aguuggcuaggacccc

SEQ ID NO: 2179700 - RNA, 19 nt, Human
aguuguuuucagacucaga

SEQ ID NO: 2179701 - RNA, 13 nt, Human
aguuguuugcaug

SEQ ID NO: 2179702 - RNA, 12 nt, Human
aguuuaaaaaaa

SEQ ID NO: 2179703 - RNA, 14 nt, Human
aguuuaaggaauau

SEQ ID NO: 2179704 - RNA, 22 nt, Human
aguuuaacacaaguccugugaa

SEQ ID NO: 2179705 - RNA, 23 nt, Human
aguuuaaccaaaaagaccagacu

SEQ ID NO: 2179706 - RNA, 22 nt, Human
aguuuaauccuucuaguuuccc

SEQ ID NO: 2179707 - RNA, 20 nt, Human
aguuuaauggugccuucauu

SEQ ID NO: 2179708 - RNA, 16 nt, Human
aguuuaggauaaaaua

SEQ ID NO: 2179709 - RNA, 13 nt, Human
aguuggugacaga

SEQ ID NO: 2179710 - RNA, 16 nt, Human
aguugggagcacugga

SEQ ID NO: 2179711 - RNA, 18 nt, Human
aguuggucccccuuccau

SEQ ID NO: 2179712 - RNA, 13 nt, Human
aguuguaaauaua

SEQ ID NO: 2179713 - RNA, 14 nt, Human
aguuguaaauauau

SEQ ID NO: 2179714 - RNA, 15 nt, Human
aguuguaaauauaua

SEQ ID NO: 2179715 - RNA, 16 nt, Human
aguuguaaauauauaa

SEQ ID NO: 2179716 - RNA, 17 nt, Human
aguuguaaauauauaaa

SEQ ID NO: 2179717 - RNA, 18 nt, Human
aguuguaaauauauaaau

SEQ ID NO: 2179718 - RNA, 20 nt, Human
aguuguaaauauauaaauau

SEQ ID NO: 2179719 - RNA, 22 nt, Human
aguuguaaauauauaaauauau

SEQ ID NO: 2179720 - RNA, 21 nt, Human
aguuguuugauucagacagcu

SEQ ID NO: 2179721 - RNA, 23 nt, Human
aguuguuugauucagacagcugc

SEQ ID NO: 2179722 - RNA, 18 nt, Human
uuacaucaaggcuucaaa

SEQ ID NO: 2179723 - RNA, 22 nt, Human
uuacauaucaccucauggccua

SEQ ID NO: 2179724 - RNA, 16 nt, Human
uuacauagguauauau

SEQ ID NO: 2179725 - RNA, 22 nt, Human
uuacauauuugcauauguauga

SEQ ID NO: 2179726 - RNA, 13 nt, Human
uuacaucauuuuu

SEQ ID NO: 2179727 - RNA, 14 nt, Human
uuacaucauuuuug

SEQ ID NO: 2179728 - RNA, 18 nt, Human
uuacaucauuuuuguauc

SEQ ID NO: 2179729 - RNA, 20 nt, Human
uuacaucauuuuuguaucua

SEQ ID NO: 2179730 - RNA, 13 nt, Human
uuacauccuuaaa

SEQ ID NO: 2179731 - RNA, 14 nt, Human
uuacauacugcugu

SEQ ID NO: 2179732 - RNA, 19 nt, Human
uuacagugaaaauguaagc

SEQ ID NO: 2179733 - RNA, 20 nt, Human
uuacagugaaaauguaagcu

SEQ ID NO: 2179734 - RNA, 21 nt, Human
uuacauaaucuguacaaugaa

SEQ ID NO: 2179735 - RNA, 20 nt, Human
uuacauaagauaaaugugcu

SEQ ID NO: 2179736 - RNA, 13 nt, Human
uuaccugugaaau

SEQ ID NO: 2179737 - RNA, 22 nt, Human
uuaccuguuuucgcaccuacca

SEQ ID NO: 2179738 - RNA, 14 nt, Human
uuaccuuacagaag

SEQ ID NO: 2179739 - RNA, 14 nt, Human
uuacaucuguuuua

SEQ ID NO: 2179740 - RNA, 18 nt, Human
uuaccugggcauucuugu

SEQ ID NO: 2179741 - RNA, 12 nt, Human
uuaccugggaaa

SEQ ID NO: 2179742 - RNA, 14 nt, Human
uuacugagcuucuc

SEQ ID NO: 2179743 - RNA, 16 nt, Human
uuacugagcuucucug

SEQ ID NO: 2179744 - RNA, 17 nt, Human
uuacugagcuucucugu

SEQ ID NO: 2179745 - RNA, 18 nt, Human
uuacugagcuucucugug

SEQ ID NO: 2179746 - RNA, 12 nt, Human
uuacugaccagc

SEQ ID NO: 2179747 - RNA, 13 nt, Human
uuacugagcuucu

SEQ ID NO: 2179748 - RNA, 12 nt, Human
uuacucagcccu

SEQ ID NO: 2179749 - RNA, 23 nt, Human
uuacugaaugcaccauggucaaa

SEQ ID NO: 2179750 - RNA, 21 nt, Human
uuacugaucaugcauuguuga

SEQ ID NO: 2179751 - RNA, 18 nt, Human
uuacugaucaugcauugu

SEQ ID NO: 2179752 - RNA, 17 nt, Human
uuacugaucaugcauug

SEQ ID NO: 2179753 - RNA, 16 nt, Human
uuacugaucaugcauu

SEQ ID NO: 2179754 - RNA, 15 nt, Human
uuacugaucaugcau

SEQ ID NO: 2179755 - RNA, 14 nt, Human
uuacugaucaugca

SEQ ID NO: 2179756 - RNA, 13 nt, Human
uuacugaucaugc

SEQ ID NO: 2179757 - RNA, 19 nt, Human
uuacugagcuucucuguga

SEQ ID NO: 2179758 - RNA, 22 nt, Human
uuacugauagggauacaugcuc

SEQ ID NO: 2179759 - RNA, 23 nt, Human
uuacugauauauuuuacaauuuu

SEQ ID NO: 2179760 - RNA, 14 nt, Human
uuacugauauauuu

SEQ ID NO: 2179761 - RNA, 23 nt, Human
uuaccuguuuucgcaccuaccau

SEQ ID NO: 2179762 - RNA, 21 nt, Human
uuaccuuagauuagcucugga

SEQ ID NO: 2179763 - RNA, 19 nt, Human
uuacuauuuuacuucuaga

SEQ ID NO: 2179764 - RNA, 15 nt, Human
uuacucaacccucuc

SEQ ID NO: 2179765 - RNA, 19 nt, Human
uuaccuuagauuagcucug

SEQ ID NO: 2179766 - RNA, 23 nt, Human
uuacucagaauucucuaguuuga

SEQ ID NO: 2179767 - RNA, 18 nt, Human
uuacucagaauucucuag

SEQ ID NO: 2179768 - RNA, 14 nt, Human
uuacugguccaaaa

SEQ ID NO: 2179769 - RNA, 17 nt, Human
uuacugguccaaaagau

SEQ ID NO: 2179770 - RNA, 15 nt, Human
uuacugguccaaaag

SEQ ID NO: 2179771 - RNA, 18 nt, Human
uuacugcaaaugucauca

SEQ ID NO: 2179772 - RNA, 19 nt, Human
uuacugaucaugcauuguu

SEQ ID NO: 2179773 - RNA, 13 nt, Human
uuacugcaaaugu

SEQ ID NO: 2179774 - RNA, 18 nt, Human
uuacugguccaaaagauu

SEQ ID NO: 2179775 - RNA, 15 nt, Human
uuacuguaagaaaau

SEQ ID NO: 2179776 - RNA, 14 nt, Human
uuagaaauauaauu

SEQ ID NO: 2179777 - RNA, 12 nt, Human
uuagaaauauaa

SEQ ID NO: 2179778 - RNA, 15 nt, Human
uuagaaauagacagu

SEQ ID NO: 2179779 - RNA, 13 nt, Human
uuagaaauagaca

SEQ ID NO: 2179780 - RNA, 11 nt, Human
uuagaaauaua

SEQ ID NO: 2179781 - RNA, 13 nt, Human
uuagaaccuuucu

SEQ ID NO: 2179782 - RNA, 12 nt, Human
uuagaacauuuu

SEQ ID NO: 2179783 - RNA, 15 nt, Human
uuagaagaagugugu

SEQ ID NO: 2179784 - RNA, 14 nt, Human
uuagaagaagugug

SEQ ID NO: 2179785 - RNA, 23 nt, Human
uuagaagauauuagucuuggggc

SEQ ID NO: 2179786 - RNA, 16 nt, Human
uuagaagaaguguguc

SEQ ID NO: 2179787 - RNA, 18 nt, Human
uuagaacauuuuaauuca

SEQ ID NO: 2179788 - RNA, 18 nt, Human
uuagaagauauuagucuu

SEQ ID NO: 2179789 - RNA, 11 nt, Human
uuagacagagu

SEQ ID NO: 2179790 - RNA, 15 nt, Human
uuagacaaauacuca

SEQ ID NO: 2179791 - RNA, 18 nt, Human
uuagacaaauacucaugu

SEQ ID NO: 2179792 - RNA, 19 nt, Human
uuagacaaauacucaugug

SEQ ID NO: 2179793 - RNA, 20 nt, Human
uuagacaaauacucaugugu

SEQ ID NO: 2179794 - RNA, 21 nt, Human
uuagacaaauacucaugugua

SEQ ID NO: 2179795 - RNA, 22 nt, Human
uuagacaaauacucauguguau

SEQ ID NO: 2179796 - RNA, 16 nt, Human
uuagacaagagauggg

SEQ ID NO: 2179797 - RNA, 23 nt, Human
uuagacaaauacucauguguaug

SEQ ID NO: 2179798 - RNA, 23 nt, Human
uuagacacuggcugccagcuauu

SEQ ID NO: 2179799 - RNA, 20 nt, Human
auaacuuauauuguaagaaa

SEQ ID NO: 2179800 - RNA, 23 nt, Human
auaacuuauauuguaagaaauac

SEQ ID NO: 2179801 - RNA, 22 nt, Human
auaacuuauauuguaagaaaua

SEQ ID NO: 2179802 - RNA, 21 nt, Human
auaacuuauauuguaagaaau

SEQ ID NO: 2179803 - RNA, 13 nt, Human
auaaaguguaaua

SEQ ID NO: 2179804 - RNA, 17 nt, Human
auaaacacccaugaauc

SEQ ID NO: 2179805 - RNA, 16 nt, Human
auaaaguuggugacag

SEQ ID NO: 2179806 - RNA, 17 nt, Human
auaaaguuggugacaga

SEQ ID NO: 2179807 - RNA, 21 nt, Human
auaaaguucugaguguuuuua

SEQ ID NO: 2179808 - RNA, 22 nt, Human
auaaaguugaagcuaagauuua

SEQ ID NO: 2179809 - RNA, 15 nt, Human
auaaaguucuguacu

SEQ ID NO: 2179810 - RNA, 12 nt, Human
auaaauaacuuu

SEQ ID NO: 2179811 - RNA, 19 nt, Human
auaaaguuugcuuagaaaa

SEQ ID NO: 2179812 - RNA, 14 nt, Human
auaaauaacuuuuu

SEQ ID NO: 2179813 - RNA, 18 nt, Human
auaaaguuggugacagau

SEQ ID NO: 2179814 - RNA, 13 nt, Human
auaaaguuucuca

SEQ ID NO: 2179815 - RNA, 12 nt, Human
auaaaguuugcu

SEQ ID NO: 2179816 - RNA, 21 nt, Human
auaaauaaucggcccacagcu

SEQ ID NO: 2179817 - RNA, 15 nt, Human
auaaauaaucuguac

SEQ ID NO: 2179818 - RNA, 14 nt, Human
auaaauaccucuua

SEQ ID NO: 2179819 - RNA, 18 nt, Human
auaaauaccucuuagcug

SEQ ID NO: 2179820 - RNA, 23 nt, Human
auaaauaccucuuagcugagugg

SEQ ID NO: 2179821 - RNA, 11 nt, Human
auaaauagcua

SEQ ID NO: 2179822 - RNA, 20 nt, Human
auaaauauauauaaauauau

SEQ ID NO: 2179823 - RNA, 21 nt, Human
auaaauauauauaaauauaua

SEQ ID NO: 2179824 - RNA, 21 nt, Human
auaaauauauauauauauaaa

SEQ ID NO: 2179825 - RNA, 22 nt, Human
auaaauauauauauauauaaaa

SEQ ID NO: 2179826 - RNA, 23 nt, Human
auaaauauauauauauauaaaau

SEQ ID NO: 2179827 - RNA, 14 nt, Human
auaaauaugaagcu

SEQ ID NO: 2179828 - RNA, 14 nt, Human
auaaauaugagugc

SEQ ID NO: 2179829 - RNA, 15 nt, Human
auaaauaugagugcc

SEQ ID NO: 2179830 - RNA, 12 nt, Human
auaaauaugaag

SEQ ID NO: 2179831 - RNA, 20 nt, Human
auaaauauauauauccucug

SEQ ID NO: 2179832 - RNA, 11 nt, Human
auaaaugaagc

SEQ ID NO: 2179833 - RNA, 17 nt, Human
auaaaugaagcagcuuu

SEQ ID NO: 2179834 - RNA, 14 nt, Human
auaaaucuguugcc

SEQ ID NO: 2179835 - RNA, 22 nt, Human
auaaauauuauauuauauauau

SEQ ID NO: 2179836 - RNA, 12 nt, Human
auaaauauuaua

SEQ ID NO: 2179837 - RNA, 13 nt, Human
auaaauaugcagu

SEQ ID NO: 2179838 - RNA, 14 nt, Human
auaaauaugcagug

SEQ ID NO: 2179839 - RNA, 22 nt, Human
auaaauaugccucuccuuugua

SEQ ID NO: 2179840 - RNA, 17 nt, Human
uuacagugaaaauguaa

SEQ ID NO: 2179841 - RNA, 19 nt, Human
uuacaguaggagcccagcu

SEQ ID NO: 2179842 - RNA, 11 nt, Human
uuacagcugug

SEQ ID NO: 2179843 - RNA, 14 nt, Human
uuacagcugccugc

SEQ ID NO: 2179844 - RNA, 21 nt, Human
uuacagcgagaggcagagaaa

SEQ ID NO: 2179845 - RNA, 20 nt, Human
uuacagcuggguggcacugc

SEQ ID NO: 2179846 - RNA, 21 nt, Human
uuacagcuggguggcacugcc

SEQ ID NO: 2179847 - RNA, 14 nt, Human
uuacaggaaguacu

SEQ ID NO: 2179848 - RNA, 18 nt, Human
auaacuacuguguuccug

SEQ ID NO: 2179849 - RNA, 16 nt, Human
auaacuacuguguucc

SEQ ID NO: 2179850 - RNA, 19 nt, Human
auaacuacuguguuccugg

SEQ ID NO: 2179851 - RNA, 19 nt, Human
auaacuagauggugcugag

SEQ ID NO: 2179852 - RNA, 17 nt, Human
uuacagccucacuugaa

SEQ ID NO: 2179853 - RNA, 21 nt, Human
auaacuagauggugcugagaa

SEQ ID NO: 2179854 - RNA, 20 nt, Human
auaacuagauggugcugaga

SEQ ID NO: 2179855 - RNA, 13 nt, Human
uuacagcugccug

SEQ ID NO: 2179856 - RNA, 15 nt, Human
uuacagcgagaggca

SEQ ID NO: 2179857 - RNA, 14 nt, Human
uuacagccucugac

SEQ ID NO: 2179858 - RNA, 15 nt, Human
uuacagccucugacu

SEQ ID NO: 2179859 - RNA, 15 nt, Human
auaacuacuguguuc

SEQ ID NO: 2179860 - RNA, 13 nt, Human
auaacuacugugu

SEQ ID NO: 2179861 - RNA, 19 nt, Human
auaacuacuccggagacag

SEQ ID NO: 2179862 - RNA, 20 nt, Human
auaacuacuccggagacagg

SEQ ID NO: 2179863 - RNA, 17 nt, Human
auaaaugucauuaaaau

SEQ ID NO: 2179864 - RNA, 15 nt, Human
auaaauguaucuuau

SEQ ID NO: 2179865 - RNA, 18 nt, Human
auaaauguaucuuauuca

SEQ ID NO: 2179866 - RNA, 16 nt, Human
auaacuaaaagguaug

SEQ ID NO: 2179867 - RNA, 14 nt, Human
auaacuaaauaaag

SEQ ID NO: 2179868 - RNA, 11 nt, Human
auaaaugaaug

SEQ ID NO: 2179869 - RNA, 18 nt, Human
auaaaugaagcagcuuua

SEQ ID NO: 2179870 - RNA, 20 nt, Human
auaaaugaagcagcuuuaaa

SEQ ID NO: 2179871 - RNA, 16 nt, Human
auaaaugaauuuuagu

SEQ ID NO: 2179872 - RNA, 22 nt, Human
auaaaugguauagcaaauguuu

SEQ ID NO: 2179873 - RNA, 16 nt, Human
auaaaugguuaaaaga

SEQ ID NO: 2179874 - RNA, 17 nt, Human
auaaaugaauuuuaguu

SEQ ID NO: 2179875 - RNA, 17 nt, Human
auaaaugagcuauguau

SEQ ID NO: 2179876 - RNA, 18 nt, Human
auaaaugagcuauguauu

SEQ ID NO: 2179877 - RNA, 20 nt, Human
auaaaugagcuauguauuaa

SEQ ID NO: 2179878 - RNA, 15 nt, Human
auaaauguacauuaa

SEQ ID NO: 2179879 - RNA, 13 nt, Human
auaaauguaucau

SEQ ID NO: 2179880 - RNA, 21 nt, Human
auaaauguaucauagaaaugu

SEQ ID NO: 2179881 - RNA, 17 nt, Human
auaaauguaucauagaa

SEQ ID NO: 2179882 - RNA, 22 nt, Human
auaaaugguuaaaagagguuuu

SEQ ID NO: 2179883 - RNA, 15 nt, Human
auaaaaugaccagua

SEQ ID NO: 2179884 - RNA, 20 nt, Human
auaaaaucauguacauuucu

SEQ ID NO: 2179885 - RNA, 18 nt, Human
auaaaaucauguacauuu

SEQ ID NO: 2179886 - RNA, 19 nt, Human
auaaaaugaggacauguuu

SEQ ID NO: 2179887 - RNA, 13 nt, Human
auaaaaugaccag

SEQ ID NO: 2179888 - RNA, 18 nt, Human
auaaaaugaggacauguu

SEQ ID NO: 2179889 - RNA, 20 nt, Human
auaaaaugugauuuuucuga

SEQ ID NO: 2179890 - RNA, 13 nt, Human
auaaaaugugauu

SEQ ID NO: 2179891 - RNA, 12 nt, Human
auaaaauguuga

SEQ ID NO: 2179892 - RNA, 13 nt, Human
auaaaauguugaa

SEQ ID NO: 2179893 - RNA, 16 nt, Human
auaaaauguugaaaag

SEQ ID NO: 2179894 - RNA, 17 nt, Human
auaaaauguugaaaagu

SEQ ID NO: 2179895 - RNA, 16 nt, Human
auaaaauaaaguauau

SEQ ID NO: 2179896 - RNA, 16 nt, Human
auaaaaucagccaauu

SEQ ID NO: 2179897 - RNA, 18 nt, Human
auaaaaucagccaauuau

SEQ ID NO: 2179898 - RNA, 22 nt, Human
auaaaaucagccaauuauguua

SEQ ID NO: 2179899 - RNA, 23 nt, Human
auaaaaucagccaauuauguuaa

SEQ ID NO: 2179900 - RNA, 18 nt, Human
auaaaauccauacauuug

SEQ ID NO: 2179901 - RNA, 19 nt, Human
auaaaauccauacauuugu

SEQ ID NO: 2179902 - RNA, 15 nt, Human
auaaaaguacauguu

SEQ ID NO: 2179903 - RNA, 21 nt, Human
auaaaaguacauguuaaacuu

SEQ ID NO: 2179904 - RNA, 21 nt, Human
auaaaagugauuguuggcaca

SEQ ID NO: 2179905 - RNA, 14 nt, Human
auaaaagugauugu

SEQ ID NO: 2179906 - RNA, 18 nt, Human
auaaaagugauuguuggc

SEQ ID NO: 2179907 - RNA, 22 nt, Human
auaaaagugaucaauaaaaugu

SEQ ID NO: 2179908 - RNA, 18 nt, Human
auaaaagugaucaauaaa

SEQ ID NO: 2179909 - RNA, 17 nt, Human
auaaaagugaucaauaa

SEQ ID NO: 2179910 - RNA, 13 nt, Human
auaaaagugauca

SEQ ID NO: 2179911 - RNA, 18 nt, Human
aguuucagguguuuaguu

SEQ ID NO: 2179912 - RNA, 20 nt, Human
auaaaaggucggaccagcuu

SEQ ID NO: 2179913 - RNA, 22 nt, Human
auaaaagggacugagaaauuua

SEQ ID NO: 2179914 - RNA, 21 nt, Human
aguuucaggugacaugugaaa

SEQ ID NO: 2179915 - RNA, 22 nt, Human
aguuucaggugacaugugaaac

SEQ ID NO: 2179916 - RNA, 20 nt, Human
aguuucaggauacaugugcc

SEQ ID NO: 2179917 - RNA, 11 nt, Human
aguuucaggug

SEQ ID NO: 2179918 - RNA, 14 nt, Human
aguuucaggugaca

SEQ ID NO: 2179919 - RNA, 15 nt, Human
aguuucaggugacau

SEQ ID NO: 2179920 - RNA, 16 nt, Human
aguuucaggugacaug

SEQ ID NO: 2179921 - RNA, 17 nt, Human
aguuucaggugacaugu

SEQ ID NO: 2179922 - RNA, 18 nt, Human
aguuucaggugacaugug

SEQ ID NO: 2179923 - RNA, 20 nt, Human
aguuucaggugacaugugaa

SEQ ID NO: 2179924 - RNA, 14 nt, Human
auaaaauaaaguau

SEQ ID NO: 2179925 - RNA, 13 nt, Human
auaaaauaaagua

SEQ ID NO: 2179926 - RNA, 16 nt, Human
auaaaauaauuuuuau

SEQ ID NO: 2179927 - RNA, 21 nt, Human
auaaaauaauuuuuauauuug

SEQ ID NO: 2179928 - RNA, 22 nt, Human
auaaaauaauuuuuauauuuga

SEQ ID NO: 2179929 - RNA, 18 nt, Human
uuaaguuagggaauggca

SEQ ID NO: 2179930 - RNA, 21 nt, Human
uuaaguguuguaaauauuuau

SEQ ID NO: 2179931 - RNA, 22 nt, Human
uuaaguuacacauuuuucagau

SEQ ID NO: 2179932 - RNA, 16 nt, Human
uuaagugcuuuguaau

SEQ ID NO: 2179933 - RNA, 17 nt, Human
uuaagugcguguguaga

SEQ ID NO: 2179934 - RNA, 18 nt, Human
uuaagugcguguguagag

SEQ ID NO: 2179935 - RNA, 19 nt, Human
uuaagugcguguguagagu

SEQ ID NO: 2179936 - RNA, 21 nt, Human
uuaagugcguguguagaguua

SEQ ID NO: 2179937 - RNA, 16 nt, Human
uuaagugaugaacauu

SEQ ID NO: 2179938 - RNA, 13 nt, Human
uuaagugaauguc

SEQ ID NO: 2179939 - RNA, 22 nt, Human
uuaagugcugcauuuaaaagau

SEQ ID NO: 2179940 - RNA, 17 nt, Human
uuaaguacuauguauca

SEQ ID NO: 2179941 - RNA, 18 nt, Human
uuaaguaaugauaacugg

SEQ ID NO: 2179942 - RNA, 21 nt, Human
uuaagucuguuuuaugacuuc

SEQ ID NO: 2179943 - RNA, 20 nt, Human
uuaagucuguuuuaugacuu

SEQ ID NO: 2179944 - RNA, 18 nt, Human
uuaagucuguuuuaugac

SEQ ID NO: 2179945 - RNA, 17 nt, Human
uuaagucuguuuuauga

SEQ ID NO: 2179946 - RNA, 22 nt, Human
uuaagguuauuuauuuaaaugu

SEQ ID NO: 2179947 - RNA, 23 nt, Human
uuaagagccauauaaguuugaag

SEQ ID NO: 2179948 - RNA, 23 nt, Human
uuaagaagcuguuguacauuuau

SEQ ID NO: 2179949 - RNA, 20 nt, Human
uuaagaggcagaaaauugca

SEQ ID NO: 2179950 - RNA, 18 nt, Human
uuaaguaaggaauuuuau

SEQ ID NO: 2179951 - RNA, 15 nt, Human
uuaagaggcaggguc

SEQ ID NO: 2179952 - RNA, 16 nt, Human
uuaagaggcagggucu

SEQ ID NO: 2179953 - RNA, 13 nt, Human
uuaagaggcaggg

SEQ ID NO: 2179954 - RNA, 14 nt, Human
uuaagaaggcaaaa

SEQ ID NO: 2179955 - RNA, 12 nt, Human
uuaagaaggcaa

SEQ ID NO: 2179956 - RNA, 18 nt, Human
uuaagaagcuguuguaca

SEQ ID NO: 2179957 - RNA, 20 nt, Human
uuaagaagcuguuguacauu

SEQ ID NO: 2179958 - RNA, 21 nt, Human
uuaagaagcuguuguacauuu

SEQ ID NO: 2179959 - RNA, 22 nt, Human
uuaagaagcuguuguacauuua

SEQ ID NO: 2179960 - RNA, 22 nt, Human
uuaagaagacugcauuauauuu

SEQ ID NO: 2179961 - RNA, 19 nt, Human
auaaaauguugaaaaguca

SEQ ID NO: 2179962 - RNA, 11 nt, Human
uuaagaagcug

SEQ ID NO: 2179963 - RNA, 13 nt, Human
uuaagaagcuguu

SEQ ID NO: 2179964 - RNA, 14 nt, Human
uuaagaagcuguug

SEQ ID NO: 2179965 - RNA, 16 nt, Human
uuaagaagcuguugua

SEQ ID NO: 2179966 - RNA, 17 nt, Human
uuaauuuuuuuaaccaa

SEQ ID NO: 2179967 - RNA, 18 nt, Human
uuaauuuuuuuaaccaaa

SEQ ID NO: 2179968 - RNA, 23 nt, Human
uuaauuuacaaaaauauaaaaua

SEQ ID NO: 2179969 - RNA, 14 nt, Human
uuaauuuacaaaaa

SEQ ID NO: 2179970 - RNA, 22 nt, Human
uuaauuuacaaaaauauaaaau

SEQ ID NO: 2179971 - RNA, 18 nt, Human
uuacaaaaauauaaaaua

SEQ ID NO: 2179972 - RNA, 22 nt, Human
uuaauuuuuuuaaccaaaggug

SEQ ID NO: 2179973 - RNA, 23 nt, Human
uuaauuuuuuuaaccaaagguga

SEQ ID NO: 2179974 - RNA, 15 nt, Human
uuaauuuuuuuauug

SEQ ID NO: 2179975 - RNA, 17 nt, Human
uuaauuuuuuuauuguu

SEQ ID NO: 2179976 - RNA, 19 nt, Human
uuaauuuuuuugagacaga

SEQ ID NO: 2179977 - RNA, 16 nt, Human
auaaaauuaaagcuga

SEQ ID NO: 2179978 - RNA, 20 nt, Human
uuacaaaacuacaugagaac

SEQ ID NO: 2179979 - RNA, 18 nt, Human
uuacaaaacuacaugaga

SEQ ID NO: 2179980 - RNA, 17 nt, Human
uuacaaaacuacaugag

SEQ ID NO: 2179981 - RNA, 13 nt, Human
auaaaauuaugcc

SEQ ID NO: 2179982 - RNA, 13 nt, Human
auaaaauuauucc

SEQ ID NO: 2179983 - RNA, 23 nt, Human
auaaaauuauagaugggaaugaa

SEQ ID NO: 2179984 - RNA, 20 nt, Human
auaaaauuauagaugggaau

SEQ ID NO: 2179985 - RNA, 21 nt, Human
auaaaauuauagaugggaaug

SEQ ID NO: 2179986 - RNA, 13 nt, Human
auaaaauuauaga

SEQ ID NO: 2179987 - RNA, 14 nt, Human
auaaaauuauagau

SEQ ID NO: 2179988 - RNA, 22 nt, Human
auaaaauucuauuacaguaugu

SEQ ID NO: 2179989 - RNA, 11 nt, Human
auaaaauugua

SEQ ID NO: 2179990 - RNA, 21 nt, Human
auaaaauuguaaaauuguaua

SEQ ID NO: 2179991 - RNA, 13 nt, Human
auaaaauuauuuu

SEQ ID NO: 2179992 - RNA, 18 nt, Human
auaaaauuauuuuggauu

SEQ ID NO: 2179993 - RNA, 20 nt, Human
auaaaauuuuuaaucuuuaa

SEQ ID NO: 2179994 - RNA, 15 nt, Human
auaaacaaaguuacu

SEQ ID NO: 2179995 - RNA, 23 nt, Human
auaaaauuuuuuuucauguuuua

SEQ ID NO: 2179996 - RNA, 16 nt, Human
auaaacaacuuaaugu

SEQ ID NO: 2179997 - RNA, 19 nt, Human
auaaacaacuuaauguucu

SEQ ID NO: 2179998 - RNA, 19 nt, Human
auaaaauuuuuuuucaugu

SEQ ID NO: 2179999 - RNA, 17 nt, Human
auaaaauuuuuuuucau

SEQ ID NO: 2180000 - RNA, 16 nt, Human
auaaaauuuguugcau

SEQ ID NO: 2180001 - RNA, 13 nt, Human
auaaaauuuguug

SEQ ID NO: 2180002 - RNA, 23 nt, Human
auaaaauuguaaaauuguauaga

SEQ ID NO: 2180003 - RNA, 22 nt, Human
auaaacaagaccacguuucuaa

SEQ ID NO: 2180004 - RNA, 15 nt, Human
auaaacaagaccacg

SEQ ID NO: 2180005 - RNA, 23 nt, Human
auaaacaagaccacguuucuaaa

SEQ ID NO: 2180006 - RNA, 19 nt, Human
uuaauuguuuugcacuuuu

SEQ ID NO: 2180007 - RNA, 18 nt, Human
uuaauuuaaacaccuccu

SEQ ID NO: 2180008 - RNA, 18 nt, Human
uuaauuguuuugcacuuu

SEQ ID NO: 2180009 - RNA, 16 nt, Human
uuaauuguuguuucuu

SEQ ID NO: 2180010 - RNA, 19 nt, Human
uuaauuguuguuucuuucu

SEQ ID NO: 2180011 - RNA, 20 nt, Human
uuaauuguuguuucuuucua

SEQ ID NO: 2180012 - RNA, 22 nt, Human
uuaauuguuguuucuuucuagu

SEQ ID NO: 2180013 - RNA, 14 nt, Human
uuaauucucuugaa

SEQ ID NO: 2180014 - RNA, 22 nt, Human
uuaauuccaugaaucgcuucuc

SEQ ID NO: 2180015 - RNA, 17 nt, Human
uuaauucucaugugauc

SEQ ID NO: 2180016 - RNA, 17 nt, Human
uuaauucucuuucaaag

SEQ ID NO: 2180017 - RNA, 15 nt, Human
uuaauuguucauuuu

SEQ ID NO: 2180018 - RNA, 13 nt, Human
uuaauuguuguuu

SEQ ID NO: 2180019 - RNA, 15 nt, Human
uuaauucuuagcuca

SEQ ID NO: 2180020 - RNA, 16 nt, Human
uuaauuccuuucucau

SEQ ID NO: 2180021 - RNA, 15 nt, Human
uuaauucauguuucu

SEQ ID NO: 2180022 - RNA, 19 nt, Human
uuaauuccaauaugaugac

SEQ ID NO: 2180023 - RNA, 21 nt, Human
uuaauuccaugaaucgcuucu

SEQ ID NO: 2180024 - RNA, 17 nt, Human
uuaauuccaauuauaug

SEQ ID NO: 2180025 - RNA, 14 nt, Human
uuaauucauguuuc

SEQ ID NO: 2180026 - RNA, 14 nt, Human
uuaaugaaguuuga

SEQ ID NO: 2180027 - RNA, 23 nt, Human
uuaaugaagaaaguggaaaacaa

SEQ ID NO: 2180028 - RNA, 18 nt, Human
uuaaugaagaaaguggaa

SEQ ID NO: 2180029 - RNA, 14 nt, Human
uuaaugaagaaagu

SEQ ID NO: 2180030 - RNA, 22 nt, Human
uuaaugaaauaucuguauuuaa

SEQ ID NO: 2180031 - RNA, 17 nt, Human
uuaaugaaauaucugua

SEQ ID NO: 2180032 - RNA, 21 nt, Human
uuaaugaaauaucuguauuua

SEQ ID NO: 2180033 - RNA, 13 nt, Human
uuaauaaagacag

SEQ ID NO: 2180034 - RNA, 14 nt, Human
uuaauaaagacagg

SEQ ID NO: 2180035 - RNA, 12 nt, Human
uuaauaacaauu

SEQ ID NO: 2180036 - RNA, 18 nt, Human
uuaauaaauuauuuauua

SEQ ID NO: 2180037 - RNA, 20 nt, Human
uuaauaaauuauuuauuauu

SEQ ID NO: 2180038 - RNA, 20 nt, Human
uuaaugaaagacuguacaaa

SEQ ID NO: 2180039 - RNA, 23 nt, Human
uuaaugaaagacuguacaaagua

SEQ ID NO: 2180040 - RNA, 22 nt, Human
uuaauaaacuuuuuuuugagaa

SEQ ID NO: 2180041 - RNA, 18 nt, Human
uuaaguugcugaugaacu

SEQ ID NO: 2180042 - RNA, 17 nt, Human
uuaauaaacacucuuga

SEQ ID NO: 2180043 - RNA, 12 nt, Human
uuaaguuacuuc

SEQ ID NO: 2180044 - RNA, 22 nt, Human
uuaaguucuggaugcauuucuc

SEQ ID NO: 2180045 - RNA, 13 nt, Human
uuaauaaacacuc

SEQ ID NO: 2180046 - RNA, 21 nt, Human
ugggagacaagaaaucccugu

SEQ ID NO: 2180047 - RNA, 19 nt, Human
ugggagacacccaaagggu

SEQ ID NO: 2180048 - RNA, 14 nt, Human
ugggagacauguga

SEQ ID NO: 2180049 - RNA, 15 nt, Human
ugggagacaugugac

SEQ ID NO: 2180050 - RNA, 18 nt, Human
ugggagaccuguaaucau

SEQ ID NO: 2180051 - RNA, 22 nt, Human
ugggagacaagaaaucccuguu

SEQ ID NO: 2180052 - RNA, 16 nt, Human
ugggagacaugugaca

SEQ ID NO: 2180053 - RNA, 19 nt, Human
ugggagagaagagaaugca

SEQ ID NO: 2180054 - RNA, 21 nt, Human
ugggagagaagagaaugcaca

SEQ ID NO: 2180055 - RNA, 18 nt, Human
ugggaggaucucuugagc

SEQ ID NO: 2180056 - RNA, 16 nt, Human
ugggagagccuuccag

SEQ ID NO: 2180057 - RNA, 18 nt, Human
ugggagagcccagccauu

SEQ ID NO: 2180058 - RNA, 14 nt, Human
ugggagagcccagc

SEQ ID NO: 2180059 - RNA, 21 nt, Human
ugggagagagacguguacaua

SEQ ID NO: 2180060 - RNA, 18 nt, Human
ugggagacugcugaguca

SEQ ID NO: 2180061 - RNA, 22 nt, Human
ugggagaauucuuacauguuuu

SEQ ID NO: 2180062 - RNA, 21 nt, Human
ugggagaauucuuacauguuu

SEQ ID NO: 2180063 - RNA, 22 nt, Human
ugggagaaugucaguaugugga

SEQ ID NO: 2180064 - RNA, 20 nt, Human
ugggagaaugucaguaugug

SEQ ID NO: 2180065 - RNA, 19 nt, Human
ugggagaaugucaguaugu

SEQ ID NO: 2180066 - RNA, 23 nt, Human
ugggagaaccucaggcuuccuug

SEQ ID NO: 2180067 - RNA, 22 nt, Human
ugggagaaccucaggcuuccuu

SEQ ID NO: 2180068 - RNA, 15 nt, Human
ugggagaaccucagg

SEQ ID NO: 2180069 - RNA, 14 nt, Human
ugggagaaccucag

SEQ ID NO: 2180070 - RNA, 22 nt, Human
ugggagaaccaaaaagaggcua

SEQ ID NO: 2180071 - RNA, 23 nt, Human
ugggacuggccagguuucugccc

SEQ ID NO: 2180072 - RNA, 18 nt, Human
ugggacugcugcuucuua

SEQ ID NO: 2180073 - RNA, 20 nt, Human
ugggacugagccagucccag

SEQ ID NO: 2180074 - RNA, 17 nt, Human
ugggacugcuaaauaaa

SEQ ID NO: 2180075 - RNA, 18 nt, Human
ugggacugcuaaauaaaa

SEQ ID NO: 2180076 - RNA, 14 nt, Human
ugggacugagccag

SEQ ID NO: 2180077 - RNA, 15 nt, Human
ugggacugagccagu

SEQ ID NO: 2180078 - RNA, 16 nt, Human
ugggacugagccaguc

SEQ ID NO: 2180079 - RNA, 17 nt, Human
ugggacucagccuucag

SEQ ID NO: 2180080 - RNA, 23 nt, Human
ugggacucagccuucagacagag

SEQ ID NO: 2180081 - RNA, 23 nt, Human
agggaggaggccaccucuccaag

SEQ ID NO: 2180082 - RNA, 21 nt, Human
ugggacguggcucagccagca

SEQ ID NO: 2180083 - RNA, 13 nt, Human
ugggacucagccu

SEQ ID NO: 2180084 - RNA, 20 nt, Human
ugggacucaaugcacugaca

SEQ ID NO: 2180085 - RNA, 19 nt, Human
agggagcaaguccuucccu

SEQ ID NO: 2180086 - RNA, 21 nt, Human
agggagcaaguccuucccuuu

SEQ ID NO: 2180087 - RNA, 19 nt, Human
agggagagucauauuuuga

SEQ ID NO: 2180088 - RNA, 13 nt, Human
agggagagggagg

SEQ ID NO: 2180089 - RNA, 14 nt, Human
agggagagggaggu

SEQ ID NO: 2180090 - RNA, 16 nt, Human
agggagagguggagca

SEQ ID NO: 2180091 - RNA, 17 nt, Human
agggagcagacaggagg

SEQ ID NO: 2180092 - RNA, 14 nt, Human
agggagcagacagg

SEQ ID NO: 2180093 - RNA, 13 nt, Human
agggagcacuggg

SEQ ID NO: 2180094 - RNA, 13 nt, Human
agggagcugggac

SEQ ID NO: 2180095 - RNA, 15 nt, Human
agggaggaagaagcu

SEQ ID NO: 2180096 - RNA, 21 nt, Human
agggaggaagaagcuuaggca

SEQ ID NO: 2180097 - RNA, 23 nt, Human
agggaggaagaagcuuaggcagg

SEQ ID NO: 2180098 - RNA, 20 nt, Human
agggacagagacaccugcac

SEQ ID NO: 2180099 - RNA, 19 nt, Human
agggacagagacaccugca

SEQ ID NO: 2180100 - RNA, 18 nt, Human
agggacagagacaccugc

SEQ ID NO: 2180101 - RNA, 10 nt, Human
agggacagag

SEQ ID NO: 2180102 - RNA, 19 nt, Human
agggacaaguggacucagg

SEQ ID NO: 2180103 - RNA, 14 nt, Human
agggacaccagcca

SEQ ID NO: 2180104 - RNA, 15 nt, Human
agggacaccagccag

SEQ ID NO: 2180105 - RNA, 16 nt, Human
agggacaccagccagg

SEQ ID NO: 2180106 - RNA, 18 nt, Human
agggacaccagccaggcu

SEQ ID NO: 2180107 - RNA, 20 nt, Human
agggacaccagccaggcucu

SEQ ID NO: 2180108 - RNA, 21 nt, Human
agggacaccagccaggcucug

SEQ ID NO: 2180109 - RNA, 16 nt, Human
agggagagcggggcag

SEQ ID NO: 2180110 - RNA, 13 nt, Human
agggagaggagug

SEQ ID NO: 2180111 - RNA, 17 nt, Human
agggagaggagugacug

SEQ ID NO: 2180112 - RNA, 14 nt, Human
agggagagcggggc

SEQ ID NO: 2180113 - RNA, 15 nt, Human
agggagagccagcuc

SEQ ID NO: 2180114 - RNA, 23 nt, Human
agggagagagagagagagaggac

SEQ ID NO: 2180115 - RNA, 16 nt, Human
agggacagaggcccca

SEQ ID NO: 2180116 - RNA, 14 nt, Human
agggacagagccau

SEQ ID NO: 2180117 - RNA, 22 nt, Human
agggagagagagagagagagga

SEQ ID NO: 2180118 - RNA, 23 nt, Human
agggaggaaucgaggaaccagag

SEQ ID NO: 2180119 - RNA, 22 nt, Human
agggaggaaucgaggaaccaga

SEQ ID NO: 2180120 - RNA, 21 nt, Human
agggaggaaucgaggaaccag

SEQ ID NO: 2180121 - RNA, 15 nt, Human
agggaggaggccacc

SEQ ID NO: 2180122 - RNA, 22 nt, Human
agggaggaccagggcagggcca

SEQ ID NO: 2180123 - RNA, 23 nt, Human
agggaggacgcucucuggccuuc

SEQ ID NO: 2180124 - RNA, 22 nt, Human
agggaggacgcucucuggccuu

SEQ ID NO: 2180125 - RNA, 21 nt, Human
agggaggacgcucucuggccu

SEQ ID NO: 2180126 - RNA, 14 nt, Human
ugggacuacaggca

SEQ ID NO: 2180127 - RNA, 20 nt, Human
ugggacguggcucagccagc

SEQ ID NO: 2180128 - RNA, 20 nt, Human
agggaggaggccaccucucc

SEQ ID NO: 2180129 - RNA, 21 nt, Human
agggaggaggccaccucucca

SEQ ID NO: 2180130 - RNA, 16 nt, Human
agggaggaggccaccu

SEQ ID NO: 2180131 - RNA, 17 nt, Human
agggaggaggccaccuc

SEQ ID NO: 2180132 - RNA, 19 nt, Human
agggaggaggccaccucuc

SEQ ID NO: 2180133 - RNA, 15 nt, Human
ugggacuacaggcac

SEQ ID NO: 2180134 - RNA, 16 nt, Human
ugggacuacaggcacc

SEQ ID NO: 2180135 - RNA, 15 nt, Human
agggaauggcacagc

SEQ ID NO: 2180136 - RNA, 15 nt, Human
agggaauuucaggaa

SEQ ID NO: 2180137 - RNA, 21 nt, Human
agggaauuucuucaacucccu

SEQ ID NO: 2180138 - RNA, 16 nt, Human
agggaauugcagagua

SEQ ID NO: 2180139 - RNA, 18 nt, Human
agggaauugaggucugcu

SEQ ID NO: 2180140 - RNA, 22 nt, Human
agggacaaguggacucagggca

SEQ ID NO: 2180141 - RNA, 13 nt, Human
agggaaguuuugu

SEQ ID NO: 2180142 - RNA, 15 nt, Human
agggaaguccccagg

SEQ ID NO: 2180143 - RNA, 22 nt, Human
agggaaguaacaguaacgcagg

SEQ ID NO: 2180144 - RNA, 21 nt, Human
agggaaugaaggugucagaau

SEQ ID NO: 2180145 - RNA, 18 nt, Human
agggaaugaaccuggagg

SEQ ID NO: 2180146 - RNA, 23 nt, Human
agggaaugagacaggaccuagga

SEQ ID NO: 2180147 - RNA, 13 nt, Human
agggaaugccuga

SEQ ID NO: 2180148 - RNA, 14 nt, Human
agggaaugccugag

SEQ ID NO: 2180149 - RNA, 18 nt, Human
agggaaugccugagugcc

SEQ ID NO: 2180150 - RNA, 21 nt, Human
agggaaugccugagugccugg

SEQ ID NO: 2180151 - RNA, 22 nt, Human
agggaaugccugagugccuggc

SEQ ID NO: 2180152 - RNA, 16 nt, Human
agggaauccccgaagg

SEQ ID NO: 2180153 - RNA, 18 nt, Human
agggaauccccgaaggug

SEQ ID NO: 2180154 - RNA, 20 nt, Human
agggaauccccgaaggugcu

SEQ ID NO: 2180155 - RNA, 23 nt, Human
agggaauccccgaaggugcugga

SEQ ID NO: 2180156 - RNA, 16 nt, Human
agggaaggccccacag

SEQ ID NO: 2180157 - RNA, 18 nt, Human
agggaaggaacucuggcu

SEQ ID NO: 2180158 - RNA, 22 nt, Human
agggaaggauacaaaagcaugu

SEQ ID NO: 2180159 - RNA, 20 nt, Human
agggaaggggaggcagccgg

SEQ ID NO: 2180160 - RNA, 18 nt, Human
agggaagggccugccaca

SEQ ID NO: 2180161 - RNA, 21 nt, Human
agggaaggggaggcagccggc

SEQ ID NO: 2180162 - RNA, 12 nt, Human
agggaagggugg

SEQ ID NO: 2180163 - RNA, 16 nt, Human
agggaaguaacaguaa

SEQ ID NO: 2180164 - RNA, 22 nt, Human
agggaaggggacaaggacuagg

SEQ ID NO: 2180165 - RNA, 13 nt, Human
agggaaggggaca

SEQ ID NO: 2180166 - RNA, 16 nt, Human
agggaagggccugcca

SEQ ID NO: 2180167 - RNA, 14 nt, Human
agggaagggccugc

SEQ ID NO: 2180168 - RNA, 13 nt, Human
agggaagggccug

SEQ ID NO: 2180169 - RNA, 15 nt, Human
aggcccguccggcag

SEQ ID NO: 2180170 - RNA, 14 nt, Human
aggcccggggcugg

SEQ ID NO: 2180171 - RNA, 13 nt, Human
aggcccggggcug

SEQ ID NO: 2180172 - RNA, 20 nt, Human
aggcccgcucuacaucuucu

SEQ ID NO: 2180173 - RNA, 21 nt, Human
aggcccggcuccaggcuccuu

SEQ ID NO: 2180174 - RNA, 18 nt, Human
aggcccggcuccaggcuc

SEQ ID NO: 2180175 - RNA, 20 nt, Human
aggcccggcuccaggcuccu

SEQ ID NO: 2180176 - RNA, 15 nt, Human
aggcccggggcuggc

SEQ ID NO: 2180177 - RNA, 22 nt, Human
aggcccuaucuguuuacagugu

SEQ ID NO: 2180178 - RNA, 20 nt, Human
aggcccucccuguuccccag

SEQ ID NO: 2180179 - RNA, 13 nt, Human
agggaaauuucag

SEQ ID NO: 2180180 - RNA, 23 nt, Human
aggcccucccuguuccccagaga

SEQ ID NO: 2180181 - RNA, 22 nt, Human
aggcccucccuguuccccagag

SEQ ID NO: 2180182 - RNA, 19 nt, Human
agggaacgggguccuucaa

SEQ ID NO: 2180183 - RNA, 14 nt, Human
agggaaccuguguc

SEQ ID NO: 2180184 - RNA, 22 nt, Human
agggaaccguuauuauaauugu

SEQ ID NO: 2180185 - RNA, 19 nt, Human
agggaaccguuauuauaau

SEQ ID NO: 2180186 - RNA, 16 nt, Human
agggaagaaaagagcu

SEQ ID NO: 2180187 - RNA, 14 nt, Human
agggaacucugggg

SEQ ID NO: 2180188 - RNA, 15 nt, Human
agggaacucuggggu

SEQ ID NO: 2180189 - RNA, 20 nt, Human
agggaacagacaggagaaau

SEQ ID NO: 2180190 - RNA, 19 nt, Human
agggaacagacaggagaaa

SEQ ID NO: 2180191 - RNA, 18 nt, Human
agggaacagacaggagaa

SEQ ID NO: 2180192 - RNA, 17 nt, Human
agggaacagacaggaga

SEQ ID NO: 2180193 - RNA, 21 nt, Human
agggaacagacaggagaaaug

SEQ ID NO: 2180194 - RNA, 14 nt, Human
agggaacagugagg

SEQ ID NO: 2180195 - RNA, 15 nt, Human
agggaacagacagga

SEQ ID NO: 2180196 - RNA, 14 nt, Human
agggaacagacagg

SEQ ID NO: 2180197 - RNA, 13 nt, Human
agggaacagacag

SEQ ID NO: 2180198 - RNA, 15 nt, Human
agggaagagaaagug

SEQ ID NO: 2180199 - RNA, 12 nt, Human
agggaagagcag

SEQ ID NO: 2180200 - RNA, 14 nt, Human
agggaagagugcau

SEQ ID NO: 2180201 - RNA, 16 nt, Human
agggaagccugaaaaa

SEQ ID NO: 2180202 - RNA, 13 nt, Human
agggaagcuggcc

SEQ ID NO: 2180203 - RNA, 16 nt, Human
agggaagcuacagguu

SEQ ID NO: 2180204 - RNA, 19 nt, Human
agggaagcuacagguuaca

SEQ ID NO: 2180205 - RNA, 19 nt, Human
agggaagcacugccucccu

SEQ ID NO: 2180206 - RNA, 13 nt, Human
agggaagcuacag

SEQ ID NO: 2180207 - RNA, 16 nt, Human
agggaagcuggccgag

SEQ ID NO: 2180208 - RNA, 21 nt, Human
agggaagcuacagguuacaac

SEQ ID NO: 2180209 - RNA, 23 nt, Human
agggaaggaacucuggcuuccag

SEQ ID NO: 2180210 - RNA, 17 nt, Human
agggcagcgccaggcug

SEQ ID NO: 2180211 - RNA, 16 nt, Human
agggcacugguggccc

SEQ ID NO: 2180212 - RNA, 14 nt, Human
agggcagcugggcc

SEQ ID NO: 2180213 - RNA, 15 nt, Human
agggcagcugggccc

SEQ ID NO: 2180214 - RNA, 16 nt, Human
agggcagcugggccca

SEQ ID NO: 2180215 - RNA, 17 nt, Human
agggcagcugggcccaa

SEQ ID NO: 2180216 - RNA, 18 nt, Human
agggcagcugggcccaac

SEQ ID NO: 2180217 - RNA, 20 nt, Human
agggcagcugggcccaaccc

SEQ ID NO: 2180218 - RNA, 11 nt, Human
agggcagcuug

SEQ ID NO: 2180219 - RNA, 16 nt, Human
agggcacugcugcugc

SEQ ID NO: 2180220 - RNA, 21 nt, Human
agggcacccuaguucuaccuc

SEQ ID NO: 2180221 - RNA, 19 nt, Human
agggcaccagggguuucuc

SEQ ID NO: 2180222 - RNA, 21 nt, Human
agggcaccagggguuucucgc

SEQ ID NO: 2180223 - RNA, 14 nt, Human
agggcacugguggc

SEQ ID NO: 2180224 - RNA, 21 nt, Human
agggcacauuccuugccugca

SEQ ID NO: 2180225 - RNA, 13 nt, Human
agggcacuggagc

SEQ ID NO: 2180226 - RNA, 15 nt, Human
agggcacuggagcug

SEQ ID NO: 2180227 - RNA, 14 nt, Human
agggcaccaggggu

SEQ ID NO: 2180228 - RNA, 19 nt, Human
agggcacauuccuugccug

SEQ ID NO: 2180229 - RNA, 20 nt, Human
agggcacauuccuugccugc

SEQ ID NO: 2180230 - RNA, 16 nt, Human
agggagggcuccagac

SEQ ID NO: 2180231 - RNA, 14 nt, Human
agggagggcuccag

SEQ ID NO: 2180232 - RNA, 15 nt, Human
agggagggcuccaga

SEQ ID NO: 2180233 - RNA, 16 nt, Human
agggcaucuccugugc

SEQ ID NO: 2180234 - RNA, 14 nt, Human
agggcaucuccugu

SEQ ID NO: 2180235 - RNA, 13 nt, Human
agggcaucuccug

SEQ ID NO: 2180236 - RNA, 11 nt, Human
agggcaggcau

SEQ ID NO: 2180237 - RNA, 23 nt, Human
agggcaucuccugugcaugggug

SEQ ID NO: 2180238 - RNA, 21 nt, Human
agggcaucuccugugcauggg

SEQ ID NO: 2180239 - RNA, 12 nt, Human
agggcaucuccu

SEQ ID NO: 2180240 - RNA, 18 nt, Human
agggcaggaaggagagcc

SEQ ID NO: 2180241 - RNA, 16 nt, Human
agggcaggaaggagag

SEQ ID NO: 2180242 - RNA, 13 nt, Human
agggcagcuugcc

SEQ ID NO: 2180243 - RNA, 17 nt, Human
agggcagcuugccccgg

SEQ ID NO: 2180244 - RNA, 18 nt, Human
agggcagcuugccccggc

SEQ ID NO: 2180245 - RNA, 23 nt, Human
agggcagcuugccccggccccgg

SEQ ID NO: 2180246 - RNA, 21 nt, Human
agggcaggaaggagagccugc

SEQ ID NO: 2180247 - RNA, 19 nt, Human
agggcaggaaggagagccu

SEQ ID NO: 2180248 - RNA, 23 nt, Human
agggcaggaaggagagccugcug

SEQ ID NO: 2180249 - RNA, 21 nt, Human
agggcaugcgcacaaggcuga

SEQ ID NO: 2180250 - RNA, 17 nt, Human
agggcaugcgcacaagg

SEQ ID NO: 2180251 - RNA, 23 nt, Human
agggcaugccccggccaccucug

SEQ ID NO: 2180252 - RNA, 20 nt, Human
agggccacaugggaggcuca

SEQ ID NO: 2180253 - RNA, 16 nt, Human
agggccacgugccagg

SEQ ID NO: 2180254 - RNA, 15 nt, Human
agggccacgugccag

SEQ ID NO: 2180255 - RNA, 21 nt, Human
agggccacaugggaggcucac

SEQ ID NO: 2180256 - RNA, 18 nt, Human
agggcaugcauuuugcag

SEQ ID NO: 2180257 - RNA, 22 nt, Human
agggcaugccacgugggcucau

SEQ ID NO: 2180258 - RNA, 15 nt, Human
agggcaugccccggc

SEQ ID NO: 2180259 - RNA, 20 nt, Human
agggcaugccccggccaccu

SEQ ID NO: 2180260 - RNA, 21 nt, Human
agggcaugccccggccaccuc

SEQ ID NO: 2180261 - RNA, 22 nt, Human
agggcaugccccggccaccucu

SEQ ID NO: 2180262 - RNA, 22 nt, Human
agggcaucuugguccaggaaau

SEQ ID NO: 2180263 - RNA, 17 nt, Human
agggcaucuuagcuucu

SEQ ID NO: 2180264 - RNA, 14 nt, Human
agggccacugaaga

SEQ ID NO: 2180265 - RNA, 18 nt, Human
agggccacucugccucug

SEQ ID NO: 2180266 - RNA, 15 nt, Human
agggccacucugccu

SEQ ID NO: 2180267 - RNA, 14 nt, Human
agggccacucugcc

SEQ ID NO: 2180268 - RNA, 20 nt, Human
agggccacgugccaggcccg

SEQ ID NO: 2180269 - RNA, 19 nt, Human
agggccacgugccaggccc

SEQ ID NO: 2180270 - RNA, 18 nt, Human
agggccacgugccaggcc

SEQ ID NO: 2180271 - RNA, 14 nt, Human
agggccagagccag

SEQ ID NO: 2180272 - RNA, 13 nt, Human
agggccagagcca

SEQ ID NO: 2180273 - RNA, 12 nt, Human
agggccagagcc

SEQ ID NO: 2180274 - RNA, 11 nt, Human
agggccagagc

SEQ ID NO: 2180275 - RNA, 23 nt, Human
agggccaguccugccuggccagg

SEQ ID NO: 2180276 - RNA, 22 nt, Human
agggccaguccugccuggccag

SEQ ID NO: 2180277 - RNA, 15 nt, Human
agggccagucugggc

SEQ ID NO: 2180278 - RNA, 21 nt, Human
agggccaguccugccuggcca

SEQ ID NO: 2180279 - RNA, 19 nt, Human
agggccaguccugccuggc

SEQ ID NO: 2180280 - RNA, 16 nt, Human
agggccagagccaggg

SEQ ID NO: 2180281 - RNA, 15 nt, Human
agggccagagccagg

SEQ ID NO: 2180282 - RNA, 17 nt, Human
agggccaugccugcccc

SEQ ID NO: 2180283 - RNA, 18 nt, Human
agggccaugcugaaggga

SEQ ID NO: 2180284 - RNA, 19 nt, Human
agggccaugcugaggccug

SEQ ID NO: 2180285 - RNA, 20 nt, Human
agggccaugcugaggccugg

SEQ ID NO: 2180286 - RNA, 21 nt, Human
agggccaugcugaggccuggg

SEQ ID NO: 2180287 - RNA, 22 nt, Human
agggccaugcugaggccugggc

SEQ ID NO: 2180288 - RNA, 23 nt, Human
agggccaugcugaggccugggcc

SEQ ID NO: 2180289 - RNA, 19 nt, Human
agggcccaagucccuguuu

SEQ ID NO: 2180290 - RNA, 22 nt, Human
agggcccaagucccuguuuucu

SEQ ID NO: 2180291 - RNA, 19 nt, Human
agggccaugcugaagggac

SEQ ID NO: 2180292 - RNA, 16 nt, Human
agggcccaagucccug

SEQ ID NO: 2180293 - RNA, 17 nt, Human
agggcccaagucccugu

SEQ ID NO: 2180294 - RNA, 11 nt, Human
agggcccagag

SEQ ID NO: 2180295 - RNA, 13 nt, Human
agggccccucugc

SEQ ID NO: 2180296 - RNA, 14 nt, Human
agggccccucugcc

SEQ ID NO: 2180297 - RNA, 15 nt, Human
agggccccucugccc

SEQ ID NO: 2180298 - RNA, 16 nt, Human
agggccccucugccca

SEQ ID NO: 2180299 - RNA, 17 nt, Human
agggccccucugcccag

SEQ ID NO: 2180300 - RNA, 18 nt, Human
agggccccucugcccagc

SEQ ID NO: 2180301 - RNA, 19 nt, Human
agggccccucugcccagcu

SEQ ID NO: 2180302 - RNA, 20 nt, Human
agggccccucugcccagcuu

SEQ ID NO: 2180303 - RNA, 19 nt, Human
agggcucagcggggacagc

SEQ ID NO: 2180304 - RNA, 20 nt, Human
agggcucagcggggacagcu

SEQ ID NO: 2180305 - RNA, 22 nt, Human
agggcucagcggggacagcucc

SEQ ID NO: 2180306 - RNA, 23 nt, Human
agggcucagcggggacagcuccu

SEQ ID NO: 2180307 - RNA, 13 nt, Human
agggcucagccug

SEQ ID NO: 2180308 - RNA, 12 nt, Human
agggcucagccu

SEQ ID NO: 2180309 - RNA, 13 nt, Human
agggcccuggugu

SEQ ID NO: 2180310 - RNA, 24 nt, Human
agggcccugguguuucuagcacug

SEQ ID NO: 2180311 - RNA, 15 nt, Human
agggcccuucacugc

SEQ ID NO: 2180312 - RNA, 13 nt, Human
agggcccugcaga

SEQ ID NO: 2180313 - RNA, 12 nt, Human
agggcccugcag

SEQ ID NO: 2180314 - RNA, 18 nt, Human
agggcccugagcugaggg

SEQ ID NO: 2180315 - RNA, 19 nt, Human
agggcccugagcugagggc

SEQ ID NO: 2180316 - RNA, 13 nt, Human
agggcccuaccug

SEQ ID NO: 2180317 - RNA, 21 nt, Human
agggccccucugcccagcuug

SEQ ID NO: 2180318 - RNA, 23 nt, Human
agggccccucugcccagcuuggg

SEQ ID NO: 2180319 - RNA, 16 nt, Human
agggcccugagcucgg

SEQ ID NO: 2180320 - RNA, 15 nt, Human
agggcccugagcuga

SEQ ID NO: 2180321 - RNA, 19 nt, Human
ugggcacgcugugggcagg

SEQ ID NO: 2180322 - RNA, 21 nt, Human
ugggcacgcugugggcaggug

SEQ ID NO: 2180323 - RNA, 14 nt, Human
ugggcacugcuggg

SEQ ID NO: 2180324 - RNA, 16 nt, Human
ugggcacugcugggug

SEQ ID NO: 2180325 - RNA, 17 nt, Human
ugggcacugcugggugg

SEQ ID NO: 2180326 - RNA, 20 nt, Human
ugggcaccuggggaguggga

SEQ ID NO: 2180327 - RNA, 19 nt, Human
ugggcaccuggggaguggg

SEQ ID NO: 2180328 - RNA, 17 nt, Human
ugggcaccuggggagug

SEQ ID NO: 2180329 - RNA, 18 nt, Human
ugggaggccccacugggg

SEQ ID NO: 2180330 - RNA, 15 nt, Human
ugggcaccuggggag

SEQ ID NO: 2180331 - RNA, 20 nt, Human
ugggaggccccacuggggaa

SEQ ID NO: 2180332 - RNA, 16 nt, Human
ugggaggccccacugg

SEQ ID NO: 2180333 - RNA, 14 nt, Human
ugggaggccaagga

SEQ ID NO: 2180334 - RNA, 23 nt, Human
ugggaggcaagagggguggagac

SEQ ID NO: 2180335 - RNA, 18 nt, Human
ugggaggcauggcccugg

SEQ ID NO: 2180336 - RNA, 16 nt, Human
ugggaggcauggcccu

SEQ ID NO: 2180337 - RNA, 18 nt, Human
ugggaggcaagaggggug

SEQ ID NO: 2180338 - RNA, 19 nt, Human
ugggaggcaagaggggugg

SEQ ID NO: 2180339 - RNA, 20 nt, Human
ugggaggccaaggugggagg

SEQ ID NO: 2180340 - RNA, 19 nt, Human
ugggaggccaaggugggag

SEQ ID NO: 2180341 - RNA, 22 nt, Human
ugggaggaucucuugagccugg

SEQ ID NO: 2180342 - RNA, 21 nt, Human
ugggaggaucucuugagccug

SEQ ID NO: 2180343 - RNA, 20 nt, Human
ugggaggaucucuugagccu

SEQ ID NO: 2180344 - RNA, 15 nt, Human
ugggcagaaggccaa

SEQ ID NO: 2180345 - RNA, 23 nt, Human
ugggcacugcuggguggcccauc

SEQ ID NO: 2180346 - RNA, 15 nt, Human
ugggcacugggauga

SEQ ID NO: 2180347 - RNA, 16 nt, Human
ugggcacugggaugag

SEQ ID NO: 2180348 - RNA, 15 nt, Human
ugggcacuuuuuaau

SEQ ID NO: 2180349 - RNA, 16 nt, Human
ugggcagaaggccaag

SEQ ID NO: 2180350 - RNA, 17 nt, Human
ugggcagaaggccaaga

SEQ ID NO: 2180351 - RNA, 18 nt, Human
ugggcagaaggccaagag

SEQ ID NO: 2180352 - RNA, 15 nt, Human
ugggcagaagggaga

SEQ ID NO: 2180353 - RNA, 17 nt, Human
ugggcagaagggagaag

SEQ ID NO: 2180354 - RNA, 21 nt, Human
ugggcacugcuggguggccca

SEQ ID NO: 2180355 - RNA, 22 nt, Human
ugggcacugcuggguggcccau

SEQ ID NO: 2180356 - RNA, 22 nt, Human
ugggcacugggaugagccgcug

SEQ ID NO: 2180357 - RNA, 12 nt, Human
ugggcagaagga

SEQ ID NO: 2180358 - RNA, 11 nt, Human
ugggcagagca

SEQ ID NO: 2180359 - RNA, 12 nt, Human
ugggcagagcag

SEQ ID NO: 2180360 - RNA, 18 nt, Human
ugggccaggagccuccug

SEQ ID NO: 2180361 - RNA, 13 nt, Human
ugggcagagcaga

SEQ ID NO: 2180362 - RNA, 15 nt, Human
ugggccccucuccca

SEQ ID NO: 2180363 - RNA, 19 nt, Human
ugggccccucaucugcuca

SEQ ID NO: 2180364 - RNA, 23 nt, Human
ugggccccucaucugcucagcag

SEQ ID NO: 2180365 - RNA, 21 nt, Human
ugggcccccaaauggaaaugg

SEQ ID NO: 2180366 - RNA, 22 nt, Human
ugggccccaguuguauuuauuu

SEQ ID NO: 2180367 - RNA, 15 nt, Human
ugggccccagccuuc

SEQ ID NO: 2180368 - RNA, 16 nt, Human
ugggcccccaaaugga

SEQ ID NO: 2180369 - RNA, 14 nt, Human
ugggccaguguggg

SEQ ID NO: 2180370 - RNA, 15 nt, Human
ugggccauacuggcc

SEQ ID NO: 2180371 - RNA, 20 nt, Human
ugggccagucuguggaucag

SEQ ID NO: 2180372 - RNA, 16 nt, Human
ugggccagucugugga

SEQ ID NO: 2180373 - RNA, 18 nt, Human
ugggcagaagggagaagg

SEQ ID NO: 2180374 - RNA, 19 nt, Human
ugggcagaagggagaagga

SEQ ID NO: 2180375 - RNA, 24 nt, Human
ugggccauacuggccucgccuggc

SEQ ID NO: 2180376 - RNA, 18 nt, Human
ugggccauagcuccugcu

SEQ ID NO: 2180377 - RNA, 16 nt, Human
ugggccauacuggccu

SEQ ID NO: 2180378 - RNA, 17 nt, Human
ugggccauacuggccuc

SEQ ID NO: 2180379 - RNA, 18 nt, Human
ugggccauacuggccucg

SEQ ID NO: 2180380 - RNA, 20 nt, Human
ugggccauacuggccucgcc

SEQ ID NO: 2180381 - RNA, 18 nt, Human
ugggccccaguuguauuu

SEQ ID NO: 2180382 - RNA, 17 nt, Human
ugggccccagcccaccc

SEQ ID NO: 2180383 - RNA, 18 nt, Human
ugggccccagcccacccu

SEQ ID NO: 2180384 - RNA, 20 nt, Human
ugggccccagcccacccucc

SEQ ID NO: 2180385 - RNA, 22 nt, Human
ugggccccagcccacccuccug

SEQ ID NO: 2180386 - RNA, 18 nt, Human
ugggaggccuaggcgggc

SEQ ID NO: 2180387 - RNA, 14 nt, Human
agggaggcaagccc

SEQ ID NO: 2180388 - RNA, 13 nt, Human
agggaggcaagcc

SEQ ID NO: 2180389 - RNA, 16 nt, Human
agggaggcaagcccug

SEQ ID NO: 2180390 - RNA, 15 nt, Human
ugggccccugccaga

SEQ ID NO: 2180391 - RNA, 15 nt, Human
ugggccccugccucu

SEQ ID NO: 2180392 - RNA, 19 nt, Human
ugggccccugccucucugc

SEQ ID NO: 2180393 - RNA, 15 nt, Human
agggagggagggcuc

SEQ ID NO: 2180394 - RNA, 13 nt, Human
agggagggcucca

SEQ ID NO: 2180395 - RNA, 15 nt, Human
agggaggcaagcccu

SEQ ID NO: 2180396 - RNA, 18 nt, Human
agggagggacauggcccc

SEQ ID NO: 2180397 - RNA, 14 nt, Human
ugggguccagggag

SEQ ID NO: 2180398 - RNA, 20 nt, Human
uggggucaugcccuccucuc

SEQ ID NO: 2180399 - RNA, 18 nt, Human
uggggucaugcccuccuc

SEQ ID NO: 2180400 - RNA, 13 nt, Human
uggggucaugccc

SEQ ID NO: 2180401 - RNA, 12 nt, Human
ugggguccuggc

SEQ ID NO: 2180402 - RNA, 13 nt, Human
uggggucccucua

SEQ ID NO: 2180403 - RNA, 20 nt, Human
ugggguccuggagcagacca

SEQ ID NO: 2180404 - RNA, 13 nt, Human
ugggguccccauc

SEQ ID NO: 2180405 - RNA, 22 nt, Human
uggggucucccucuccugccua

SEQ ID NO: 2180406 - RNA, 21 nt, Human
uggggucucccucuccugccu

SEQ ID NO: 2180407 - RNA, 19 nt, Human
uggggucucccucuccugc

SEQ ID NO: 2180408 - RNA, 13 nt, Human
uggggucucccuc

SEQ ID NO: 2180409 - RNA, 23 nt, Human
uggggucucacaguguugcccag

SEQ ID NO: 2180410 - RNA, 21 nt, Human
uggggucucacaguguugccc

SEQ ID NO: 2180411 - RNA, 16 nt, Human
ugggguccuggggccu

SEQ ID NO: 2180412 - RNA, 16 nt, Human
ugggguccuggccauc

SEQ ID NO: 2180413 - RNA, 15 nt, Human
ugggguccuggccau

SEQ ID NO: 2180414 - RNA, 19 nt, Human
ugggguccuggccauccca

SEQ ID NO: 2180415 - RNA, 16 nt, Human
uggggcugggcagcua

SEQ ID NO: 2180416 - RNA, 20 nt, Human
ugggguauuuaccacagcag

SEQ ID NO: 2180417 - RNA, 24 nt, Human
ugggguauuuaccacagcagcuga

SEQ ID NO: 2180418 - RNA, 21 nt, Human
ugggguauuuggggcuuauuu

SEQ ID NO: 2180419 - RNA, 16 nt, Human
uggggucacucuggca

SEQ ID NO: 2180420 - RNA, 21 nt, Human
uggggucagccagggccaggg

SEQ ID NO: 2180421 - RNA, 18 nt, Human
uggggucagccagggcca

SEQ ID NO: 2180422 - RNA, 19 nt, Human
uggggucagccagggccag

SEQ ID NO: 2180423 - RNA, 17 nt, Human
uggggucagagacugcu

SEQ ID NO: 2180424 - RNA, 13 nt, Human
uggggucagccag

SEQ ID NO: 2180425 - RNA, 14 nt, Human
uggggucagccagg

SEQ ID NO: 2180426 - RNA, 15 nt, Human
uggggucagccaggg

SEQ ID NO: 2180427 - RNA, 22 nt, Human
uggggucacucuggcagcucag

SEQ ID NO: 2180428 - RNA, 17 nt, Human
uggggcugcuccuccag

SEQ ID NO: 2180429 - RNA, 16 nt, Human
uggggcugcuccucca

SEQ ID NO: 2180430 - RNA, 15 nt, Human
uggggcugcuccucc

SEQ ID NO: 2180431 - RNA, 14 nt, Human
uggggcugcuccuc

SEQ ID NO: 2180432 - RNA, 21 nt, Human
uggggcugcuccuccagggcc

SEQ ID NO: 2180433 - RNA, 19 nt, Human
uggggcugcuccuccaggg

SEQ ID NO: 2180434 - RNA, 12 nt, Human
uggggcugcugg

SEQ ID NO: 2180435 - RNA, 13 nt, Human
uggggcugcuggc

SEQ ID NO: 2180436 - RNA, 14 nt, Human
uggggcuggccucc

SEQ ID NO: 2180437 - RNA, 14 nt, Human
uggggcuggcacaa

SEQ ID NO: 2180438 - RNA, 17 nt, Human
ugggguacccacugcuc

SEQ ID NO: 2180439 - RNA, 18 nt, Human
ugggguacccacugcucu

SEQ ID NO: 2180440 - RNA, 19 nt, Human
ugggguacccacugcucug

SEQ ID NO: 2180441 - RNA, 13 nt, Human
uggggucacucug

SEQ ID NO: 2180442 - RNA, 14 nt, Human
uggggucacucugg

SEQ ID NO: 2180443 - RNA, 19 nt, Human
aggggaauaauagaagaac

SEQ ID NO: 2180444 - RNA, 18 nt, Human
aggggaauaauagaagaa

SEQ ID NO: 2180445 - RNA, 17 nt, Human
aggggaauaauagaaga

SEQ ID NO: 2180446 - RNA, 23 nt, Human
aggggaagggccagucugggcug

SEQ ID NO: 2180447 - RNA, 14 nt, Human
aggggaagggccag

SEQ ID NO: 2180448 - RNA, 13 nt, Human
aggggaauguuug

SEQ ID NO: 2180449 - RNA, 22 nt, Human
aggggaagaguguacugggggu

SEQ ID NO: 2180450 - RNA, 21 nt, Human
aggggaauaaacuguugaguc

SEQ ID NO: 2180451 - RNA, 16 nt, Human
aggggaagaguguacu

SEQ ID NO: 2180452 - RNA, 18 nt, Human
aggggaagaguguacugg

SEQ ID NO: 2180453 - RNA, 22 nt, Human
aggggaaaaucagccugcucca

SEQ ID NO: 2180454 - RNA, 18 nt, Human
aggggaaaaucagccugc

SEQ ID NO: 2180455 - RNA, 14 nt, Human
aggggaacagacug

SEQ ID NO: 2180456 - RNA, 21 nt, Human
aggggaaaccaguguagccuu

SEQ ID NO: 2180457 - RNA, 20 nt, Human
aggggaaaccaguguagccu

SEQ ID NO: 2180458 - RNA, 23 nt, Human
aggggaaaccaguguagccuugc

SEQ ID NO: 2180459 - RNA, 13 nt, Human
aggggaaaaugaa

SEQ ID NO: 2180460 - RNA, 15 nt, Human
uggggugccgccugc

SEQ ID NO: 2180461 - RNA, 17 nt, Human
uggggugccgccugccc

SEQ ID NO: 2180462 - RNA, 13 nt, Human
uggggugcuggga

SEQ ID NO: 2180463 - RNA, 17 nt, Human
uggggugaugcugggcu

SEQ ID NO: 2180464 - RNA, 17 nt, Human
uggggugaggaccacuc

SEQ ID NO: 2180465 - RNA, 14 nt, Human
uggggugaggacca

SEQ ID NO: 2180466 - RNA, 16 nt, Human
uggggucuguaaaauc

SEQ ID NO: 2180467 - RNA, 21 nt, Human
uggggucuggaguugaucugg

SEQ ID NO: 2180468 - RNA, 14 nt, Human
uggggucugacccc

SEQ ID NO: 2180469 - RNA, 17 nt, Human
uggggucuggcagccuc

SEQ ID NO: 2180470 - RNA, 14 nt, Human
uggggucuggcagc

SEQ ID NO: 2180471 - RNA, 18 nt, Human
uggggucuggcagccucc

SEQ ID NO: 2180472 - RNA, 13 nt, Human
uggggucuguaaa

SEQ ID NO: 2180473 - RNA, 15 nt, Human
uggggugggagaggu

SEQ ID NO: 2180474 - RNA, 13 nt, Human
uggggugggagag

SEQ ID NO: 2180475 - RNA, 12 nt, Human
uggggugggccu

SEQ ID NO: 2180476 - RNA, 16 nt, Human
uggggugggccucugg

SEQ ID NO: 2180477 - RNA, 18 nt, Human
uggggugcugggaggagg

SEQ ID NO: 2180478 - RNA, 18 nt, Human
agggcuuuguuuugcaca

SEQ ID NO: 2180479 - RNA, 13 nt, Human
aggggaaaagagg

SEQ ID NO: 2180480 - RNA, 22 nt, Human
uggggaggcggacguuccagcc

SEQ ID NO: 2180481 - RNA, 14 nt, Human
uggggagggauuug

SEQ ID NO: 2180482 - RNA, 23 nt, Human
uggggaggcggacguuccagccg

SEQ ID NO: 2180483 - RNA, 18 nt, Human
uggggagggauucugguu

SEQ ID NO: 2180484 - RNA, 17 nt, Human
uggggagcagagacacu

SEQ ID NO: 2180485 - RNA, 15 nt, Human
uggggagcagagaca

SEQ ID NO: 2180486 - RNA, 16 nt, Human
uggggagccaacagaa

SEQ ID NO: 2180487 - RNA, 22 nt, Human
uggggagccaacagaagcuucc

SEQ ID NO: 2180488 - RNA, 18 nt, Human
uggggagcccgucucagu

SEQ ID NO: 2180489 - RNA, 19 nt, Human
uggggagcccgucucagug

SEQ ID NO: 2180490 - RNA, 21 nt, Human
uggggagcccgucucaguguu

SEQ ID NO: 2180491 - RNA, 21 nt, Human
agggcucugauauuccaugaa

SEQ ID NO: 2180492 - RNA, 15 nt, Human
agggcucuuuagcca

SEQ ID NO: 2180493 - RNA, 17 nt, Human
agggcucugauauucca

SEQ ID NO: 2180494 - RNA, 20 nt, Human
agggcugacacguccacccc

SEQ ID NO: 2180495 - RNA, 14 nt, Human
agggcugaaagcca

SEQ ID NO: 2180496 - RNA, 17 nt, Human
uggggagacugggcuga

SEQ ID NO: 2180497 - RNA, 21 nt, Human
uggggagacugggcugaggga

SEQ ID NO: 2180498 - RNA, 16 nt, Human
uggggaccucaggccu

SEQ ID NO: 2180499 - RNA, 17 nt, Human
uggggaccucaggccug

SEQ ID NO: 2180500 - RNA, 22 nt, Human
agggcucugauauuccaugaau

SEQ ID NO: 2180501 - RNA, 15 nt, Human
agggcucugauauuc

SEQ ID NO: 2180502 - RNA, 14 nt, Human
agggcucugaccag

SEQ ID NO: 2180503 - RNA, 15 nt, Human
agggcucugaccagu

SEQ ID NO: 2180504 - RNA, 19 nt, Human
agggcucucuuuccuucuu

SEQ ID NO: 2180505 - RNA, 21 nt, Human
agggcucucuuuccuucuugc

SEQ ID NO: 2180506 - RNA, 14 nt, Human
uggggaccucaggc

SEQ ID NO: 2180507 - RNA, 15 nt, Human
uggggaccucaggcc

SEQ ID NO: 2180508 - RNA, 15 nt, Human
agggcucuaaaaaaa

SEQ ID NO: 2180509 - RNA, 23 nt, Human
agggcucuaaaaaaagccccaaa

SEQ ID NO: 2180510 - RNA, 24 nt, Human
agggcucaggauuucgugggucug

SEQ ID NO: 2180511 - RNA, 13 nt, Human
agggcucaggauu

SEQ ID NO: 2180512 - RNA, 23 nt, Human
agggcucaggauuucgugggucu

SEQ ID NO: 2180513 - RNA, 15 nt, Human
agggcucagccuggu

SEQ ID NO: 2180514 - RNA, 14 nt, Human
agggcucagccugg

SEQ ID NO: 2180515 - RNA, 15 nt, Human
agggcuccagacaca

SEQ ID NO: 2180516 - RNA, 12 nt, Human
agggcuccagac

SEQ ID NO: 2180517 - RNA, 12 nt, Human
uggggccucugu

SEQ ID NO: 2180518 - RNA, 20 nt, Human
uggggccuaucagugugccc

SEQ ID NO: 2180519 - RNA, 11 nt, Human
uggggccucug

SEQ ID NO: 2180520 - RNA, 20 nt, Human
uggggccuccagaacucacu

SEQ ID NO: 2180521 - RNA, 14 nt, Human
uggggccuccagaa

SEQ ID NO: 2180522 - RNA, 19 nt, Human
uggggccuaucagugugcc

SEQ ID NO: 2180523 - RNA, 22 nt, Human
uggggccuaucagugugccccc

SEQ ID NO: 2180524 - RNA, 22 nt, Human
uggggccccuuuuuacuccccu

SEQ ID NO: 2180525 - RNA, 21 nt, Human
uggggccccuuuuuacucccc

SEQ ID NO: 2180526 - RNA, 23 nt, Human
uggggaggggcgcuggcccagcc

SEQ ID NO: 2180527 - RNA, 12 nt, Human
uggggcccugcc

SEQ ID NO: 2180528 - RNA, 21 nt, Human
uggggccaguuggucccccuu

SEQ ID NO: 2180529 - RNA, 22 nt, Human
uggggagggauuuggggcucag

SEQ ID NO: 2180530 - RNA, 22 nt, Human
uggggagggauucugguuccag

SEQ ID NO: 2180531 - RNA, 17 nt, Human
uggggagggccguaccc

SEQ ID NO: 2180532 - RNA, 21 nt, Human
uggggagggccguaccccacc

SEQ ID NO: 2180533 - RNA, 21 nt, Human
uggggaggggcgcuggcccag

SEQ ID NO: 2180534 - RNA, 22 nt, Human
uggggaggggcgcuggcccagc

SEQ ID NO: 2180535 - RNA, 12 nt, Human
uggggaggggcg

SEQ ID NO: 2180536 - RNA, 15 nt, Human
uggggaggggcgcug

SEQ ID NO: 2180537 - RNA, 19 nt, Human
uggggaggggcgcuggccc

SEQ ID NO: 2180538 - RNA, 20 nt, Human
uggggaggggcgcuggccca

SEQ ID NO: 2180539 - RNA, 14 nt, Human
uggggcucccgccc

SEQ ID NO: 2180540 - RNA, 11 nt, Human
uggggcuccuu

SEQ ID NO: 2180541 - RNA, 21 nt, Human
uggggcuccuuucuccagcca

SEQ ID NO: 2180542 - RNA, 23 nt, Human
uggggcuccuuucuccagccagc

SEQ ID NO: 2180543 - RNA, 13 nt, Human
uggggcucgccau

SEQ ID NO: 2180544 - RNA, 17 nt, Human
uggggcucgccaugccg

SEQ ID NO: 2180545 - RNA, 22 nt, Human
uggggcugcaccggcuggccug

SEQ ID NO: 2180546 - RNA, 23 nt, Human
uggggcugcaccggcuggccugg

SEQ ID NO: 2180547 - RNA, 15 nt, Human
uggggcucagagugg

SEQ ID NO: 2180548 - RNA, 20 nt, Human
uggggcuagggggagccccu

SEQ ID NO: 2180549 - RNA, 17 nt, Human
uggggcucacacaccug

SEQ ID NO: 2180550 - RNA, 19 nt, Human
uggggccugauggggaggg

SEQ ID NO: 2180551 - RNA, 15 nt, Human
uggggccuggaccug

SEQ ID NO: 2180552 - RNA, 16 nt, Human
uggggccuggaccugc

SEQ ID NO: 2180553 - RNA, 17 nt, Human
uggggccuggaccugcc

SEQ ID NO: 2180554 - RNA, 19 nt, Human
uggggccuggaccugccuc

SEQ ID NO: 2180555 - RNA, 20 nt, Human
uggggccuggaccugccucc

SEQ ID NO: 2180556 - RNA, 15 nt, Human
uggggccuggagcag

SEQ ID NO: 2180557 - RNA, 21 nt, Human
ugggugagaugcuggagaaga

SEQ ID NO: 2180558 - RNA, 23 nt, Human
ugggugccccccuugccagacau

SEQ ID NO: 2180559 - RNA, 17 nt, Human
ugggugcccaagcucag

SEQ ID NO: 2180560 - RNA, 18 nt, Human
ugggugcccaagcucaga

SEQ ID NO: 2180561 - RNA, 13 nt, Human
ugggugcgacccc

SEQ ID NO: 2180562 - RNA, 18 nt, Human
uggguccuuuucagaagu

SEQ ID NO: 2180563 - RNA, 15 nt, Human
ugggugaagggagag

SEQ ID NO: 2180564 - RNA, 14 nt, Human
ugggugacagagca

SEQ ID NO: 2180565 - RNA, 17 nt, Human
ugggugacagagcaaga

SEQ ID NO: 2180566 - RNA, 12 nt, Human
ugggugacauuu

SEQ ID NO: 2180567 - RNA, 23 nt, Human
ugggugaccaguugcacuuggcc

SEQ ID NO: 2180568 - RNA, 13 nt, Human
ugggugagaacaa

SEQ ID NO: 2180569 - RNA, 18 nt, Human
ugggugagaugcuggaga

SEQ ID NO: 2180570 - RNA, 19 nt, Human
ugggugagaugcuggagaa

SEQ ID NO: 2180571 - RNA, 17 nt, Human
ugggucccccacgugac

SEQ ID NO: 2180572 - RNA, 18 nt, Human
uggguccucacaucuuuc

SEQ ID NO: 2180573 - RNA, 21 nt, Human
uggguccugggucuuucaugg

SEQ ID NO: 2180574 - RNA, 22 nt, Human
ugggucccacuuccccuccuac

SEQ ID NO: 2180575 - RNA, 17 nt, Human
ugggucccacuuccccu

SEQ ID NO: 2180576 - RNA, 19 nt, Human
ugggucccacuuccccucc

SEQ ID NO: 2180577 - RNA, 20 nt, Human
ugggucccacuuccccuccu

SEQ ID NO: 2180578 - RNA, 16 nt, Human
ugggucgcccuggacu

SEQ ID NO: 2180579 - RNA, 18 nt, Human
ugggucgcccuggacugu

SEQ ID NO: 2180580 - RNA, 17 nt, Human
agggucuucccuaccuc

SEQ ID NO: 2180581 - RNA, 14 nt, Human
agggucuugggaaa

SEQ ID NO: 2180582 - RNA, 15 nt, Human
agggucuucccuacc

SEQ ID NO: 2180583 - RNA, 15 nt, Human
agggucuggagaagc

SEQ ID NO: 2180584 - RNA, 17 nt, Human
agggucugggcaggacu

SEQ ID NO: 2180585 - RNA, 19 nt, Human
agggucuggagaagcagug

SEQ ID NO: 2180586 - RNA, 14 nt, Human
agggucuggagaag

SEQ ID NO: 2180587 - RNA, 13 nt, Human
agggucuggagaa

SEQ ID NO: 2180588 - RNA, 23 nt, Human
agggucugcucuuucucugccag

SEQ ID NO: 2180589 - RNA, 21 nt, Human
agggucugcucuuucucugcc

SEQ ID NO: 2180590 - RNA, 22 nt, Human
agggucugcucuuucucugcca

SEQ ID NO: 2180591 - RNA, 13 nt, Human
agggucugcucuu

SEQ ID NO: 2180592 - RNA, 14 nt, Human
agggucugcucuuu

SEQ ID NO: 2180593 - RNA, 17 nt, Human
agggucugcucuuucuc

SEQ ID NO: 2180594 - RNA, 20 nt, Human
agggucugcucuuucucugc

SEQ ID NO: 2180595 - RNA, 18 nt, Human
agggugggauggaggaga

SEQ ID NO: 2180596 - RNA, 17 nt, Human
agggugggauggaggag

SEQ ID NO: 2180597 - RNA, 15 nt, Human
agggucuugggaaau

SEQ ID NO: 2180598 - RNA, 16 nt, Human
agggucuugggaaaua

SEQ ID NO: 2180599 - RNA, 16 nt, Human
aggguggugaccucug

SEQ ID NO: 2180600 - RNA, 18 nt, Human
uggguccaugggcagagc

SEQ ID NO: 2180601 - RNA, 14 nt, Human
agggugggcuucag

SEQ ID NO: 2180602 - RNA, 21 nt, Human
uggguggcaccagcagccugg

SEQ ID NO: 2180603 - RNA, 19 nt, Human
ugggugcgaccccaucugc

SEQ ID NO: 2180604 - RNA, 20 nt, Human
ugggugcgaccccaucugcc

SEQ ID NO: 2180605 - RNA, 21 nt, Human
ugggugcgaccccaucugccc

SEQ ID NO: 2180606 - RNA, 22 nt, Human
ugggugcgaccccaucugccca

SEQ ID NO: 2180607 - RNA, 20 nt, Human
uggguggcaccagcagccug

SEQ ID NO: 2180608 - RNA, 17 nt, Human
uggguggcaccagcagc

SEQ ID NO: 2180609 - RNA, 21 nt, Human
ugguaaauuaguauuuauuua

SEQ ID NO: 2180610 - RNA, 16 nt, Human
ugguaaauuuccccaa

SEQ ID NO: 2180611 - RNA, 19 nt, Human
ugguaaauuuccccaacag

SEQ ID NO: 2180612 - RNA, 23 nt, Human
ugggugcgaccccaucugcccag

SEQ ID NO: 2180613 - RNA, 21 nt, Human
ugguaacauccuuucuauuga

SEQ ID NO: 2180614 - RNA, 18 nt, Human
ugguaacaguucauguuu

SEQ ID NO: 2180615 - RNA, 21 nt, Human
ugguaacaguucauguuugcu

SEQ ID NO: 2180616 - RNA, 20 nt, Human
ugguaaauuuccccaacagu

SEQ ID NO: 2180617 - RNA, 22 nt, Human
ugguaaauuuccccaacagugu

SEQ ID NO: 2180618 - RNA, 23 nt, Human
ugguaaauuuccccaacagugug

SEQ ID NO: 2180619 - RNA, 17 nt, Human
ugguaacaguucauguu

SEQ ID NO: 2180620 - RNA, 22 nt, Human
ugguaagaagccgggaacagac

SEQ ID NO: 2180621 - RNA, 13 nt, Human
ugguaacuguuaa

SEQ ID NO: 2180622 - RNA, 20 nt, Human
ugguagagugugccugaagu

SEQ ID NO: 2180623 - RNA, 20 nt, Human
ugguagaauuggagaguaaa

SEQ ID NO: 2180624 - RNA, 23 nt, Human
ugguacuuuuaugauguauauuu

SEQ ID NO: 2180625 - RNA, 21 nt, Human
ugguacuuuuaugauguauau

SEQ ID NO: 2180626 - RNA, 22 nt, Human
ugguacuuuuaugauguauauu

SEQ ID NO: 2180627 - RNA, 19 nt, Human
ugguagccaguugaauuua

SEQ ID NO: 2180628 - RNA, 12 nt, Human
ugguagcucagg

SEQ ID NO: 2180629 - RNA, 17 nt, Human
ugguagaccaaaauaaa

SEQ ID NO: 2180630 - RNA, 22 nt, Human
ugguagagaccgagccucuguc

SEQ ID NO: 2180631 - RNA, 13 nt, Human
ugguagagauuca

SEQ ID NO: 2180632 - RNA, 14 nt, Human
ugguaccagauaaa

SEQ ID NO: 2180633 - RNA, 15 nt, Human
ugguaccagauaaaa

SEQ ID NO: 2180634 - RNA, 18 nt, Human
ugguaccagauaaaauua

SEQ ID NO: 2180635 - RNA, 15 nt, Human
ugguaccaggucucc

SEQ ID NO: 2180636 - RNA, 18 nt, Human
ugguaccaggucuccucc

SEQ ID NO: 2180637 - RNA, 13 nt, Human
ugguacccagcca

SEQ ID NO: 2180638 - RNA, 14 nt, Human
ugguacccagccau

SEQ ID NO: 2180639 - RNA, 15 nt, Human
ugguacccuccuggc

SEQ ID NO: 2180640 - RNA, 16 nt, Human
ugguacccuccuggcu

SEQ ID NO: 2180641 - RNA, 21 nt, Human
ugguacccuccuggcucuuga

SEQ ID NO: 2180642 - RNA, 14 nt, Human
ugguacccucugga

SEQ ID NO: 2180643 - RNA, 17 nt, Human
ugguacccagccaucug

SEQ ID NO: 2180644 - RNA, 18 nt, Human
ugguacccagccaucugc

SEQ ID NO: 2180645 - RNA, 19 nt, Human
ugguacccagccaucugcc

SEQ ID NO: 2180646 - RNA, 21 nt, Human
ugguacccagccaucugccca

SEQ ID NO: 2180647 - RNA, 22 nt, Human
ugguacccagccaucugcccag

SEQ ID NO: 2180648 - RNA, 16 nt, Human
ugguacccccuucugg

SEQ ID NO: 2180649 - RNA, 17 nt, Human
ugguacccccuucuggg

SEQ ID NO: 2180650 - RNA, 20 nt, Human
ugguacccccuucugggcau

SEQ ID NO: 2180651 - RNA, 10 nt, Human
agggggccac

SEQ ID NO: 2180652 - RNA, 15 nt, Human
agggggccaccuccc

SEQ ID NO: 2180653 - RNA, 21 nt, Human
aggggcugcuuccuccuggaa

SEQ ID NO: 2180654 - RNA, 19 nt, Human
agggggccaccuccccagg

SEQ ID NO: 2180655 - RNA, 15 nt, Human
agggggccaggugca

SEQ ID NO: 2180656 - RNA, 22 nt, Human
aggggcugcugaccuccacagc

SEQ ID NO: 2180657 - RNA, 23 nt, Human
aggggcuccuggaaaggcucagu

SEQ ID NO: 2180658 - RNA, 14 nt, Human
aggggcuccuggaa

SEQ ID NO: 2180659 - RNA, 13 nt, Human
aggggcuccugga

SEQ ID NO: 2180660 - RNA, 11 nt, Human
aggggagcccu

SEQ ID NO: 2180661 - RNA, 12 nt, Human
aggggagcccuc

SEQ ID NO: 2180662 - RNA, 15 nt, Human
aggggcucuggagag

SEQ ID NO: 2180663 - RNA, 17 nt, Human
aggggcucuggagagaa

SEQ ID NO: 2180664 - RNA, 21 nt, Human
aggggcucuggagagaaacaa

SEQ ID NO: 2180665 - RNA, 17 nt, Human
aggggcucucagcucag

SEQ ID NO: 2180666 - RNA, 16 nt, Human
aggggagcccuccacg

SEQ ID NO: 2180667 - RNA, 22 nt, Human
aggggcucucagcucagcgcca

SEQ ID NO: 2180668 - RNA, 15 nt, Human
aggggcugcuuccuc

SEQ ID NO: 2180669 - RNA, 16 nt, Human
aggggcugcuuccucc

SEQ ID NO: 2180670 - RNA, 18 nt, Human
aggggcugcuuccuccug

SEQ ID NO: 2180671 - RNA, 20 nt, Human
aggggcugcuuccuccugga

SEQ ID NO: 2180672 - RNA, 20 nt, Human
aggggcugaaagaacaugga

SEQ ID NO: 2180673 - RNA, 12 nt, Human
aggggcugcccg

SEQ ID NO: 2180674 - RNA, 13 nt, Human
aggggcugcccgc

SEQ ID NO: 2180675 - RNA, 15 nt, Human
aggggcugcccgcuc

SEQ ID NO: 2180676 - RNA, 16 nt, Human
aggggcugcccgcucc

SEQ ID NO: 2180677 - RNA, 17 nt, Human
aggggcugcccgcuccc

SEQ ID NO: 2180678 - RNA, 19 nt, Human
aggggcugcccgcucccag

SEQ ID NO: 2180679 - RNA, 20 nt, Human
aggggcugcccgcucccagu

SEQ ID NO: 2180680 - RNA, 19 nt, Human
aggggaauguuugccucug

SEQ ID NO: 2180681 - RNA, 20 nt, Human
aggggaauguuugccucugc

SEQ ID NO: 2180682 - RNA, 21 nt, Human
aggggaauguuugccucugcc

SEQ ID NO: 2180683 - RNA, 16 nt, Human
aggggaauugaggaca

SEQ ID NO: 2180684 - RNA, 18 nt, Human
aggggagcaugggaagug

SEQ ID NO: 2180685 - RNA, 16 nt, Human
aggggaaucagaacuc

SEQ ID NO: 2180686 - RNA, 15 nt, Human
aggggaaucagaacu

SEQ ID NO: 2180687 - RNA, 12 nt, Human
aggggagcccac

SEQ ID NO: 2180688 - RNA, 24 nt, Human
aggggagcccacuguccugggccu

SEQ ID NO: 2180689 - RNA, 21 nt, Human
aggggagcccacuguccuggg

SEQ ID NO: 2180690 - RNA, 17 nt, Human
aggggagcccacugucc

SEQ ID NO: 2180691 - RNA, 13 nt, Human
aggggagcccacu

SEQ ID NO: 2180692 - RNA, 20 nt, Human
agggguugguugagguggaa

SEQ ID NO: 2180693 - RNA, 17 nt, Human
agggguuuggucuggga

SEQ ID NO: 2180694 - RNA, 20 nt, Human
agggguuuuaggucucuucc

SEQ ID NO: 2180695 - RNA, 23 nt, Human
agggguugguugagguggaagcc

SEQ ID NO: 2180696 - RNA, 19 nt, Human
agggguugguugaggugga

SEQ ID NO: 2180697 - RNA, 21 nt, Human
agggguggcugccucauuuag

SEQ ID NO: 2180698 - RNA, 20 nt, Human
agggguggcugccucauuua

SEQ ID NO: 2180699 - RNA, 20 nt, Human
agggguggagacugcuuccc

SEQ ID NO: 2180700 - RNA, 22 nt, Human
agggguugccacaggccucccu

SEQ ID NO: 2180701 - RNA, 23 nt, Human
agggguugccacaggccucccug

SEQ ID NO: 2180702 - RNA, 21 nt, Human
agggguuuucgaagcucagcc

SEQ ID NO: 2180703 - RNA, 22 nt, Human
agggguuuuaggucucuucccc

SEQ ID NO: 2180704 - RNA, 22 nt, Human
agggguuuucgaagcucagccc

SEQ ID NO: 2180705 - RNA, 15 nt, Human
aggguaaggcugugg

SEQ ID NO: 2180706 - RNA, 14 nt, Human
agggucucacucug

SEQ ID NO: 2180707 - RNA, 15 nt, Human
agggucucacucugu

SEQ ID NO: 2180708 - RNA, 14 nt, Human
aggguaaggugccu

SEQ ID NO: 2180709 - RNA, 16 nt, Human
agggucucacucuguc

SEQ ID NO: 2180710 - RNA, 15 nt, Human
aggggucaggcucca

SEQ ID NO: 2180711 - RNA, 13 nt, Human
aggggugauuuca

SEQ ID NO: 2180712 - RNA, 17 nt, Human
aggggugauuucagaga

SEQ ID NO: 2180713 - RNA, 13 nt, Human
aggggucaggcuc

SEQ ID NO: 2180714 - RNA, 16 nt, Human
aggggucaaagaaaug

SEQ ID NO: 2180715 - RNA, 22 nt, Human
aggggugauuucagagagggca

SEQ ID NO: 2180716 - RNA, 11 nt, Human
aggggugcccc

SEQ ID NO: 2180717 - RNA, 13 nt, Human
aggggugcccccu

SEQ ID NO: 2180718 - RNA, 16 nt, Human
aggggugcccccuccu

SEQ ID NO: 2180719 - RNA, 17 nt, Human
aggggugcccccuccuc

SEQ ID NO: 2180720 - RNA, 20 nt, Human
aggggugcccccuccucucc

SEQ ID NO: 2180721 - RNA, 21 nt, Human
aggggugcccccuccucuccc

SEQ ID NO: 2180722 - RNA, 18 nt, Human
aggggugggacacccugu

SEQ ID NO: 2180723 - RNA, 23 nt, Human
aggggugcccccuccucucccau

SEQ ID NO: 2180724 - RNA, 17 nt, Human
agggguggagacugcuu

SEQ ID NO: 2180725 - RNA, 15 nt, Human
agggguggagacugc

SEQ ID NO: 2180726 - RNA, 22 nt, Human
aggggguuugggggcuugcaag

SEQ ID NO: 2180727 - RNA, 16 nt, Human
aggggguuugggggcu

SEQ ID NO: 2180728 - RNA, 20 nt, Human
aggggguuugcuggggaacu

SEQ ID NO: 2180729 - RNA, 19 nt, Human
agggguaauauauugcugc

SEQ ID NO: 2180730 - RNA, 22 nt, Human
agggguacauuucccugugcug

SEQ ID NO: 2180731 - RNA, 14 nt, Human
aggggucaaagaaa

SEQ ID NO: 2180732 - RNA, 17 nt, Human
agggguaggcagagccu

SEQ ID NO: 2180733 - RNA, 19 nt, Human
agggguaggcagagccuuu

SEQ ID NO: 2180734 - RNA, 20 nt, Human
aggggguggccucccaacuc

SEQ ID NO: 2180735 - RNA, 20 nt, Human
agggggugucucaggccaca

SEQ ID NO: 2180736 - RNA, 15 nt, Human
ugguuauaaaaguga

SEQ ID NO: 2180737 - RNA, 20 nt, Human
ugguuauaaaagugauuguu

SEQ ID NO: 2180738 - RNA, 16 nt, Human
ugguuauaaaagugau

SEQ ID NO: 2180739 - RNA, 14 nt, Human
ugguuauggagagg

SEQ ID NO: 2180740 - RNA, 19 nt, Human
ugguuuccucauuccugaa

SEQ ID NO: 2180741 - RNA, 17 nt, Human
ugguuucccccuucuac

SEQ ID NO: 2180742 - RNA, 13 nt, Human
ugguuuccugccc

SEQ ID NO: 2180743 - RNA, 12 nt, Human
ugguuuccugcc

SEQ ID NO: 2180744 - RNA, 20 nt, Human
ugguuuccugcccugggagg

SEQ ID NO: 2180745 - RNA, 19 nt, Human
ugguuugcagaugacaaaa

SEQ ID NO: 2180746 - RNA, 20 nt, Human
ugguuucccccuucuacauu

SEQ ID NO: 2180747 - RNA, 17 nt, Human
ugguuugcagaugacaa

SEQ ID NO: 2180748 - RNA, 15 nt, Human
ugguuuccugcccug

SEQ ID NO: 2180749 - RNA, 14 nt, Human
ugguuuccugcccu

SEQ ID NO: 2180750 - RNA, 14 nt, Human
ugguuugcuacuuc

SEQ ID NO: 2180751 - RNA, 16 nt, Human
ugguuuggaaugcuuc

SEQ ID NO: 2180752 - RNA, 22 nt, Human
ugguuuggaaugcuucuucuca

SEQ ID NO: 2180753 - RNA, 19 nt, Human
ugguuuggccaucucugga

SEQ ID NO: 2180754 - RNA, 20 nt, Human
ugguuuggccaucucuggau

SEQ ID NO: 2180755 - RNA, 21 nt, Human
ugguuuggcccuucuccuuuu

SEQ ID NO: 2180756 - RNA, 22 nt, Human
ugguuuggcccuucuccuuuug

SEQ ID NO: 2180757 - RNA, 23 nt, Human
ugguuuggcccuucuccuuuuga

SEQ ID NO: 2180758 - RNA, 19 nt, Human
ugguuuggggcgaggcaga

SEQ ID NO: 2180759 - RNA, 14 nt, Human
ugguuuucaaaaua

SEQ ID NO: 2180760 - RNA, 15 nt, Human
ugguuuguaaauuaa

SEQ ID NO: 2180761 - RNA, 17 nt, Human
ugguuuucaaaauaaaa

SEQ ID NO: 2180762 - RNA, 15 nt, Human
ugguuuucaaaauaa

SEQ ID NO: 2180763 - RNA, 14 nt, Human
ugguuuuccccucc

SEQ ID NO: 2180764 - RNA, 18 nt, Human
ugguuuuccccucccugg

SEQ ID NO: 2180765 - RNA, 19 nt, Human
uguaaacuguguauuccaa

SEQ ID NO: 2180766 - RNA, 20 nt, Human
ugguuuuccccucccugggu

SEQ ID NO: 2180767 - RNA, 21 nt, Human
ugguuuuccccucccuggguu

SEQ ID NO: 2180768 - RNA, 22 nt, Human
ugguuuggggcgaggcagagga

SEQ ID NO: 2180769 - RNA, 23 nt, Human
ugguuuggggcgaggcagaggac

SEQ ID NO: 2180770 - RNA, 18 nt, Human
uguaaaguauguaaacag

SEQ ID NO: 2180771 - RNA, 17 nt, Human
uguaaaguguaaauccu

SEQ ID NO: 2180772 - RNA, 16 nt, Human
uguaaaguguaaaucc

SEQ ID NO: 2180773 - RNA, 12 nt, Human
uguaaagugugg

SEQ ID NO: 2180774 - RNA, 13 nt, Human
uguaaaguguggu

SEQ ID NO: 2180775 - RNA, 19 nt, Human
uguaaaguaggaaaaauaa

SEQ ID NO: 2180776 - RNA, 21 nt, Human
uguaaaggagucaaaacuaca

SEQ ID NO: 2180777 - RNA, 19 nt, Human
uguaaaggagucaaaacua

SEQ ID NO: 2180778 - RNA, 16 nt, Human
uguaaaggaauuuaaa

SEQ ID NO: 2180779 - RNA, 22 nt, Human
uguaaagaaagagagaaaauaa

SEQ ID NO: 2180780 - RNA, 16 nt, Human
uguaaaggagucaaaa

SEQ ID NO: 2180781 - RNA, 21 nt, Human
uguaaagaaagagagaaaaua

SEQ ID NO: 2180782 - RNA, 20 nt, Human
uguaaagaaagagagaaaau

SEQ ID NO: 2180783 - RNA, 13 nt, Human
uguaaagaaagag

SEQ ID NO: 2180784 - RNA, 15 nt, Human
uguaaagaaagagag

SEQ ID NO: 2180785 - RNA, 14 nt, Human
uguaaagaaagaga

SEQ ID NO: 2180786 - RNA, 19 nt, Human
uguaaagaaagagagaaaa

SEQ ID NO: 2180787 - RNA, 18 nt, Human
uguaaagaaagagagaaa

SEQ ID NO: 2180788 - RNA, 17 nt, Human
uguaaagaaagagagaa

SEQ ID NO: 2180789 - RNA, 16 nt, Human
uguaaagaaagagaga

SEQ ID NO: 2180790 - RNA, 13 nt, Human
uguaaacuuuuug

SEQ ID NO: 2180791 - RNA, 22 nt, Human
uguaaacuguguauuccaagac

SEQ ID NO: 2180792 - RNA, 14 nt, Human
uguaaauaaaaaga

SEQ ID NO: 2180793 - RNA, 22 nt, Human
uguaaaguguggucccaacagg

SEQ ID NO: 2180794 - RNA, 12 nt, Human
uguaaaguuagu

SEQ ID NO: 2180795 - RNA, 14 nt, Human
uguaaaguuagucu

SEQ ID NO: 2180796 - RNA, 17 nt, Human
uguaaaguuagucuacu

SEQ ID NO: 2180797 - RNA, 13 nt, Human
uguaaauaaagcc

SEQ ID NO: 2180798 - RNA, 14 nt, Human
uguaaauaaagccc

SEQ ID NO: 2180799 - RNA, 19 nt, Human
uguaaauaaagaacuagca

SEQ ID NO: 2180800 - RNA, 18 nt, Human
uguaaauaaagcccuggg

SEQ ID NO: 2180801 - RNA, 17 nt, Human
uguaaauaaaggaacca

SEQ ID NO: 2180802 - RNA, 15 nt, Human
uguaaauagcucagg

SEQ ID NO: 2180803 - RNA, 16 nt, Human
uguaaauagcucaggu

SEQ ID NO: 2180804 - RNA, 21 nt, Human
uguaaauacuguuuuuaacaa

SEQ ID NO: 2180805 - RNA, 16 nt, Human
aggugauauauuuaaa

SEQ ID NO: 2180806 - RNA, 16 nt, Human
uguaaauaguauuuga

SEQ ID NO: 2180807 - RNA, 14 nt, Human
aggugucuuccucc

SEQ ID NO: 2180808 - RNA, 21 nt, Human
aggugucugcacccaggggug

SEQ ID NO: 2180809 - RNA, 15 nt, Human
aggugucuuccuccc

SEQ ID NO: 2180810 - RNA, 14 nt, Human
aggugucugcaccc

SEQ ID NO: 2180811 - RNA, 16 nt, Human
aggugucugcacccag

SEQ ID NO: 2180812 - RNA, 17 nt, Human
aggugucugcacccagg

SEQ ID NO: 2180813 - RNA, 17 nt, Human
aggugugaaccaccaca

SEQ ID NO: 2180814 - RNA, 15 nt, Human
aggugugcucugauc

SEQ ID NO: 2180815 - RNA, 20 nt, Human
aggugugcucugaucaucca

SEQ ID NO: 2180816 - RNA, 22 nt, Human
aggugggguauuuaccacagca

SEQ ID NO: 2180817 - RNA, 17 nt, Human
agguggggcgggaaagc

SEQ ID NO: 2180818 - RNA, 19 nt, Human
agguggggucacucuggca

SEQ ID NO: 2180819 - RNA, 21 nt, Human
agguggggcgggaaagccagu

SEQ ID NO: 2180820 - RNA, 23 nt, Human
aggugggguauuuaccacagcag

SEQ ID NO: 2180821 - RNA, 14 nt, Human
agguuuaagcuguu

SEQ ID NO: 2180822 - RNA, 17 nt, Human
agguuuaacucagauca

SEQ ID NO: 2180823 - RNA, 18 nt, Human
agguuuaacucagaucac

SEQ ID NO: 2180824 - RNA, 19 nt, Human
agguuuaacucagaucacu

SEQ ID NO: 2180825 - RNA, 20 nt, Human
agguuuaacucagaucacua

SEQ ID NO: 2180826 - RNA, 23 nt, Human
agguuuaacucagaucacuacug

SEQ ID NO: 2180827 - RNA, 16 nt, Human
agguuuacaauuuaca

SEQ ID NO: 2180828 - RNA, 17 nt, Human
agguuuacaauuuacaa

SEQ ID NO: 2180829 - RNA, 15 nt, Human
agguuuaacucagau

SEQ ID NO: 2180830 - RNA, 17 nt, Human
agguucuuagugucacu

SEQ ID NO: 2180831 - RNA, 17 nt, Human
agguucuggugugaacu

SEQ ID NO: 2180832 - RNA, 14 nt, Human
agguucucuccucc

SEQ ID NO: 2180833 - RNA, 17 nt, Human
agguucucuccucccca

SEQ ID NO: 2180834 - RNA, 22 nt, Human
agguucucuccuccccaaggag

SEQ ID NO: 2180835 - RNA, 15 nt, Human
agguucuauuuggaa

SEQ ID NO: 2180836 - RNA, 17 nt, Human
agguucuauuuggaauu

SEQ ID NO: 2180837 - RNA, 19 nt, Human
agguucuccguuagcuccu

SEQ ID NO: 2180838 - RNA, 20 nt, Human
agguucuccguuagcuccug

SEQ ID NO: 2180839 - RNA, 21 nt, Human
agguucuccguuagcuccugu

SEQ ID NO: 2180840 - RNA, 22 nt, Human
agguucuccguuagcuccugug

SEQ ID NO: 2180841 - RNA, 20 nt, Human
aggugucuuccucccaagug

SEQ ID NO: 2180842 - RNA, 14 nt, Human
aggugugggggcug

SEQ ID NO: 2180843 - RNA, 16 nt, Human
aggugugggggcugca

SEQ ID NO: 2180844 - RNA, 17 nt, Human
aggugugggggcugcag

SEQ ID NO: 2180845 - RNA, 18 nt, Human
aggugugggggcugcagc

SEQ ID NO: 2180846 - RNA, 20 nt, Human
agguguggagccgaggccua

SEQ ID NO: 2180847 - RNA, 16 nt, Human
aggugucuuccuccca

SEQ ID NO: 2180848 - RNA, 19 nt, Human
aggugucuuccucccaagu

SEQ ID NO: 2180849 - RNA, 22 nt, Human
aggugcccuuggaggccagcca

SEQ ID NO: 2180850 - RNA, 21 nt, Human
aggugcccuuggaggccagcc

SEQ ID NO: 2180851 - RNA, 20 nt, Human
aggugcccuuggaggccagc

SEQ ID NO: 2180852 - RNA, 19 nt, Human
aggugcccuuggaggccag

SEQ ID NO: 2180853 - RNA, 12 nt, Human
aggugccuccag

SEQ ID NO: 2180854 - RNA, 14 nt, Human
aggugccuccaggu

SEQ ID NO: 2180855 - RNA, 15 nt, Human
aggugccuccaggug

SEQ ID NO: 2180856 - RNA, 16 nt, Human
aggugccuccaggugu

SEQ ID NO: 2180857 - RNA, 18 nt, Human
aggugccucaagagaagg

SEQ ID NO: 2180858 - RNA, 23 nt, Human
aggugggauaucccuaugcugcc

SEQ ID NO: 2180859 - RNA, 17 nt, Human
aggugccugugaggcag

SEQ ID NO: 2180860 - RNA, 11 nt, Human
aggugccugug

SEQ ID NO: 2180861 - RNA, 18 nt, Human
aggugccuccaggugugc

SEQ ID NO: 2180862 - RNA, 17 nt, Human
aggugccugucccaccc

SEQ ID NO: 2180863 - RNA, 18 nt, Human
aggugccugucccacccc

SEQ ID NO: 2180864 - RNA, 15 nt, Human
aggugggauccucca

SEQ ID NO: 2180865 - RNA, 16 nt, Human
agguggggcagcuuga

SEQ ID NO: 2180866 - RNA, 18 nt, Human
aggugggauccuccaggu

SEQ ID NO: 2180867 - RNA, 23 nt, Human
agguggggcagcuugaggguugg

SEQ ID NO: 2180868 - RNA, 16 nt, Human
aggugggauccuccag

SEQ ID NO: 2180869 - RNA, 17 nt, Human
aggugggauccuccagg

SEQ ID NO: 2180870 - RNA, 21 nt, Human
aggugcccagaauaaguuauu

SEQ ID NO: 2180871 - RNA, 18 nt, Human
aggugccagcaacugaau

SEQ ID NO: 2180872 - RNA, 19 nt, Human
aggugccagcaacugaaua

SEQ ID NO: 2180873 - RNA, 20 nt, Human
aggugccagcaacugaauaa

SEQ ID NO: 2180874 - RNA, 21 nt, Human
aggugccagcaacugaauaaa

SEQ ID NO: 2180875 - RNA, 16 nt, Human
aggugccagcaaagcc

SEQ ID NO: 2180876 - RNA, 18 nt, Human
aggugccagcaaagcccc

SEQ ID NO: 2180877 - RNA, 19 nt, Human
aggugccagcaaagcccca

SEQ ID NO: 2180878 - RNA, 20 nt, Human
aggugccagcaaagccccau

SEQ ID NO: 2180879 - RNA, 14 nt, Human
aggugccagcaacu

SEQ ID NO: 2180880 - RNA, 15 nt, Human
aggugccagcaacug

SEQ ID NO: 2180881 - RNA, 17 nt, Human
aggugccccaaaaugca

SEQ ID NO: 2180882 - RNA, 17 nt, Human
aggugcccaucccugga

SEQ ID NO: 2180883 - RNA, 22 nt, Human
aggugcccagaaugaggcugcu

SEQ ID NO: 2180884 - RNA, 18 nt, Human
aggugcccagaaugaggc

SEQ ID NO: 2180885 - RNA, 14 nt, Human
aggugauccaccca

SEQ ID NO: 2180886 - RNA, 20 nt, Human
aggugauccacccaccucag

SEQ ID NO: 2180887 - RNA, 23 nt, Human
aggugcaucuggggaacuagagg

SEQ ID NO: 2180888 - RNA, 21 nt, Human
aggugcaucuggggaacuaga

SEQ ID NO: 2180889 - RNA, 20 nt, Human
aggugcauauuuauaaaaau

SEQ ID NO: 2180890 - RNA, 22 nt, Human
aggugauauccauucuuucuga

SEQ ID NO: 2180891 - RNA, 19 nt, Human
aggugauauccauucuuuc

SEQ ID NO: 2180892 - RNA, 18 nt, Human
aggugauauccauucuuu

SEQ ID NO: 2180893 - RNA, 18 nt, Human
aggugauauauuuaaaaa

SEQ ID NO: 2180894 - RNA, 22 nt, Human
aggugaguuugagcugccuucc

SEQ ID NO: 2180895 - RNA, 20 nt, Human
aggugaguuugagcugccuu

SEQ ID NO: 2180896 - RNA, 21 nt, Human
aggugaguuugagcugccuuc

SEQ ID NO: 2180897 - RNA, 13 nt, Human
aggugagggaugu

SEQ ID NO: 2180898 - RNA, 19 nt, Human
aggugaguuugagcugccu

SEQ ID NO: 2180899 - RNA, 20 nt, Human
uggugcccuguucucuacca

SEQ ID NO: 2180900 - RNA, 10 nt, Human
uggugccuga

SEQ ID NO: 2180901 - RNA, 13 nt, Human
uggugccugagag

SEQ ID NO: 2180902 - RNA, 22 nt, Human
uggugccuaaaguuuaaccaaa

SEQ ID NO: 2180903 - RNA, 12 nt, Human
uggugccuggcc

SEQ ID NO: 2180904 - RNA, 19 nt, Human
uggugccugagaggcaggc

SEQ ID NO: 2180905 - RNA, 20 nt, Human
uggugccugagaggcaggca

SEQ ID NO: 2180906 - RNA, 14 nt, Human
uggugccugagagg

SEQ ID NO: 2180907 - RNA, 15 nt, Human
uggugccugagaggc

SEQ ID NO: 2180908 - RNA, 17 nt, Human
uggugccugagaggcag

SEQ ID NO: 2180909 - RNA, 18 nt, Human
uggugccugagaggcagg

SEQ ID NO: 2180910 - RNA, 13 nt, Human
uggugccuggccu

SEQ ID NO: 2180911 - RNA, 14 nt, Human
uggugccuggccug

SEQ ID NO: 2180912 - RNA, 17 nt, Human
uggugccuggccuggca

SEQ ID NO: 2180913 - RNA, 18 nt, Human
uggugccuggccuggcac

SEQ ID NO: 2180914 - RNA, 19 nt, Human
uggugccuggccuggcaca

SEQ ID NO: 2180915 - RNA, 22 nt, Human
uggugccuggccuggcacacau

SEQ ID NO: 2180916 - RNA, 23 nt, Human
uggugccuggccuggcacacauc

SEQ ID NO: 2180917 - RNA, 24 nt, Human
uggugccuggccuggcacacauca

SEQ ID NO: 2180918 - RNA, 14 nt, Human
uggugccuucauuu

SEQ ID NO: 2180919 - RNA, 12 nt, Human
uggugccuucau

SEQ ID NO: 2180920 - RNA, 21 nt, Human
uggugccugauucggcugucu

SEQ ID NO: 2180921 - RNA, 11 nt, Human
uggugccuuca

SEQ ID NO: 2180922 - RNA, 16 nt, Human
uggugcgaucuggguu

SEQ ID NO: 2180923 - RNA, 16 nt, Human
uggugcuacgccugca

SEQ ID NO: 2180924 - RNA, 18 nt, Human
uggugcuauaggcuggag

SEQ ID NO: 2180925 - RNA, 17 nt, Human
uggugcgaucuggguuc

SEQ ID NO: 2180926 - RNA, 15 nt, Human
uggugcucucugcca

SEQ ID NO: 2180927 - RNA, 21 nt, Human
uggugcucaguuguagaaugu

SEQ ID NO: 2180928 - RNA, 15 nt, Human
uggugcucaguugua

SEQ ID NO: 2180929 - RNA, 17 nt, Human
uggugcucaguuguaga

SEQ ID NO: 2180930 - RNA, 22 nt, Human
uggugcuauaggcuggagaagc

SEQ ID NO: 2180931 - RNA, 23 nt, Human
uggugcuauaggcuggagaagcu

SEQ ID NO: 2180932 - RNA, 11 nt, Human
uggugcucagu

SEQ ID NO: 2180933 - RNA, 14 nt, Human
uggugcucaguugu

SEQ ID NO: 2180934 - RNA, 13 nt, Human
uggugcugccaca

SEQ ID NO: 2180935 - RNA, 13 nt, Human
uggugcugagaag

SEQ ID NO: 2180936 - RNA, 15 nt, Human
uggugcugaccucug

SEQ ID NO: 2180937 - RNA, 16 nt, Human
uggugcucucugccac

SEQ ID NO: 2180938 - RNA, 13 nt, Human
uggugcugaccuc

SEQ ID NO: 2180939 - RNA, 18 nt, Human
uggugcuggauauuuuca

SEQ ID NO: 2180940 - RNA, 13 nt, Human
uggugcugggacu

SEQ ID NO: 2180941 - RNA, 14 nt, Human
uggugcugggacug

SEQ ID NO: 2180942 - RNA, 15 nt, Human
uggugcugggacuga

SEQ ID NO: 2180943 - RNA, 21 nt, Human
uggugcuggauauuuucaaau

SEQ ID NO: 2180944 - RNA, 17 nt, Human
uggugcuggauauuuuc

SEQ ID NO: 2180945 - RNA, 12 nt, Human
uggugcuggaua

SEQ ID NO: 2180946 - RNA, 19 nt, Human
uggugcugcugcugcugug

SEQ ID NO: 2180947 - RNA, 15 nt, Human
uggugcugagaagcu

SEQ ID NO: 2180948 - RNA, 18 nt, Human
uggugcugccacacuuca

SEQ ID NO: 2180949 - RNA, 13 nt, Human
ugguuaaugccau

SEQ ID NO: 2180950 - RNA, 13 nt, Human
ugguuagaaaagu

SEQ ID NO: 2180951 - RNA, 14 nt, Human
ugguuagaaaugca

SEQ ID NO: 2180952 - RNA, 13 nt, Human
ugguuagaaaugc

SEQ ID NO: 2180953 - RNA, 18 nt, Human
ugguuaggcauuguggga

SEQ ID NO: 2180954 - RNA, 20 nt, Human
ugguuaggcauugugggaag

SEQ ID NO: 2180955 - RNA, 15 nt, Human
uggugugaaagucag

SEQ ID NO: 2180956 - RNA, 19 nt, Human
uggugucuggauucccagg

SEQ ID NO: 2180957 - RNA, 16 nt, Human
ugguggcacugagccc

SEQ ID NO: 2180958 - RNA, 11 nt, Human
uggugucucca

SEQ ID NO: 2180959 - RNA, 15 nt, Human
ugguggcacaggccc

SEQ ID NO: 2180960 - RNA, 19 nt, Human
uggugucuccaacccccca

SEQ ID NO: 2180961 - RNA, 20 nt, Human
uggugucuccaaccccccag

SEQ ID NO: 2180962 - RNA, 23 nt, Human
uggugugaccacugcagaagaca

SEQ ID NO: 2180963 - RNA, 23 nt, Human
uggugugaacuaaacuuucacac

SEQ ID NO: 2180964 - RNA, 11 nt, Human
uggugugaagg

SEQ ID NO: 2180965 - RNA, 12 nt, Human
uggugugaaggu

SEQ ID NO: 2180966 - RNA, 22 nt, Human
uggugugaacuaaacuuucaca

SEQ ID NO: 2180967 - RNA, 14 nt, Human
uggugugaacuaaa

SEQ ID NO: 2180968 - RNA, 14 nt, Human
ugguggcagcugcg

SEQ ID NO: 2180969 - RNA, 13 nt, Human
ugguggcagcugc

SEQ ID NO: 2180970 - RNA, 15 nt, Human
ugguggcagcugcgg

SEQ ID NO: 2180971 - RNA, 12 nt, Human
ugguggcagugg

SEQ ID NO: 2180972 - RNA, 19 nt, Human
ugguggaagaggggacagg

SEQ ID NO: 2180973 - RNA, 16 nt, Human
ugguggcaagagcccc

SEQ ID NO: 2180974 - RNA, 18 nt, Human
ugguggacaguccuggga

SEQ ID NO: 2180975 - RNA, 13 nt, Human
ugguggagggcca

SEQ ID NO: 2180976 - RNA, 17 nt, Human
ugguggacaguccuggg

SEQ ID NO: 2180977 - RNA, 16 nt, Human
ugguggacaguccugg

SEQ ID NO: 2180978 - RNA, 21 nt, Human
ugguggagaggcccggccucu

SEQ ID NO: 2180979 - RNA, 18 nt, Human
ugguggaagaggggacag

SEQ ID NO: 2180980 - RNA, 20 nt, Human
uggugcuguggccaggguga

SEQ ID NO: 2180981 - RNA, 22 nt, Human
uggugcuuacacaucucagacc

SEQ ID NO: 2180982 - RNA, 21 nt, Human
uggugcugggacugagccagu

SEQ ID NO: 2180983 - RNA, 16 nt, Human
uggugcugggacugag

SEQ ID NO: 2180984 - RNA, 19 nt, Human
uggugcugggacugagcca

SEQ ID NO: 2180985 - RNA, 12 nt, Human
uggugcuguggc

SEQ ID NO: 2180986 - RNA, 13 nt, Human
uggugcuguggcc

SEQ ID NO: 2180987 - RNA, 17 nt, Human
uggugcuguggccaggg

SEQ ID NO: 2180988 - RNA, 13 nt, Human
uggucacugccau

SEQ ID NO: 2180989 - RNA, 14 nt, Human
uggucacugccaug

SEQ ID NO: 2180990 - RNA, 22 nt, Human
uggucacugccauggaggcaca

SEQ ID NO: 2180991 - RNA, 14 nt, Human
ugguagcucaggug

SEQ ID NO: 2180992 - RNA, 13 nt, Human
uggucacugcugu

SEQ ID NO: 2180993 - RNA, 15 nt, Human
uggucagauuugaac

SEQ ID NO: 2180994 - RNA, 16 nt, Human
uggucagauuugaacu

SEQ ID NO: 2180995 - RNA, 13 nt, Human
aggucagagccug

SEQ ID NO: 2180996 - RNA, 14 nt, Human
aggucagagccugc

SEQ ID NO: 2180997 - RNA, 15 nt, Human
aggucagagccugca

SEQ ID NO: 2180998 - RNA, 17 nt, Human
aggucagagccugcagu

SEQ ID NO: 2180999 - RNA, 18 nt, Human
aggucagagccugcaguu

SEQ ID NO: 2181000 - RNA, 16 nt, Human
aggucaggaguuccua

SEQ ID NO: 2181001 - RNA, 21 nt, Human
aggucaggaguuagaggccag

SEQ ID NO: 2181002 - RNA, 19 nt, Human
aggucaggaguuagaggcc

SEQ ID NO: 2181003 - RNA, 15 nt, Human
aggucaggaguuccu

SEQ ID NO: 2181004 - RNA, 19 nt, Human
agguccacaacacacagau

SEQ ID NO: 2181005 - RNA, 18 nt, Human
aggucagcuugcugcccu

SEQ ID NO: 2181006 - RNA, 16 nt, Human
aggucagcuugcugcc

SEQ ID NO: 2181007 - RNA, 16 nt, Human
aggucagcaugucuau

SEQ ID NO: 2181008 - RNA, 19 nt, Human
aggucagcgugcuuagccu

SEQ ID NO: 2181009 - RNA, 15 nt, Human
aggucagcaugucua

SEQ ID NO: 2181010 - RNA, 14 nt, Human
uggucacugcuguc

SEQ ID NO: 2181011 - RNA, 15 nt, Human
uggucacugcuguca

SEQ ID NO: 2181012 - RNA, 16 nt, Human
aggucuugaacuccug

SEQ ID NO: 2181013 - RNA, 15 nt, Human
agguccagcucugga

SEQ ID NO: 2181014 - RNA, 16 nt, Human
agguccagcucuggag

SEQ ID NO: 2181015 - RNA, 17 nt, Human
agguccagcucuggagg

SEQ ID NO: 2181016 - RNA, 23 nt, Human
agguccagcccuggcugaaggac

SEQ ID NO: 2181017 - RNA, 21 nt, Human
agguccacggucuguucuuga

SEQ ID NO: 2181018 - RNA, 22 nt, Human
agguccacggucuguucuugaa

SEQ ID NO: 2181019 - RNA, 16 nt, Human
agguccagcccuggcu

SEQ ID NO: 2181020 - RNA, 17 nt, Human
agguccagcccuggcug

SEQ ID NO: 2181021 - RNA, 13 nt, Human
agguccagcucug

SEQ ID NO: 2181022 - RNA, 14 nt, Human
agguccagcucugg

SEQ ID NO: 2181023 - RNA, 18 nt, Human
agguccagcccuggcuga

SEQ ID NO: 2181024 - RNA, 20 nt, Human
agguccagcccuggcugaag

SEQ ID NO: 2181025 - RNA, 21 nt, Human
agguccagcccuggcugaagg

SEQ ID NO: 2181026 - RNA, 22 nt, Human
agguccagcccuggcugaagga

SEQ ID NO: 2181027 - RNA, 16 nt, Human
aggugaccuucuggga

SEQ ID NO: 2181028 - RNA, 20 nt, Human
aggugaccuugcaacuucau

SEQ ID NO: 2181029 - RNA, 19 nt, Human
aggugacugggcccugccu

SEQ ID NO: 2181030 - RNA, 19 nt, Human
aggugaccaaaucagugug

SEQ ID NO: 2181031 - RNA, 22 nt, Human
aggugaccaaaauccccuucuc

SEQ ID NO: 2181032 - RNA, 19 nt, Human
aggugacccaaugauucag

SEQ ID NO: 2181033 - RNA, 16 nt, Human
aggugagaagcagagg

SEQ ID NO: 2181034 - RNA, 20 nt, Human
aggugacugggcccugccuc

SEQ ID NO: 2181035 - RNA, 22 nt, Human
aggugacugggcccugccucug

SEQ ID NO: 2181036 - RNA, 23 nt, Human
aggugagaagcagaggaaggaga

SEQ ID NO: 2181037 - RNA, 21 nt, Human
aggugagaagcagaggaagga

SEQ ID NO: 2181038 - RNA, 13 nt, Human
aggugagggaagc

SEQ ID NO: 2181039 - RNA, 22 nt, Human
aggugagcacggccaacaaagc

SEQ ID NO: 2181040 - RNA, 18 nt, Human
aggugagcacggccaaca

SEQ ID NO: 2181041 - RNA, 20 nt, Human
aggugagcccauggcccucc

SEQ ID NO: 2181042 - RNA, 21 nt, Human
aggugagcaaccaguuggcua

SEQ ID NO: 2181043 - RNA, 22 nt, Human
aggugagcaaccaguuggcuag

SEQ ID NO: 2181044 - RNA, 22 nt, Human
aggugacagagugagacucugu

SEQ ID NO: 2181045 - RNA, 14 nt, Human
aggugacaugugaa

SEQ ID NO: 2181046 - RNA, 15 nt, Human
aggugacaugugaaa

SEQ ID NO: 2181047 - RNA, 16 nt, Human
aggugacaugugaaac

SEQ ID NO: 2181048 - RNA, 20 nt, Human
aggugacaugugaaaccuuu

SEQ ID NO: 2181049 - RNA, 20 nt, Human
aggugaccaaaauccccuuc

SEQ ID NO: 2181050 - RNA, 13 nt, Human
aggugaccccagg

SEQ ID NO: 2181051 - RNA, 18 nt, Human
aggucuugaacuccuggc

SEQ ID NO: 2181052 - RNA, 21 nt, Human
aggucuucaucgaaucuacua

SEQ ID NO: 2181053 - RNA, 20 nt, Human
aggucuucaucgaaucuacu

SEQ ID NO: 2181054 - RNA, 17 nt, Human
aggucuugaacuccugg

SEQ ID NO: 2181055 - RNA, 13 nt, Human
aggugacagagug

SEQ ID NO: 2181056 - RNA, 15 nt, Human
aggugacagagugag

SEQ ID NO: 2181057 - RNA, 20 nt, Human
aguagcauguugagccaggc

SEQ ID NO: 2181058 - RNA, 23 nt, Human
aguagaccuuguuacuucugagg

SEQ ID NO: 2181059 - RNA, 11 nt, Human
aguagagacag

SEQ ID NO: 2181060 - RNA, 14 nt, Human
aguagaauugcauu

SEQ ID NO: 2181061 - RNA, 20 nt, Human
aguagaccuuguuacuucug

SEQ ID NO: 2181062 - RNA, 21 nt, Human
aguagaccuuguuacuucuga

SEQ ID NO: 2181063 - RNA, 15 nt, Human
aguagaauugcauug

SEQ ID NO: 2181064 - RNA, 22 nt, Human
aguagacauuucucuuacugca

SEQ ID NO: 2181065 - RNA, 13 nt, Human
aguagcauuucau

SEQ ID NO: 2181066 - RNA, 14 nt, Human
aguagcauuucauu

SEQ ID NO: 2181067 - RNA, 15 nt, Human
aguagcauuucauuc

SEQ ID NO: 2181068 - RNA, 15 nt, Human
aguagcccuuucugu

SEQ ID NO: 2181069 - RNA, 23 nt, Human
aguagccaggguguggcccugcc

SEQ ID NO: 2181070 - RNA, 16 nt, Human
aguagccgagagccug

SEQ ID NO: 2181071 - RNA, 15 nt, Human
aguagccgagagccu

SEQ ID NO: 2181072 - RNA, 20 nt, Human
aguagcccuuucugugugca

SEQ ID NO: 2181073 - RNA, 21 nt, Human
aguagcccuuucugugugcac

SEQ ID NO: 2181074 - RNA, 22 nt, Human
aguagccaggguguggcccugc

SEQ ID NO: 2181075 - RNA, 16 nt, Human
aguagcccuuucugug

SEQ ID NO: 2181076 - RNA, 17 nt, Human
aguagcccuuucugugu

SEQ ID NO: 2181077 - RNA, 19 nt, Human
aguagcccuuucugugugc

SEQ ID NO: 2181078 - RNA, 19 nt, Human
aguagccgagagccugcuc

SEQ ID NO: 2181079 - RNA, 22 nt, Human
aguagccuaacacacuccaaga

SEQ ID NO: 2181080 - RNA, 18 nt, Human
aguagccgagagccugcu

SEQ ID NO: 2181081 - RNA, 17 nt, Human
aguagccgagagccugc

SEQ ID NO: 2181082 - RNA, 11 nt, Human
uguaggcagac

SEQ ID NO: 2181083 - RNA, 12 nt, Human
uguaggcagaca

SEQ ID NO: 2181084 - RNA, 15 nt, Human
uguaguauaaagaaa

SEQ ID NO: 2181085 - RNA, 14 nt, Human
uguaguagucucau

SEQ ID NO: 2181086 - RNA, 14 nt, Human
uguaguaucaaaua

SEQ ID NO: 2181087 - RNA, 13 nt, Human
uguaguagucuca

SEQ ID NO: 2181088 - RNA, 20 nt, Human
uguaggccaaauuuguagug

SEQ ID NO: 2181089 - RNA, 18 nt, Human
uguaguagcccuuucugu

SEQ ID NO: 2181090 - RNA, 18 nt, Human
uguaguaucaaauauuag

SEQ ID NO: 2181091 - RNA, 19 nt, Human
uguaguaucaaauauuaga

SEQ ID NO: 2181092 - RNA, 21 nt, Human
uguaguaucaaauauuagaug

SEQ ID NO: 2181093 - RNA, 23 nt, Human
uguaguaucaaauauuagaugug

SEQ ID NO: 2181094 - RNA, 12 nt, Human
uguagggaacuc

SEQ ID NO: 2181095 - RNA, 13 nt, Human
uguagggagggcg

SEQ ID NO: 2181096 - RNA, 18 nt, Human
uguaguaauugacaugug

SEQ ID NO: 2181097 - RNA, 19 nt, Human
uguaguaauugacaugugc

SEQ ID NO: 2181098 - RNA, 17 nt, Human
uguaggcuuaguuugug

SEQ ID NO: 2181099 - RNA, 13 nt, Human
uguaggcagacac

SEQ ID NO: 2181100 - RNA, 14 nt, Human
uguaggcagacaca

SEQ ID NO: 2181101 - RNA, 15 nt, Human
uguaggcagacacag

SEQ ID NO: 2181102 - RNA, 16 nt, Human
uguaggcagacacagg

SEQ ID NO: 2181103 - RNA, 17 nt, Human
uguaggcauaaagucag

SEQ ID NO: 2181104 - RNA, 20 nt, Human
uguaggcauaaagucagggg

SEQ ID NO: 2181105 - RNA, 14 nt, Human
aguacauguuaaac

SEQ ID NO: 2181106 - RNA, 12 nt, Human
aguacauuuaau

SEQ ID NO: 2181107 - RNA, 13 nt, Human
aguacauuuaaua

SEQ ID NO: 2181108 - RNA, 21 nt, Human
aguacauuuaauacagcagug

SEQ ID NO: 2181109 - RNA, 17 nt, Human
aguacauauuaggaaaa

SEQ ID NO: 2181110 - RNA, 22 nt, Human
aguacauaaaggugguaugugu

SEQ ID NO: 2181111 - RNA, 18 nt, Human
aguacauauuaggaaaau

SEQ ID NO: 2181112 - RNA, 21 nt, Human
aguacagguaaggugagggaa

SEQ ID NO: 2181113 - RNA, 20 nt, Human
aguaauuaucgggaacagug

SEQ ID NO: 2181114 - RNA, 22 nt, Human
aguaauuaucgggaacaguguu

SEQ ID NO: 2181115 - RNA, 23 nt, Human
aguacagguaaggugagggaaua

SEQ ID NO: 2181116 - RNA, 13 nt, Human
aguaauuaucggg

SEQ ID NO: 2181117 - RNA, 15 nt, Human
aguaauucaagaaaa

SEQ ID NO: 2181118 - RNA, 22 nt, Human
aguaauggguuucauauuucuu

SEQ ID NO: 2181119 - RNA, 23 nt, Human
aguaauggguuucauauuucuua

SEQ ID NO: 2181120 - RNA, 17 nt, Human
aguaaugcuacguguga

SEQ ID NO: 2181121 - RNA, 18 nt, Human
aguaaugcuacgugugau

SEQ ID NO: 2181122 - RNA, 19 nt, Human
aguaaugcuacgugugauu

SEQ ID NO: 2181123 - RNA, 20 nt, Human
aguaaugcuacgugugauuu

SEQ ID NO: 2181124 - RNA, 21 nt, Human
aguaaugcuacgugugauuuu

SEQ ID NO: 2181125 - RNA, 15 nt, Human
aguaauggguuucau

SEQ ID NO: 2181126 - RNA, 21 nt, Human
aguaauggguuucauauuucu

SEQ ID NO: 2181127 - RNA, 22 nt, Human
aguacccaaaagcucagccagc

SEQ ID NO: 2181128 - RNA, 21 nt, Human
aguaccauuuauacaaauuag

SEQ ID NO: 2181129 - RNA, 14 nt, Human
aguaccauuuauac

SEQ ID NO: 2181130 - RNA, 15 nt, Human
aguacccaaaagcuc

SEQ ID NO: 2181131 - RNA, 21 nt, Human
aguacccaaaagcucagccag

SEQ ID NO: 2181132 - RNA, 16 nt, Human
aguacauuuggagaca

SEQ ID NO: 2181133 - RNA, 21 nt, Human
aguaccuauaaaguaaagcua

SEQ ID NO: 2181134 - RNA, 23 nt, Human
aguaccuauaaaguaaagcuaaa

SEQ ID NO: 2181135 - RNA, 15 nt, Human
aguaccuccugcccc

SEQ ID NO: 2181136 - RNA, 15 nt, Human
aguaccuauaaagua

SEQ ID NO: 2181137 - RNA, 19 nt, Human
aguacccguucacauuuuu

SEQ ID NO: 2181138 - RNA, 16 nt, Human
aguacccucucagcuc

SEQ ID NO: 2181139 - RNA, 18 nt, Human
aguacccucucagcucca

SEQ ID NO: 2181140 - RNA, 19 nt, Human
aguacccucucagcuccag

SEQ ID NO: 2181141 - RNA, 20 nt, Human
aguagaagucuuagauguau

SEQ ID NO: 2181142 - RNA, 19 nt, Human
aguagaagucuuagaugua

SEQ ID NO: 2181143 - RNA, 21 nt, Human
aguagaagucuuagauguaua

SEQ ID NO: 2181144 - RNA, 12 nt, Human
aguaccuccugu

SEQ ID NO: 2181145 - RNA, 22 nt, Human
aguaccuccugucucuggccug

SEQ ID NO: 2181146 - RNA, 14 nt, Human
aguaauagagcaaa

SEQ ID NO: 2181147 - RNA, 15 nt, Human
aguaauaugcacaca

SEQ ID NO: 2181148 - RNA, 14 nt, Human
aguaauaugcacac

SEQ ID NO: 2181149 - RNA, 17 nt, Human
aguaaugauaacuggaa

SEQ ID NO: 2181150 - RNA, 18 nt, Human
aguaaugauaacuggaaa

SEQ ID NO: 2181151 - RNA, 20 nt, Human
aguaaugauaacuggaaacu

SEQ ID NO: 2181152 - RNA, 14 nt, Human
aguaaaacuugcug

SEQ ID NO: 2181153 - RNA, 19 nt, Human
agguuuuuguuuguuuccu

SEQ ID NO: 2181154 - RNA, 13 nt, Human
aguaaaauccaca

SEQ ID NO: 2181155 - RNA, 17 nt, Human
agguuuuauaaggcuga

SEQ ID NO: 2181156 - RNA, 20 nt, Human
agguuuuuauuaguaccaua

SEQ ID NO: 2181157 - RNA, 15 nt, Human
agguuuuuauuagua

SEQ ID NO: 2181158 - RNA, 12 nt, Human
agguuuuucaau

SEQ ID NO: 2181159 - RNA, 13 nt, Human
agguuuuucaauu

SEQ ID NO: 2181160 - RNA, 13 nt, Human
agguuuuuauuag

SEQ ID NO: 2181161 - RNA, 14 nt, Human
agguuuuauuuugu

SEQ ID NO: 2181162 - RNA, 20 nt, Human
agguuuuuggaauuaugucu

SEQ ID NO: 2181163 - RNA, 13 nt, Human
agguuuuucuuaa

SEQ ID NO: 2181164 - RNA, 23 nt, Human
agguuuuucaauuaaacggauua

SEQ ID NO: 2181165 - RNA, 14 nt, Human
agguuuuucaauua

SEQ ID NO: 2181166 - RNA, 15 nt, Human
agguuuuucaauuaa

SEQ ID NO: 2181167 - RNA, 16 nt, Human
agguuuuucaauuaaa

SEQ ID NO: 2181168 - RNA, 17 nt, Human
agguuuuucaauuaaac

SEQ ID NO: 2181169 - RNA, 18 nt, Human
agguuuuucaauuaaacg

SEQ ID NO: 2181170 - RNA, 20 nt, Human
agguuuuucaauuaaacgga

SEQ ID NO: 2181171 - RNA, 21 nt, Human
agguuuuucaauuaaacggau

SEQ ID NO: 2181172 - RNA, 22 nt, Human
agguuuuucaauuaaacggauu

SEQ ID NO: 2181173 - RNA, 11 nt, Human
uguacuuugug

SEQ ID NO: 2181174 - RNA, 22 nt, Human
uguacuuggaguauuggggucu

SEQ ID NO: 2181175 - RNA, 15 nt, Human
uguacuugucaaaga

SEQ ID NO: 2181176 - RNA, 18 nt, Human
uguagaaaagggaacuga

SEQ ID NO: 2181177 - RNA, 19 nt, Human
uguagaaaagggaacugaa

SEQ ID NO: 2181178 - RNA, 20 nt, Human
uguagaaaagggaacugaac

SEQ ID NO: 2181179 - RNA, 21 nt, Human
uguagaaaagggaacugaaca

SEQ ID NO: 2181180 - RNA, 22 nt, Human
uguacuugcucuugaugccugg

SEQ ID NO: 2181181 - RNA, 23 nt, Human
uguacuugcucuugaugccuggc

SEQ ID NO: 2181182 - RNA, 19 nt, Human
uguacuugcucuugaugcc

SEQ ID NO: 2181183 - RNA, 21 nt, Human
agguuuaggcugguggcccag

SEQ ID NO: 2181184 - RNA, 20 nt, Human
agguuuaggcugguggccca

SEQ ID NO: 2181185 - RNA, 18 nt, Human
agguuuaggcugguggcc

SEQ ID NO: 2181186 - RNA, 23 nt, Human
agguuuacaauuuacaaagugug

SEQ ID NO: 2181187 - RNA, 18 nt, Human
agguuuacaauuuacaaa

SEQ ID NO: 2181188 - RNA, 22 nt, Human
agguuuacaauuuacaaagugu

SEQ ID NO: 2181189 - RNA, 23 nt, Human
uguagaaaagggaacugaacauu

SEQ ID NO: 2181190 - RNA, 21 nt, Human
uguagaaaugaugauguggaa

SEQ ID NO: 2181191 - RNA, 23 nt, Human
uguagaaaauuuguuauuuugca

SEQ ID NO: 2181192 - RNA, 13 nt, Human
uguagaaaugguu

SEQ ID NO: 2181193 - RNA, 21 nt, Human
uguagaaaugguuguauuaga

SEQ ID NO: 2181194 - RNA, 14 nt, Human
uguacuuuguacaa

SEQ ID NO: 2181195 - RNA, 16 nt, Human
uguagagccagggucu

SEQ ID NO: 2181196 - RNA, 18 nt, Human
uguagagccagggucuca

SEQ ID NO: 2181197 - RNA, 14 nt, Human
uguagagcuucugg

SEQ ID NO: 2181198 - RNA, 23 nt, Human
agguuuguuuagaagaagugugu

SEQ ID NO: 2181199 - RNA, 16 nt, Human
uguagaggagaaacug

SEQ ID NO: 2181200 - RNA, 15 nt, Human
agguuuuaaagugau

SEQ ID NO: 2181201 - RNA, 17 nt, Human
agguuuuaaagugauua

SEQ ID NO: 2181202 - RNA, 21 nt, Human
agguuuuaaagugauuaaacg

SEQ ID NO: 2181203 - RNA, 14 nt, Human
agguuuuaaguugu

SEQ ID NO: 2181204 - RNA, 19 nt, Human
agguuuuaaguuguuugca

SEQ ID NO: 2181205 - RNA, 11 nt, Human
uguauguuuac

SEQ ID NO: 2181206 - RNA, 13 nt, Human
uguauguuuacau

SEQ ID NO: 2181207 - RNA, 15 nt, Human
uguauguuuacauau

SEQ ID NO: 2181208 - RNA, 16 nt, Human
uguauguuuacauauc

SEQ ID NO: 2181209 - RNA, 22 nt, Human
uguauguuugcacacuugugug

SEQ ID NO: 2181210 - RNA, 11 nt, Human
uguauguuuug

SEQ ID NO: 2181211 - RNA, 16 nt, Human
uguauguuugcacacu

SEQ ID NO: 2181212 - RNA, 14 nt, Human
uguauguuugcaca

SEQ ID NO: 2181213 - RNA, 19 nt, Human
uguauguuuugguaucugu

SEQ ID NO: 2181214 - RNA, 13 nt, Human
uguauuacaaauc

SEQ ID NO: 2181215 - RNA, 17 nt, Human
uguauucccaguuacuu

SEQ ID NO: 2181216 - RNA, 20 nt, Human
uguauucuagcuaauguaau

SEQ ID NO: 2181217 - RNA, 17 nt, Human
uguauguuuuuuuucug

SEQ ID NO: 2181218 - RNA, 21 nt, Human
uguauuaauauucauuguaua

SEQ ID NO: 2181219 - RNA, 22 nt, Human
uguauuacaaauccaaugaaau

SEQ ID NO: 2181220 - RNA, 16 nt, Human
ugucaagucucugcug

SEQ ID NO: 2181221 - RNA, 19 nt, Human
ugucaaggcugcuuagaau

SEQ ID NO: 2181222 - RNA, 18 nt, Human
ugucaaggcugcuuagaa

SEQ ID NO: 2181223 - RNA, 22 nt, Human
ugucaaacaaagccagaagcug

SEQ ID NO: 2181224 - RNA, 21 nt, Human
ugucaaacaaagccagaagcu

SEQ ID NO: 2181225 - RNA, 17 nt, Human
ugucaaacaaagccaga

SEQ ID NO: 2181226 - RNA, 16 nt, Human
ugucaaacaaagccag

SEQ ID NO: 2181227 - RNA, 15 nt, Human
ugucaaaauaauuuu

SEQ ID NO: 2181228 - RNA, 23 nt, Human
ugucaaaaaugucuuggguaggc

SEQ ID NO: 2181229 - RNA, 14 nt, Human
ugucaaaaaaaaaa

SEQ ID NO: 2181230 - RNA, 17 nt, Human
uguauuuuuuugcaagu

SEQ ID NO: 2181231 - RNA, 20 nt, Human
uguauuuuuuugcaagugaa

SEQ ID NO: 2181232 - RNA, 21 nt, Human
uguauuuuuuuuucuaagaga

SEQ ID NO: 2181233 - RNA, 22 nt, Human
uguauuuuuuuuucuaagagaa

SEQ ID NO: 2181234 - RNA, 22 nt, Human
uguauucuagcuaauguaauaa

SEQ ID NO: 2181235 - RNA, 20 nt, Human
uguauucucuccuguaccuc

SEQ ID NO: 2181236 - RNA, 19 nt, Human
uguauucucuccuguaccu

SEQ ID NO: 2181237 - RNA, 21 nt, Human
uguaucaggaaauauauaugu

SEQ ID NO: 2181238 - RNA, 18 nt, Human
uguaucagaggccuauaa

SEQ ID NO: 2181239 - RNA, 21 nt, Human
uguaucaggugcccaucccug

SEQ ID NO: 2181240 - RNA, 15 nt, Human
uguaucauagaaaug

SEQ ID NO: 2181241 - RNA, 17 nt, Human
uguaucauuugaacaac

SEQ ID NO: 2181242 - RNA, 21 nt, Human
uguaucaucuggauaggagcc

SEQ ID NO: 2181243 - RNA, 17 nt, Human
uguaucauagaaaugua

SEQ ID NO: 2181244 - RNA, 16 nt, Human
uguaucauagaaaugu

SEQ ID NO: 2181245 - RNA, 13 nt, Human
uguauguauaauu

SEQ ID NO: 2181246 - RNA, 15 nt, Human
uguauguauaauuca

SEQ ID NO: 2181247 - RNA, 18 nt, Human
uguaugucucgugguagg

SEQ ID NO: 2181248 - RNA, 14 nt, Human
uguaugucuuggac

SEQ ID NO: 2181249 - RNA, 19 nt, Human
uguaugucuuggacacugu

SEQ ID NO: 2181250 - RNA, 12 nt, Human
uguauguggggg

SEQ ID NO: 2181251 - RNA, 21 nt, Human
uguaugucagacauccauguu

SEQ ID NO: 2181252 - RNA, 11 nt, Human
uguaugugcac

SEQ ID NO: 2181253 - RNA, 16 nt, Human
uguaugugcacuguca

SEQ ID NO: 2181254 - RNA, 17 nt, Human
uguaugugcacugucac

SEQ ID NO: 2181255 - RNA, 14 nt, Human
uguauguguguaug

SEQ ID NO: 2181256 - RNA, 19 nt, Human
uguaugugcacugucacuu

SEQ ID NO: 2181257 - RNA, 20 nt, Human
uguaugugggggucugugug

SEQ ID NO: 2181258 - RNA, 17 nt, Human
uguaugugcgugugugc

SEQ ID NO: 2181259 - RNA, 21 nt, Human
uguagugccucuuucauccac

SEQ ID NO: 2181260 - RNA, 14 nt, Human
uguaguguuggaga

SEQ ID NO: 2181261 - RNA, 22 nt, Human
uguauauuugugauagcacuuu

SEQ ID NO: 2181262 - RNA, 22 nt, Human
uguauauuuuaagaaauaacag

SEQ ID NO: 2181263 - RNA, 15 nt, Human
uguaguguuggagaa

SEQ ID NO: 2181264 - RNA, 17 nt, Human
uguaucaaugaguaaca

SEQ ID NO: 2181265 - RNA, 23 nt, Human
uguauauuugugauagcacuuuc

SEQ ID NO: 2181266 - RNA, 18 nt, Human
uguaucacaaaucuuaac

SEQ ID NO: 2181267 - RNA, 15 nt, Human
uguaucacaaaucuu

SEQ ID NO: 2181268 - RNA, 13 nt, Human
aguagggucaggc

SEQ ID NO: 2181269 - RNA, 13 nt, Human
aguaggugcuuga

SEQ ID NO: 2181270 - RNA, 20 nt, Human
aguagguuggaagcuagcuc

SEQ ID NO: 2181271 - RNA, 23 nt, Human
aguagguuggaagcuagcucccc

SEQ ID NO: 2181272 - RNA, 13 nt, Human
aguaguaaaaauu

SEQ ID NO: 2181273 - RNA, 16 nt, Human
aguaguaauagagcaa

SEQ ID NO: 2181274 - RNA, 19 nt, Human
ugucaauuacaggaaguac

SEQ ID NO: 2181275 - RNA, 17 nt, Human
ugucaauuacaggaagu

SEQ ID NO: 2181276 - RNA, 18 nt, Human
ugucaagucucugcuggc

SEQ ID NO: 2181277 - RNA, 17 nt, Human
ugucaagucucugcugg

SEQ ID NO: 2181278 - RNA, 19 nt, Human
ugucaagucucugcuggcc

SEQ ID NO: 2181279 - RNA, 18 nt, Human
ugucaaguuccuuugggu

SEQ ID NO: 2181280 - RNA, 19 nt, Human
ugucaagugggaucuguca

SEQ ID NO: 2181281 - RNA, 14 nt, Human
ugucaaguugugcu

SEQ ID NO: 2181282 - RNA, 15 nt, Human
ugucaaguugugcuu

SEQ ID NO: 2181283 - RNA, 16 nt, Human
ugucaaguugugcuug

SEQ ID NO: 2181284 - RNA, 17 nt, Human
ugucaaguugugcuugu

SEQ ID NO: 2181285 - RNA, 14 nt, Human
ugucaauuacagga

SEQ ID NO: 2181286 - RNA, 15 nt, Human
ugucaauuacaggaa

SEQ ID NO: 2181287 - RNA, 15 nt, Human
aguaugguggcuggg

SEQ ID NO: 2181288 - RNA, 16 nt, Human
aguaugguggcugggu

SEQ ID NO: 2181289 - RNA, 18 nt, Human
aguaguaccaaaugcuuu

SEQ ID NO: 2181290 - RNA, 19 nt, Human
aguaguaccaaaugcuuua

SEQ ID NO: 2181291 - RNA, 21 nt, Human
aguaguaccaaaugcuuuaaa

SEQ ID NO: 2181292 - RNA, 14 nt, Human
aguaguacuugaaa

SEQ ID NO: 2181293 - RNA, 17 nt, Human
aguaguaccaaaugcuu

SEQ ID NO: 2181294 - RNA, 14 nt, Human
aguaguaaaaauua

SEQ ID NO: 2181295 - RNA, 18 nt, Human
aguaguaaaaauuaaaaa

SEQ ID NO: 2181296 - RNA, 22 nt, Human
aguaguaccaaaugcuuuaaaa

SEQ ID NO: 2181297 - RNA, 15 nt, Human
aguauuacuucugcu

SEQ ID NO: 2181298 - RNA, 17 nt, Human
aguaugguggcuggguu

SEQ ID NO: 2181299 - RNA, 18 nt, Human
aguauuacuucugcuaca

SEQ ID NO: 2181300 - RNA, 18 nt, Human
aguauuagaauaccacag

SEQ ID NO: 2181301 - RNA, 14 nt, Human
aguaugguggcugg

SEQ ID NO: 2181302 - RNA, 14 nt, Human
aguauugaagcauu

SEQ ID NO: 2181303 - RNA, 18 nt, Human
aguauucuugucaaaaaa

SEQ ID NO: 2181304 - RNA, 12 nt, Human
aguauucuucuc

SEQ ID NO: 2181305 - RNA, 14 nt, Human
aguauucuucucuu

SEQ ID NO: 2181306 - RNA, 15 nt, Human
aguauucuugucaaa

SEQ ID NO: 2181307 - RNA, 21 nt, Human
aguauugaagcauuuuauaaa

SEQ ID NO: 2181308 - RNA, 20 nt, Human
aguauugaagcauuuuauaa

SEQ ID NO: 2181309 - RNA, 18 nt, Human
aguauugaagcauuuuau

SEQ ID NO: 2181310 - RNA, 15 nt, Human
aguauugaagcauuu

SEQ ID NO: 2181311 - RNA, 23 nt, Human
agucacacaguauuacuucugcu

SEQ ID NO: 2181312 - RNA, 18 nt, Human
aguauuucuaugaaauau

SEQ ID NO: 2181313 - RNA, 17 nt, Human
aguauuucuaugaaaua

SEQ ID NO: 2181314 - RNA, 16 nt, Human
aguauuucuaugaaau

SEQ ID NO: 2181315 - RNA, 15 nt, Human
agucacacagugagu

SEQ ID NO: 2181316 - RNA, 23 nt, Human
agucacacagugagucgaggaca

SEQ ID NO: 2181317 - RNA, 19 nt, Human
agucaccccggccaccugc

SEQ ID NO: 2181318 - RNA, 16 nt, Human
agucacacgggggcag

SEQ ID NO: 2181319 - RNA, 19 nt, Human
agucacccuaccugugccu

SEQ ID NO: 2181320 - RNA, 19 nt, Human
agucacacgggggcagcug

SEQ ID NO: 2181321 - RNA, 14 nt, Human
agucaccucaugga

SEQ ID NO: 2181322 - RNA, 15 nt, Human
agucaccucauggaa

SEQ ID NO: 2181323 - RNA, 17 nt, Human
agucaccucauggaauu

SEQ ID NO: 2181324 - RNA, 20 nt, Human
agucacccuaccugugccug

SEQ ID NO: 2181325 - RNA, 20 nt, Human
agcuggguaaucgauggggg

SEQ ID NO: 2181326 - RNA, 14 nt, Human
agcugggucaggca

SEQ ID NO: 2181327 - RNA, 19 nt, Human
agcugugcagguggggaga

SEQ ID NO: 2181328 - RNA, 12 nt, Human
agcugugccacc

SEQ ID NO: 2181329 - RNA, 13 nt, Human
agcugugccaccc

SEQ ID NO: 2181330 - RNA, 18 nt, Human
agcugugccacccugggc

SEQ ID NO: 2181331 - RNA, 19 nt, Human
agcugugccacccugggcu

SEQ ID NO: 2181332 - RNA, 20 nt, Human
agcugugccacccugggcuc

SEQ ID NO: 2181333 - RNA, 22 nt, Human
agcugggguggggaccucaggc

SEQ ID NO: 2181334 - RNA, 23 nt, Human
agcugggguggggaccucaggcc

SEQ ID NO: 2181335 - RNA, 20 nt, Human
agcugggacuacaggcaccc

SEQ ID NO: 2181336 - RNA, 23 nt, Human
agcugggacuacaggcacccacc

SEQ ID NO: 2181337 - RNA, 16 nt, Human
agcugggacuacaggu

SEQ ID NO: 2181338 - RNA, 20 nt, Human
agcugggguggggaccucag

SEQ ID NO: 2181339 - RNA, 14 nt, Human
agcugugugaaaua

SEQ ID NO: 2181340 - RNA, 13 nt, Human
agcugugugaaau

SEQ ID NO: 2181341 - RNA, 24 nt, Human
agcuguguccuugcaccugcaucc

SEQ ID NO: 2181342 - RNA, 21 nt, Human
agcuguguccuugcaccugca

SEQ ID NO: 2181343 - RNA, 14 nt, Human
agcuguuacugucu

SEQ ID NO: 2181344 - RNA, 18 nt, Human
agcuguuacugucuucag

SEQ ID NO: 2181345 - RNA, 21 nt, Human
agcuguggguacagagagguc

SEQ ID NO: 2181346 - RNA, 20 nt, Human
agcuguguccuugcaccugc

SEQ ID NO: 2181347 - RNA, 18 nt, Human
agcuguguccuugcaccu

SEQ ID NO: 2181348 - RNA, 15 nt, Human
agcuguguccuugca

SEQ ID NO: 2181349 - RNA, 17 nt, Human
agcugugcucuggacag

SEQ ID NO: 2181350 - RNA, 18 nt, Human
agcugugcucuggacagg

SEQ ID NO: 2181351 - RNA, 21 nt, Human
agcugugccacccugggcucu

SEQ ID NO: 2181352 - RNA, 22 nt, Human
agcugugccacccugggcucug

SEQ ID NO: 2181353 - RNA, 19 nt, Human
agcuguggacuuuguucac

SEQ ID NO: 2181354 - RNA, 16 nt, Human
ugccuuaacuggagcc

SEQ ID NO: 2181355 - RNA, 17 nt, Human
ugccuuaaagucaguaa

SEQ ID NO: 2181356 - RNA, 22 nt, Human
ugccuguucaguuacagaaagu

SEQ ID NO: 2181357 - RNA, 20 nt, Human
ugccuuacccucauguucuu

SEQ ID NO: 2181358 - RNA, 16 nt, Human
ugccuguugggccagg

SEQ ID NO: 2181359 - RNA, 17 nt, Human
ugccuguugggccagga

SEQ ID NO: 2181360 - RNA, 19 nt, Human
ugccuugggcugcuccuca

SEQ ID NO: 2181361 - RNA, 18 nt, Human
ugccuuggggaauuuccu

SEQ ID NO: 2181362 - RNA, 19 nt, Human
ugccuuggggaauuuccuc

SEQ ID NO: 2181363 - RNA, 17 nt, Human
ugccuugggcugcuccu

SEQ ID NO: 2181364 - RNA, 16 nt, Human
ugccuugggcugcucc

SEQ ID NO: 2181365 - RNA, 16 nt, Human
ugccuuggggacaaga

SEQ ID NO: 2181366 - RNA, 17 nt, Human
ugccuuaccuccugccc

SEQ ID NO: 2181367 - RNA, 16 nt, Human
ugccuuaccuccugcc

SEQ ID NO: 2181368 - RNA, 15 nt, Human
ugccuuaccuccugc

SEQ ID NO: 2181369 - RNA, 14 nt, Human
ugccuuaccuccug

SEQ ID NO: 2181370 - RNA, 23 nt, Human
ugccuuaauaagaaugguugccu

SEQ ID NO: 2181371 - RNA, 21 nt, Human
ugccuuacccucauguucuua

SEQ ID NO: 2181372 - RNA, 16 nt, Human
ugccugugccacccac

SEQ ID NO: 2181373 - RNA, 17 nt, Human
ugccugugaggcagggg

SEQ ID NO: 2181374 - RNA, 14 nt, Human
ugccugugccaccc

SEQ ID NO: 2181375 - RNA, 23 nt, Human
agcugugugaaauaccagugugg

SEQ ID NO: 2181376 - RNA, 19 nt, Human
agcuguuauuucuauuuuu

SEQ ID NO: 2181377 - RNA, 20 nt, Human
ugccugugccacccaccagg

SEQ ID NO: 2181378 - RNA, 19 nt, Human
ugccugugccacccaccag

SEQ ID NO: 2181379 - RNA, 14 nt, Human
ugccuguggaacug

SEQ ID NO: 2181380 - RNA, 12 nt, Human
ugccugugccug

SEQ ID NO: 2181381 - RNA, 19 nt, Human
agcuguuacugucuucagu

SEQ ID NO: 2181382 - RNA, 14 nt, Human
agcuguucacagcc

SEQ ID NO: 2181383 - RNA, 14 nt, Human
ugccuguucccauu

SEQ ID NO: 2181384 - RNA, 18 nt, Human
ugccuguucaguuacaga

SEQ ID NO: 2181385 - RNA, 19 nt, Human
ugccuguucaguuacagaa

SEQ ID NO: 2181386 - RNA, 20 nt, Human
ugccuguucaguuacagaaa

SEQ ID NO: 2181387 - RNA, 21 nt, Human
ugccuguucaguuacagaaag

SEQ ID NO: 2181388 - RNA, 21 nt, Human
ugccuguguccaugcgcucag

SEQ ID NO: 2181389 - RNA, 22 nt, Human
ugccuguguccaugcgcucagg

SEQ ID NO: 2181390 - RNA, 12 nt, Human
ugccuguucagu

SEQ ID NO: 2181391 - RNA, 13 nt, Human
ugccuguucaguu

SEQ ID NO: 2181392 - RNA, 17 nt, Human
ugccuguucaguuacag

SEQ ID NO: 2181393 - RNA, 11 nt, Human
ugccuguggcg

SEQ ID NO: 2181394 - RNA, 19 nt, Human
ugccuguggaaucuggagu

SEQ ID NO: 2181395 - RNA, 21 nt, Human
ugccuguggaaucuggaguga

SEQ ID NO: 2181396 - RNA, 21 nt, Human
ugccuguggcgccgucuccag

SEQ ID NO: 2181397 - RNA, 22 nt, Human
ugccuguggcgccgucuccagg

SEQ ID NO: 2181398 - RNA, 23 nt, Human
ugccuguggcgccgucuccaggg

SEQ ID NO: 2181399 - RNA, 15 nt, Human
ugccuguguccaugc

SEQ ID NO: 2181400 - RNA, 19 nt, Human
ugccuguguccaugcgcuc

SEQ ID NO: 2181401 - RNA, 19 nt, Human
ugccucagcccugacccug

SEQ ID NO: 2181402 - RNA, 13 nt, Human
ugccuccacuccc

SEQ ID NO: 2181403 - RNA, 14 nt, Human
ugccuccacuccca

SEQ ID NO: 2181404 - RNA, 15 nt, Human
ugccuccacucccac

SEQ ID NO: 2181405 - RNA, 16 nt, Human
ugccuccacucccacu

SEQ ID NO: 2181406 - RNA, 17 nt, Human
ugccuccacucccacuu

SEQ ID NO: 2181407 - RNA, 14 nt, Human
ugccucagccuccc

SEQ ID NO: 2181408 - RNA, 17 nt, Human
ugccuccaggaaccaca

SEQ ID NO: 2181409 - RNA, 14 nt, Human
ugccuccaggaacc

SEQ ID NO: 2181410 - RNA, 19 nt, Human
ugccuccacucccacuucc

SEQ ID NO: 2181411 - RNA, 20 nt, Human
ugccuccacucccacuuccc

SEQ ID NO: 2181412 - RNA, 20 nt, Human
ugccuccaggaaccacacca

SEQ ID NO: 2181413 - RNA, 19 nt, Human
ugccuccaggaaccacacc

SEQ ID NO: 2181414 - RNA, 12 nt, Human
ugccuccagggc

SEQ ID NO: 2181415 - RNA, 14 nt, Human
ugccuccagggcug

SEQ ID NO: 2181416 - RNA, 15 nt, Human
ugccuccagggcugg

SEQ ID NO: 2181417 - RNA, 16 nt, Human
ugccuccagggcugga

SEQ ID NO: 2181418 - RNA, 17 nt, Human
ugccuccagggcuggac

SEQ ID NO: 2181419 - RNA, 18 nt, Human
ugccucugccucugacac

SEQ ID NO: 2181420 - RNA, 20 nt, Human
ugccucugccucugacacac

SEQ ID NO: 2181421 - RNA, 17 nt, Human
ugccucugccucugaca

SEQ ID NO: 2181422 - RNA, 18 nt, Human
ugccuccagggcuggacu

SEQ ID NO: 2181423 - RNA, 19 nt, Human
ugccuccagggcuggacug

SEQ ID NO: 2181424 - RNA, 20 nt, Human
ugccuccagggcuggacuga

SEQ ID NO: 2181425 - RNA, 21 nt, Human
ugccuccagggcuggacugag

SEQ ID NO: 2181426 - RNA, 22 nt, Human
ugccugcuuuuuauggccugug

SEQ ID NO: 2181427 - RNA, 20 nt, Human
ugccugcuuuuuauggccug

SEQ ID NO: 2181428 - RNA, 21 nt, Human
ugccugcuuuuuauggccugu

SEQ ID NO: 2181429 - RNA, 12 nt, Human
ugccucugccug

SEQ ID NO: 2181430 - RNA, 23 nt, Human
ugccuccagggcuggacugaggc

SEQ ID NO: 2181431 - RNA, 11 nt, Human
ugccuccaggu

SEQ ID NO: 2181432 - RNA, 20 nt, Human
ugccugcccaggccccugcc

SEQ ID NO: 2181433 - RNA, 22 nt, Human
ugccugcccaggccccugccac

SEQ ID NO: 2181434 - RNA, 23 nt, Human
ugccugcccaggccccugccacc

SEQ ID NO: 2181435 - RNA, 23 nt, Human
agcuggccgaggguccuggcucc

SEQ ID NO: 2181436 - RNA, 23 nt, Human
agcugcuucucccacuuggccaa

SEQ ID NO: 2181437 - RNA, 18 nt, Human
agcuggccgggagccuga

SEQ ID NO: 2181438 - RNA, 19 nt, Human
agcuggccgggagccugau

SEQ ID NO: 2181439 - RNA, 22 nt, Human
agcuggccgcgccaaauaaugu

SEQ ID NO: 2181440 - RNA, 16 nt, Human
agcuggccgugggccu

SEQ ID NO: 2181441 - RNA, 17 nt, Human
agcuggccgugggccug

SEQ ID NO: 2181442 - RNA, 15 nt, Human
agcuggcgucugucu

SEQ ID NO: 2181443 - RNA, 21 nt, Human
agcuggcgucaugcaaaguca

SEQ ID NO: 2181444 - RNA, 18 nt, Human
agcuggcgucugucuuca

SEQ ID NO: 2181445 - RNA, 19 nt, Human
agcuggccgugggccuggg

SEQ ID NO: 2181446 - RNA, 17 nt, Human
agcugcuggcuugcagu

SEQ ID NO: 2181447 - RNA, 14 nt, Human
agcugcuggcuugc

SEQ ID NO: 2181448 - RNA, 14 nt, Human
agcugcuggagacu

SEQ ID NO: 2181449 - RNA, 23 nt, Human
agcugcuggagacuccuaggcag

SEQ ID NO: 2181450 - RNA, 21 nt, Human
ugccuggacauuugccuugcu

SEQ ID NO: 2181451 - RNA, 23 nt, Human
ugccugcuuuucacugcugcaag

SEQ ID NO: 2181452 - RNA, 20 nt, Human
agcugcuugggcuucauccu

SEQ ID NO: 2181453 - RNA, 12 nt, Human
agcugcuucucc

SEQ ID NO: 2181454 - RNA, 22 nt, Human
agcugcuucucccacuuggcca

SEQ ID NO: 2181455 - RNA, 16 nt, Human
agcugcuugggcuuca

SEQ ID NO: 2181456 - RNA, 18 nt, Human
agcugccuguucagcucc

SEQ ID NO: 2181457 - RNA, 14 nt, Human
agcugccuguucag

SEQ ID NO: 2181458 - RNA, 16 nt, Human
agcugccuguucagcu

SEQ ID NO: 2181459 - RNA, 16 nt, Human
ugccuggauggggcug

SEQ ID NO: 2181460 - RNA, 17 nt, Human
ugccuggauggggcugc

SEQ ID NO: 2181461 - RNA, 20 nt, Human
ugccuggauggggcugcacc

SEQ ID NO: 2181462 - RNA, 21 nt, Human
ugccuggauggggcugcaccg

SEQ ID NO: 2181463 - RNA, 15 nt, Human
ugccauacuuugucu

SEQ ID NO: 2181464 - RNA, 22 nt, Human
ugccauaaaacauuaagaaaau

SEQ ID NO: 2181465 - RNA, 20 nt, Human
ugccauaaaacauuaagaaa

SEQ ID NO: 2181466 - RNA, 21 nt, Human
ugccauaaaacauuaagaaaa

SEQ ID NO: 2181467 - RNA, 23 nt, Human
ugccauaaaacauuaagaaaauc

SEQ ID NO: 2181468 - RNA, 13 nt, Human
ugccauagaguuu

SEQ ID NO: 2181469 - RNA, 18 nt, Human
ugccauagaguuuaacac

SEQ ID NO: 2181470 - RNA, 22 nt, Human
ugccauacuuugucugaaaaau

SEQ ID NO: 2181471 - RNA, 17 nt, Human
ugccauacuuugucuga

SEQ ID NO: 2181472 - RNA, 18 nt, Human
ugccauacuuugucugaa

SEQ ID NO: 2181473 - RNA, 17 nt, Human
ugccauagucacauggc

SEQ ID NO: 2181474 - RNA, 21 nt, Human
ugccauauugcacaugucuua

SEQ ID NO: 2181475 - RNA, 16 nt, Human
ugccauagucacaugg

SEQ ID NO: 2181476 - RNA, 21 nt, Human
ugccauagaguuuaacacaag

SEQ ID NO: 2181477 - RNA, 17 nt, Human
ugccauauuuucaccau

SEQ ID NO: 2181478 - RNA, 14 nt, Human
ugccauauuuucac

SEQ ID NO: 2181479 - RNA, 13 nt, Human
ugccauauuuuca

SEQ ID NO: 2181480 - RNA, 23 nt, Human
ugccaucaucuccugccuuccuc

SEQ ID NO: 2181481 - RNA, 16 nt, Human
ugccaucauguuuaca

SEQ ID NO: 2181482 - RNA, 16 nt, Human
ugccaucaucuccugc

SEQ ID NO: 2181483 - RNA, 15 nt, Human
ugccaucaucuccug

SEQ ID NO: 2181484 - RNA, 13 nt, Human
ugccaucaucucc

SEQ ID NO: 2181485 - RNA, 20 nt, Human
ugccauagaguuuaacacaa

SEQ ID NO: 2181486 - RNA, 14 nt, Human
agcucccaggccga

SEQ ID NO: 2181487 - RNA, 21 nt, Human
agcucccaggccgagaagcca

SEQ ID NO: 2181488 - RNA, 13 nt, Human
agcucccaggccg

SEQ ID NO: 2181489 - RNA, 13 nt, Human
agcucccaggaac

SEQ ID NO: 2181490 - RNA, 14 nt, Human
agcucccaggaaca

SEQ ID NO: 2181491 - RNA, 23 nt, Human
agcucccaggcauuccccaggag

SEQ ID NO: 2181492 - RNA, 17 nt, Human
agcucccauuucuacuc

SEQ ID NO: 2181493 - RNA, 15 nt, Human
agcuccuucuguccu

SEQ ID NO: 2181494 - RNA, 13 nt, Human
agcuccaguucga

SEQ ID NO: 2181495 - RNA, 13 nt, Human
agcuccaucucca

SEQ ID NO: 2181496 - RNA, 15 nt, Human
agcuccaucuccacu

SEQ ID NO: 2181497 - RNA, 16 nt, Human
agcuccaucuccacuc

SEQ ID NO: 2181498 - RNA, 12 nt, Human
agcucccaggaa

SEQ ID NO: 2181499 - RNA, 13 nt, Human
agcucccaggcau

SEQ ID NO: 2181500 - RNA, 22 nt, Human
agcuccuugggaggccccacug

SEQ ID NO: 2181501 - RNA, 16 nt, Human
agcucccauuucuacu

SEQ ID NO: 2181502 - RNA, 16 nt, Human
agcuccuucuguccua

SEQ ID NO: 2181503 - RNA, 21 nt, Human
agcuccuucuguccuacucug

SEQ ID NO: 2181504 - RNA, 20 nt, Human
agcucgguggacccagggau

SEQ ID NO: 2181505 - RNA, 17 nt, Human
agcucguguauccuggg

SEQ ID NO: 2181506 - RNA, 11 nt, Human
agcucucugca

SEQ ID NO: 2181507 - RNA, 18 nt, Human
agcucugaaaccaguguu

SEQ ID NO: 2181508 - RNA, 19 nt, Human
agcucgguggacccaggga

SEQ ID NO: 2181509 - RNA, 18 nt, Human
agcucgguggacccaggg

SEQ ID NO: 2181510 - RNA, 17 nt, Human
agcucgguggacccagg

SEQ ID NO: 2181511 - RNA, 16 nt, Human
agcucgguggacccag

SEQ ID NO: 2181512 - RNA, 15 nt, Human
agcucgguggaccca

SEQ ID NO: 2181513 - RNA, 14 nt, Human
agcucgguggaccc

SEQ ID NO: 2181514 - RNA, 12 nt, Human
agcucgguggac

SEQ ID NO: 2181515 - RNA, 20 nt, Human
agcucuggcuuccagaaaac

SEQ ID NO: 2181516 - RNA, 12 nt, Human
agcucuggcuuc

SEQ ID NO: 2181517 - RNA, 15 nt, Human
agcucugggagagga

SEQ ID NO: 2181518 - RNA, 18 nt, Human
agcucugggagaggauuu

SEQ ID NO: 2181519 - RNA, 23 nt, Human
agcucuggcugaacccugugcug

SEQ ID NO: 2181520 - RNA, 23 nt, Human
agcucugaagucacaucacagga

SEQ ID NO: 2181521 - RNA, 21 nt, Human
agcucugaagucacaucacag

SEQ ID NO: 2181522 - RNA, 19 nt, Human
agcucugaaaccaguguua

SEQ ID NO: 2181523 - RNA, 15 nt, Human
agcucucugcaucua

SEQ ID NO: 2181524 - RNA, 14 nt, Human
agcucuguccuggg

SEQ ID NO: 2181525 - RNA, 17 nt, Human
agcucugguccauagag

SEQ ID NO: 2181526 - RNA, 12 nt, Human
agcucuggucca

SEQ ID NO: 2181527 - RNA, 16 nt, Human
ugccucagcccugacc

SEQ ID NO: 2181528 - RNA, 15 nt, Human
ugccucagcccugac

SEQ ID NO: 2181529 - RNA, 18 nt, Human
ugccgcaccccagagugu

SEQ ID NO: 2181530 - RNA, 14 nt, Human
ugccgcagcccugc

SEQ ID NO: 2181531 - RNA, 12 nt, Human
ugccgcagcccu

SEQ ID NO: 2181532 - RNA, 12 nt, Human
ugccucagccuc

SEQ ID NO: 2181533 - RNA, 13 nt, Human
ugccucagccucc

SEQ ID NO: 2181534 - RNA, 15 nt, Human
ugccgcaccccagag

SEQ ID NO: 2181535 - RNA, 13 nt, Human
ugccgcaccccag

SEQ ID NO: 2181536 - RNA, 12 nt, Human
ugccgcacccca

SEQ ID NO: 2181537 - RNA, 22 nt, Human
ugccgcaauggccaugugggga

SEQ ID NO: 2181538 - RNA, 20 nt, Human
ugccgcaagucugcagcccg

SEQ ID NO: 2181539 - RNA, 17 nt, Human
ugccgcaauacaggaac

SEQ ID NO: 2181540 - RNA, 13 nt, Human
ugccgcagagcug

SEQ ID NO: 2181541 - RNA, 14 nt, Human
ugccgcagagcugg

SEQ ID NO: 2181542 - RNA, 15 nt, Human
ugccgcagagcuggc

SEQ ID NO: 2181543 - RNA, 17 nt, Human
ugccgcagagcuggccg

SEQ ID NO: 2181544 - RNA, 22 nt, Human
ugccgaccucguccucccccug

SEQ ID NO: 2181545 - RNA, 14 nt, Human
ugccgacuccuggg

SEQ ID NO: 2181546 - RNA, 15 nt, Human
ugccgacuccugggu

SEQ ID NO: 2181547 - RNA, 21 nt, Human
ugccgauauacucuagaugaa

SEQ ID NO: 2181548 - RNA, 21 nt, Human
ugccgaccucguccucccccu

SEQ ID NO: 2181549 - RNA, 17 nt, Human
ugccgaccucguccucc

SEQ ID NO: 2181550 - RNA, 15 nt, Human
ugccgaccucguccu

SEQ ID NO: 2181551 - RNA, 14 nt, Human
ugccgaccucgucc

SEQ ID NO: 2181552 - RNA, 23 nt, Human
ugccgaccgaggcuggagcuggc

SEQ ID NO: 2181553 - RNA, 22 nt, Human
ugccgaccgaggcuggagcugg

SEQ ID NO: 2181554 - RNA, 16 nt, Human
ugccgaccgaggcugg

SEQ ID NO: 2181555 - RNA, 15 nt, Human
ugccgaccgaggcug

SEQ ID NO: 2181556 - RNA, 22 nt, Human
ugccgaccagagccccacacgg

SEQ ID NO: 2181557 - RNA, 21 nt, Human
ugccgaccagagccccacacg

SEQ ID NO: 2181558 - RNA, 15 nt, Human
ugccgaccagagccc

SEQ ID NO: 2181559 - RNA, 15 nt, Human
ugccgacagaaggaa

SEQ ID NO: 2181560 - RNA, 18 nt, Human
ugcccuuacacuuacugu

SEQ ID NO: 2181561 - RNA, 20 nt, Human
ugcccuuacacuuacuguug

SEQ ID NO: 2181562 - RNA, 15 nt, Human
ugcccuuaaaucaua

SEQ ID NO: 2181563 - RNA, 19 nt, Human
ugcccuguuguguauagau

SEQ ID NO: 2181564 - RNA, 20 nt, Human
ugcccuguuguguauagaug

SEQ ID NO: 2181565 - RNA, 22 nt, Human
ugccgaaugugcagguuuguua

SEQ ID NO: 2181566 - RNA, 18 nt, Human
ugcccuuaccugccagga

SEQ ID NO: 2181567 - RNA, 22 nt, Human
agcugcccuccuuguccaccca

SEQ ID NO: 2181568 - RNA, 17 nt, Human
ugcccuguucucuacca

SEQ ID NO: 2181569 - RNA, 19 nt, Human
ugcccuguucucuaccaag

SEQ ID NO: 2181570 - RNA, 20 nt, Human
ugcccuguuaaaagaugaaa

SEQ ID NO: 2181571 - RNA, 16 nt, Human
agcugcagagccaccc

SEQ ID NO: 2181572 - RNA, 17 nt, Human
agcugccauccagggau

SEQ ID NO: 2181573 - RNA, 16 nt, Human
agcugccccagccaga

SEQ ID NO: 2181574 - RNA, 14 nt, Human
agcugccccagcca

SEQ ID NO: 2181575 - RNA, 15 nt, Human
agcugccccagccag

SEQ ID NO: 2181576 - RNA, 14 nt, Human
agcugcccagaguu

SEQ ID NO: 2181577 - RNA, 18 nt, Human
agcugcccagaguugcug

SEQ ID NO: 2181578 - RNA, 20 nt, Human
agcugccccggggaggggcg

SEQ ID NO: 2181579 - RNA, 14 nt, Human
agcugccccuggcu

SEQ ID NO: 2181580 - RNA, 11 nt, Human
agcugcccucc

SEQ ID NO: 2181581 - RNA, 11 nt, Human
agcugcagaac

SEQ ID NO: 2181582 - RNA, 15 nt, Human
agcugcagagacaga

SEQ ID NO: 2181583 - RNA, 22 nt, Human
agcugcacugaugcugccccuc

SEQ ID NO: 2181584 - RNA, 20 nt, Human
agcugcacugaugcugcccc

SEQ ID NO: 2181585 - RNA, 17 nt, Human
agcugcagagacagaga

SEQ ID NO: 2181586 - RNA, 18 nt, Human
agcugcagagacagagag

SEQ ID NO: 2181587 - RNA, 19 nt, Human
agcugcagagacagagagg

SEQ ID NO: 2181588 - RNA, 13 nt, Human
agcugcagagcca

SEQ ID NO: 2181589 - RNA, 20 nt, Human
agcugccagccgagauagcc

SEQ ID NO: 2181590 - RNA, 18 nt, Human
agcugcaagugacaucuc

SEQ ID NO: 2181591 - RNA, 15 nt, Human
agcugcaagugacau

SEQ ID NO: 2181592 - RNA, 21 nt, Human
agcugcaagugacaucucuuu

SEQ ID NO: 2181593 - RNA, 11 nt, Human
agcugcacuga

SEQ ID NO: 2181594 - RNA, 19 nt, Human
agcugcacugaugcugccc

SEQ ID NO: 2181595 - RNA, 17 nt, Human
agcugcacugaugcugc

SEQ ID NO: 2181596 - RNA, 15 nt, Human
agcugcacagggcag

SEQ ID NO: 2181597 - RNA, 19 nt, Human
agcugcacagggcagcugg

SEQ ID NO: 2181598 - RNA, 20 nt, Human
agcugcacagggcagcuggg

SEQ ID NO: 2181599 - RNA, 21 nt, Human
agcugcacagggcagcugggc

SEQ ID NO: 2181600 - RNA, 22 nt, Human
agcugcacagggcagcugggcc

SEQ ID NO: 2181601 - RNA, 23 nt, Human
agcugcacagggcagcugggccc

SEQ ID NO: 2181602 - RNA, 24 nt, Human
agcugcacagggcagcugggccca

SEQ ID NO: 2181603 - RNA, 16 nt, Human
agcucuguccugggag

SEQ ID NO: 2181604 - RNA, 21 nt, Human
agcucuguccugggagugagc

SEQ ID NO: 2181605 - RNA, 20 nt, Human
agcugauuuuaacaauaacu

SEQ ID NO: 2181606 - RNA, 13 nt, Human
agcugcaaaggac

SEQ ID NO: 2181607 - RNA, 19 nt, Human
agcugcaaaggacagaucc

SEQ ID NO: 2181608 - RNA, 16 nt, Human
agcugcaaaggacaga

SEQ ID NO: 2181609 - RNA, 15 nt, Human
agcugcaaaggacag

SEQ ID NO: 2181610 - RNA, 14 nt, Human
agcugcaaaggaca

SEQ ID NO: 2181611 - RNA, 23 nt, Human
agcucuguccugggagugagcug

SEQ ID NO: 2181612 - RNA, 16 nt, Human
aggaagaucuuaaauu

SEQ ID NO: 2181613 - RNA, 16 nt, Human
aggaagcaaacuaagc

SEQ ID NO: 2181614 - RNA, 19 nt, Human
aggaagaugggggcaagaa

SEQ ID NO: 2181615 - RNA, 20 nt, Human
aggaagaugggggcaagaag

SEQ ID NO: 2181616 - RNA, 18 nt, Human
aggaagaucuuaaauuuu

SEQ ID NO: 2181617 - RNA, 15 nt, Human
aggaagaugaaagag

SEQ ID NO: 2181618 - RNA, 17 nt, Human
aggaagaugaaagagga

SEQ ID NO: 2181619 - RNA, 18 nt, Human
aggaagaugggggcaaga

SEQ ID NO: 2181620 - RNA, 19 nt, Human
aggaagcaacgaagggaaa

SEQ ID NO: 2181621 - RNA, 21 nt, Human
aggaagcagaauaaagcaauu

SEQ ID NO: 2181622 - RNA, 22 nt, Human
aggaagcagaauaaagcaauuu

SEQ ID NO: 2181623 - RNA, 23 nt, Human
aggaagcagaauaaagcaauuuu

SEQ ID NO: 2181624 - RNA, 13 nt, Human
aggaagcaacgaa

SEQ ID NO: 2181625 - RNA, 22 nt, Human
aggaagaugggggcaagaagau

SEQ ID NO: 2181626 - RNA, 18 nt, Human
aggaagcauucagagagc

SEQ ID NO: 2181627 - RNA, 19 nt, Human
aggaagcauucagagagca

SEQ ID NO: 2181628 - RNA, 18 nt, Human
aggaagcagcuuucccca

SEQ ID NO: 2181629 - RNA, 13 nt, Human
aggaagccagcag

SEQ ID NO: 2181630 - RNA, 15 nt, Human
aggaagccaaagagu

SEQ ID NO: 2181631 - RNA, 13 nt, Human
aggaagcucaggg

SEQ ID NO: 2181632 - RNA, 14 nt, Human
aggaagcucagggc

SEQ ID NO: 2181633 - RNA, 15 nt, Human
aggaagccacagcug

SEQ ID NO: 2181634 - RNA, 16 nt, Human
aggaagccacagcugg

SEQ ID NO: 2181635 - RNA, 16 nt, Human
aggaagcucagggccu

SEQ ID NO: 2181636 - RNA, 15 nt, Human
aggaagcucagggcc

SEQ ID NO: 2181637 - RNA, 18 nt, Human
aggaagccacagcuggug

SEQ ID NO: 2181638 - RNA, 17 nt, Human
aggaaggaugagcauuu

SEQ ID NO: 2181639 - RNA, 14 nt, Human
aggaaggaugagca

SEQ ID NO: 2181640 - RNA, 14 nt, Human
aggaaggauuguaa

SEQ ID NO: 2181641 - RNA, 15 nt, Human
aggaaggauuguaaa

SEQ ID NO: 2181642 - RNA, 14 nt, Human
aggaaggcaagagg

SEQ ID NO: 2181643 - RNA, 15 nt, Human
aggaaggcaggaaga

SEQ ID NO: 2181644 - RNA, 17 nt, Human
aggaaggcaggaagaga

SEQ ID NO: 2181645 - RNA, 16 nt, Human
aggaaggauuguaaaa

SEQ ID NO: 2181646 - RNA, 17 nt, Human
aggaaggauuguaaaaa

SEQ ID NO: 2181647 - RNA, 18 nt, Human
aggaaggauuguaaaaaa

SEQ ID NO: 2181648 - RNA, 13 nt, Human
aggaaggcaagag

SEQ ID NO: 2181649 - RNA, 23 nt, Human
aggaauuaaguuagggaauggca

SEQ ID NO: 2181650 - RNA, 22 nt, Human
aggaauguuaaagucaguggga

SEQ ID NO: 2181651 - RNA, 22 nt, Human
aggaauucccagcccaaagcug

SEQ ID NO: 2181652 - RNA, 17 nt, Human
aggaauuaaguuaucuu

SEQ ID NO: 2181653 - RNA, 18 nt, Human
aggaauguagcugguuuc

SEQ ID NO: 2181654 - RNA, 21 nt, Human
aggaaugggggccucuucaaa

SEQ ID NO: 2181655 - RNA, 13 nt, Human
aggaaugggcugu

SEQ ID NO: 2181656 - RNA, 20 nt, Human
aggaaugggggccucuucaa

SEQ ID NO: 2181657 - RNA, 14 nt, Human
aggaauguuaaagu

SEQ ID NO: 2181658 - RNA, 16 nt, Human
aggaauguguggccug

SEQ ID NO: 2181659 - RNA, 19 nt, Human
aggaaggcaggaagagagc

SEQ ID NO: 2181660 - RNA, 13 nt, Human
aggaaggcggggc

SEQ ID NO: 2181661 - RNA, 20 nt, Human
aggaaggcucuucuccccag

SEQ ID NO: 2181662 - RNA, 21 nt, Human
aggaaggcucuucuccccaga

SEQ ID NO: 2181663 - RNA, 22 nt, Human
ugcugagagacccaaggaggaa

SEQ ID NO: 2181664 - RNA, 20 nt, Human
ugcugagauuacagguguga

SEQ ID NO: 2181665 - RNA, 21 nt, Human
ugcugagagacccaaggagga

SEQ ID NO: 2181666 - RNA, 18 nt, Human
ugcugagagacccaagga

SEQ ID NO: 2181667 - RNA, 17 nt, Human
ugcugagagacccaagg

SEQ ID NO: 2181668 - RNA, 15 nt, Human
ugcugagagacccaa

SEQ ID NO: 2181669 - RNA, 23 nt, Human
ugcugagagaaauauggaacuua

SEQ ID NO: 2181670 - RNA, 17 nt, Human
ugcugagaagcuuuuga

SEQ ID NO: 2181671 - RNA, 14 nt, Human
ugcugagagaaaua

SEQ ID NO: 2181672 - RNA, 14 nt, Human
ugcugagccucugc

SEQ ID NO: 2181673 - RNA, 12 nt, Human
ugcugagccucu

SEQ ID NO: 2181674 - RNA, 17 nt, Human
ugcugagccucugcucc

SEQ ID NO: 2181675 - RNA, 16 nt, Human
ugcugagccucugcuc

SEQ ID NO: 2181676 - RNA, 20 nt, Human
ugcugagccucugcucccca

SEQ ID NO: 2181677 - RNA, 23 nt, Human
ugcugagccuguaaaauaaaagg

SEQ ID NO: 2181678 - RNA, 13 nt, Human
aggaaagggaagg

SEQ ID NO: 2181679 - RNA, 19 nt, Human
aggaaagggggucccagug

SEQ ID NO: 2181680 - RNA, 21 nt, Human
aggaaagggggucccaguggg

SEQ ID NO: 2181681 - RNA, 13 nt, Human
aggaaagucauug

SEQ ID NO: 2181682 - RNA, 23 nt, Human
aggaaaggcuccaggagcagcca

SEQ ID NO: 2181683 - RNA, 17 nt, Human
ugcugaggccugggccg

SEQ ID NO: 2181684 - RNA, 17 nt, Human
ugcugaggccuccagcu

SEQ ID NO: 2181685 - RNA, 16 nt, Human
ugcugaggcucugacc

SEQ ID NO: 2181686 - RNA, 13 nt, Human
ugcugaggccugg

SEQ ID NO: 2181687 - RNA, 14 nt, Human
ugcugaggccuggg

SEQ ID NO: 2181688 - RNA, 15 nt, Human
ugcugaggccugggc

SEQ ID NO: 2181689 - RNA, 16 nt, Human
ugcugaggccugggcc

SEQ ID NO: 2181690 - RNA, 14 nt, Human
aggaagagggacag

SEQ ID NO: 2181691 - RNA, 21 nt, Human
aggaagaguagcauuucauuc

SEQ ID NO: 2181692 - RNA, 16 nt, Human
aggaaauaaaaccuuu

SEQ ID NO: 2181693 - RNA, 22 nt, Human
aggaaaucaaauaugcaaagca

SEQ ID NO: 2181694 - RNA, 21 nt, Human
aggaaaucaaauaugcaaagc

SEQ ID NO: 2181695 - RNA, 22 nt, Human
aggaaagucauuggcuuuaucc

SEQ ID NO: 2181696 - RNA, 23 nt, Human
aggaaagucauuggcuuuauccu

SEQ ID NO: 2181697 - RNA, 16 nt, Human
aggaaagucauuggcu

SEQ ID NO: 2181698 - RNA, 17 nt, Human
aggaaagucauuggcuu

SEQ ID NO: 2181699 - RNA, 19 nt, Human
aggaaagucauuggcuuua

SEQ ID NO: 2181700 - RNA, 20 nt, Human
aggaaagucauuggcuuuau

SEQ ID NO: 2181701 - RNA, 17 nt, Human
aggaaauaaaaccuuuc

SEQ ID NO: 2181702 - RNA, 14 nt, Human
aggaaauaaaaccu

SEQ ID NO: 2181703 - RNA, 20 nt, Human
aggaaaucaaauaugcaaag

SEQ ID NO: 2181704 - RNA, 15 nt, Human
aggaaacaacagcuu

SEQ ID NO: 2181705 - RNA, 14 nt, Human
aggaaacaacagcu

SEQ ID NO: 2181706 - RNA, 21 nt, Human
aggaaacaaagcuuagcagga

SEQ ID NO: 2181707 - RNA, 12 nt, Human
aggaaacaguua

SEQ ID NO: 2181708 - RNA, 13 nt, Human
aggaaaauuucac

SEQ ID NO: 2181709 - RNA, 15 nt, Human
aggaaaaugaucuga

SEQ ID NO: 2181710 - RNA, 16 nt, Human
aggaaaagcugcugac

SEQ ID NO: 2181711 - RNA, 13 nt, Human
ugcuaucuccccc

SEQ ID NO: 2181712 - RNA, 22 nt, Human
ugcuaucgcaccacuguguauu

SEQ ID NO: 2181713 - RNA, 16 nt, Human
aggaaaccacagcugc

SEQ ID NO: 2181714 - RNA, 17 nt, Human
aggaaaccacagcugcu

SEQ ID NO: 2181715 - RNA, 14 nt, Human
ugcuaucuccccca

SEQ ID NO: 2181716 - RNA, 17 nt, Human
ugcuaucucccccagcc

SEQ ID NO: 2181717 - RNA, 15 nt, Human
ugcucaaaaaaugag

SEQ ID NO: 2181718 - RNA, 15 nt, Human
ugcucaaaaaucugu

SEQ ID NO: 2181719 - RNA, 14 nt, Human
ugcucaagaaacaa

SEQ ID NO: 2181720 - RNA, 14 nt, Human
ugcucaagaagaca

SEQ ID NO: 2181721 - RNA, 19 nt, Human
ugcucaaaucuauucagac

SEQ ID NO: 2181722 - RNA, 21 nt, Human
ugcucaaaucuauucagacaa

SEQ ID NO: 2181723 - RNA, 14 nt, Human
ugcucaaaauuuga

SEQ ID NO: 2181724 - RNA, 18 nt, Human
ugcucaaaauuugaagaa

SEQ ID NO: 2181725 - RNA, 21 nt, Human
ugcucaaaauuugaagaauga

SEQ ID NO: 2181726 - RNA, 19 nt, Human
ugcucaaaauuugaagaau

SEQ ID NO: 2181727 - RNA, 18 nt, Human
ugcucaaaucuauucaga

SEQ ID NO: 2181728 - RNA, 13 nt, Human
ugcuaugaaugau

SEQ ID NO: 2181729 - RNA, 20 nt, Human
aggaaaccacagcugcugga

SEQ ID NO: 2181730 - RNA, 22 nt, Human
ugcuaugagcuggggaugucuc

SEQ ID NO: 2181731 - RNA, 19 nt, Human
ugcuauggggagaaaagac

SEQ ID NO: 2181732 - RNA, 18 nt, Human
ugcuauggggagaaaaga

SEQ ID NO: 2181733 - RNA, 12 nt, Human
ugcuauggggag

SEQ ID NO: 2181734 - RNA, 16 nt, Human
ugcuauggauggcuuc

SEQ ID NO: 2181735 - RNA, 18 nt, Human
ugcuaucucccccagccc

SEQ ID NO: 2181736 - RNA, 16 nt, Human
ugcuaugagcugggga

SEQ ID NO: 2181737 - RNA, 20 nt, Human
ugcuaugagcuggggauguc

SEQ ID NO: 2181738 - RNA, 19 nt, Human
ugcuaugagcuggggaugu

SEQ ID NO: 2181739 - RNA, 21 nt, Human
ugcuccagcuguucagcuggu

SEQ ID NO: 2181740 - RNA, 20 nt, Human
ugcuccagcuguucagcugg

SEQ ID NO: 2181741 - RNA, 22 nt, Human
ugcuccaggcaggcuaaggcgu

SEQ ID NO: 2181742 - RNA, 23 nt, Human
ugcuccagucaacaaacuauuuc

SEQ ID NO: 2181743 - RNA, 12 nt, Human
ugcuccaggcag

SEQ ID NO: 2181744 - RNA, 14 nt, Human
ugcuccaggcaggc

SEQ ID NO: 2181745 - RNA, 12 nt, Human
ugcucuccuuuc

SEQ ID NO: 2181746 - RNA, 19 nt, Human
ugcucucgcaccuuuccaa

SEQ ID NO: 2181747 - RNA, 15 nt, Human
ugcucucugcagcca

SEQ ID NO: 2181748 - RNA, 14 nt, Human
ugcucucugcagcc

SEQ ID NO: 2181749 - RNA, 13 nt, Human
ugcucucugcagc

SEQ ID NO: 2181750 - RNA, 22 nt, Human
ugcucucgcaccuuuccaaagu

SEQ ID NO: 2181751 - RNA, 21 nt, Human
ugcucucugcagccagcccag

SEQ ID NO: 2181752 - RNA, 12 nt, Human
ugcucucugcca

SEQ ID NO: 2181753 - RNA, 20 nt, Human
ugcucucugcagccagccca

SEQ ID NO: 2181754 - RNA, 17 nt, Human
ugcucucugcagccagc

SEQ ID NO: 2181755 - RNA, 22 nt, Human
ugcucugaauuaguccuugcuu

SEQ ID NO: 2181756 - RNA, 13 nt, Human
ugcucucugccac

SEQ ID NO: 2181757 - RNA, 16 nt, Human
ugcucugaggcuucca

SEQ ID NO: 2181758 - RNA, 17 nt, Human
ugcucugaggcuuccag

SEQ ID NO: 2181759 - RNA, 18 nt, Human
ugcucugaggcuuccaga

SEQ ID NO: 2181760 - RNA, 20 nt, Human
ugcucugaggcuuccagaga

SEQ ID NO: 2181761 - RNA, 11 nt, Human
ugcucugcccu

SEQ ID NO: 2181762 - RNA, 12 nt, Human
ugcucugcccuu

SEQ ID NO: 2181763 - RNA, 13 nt, Human
ugcucuucagugg

SEQ ID NO: 2181764 - RNA, 13 nt, Human
ugcucuucugugg

SEQ ID NO: 2181765 - RNA, 15 nt, Human
ugcucuugaacuccu

SEQ ID NO: 2181766 - RNA, 22 nt, Human
ugcucuugaacuccugaccuca

SEQ ID NO: 2181767 - RNA, 20 nt, Human
ugcucuugaacuccugaccu

SEQ ID NO: 2181768 - RNA, 23 nt, Human
ugcucuucuguggaccacugcau

SEQ ID NO: 2181769 - RNA, 14 nt, Human
ugcucuucuuuaga

SEQ ID NO: 2181770 - RNA, 14 nt, Human
ugcugagaagcuuu

SEQ ID NO: 2181771 - RNA, 15 nt, Human
ugcugagaaaacaug

SEQ ID NO: 2181772 - RNA, 14 nt, Human
ugcucugcugacag

SEQ ID NO: 2181773 - RNA, 15 nt, Human
ugcucugcugacaga

SEQ ID NO: 2181774 - RNA, 23 nt, Human
ugcucugcgugucaccugugcuu

SEQ ID NO: 2181775 - RNA, 22 nt, Human
ugcucugcgugucaccugugcu

SEQ ID NO: 2181776 - RNA, 14 nt, Human
ugcucuucaagaaa

SEQ ID NO: 2181777 - RNA, 18 nt, Human
ugcucuuagcugucugcu

SEQ ID NO: 2181778 - RNA, 20 nt, Human
aggaaaagcggacaucagcu

SEQ ID NO: 2181779 - RNA, 17 nt, Human
aggaaaagccucugugu

SEQ ID NO: 2181780 - RNA, 19 nt, Human
aggaaaagccucuguguca

SEQ ID NO: 2181781 - RNA, 16 nt, Human
aggaaaagcaaauuga

SEQ ID NO: 2181782 - RNA, 14 nt, Human
aggaaaagccucug

SEQ ID NO: 2181783 - RNA, 15 nt, Human
aggaaaagccucugu

SEQ ID NO: 2181784 - RNA, 14 nt, Human
aggaaaagcugcug

SEQ ID NO: 2181785 - RNA, 13 nt, Human
aggaaaagaaaag

SEQ ID NO: 2181786 - RNA, 21 nt, Human
agcuuuggcuaugagggccuu

SEQ ID NO: 2181787 - RNA, 17 nt, Human
agcuuuggugcaauggc

SEQ ID NO: 2181788 - RNA, 20 nt, Human
agcuuugcuucucucucuaa

SEQ ID NO: 2181789 - RNA, 22 nt, Human
agcuuugcugcugaaggcucau

SEQ ID NO: 2181790 - RNA, 13 nt, Human
agcuuugcugcug

SEQ ID NO: 2181791 - RNA, 23 nt, Human
agcuuugcucuuugguagaaaag

SEQ ID NO: 2181792 - RNA, 12 nt, Human
agcuuugcugcu

SEQ ID NO: 2181793 - RNA, 13 nt, Human
agcuuugcugcua

SEQ ID NO: 2181794 - RNA, 21 nt, Human
agcuuugcucuuugguagaaa

SEQ ID NO: 2181795 - RNA, 18 nt, Human
agcuuugcucuuugguag

SEQ ID NO: 2181796 - RNA, 16 nt, Human
agcuuuggaaacagga

SEQ ID NO: 2181797 - RNA, 18 nt, Human
agcuuuggaccuaaucca

SEQ ID NO: 2181798 - RNA, 19 nt, Human
agcuuuggaccuaauccaa

SEQ ID NO: 2181799 - RNA, 20 nt, Human
agcuuuggcuaugagggccu

SEQ ID NO: 2181800 - RNA, 15 nt, Human
agcuuugauuuuuac

SEQ ID NO: 2181801 - RNA, 22 nt, Human
agcuuugagguggaagagggcu

SEQ ID NO: 2181802 - RNA, 20 nt, Human
agcuuuccugccccaggccu

SEQ ID NO: 2181803 - RNA, 21 nt, Human
agcuuuccugccccaggccug

SEQ ID NO: 2181804 - RNA, 22 nt, Human
agcuuuccugccccaggccuga

SEQ ID NO: 2181805 - RNA, 23 nt, Human
agcuuuccugccccaggccugaa

SEQ ID NO: 2181806 - RNA, 10 nt, Human
agcuuugcuc

SEQ ID NO: 2181807 - RNA, 21 nt, Human
agcuuugcuaccaaagcaccu

SEQ ID NO: 2181808 - RNA, 16 nt, Human
agcuuugcuaccaaag

SEQ ID NO: 2181809 - RNA, 10 nt, Human
agcuuugcua

SEQ ID NO: 2181810 - RNA, 18 nt, Human
agcuuugcauguuccacu

SEQ ID NO: 2181811 - RNA, 22 nt, Human
agcuuugcauguuccacuaacc

SEQ ID NO: 2181812 - RNA, 16 nt, Human
agcuuugccagcugcu

SEQ ID NO: 2181813 - RNA, 17 nt, Human
agcuuugccagcugcug

SEQ ID NO: 2181814 - RNA, 19 nt, Human
agcuuugccagcugcugcu

SEQ ID NO: 2181815 - RNA, 20 nt, Human
agcuuugccagcugcugcug

SEQ ID NO: 2181816 - RNA, 15 nt, Human
agcuuugcccaacac

SEQ ID NO: 2181817 - RNA, 22 nt, Human
agcuuugcccaacaccagcccc

SEQ ID NO: 2181818 - RNA, 22 nt, Human
agcuuuccccaugucucgacuc

SEQ ID NO: 2181819 - RNA, 16 nt, Human
agcuuucccugccucu

SEQ ID NO: 2181820 - RNA, 12 nt, Human
agcuuucccugc

SEQ ID NO: 2181821 - RNA, 12 nt, Human
agcuuuccugcc

SEQ ID NO: 2181822 - RNA, 13 nt, Human
agcuuuccugccc

SEQ ID NO: 2181823 - RNA, 14 nt, Human
agcuuuccugcccc

SEQ ID NO: 2181824 - RNA, 15 nt, Human
agcuuuccugcccca

SEQ ID NO: 2181825 - RNA, 22 nt, Human
agcuuucauguaaacugugcac

SEQ ID NO: 2181826 - RNA, 16 nt, Human
agcuuuccauguugcu

SEQ ID NO: 2181827 - RNA, 17 nt, Human
agcuuuccauguugcug

SEQ ID NO: 2181828 - RNA, 21 nt, Human
agcuuucccaaauaaacucua

SEQ ID NO: 2181829 - RNA, 19 nt, Human
agcuuuccauguugcugcc

SEQ ID NO: 2181830 - RNA, 20 nt, Human
agcuuuccauguugcugcca

SEQ ID NO: 2181831 - RNA, 15 nt, Human
agcuuucaauuccgu

SEQ ID NO: 2181832 - RNA, 15 nt, Human
agcuuacaagccagc

SEQ ID NO: 2181833 - RNA, 17 nt, Human
agcuuacaagccagcug

SEQ ID NO: 2181834 - RNA, 20 nt, Human
agcuugaccgugaggccaga

SEQ ID NO: 2181835 - RNA, 22 nt, Human
agcuugaccgugaggccagaga

SEQ ID NO: 2181836 - RNA, 18 nt, Human
agcuugauaaagggccaa

SEQ ID NO: 2181837 - RNA, 14 nt, Human
agcuugccccggcc

SEQ ID NO: 2181838 - RNA, 18 nt, Human
agcuugccccggccccgg

SEQ ID NO: 2181839 - RNA, 20 nt, Human
agcuugcccuggugccucac

SEQ ID NO: 2181840 - RNA, 22 nt, Human
agcuugaggguugggcuggugu

SEQ ID NO: 2181841 - RNA, 14 nt, Human
agcuugaccugagg

SEQ ID NO: 2181842 - RNA, 16 nt, Human
agcuugaccugaggcu

SEQ ID NO: 2181843 - RNA, 23 nt, Human
agcuugaccgugaggccagagac

SEQ ID NO: 2181844 - RNA, 14 nt, Human
agcuugcucuucag

SEQ ID NO: 2181845 - RNA, 15 nt, Human
agcuugcucacaucu

SEQ ID NO: 2181846 - RNA, 17 nt, Human
agcuugcucacaucuug

SEQ ID NO: 2181847 - RNA, 23 nt, Human
agcuugcguuagaaugaggagga

SEQ ID NO: 2181848 - RNA, 23 nt, Human
agcuugcgcauucucauggagaa

SEQ ID NO: 2181849 - RNA, 21 nt, Human
agcuugcgcauucucauggag

SEQ ID NO: 2181850 - RNA, 22 nt, Human
agcuugcgcauucucauggaga

SEQ ID NO: 2181851 - RNA, 19 nt, Human
agcuugcccuguuaaaaga

SEQ ID NO: 2181852 - RNA, 18 nt, Human
agcuugcccuguuaaaag

SEQ ID NO: 2181853 - RNA, 16 nt, Human
agcuugcccuguuaaa

SEQ ID NO: 2181854 - RNA, 22 nt, Human
agcuuguccaacccgaggcccg

SEQ ID NO: 2181855 - RNA, 20 nt, Human
agcuuguauaguguaaaaua

SEQ ID NO: 2181856 - RNA, 12 nt, Human
agcuuguauuuu

SEQ ID NO: 2181857 - RNA, 18 nt, Human
agcuuguauaguguaaaa

SEQ ID NO: 2181858 - RNA, 21 nt, Human
agcuuguauaguguaaaauaa

SEQ ID NO: 2181859 - RNA, 16 nt, Human
agcuugcugcccuagg

SEQ ID NO: 2181860 - RNA, 22 nt, Human
agcuugcucuucagugggagaa

SEQ ID NO: 2181861 - RNA, 19 nt, Human
agcuugcucuucaguggga

SEQ ID NO: 2181862 - RNA, 22 nt, Human
agcuugucuaugguacaaaaau

SEQ ID NO: 2181863 - RNA, 22 nt, Human
agcuuguauuuugugaagacug

SEQ ID NO: 2181864 - RNA, 23 nt, Human
agcuuguccaacccgaggcccgc

SEQ ID NO: 2181865 - RNA, 19 nt, Human
agcuugugcacaauucugu

SEQ ID NO: 2181866 - RNA, 14 nt, Human
agcuuguggagccc

SEQ ID NO: 2181867 - RNA, 17 nt, Human
agcuuguggagccccac

SEQ ID NO: 2181868 - RNA, 18 nt, Human
agcuuguggagccccaca

SEQ ID NO: 2181869 - RNA, 16 nt, Human
agcuuguuauuuauaa

SEQ ID NO: 2181870 - RNA, 17 nt, Human
agcuuguucccugucuu

SEQ ID NO: 2181871 - RNA, 20 nt, Human
agcuuguguauccauuauca

SEQ ID NO: 2181872 - RNA, 12 nt, Human
agcuuguguauc

SEQ ID NO: 2181873 - RNA, 19 nt, Human
ugcuaaucagugucucaca

SEQ ID NO: 2181874 - RNA, 17 nt, Human
ugcuaaucuucagggca

SEQ ID NO: 2181875 - RNA, 13 nt, Human
ugcuaaucuucuu

SEQ ID NO: 2181876 - RNA, 22 nt, Human
ugcuaaucuucuuaugcaauuu

SEQ ID NO: 2181877 - RNA, 20 nt, Human
ugcuaaucuucuuaugcaau

SEQ ID NO: 2181878 - RNA, 18 nt, Human
ugcuaauuuauccugaaa

SEQ ID NO: 2181879 - RNA, 12 nt, Human
ugcuaauaaaac

SEQ ID NO: 2181880 - RNA, 21 nt, Human
ugcuaauauaaguuucuuugc

SEQ ID NO: 2181881 - RNA, 17 nt, Human
ugcuaagugugaacugg

SEQ ID NO: 2181882 - RNA, 19 nt, Human
ugcuaagugugaacuggac

SEQ ID NO: 2181883 - RNA, 22 nt, Human
ugcuaaucagggaggucauuuu

SEQ ID NO: 2181884 - RNA, 23 nt, Human
ugcuaaucagggaggucauuuug

SEQ ID NO: 2181885 - RNA, 13 nt, Human
ugcuaaucagugu

SEQ ID NO: 2181886 - RNA, 14 nt, Human
ugcuaaucaguguc

SEQ ID NO: 2181887 - RNA, 18 nt, Human
ugcuaaguauuucccagc

SEQ ID NO: 2181888 - RNA, 18 nt, Human
ugcgguagccagcacaca

SEQ ID NO: 2181889 - RNA, 17 nt, Human
ugcggguuugaggauag

SEQ ID NO: 2181890 - RNA, 17 nt, Human
ugcgguauccgccccca

SEQ ID NO: 2181891 - RNA, 13 nt, Human
ugcuaagugugaa

SEQ ID NO: 2181892 - RNA, 14 nt, Human
ugcuaagugugaac

SEQ ID NO: 2181893 - RNA, 15 nt, Human
ugcuaagugugaacu

SEQ ID NO: 2181894 - RNA, 16 nt, Human
ugcuaagugugaacug

SEQ ID NO: 2181895 - RNA, 14 nt, Human
ugcgguccacccag

SEQ ID NO: 2181896 - RNA, 15 nt, Human
ugcgguccacccagg

SEQ ID NO: 2181897 - RNA, 17 nt, Human
ugcgguagccagcacac

SEQ ID NO: 2181898 - RNA, 16 nt, Human
ugcgguagccagcaca

SEQ ID NO: 2181899 - RNA, 15 nt, Human
ugcgguagccagcac

SEQ ID NO: 2181900 - RNA, 21 nt, Human
ugccuuuugcaccccucccau

SEQ ID NO: 2181901 - RNA, 17 nt, Human
ugccuuuugcaccccuc

SEQ ID NO: 2181902 - RNA, 18 nt, Human
ugccuuuugcaccccucc

SEQ ID NO: 2181903 - RNA, 19 nt, Human
ugccuuuugcaccccuccc

SEQ ID NO: 2181904 - RNA, 20 nt, Human
ugccuuuugcaccccuccca

SEQ ID NO: 2181905 - RNA, 22 nt, Human
ugccuuuugcaccccucccauu

SEQ ID NO: 2181906 - RNA, 16 nt, Human
ugccuuggugugcugu

SEQ ID NO: 2181907 - RNA, 20 nt, Human
ugccuuggggaauuuccucu

SEQ ID NO: 2181908 - RNA, 21 nt, Human
ugccuuggggaauuuccucua

SEQ ID NO: 2181909 - RNA, 17 nt, Human
ugccuuuucccaacucc

SEQ ID NO: 2181910 - RNA, 19 nt, Human
ugccuuuucccaacuccag

SEQ ID NO: 2181911 - RNA, 15 nt, Human
ugccuuuucuagccc

SEQ ID NO: 2181912 - RNA, 14 nt, Human
ugccuuuugcaccc

SEQ ID NO: 2181913 - RNA, 15 nt, Human
ugccuuuugcacccc

SEQ ID NO: 2181914 - RNA, 14 nt, Human
ugcuacacaguaua

SEQ ID NO: 2181915 - RNA, 13 nt, Human
ugcuaccaaagca

SEQ ID NO: 2181916 - RNA, 11 nt, Human
ugcuacacacu

SEQ ID NO: 2181917 - RNA, 15 nt, Human
ugcuacaaaaacaca

SEQ ID NO: 2181918 - RNA, 14 nt, Human
ugcuacaaaaacac

SEQ ID NO: 2181919 - RNA, 16 nt, Human
ugcuaauuuugaaaaa

SEQ ID NO: 2181920 - RNA, 18 nt, Human
ugcuaauuuugaaaaacu

SEQ ID NO: 2181921 - RNA, 19 nt, Human
ugcuaauuuugaaaaacug

SEQ ID NO: 2181922 - RNA, 20 nt, Human
ugcuaauuuugaaaaacugc

SEQ ID NO: 2181923 - RNA, 13 nt, Human
agcuguuuaugca

SEQ ID NO: 2181924 - RNA, 18 nt, Human
agcuguuuauggccucag

SEQ ID NO: 2181925 - RNA, 17 nt, Human
agcuguuuauggccuca

SEQ ID NO: 2181926 - RNA, 21 nt, Human
agcuguuuauggccucagcug

SEQ ID NO: 2181927 - RNA, 20 nt, Human
agcuguuuauggccucagcu

SEQ ID NO: 2181928 - RNA, 19 nt, Human
agcuguuuauggccucagc

SEQ ID NO: 2181929 - RNA, 16 nt, Human
agcuguuuaagauggg

SEQ ID NO: 2181930 - RNA, 19 nt, Human
agcuguuuauuuuauauua

SEQ ID NO: 2181931 - RNA, 13 nt, Human
agcuuaacagugu

SEQ ID NO: 2181932 - RNA, 23 nt, Human
ugcuacccaugacuuuauaugga

SEQ ID NO: 2181933 - RNA, 22 nt, Human
agcuguuguacauuuaugauuu

SEQ ID NO: 2181934 - RNA, 23 nt, Human
agcuguuguacauuuaugauuua

SEQ ID NO: 2181935 - RNA, 14 nt, Human
ugcuacccucccug

SEQ ID NO: 2181936 - RNA, 15 nt, Human
ugcuacccucccugc

SEQ ID NO: 2181937 - RNA, 18 nt, Human
agcuguuguacauuuaug

SEQ ID NO: 2181938 - RNA, 20 nt, Human
agcuguuguacauuuaugau

SEQ ID NO: 2181939 - RNA, 12 nt, Human
agcuguuuaaga

SEQ ID NO: 2181940 - RNA, 22 nt, Human
agcuguuuacuagggaucccuc

SEQ ID NO: 2181941 - RNA, 16 nt, Human
agcuguuuacuaggga

SEQ ID NO: 2181942 - RNA, 21 nt, Human
aggcagggucccauuucucac

SEQ ID NO: 2181943 - RNA, 23 nt, Human
aggcagggucaggagaggggcag

SEQ ID NO: 2181944 - RNA, 20 nt, Human
aggcagggucaggagagggg

SEQ ID NO: 2181945 - RNA, 22 nt, Human
aggcaggucuugaacuccuggc

SEQ ID NO: 2181946 - RNA, 19 nt, Human
aggcagggucaggagaggg

SEQ ID NO: 2181947 - RNA, 17 nt, Human
aggcagggucaggagag

SEQ ID NO: 2181948 - RNA, 14 nt, Human
aggcagggucagga

SEQ ID NO: 2181949 - RNA, 22 nt, Human
aggcagggguggggguggaggc

SEQ ID NO: 2181950 - RNA, 23 nt, Human
aggcagggguggggguggaggcu

SEQ ID NO: 2181951 - RNA, 12 nt, Human
aggcagggucuc

SEQ ID NO: 2181952 - RNA, 17 nt, Human
aggcaggugggauggau

SEQ ID NO: 2181953 - RNA, 14 nt, Human
aggcaggugccucc

SEQ ID NO: 2181954 - RNA, 15 nt, Human
aggcaggugccucca

SEQ ID NO: 2181955 - RNA, 17 nt, Human
aggcaggugccuccagg

SEQ ID NO: 2181956 - RNA, 18 nt, Human
aggcaggugccuccaggu

SEQ ID NO: 2181957 - RNA, 20 nt, Human
aggcaggugccuccaggugu

SEQ ID NO: 2181958 - RNA, 15 nt, Human
aggcaggugccugga

SEQ ID NO: 2181959 - RNA, 21 nt, Human
aggcaggugccuccaggugug

SEQ ID NO: 2181960 - RNA, 13 nt, Human
aggcaggugccug

SEQ ID NO: 2181961 - RNA, 15 nt, Human
aggcauaaagucagg

SEQ ID NO: 2181962 - RNA, 14 nt, Human
aggcauuguuugag

SEQ ID NO: 2181963 - RNA, 12 nt, Human
aggcauuuccua

SEQ ID NO: 2181964 - RNA, 20 nt, Human
aggcauuucuaucacauauu

SEQ ID NO: 2181965 - RNA, 18 nt, Human
aggcauugugggaagggg

SEQ ID NO: 2181966 - RNA, 20 nt, Human
aggcauuuaggccaugggac

SEQ ID NO: 2181967 - RNA, 15 nt, Human
aggcauaggccuggg

SEQ ID NO: 2181968 - RNA, 14 nt, Human
aggcauaggccugg

SEQ ID NO: 2181969 - RNA, 13 nt, Human
aggcauaggccug

SEQ ID NO: 2181970 - RNA, 22 nt, Human
aggcauagaggcuucuccgcca

SEQ ID NO: 2181971 - RNA, 14 nt, Human
aggcauugccaagg

SEQ ID NO: 2181972 - RNA, 13 nt, Human
aggcauugccaag

SEQ ID NO: 2181973 - RNA, 21 nt, Human
aggcauugccaagggcuuugu

SEQ ID NO: 2181974 - RNA, 20 nt, Human
aggcauugccaagggcuuug

SEQ ID NO: 2181975 - RNA, 18 nt, Human
aggcauugccaagggcuu

SEQ ID NO: 2181976 - RNA, 16 nt, Human
aggcauugccaagggc

SEQ ID NO: 2181977 - RNA, 22 nt, Human
aggcauaaagucagggguuccc

SEQ ID NO: 2181978 - RNA, 15 nt, Human
aggcauagaggcuuc

SEQ ID NO: 2181979 - RNA, 20 nt, Human
aggcagcuuuuucucuccca

SEQ ID NO: 2181980 - RNA, 22 nt, Human
aggcagcuuuaaccauuaaaac

SEQ ID NO: 2181981 - RNA, 23 nt, Human
aggcagcuuuaaccauuaaaacu

SEQ ID NO: 2181982 - RNA, 15 nt, Human
aggcagcuugaaacu

SEQ ID NO: 2181983 - RNA, 17 nt, Human
aggcaggaagggcagga

SEQ ID NO: 2181984 - RNA, 16 nt, Human
aggcaggaagggcagg

SEQ ID NO: 2181985 - RNA, 20 nt, Human
aggcaggaagggcaggaagg

SEQ ID NO: 2181986 - RNA, 14 nt, Human
aggcaggacaugcu

SEQ ID NO: 2181987 - RNA, 19 nt, Human
aggcaggacaugcugaagc

SEQ ID NO: 2181988 - RNA, 21 nt, Human
aggcaggacaugcugaagcca

SEQ ID NO: 2181989 - RNA, 14 nt, Human
aggcacacagcugc

SEQ ID NO: 2181990 - RNA, 23 nt, Human
aggcacacacugugcuuucuauu

SEQ ID NO: 2181991 - RNA, 18 nt, Human
aggcacacagcugcagag

SEQ ID NO: 2181992 - RNA, 23 nt, Human
aggcacacagcugcagagacaga

SEQ ID NO: 2181993 - RNA, 20 nt, Human
aggcacacuucuucuugguc

SEQ ID NO: 2181994 - RNA, 16 nt, Human
aggcacacuucuucuu

SEQ ID NO: 2181995 - RNA, 15 nt, Human
aggcacacuucuucu

SEQ ID NO: 2181996 - RNA, 12 nt, Human
aggcacacuucu

SEQ ID NO: 2181997 - RNA, 12 nt, Human
aggcacagcaca

SEQ ID NO: 2181998 - RNA, 22 nt, Human
aggcagcuggaugagacuucca

SEQ ID NO: 2181999 - RNA, 17 nt, Human
aggcagcugccugcucu

SEQ ID NO: 2182000 - RNA, 18 nt, Human
aggcagcuggaugagacu

SEQ ID NO: 2182001 - RNA, 22 nt, Human
aggcagggccuugcccagagau

SEQ ID NO: 2182002 - RNA, 22 nt, Human
aggcagggaaaggcucugaaag

SEQ ID NO: 2182003 - RNA, 23 nt, Human
aggcagggccuugcccagagaug

SEQ ID NO: 2182004 - RNA, 21 nt, Human
aggcagggccuugcccagaga

SEQ ID NO: 2182005 - RNA, 14 nt, Human
aggcaggcuuuguu

SEQ ID NO: 2182006 - RNA, 23 nt, Human
aggcaggcuaaggcguggagcug

SEQ ID NO: 2182007 - RNA, 18 nt, Human
aggcaggcuaaggcgugg

SEQ ID NO: 2182008 - RNA, 22 nt, Human
aggcaggcuaaggcguggagcu

SEQ ID NO: 2182009 - RNA, 22 nt, Human
aggcaggcauagaggcuucucc

SEQ ID NO: 2182010 - RNA, 22 nt, Human
aggcaggccaaggccuucuccu

SEQ ID NO: 2182011 - RNA, 21 nt, Human
aggcaggccaaggccuucucc

SEQ ID NO: 2182012 - RNA, 13 nt, Human
aggcaggggcgga

SEQ ID NO: 2182013 - RNA, 23 nt, Human
aggcagggggaaggugggguccu

SEQ ID NO: 2182014 - RNA, 15 nt, Human
aggcagggguggggg

SEQ ID NO: 2182015 - RNA, 16 nt, Human
aggcaggggugggggu

SEQ ID NO: 2182016 - RNA, 19 nt, Human
aggcaggggugggggugga

SEQ ID NO: 2182017 - RNA, 20 nt, Human
aggcagggguggggguggag

SEQ ID NO: 2182018 - RNA, 22 nt, Human
aggcagggcucucuuuccuucu

SEQ ID NO: 2182019 - RNA, 22 nt, Human
uggagaaacuguagucucagga

SEQ ID NO: 2182020 - RNA, 14 nt, Human
uggagaaagcacug

SEQ ID NO: 2182021 - RNA, 17 nt, Human
uggagaaacuguagucu

SEQ ID NO: 2182022 - RNA, 17 nt, Human
uggagaaacccuugaaa

SEQ ID NO: 2182023 - RNA, 19 nt, Human
uggagaaagcacugaccug

SEQ ID NO: 2182024 - RNA, 17 nt, Human
uggagaaagcacugacc

SEQ ID NO: 2182025 - RNA, 18 nt, Human
uggagaaagcacugaccu

SEQ ID NO: 2182026 - RNA, 16 nt, Human
uggagaaacccugucu

SEQ ID NO: 2182027 - RNA, 14 nt, Human
uggagaaacccugu

SEQ ID NO: 2182028 - RNA, 20 nt, Human
uggacuucuuuuacucauga

SEQ ID NO: 2182029 - RNA, 22 nt, Human
uggacuucacauaagcucagaa

SEQ ID NO: 2182030 - RNA, 15 nt, Human
uggagaaaggaguga

SEQ ID NO: 2182031 - RNA, 21 nt, Human
uggagaaauaaaaauaccucu

SEQ ID NO: 2182032 - RNA, 23 nt, Human
uggagaaauaaaaauaccucuuu

SEQ ID NO: 2182033 - RNA, 11 nt, Human
uggagaaauua

SEQ ID NO: 2182034 - RNA, 15 nt, Human
uggagaaauuauuua

SEQ ID NO: 2182035 - RNA, 17 nt, Human
uggagaaauuauuuaau

SEQ ID NO: 2182036 - RNA, 19 nt, Human
uggagaaauuauuuaauaa

SEQ ID NO: 2182037 - RNA, 21 nt, Human
uggagcaaagugagggccgag

SEQ ID NO: 2182038 - RNA, 17 nt, Human
uggagcaccaggcacga

SEQ ID NO: 2182039 - RNA, 14 nt, Human
uggagcagaaucag

SEQ ID NO: 2182040 - RNA, 16 nt, Human
uggagcagaggggcug

SEQ ID NO: 2182041 - RNA, 13 nt, Human
uggagcagagggg

SEQ ID NO: 2182042 - RNA, 12 nt, Human
uggagcagaggg

SEQ ID NO: 2182043 - RNA, 21 nt, Human
uggagcagagcaagucugcag

SEQ ID NO: 2182044 - RNA, 22 nt, Human
uggagcagagcaagucugcagg

SEQ ID NO: 2182045 - RNA, 15 nt, Human
uggagcagaaucagu

SEQ ID NO: 2182046 - RNA, 13 nt, Human
uggagcagaccac

SEQ ID NO: 2182047 - RNA, 17 nt, Human
uggagcagaccaccccg

SEQ ID NO: 2182048 - RNA, 12 nt, Human
uggagcagagca

SEQ ID NO: 2182049 - RNA, 20 nt, Human
uggagcagagcaagucugca

SEQ ID NO: 2182050 - RNA, 17 nt, Human
uggaagccggcggccca

SEQ ID NO: 2182051 - RNA, 15 nt, Human
uggacuuagaaagca

SEQ ID NO: 2182052 - RNA, 16 nt, Human
uggacuuagaaagcag

SEQ ID NO: 2182053 - RNA, 18 nt, Human
uggacuuagaaagcaggg

SEQ ID NO: 2182054 - RNA, 22 nt, Human
uggacuguuuucucucggcucc

SEQ ID NO: 2182055 - RNA, 17 nt, Human
uggacuguucccugagg

SEQ ID NO: 2182056 - RNA, 17 nt, Human
uggacuguuuucucucg

SEQ ID NO: 2182057 - RNA, 20 nt, Human
uggacuguuuucucucggcu

SEQ ID NO: 2182058 - RNA, 20 nt, Human
uggacuuagaaagcaggggc

SEQ ID NO: 2182059 - RNA, 21 nt, Human
uggacuuagaaagcaggggcu

SEQ ID NO: 2182060 - RNA, 18 nt, Human
uggacuucacauaagcuc

SEQ ID NO: 2182061 - RNA, 23 nt, Human
uggacuucacauaagcucagaau

SEQ ID NO: 2182062 - RNA, 14 nt, Human
uggagaaaauggac

SEQ ID NO: 2182063 - RNA, 18 nt, Human
aggauugcuacuguccua

SEQ ID NO: 2182064 - RNA, 16 nt, Human
uggacuguucccugag

SEQ ID NO: 2182065 - RNA, 15 nt, Human
aggauugcuacuguc

SEQ ID NO: 2182066 - RNA, 17 nt, Human
aggauugcuacuguccu

SEQ ID NO: 2182067 - RNA, 20 nt, Human
aggcaagcaccuccugccuc

SEQ ID NO: 2182068 - RNA, 12 nt, Human
aggcaagcccug

SEQ ID NO: 2182069 - RNA, 18 nt, Human
aggcaagcaccuccugcc

SEQ ID NO: 2182070 - RNA, 19 nt, Human
aggcaagcaccuccugccu

SEQ ID NO: 2182071 - RNA, 17 nt, Human
aggcaaggcugucaauu

SEQ ID NO: 2182072 - RNA, 14 nt, Human
aggcacacacugug

SEQ ID NO: 2182073 - RNA, 16 nt, Human
aggcacacacugugcu

SEQ ID NO: 2182074 - RNA, 19 nt, Human
aggcacacacugugcuuuc

SEQ ID NO: 2182075 - RNA, 20 nt, Human
aggcacacacugugcuuucu

SEQ ID NO: 2182076 - RNA, 21 nt, Human
aggcacacacugugcuuucua

SEQ ID NO: 2182077 - RNA, 16 nt, Human
aggcaaggcugucaau

SEQ ID NO: 2182078 - RNA, 13 nt, Human
aggcaaggcaggu

SEQ ID NO: 2182079 - RNA, 14 nt, Human
aggcaaggcaggug

SEQ ID NO: 2182080 - RNA, 15 nt, Human
aggcaaggcaggugc

SEQ ID NO: 2182081 - RNA, 19 nt, Human
aggcaaggcaggugccucc

SEQ ID NO: 2182082 - RNA, 22 nt, Human
aggcaaggcaggugccuccagg

SEQ ID NO: 2182083 - RNA, 20 nt, Human
aggcaaggcaggugccucca

SEQ ID NO: 2182084 - RNA, 11 nt, Human
uggagcaucug

SEQ ID NO: 2182085 - RNA, 17 nt, Human
uggagcagaggggcuga

SEQ ID NO: 2182086 - RNA, 18 nt, Human
uggagcaggacucuauuu

SEQ ID NO: 2182087 - RNA, 17 nt, Human
uggagcauuggcugaga

SEQ ID NO: 2182088 - RNA, 16 nt, Human
uggagccaacugcugc

SEQ ID NO: 2182089 - RNA, 15 nt, Human
uggagcaucugacuc

SEQ ID NO: 2182090 - RNA, 16 nt, Human
uggagcaucugacuca

SEQ ID NO: 2182091 - RNA, 17 nt, Human
uggagcaugggccuggc

SEQ ID NO: 2182092 - RNA, 18 nt, Human
uggagcaugggccuggcc

SEQ ID NO: 2182093 - RNA, 16 nt, Human
uggagccaaguccaga

SEQ ID NO: 2182094 - RNA, 16 nt, Human
uggagccacuaacuag

SEQ ID NO: 2182095 - RNA, 13 nt, Human
uggagccagcucc

SEQ ID NO: 2182096 - RNA, 17 nt, Human
uggagccaaggguucag

SEQ ID NO: 2182097 - RNA, 17 nt, Human
uggagccaacugcugcu

SEQ ID NO: 2182098 - RNA, 15 nt, Human
uggagccaaguccag

SEQ ID NO: 2182099 - RNA, 17 nt, Human
uggagccaauggagacu

SEQ ID NO: 2182100 - RNA, 17 nt, Human
aggcaagcaccuccugc

SEQ ID NO: 2182101 - RNA, 21 nt, Human
uggagcucgugggacagucac

SEQ ID NO: 2182102 - RNA, 17 nt, Human
uggagcucguggaacag

SEQ ID NO: 2182103 - RNA, 21 nt, Human
uggagcucguggaacaguuac

SEQ ID NO: 2182104 - RNA, 17 nt, Human
aggccccgaggacccag

SEQ ID NO: 2182105 - RNA, 18 nt, Human
aggccccgaggacccaga

SEQ ID NO: 2182106 - RNA, 19 nt, Human
aggccccgaggacccagac

SEQ ID NO: 2182107 - RNA, 20 nt, Human
aggccccgaggacccagacc

SEQ ID NO: 2182108 - RNA, 14 nt, Human
aggccccgcccagg

SEQ ID NO: 2182109 - RNA, 15 nt, Human
aggcccccaggugcc

SEQ ID NO: 2182110 - RNA, 23 nt, Human
aggcccccagcccagggcuccug

SEQ ID NO: 2182111 - RNA, 13 nt, Human
aggcccggcucca

SEQ ID NO: 2182112 - RNA, 15 nt, Human
aggcccggccucuca

SEQ ID NO: 2182113 - RNA, 17 nt, Human
aggcccggcuccaggcu

SEQ ID NO: 2182114 - RNA, 19 nt, Human
aggcccgcaugcggcccag

SEQ ID NO: 2182115 - RNA, 21 nt, Human
aggccccgaggacccagaccc

SEQ ID NO: 2182116 - RNA, 23 nt, Human
aggccccgaggacccagacccag

SEQ ID NO: 2182117 - RNA, 14 nt, Human
aggcccggccucuc

SEQ ID NO: 2182118 - RNA, 13 nt, Human
aggcccggccucu

SEQ ID NO: 2182119 - RNA, 13 nt, Human
aggcccagagggc

SEQ ID NO: 2182120 - RNA, 20 nt, Human
aggcccaagagaugaagagu

SEQ ID NO: 2182121 - RNA, 12 nt, Human
aggcccaagaga

SEQ ID NO: 2182122 - RNA, 19 nt, Human
aggccagcugccccagcca

SEQ ID NO: 2182123 - RNA, 13 nt, Human
aggcccccaagcc

SEQ ID NO: 2182124 - RNA, 13 nt, Human
aggcccccacuug

SEQ ID NO: 2182125 - RNA, 16 nt, Human
aggccccaggaagccg

SEQ ID NO: 2182126 - RNA, 15 nt, Human
aggccccaggaagcc

SEQ ID NO: 2182127 - RNA, 14 nt, Human
aggccccaggaagc

SEQ ID NO: 2182128 - RNA, 17 nt, Human
aggcccccacuugccuc

SEQ ID NO: 2182129 - RNA, 18 nt, Human
aggcccccacuugccucu

SEQ ID NO: 2182130 - RNA, 20 nt, Human
aggcccccacuugccucuuc

SEQ ID NO: 2182131 - RNA, 14 nt, Human
aggcccccagccca

SEQ ID NO: 2182132 - RNA, 17 nt, Human
aggcccccagcccaggg

SEQ ID NO: 2182133 - RNA, 18 nt, Human
aggcccccagcccagggc

SEQ ID NO: 2182134 - RNA, 19 nt, Human
aggcccccagcccagggcu

SEQ ID NO: 2182135 - RNA, 22 nt, Human
aggcccccagcccagggcuccu

SEQ ID NO: 2182136 - RNA, 13 nt, Human
aggccagcugccu

SEQ ID NO: 2182137 - RNA, 15 nt, Human
aggccagccuugacc

SEQ ID NO: 2182138 - RNA, 13 nt, Human
aggccagccuuga

SEQ ID NO: 2182139 - RNA, 17 nt, Human
aggccaccugcccccuu

SEQ ID NO: 2182140 - RNA, 16 nt, Human
aggccaccugcccccu

SEQ ID NO: 2182141 - RNA, 15 nt, Human
aggccaccugccccc

SEQ ID NO: 2182142 - RNA, 14 nt, Human
aggccaccugcccc

SEQ ID NO: 2182143 - RNA, 19 nt, Human
aggccaccugcccccuucu

SEQ ID NO: 2182144 - RNA, 18 nt, Human
aggccaccugcccccuuc

SEQ ID NO: 2182145 - RNA, 13 nt, Human
aggccagccuggc

SEQ ID NO: 2182146 - RNA, 13 nt, Human
aggccaccugccc

SEQ ID NO: 2182147 - RNA, 19 nt, Human
aggccaccucuccaagggc

SEQ ID NO: 2182148 - RNA, 23 nt, Human
aggccaccucuccaagggcuucu

SEQ ID NO: 2182149 - RNA, 16 nt, Human
aggccaccuccagaaa

SEQ ID NO: 2182150 - RNA, 17 nt, Human
aggccaccuccccagca

SEQ ID NO: 2182151 - RNA, 11 nt, Human
aggccaccucu

SEQ ID NO: 2182152 - RNA, 12 nt, Human
aggccaccucuc

SEQ ID NO: 2182153 - RNA, 13 nt, Human
aggccaccucucc

SEQ ID NO: 2182154 - RNA, 14 nt, Human
aggccaccucucca

SEQ ID NO: 2182155 - RNA, 15 nt, Human
aggccaccucuccaa

SEQ ID NO: 2182156 - RNA, 16 nt, Human
aggccaccucuccaag

SEQ ID NO: 2182157 - RNA, 17 nt, Human
aggccaccucuccaagg

SEQ ID NO: 2182158 - RNA, 18 nt, Human
aggccaccucuccaaggg

SEQ ID NO: 2182159 - RNA, 18 nt, Human
uggcacccggccccugcu

SEQ ID NO: 2182160 - RNA, 16 nt, Human
uggcaccagacaccca

SEQ ID NO: 2182161 - RNA, 14 nt, Human
uggcaccagacacc

SEQ ID NO: 2182162 - RNA, 19 nt, Human
uggcacccggccccugcug

SEQ ID NO: 2182163 - RNA, 20 nt, Human
uggcacccggccccugcugg

SEQ ID NO: 2182164 - RNA, 13 nt, Human
uggcagcucagag

SEQ ID NO: 2182165 - RNA, 14 nt, Human
aggccaccucccca

SEQ ID NO: 2182166 - RNA, 15 nt, Human
aggccaccuccccag

SEQ ID NO: 2182167 - RNA, 23 nt, Human
uggcagcucaccucucccuugga

SEQ ID NO: 2182168 - RNA, 21 nt, Human
uggcagcucaccucucccuug

SEQ ID NO: 2182169 - RNA, 22 nt, Human
uggcagcucaccucucccuugg

SEQ ID NO: 2182170 - RNA, 18 nt, Human
uggauucauuacagcuua

SEQ ID NO: 2182171 - RNA, 13 nt, Human
uggauucauuucc

SEQ ID NO: 2182172 - RNA, 15 nt, Human
uggauucauuuccug

SEQ ID NO: 2182173 - RNA, 17 nt, Human
uggauucauuuccugcc

SEQ ID NO: 2182174 - RNA, 18 nt, Human
uggauucauuuccugccc

SEQ ID NO: 2182175 - RNA, 19 nt, Human
uggauucauuuccugcccu

SEQ ID NO: 2182176 - RNA, 20 nt, Human
uggauucauuuccugcccuu

SEQ ID NO: 2182177 - RNA, 23 nt, Human
uggaugcggaacccaaauuacgu

SEQ ID NO: 2182178 - RNA, 22 nt, Human
uggaguugaucuggaacccaga

SEQ ID NO: 2182179 - RNA, 13 nt, Human
uggauggaagggg

SEQ ID NO: 2182180 - RNA, 17 nt, Human
uggauuauuuaauaaca

SEQ ID NO: 2182181 - RNA, 18 nt, Human
uggauuauuuaauaacau

SEQ ID NO: 2182182 - RNA, 20 nt, Human
uggauuauuuaauaacauua

SEQ ID NO: 2182183 - RNA, 23 nt, Human
uggauuauuuaauaacauuaccu

SEQ ID NO: 2182184 - RNA, 21 nt, Human
uggaugccugguggcagcugc

SEQ ID NO: 2182185 - RNA, 23 nt, Human
uggaugccugguggcagcugcgg

SEQ ID NO: 2182186 - RNA, 19 nt, Human
uggaguugaucuggaaccc

SEQ ID NO: 2182187 - RNA, 17 nt, Human
uggaguugaucuggaac

SEQ ID NO: 2182188 - RNA, 15 nt, Human
uggaguugaucugga

SEQ ID NO: 2182189 - RNA, 16 nt, Human
uggaguucuugugcca

SEQ ID NO: 2182190 - RNA, 14 nt, Human
uggaguucuugugc

SEQ ID NO: 2182191 - RNA, 15 nt, Human
uggaguucuugugcc

SEQ ID NO: 2182192 - RNA, 19 nt, Human
uggauucucagauauuuau

SEQ ID NO: 2182193 - RNA, 17 nt, Human
uggauucuuauguagca

SEQ ID NO: 2182194 - RNA, 13 nt, Human
uggauugagggua

SEQ ID NO: 2182195 - RNA, 17 nt, Human
uggauucugagagcugu

SEQ ID NO: 2182196 - RNA, 16 nt, Human
uggauucugagagcug

SEQ ID NO: 2182197 - RNA, 16 nt, Human
uggauucucagauauu

SEQ ID NO: 2182198 - RNA, 15 nt, Human
uggauucucagauau

SEQ ID NO: 2182199 - RNA, 14 nt, Human
uggauucucagaua

SEQ ID NO: 2182200 - RNA, 13 nt, Human
uggauucucagau

SEQ ID NO: 2182201 - RNA, 12 nt, Human
uggauucucaga

SEQ ID NO: 2182202 - RNA, 17 nt, Human
uggauuccaaccccaac

SEQ ID NO: 2182203 - RNA, 21 nt, Human
uggcaccacugcacuccagcc

SEQ ID NO: 2182204 - RNA, 19 nt, Human
uggcaccacugcacuccag

SEQ ID NO: 2182205 - RNA, 18 nt, Human
uggcaccacugcacucca

SEQ ID NO: 2182206 - RNA, 21 nt, Human
uggcacauuuccccagaccug

SEQ ID NO: 2182207 - RNA, 15 nt, Human
uggcacauccuaugc

SEQ ID NO: 2182208 - RNA, 18 nt, Human
uggcacauccuaugcaau

SEQ ID NO: 2182209 - RNA, 19 nt, Human
uggcacauccuaugcaaua

SEQ ID NO: 2182210 - RNA, 23 nt, Human
uggcacauccuaugcaauauauc

SEQ ID NO: 2182211 - RNA, 18 nt, Human
uggcacauuuaagagaca

SEQ ID NO: 2182212 - RNA, 23 nt, Human
uggcacaucagcacgauuucugu

SEQ ID NO: 2182213 - RNA, 23 nt, Human
uggauuggagaaguaauccuagg

SEQ ID NO: 2182214 - RNA, 17 nt, Human
uggauugcacguggccu

SEQ ID NO: 2182215 - RNA, 21 nt, Human
uggauugcacguggccucuug

SEQ ID NO: 2182216 - RNA, 17 nt, Human
uggagugcaaugacaca

SEQ ID NO: 2182217 - RNA, 14 nt, Human
uggagugcagugag

SEQ ID NO: 2182218 - RNA, 14 nt, Human
uggagguggggccu

SEQ ID NO: 2182219 - RNA, 15 nt, Human
uggaggugggguugg

SEQ ID NO: 2182220 - RNA, 17 nt, Human
uggaggugggguuggga

SEQ ID NO: 2182221 - RNA, 16 nt, Human
uggaggugucaggcug

SEQ ID NO: 2182222 - RNA, 18 nt, Human
uggaggugggagcaggag

SEQ ID NO: 2182223 - RNA, 20 nt, Human
uggaggugggagcaggagau

SEQ ID NO: 2182224 - RNA, 19 nt, Human
uggagguggggccuggagc

SEQ ID NO: 2182225 - RNA, 19 nt, Human
uggagguuaaggcugagga

SEQ ID NO: 2182226 - RNA, 17 nt, Human
uggagguuaaggcugag

SEQ ID NO: 2182227 - RNA, 18 nt, Human
uggaggugucaggcugcu

SEQ ID NO: 2182228 - RNA, 20 nt, Human
uggaggugucaggcugcugg

SEQ ID NO: 2182229 - RNA, 21 nt, Human
uggaggugucaggcugcuggc

SEQ ID NO: 2182230 - RNA, 22 nt, Human
uggaggugucaggcugcuggcg

SEQ ID NO: 2182231 - RNA, 20 nt, Human
aggcauuugcugaauacaga

SEQ ID NO: 2182232 - RNA, 16 nt, Human
aggcauuugcugaaua

SEQ ID NO: 2182233 - RNA, 20 nt, Human
uggaggucgguagguucagc

SEQ ID NO: 2182234 - RNA, 18 nt, Human
uggaggucacauucagga

SEQ ID NO: 2182235 - RNA, 20 nt, Human
uggaggucacauucaggaag

SEQ ID NO: 2182236 - RNA, 12 nt, Human
uggaggugggag

SEQ ID NO: 2182237 - RNA, 13 nt, Human
uggaggugggagc

SEQ ID NO: 2182238 - RNA, 17 nt, Human
uggaggugggagcagga

SEQ ID NO: 2182239 - RNA, 22 nt, Human
uggaggucacauucaggaagau

SEQ ID NO: 2182240 - RNA, 17 nt, Human
uggaggugccagcaaag

SEQ ID NO: 2182241 - RNA, 19 nt, Human
uggaggugccagcaaagcc

SEQ ID NO: 2182242 - RNA, 20 nt, Human
uggaggugccagcaaagccc

SEQ ID NO: 2182243 - RNA, 15 nt, Human
uggagugcagggagg

SEQ ID NO: 2182244 - RNA, 17 nt, Human
uggagugcagggaggag

SEQ ID NO: 2182245 - RNA, 19 nt, Human
uggagugcagggaggagag

SEQ ID NO: 2182246 - RNA, 13 nt, Human
uggaguggccacu

SEQ ID NO: 2182247 - RNA, 14 nt, Human
uggaguguaugacu

SEQ ID NO: 2182248 - RNA, 13 nt, Human
uggaguggggcag

SEQ ID NO: 2182249 - RNA, 16 nt, Human
uggaguggggcaguag

SEQ ID NO: 2182250 - RNA, 17 nt, Human
uggaguguggcugagga

SEQ ID NO: 2182251 - RNA, 17 nt, Human
uggaguguaugacugca

SEQ ID NO: 2182252 - RNA, 19 nt, Human
uggaguguaugacugcaca

SEQ ID NO: 2182253 - RNA, 20 nt, Human
uggaguguguauuguuccca

SEQ ID NO: 2182254 - RNA, 15 nt, Human
uggaguguguauugu

SEQ ID NO: 2182255 - RNA, 17 nt, Human
uggaguggggcaguaga

SEQ ID NO: 2182256 - RNA, 22 nt, Human
uggaguguuccccuuccacuga

SEQ ID NO: 2182257 - RNA, 19 nt, Human
uggaguguuccccuuccac

SEQ ID NO: 2182258 - RNA, 19 nt, Human
uggaguguguauuguuccc

SEQ ID NO: 2182259 - RNA, 20 nt, Human
uggaguuaacgggugaauaa

SEQ ID NO: 2182260 - RNA, 17 nt, Human
uggaguuacauuaaugu

SEQ ID NO: 2182261 - RNA, 18 nt, Human
uggaguuacauuaauguu

SEQ ID NO: 2182262 - RNA, 20 nt, Human
uggaguuacauuaauguuaa

SEQ ID NO: 2182263 - RNA, 14 nt, Human
uggaguugaaaauc

SEQ ID NO: 2182264 - RNA, 17 nt, Human
ugcuuuggcuuacuugu

SEQ ID NO: 2182265 - RNA, 16 nt, Human
ugcuuugugugauuga

SEQ ID NO: 2182266 - RNA, 17 nt, Human
ugcuuugugauuuuugu

SEQ ID NO: 2182267 - RNA, 17 nt, Human
ugcuuugugugauugaa

SEQ ID NO: 2182268 - RNA, 16 nt, Human
ugcuuugggcugcccu

SEQ ID NO: 2182269 - RNA, 22 nt, Human
ugcuuugugauuuuuguaauuu

SEQ ID NO: 2182270 - RNA, 23 nt, Human
ugcuuuuuaauauugauaugcuu

SEQ ID NO: 2182271 - RNA, 20 nt, Human
ugcuuuugucuaugggacuc

SEQ ID NO: 2182272 - RNA, 18 nt, Human
ugcuuuuggucuguguga

SEQ ID NO: 2182273 - RNA, 17 nt, Human
ugcuuuuaaaaaaaaau

SEQ ID NO: 2182274 - RNA, 23 nt, Human
aggagcccuuaucugugcucagg

SEQ ID NO: 2182275 - RNA, 17 nt, Human
aggagccuccugcccuu

SEQ ID NO: 2182276 - RNA, 20 nt, Human
ugcuugacauaauuucacug

SEQ ID NO: 2182277 - RNA, 16 nt, Human
ugcuugacaacaucug

SEQ ID NO: 2182278 - RNA, 15 nt, Human
ugcuugacaacaucu

SEQ ID NO: 2182279 - RNA, 15 nt, Human
ugcuugagcucagga

SEQ ID NO: 2182280 - RNA, 14 nt, Human
ugcuugagcccagg

SEQ ID NO: 2182281 - RNA, 13 nt, Human
ugcuugagcccag

SEQ ID NO: 2182282 - RNA, 16 nt, Human
ugcuugagcccaggag

SEQ ID NO: 2182283 - RNA, 12 nt, Human
ugcuugaggaaa

SEQ ID NO: 2182284 - RNA, 13 nt, Human
ugcuugaggaaaa

SEQ ID NO: 2182285 - RNA, 18 nt, Human
ugcuuuggaccuaaaugg

SEQ ID NO: 2182286 - RNA, 16 nt, Human
ugcuugaggaaaacaa

SEQ ID NO: 2182287 - RNA, 14 nt, Human
ugcuuugggcugcc

SEQ ID NO: 2182288 - RNA, 15 nt, Human
ugcuuugggcugccc

SEQ ID NO: 2182289 - RNA, 15 nt, Human
ugcuuugggaagccg

SEQ ID NO: 2182290 - RNA, 23 nt, Human
ugcuuuggaccuaaauggccuca

SEQ ID NO: 2182291 - RNA, 21 nt, Human
ugcuuuggaccuaaauggccu

SEQ ID NO: 2182292 - RNA, 22 nt, Human
ugcuuuggaccuaaauggccuc

SEQ ID NO: 2182293 - RNA, 23 nt, Human
uggaaagugaauuugaaugaaaa

SEQ ID NO: 2182294 - RNA, 21 nt, Human
uggaaagugaauuugaaugaa

SEQ ID NO: 2182295 - RNA, 20 nt, Human
uggaaagugaauuugaauga

SEQ ID NO: 2182296 - RNA, 17 nt, Human
uggaaagugaauuugaa

SEQ ID NO: 2182297 - RNA, 13 nt, Human
uggaaaguguaaa

SEQ ID NO: 2182298 - RNA, 14 nt, Human
uggaaaguguaaag

SEQ ID NO: 2182299 - RNA, 15 nt, Human
uggaaaguguaaagc

SEQ ID NO: 2182300 - RNA, 16 nt, Human
uggaaaguguaaagca

SEQ ID NO: 2182301 - RNA, 16 nt, Human
uggaaagugaauuuga

SEQ ID NO: 2182302 - RNA, 15 nt, Human
uggaaagugaauuug

SEQ ID NO: 2182303 - RNA, 14 nt, Human
uggaaagugaauuu

SEQ ID NO: 2182304 - RNA, 17 nt, Human
ugcuuuuugagguggca

SEQ ID NO: 2182305 - RNA, 20 nt, Human
ugcuuuuugagguggcacuu

SEQ ID NO: 2182306 - RNA, 21 nt, Human
ugcuuuuugagguggcacuuu

SEQ ID NO: 2182307 - RNA, 23 nt, Human
uggaaauaaauguaucauagaaa

SEQ ID NO: 2182308 - RNA, 15 nt, Human
uggaaauaaauguau

SEQ ID NO: 2182309 - RNA, 13 nt, Human
uggaaauaaaugu

SEQ ID NO: 2182310 - RNA, 17 nt, Human
uggaaaguguaaagcau

SEQ ID NO: 2182311 - RNA, 18 nt, Human
uggaaaguguaaagcauu

SEQ ID NO: 2182312 - RNA, 21 nt, Human
uggaaaguguaaagcauucca

SEQ ID NO: 2182313 - RNA, 17 nt, Human
ugcuuuuuaaguguuaa

SEQ ID NO: 2182314 - RNA, 15 nt, Human
ugcuuuuuauuucug

SEQ ID NO: 2182315 - RNA, 16 nt, Human
ugcuuuuuauggccug

SEQ ID NO: 2182316 - RNA, 19 nt, Human
ugcuuuuuauuucugcaua

SEQ ID NO: 2182317 - RNA, 18 nt, Human
ugcuuuuuauuucugcau

SEQ ID NO: 2182318 - RNA, 15 nt, Human
ugcuuuuucaccaga

SEQ ID NO: 2182319 - RNA, 12 nt, Human
ugcuuuuucuga

SEQ ID NO: 2182320 - RNA, 13 nt, Human
ugcuuuuucuaau

SEQ ID NO: 2182321 - RNA, 14 nt, Human
ugcuuuuucuaaug

SEQ ID NO: 2182322 - RNA, 13 nt, Human
ugcuuuuucugac

SEQ ID NO: 2182323 - RNA, 23 nt, Human
uggaaauuuguuauaaugaauga

SEQ ID NO: 2182324 - RNA, 21 nt, Human
uggaaauuuguuauaaugaau

SEQ ID NO: 2182325 - RNA, 13 nt, Human
uggaagaccccac

SEQ ID NO: 2182326 - RNA, 15 nt, Human
uggaagaccccaccc

SEQ ID NO: 2182327 - RNA, 15 nt, Human
uggaagacagcucuu

SEQ ID NO: 2182328 - RNA, 16 nt, Human
uggaagacagcucuua

SEQ ID NO: 2182329 - RNA, 23 nt, Human
uggaagagccugcaggugcugcu

SEQ ID NO: 2182330 - RNA, 15 nt, Human
uggaagagccugcag

SEQ ID NO: 2182331 - RNA, 15 nt, Human
uggaagagggcugca

SEQ ID NO: 2182332 - RNA, 17 nt, Human
uggaagaccccacccaa

SEQ ID NO: 2182333 - RNA, 18 nt, Human
aggaucuuuugaacccag

SEQ ID NO: 2182334 - RNA, 13 nt, Human
aggaucuuuugaa

SEQ ID NO: 2182335 - RNA, 21 nt, Human
aggaucauuuguuggaaugaa

SEQ ID NO: 2182336 - RNA, 22 nt, Human
aggaugaaugaggucccaggca

SEQ ID NO: 2182337 - RNA, 21 nt, Human
aggaugaaugaggucccaggc

SEQ ID NO: 2182338 - RNA, 20 nt, Human
aggaugaaugaggucccagg

SEQ ID NO: 2182339 - RNA, 19 nt, Human
aggaugaaugaggucccag

SEQ ID NO: 2182340 - RNA, 20 nt, Human
aggaugaccuggauaacuua

SEQ ID NO: 2182341 - RNA, 20 nt, Human
aggaugacgguauuaugcuu

SEQ ID NO: 2182342 - RNA, 23 nt, Human
aggaugacgguauuaugcuucuu

SEQ ID NO: 2182343 - RNA, 22 nt, Human
aggaucaugguguaauaagaca

SEQ ID NO: 2182344 - RNA, 12 nt, Human
aggaugaaugua

SEQ ID NO: 2182345 - RNA, 18 nt, Human
aggaugaauguaugugca

SEQ ID NO: 2182346 - RNA, 20 nt, Human
aggaugaauguaugugcacu

SEQ ID NO: 2182347 - RNA, 13 nt, Human
aggaugagagccc

SEQ ID NO: 2182348 - RNA, 14 nt, Human
aggaugagagccca

SEQ ID NO: 2182349 - RNA, 15 nt, Human
aggaugagagcccag

SEQ ID NO: 2182350 - RNA, 16 nt, Human
aggaugagagcccaga

SEQ ID NO: 2182351 - RNA, 17 nt, Human
aggaugagagcccagag

SEQ ID NO: 2182352 - RNA, 18 nt, Human
aggaugagagcccagagg

SEQ ID NO: 2182353 - RNA, 19 nt, Human
aggaugagagcccagaggu

SEQ ID NO: 2182354 - RNA, 20 nt, Human
aggaugagagcccagaggua

SEQ ID NO: 2182355 - RNA, 13 nt, Human
aggaucagucuga

SEQ ID NO: 2182356 - RNA, 21 nt, Human
aggauauauuuucacuuugug

SEQ ID NO: 2182357 - RNA, 15 nt, Human
aggauaucuucucca

SEQ ID NO: 2182358 - RNA, 15 nt, Human
aggaucaugguguaa

SEQ ID NO: 2182359 - RNA, 20 nt, Human
aggaucauuuguuggaauga

SEQ ID NO: 2182360 - RNA, 17 nt, Human
aggaucaugguguaaua

SEQ ID NO: 2182361 - RNA, 18 nt, Human
aggaucaugguguaauaa

SEQ ID NO: 2182362 - RNA, 16 nt, Human
aggaugauuuuggccu

SEQ ID NO: 2182363 - RNA, 18 nt, Human
aggaugcagagucagcag

SEQ ID NO: 2182364 - RNA, 13 nt, Human
aggauugaagagc

SEQ ID NO: 2182365 - RNA, 14 nt, Human
aggauugaagagca

SEQ ID NO: 2182366 - RNA, 22 nt, Human
aggauugaagagcauugcaugg

SEQ ID NO: 2182367 - RNA, 17 nt, Human
aggauugauuaugcaga

SEQ ID NO: 2182368 - RNA, 19 nt, Human
aggauucuuccucccuccc

SEQ ID NO: 2182369 - RNA, 17 nt, Human
aggauucuuccucccuc

SEQ ID NO: 2182370 - RNA, 19 nt, Human
aggaugagcucuacccagg

SEQ ID NO: 2182371 - RNA, 23 nt, Human
aggaugagagcccagagguaaca

SEQ ID NO: 2182372 - RNA, 22 nt, Human
aggaugcacagaguuguuacau

SEQ ID NO: 2182373 - RNA, 22 nt, Human
aggaugaucuaggaagacuuug

SEQ ID NO: 2182374 - RNA, 23 nt, Human
aggaugaucuaggaagacuuugg

SEQ ID NO: 2182375 - RNA, 16 nt, Human
aggaggcuggcaggua

SEQ ID NO: 2182376 - RNA, 13 nt, Human
aggaggcuggcug

SEQ ID NO: 2182377 - RNA, 14 nt, Human
aggaggcuggcugg

SEQ ID NO: 2182378 - RNA, 13 nt, Human
aggaggcuggcag

SEQ ID NO: 2182379 - RNA, 13 nt, Human
aggaggcuggcuu

SEQ ID NO: 2182380 - RNA, 14 nt, Human
aggauagaugcugg

SEQ ID NO: 2182381 - RNA, 15 nt, Human
aggauagaugcuggc

SEQ ID NO: 2182382 - RNA, 19 nt, Human
aggauagaugcuggcccag

SEQ ID NO: 2182383 - RNA, 18 nt, Human
aggauagaugcuggccca

SEQ ID NO: 2182384 - RNA, 14 nt, Human
aggauauauuuuca

SEQ ID NO: 2182385 - RNA, 18 nt, Human
aggauauauuuucacuuu

SEQ ID NO: 2182386 - RNA, 16 nt, Human
aggauaggaguucacu

SEQ ID NO: 2182387 - RNA, 21 nt, Human
aggauaggaguucacuucauc

SEQ ID NO: 2182388 - RNA, 22 nt, Human
aggauagaugcuggcccagggc

SEQ ID NO: 2182389 - RNA, 14 nt, Human
aggauagcauuuuu

SEQ ID NO: 2182390 - RNA, 21 nt, Human
aggauagaugcuggcccaggg

SEQ ID NO: 2182391 - RNA, 20 nt, Human
aggauagaugcuggcccagg

SEQ ID NO: 2182392 - RNA, 13 nt, Human
aggaggcugaggg

SEQ ID NO: 2182393 - RNA, 19 nt, Human
aggaggcugaggcaggagg

SEQ ID NO: 2182394 - RNA, 17 nt, Human
aggaggcugaggcagga

SEQ ID NO: 2182395 - RNA, 17 nt, Human
aggaggcugaggcagaa

SEQ ID NO: 2182396 - RNA, 16 nt, Human
aggaggcugaggcaga

SEQ ID NO: 2182397 - RNA, 19 nt, Human
aggaggcuccagagggcac

SEQ ID NO: 2182398 - RNA, 18 nt, Human
aggaggcuccagagggca

SEQ ID NO: 2182399 - RNA, 17 nt, Human
aggaggcuccagagggc

SEQ ID NO: 2182400 - RNA, 15 nt, Human
aggaggagcaggggc

SEQ ID NO: 2182401 - RNA, 23 nt, Human
aggaggcgcacuuuccuccuggc

SEQ ID NO: 2182402 - RNA, 16 nt, Human
aggaggcuccagaggg

SEQ ID NO: 2182403 - RNA, 13 nt, Human
aggaggcuccaga

SEQ ID NO: 2182404 - RNA, 19 nt, Human
uggaagcccuccuuccacg

SEQ ID NO: 2182405 - RNA, 14 nt, Human
aggaggaaggcaag

SEQ ID NO: 2182406 - RNA, 17 nt, Human
uggaagccggagggugu

SEQ ID NO: 2182407 - RNA, 17 nt, Human
aggaggaaggcaagagg

SEQ ID NO: 2182408 - RNA, 22 nt, Human
aggaggaaucaugucaggccug

SEQ ID NO: 2182409 - RNA, 23 nt, Human
aggaggaaucaugucaggccugu

SEQ ID NO: 2182410 - RNA, 13 nt, Human
aggaggacaauuc

SEQ ID NO: 2182411 - RNA, 14 nt, Human
aggaggacaauuca

SEQ ID NO: 2182412 - RNA, 22 nt, Human
aggaggacaauucaugaacuuc

SEQ ID NO: 2182413 - RNA, 19 nt, Human
uggaagcauguaggagaau

SEQ ID NO: 2182414 - RNA, 17 nt, Human
uggaagcauguaggaga

SEQ ID NO: 2182415 - RNA, 15 nt, Human
uggaagccagcuuuc

SEQ ID NO: 2182416 - RNA, 18 nt, Human
uggaagccagcuuucccu

SEQ ID NO: 2182417 - RNA, 16 nt, Human
uggaagccagcuuucc

SEQ ID NO: 2182418 - RNA, 17 nt, Human
uggaagcccuccuucca

SEQ ID NO: 2182419 - RNA, 16 nt, Human
uggaagcccuccuucc

SEQ ID NO: 2182420 - RNA, 15 nt, Human
uggaagcccuccuuc

SEQ ID NO: 2182421 - RNA, 13 nt, Human
uggaagcccuccu

SEQ ID NO: 2182422 - RNA, 12 nt, Human
uggaagcccucc

SEQ ID NO: 2182423 - RNA, 22 nt, Human
uggaagcauguaggagaaucca

SEQ ID NO: 2182424 - RNA, 19 nt, Human
uggaagcauauuguuauua

SEQ ID NO: 2182425 - RNA, 15 nt, Human
uggaagaggggacag

SEQ ID NO: 2182426 - RNA, 15 nt, Human
aggagcacaggcagc

SEQ ID NO: 2182427 - RNA, 22 nt, Human
aggagcacaggcagcuggauga

SEQ ID NO: 2182428 - RNA, 17 nt, Human
aggagcaaauguuucug

SEQ ID NO: 2182429 - RNA, 18 nt, Human
aggagcaaauguuucugc

SEQ ID NO: 2182430 - RNA, 19 nt, Human
aggagcaaauguuucugca

SEQ ID NO: 2182431 - RNA, 20 nt, Human
aggagauggaaguugcagug

SEQ ID NO: 2182432 - RNA, 22 nt, Human
aggagaugcuccuugggcccuu

SEQ ID NO: 2182433 - RNA, 18 nt, Human
aggagaugcuccuugggc

SEQ ID NO: 2182434 - RNA, 17 nt, Human
aggagaugcuccuuggg

SEQ ID NO: 2182435 - RNA, 12 nt, Human
aggagcagccac

SEQ ID NO: 2182436 - RNA, 13 nt, Human
aggagcagccaca

SEQ ID NO: 2182437 - RNA, 12 nt, Human
aggagauaaauc

SEQ ID NO: 2182438 - RNA, 21 nt, Human
aggagagucccagagcaggag

SEQ ID NO: 2182439 - RNA, 24 nt, Human
aggagagucccagagcaggaggcc

SEQ ID NO: 2182440 - RNA, 21 nt, Human
aggagauaaaucuaguauaca

SEQ ID NO: 2182441 - RNA, 14 nt, Human
aggagauaucugag

SEQ ID NO: 2182442 - RNA, 18 nt, Human
aggagauaucugagggag

SEQ ID NO: 2182443 - RNA, 19 nt, Human
aggagauaucugagggagg

SEQ ID NO: 2182444 - RNA, 23 nt, Human
aggagauaucugagggaggaggc

SEQ ID NO: 2182445 - RNA, 16 nt, Human
aggagaugcuccuugg

SEQ ID NO: 2182446 - RNA, 20 nt, Human
aggagauaucugagggagga

SEQ ID NO: 2182447 - RNA, 12 nt, Human
aggagaaaugca

SEQ ID NO: 2182448 - RNA, 21 nt, Human
aggacuugaaagcauccaugu

SEQ ID NO: 2182449 - RNA, 19 nt, Human
aggacuugaaagcauccau

SEQ ID NO: 2182450 - RNA, 16 nt, Human
aggacuugaaagcauc

SEQ ID NO: 2182451 - RNA, 16 nt, Human
aggagaaaugcaucca

SEQ ID NO: 2182452 - RNA, 20 nt, Human
aggagagucccagagcagga

SEQ ID NO: 2182453 - RNA, 17 nt, Human
aggagagucccagagca

SEQ ID NO: 2182454 - RNA, 17 nt, Human
aggagaguagaacagau

SEQ ID NO: 2182455 - RNA, 16 nt, Human
aggagccuccugcccu

SEQ ID NO: 2182456 - RNA, 17 nt, Human
aggagccccgaggccuu

SEQ ID NO: 2182457 - RNA, 23 nt, Human
aggagcccugggaggcucuggag

SEQ ID NO: 2182458 - RNA, 21 nt, Human
aggagcccuuaucugugcuca

SEQ ID NO: 2182459 - RNA, 22 nt, Human
aggagcaaauguuucugcagua

SEQ ID NO: 2182460 - RNA, 21 nt, Human
aggagccccauuccugggaaa

SEQ ID NO: 2182461 - RNA, 19 nt, Human
aggagccccauuccuggga

SEQ ID NO: 2182462 - RNA, 18 nt, Human
aggagccccauuccuggg

SEQ ID NO: 2182463 - RNA, 16 nt, Human
aggagccccauuccug

SEQ ID NO: 2182464 - RNA, 15 nt, Human
aggagccccauuccu

SEQ ID NO: 2182465 - RNA, 14 nt, Human
aggagccccagcua

SEQ ID NO: 2182466 - RNA, 21 nt, Human
aggacugccgaccgaggcugg

SEQ ID NO: 2182467 - RNA, 17 nt, Human
aggacugccgaccgagg

SEQ ID NO: 2182468 - RNA, 13 nt, Human
aggacugccgacc

SEQ ID NO: 2182469 - RNA, 21 nt, Human
aggacugccccgugcagacug

SEQ ID NO: 2182470 - RNA, 18 nt, Human
aggacugccccgugcaga

SEQ ID NO: 2182471 - RNA, 22 nt, Human
aggacugccgaccgaggcugga

SEQ ID NO: 2182472 - RNA, 11 nt, Human
aggacugggcc

SEQ ID NO: 2182473 - RNA, 12 nt, Human
aggacugggcca

SEQ ID NO: 2182474 - RNA, 15 nt, Human
aggacugggccacuu

SEQ ID NO: 2182475 - RNA, 15 nt, Human
aggacuguauuugug

SEQ ID NO: 2182476 - RNA, 16 nt, Human
aggacuguauuuguga

SEQ ID NO: 2182477 - RNA, 22 nt, Human
aggacuuccuguccagcuccaa

SEQ ID NO: 2182478 - RNA, 17 nt, Human
aggacuguauuugugac

SEQ ID NO: 2182479 - RNA, 18 nt, Human
aggacuguauuugugacu

SEQ ID NO: 2182480 - RNA, 21 nt, Human
aggacuuccuguccagcucca

SEQ ID NO: 2182481 - RNA, 12 nt, Human
aggacucugccu

SEQ ID NO: 2182482 - RNA, 13 nt, Human
aggacucugccuc

SEQ ID NO: 2182483 - RNA, 14 nt, Human
aggacucugccucc

SEQ ID NO: 2182484 - RNA, 16 nt, Human
aggacucugccuccuc

SEQ ID NO: 2182485 - RNA, 17 nt, Human
aggacucugccuccucu

SEQ ID NO: 2182486 - RNA, 18 nt, Human
aggacucugccuccucuu

SEQ ID NO: 2182487 - RNA, 21 nt, Human
aggacugcacagcguccuguc

SEQ ID NO: 2182488 - RNA, 23 nt, Human
aggacugcacagcguccugucca

SEQ ID NO: 2182489 - RNA, 22 nt, Human
aggacuuuucuuuguggcuucc

SEQ ID NO: 2182490 - RNA, 17 nt, Human
aggagaaacuggaacuc

SEQ ID NO: 2182491 - RNA, 19 nt, Human
aggagaaacuggaacucuc

SEQ ID NO: 2182492 - RNA, 18 nt, Human
aggagaaacuggaacucu

SEQ ID NO: 2182493 - RNA, 17 nt, Human
aggacuuuucuuugugg

SEQ ID NO: 2182494 - RNA, 19 nt, Human
aggacuuuucuuuguggcu

SEQ ID NO: 2182495 - RNA, 14 nt, Human
aggacgugggcggc

SEQ ID NO: 2182496 - RNA, 20 nt, Human
aggacgugggcggcagagag

SEQ ID NO: 2182497 - RNA, 13 nt, Human
aggacgcuucuga

SEQ ID NO: 2182498 - RNA, 14 nt, Human
aggacgcuucugaa

SEQ ID NO: 2182499 - RNA, 15 nt, Human
aggacgcuucugaau

SEQ ID NO: 2182500 - RNA, 15 nt, Human
aggacgccacccagc

SEQ ID NO: 2182501 - RNA, 13 nt, Human
aggacggccggcu

SEQ ID NO: 2182502 - RNA, 15 nt, Human
aggacggggccggcc

SEQ ID NO: 2182503 - RNA, 16 nt, Human
aggacggggccggcca

SEQ ID NO: 2182504 - RNA, 19 nt, Human
aggacggggccggccaggu

SEQ ID NO: 2182505 - RNA, 20 nt, Human
aggacggggccggccaggug

SEQ ID NO: 2182506 - RNA, 21 nt, Human
aggacggggccggccaggugg

SEQ ID NO: 2182507 - RNA, 22 nt, Human
aggacggggccggccagguggg

SEQ ID NO: 2182508 - RNA, 16 nt, Human
aggacggugcaaccca

SEQ ID NO: 2182509 - RNA, 15 nt, Human
aggacuaggguccug

SEQ ID NO: 2182510 - RNA, 19 nt, Human
aggacuacguuaagggaag

SEQ ID NO: 2182511 - RNA, 20 nt, Human
aggacuacguuaagggaagg

SEQ ID NO: 2182512 - RNA, 17 nt, Human
aggacuagaaccuggag

SEQ ID NO: 2182513 - RNA, 18 nt, Human
aggacuaggguccugggg

SEQ ID NO: 2182514 - RNA, 16 nt, Human
aggacuaggguccugg

SEQ ID NO: 2182515 - RNA, 19 nt, Human
aggacuaggguccugggga

SEQ ID NO: 2182516 - RNA, 18 nt, Human
aggacuagaaccuggagg

SEQ ID NO: 2182517 - RNA, 22 nt, Human
aggacuagaaccuggagggcug

SEQ ID NO: 2182518 - RNA, 16 nt, Human
aggacuauagcccagg

SEQ ID NO: 2182519 - RNA, 18 nt, Human
aggacuauagcccagguc

SEQ ID NO: 2182520 - RNA, 20 nt, Human
aggacuauauuugggccugc

SEQ ID NO: 2182521 - RNA, 19 nt, Human
aggacuauagcccaggucc

SEQ ID NO: 2182522 - RNA, 20 nt, Human
aggacuauagcccagguccu

SEQ ID NO: 2182523 - RNA, 18 nt, Human
aggacucagaagccucug

SEQ ID NO: 2182524 - RNA, 13 nt, Human
aggacucagcucc

SEQ ID NO: 2182525 - RNA, 14 nt, Human
aggacucagcuccc

SEQ ID NO: 2182526 - RNA, 17 nt, Human
aggacucccuccucacc

SEQ ID NO: 2182527 - RNA, 16 nt, Human
aggacucccuccucac

SEQ ID NO: 2182528 - RNA, 15 nt, Human
aggacucccuccuca

SEQ ID NO: 2182529 - RNA, 14 nt, Human
aggacucccuccuc

SEQ ID NO: 2182530 - RNA, 13 nt, Human
aggacucccuccu

SEQ ID NO: 2182531 - RNA, 12 nt, Human
aggacucccucc

SEQ ID NO: 2182532 - RNA, 16 nt, Human
aggacuccccaggcca

SEQ ID NO: 2182533 - RNA, 17 nt, Human
aggacuccccaggccag

SEQ ID NO: 2182534 - RNA, 18 nt, Human
aggacuccccaggccagg

SEQ ID NO: 2182535 - RNA, 19 nt, Human
aggacuccccaggccaggc

SEQ ID NO: 2182536 - RNA, 17 nt, Human
aggacuccacccauccu

SEQ ID NO: 2182537 - RNA, 17 nt, Human
aggacucagcuccccag

SEQ ID NO: 2182538 - RNA, 18 nt, Human
aggacucagcuccccaga

SEQ ID NO: 2182539 - RNA, 19 nt, Human
aggacucagcuccccagag

SEQ ID NO: 2182540 - RNA, 20 nt, Human
aggacucagcuccccagagu

SEQ ID NO: 2182541 - RNA, 13 nt, Human
aggacuccccagg

SEQ ID NO: 2182542 - RNA, 18 nt, Human
aggacucugcccagacca

SEQ ID NO: 2182543 - RNA, 15 nt, Human
aggacucugcccaga

SEQ ID NO: 2182544 - RNA, 17 nt, Human
aggacucugaggcucuu

SEQ ID NO: 2182545 - RNA, 14 nt, Human
aggacucugaggcu

SEQ ID NO: 2182546 - RNA, 13 nt, Human
aggacucugaggc

SEQ ID NO: 2182547 - RNA, 12 nt, Human
aggacucucagg

SEQ ID NO: 2182548 - RNA, 19 nt, Human
aggacucccuccucaccuc

SEQ ID NO: 2182549 - RNA, 18 nt, Human
aggacucccuccucaccu

SEQ ID NO: 2182550 - RNA, 23 nt, Human
aggacucccuccucaccucugga

SEQ ID NO: 2182551 - RNA, 20 nt, Human
aggacuccccaggccaggcc

SEQ ID NO: 2182552 - RNA, 17 nt, Human
aggacuccuuaaauuug

SEQ ID NO: 2182553 - RNA, 21 nt, Human
aggaccuguggccaaguucuu

SEQ ID NO: 2182554 - RNA, 16 nt, Human
aggaccuuaucugugc

SEQ ID NO: 2182555 - RNA, 15 nt, Human
aggaccuuaucugug

SEQ ID NO: 2182556 - RNA, 19 nt, Human
aggaccuucgggcugugcc

SEQ ID NO: 2182557 - RNA, 18 nt, Human
aggaccuucgggcugugc

SEQ ID NO: 2182558 - RNA, 13 nt, Human
aggacacagucag

SEQ ID NO: 2182559 - RNA, 23 nt, Human
aggacacagaugaaacacaaaca

SEQ ID NO: 2182560 - RNA, 13 nt, Human
aggacacacuaau

SEQ ID NO: 2182561 - RNA, 23 nt, Human
aggacacacuaaucgaacuauga

SEQ ID NO: 2182562 - RNA, 18 nt, Human
aggacaauucaugaacuu

SEQ ID NO: 2182563 - RNA, 14 nt, Human
aggacaauuucaaa

SEQ ID NO: 2182564 - RNA, 15 nt, Human
aggacaauuucaaaa

SEQ ID NO: 2182565 - RNA, 16 nt, Human
aggacaauuucaaaaa

SEQ ID NO: 2182566 - RNA, 16 nt, Human
aggacaacgaggaagc

SEQ ID NO: 2182567 - RNA, 22 nt, Human
aggaauucuaggcaucccaggg

SEQ ID NO: 2182568 - RNA, 23 nt, Human
aggaauucccagcccaaagcugu

SEQ ID NO: 2182569 - RNA, 20 nt, Human
aggaauuccccaaagaaugu

SEQ ID NO: 2182570 - RNA, 14 nt, Human
aggacaacgaggaa

SEQ ID NO: 2182571 - RNA, 18 nt, Human
aggacaacgaggaagccc

SEQ ID NO: 2182572 - RNA, 17 nt, Human
aggacaacgaggaagcc

SEQ ID NO: 2182573 - RNA, 14 nt, Human
aggacaaggcuaga

SEQ ID NO: 2182574 - RNA, 17 nt, Human
aggacaaucaguccccu

SEQ ID NO: 2182575 - RNA, 18 nt, Human
aggacaaucaguccccuc

SEQ ID NO: 2182576 - RNA, 19 nt, Human
aggacaaucaguccccucc

SEQ ID NO: 2182577 - RNA, 20 nt, Human
aggacaaucaguccccuccc

SEQ ID NO: 2182578 - RNA, 21 nt, Human
aggacaaucaguccccuccca

SEQ ID NO: 2182579 - RNA, 22 nt, Human
aggacaaucaguccccucccau

SEQ ID NO: 2182580 - RNA, 23 nt, Human
aggacaaucaguccccucccauc

SEQ ID NO: 2182581 - RNA, 14 nt, Human
aggacgcucucugg

SEQ ID NO: 2182582 - RNA, 13 nt, Human
aggacgcucucug

SEQ ID NO: 2182583 - RNA, 21 nt, Human
aggaccuuuccaccacagcca

SEQ ID NO: 2182584 - RNA, 20 nt, Human
aggaccuucgggcugugccc

SEQ ID NO: 2182585 - RNA, 20 nt, Human
aggacgaacauccaaccuuc

SEQ ID NO: 2182586 - RNA, 22 nt, Human
aggaccuuuccaccacagccag

SEQ ID NO: 2182587 - RNA, 14 nt, Human
aggacgccacccag

SEQ ID NO: 2182588 - RNA, 20 nt, Human
aggacgcucucuggccuucg

SEQ ID NO: 2182589 - RNA, 19 nt, Human
aggacgcucucuggccuuc

SEQ ID NO: 2182590 - RNA, 17 nt, Human
aggacgcucucuggccu

SEQ ID NO: 2182591 - RNA, 16 nt, Human
aggacgcucucuggcc

SEQ ID NO: 2182592 - RNA, 16 nt, Human
agcccugggaucacug

SEQ ID NO: 2182593 - RNA, 18 nt, Human
agcccugggaucacugug

SEQ ID NO: 2182594 - RNA, 16 nt, Human
agcccugggccccacc

SEQ ID NO: 2182595 - RNA, 23 nt, Human
agcccugggccccaccaccuagg

SEQ ID NO: 2182596 - RNA, 19 nt, Human
agcccugggccccaccacc

SEQ ID NO: 2182597 - RNA, 17 nt, Human
agcccugggccccacca

SEQ ID NO: 2182598 - RNA, 22 nt, Human
ugcacaugucuuguacaugugu

SEQ ID NO: 2182599 - RNA, 13 nt, Human
ugcacaugugugc

SEQ ID NO: 2182600 - RNA, 21 nt, Human
agcccugggccccaccaccua

SEQ ID NO: 2182601 - RNA, 23 nt, Human
ugcacaugucuuguacaugugua

SEQ ID NO: 2182602 - RNA, 13 nt, Human
ugcacauguuucc

SEQ ID NO: 2182603 - RNA, 14 nt, Human
ugcacauguuuccu

SEQ ID NO: 2182604 - RNA, 16 nt, Human
ugcacauguuuccucu

SEQ ID NO: 2182605 - RNA, 17 nt, Human
ugcacauguuuccucua

SEQ ID NO: 2182606 - RNA, 18 nt, Human
ugcacauguuuccucuag

SEQ ID NO: 2182607 - RNA, 20 nt, Human
agcccugcagugugguagcg

SEQ ID NO: 2182608 - RNA, 17 nt, Human
agcccugggaggcucug

SEQ ID NO: 2182609 - RNA, 18 nt, Human
agcccugggaggcucugg

SEQ ID NO: 2182610 - RNA, 20 nt, Human
agcccugggaggcucuggag

SEQ ID NO: 2182611 - RNA, 19 nt, Human
ugcacaugugugcgugugc

SEQ ID NO: 2182612 - RNA, 15 nt, Human
ugcaccacugcacuc

SEQ ID NO: 2182613 - RNA, 15 nt, Human
ugcaccaacccagcc

SEQ ID NO: 2182614 - RNA, 21 nt, Human
ugcaccacugcacuccagccu

SEQ ID NO: 2182615 - RNA, 13 nt, Human
ugcaccagcccuu

SEQ ID NO: 2182616 - RNA, 16 nt, Human
ugcaccccccugggcu

SEQ ID NO: 2182617 - RNA, 15 nt, Human
ugcaccccccugggc

SEQ ID NO: 2182618 - RNA, 12 nt, Human
ugcacccccucc

SEQ ID NO: 2182619 - RNA, 14 nt, Human
ugcacccccuccug

SEQ ID NO: 2182620 - RNA, 14 nt, Human
ugcaccccccuggg

SEQ ID NO: 2182621 - RNA, 16 nt, Human
ugcaccccaugcuguu

SEQ ID NO: 2182622 - RNA, 14 nt, Human
ugcaccccaugcug

SEQ ID NO: 2182623 - RNA, 20 nt, Human
ugcaccccaaagcuuuccug

SEQ ID NO: 2182624 - RNA, 21 nt, Human
ugcaccccaaagcuuuccugc

SEQ ID NO: 2182625 - RNA, 22 nt, Human
ugcaccccaaagcuuuccugcc

SEQ ID NO: 2182626 - RNA, 23 nt, Human
ugcaccccaaagcuuuccugccc

SEQ ID NO: 2182627 - RNA, 16 nt, Human
ugcaccaacccagccg

SEQ ID NO: 2182628 - RNA, 14 nt, Human
agcccuggucucag

SEQ ID NO: 2182629 - RNA, 19 nt, Human
ugcaccaacccagccgcug

SEQ ID NO: 2182630 - RNA, 23 nt, Human
ugcaccaggguugaccccagagg

SEQ ID NO: 2182631 - RNA, 15 nt, Human
ugcaccaucccuuuu

SEQ ID NO: 2182632 - RNA, 18 nt, Human
ugcaccccaaagcuuucc

SEQ ID NO: 2182633 - RNA, 19 nt, Human
ugcaccccaaagcuuuccu

SEQ ID NO: 2182634 - RNA, 14 nt, Human
ugcacucagcucuu

SEQ ID NO: 2182635 - RNA, 22 nt, Human
ugcacccuggggccuggaccug

SEQ ID NO: 2182636 - RNA, 16 nt, Human
ugcaccggcuggccug

SEQ ID NO: 2182637 - RNA, 14 nt, Human
ugcacuccagccug

SEQ ID NO: 2182638 - RNA, 15 nt, Human
ugcacuccagccuga

SEQ ID NO: 2182639 - RNA, 15 nt, Human
ugcacccuggggccu

SEQ ID NO: 2182640 - RNA, 15 nt, Human
ugcaccccucccauu

SEQ ID NO: 2182641 - RNA, 15 nt, Human
ugcacccccuccugc

SEQ ID NO: 2182642 - RNA, 16 nt, Human
ugcacccccuccugcu

SEQ ID NO: 2182643 - RNA, 17 nt, Human
ugcacccccuccugcug

SEQ ID NO: 2182644 - RNA, 18 nt, Human
ugcacccccuccugcugc

SEQ ID NO: 2182645 - RNA, 19 nt, Human
ugcacccccuccugcugca

SEQ ID NO: 2182646 - RNA, 12 nt, Human
ugcaccccuccc

SEQ ID NO: 2182647 - RNA, 13 nt, Human
ugcaccccuccca

SEQ ID NO: 2182648 - RNA, 14 nt, Human
ugcaccccucccau

SEQ ID NO: 2182649 - RNA, 14 nt, Human
ugcaccggcuggcc

SEQ ID NO: 2182650 - RNA, 15 nt, Human
ugcaccggcuggccu

SEQ ID NO: 2182651 - RNA, 15 nt, Human
ugcacuccagccugg

SEQ ID NO: 2182652 - RNA, 17 nt, Human
ugcacuccagccugagc

SEQ ID NO: 2182653 - RNA, 18 nt, Human
ugcacuccagccugggca

SEQ ID NO: 2182654 - RNA, 17 nt, Human
ugcacuccagccugggc

SEQ ID NO: 2182655 - RNA, 13 nt, Human
ugcacuccagccu

SEQ ID NO: 2182656 - RNA, 12 nt, Human
ugcacuccagcc

SEQ ID NO: 2182657 - RNA, 16 nt, Human
ugcacuccagccuggg

SEQ ID NO: 2182658 - RNA, 18 nt, Human
ugcacuccagccugggcg

SEQ ID NO: 2182659 - RNA, 20 nt, Human
ugcacuccagccugggcaac

SEQ ID NO: 2182660 - RNA, 15 nt, Human
ugcagaaggaaaaau

SEQ ID NO: 2182661 - RNA, 16 nt, Human
ugcagaaggaaaaaug

SEQ ID NO: 2182662 - RNA, 19 nt, Human
ugcagaaggaaaaaugugu

SEQ ID NO: 2182663 - RNA, 22 nt, Human
ugcagaagacaguauggcagcu

SEQ ID NO: 2182664 - RNA, 13 nt, Human
ugcagaaggccaa

SEQ ID NO: 2182665 - RNA, 15 nt, Human
ugcagaaggccaaga

SEQ ID NO: 2182666 - RNA, 20 nt, Human
ugcagaaggaaaaaugugua

SEQ ID NO: 2182667 - RNA, 21 nt, Human
ugcagaaggaaaaauguguaa

SEQ ID NO: 2182668 - RNA, 22 nt, Human
ugcagaaggaaaaauguguaau

SEQ ID NO: 2182669 - RNA, 23 nt, Human
ugcagaaggaagggcauccuucu

SEQ ID NO: 2182670 - RNA, 21 nt, Human
ugcagaauacaguaagcugcu

SEQ ID NO: 2182671 - RNA, 23 nt, Human
agcccugaguuccuagccaccgc

SEQ ID NO: 2182672 - RNA, 20 nt, Human
agcccugaguuccuagccac

SEQ ID NO: 2182673 - RNA, 16 nt, Human
agcccgggcucugccu

SEQ ID NO: 2182674 - RNA, 18 nt, Human
agcccugaguuccuagcc

SEQ ID NO: 2182675 - RNA, 15 nt, Human
agccccuucucagaa

SEQ ID NO: 2182676 - RNA, 16 nt, Human
agccccuucucagaau

SEQ ID NO: 2182677 - RNA, 18 nt, Human
agccccuucucagaaucu

SEQ ID NO: 2182678 - RNA, 19 nt, Human
agccccuucucagaaucua

SEQ ID NO: 2182679 - RNA, 14 nt, Human
agcccugcagaggg

SEQ ID NO: 2182680 - RNA, 15 nt, Human
agcccugcagagggc

SEQ ID NO: 2182681 - RNA, 16 nt, Human
agcccugcagagggca

SEQ ID NO: 2182682 - RNA, 19 nt, Human
agcccugcagagggcacag

SEQ ID NO: 2182683 - RNA, 14 nt, Human
agccccuucugacc

SEQ ID NO: 2182684 - RNA, 14 nt, Human
agccccuuagcccc

SEQ ID NO: 2182685 - RNA, 18 nt, Human
agccccuguggagacugg

SEQ ID NO: 2182686 - RNA, 13 nt, Human
agccccuucccca

SEQ ID NO: 2182687 - RNA, 15 nt, Human
agccccuuccccaug

SEQ ID NO: 2182688 - RNA, 17 nt, Human
agccccuuccccauggg

SEQ ID NO: 2182689 - RNA, 17 nt, Human
agccccuuccuugcucu

SEQ ID NO: 2182690 - RNA, 23 nt, Human
agccccuuccuugcucugcaccc

SEQ ID NO: 2182691 - RNA, 15 nt, Human
agccccuucugaccc

SEQ ID NO: 2182692 - RNA, 16 nt, Human
agccccuucugaccca

SEQ ID NO: 2182693 - RNA, 19 nt, Human
agccccuucugacccaugc

SEQ ID NO: 2182694 - RNA, 13 nt, Human
agcccgggcucug

SEQ ID NO: 2182695 - RNA, 14 nt, Human
agcccgggcucugc

SEQ ID NO: 2182696 - RNA, 15 nt, Human
agcccgggcucugcc

SEQ ID NO: 2182697 - RNA, 19 nt, Human
agcccccuggccucugugc

SEQ ID NO: 2182698 - RNA, 17 nt, Human
agcccccuggccucugu

SEQ ID NO: 2182699 - RNA, 16 nt, Human
agcccccuggccucug

SEQ ID NO: 2182700 - RNA, 22 nt, Human
agcccaggccgggguggagcau

SEQ ID NO: 2182701 - RNA, 15 nt, Human
agcccccuggccucu

SEQ ID NO: 2182702 - RNA, 14 nt, Human
agcccaggccuccu

SEQ ID NO: 2182703 - RNA, 19 nt, Human
agcccaggccuccuacagc

SEQ ID NO: 2182704 - RNA, 18 nt, Human
agccccgcgccuccuucc

SEQ ID NO: 2182705 - RNA, 15 nt, Human
agccccgcgccuccu

SEQ ID NO: 2182706 - RNA, 16 nt, Human
agccccgccuccaggc

SEQ ID NO: 2182707 - RNA, 23 nt, Human
agccccgcagaccuccccagccc

SEQ ID NO: 2182708 - RNA, 14 nt, Human
agccccgaggccuu

SEQ ID NO: 2182709 - RNA, 16 nt, Human
agcccccuugacaccg

SEQ ID NO: 2182710 - RNA, 18 nt, Human
agcccccuuugggcccag

SEQ ID NO: 2182711 - RNA, 19 nt, Human
agcccccuuugggcccagg

SEQ ID NO: 2182712 - RNA, 20 nt, Human
agcccccuuugggcccaggg

SEQ ID NO: 2182713 - RNA, 21 nt, Human
agcccccuuugggcccaggga

SEQ ID NO: 2182714 - RNA, 22 nt, Human
agccccuccucugccaccuccc

SEQ ID NO: 2182715 - RNA, 21 nt, Human
agccccuccucugccaccucc

SEQ ID NO: 2182716 - RNA, 20 nt, Human
agccccuccucugccaccuc

SEQ ID NO: 2182717 - RNA, 19 nt, Human
agccccuccucugccaccu

SEQ ID NO: 2182718 - RNA, 23 nt, Human
agccccuccucugccaccucccc

SEQ ID NO: 2182719 - RNA, 12 nt, Human
agccccucuggu

SEQ ID NO: 2182720 - RNA, 13 nt, Human
agccccucugguc

SEQ ID NO: 2182721 - RNA, 16 nt, Human
agccccucuggucgcu

SEQ ID NO: 2182722 - RNA, 23 nt, Human
agccccugucuagagagggaggc

SEQ ID NO: 2182723 - RNA, 22 nt, Human
agccccugucuagagagggagg

SEQ ID NO: 2182724 - RNA, 14 nt, Human
agccccuguggaga

SEQ ID NO: 2182725 - RNA, 15 nt, Human
agccccuguggagac

SEQ ID NO: 2182726 - RNA, 21 nt, Human
agccccugucuagagagggag

SEQ ID NO: 2182727 - RNA, 20 nt, Human
agccccugucuagagaggga

SEQ ID NO: 2182728 - RNA, 12 nt, Human
agccccugggug

SEQ ID NO: 2182729 - RNA, 14 nt, Human
agccccugguccug

SEQ ID NO: 2182730 - RNA, 18 nt, Human
agccccuguauggcacug

SEQ ID NO: 2182731 - RNA, 11 nt, Human
agccccuccuc

SEQ ID NO: 2182732 - RNA, 23 nt, Human
agccccucccaccacagcaggug

SEQ ID NO: 2182733 - RNA, 18 nt, Human
agccccuccucugccacc

SEQ ID NO: 2182734 - RNA, 17 nt, Human
agccccuccucugccac

SEQ ID NO: 2182735 - RNA, 16 nt, Human
agccccuccucugcca

SEQ ID NO: 2182736 - RNA, 15 nt, Human
agccccuccucugcc

SEQ ID NO: 2182737 - RNA, 14 nt, Human
agccccuccucugc

SEQ ID NO: 2182738 - RNA, 13 nt, Human
agccccuccucug

SEQ ID NO: 2182739 - RNA, 12 nt, Human
agccccuccucu

SEQ ID NO: 2182740 - RNA, 18 nt, Human
agccccgugggguuccuc

SEQ ID NO: 2182741 - RNA, 18 nt, Human
agccccucccaccacagc

SEQ ID NO: 2182742 - RNA, 21 nt, Human
agccccggcccugggcucgga

SEQ ID NO: 2182743 - RNA, 24 nt, Human
agccccggggugaguccauucucc

SEQ ID NO: 2182744 - RNA, 22 nt, Human
agccccgcagaccuccccagcc

SEQ ID NO: 2182745 - RNA, 14 nt, Human
agccccggcccugg

SEQ ID NO: 2182746 - RNA, 16 nt, Human
agccccggcccugggc

SEQ ID NO: 2182747 - RNA, 18 nt, Human
agccccggcccugggcuc

SEQ ID NO: 2182748 - RNA, 13 nt, Human
ugcaacaacaugu

SEQ ID NO: 2182749 - RNA, 15 nt, Human
ugcaacaacauguau

SEQ ID NO: 2182750 - RNA, 14 nt, Human
ugcaacacacagac

SEQ ID NO: 2182751 - RNA, 13 nt, Human
ugcaacacacaga

SEQ ID NO: 2182752 - RNA, 12 nt, Human
ugcaacacacag

SEQ ID NO: 2182753 - RNA, 13 nt, Human
ugcaacaaaauuc

SEQ ID NO: 2182754 - RNA, 15 nt, Human
ugcaacacacagaca

SEQ ID NO: 2182755 - RNA, 13 nt, Human
ugcaacagcacug

SEQ ID NO: 2182756 - RNA, 14 nt, Human
ugcaacagcacugg

SEQ ID NO: 2182757 - RNA, 17 nt, Human
ugcaacagcacuggcuc

SEQ ID NO: 2182758 - RNA, 13 nt, Human
ugcaacaggcugg

SEQ ID NO: 2182759 - RNA, 15 nt, Human
ugcaaauccuaugug

SEQ ID NO: 2182760 - RNA, 14 nt, Human
ugcaaauccuaugu

SEQ ID NO: 2182761 - RNA, 12 nt, Human
ugcaaauccuau

SEQ ID NO: 2182762 - RNA, 21 nt, Human
ugcaaauauuuuuuuguagau

SEQ ID NO: 2182763 - RNA, 10 nt, Human
ugcaaauccu

SEQ ID NO: 2182764 - RNA, 18 nt, Human
ugcaaauauuuuuuugua

SEQ ID NO: 2182765 - RNA, 22 nt, Human
ugcaaaugucagauacaaugua

SEQ ID NO: 2182766 - RNA, 18 nt, Human
ugcaaaugucaucagaac

SEQ ID NO: 2182767 - RNA, 14 nt, Human
ugcaaauuaacagu

SEQ ID NO: 2182768 - RNA, 15 nt, Human
ugcaaaugcuguauu

SEQ ID NO: 2182769 - RNA, 21 nt, Human
ugcaaaugcuaugagaugcau

SEQ ID NO: 2182770 - RNA, 14 nt, Human
ugcaaaucuugaaa

SEQ ID NO: 2182771 - RNA, 19 nt, Human
ugcaaauccuaugugauuu

SEQ ID NO: 2182772 - RNA, 21 nt, Human
ugcaaauccuaugugauuuua

SEQ ID NO: 2182773 - RNA, 18 nt, Human
ugcaaauccuaugugauu

SEQ ID NO: 2182774 - RNA, 17 nt, Human
ugcaaauccuaugugau

SEQ ID NO: 2182775 - RNA, 23 nt, Human
ugcaagccccugcuccagaagau

SEQ ID NO: 2182776 - RNA, 20 nt, Human
ugcaagcagggcucugcccc

SEQ ID NO: 2182777 - RNA, 16 nt, Human
ugcaagcagggcucug

SEQ ID NO: 2182778 - RNA, 17 nt, Human
ugcaagcagggcucugc

SEQ ID NO: 2182779 - RNA, 19 nt, Human
ugcaaggaagccacagcug

SEQ ID NO: 2182780 - RNA, 12 nt, Human
ugcaagccugcg

SEQ ID NO: 2182781 - RNA, 14 nt, Human
ugcaagccugcguu

SEQ ID NO: 2182782 - RNA, 20 nt, Human
ugcaaggaagccacagcugg

SEQ ID NO: 2182783 - RNA, 12 nt, Human
ugcaaggaagga

SEQ ID NO: 2182784 - RNA, 16 nt, Human
ugcaaggaaggaaaga

SEQ ID NO: 2182785 - RNA, 15 nt, Human
ugcaaggaaggaaag

SEQ ID NO: 2182786 - RNA, 15 nt, Human
ugcaaggaccaggac

SEQ ID NO: 2182787 - RNA, 14 nt, Human
ugcaaggaccagga

SEQ ID NO: 2182788 - RNA, 13 nt, Human
ugcaaggaccagg

SEQ ID NO: 2182789 - RNA, 19 nt, Human
ugcaaggaaggaaagaaag

SEQ ID NO: 2182790 - RNA, 14 nt, Human
ugcaagagccuugg

SEQ ID NO: 2182791 - RNA, 19 nt, Human
ugcaagagacucuggccuc

SEQ ID NO: 2182792 - RNA, 24 nt, Human
ugcaacagcacuggcucucuccag

SEQ ID NO: 2182793 - RNA, 15 nt, Human
ugcaacaggcacuca

SEQ ID NO: 2182794 - RNA, 23 nt, Human
ugcaagagccuugguguccaccu

SEQ ID NO: 2182795 - RNA, 18 nt, Human
ugcaagauucugaaacau

SEQ ID NO: 2182796 - RNA, 15 nt, Human
ugcaagccagauuuu

SEQ ID NO: 2182797 - RNA, 21 nt, Human
ugcaagccagauuuuccugaa

SEQ ID NO: 2182798 - RNA, 13 nt, Human
ugcaaggcaaaga

SEQ ID NO: 2182799 - RNA, 17 nt, Human
ugcaaggaccaggacuc

SEQ ID NO: 2182800 - RNA, 24 nt, Human
ugcaaggccgcuguucacccacag

SEQ ID NO: 2182801 - RNA, 23 nt, Human
ugcaaggccgcuguucacccaca

SEQ ID NO: 2182802 - RNA, 22 nt, Human
ugcaagggcagaacacuaaccu

SEQ ID NO: 2182803 - RNA, 15 nt, Human
ugcaagggcucccca

SEQ ID NO: 2182804 - RNA, 16 nt, Human
ugcaagggcuccccac

SEQ ID NO: 2182805 - RNA, 21 nt, Human
ugcaagggacuguguguugcc

SEQ ID NO: 2182806 - RNA, 20 nt, Human
ugcaagggcagaacacuaac

SEQ ID NO: 2182807 - RNA, 21 nt, Human
ugcaagggcagaacacuaacc

SEQ ID NO: 2182808 - RNA, 16 nt, Human
ugcaagggacugugug

SEQ ID NO: 2182809 - RNA, 14 nt, Human
ugcaaggccuuucu

SEQ ID NO: 2182810 - RNA, 11 nt, Human
ugcaagggaaa

SEQ ID NO: 2182811 - RNA, 22 nt, Human
ugcaaguguguaugugcgugug

SEQ ID NO: 2182812 - RNA, 19 nt, Human
ugcaaguguguaugugcgu

SEQ ID NO: 2182813 - RNA, 19 nt, Human
ugcaaguacugcuguaaau

SEQ ID NO: 2182814 - RNA, 15 nt, Human
ugcaaguacugcugu

SEQ ID NO: 2182815 - RNA, 23 nt, Human
ugcaagguuuaggcugguggccc

SEQ ID NO: 2182816 - RNA, 16 nt, Human
ugcaaggucuuugguu

SEQ ID NO: 2182817 - RNA, 15 nt, Human
ugcaagguggcucca

SEQ ID NO: 2182818 - RNA, 18 nt, Human
ugcaaggggaaaaucuca

SEQ ID NO: 2182819 - RNA, 20 nt, Human
ugcaagggcuccccacugcc

SEQ ID NO: 2182820 - RNA, 15 nt, Human
ugcaaggucauuuuu

SEQ ID NO: 2182821 - RNA, 23 nt, Human
ugcaagugugugcacaugugugc

SEQ ID NO: 2182822 - RNA, 21 nt, Human
ugcaagugugugcacaugugu

SEQ ID NO: 2182823 - RNA, 14 nt, Human
ugcaagugugugca

SEQ ID NO: 2182824 - RNA, 13 nt, Human
ugcaagugugugc

SEQ ID NO: 2182825 - RNA, 23 nt, Human
ugcaagugugugcaugugugcga

SEQ ID NO: 2182826 - RNA, 18 nt, Human
ugcaagugugugcaugug

SEQ ID NO: 2182827 - RNA, 22 nt, Human
ugcaauauaucuaaauugaaua

SEQ ID NO: 2182828 - RNA, 23 nt, Human
ugcaauauaucuaaauugaauaa

SEQ ID NO: 2182829 - RNA, 14 nt, Human
ugcaauauguauua

SEQ ID NO: 2182830 - RNA, 18 nt, Human
ugcaauauuaaugccuuu

SEQ ID NO: 2182831 - RNA, 21 nt, Human
ugcaauauuaaugccuuuaaa

SEQ ID NO: 2182832 - RNA, 16 nt, Human
ugcaauauuuccucau

SEQ ID NO: 2182833 - RNA, 19 nt, Human
ugcaauauuuccucaugug

SEQ ID NO: 2182834 - RNA, 19 nt, Human
ugcaauccugucuuucuga

SEQ ID NO: 2182835 - RNA, 22 nt, Human
ugcaauauuuccucaugugauc

SEQ ID NO: 2182836 - RNA, 22 nt, Human
ugcaaucguaauguacagaugg

SEQ ID NO: 2182837 - RNA, 13 nt, Human
agcccaggccccu

SEQ ID NO: 2182838 - RNA, 12 nt, Human
agcccaggccuc

SEQ ID NO: 2182839 - RNA, 17 nt, Human
ugauuucccguggcccc

SEQ ID NO: 2182840 - RNA, 18 nt, Human
ugauuucccguggcccca

SEQ ID NO: 2182841 - RNA, 18 nt, Human
ugauuuccaaagagaaaa

SEQ ID NO: 2182842 - RNA, 21 nt, Human
ugauuuccccuccaagguaug

SEQ ID NO: 2182843 - RNA, 19 nt, Human
ugauuucccguggccccag

SEQ ID NO: 2182844 - RNA, 20 nt, Human
ugauuucccguggccccagc

SEQ ID NO: 2182845 - RNA, 21 nt, Human
ugauuucccguggccccagcc

SEQ ID NO: 2182846 - RNA, 22 nt, Human
ugauuucccguggccccagccu

SEQ ID NO: 2182847 - RNA, 23 nt, Human
ugauuugacuguuuuuacccaua

SEQ ID NO: 2182848 - RNA, 12 nt, Human
ugauuugcauug

SEQ ID NO: 2182849 - RNA, 23 nt, Human
ugauuucccguggccccagccug

SEQ ID NO: 2182850 - RNA, 14 nt, Human
ugauuugacuguuu

SEQ ID NO: 2182851 - RNA, 18 nt, Human
ugauuugacuguuuuuac

SEQ ID NO: 2182852 - RNA, 20 nt, Human
ugauuugacuguuuuuaccc

SEQ ID NO: 2182853 - RNA, 12 nt, Human
ugauuuggaaaa

SEQ ID NO: 2182854 - RNA, 15 nt, Human
ugauuugcauugaac

SEQ ID NO: 2182855 - RNA, 18 nt, Human
ugauuugcauugaacaca

SEQ ID NO: 2182856 - RNA, 14 nt, Human
ugauuugcauugaa

SEQ ID NO: 2182857 - RNA, 13 nt, Human
ugauuugcauuga

SEQ ID NO: 2182858 - RNA, 12 nt, Human
ugcaaaccauca

SEQ ID NO: 2182859 - RNA, 13 nt, Human
ugcaaaccaucau

SEQ ID NO: 2182860 - RNA, 17 nt, Human
agccacggccaggccag

SEQ ID NO: 2182861 - RNA, 18 nt, Human
agccacggccaggccaga

SEQ ID NO: 2182862 - RNA, 16 nt, Human
ugauuuauaguuugua

SEQ ID NO: 2182863 - RNA, 22 nt, Human
ugauuuauaguuuguacaugca

SEQ ID NO: 2182864 - RNA, 13 nt, Human
ugauuuaugcaug

SEQ ID NO: 2182865 - RNA, 22 nt, Human
ugauuuaugcauggaaaccuga

SEQ ID NO: 2182866 - RNA, 14 nt, Human
ugauuuccaaagag

SEQ ID NO: 2182867 - RNA, 17 nt, Human
ugauuucauuucaacug

SEQ ID NO: 2182868 - RNA, 13 nt, Human
ugauuucauuuca

SEQ ID NO: 2182869 - RNA, 13 nt, Human
ugauuucauucaa

SEQ ID NO: 2182870 - RNA, 16 nt, Human
ugauuucacaacagau

SEQ ID NO: 2182871 - RNA, 19 nt, Human
ugauuucacaacagaucaa

SEQ ID NO: 2182872 - RNA, 19 nt, Human
ugcaaagaggcaagaggcu

SEQ ID NO: 2182873 - RNA, 15 nt, Human
ugcaaagaggcaaga

SEQ ID NO: 2182874 - RNA, 13 nt, Human
ugcaaagaggcaa

SEQ ID NO: 2182875 - RNA, 16 nt, Human
ugcaaagaaaaucaga

SEQ ID NO: 2182876 - RNA, 12 nt, Human
ugcaaagaaaau

SEQ ID NO: 2182877 - RNA, 12 nt, Human
ugcaaacuuuau

SEQ ID NO: 2182878 - RNA, 17 nt, Human
ugcaaacuuuauuuuca

SEQ ID NO: 2182879 - RNA, 18 nt, Human
ugcaaaccaucauugaaa

SEQ ID NO: 2182880 - RNA, 20 nt, Human
ugcaaaccaucauugaaauc

SEQ ID NO: 2182881 - RNA, 12 nt, Human
ugcaaagaucug

SEQ ID NO: 2182882 - RNA, 23 nt, Human
ugcaaagaucuguccucagccuu

SEQ ID NO: 2182883 - RNA, 18 nt, Human
ugcaaagcacugacuucu

SEQ ID NO: 2182884 - RNA, 22 nt, Human
ugcaaagcacugacuucuaagu

SEQ ID NO: 2182885 - RNA, 20 nt, Human
ugcaaagcacugacuucuaa

SEQ ID NO: 2182886 - RNA, 12 nt, Human
ugcaaagauuug

SEQ ID NO: 2182887 - RNA, 13 nt, Human
ugcaaaggacaga

SEQ ID NO: 2182888 - RNA, 12 nt, Human
ugcaaaggacug

SEQ ID NO: 2182889 - RNA, 15 nt, Human
ugcaaaggacagauc

SEQ ID NO: 2182890 - RNA, 12 nt, Human
ugcaaaggcugg

SEQ ID NO: 2182891 - RNA, 13 nt, Human
ugcaaaggcuggg

SEQ ID NO: 2182892 - RNA, 21 nt, Human
ugcaaaggguaucaggugcug

SEQ ID NO: 2182893 - RNA, 16 nt, Human
ugcaaaggaaauacca

SEQ ID NO: 2182894 - RNA, 13 nt, Human
ugcaaaggaaaua

SEQ ID NO: 2182895 - RNA, 17 nt, Human
ugcaaagcccagcuuga

SEQ ID NO: 2182896 - RNA, 15 nt, Human
ugcaaagcccagcuu

SEQ ID NO: 2182897 - RNA, 14 nt, Human
ugcaaagcccagcu

SEQ ID NO: 2182898 - RNA, 23 nt, Human
ugcaaaguucccuacuuccugug

SEQ ID NO: 2182899 - RNA, 22 nt, Human
ugcaaagucaugcaaaggcugg

SEQ ID NO: 2182900 - RNA, 23 nt, Human
ugcaaagucaugcaaaggcuggg

SEQ ID NO: 2182901 - RNA, 21 nt, Human
ugcaaagucaugcaaaggcug

SEQ ID NO: 2182902 - RNA, 20 nt, Human
ugcaaagucaugcaaaggcu

SEQ ID NO: 2182903 - RNA, 14 nt, Human
ugcaaaggcuggga

SEQ ID NO: 2182904 - RNA, 20 nt, Human
ugcaaaguaucccuacugua

SEQ ID NO: 2182905 - RNA, 15 nt, Human
agccuguaaucccag

SEQ ID NO: 2182906 - RNA, 18 nt, Human
agccuguaaucccagcua

SEQ ID NO: 2182907 - RNA, 16 nt, Human
agccuguaucuugggg

SEQ ID NO: 2182908 - RNA, 17 nt, Human
agccuguaaucccagcu

SEQ ID NO: 2182909 - RNA, 16 nt, Human
agccuguaaucccagc

SEQ ID NO: 2182910 - RNA, 19 nt, Human
agccugucccauggacacu

SEQ ID NO: 2182911 - RNA, 11 nt, Human
agccuguccug

SEQ ID NO: 2182912 - RNA, 14 nt, Human
agccuguccugggc

SEQ ID NO: 2182913 - RNA, 17 nt, Human
agccuguccugggcugg

SEQ ID NO: 2182914 - RNA, 18 nt, Human
agccuguccugggcuggu

SEQ ID NO: 2182915 - RNA, 14 nt, Human
agccugucucuucc

SEQ ID NO: 2182916 - RNA, 15 nt, Human
agccugucucuucca

SEQ ID NO: 2182917 - RNA, 16 nt, Human
agccugucucuuccau

SEQ ID NO: 2182918 - RNA, 19 nt, Human
agccugugccucugggacu

SEQ ID NO: 2182919 - RNA, 18 nt, Human
agccugugccucugggac

SEQ ID NO: 2182920 - RNA, 17 nt, Human
agccugugccucuggga

SEQ ID NO: 2182921 - RNA, 21 nt, Human
agccugugcauguaugucuug

SEQ ID NO: 2182922 - RNA, 13 nt, Human
ugcauggagcagg

SEQ ID NO: 2182923 - RNA, 19 nt, Human
ugcauggcacuugcaucug

SEQ ID NO: 2182924 - RNA, 19 nt, Human
ugcauggaauuuguaaguu

SEQ ID NO: 2182925 - RNA, 23 nt, Human
ugcauggacaccccuuauccagg

SEQ ID NO: 2182926 - RNA, 23 nt, Human
ugcauggaaauucccuucaucug

SEQ ID NO: 2182927 - RNA, 19 nt, Human
ugcauggaaauucccuuca

SEQ ID NO: 2182928 - RNA, 20 nt, Human
ugcauggcacuugcaucugu

SEQ ID NO: 2182929 - RNA, 16 nt, Human
ugcauggcuccagaaa

SEQ ID NO: 2182930 - RNA, 11 nt, Human
agccugaggcu

SEQ ID NO: 2182931 - RNA, 18 nt, Human
ugcauggcuccagaaaug

SEQ ID NO: 2182932 - RNA, 19 nt, Human
ugcauggcuccagaaaugu

SEQ ID NO: 2182933 - RNA, 17 nt, Human
agccugaggcugagacu

SEQ ID NO: 2182934 - RNA, 13 nt, Human
agccugaguagaa

SEQ ID NO: 2182935 - RNA, 19 nt, Human
agccugagucaccugcaga

SEQ ID NO: 2182936 - RNA, 23 nt, Human
agccugaguagaaaggccuuuaa

SEQ ID NO: 2182937 - RNA, 15 nt, Human
agccugagucuccug

SEQ ID NO: 2182938 - RNA, 16 nt, Human
agccugagucaccugc

SEQ ID NO: 2182939 - RNA, 17 nt, Human
agccugaguagaaaggc

SEQ ID NO: 2182940 - RNA, 22 nt, Human
agccugaguagaaaggccuuua

SEQ ID NO: 2182941 - RNA, 19 nt, Human
agccuugcggaagguucua

SEQ ID NO: 2182942 - RNA, 21 nt, Human
agccuugaccauucuccaccu

SEQ ID NO: 2182943 - RNA, 18 nt, Human
agccuugaccauucucca

SEQ ID NO: 2182944 - RNA, 19 nt, Human
agccuugaccauucuccac

SEQ ID NO: 2182945 - RNA, 16 nt, Human
agccuuggauguauau

SEQ ID NO: 2182946 - RNA, 23 nt, Human
agccuuggauaaugcuguugccu

SEQ ID NO: 2182947 - RNA, 22 nt, Human
agccuuggauaaugcuguugcc

SEQ ID NO: 2182948 - RNA, 20 nt, Human
agccuuggauaaugcuguug

SEQ ID NO: 2182949 - RNA, 19 nt, Human
agccuuggauaaugcuguu

SEQ ID NO: 2182950 - RNA, 23 nt, Human
agccuugggaacaugcgugugac

SEQ ID NO: 2182951 - RNA, 16 nt, Human
agccuuggcaucuaga

SEQ ID NO: 2182952 - RNA, 16 nt, Human
agccuugggaccccug

SEQ ID NO: 2182953 - RNA, 23 nt, Human
agccuuggggauucuuccaucug

SEQ ID NO: 2182954 - RNA, 16 nt, Human
agccuuggggauucuu

SEQ ID NO: 2182955 - RNA, 11 nt, Human
agcgccccucc

SEQ ID NO: 2182956 - RNA, 15 nt, Human
agcgccccucccuag

SEQ ID NO: 2182957 - RNA, 19 nt, Human
agcgcccgcugggcugagc

SEQ ID NO: 2182958 - RNA, 16 nt, Human
agcgccccucccuagu

SEQ ID NO: 2182959 - RNA, 14 nt, Human
agcgcccgcugggc

SEQ ID NO: 2182960 - RNA, 15 nt, Human
agcgcccgcugggcu

SEQ ID NO: 2182961 - RNA, 16 nt, Human
agcgcccgcugggcug

SEQ ID NO: 2182962 - RNA, 20 nt, Human
agccuuagaagucacacagu

SEQ ID NO: 2182963 - RNA, 22 nt, Human
agccuuagaagucacacaguau

SEQ ID NO: 2182964 - RNA, 14 nt, Human
agccuucucuguuc

SEQ ID NO: 2182965 - RNA, 20 nt, Human
agccuguuuuaaguucugga

SEQ ID NO: 2182966 - RNA, 18 nt, Human
agccuguuuuguuggaag

SEQ ID NO: 2182967 - RNA, 18 nt, Human
agccuuaaucagguccuc

SEQ ID NO: 2182968 - RNA, 15 nt, Human
agccuguuuaagaga

SEQ ID NO: 2182969 - RNA, 12 nt, Human
agccugugccuc

SEQ ID NO: 2182970 - RNA, 20 nt, Human
agccuucugaggacauucca

SEQ ID NO: 2182971 - RNA, 15 nt, Human
agccuucuguaggaa

SEQ ID NO: 2182972 - RNA, 23 nt, Human
agccuucucuguucauuuccuca

SEQ ID NO: 2182973 - RNA, 22 nt, Human
agccuucucuguucauuuccuc

SEQ ID NO: 2182974 - RNA, 21 nt, Human
agccuucucuguucauuuccu

SEQ ID NO: 2182975 - RNA, 20 nt, Human
agccuucucuguucauuucc

SEQ ID NO: 2182976 - RNA, 19 nt, Human
agccuucucuguucauuuc

SEQ ID NO: 2182977 - RNA, 15 nt, Human
agccuucucuguuca

SEQ ID NO: 2182978 - RNA, 19 nt, Human
agccuucuuugcuugccuc

SEQ ID NO: 2182979 - RNA, 23 nt, Human
agccuucuuugcuugccucucug

SEQ ID NO: 2182980 - RNA, 18 nt, Human
agccuucuuccaucccag

SEQ ID NO: 2182981 - RNA, 20 nt, Human
agccuucuuccaucccagga

SEQ ID NO: 2182982 - RNA, 22 nt, Human
agccuucuuccaucccaggaca

SEQ ID NO: 2182983 - RNA, 15 nt, Human
agccuucuuugcuug

SEQ ID NO: 2182984 - RNA, 23 nt, Human
agccuugaacuuugaccucugca

SEQ ID NO: 2182985 - RNA, 13 nt, Human
agccuugaacuuu

SEQ ID NO: 2182986 - RNA, 18 nt, Human
ugcauuguaucgauguua

SEQ ID NO: 2182987 - RNA, 21 nt, Human
agcgccuaguggggucucccu

SEQ ID NO: 2182988 - RNA, 24 nt, Human
agcgccgugaguucucagggcucc

SEQ ID NO: 2182989 - RNA, 20 nt, Human
ugcauuggaagaccccaccc

SEQ ID NO: 2182990 - RNA, 16 nt, Human
agcgcccuuccucucc

SEQ ID NO: 2182991 - RNA, 17 nt, Human
agcgcccuuccucucca

SEQ ID NO: 2182992 - RNA, 17 nt, Human
agcgccgugaguucuca

SEQ ID NO: 2182993 - RNA, 19 nt, Human
agcgccgugaguucucagg

SEQ ID NO: 2182994 - RNA, 20 nt, Human
agcgccgugaguucucaggg

SEQ ID NO: 2182995 - RNA, 21 nt, Human
agcgccgugaguucucagggc

SEQ ID NO: 2182996 - RNA, 22 nt, Human
agcgccgugaguucucagggcu

SEQ ID NO: 2182997 - RNA, 23 nt, Human
agcgccgugaguucucagggcuc

SEQ ID NO: 2182998 - RNA, 12 nt, Human
agcgcccuuccu

SEQ ID NO: 2182999 - RNA, 13 nt, Human
agcgcccuuccuc

SEQ ID NO: 2183000 - RNA, 14 nt, Human
agcgcccuuccucu

SEQ ID NO: 2183001 - RNA, 15 nt, Human
agcgcccuuccucuc

SEQ ID NO: 2183002 - RNA, 19 nt, Human
ugccaagcacagugccugc

SEQ ID NO: 2183003 - RNA, 14 nt, Human
ugccaagcacugug

SEQ ID NO: 2183004 - RNA, 15 nt, Human
ugccaagcacugugc

SEQ ID NO: 2183005 - RNA, 17 nt, Human
ugccaagcacugugcuc

SEQ ID NO: 2183006 - RNA, 22 nt, Human
ugcauuuaaaacagacacuggc

SEQ ID NO: 2183007 - RNA, 20 nt, Human
ugcauuuaaaacagacacug

SEQ ID NO: 2183008 - RNA, 16 nt, Human
ugcauuuaaaagauac

SEQ ID NO: 2183009 - RNA, 12 nt, Human
ugcauugugcuu

SEQ ID NO: 2183010 - RNA, 15 nt, Human
ugcauugugcuucuu

SEQ ID NO: 2183011 - RNA, 13 nt, Human
ugcauugugcuuc

SEQ ID NO: 2183012 - RNA, 15 nt, Human
ugcauuuaaaacaga

SEQ ID NO: 2183013 - RNA, 19 nt, Human
ugcauuuaaaacagacacu

SEQ ID NO: 2183014 - RNA, 17 nt, Human
ugcauuuaaaacagaca

SEQ ID NO: 2183015 - RNA, 14 nt, Human
ugccaagcucagga

SEQ ID NO: 2183016 - RNA, 22 nt, Human
ugccaagcauuuaauguagcca

SEQ ID NO: 2183017 - RNA, 15 nt, Human
ugccaagcucaggac

SEQ ID NO: 2183018 - RNA, 13 nt, Human
ugccaagcuccaa

SEQ ID NO: 2183019 - RNA, 18 nt, Human
ugccaagcucaggaccag

SEQ ID NO: 2183020 - RNA, 22 nt, Human
ugccaagcucaggaccaggcaa

SEQ ID NO: 2183021 - RNA, 15 nt, Human
ugccaagcuccaagc

SEQ ID NO: 2183022 - RNA, 16 nt, Human
ugccaagcuccaagcc

SEQ ID NO: 2183023 - RNA, 23 nt, Human
ugccaagcuccaagccccaucuu

SEQ ID NO: 2183024 - RNA, 21 nt, Human
ugccaaggccagaguggccug

SEQ ID NO: 2183025 - RNA, 20 nt, Human
ugccaaggccagaguggccu

SEQ ID NO: 2183026 - RNA, 16 nt, Human
ugccaaggccagagug

SEQ ID NO: 2183027 - RNA, 21 nt, Human
ugccaaugaggucugaaaugg

SEQ ID NO: 2183028 - RNA, 19 nt, Human
ugccaauauuaaaucugcu

SEQ ID NO: 2183029 - RNA, 22 nt, Human
ugccaaggccagaguggccugg

SEQ ID NO: 2183030 - RNA, 21 nt, Human
ugccaauauuaaaucugcugg

SEQ ID NO: 2183031 - RNA, 20 nt, Human
ugccaaugaggucugaaaug

SEQ ID NO: 2183032 - RNA, 14 nt, Human
ugccaauggaaccu

SEQ ID NO: 2183033 - RNA, 18 nt, Human
ugccaauggaaccuccuu

SEQ ID NO: 2183034 - RNA, 18 nt, Human
ugccaaugggagcucaug

SEQ ID NO: 2183035 - RNA, 15 nt, Human
ugccacagagcgggg

SEQ ID NO: 2183036 - RNA, 19 nt, Human
ugccaauggaaccuccuuu

SEQ ID NO: 2183037 - RNA, 14 nt, Human
ugccacagagcggg

SEQ ID NO: 2183038 - RNA, 16 nt, Human
ugccacagagcgggga

SEQ ID NO: 2183039 - RNA, 13 nt, Human
ugccaauggacua

SEQ ID NO: 2183040 - RNA, 14 nt, Human
ugccaaugggagcu

SEQ ID NO: 2183041 - RNA, 12 nt, Human
ugccacagcucu

SEQ ID NO: 2183042 - RNA, 22 nt, Human
ugccacagccuccccugccagg

SEQ ID NO: 2183043 - RNA, 12 nt, Human
ugccacaggaca

SEQ ID NO: 2183044 - RNA, 21 nt, Human
ugccacagccuccccugccag

SEQ ID NO: 2183045 - RNA, 17 nt, Human
ugccacagccuccccug

SEQ ID NO: 2183046 - RNA, 13 nt, Human
ugccacagccucc

SEQ ID NO: 2183047 - RNA, 22 nt, Human
ugccagccagcagccagcucuc

SEQ ID NO: 2183048 - RNA, 17 nt, Human
ugccagccagcagccag

SEQ ID NO: 2183049 - RNA, 16 nt, Human
ugccagccagcagcca

SEQ ID NO: 2183050 - RNA, 14 nt, Human
ugccacaggccucc

SEQ ID NO: 2183051 - RNA, 20 nt, Human
ugccacaggacacagucaga

SEQ ID NO: 2183052 - RNA, 11 nt, Human
ugccacaggcc

SEQ ID NO: 2183053 - RNA, 12 nt, Human
ugccacaggccu

SEQ ID NO: 2183054 - RNA, 13 nt, Human
ugccacaggccuc

SEQ ID NO: 2183055 - RNA, 18 nt, Human
ugccacaggacacaguca

SEQ ID NO: 2183056 - RNA, 14 nt, Human
ugccacaggacaca

SEQ ID NO: 2183057 - RNA, 13 nt, Human
ugccacaggacac

SEQ ID NO: 2183058 - RNA, 15 nt, Human
ugccagccuggcuuc

SEQ ID NO: 2183059 - RNA, 12 nt, Human
ugccagccuggc

SEQ ID NO: 2183060 - RNA, 19 nt, Human
ugccagccgugaugcucag

SEQ ID NO: 2183061 - RNA, 20 nt, Human
ugccagccgugaugcucagg

SEQ ID NO: 2183062 - RNA, 21 nt, Human
ugccagccgugaugcucaggc

SEQ ID NO: 2183063 - RNA, 22 nt, Human
ugccagccgagauagccaaggc

SEQ ID NO: 2183064 - RNA, 23 nt, Human
ugccagccagcagccagcucuca

SEQ ID NO: 2183065 - RNA, 17 nt, Human
ugccagccgagauagcc

SEQ ID NO: 2183066 - RNA, 23 nt, Human
ugccagccuggcuucuggagccc

SEQ ID NO: 2183067 - RNA, 12 nt, Human
ugccagccuucc

SEQ ID NO: 2183068 - RNA, 14 nt, Human
ugccagccuuccuc

SEQ ID NO: 2183069 - RNA, 22 nt, Human
ugccagccuggcuucuggagcc

SEQ ID NO: 2183070 - RNA, 21 nt, Human
ugccagccuggcuucuggagc

SEQ ID NO: 2183071 - RNA, 20 nt, Human
ugccagccuggcuucuggag

SEQ ID NO: 2183072 - RNA, 18 nt, Human
ugccagccuggcuucugg

SEQ ID NO: 2183073 - RNA, 17 nt, Human
ugccagccuggcuucug

SEQ ID NO: 2183074 - RNA, 16 nt, Human
ugccagccuggcuucu

SEQ ID NO: 2183075 - RNA, 23 nt, Human
ugccagugccuuaccuccugccc

SEQ ID NO: 2183076 - RNA, 22 nt, Human
ugccagugccuuaccuccugcc

SEQ ID NO: 2183077 - RNA, 21 nt, Human
ugccagugccuuaccuccugc

SEQ ID NO: 2183078 - RNA, 20 nt, Human
ugccagugccuuaccuccug

SEQ ID NO: 2183079 - RNA, 17 nt, Human
ugccagcucagucccau

SEQ ID NO: 2183080 - RNA, 19 nt, Human
ugccagcuacuuccuccuc

SEQ ID NO: 2183081 - RNA, 21 nt, Human
ugccagccuuccucugcagcu

SEQ ID NO: 2183082 - RNA, 13 nt, Human
ugccagcuauuuu

SEQ ID NO: 2183083 - RNA, 17 nt, Human
ugccagccuuccucugc

SEQ ID NO: 2183084 - RNA, 18 nt, Human
ugccagccuuccucugca

SEQ ID NO: 2183085 - RNA, 23 nt, Human
ugccagccuuccucugcagcuga

SEQ ID NO: 2183086 - RNA, 17 nt, Human
ugccaguuauggcuaua

SEQ ID NO: 2183087 - RNA, 19 nt, Human
ugccaguuuuguuuccuuu

SEQ ID NO: 2183088 - RNA, 23 nt, Human
ugccaguuuaaucauugccuggu

SEQ ID NO: 2183089 - RNA, 12 nt, Human
ugccauaaaaca

SEQ ID NO: 2183090 - RNA, 13 nt, Human
ugccauaaaacau

SEQ ID NO: 2183091 - RNA, 14 nt, Human
ugccauaaaacauu

SEQ ID NO: 2183092 - RNA, 16 nt, Human
ugccauaaaacauuaa

SEQ ID NO: 2183093 - RNA, 13 nt, Human
ugccauaauuacu

SEQ ID NO: 2183094 - RNA, 17 nt, Human
ugcauagagccacguau

SEQ ID NO: 2183095 - RNA, 19 nt, Human
ugcauacuucaaaaguauu

SEQ ID NO: 2183096 - RNA, 23 nt, Human
ugcauacuuuuuaaauguaaaga

SEQ ID NO: 2183097 - RNA, 20 nt, Human
ugcauagauucccugagcag

SEQ ID NO: 2183098 - RNA, 17 nt, Human
ugcauagaauaaaauuu

SEQ ID NO: 2183099 - RNA, 22 nt, Human
ugcauacuuuuuaaauguaaag

SEQ ID NO: 2183100 - RNA, 19 nt, Human
ugcauacuuuuuaaaugua

SEQ ID NO: 2183101 - RNA, 18 nt, Human
ugcauacuuuuuaaaugu

SEQ ID NO: 2183102 - RNA, 21 nt, Human
ugcauacuucaaaaguauuuu

SEQ ID NO: 2183103 - RNA, 13 nt, Human
ugcagucaucuug

SEQ ID NO: 2183104 - RNA, 17 nt, Human
ugcagucacuggagguu

SEQ ID NO: 2183105 - RNA, 14 nt, Human
ugcauaccacuuuu

SEQ ID NO: 2183106 - RNA, 13 nt, Human
ugcauacucauua

SEQ ID NO: 2183107 - RNA, 19 nt, Human
ugcauacucauuaggaugg

SEQ ID NO: 2183108 - RNA, 14 nt, Human
ugcauacuucaaaa

SEQ ID NO: 2183109 - RNA, 15 nt, Human
ugcauacuucaaaag

SEQ ID NO: 2183110 - RNA, 16 nt, Human
ugcauacuucaaaagu

SEQ ID NO: 2183111 - RNA, 17 nt, Human
ugcauacuucaaaagua

SEQ ID NO: 2183112 - RNA, 18 nt, Human
ugcauacuucaaaaguau

SEQ ID NO: 2183113 - RNA, 21 nt, Human
ugcagucagucaugauggcac

SEQ ID NO: 2183114 - RNA, 14 nt, Human
ugcagucacuggag

SEQ ID NO: 2183115 - RNA, 15 nt, Human
ugcagucacuggagg

SEQ ID NO: 2183116 - RNA, 21 nt, Human
ugcagucacguggaggagcag

SEQ ID NO: 2183117 - RNA, 19 nt, Human
ugcagucacguggaggagc

SEQ ID NO: 2183118 - RNA, 16 nt, Human
ugcauaccacuuuugu

SEQ ID NO: 2183119 - RNA, 20 nt, Human
ugcauaccacuuuuguucuu

SEQ ID NO: 2183120 - RNA, 18 nt, Human
ugcauaccacuuuuguuc

SEQ ID NO: 2183121 - RNA, 20 nt, Human
ugcagguucuucuuccugaa

SEQ ID NO: 2183122 - RNA, 23 nt, Human
ugcagguugggccauacuggccu

SEQ ID NO: 2183123 - RNA, 15 nt, Human
ugcagguuuguuaca

SEQ ID NO: 2183124 - RNA, 16 nt, Human
ugcaguagauuuucuu

SEQ ID NO: 2183125 - RNA, 16 nt, Human
ugcagguuuguuacau

SEQ ID NO: 2183126 - RNA, 19 nt, Human
ugcaguagauuuucuuuaa

SEQ ID NO: 2183127 - RNA, 20 nt, Human
ugcaguagauuuucuuuaaa

SEQ ID NO: 2183128 - RNA, 15 nt, Human
ugcaguagucucugu

SEQ ID NO: 2183129 - RNA, 18 nt, Human
ugcaguagucucugugcu

SEQ ID NO: 2183130 - RNA, 15 nt, Human
ugcaguaugaaaaua

SEQ ID NO: 2183131 - RNA, 17 nt, Human
ugcaguauugagcacug

SEQ ID NO: 2183132 - RNA, 16 nt, Human
ugcaguaugaaaauaa

SEQ ID NO: 2183133 - RNA, 21 nt, Human
ugcaguaucaugcccugugca

SEQ ID NO: 2183134 - RNA, 16 nt, Human
ugcaguaucaugcccu

SEQ ID NO: 2183135 - RNA, 21 nt, Human
ugcaguagucucugugcuuug

SEQ ID NO: 2183136 - RNA, 19 nt, Human
ugcauagagccacguaugu

SEQ ID NO: 2183137 - RNA, 17 nt, Human
ugcaucguuucaucuuc

SEQ ID NO: 2183138 - RNA, 14 nt, Human
ugcaucuacuccca

SEQ ID NO: 2183139 - RNA, 19 nt, Human
ugcauagagguaccagcaa

SEQ ID NO: 2183140 - RNA, 21 nt, Human
ugcaucuagaggcuuccuuca

SEQ ID NO: 2183141 - RNA, 18 nt, Human
ugcaucuagauuauggag

SEQ ID NO: 2183142 - RNA, 21 nt, Human
ugcaucucacuggaugcaaag

SEQ ID NO: 2183143 - RNA, 19 nt, Human
ugcaucuacucccaaguau

SEQ ID NO: 2183144 - RNA, 13 nt, Human
ugcaucucagccc

SEQ ID NO: 2183145 - RNA, 14 nt, Human
ugcaucucagccca

SEQ ID NO: 2183146 - RNA, 13 nt, Human
ugcaucuguccuc

SEQ ID NO: 2183147 - RNA, 19 nt, Human
ugcaugaagguuucugaaa

SEQ ID NO: 2183148 - RNA, 21 nt, Human
ugcaugaagguuucugaaaau

SEQ ID NO: 2183149 - RNA, 13 nt, Human
ugcaugaagguuu

SEQ ID NO: 2183150 - RNA, 18 nt, Human
ugcaugaagguuucugaa

SEQ ID NO: 2183151 - RNA, 11 nt, Human
ugcaugaaaau

SEQ ID NO: 2183152 - RNA, 18 nt, Human
ugcaucuuacugaaggua

SEQ ID NO: 2183153 - RNA, 17 nt, Human
ugcaucuuacugaaggu

SEQ ID NO: 2183154 - RNA, 14 nt, Human
ugcaucuuacugaa

SEQ ID NO: 2183155 - RNA, 14 nt, Human
ugcaucuguccuca

SEQ ID NO: 2183156 - RNA, 19 nt, Human
ugcaucuguccucaugugu

SEQ ID NO: 2183157 - RNA, 22 nt, Human
ugcaucuuacugaagguaaaau

SEQ ID NO: 2183158 - RNA, 20 nt, Human
ugcaucuuggggacaucucu

SEQ ID NO: 2183159 - RNA, 19 nt, Human
ugcaugcucucugcagcca

SEQ ID NO: 2183160 - RNA, 18 nt, Human
ugcaugcucucugcagcc

SEQ ID NO: 2183161 - RNA, 17 nt, Human
ugcaugcucucugcagc

SEQ ID NO: 2183162 - RNA, 16 nt, Human
ugcaugcucucugcag

SEQ ID NO: 2183163 - RNA, 17 nt, Human
ugcaugcugcuggacag

SEQ ID NO: 2183164 - RNA, 15 nt, Human
ugcauggaaaccuga

SEQ ID NO: 2183165 - RNA, 19 nt, Human
ugcauggaaaccugaaaaa

SEQ ID NO: 2183166 - RNA, 11 nt, Human
ugcauggaaau

SEQ ID NO: 2183167 - RNA, 19 nt, Human
ugcaugcugucccuuacgu

SEQ ID NO: 2183168 - RNA, 21 nt, Human
ugcaugcugucccuuacguga

SEQ ID NO: 2183169 - RNA, 14 nt, Human
ugcaugccuggucu

SEQ ID NO: 2183170 - RNA, 13 nt, Human
ugcaugcggccca

SEQ ID NO: 2183171 - RNA, 15 nt, Human
ugcaugcggcccagc

SEQ ID NO: 2183172 - RNA, 16 nt, Human
ugcaugcggcccagcc

SEQ ID NO: 2183173 - RNA, 18 nt, Human
ugcaugcggcccagcccg

SEQ ID NO: 2183174 - RNA, 21 nt, Human
ugcaugcggcccagcccggcu

SEQ ID NO: 2183175 - RNA, 18 nt, Human
ugcaugcugucccuuacg

SEQ ID NO: 2183176 - RNA, 18 nt, Human
ugcaugauuuuguaaccc

SEQ ID NO: 2183177 - RNA, 19 nt, Human
ugcaugcacuguucccccu

SEQ ID NO: 2183178 - RNA, 14 nt, Human
ugcaugauuuugua

SEQ ID NO: 2183179 - RNA, 18 nt, Human
ugcaugcagccacugugc

SEQ ID NO: 2183180 - RNA, 22 nt, Human
ugcaugcacuguucccccugug

SEQ ID NO: 2183181 - RNA, 22 nt, Human
ugcaugcagccacugugcugaa

SEQ ID NO: 2183182 - RNA, 22 nt, Human
ugcaugccaaauuguaguucuu

SEQ ID NO: 2183183 - RNA, 19 nt, Human
ugcaggugagcccauggcc

SEQ ID NO: 2183184 - RNA, 13 nt, Human
ugcaggugcacca

SEQ ID NO: 2183185 - RNA, 15 nt, Human
ugcaggucucaaccc

SEQ ID NO: 2183186 - RNA, 13 nt, Human
ugcagguggggag

SEQ ID NO: 2183187 - RNA, 16 nt, Human
ugcaggugcugcugcg

SEQ ID NO: 2183188 - RNA, 23 nt, Human
ugcaggugagcccauggcccucc

SEQ ID NO: 2183189 - RNA, 14 nt, Human
ugcaggugcugcug

SEQ ID NO: 2183190 - RNA, 20 nt, Human
ugcaggguggugcugggacu

SEQ ID NO: 2183191 - RNA, 18 nt, Human
ugcaggguggugcuggga

SEQ ID NO: 2183192 - RNA, 19 nt, Human
ugcaggguggugcugggac

SEQ ID NO: 2183193 - RNA, 22 nt, Human
ugcaggucccuaauaaagcugu

SEQ ID NO: 2183194 - RNA, 13 nt, Human
ugcaggggcucug

SEQ ID NO: 2183195 - RNA, 20 nt, Human
ugcaggggauugaagcccuc

SEQ ID NO: 2183196 - RNA, 21 nt, Human
ugcaggggauugaagcccucc

SEQ ID NO: 2183197 - RNA, 22 nt, Human
ugcagggggugugucugcucag

SEQ ID NO: 2183198 - RNA, 17 nt, Human
ugcaggguggugcuggg

SEQ ID NO: 2183199 - RNA, 19 nt, Human
ugcagggggugugucugcu

SEQ ID NO: 2183200 - RNA, 21 nt, Human
ugcaggggcucuggagagaaa

SEQ ID NO: 2183201 - RNA, 22 nt, Human
ugcaggggauugaagcccucca

SEQ ID NO: 2183202 - RNA, 14 nt, Human
ugcaggggcucugg

SEQ ID NO: 2183203 - RNA, 18 nt, Human
ugcaggggcucuggagag

SEQ ID NO: 2183204 - RNA, 19 nt, Human
ugcaggggcucuggagaga

SEQ ID NO: 2183205 - RNA, 23 nt, Human
agccucuuaaagcugccuguagu

SEQ ID NO: 2183206 - RNA, 22 nt, Human
agccucuuaaagcugccuguag

SEQ ID NO: 2183207 - RNA, 20 nt, Human
agccucuuaaagcugccugu

SEQ ID NO: 2183208 - RNA, 21 nt, Human
agccucugugucacuggcugc

SEQ ID NO: 2183209 - RNA, 13 nt, Human
agccucuguguca

SEQ ID NO: 2183210 - RNA, 14 nt, Human
agccucugugucac

SEQ ID NO: 2183211 - RNA, 15 nt, Human
agccucugugucacu

SEQ ID NO: 2183212 - RNA, 18 nt, Human
agccucugugucacuggc

SEQ ID NO: 2183213 - RNA, 19 nt, Human
agccucugugucacuggcu

SEQ ID NO: 2183214 - RNA, 20 nt, Human
agccucugugucacuggcug

SEQ ID NO: 2183215 - RNA, 23 nt, Human
agccucugugucacuggcugccu

SEQ ID NO: 2183216 - RNA, 20 nt, Human
agccucuccggcagaaggga

SEQ ID NO: 2183217 - RNA, 23 nt, Human
agccucugggucagugguccaca

SEQ ID NO: 2183218 - RNA, 22 nt, Human
agccucugggucagugguccac

SEQ ID NO: 2183219 - RNA, 14 nt, Human
agccucugucacug

SEQ ID NO: 2183220 - RNA, 22 nt, Human
agccucugucacugcaggcacu

SEQ ID NO: 2183221 - RNA, 21 nt, Human
agccucugucacugcaggcac

SEQ ID NO: 2183222 - RNA, 11 nt, Human
agccucugugu

SEQ ID NO: 2183223 - RNA, 18 nt, Human
agccucuuucugucccuu

SEQ ID NO: 2183224 - RNA, 15 nt, Human
agccucuuucugucc

SEQ ID NO: 2183225 - RNA, 18 nt, Human
ugcagccucacaguccuu

SEQ ID NO: 2183226 - RNA, 17 nt, Human
ugcagccucacaguccu

SEQ ID NO: 2183227 - RNA, 21 nt, Human
agccucuuucugucccuucug

SEQ ID NO: 2183228 - RNA, 21 nt, Human
ugcagccucacaguccuuacc

SEQ ID NO: 2183229 - RNA, 19 nt, Human
agccuccugaguagcugga

SEQ ID NO: 2183230 - RNA, 20 nt, Human
agccuccugaguagcuggga

SEQ ID NO: 2183231 - RNA, 11 nt, Human
agccuccugcc

SEQ ID NO: 2183232 - RNA, 13 nt, Human
agccuccugccca

SEQ ID NO: 2183233 - RNA, 14 nt, Human
agccuccugcccag

SEQ ID NO: 2183234 - RNA, 15 nt, Human
agccuccugcccagu

SEQ ID NO: 2183235 - RNA, 16 nt, Human
agccuccugcccaguc

SEQ ID NO: 2183236 - RNA, 13 nt, Human
agccuccugcccu

SEQ ID NO: 2183237 - RNA, 14 nt, Human
agccuccugcccuu

SEQ ID NO: 2183238 - RNA, 18 nt, Human
agccuccugcccuuaccu

SEQ ID NO: 2183239 - RNA, 12 nt, Human
ugcagacaggca

SEQ ID NO: 2183240 - RNA, 13 nt, Human
ugcagacaggcaa

SEQ ID NO: 2183241 - RNA, 21 nt, Human
ugcagacaggcaagcaccucc

SEQ ID NO: 2183242 - RNA, 21 nt, Human
agccuccuguguagcugggau

SEQ ID NO: 2183243 - RNA, 18 nt, Human
agccuccugcccaguccc

SEQ ID NO: 2183244 - RNA, 18 nt, Human
agccucgacacagagugg

SEQ ID NO: 2183245 - RNA, 17 nt, Human
agccucgacacagagug

SEQ ID NO: 2183246 - RNA, 20 nt, Human
agccucgccgucugugaauu

SEQ ID NO: 2183247 - RNA, 14 nt, Human
agccucuccaggaa

SEQ ID NO: 2183248 - RNA, 13 nt, Human
agccucuccccug

SEQ ID NO: 2183249 - RNA, 23 nt, Human
agccucuccccagguccagcucu

SEQ ID NO: 2183250 - RNA, 18 nt, Human
agccucuccccaggucca

SEQ ID NO: 2183251 - RNA, 22 nt, Human
agccucuccccagguccagcuc

SEQ ID NO: 2183252 - RNA, 12 nt, Human
agccucuccagg

SEQ ID NO: 2183253 - RNA, 18 nt, Human
agccucucaccuguacuc

SEQ ID NO: 2183254 - RNA, 23 nt, Human
agccucuccaggaaugccuccuc

SEQ ID NO: 2183255 - RNA, 16 nt, Human
agccucuccccagguc

SEQ ID NO: 2183256 - RNA, 18 nt, Human
agccucuagggaccccuc

SEQ ID NO: 2183257 - RNA, 16 nt, Human
agccucgucuucauua

SEQ ID NO: 2183258 - RNA, 20 nt, Human
agccucuagggaccccuccu

SEQ ID NO: 2183259 - RNA, 21 nt, Human
agccucuagggaccccuccuc

SEQ ID NO: 2183260 - RNA, 22 nt, Human
agccucuagggaccccuccucc

SEQ ID NO: 2183261 - RNA, 15 nt, Human
ugaguggcauggcca

SEQ ID NO: 2183262 - RNA, 13 nt, Human
ugaguggcagggg

SEQ ID NO: 2183263 - RNA, 21 nt, Human
ugaguggcaggggacaggagu

SEQ ID NO: 2183264 - RNA, 18 nt, Human
ugaguggaugauguuucg

SEQ ID NO: 2183265 - RNA, 12 nt, Human
ugagugccuggc

SEQ ID NO: 2183266 - RNA, 14 nt, Human
ugagugccuggcca

SEQ ID NO: 2183267 - RNA, 15 nt, Human
ugagugcaguccuga

SEQ ID NO: 2183268 - RNA, 16 nt, Human
ugagugccuuacacaa

SEQ ID NO: 2183269 - RNA, 14 nt, Human
ugagugauuauuug

SEQ ID NO: 2183270 - RNA, 19 nt, Human
ugagugcagccguuugaga

SEQ ID NO: 2183271 - RNA, 17 nt, Human
ugagugcagcucuggag

SEQ ID NO: 2183272 - RNA, 13 nt, Human
ugagugccuuaca

SEQ ID NO: 2183273 - RNA, 14 nt, Human
ugagugccuuacac

SEQ ID NO: 2183274 - RNA, 20 nt, Human
ugagugauccuccaacuuca

SEQ ID NO: 2183275 - RNA, 20 nt, Human
ugagugaugcggcagauuga

SEQ ID NO: 2183276 - RNA, 15 nt, Human
ugagugauccuccaa

SEQ ID NO: 2183277 - RNA, 17 nt, Human
ugagugagccuggcucu

SEQ ID NO: 2183278 - RNA, 19 nt, Human
ugagugagccuggcucuug

SEQ ID NO: 2183279 - RNA, 22 nt, Human
ugagugaggguuucugagcugc

SEQ ID NO: 2183280 - RNA, 14 nt, Human
ugagugauagagcu

SEQ ID NO: 2183281 - RNA, 20 nt, Human
ugagugauuauuuguuauuu

SEQ ID NO: 2183282 - RNA, 22 nt, Human
ugagucaugaucucccugccgc

SEQ ID NO: 2183283 - RNA, 20 nt, Human
ugagucaugaucucccugcc

SEQ ID NO: 2183284 - RNA, 20 nt, Human
ugagucagguuugaguagag

SEQ ID NO: 2183285 - RNA, 21 nt, Human
ugagucaugaucucccugccg

SEQ ID NO: 2183286 - RNA, 14 nt, Human
ugagugagccuggc

SEQ ID NO: 2183287 - RNA, 16 nt, Human
ugagugagccuggcuc

SEQ ID NO: 2183288 - RNA, 16 nt, Human
ugagucacccaugaag

SEQ ID NO: 2183289 - RNA, 20 nt, Human
ugagucacccuaccugugcc

SEQ ID NO: 2183290 - RNA, 13 nt, Human
ugagucaccagga

SEQ ID NO: 2183291 - RNA, 22 nt, Human
ugagucacccuaccugugccug

SEQ ID NO: 2183292 - RNA, 18 nt, Human
ugagucaccaagcccagu

SEQ ID NO: 2183293 - RNA, 20 nt, Human
ugaguacguugugcauuugg

SEQ ID NO: 2183294 - RNA, 15 nt, Human
ugaguacagcagaaa

SEQ ID NO: 2183295 - RNA, 14 nt, Human
ugaguacuacaguc

SEQ ID NO: 2183296 - RNA, 22 nt, Human
ugaguguuuuuacuacaguugu

SEQ ID NO: 2183297 - RNA, 16 nt, Human
ugaguuacagccuguu

SEQ ID NO: 2183298 - RNA, 18 nt, Human
ugaguucauacccuguua

SEQ ID NO: 2183299 - RNA, 15 nt, Human
ugaguuacuuccuau

SEQ ID NO: 2183300 - RNA, 24 nt, Human
ugaguuacuugcugcccugugcuc

SEQ ID NO: 2183301 - RNA, 14 nt, Human
ugaguuccuagcca

SEQ ID NO: 2183302 - RNA, 18 nt, Human
ugaguuccuagccaccgc

SEQ ID NO: 2183303 - RNA, 21 nt, Human
ugagugggggaucacagccuc

SEQ ID NO: 2183304 - RNA, 17 nt, Human
ugaguguguccaagugu

SEQ ID NO: 2183305 - RNA, 18 nt, Human
ugaguguggcuccccucu

SEQ ID NO: 2183306 - RNA, 17 nt, Human
ugaguguggcuccccuc

SEQ ID NO: 2183307 - RNA, 16 nt, Human
ugaguguggcuccccu

SEQ ID NO: 2183308 - RNA, 14 nt, Human
ugaguguggcuccc

SEQ ID NO: 2183309 - RNA, 12 nt, Human
ugaguguggaag

SEQ ID NO: 2183310 - RNA, 15 nt, Human
ugaguguggaagccg

SEQ ID NO: 2183311 - RNA, 19 nt, Human
ugauaauauuguggugcca

SEQ ID NO: 2183312 - RNA, 15 nt, Human
ugauacaaugcugug

SEQ ID NO: 2183313 - RNA, 14 nt, Human
ugauacaaugcugu

SEQ ID NO: 2183314 - RNA, 15 nt, Human
ugaguucuacauaag

SEQ ID NO: 2183315 - RNA, 20 nt, Human
ugaguucuacauaaguaauu

SEQ ID NO: 2183316 - RNA, 22 nt, Human
ugaguucuacauaaguaauuca

SEQ ID NO: 2183317 - RNA, 16 nt, Human
ugauaaguaaaugcua

SEQ ID NO: 2183318 - RNA, 17 nt, Human
agcaguaacugacaacu

SEQ ID NO: 2183319 - RNA, 17 nt, Human
agcagguuuuucuccuc

SEQ ID NO: 2183320 - RNA, 22 nt, Human
agcagguugaggggcuccugga

SEQ ID NO: 2183321 - RNA, 21 nt, Human
agcagguugaggggcuccugg

SEQ ID NO: 2183322 - RNA, 20 nt, Human
agcagguugaggggcuccug

SEQ ID NO: 2183323 - RNA, 23 nt, Human
agcagguucccaagcucagaggc

SEQ ID NO: 2183324 - RNA, 20 nt, Human
agcaggugguccugagaccu

SEQ ID NO: 2183325 - RNA, 21 nt, Human
agcaggugguccugagaccug

SEQ ID NO: 2183326 - RNA, 16 nt, Human
agcagguucccaagcu

SEQ ID NO: 2183327 - RNA, 18 nt, Human
agcagguucccaagcuca

SEQ ID NO: 2183328 - RNA, 17 nt, Human
agcagguucccaagcuc

SEQ ID NO: 2183329 - RNA, 22 nt, Human
agcaguagaaauaauaugcauu

SEQ ID NO: 2183330 - RNA, 21 nt, Human
agcaguagaaauaauaugcau

SEQ ID NO: 2183331 - RNA, 16 nt, Human
agcaguaucaugaagc

SEQ ID NO: 2183332 - RNA, 17 nt, Human
agcagucaggaaagaga

SEQ ID NO: 2183333 - RNA, 18 nt, Human
agcagucaggaaagagaa

SEQ ID NO: 2183334 - RNA, 19 nt, Human
agcauaaaaauuagccaag

SEQ ID NO: 2183335 - RNA, 14 nt, Human
agcaguuugcuuug

SEQ ID NO: 2183336 - RNA, 19 nt, Human
agcaguuucuguccugcug

SEQ ID NO: 2183337 - RNA, 20 nt, Human
agcaguuucuguccugcugg

SEQ ID NO: 2183338 - RNA, 18 nt, Human
agcaguuucuguccugcu

SEQ ID NO: 2183339 - RNA, 22 nt, Human
agcaguccugccucagccuccg

SEQ ID NO: 2183340 - RNA, 19 nt, Human
agcaguccugccucagccu

SEQ ID NO: 2183341 - RNA, 19 nt, Human
agcagucaggaaagagaac

SEQ ID NO: 2183342 - RNA, 16 nt, Human
agcagucgugccugug

SEQ ID NO: 2183343 - RNA, 17 nt, Human
agcagucgugccugugu

SEQ ID NO: 2183344 - RNA, 14 nt, Human
agcagucgugccug

SEQ ID NO: 2183345 - RNA, 12 nt, Human
agcauacaacuu

SEQ ID NO: 2183346 - RNA, 20 nt, Human
agcauacauuuauaauguuu

SEQ ID NO: 2183347 - RNA, 14 nt, Human
agcauacauuuaua

SEQ ID NO: 2183348 - RNA, 13 nt, Human
agcauacauuuau

SEQ ID NO: 2183349 - RNA, 13 nt, Human
agcauaccaacac

SEQ ID NO: 2183350 - RNA, 23 nt, Human
agcauaaaaauuagccaagugug

SEQ ID NO: 2183351 - RNA, 22 nt, Human
agcaguuuucaagucaaauuaa

SEQ ID NO: 2183352 - RNA, 21 nt, Human
agcaguuuucaagucaaauua

SEQ ID NO: 2183353 - RNA, 18 nt, Human
agcaguuuucaagucaaa

SEQ ID NO: 2183354 - RNA, 17 nt, Human
agcaguuuucaagucaa

SEQ ID NO: 2183355 - RNA, 13 nt, Human
agcaguuuucaag

SEQ ID NO: 2183356 - RNA, 16 nt, Human
agcauagaaggcaggu

SEQ ID NO: 2183357 - RNA, 22 nt, Human
agcauaccaacacgagcaggcu

SEQ ID NO: 2183358 - RNA, 19 nt, Human
agcauaccaacacgagcag

SEQ ID NO: 2183359 - RNA, 13 nt, Human
agcauaucugccu

SEQ ID NO: 2183360 - RNA, 23 nt, Human
ugaguaagagcuggugucugauu

SEQ ID NO: 2183361 - RNA, 21 nt, Human
ugaguaagagcuggugucuga

SEQ ID NO: 2183362 - RNA, 18 nt, Human
ugaguaagagcugguguc

SEQ ID NO: 2183363 - RNA, 17 nt, Human
ugaguaagagcuggugu

SEQ ID NO: 2183364 - RNA, 16 nt, Human
ugaguaagagcuggug

SEQ ID NO: 2183365 - RNA, 14 nt, Human
ugaguaagagcugg

SEQ ID NO: 2183366 - RNA, 15 nt, Human
agcauaucugccuuu

SEQ ID NO: 2183367 - RNA, 19 nt, Human
ugaguacguugugcauuug

SEQ ID NO: 2183368 - RNA, 18 nt, Human
ugaguacguugugcauuu

SEQ ID NO: 2183369 - RNA, 17 nt, Human
ugaguacguugugcauu

SEQ ID NO: 2183370 - RNA, 16 nt, Human
ugaguacguugugcau

SEQ ID NO: 2183371 - RNA, 13 nt, Human
agcagggaaacag

SEQ ID NO: 2183372 - RNA, 15 nt, Human
agcaggcugugaguu

SEQ ID NO: 2183373 - RNA, 13 nt, Human
agcaggcuggcag

SEQ ID NO: 2183374 - RNA, 14 nt, Human
agcaggcuggcagc

SEQ ID NO: 2183375 - RNA, 16 nt, Human
agcaggcuggcagcuc

SEQ ID NO: 2183376 - RNA, 17 nt, Human
agcaggcuggcagcucu

SEQ ID NO: 2183377 - RNA, 14 nt, Human
agcagggaaacagc

SEQ ID NO: 2183378 - RNA, 15 nt, Human
agcagggaaacagcu

SEQ ID NO: 2183379 - RNA, 21 nt, Human
agcaggcucucaggccagcug

SEQ ID NO: 2183380 - RNA, 22 nt, Human
agcaggcucucaggccagcugc

SEQ ID NO: 2183381 - RNA, 23 nt, Human
agcaggcucucaggccagcugcu

SEQ ID NO: 2183382 - RNA, 16 nt, Human
agcaggcuacacugac

SEQ ID NO: 2183383 - RNA, 22 nt, Human
agcaggcuacacugacacuggu

SEQ ID NO: 2183384 - RNA, 17 nt, Human
agcaggcucgggcuccc

SEQ ID NO: 2183385 - RNA, 13 nt, Human
agcaggcucucag

SEQ ID NO: 2183386 - RNA, 14 nt, Human
agcaggcucucagg

SEQ ID NO: 2183387 - RNA, 15 nt, Human
agcaggcucucaggc

SEQ ID NO: 2183388 - RNA, 16 nt, Human
agcaggcucucaggcc

SEQ ID NO: 2183389 - RNA, 17 nt, Human
agcaggcucucaggcca

SEQ ID NO: 2183390 - RNA, 18 nt, Human
agcaggcucucaggccag

SEQ ID NO: 2183391 - RNA, 19 nt, Human
agcaggcucucaggccagc

SEQ ID NO: 2183392 - RNA, 14 nt, Human
agcagguggggagg

SEQ ID NO: 2183393 - RNA, 13 nt, Human
agcaggugguccu

SEQ ID NO: 2183394 - RNA, 17 nt, Human
agcaggugguccugaga

SEQ ID NO: 2183395 - RNA, 18 nt, Human
agcaggugguccugagac

SEQ ID NO: 2183396 - RNA, 13 nt, Human
agcagguggggag

SEQ ID NO: 2183397 - RNA, 17 nt, Human
agcaggugggaaauggu

SEQ ID NO: 2183398 - RNA, 16 nt, Human
agcagguggcaucucu

SEQ ID NO: 2183399 - RNA, 19 nt, Human
agcagguggcaucucuaau

SEQ ID NO: 2183400 - RNA, 13 nt, Human
agcaggugcugac

SEQ ID NO: 2183401 - RNA, 15 nt, Human
agcaggugcugcuac

SEQ ID NO: 2183402 - RNA, 16 nt, Human
agcaggugcugcuacc

SEQ ID NO: 2183403 - RNA, 17 nt, Human
agcaggugcugcuaccc

SEQ ID NO: 2183404 - RNA, 18 nt, Human
agcaggugcugcuacccu

SEQ ID NO: 2183405 - RNA, 20 nt, Human
agcaggugcugcuacccucc

SEQ ID NO: 2183406 - RNA, 14 nt, Human
agcagguaccacug

SEQ ID NO: 2183407 - RNA, 15 nt, Human
agcagggugcugugg

SEQ ID NO: 2183408 - RNA, 17 nt, Human
agcaggguguugggaua

SEQ ID NO: 2183409 - RNA, 20 nt, Human
agcagguccccagcuuuggc

SEQ ID NO: 2183410 - RNA, 21 nt, Human
agcagguccccagcuuuggcu

SEQ ID NO: 2183411 - RNA, 21 nt, Human
agcaggguagucugguuucua

SEQ ID NO: 2183412 - RNA, 18 nt, Human
agcaggguagucugguuu

SEQ ID NO: 2183413 - RNA, 22 nt, Human
agcagggguccuuggugugacc

SEQ ID NO: 2183414 - RNA, 16 nt, Human
agcaggggcuacaaga

SEQ ID NO: 2183415 - RNA, 19 nt, Human
agcaggggcuacaagaggg

SEQ ID NO: 2183416 - RNA, 20 nt, Human
agcaggggcuacaagaggga

SEQ ID NO: 2183417 - RNA, 21 nt, Human
agcaggggcuacaagagggaa

SEQ ID NO: 2183418 - RNA, 16 nt, Human
agcagggucugggcag

SEQ ID NO: 2183419 - RNA, 17 nt, Human
agcagggucugggcagg

SEQ ID NO: 2183420 - RNA, 16 nt, Human
agcagggucuuuucau

SEQ ID NO: 2183421 - RNA, 18 nt, Human
agcagggucuuuucaucu

SEQ ID NO: 2183422 - RNA, 19 nt, Human
agcagggucuuuucaucug

SEQ ID NO: 2183423 - RNA, 20 nt, Human
agcagggucuuuucaucugg

SEQ ID NO: 2183424 - RNA, 22 nt, Human
agcagggucuuuucaucuggga

SEQ ID NO: 2183425 - RNA, 23 nt, Human
agcagggucuuuucaucugggaa

SEQ ID NO: 2183426 - RNA, 22 nt, Human
agcagggcucagcggggacagc

SEQ ID NO: 2183427 - RNA, 23 nt, Human
agcagggcuacccugagcugagg

SEQ ID NO: 2183428 - RNA, 16 nt, Human
agcagggcucugcccc

SEQ ID NO: 2183429 - RNA, 23 nt, Human
agcagggcucugccccagaggcc

SEQ ID NO: 2183430 - RNA, 16 nt, Human
agcagggcugcuguga

SEQ ID NO: 2183431 - RNA, 16 nt, Human
agcaggggcguggagg

SEQ ID NO: 2183432 - RNA, 20 nt, Human
agcagggagggcuucugcca

SEQ ID NO: 2183433 - RNA, 20 nt, Human
agcagggaaaauauauaucu

SEQ ID NO: 2183434 - RNA, 24 nt, Human
agcaggcuggcagcucuccaguca

SEQ ID NO: 2183435 - RNA, 20 nt, Human
agcaggcuggcagcucucca

SEQ ID NO: 2183436 - RNA, 22 nt, Human
agcaggcuggcagcucuccagu

SEQ ID NO: 2183437 - RNA, 21 nt, Human
agcagggaaaaugcagcaggg

SEQ ID NO: 2183438 - RNA, 11 nt, Human
agcagggagga

SEQ ID NO: 2183439 - RNA, 22 nt, Human
agcagggaugcccuggaggugg

SEQ ID NO: 2183440 - RNA, 17 nt, Human
agcagggaugcccugga

SEQ ID NO: 2183441 - RNA, 19 nt, Human
agcagggauuaaccucugc

SEQ ID NO: 2183442 - RNA, 19 nt, Human
agcagggcauggcugggaa

SEQ ID NO: 2183443 - RNA, 13 nt, Human
agcagggcucagc

SEQ ID NO: 2183444 - RNA, 24 nt, Human
agcagggaugcccuggagguggcu

SEQ ID NO: 2183445 - RNA, 22 nt, Human
agcagggauuaaccucugcacu

SEQ ID NO: 2183446 - RNA, 20 nt, Human
agcagggauuaaccucugca

SEQ ID NO: 2183447 - RNA, 21 nt, Human
agcagggauuaaccucugcac

SEQ ID NO: 2183448 - RNA, 14 nt, Human
agcagggcucagcg

SEQ ID NO: 2183449 - RNA, 15 nt, Human
agcagggcucagcgg

SEQ ID NO: 2183450 - RNA, 18 nt, Human
ugacccagccccuugaga

SEQ ID NO: 2183451 - RNA, 19 nt, Human
ugacccagccccuugagaa

SEQ ID NO: 2183452 - RNA, 21 nt, Human
ugacccagccccuugagaaac

SEQ ID NO: 2183453 - RNA, 17 nt, Human
ugacccaugcugcccug

SEQ ID NO: 2183454 - RNA, 18 nt, Human
ugacccaugcugcccugu

SEQ ID NO: 2183455 - RNA, 19 nt, Human
ugacccaugcugcccugug

SEQ ID NO: 2183456 - RNA, 20 nt, Human
agcagcaccguucugugcac

SEQ ID NO: 2183457 - RNA, 15 nt, Human
ugacccaggccgcag

SEQ ID NO: 2183458 - RNA, 23 nt, Human
ugacccagccccuugagaaaccu

SEQ ID NO: 2183459 - RNA, 20 nt, Human
ugacccagcacugcccaaag

SEQ ID NO: 2183460 - RNA, 12 nt, Human
ugacccaggccg

SEQ ID NO: 2183461 - RNA, 19 nt, Human
agcagcaccguucugugca

SEQ ID NO: 2183462 - RNA, 13 nt, Human
ugacccaggccgc

SEQ ID NO: 2183463 - RNA, 14 nt, Human
ugacccaggccgca

SEQ ID NO: 2183464 - RNA, 20 nt, Human
ugacccaugcugcccuguga

SEQ ID NO: 2183465 - RNA, 22 nt, Human
agcagccaagcuccuugggagg

SEQ ID NO: 2183466 - RNA, 21 nt, Human
agcagccaagcuccuugggag

SEQ ID NO: 2183467 - RNA, 20 nt, Human
agcagccaagcuccuuggga

SEQ ID NO: 2183468 - RNA, 15 nt, Human
agcagccacauuccu

SEQ ID NO: 2183469 - RNA, 11 nt, Human
agcagccacau

SEQ ID NO: 2183470 - RNA, 14 nt, Human
agcaggaagcucag

SEQ ID NO: 2183471 - RNA, 12 nt, Human
agcaggaagcuc

SEQ ID NO: 2183472 - RNA, 20 nt, Human
agcagccaagggaugaaaga

SEQ ID NO: 2183473 - RNA, 13 nt, Human
agcaggacaugga

SEQ ID NO: 2183474 - RNA, 18 nt, Human
agcagcaucugcuaauaa

SEQ ID NO: 2183475 - RNA, 23 nt, Human
agcagcagugaaaacaagugcug

SEQ ID NO: 2183476 - RNA, 16 nt, Human
agcagcagugaaaaca

SEQ ID NO: 2183477 - RNA, 18 nt, Human
agcagcagugaaaacaag

SEQ ID NO: 2183478 - RNA, 19 nt, Human
agcagcagccuuuaaugca

SEQ ID NO: 2183479 - RNA, 16 nt, Human
agcagcagggagggcu

SEQ ID NO: 2183480 - RNA, 15 nt, Human
agcaggaagcucaga

SEQ ID NO: 2183481 - RNA, 13 nt, Human
agcaggaccucug

SEQ ID NO: 2183482 - RNA, 23 nt, Human
agcaggacugaauuguccccagu

SEQ ID NO: 2183483 - RNA, 22 nt, Human
agcaggaccucugaaacccugg

SEQ ID NO: 2183484 - RNA, 14 nt, Human
agcaggagaggaga

SEQ ID NO: 2183485 - RNA, 16 nt, Human
agcaggagaggagagc

SEQ ID NO: 2183486 - RNA, 17 nt, Human
agcaggagaggagagcc

SEQ ID NO: 2183487 - RNA, 19 nt, Human
agcaggagaggagagccag

SEQ ID NO: 2183488 - RNA, 20 nt, Human
agcaggagaggagagccaga

SEQ ID NO: 2183489 - RNA, 21 nt, Human
agcaggagaggagagccagag

SEQ ID NO: 2183490 - RNA, 22 nt, Human
agcaggagaggagagccagaga

SEQ ID NO: 2183491 - RNA, 23 nt, Human
agcaggagaggagagccagagaa

SEQ ID NO: 2183492 - RNA, 15 nt, Human
agcaggagauugaga

SEQ ID NO: 2183493 - RNA, 18 nt, Human
agcaggagauugagaagg

SEQ ID NO: 2183494 - RNA, 19 nt, Human
agcaggagauugagaagga

SEQ ID NO: 2183495 - RNA, 22 nt, Human
agcaggauaguugcuccgccuc

SEQ ID NO: 2183496 - RNA, 19 nt, Human
agcaggcacauggaggagc

SEQ ID NO: 2183497 - RNA, 14 nt, Human
agcaggcacaugga

SEQ ID NO: 2183498 - RNA, 21 nt, Human
agcaggauaguugcuccgccu

SEQ ID NO: 2183499 - RNA, 16 nt, Human
agcaggcacauggagg

SEQ ID NO: 2183500 - RNA, 20 nt, Human
agcaggcacuugauuccuug

SEQ ID NO: 2183501 - RNA, 15 nt, Human
agcaggaggccccug

SEQ ID NO: 2183502 - RNA, 16 nt, Human
agcaggaggccccugg

SEQ ID NO: 2183503 - RNA, 20 nt, Human
agcaggaggccccuggccca

SEQ ID NO: 2183504 - RNA, 23 nt, Human
agcaggaggccccuggcccagcg

SEQ ID NO: 2183505 - RNA, 15 nt, Human
agcaggaggccaggc

SEQ ID NO: 2183506 - RNA, 14 nt, Human
agcaggaggccagg

SEQ ID NO: 2183507 - RNA, 20 nt, Human
agcaggagauugagaaggag

SEQ ID NO: 2183508 - RNA, 21 nt, Human
agcaggagauugagaaggaga

SEQ ID NO: 2183509 - RNA, 23 nt, Human
agcaggagauugagaaggagaga

SEQ ID NO: 2183510 - RNA, 16 nt, Human
agcaggaggaggugcc

SEQ ID NO: 2183511 - RNA, 21 nt, Human
agcaggccuugcgcuguugcg

SEQ ID NO: 2183512 - RNA, 21 nt, Human
agcaggcguucagcucacugu

SEQ ID NO: 2183513 - RNA, 12 nt, Human
agcaggccuugc

SEQ ID NO: 2183514 - RNA, 13 nt, Human
agcaggccuugcg

SEQ ID NO: 2183515 - RNA, 14 nt, Human
agcaggcuacuguc

SEQ ID NO: 2183516 - RNA, 20 nt, Human
agcaggcuacugucagcucc

SEQ ID NO: 2183517 - RNA, 19 nt, Human
agcaggcuacugucagcuc

SEQ ID NO: 2183518 - RNA, 17 nt, Human
agcaggcuacugucagc

SEQ ID NO: 2183519 - RNA, 16 nt, Human
agcaggcuacugucag

SEQ ID NO: 2183520 - RNA, 22 nt, Human
ugauggcacuuagcuaucagaa

SEQ ID NO: 2183521 - RNA, 20 nt, Human
ugauggcaggauggccuggc

SEQ ID NO: 2183522 - RNA, 22 nt, Human
ugauggcaccacugcacuccag

SEQ ID NO: 2183523 - RNA, 17 nt, Human
ugauggcaauuuuguaa

SEQ ID NO: 2183524 - RNA, 23 nt, Human
ugauggcaacagaucuggaaccu

SEQ ID NO: 2183525 - RNA, 15 nt, Human
ugauggcaauuuugu

SEQ ID NO: 2183526 - RNA, 21 nt, Human
ugaugaucuuugcagacaggc

SEQ ID NO: 2183527 - RNA, 16 nt, Human
ugauggcaacagaucu

SEQ ID NO: 2183528 - RNA, 19 nt, Human
ugauggcaacagaucugga

SEQ ID NO: 2183529 - RNA, 18 nt, Human
ugauggcaacagaucugg

SEQ ID NO: 2183530 - RNA, 13 nt, Human
ugauggcuucucc

SEQ ID NO: 2183531 - RNA, 15 nt, Human
ugauggcuucuccag

SEQ ID NO: 2183532 - RNA, 21 nt, Human
ugaugggcaacccccagccug

SEQ ID NO: 2183533 - RNA, 22 nt, Human
ugaugggcaacccccagccugc

SEQ ID NO: 2183534 - RNA, 13 nt, Human
ugauggggcccug

SEQ ID NO: 2183535 - RNA, 22 nt, Human
ugaugaaaugaggucagagccu

SEQ ID NO: 2183536 - RNA, 18 nt, Human
ugaugaaaauauuuaaag

SEQ ID NO: 2183537 - RNA, 17 nt, Human
ugaucuagagccaguua

SEQ ID NO: 2183538 - RNA, 14 nt, Human
ugaucuaggaagac

SEQ ID NO: 2183539 - RNA, 15 nt, Human
ugaucuaggaagacu

SEQ ID NO: 2183540 - RNA, 23 nt, Human
ugaugaaaugaggucagagccug

SEQ ID NO: 2183541 - RNA, 18 nt, Human
ugaugaaauguaaauacu

SEQ ID NO: 2183542 - RNA, 19 nt, Human
ugaugaucuuugcagacag

SEQ ID NO: 2183543 - RNA, 20 nt, Human
ugaugaucuuugcagacagg

SEQ ID NO: 2183544 - RNA, 17 nt, Human
ugauggggaaggaggcu

SEQ ID NO: 2183545 - RNA, 15 nt, Human
ugaugggucaguugu

SEQ ID NO: 2183546 - RNA, 22 nt, Human
ugauggggcccugccuccuuug

SEQ ID NO: 2183547 - RNA, 15 nt, Human
ugauggucagcuccc

SEQ ID NO: 2183548 - RNA, 16 nt, Human
ugauggucagcucccu

SEQ ID NO: 2183549 - RNA, 21 nt, Human
ugauggucagcucccuucucu

SEQ ID NO: 2183550 - RNA, 14 nt, Human
ugauggggaaggag

SEQ ID NO: 2183551 - RNA, 15 nt, Human
ugaugggggaggggg

SEQ ID NO: 2183552 - RNA, 23 nt, Human
ugauggguuaguggauggaaggg

SEQ ID NO: 2183553 - RNA, 19 nt, Human
ugauggguuaguggaugga

SEQ ID NO: 2183554 - RNA, 23 nt, Human
ugauguuuuccaugaguccccug

SEQ ID NO: 2183555 - RNA, 16 nt, Human
ugauggucuucagccu

SEQ ID NO: 2183556 - RNA, 19 nt, Human
ugauguuuuccaugagucc

SEQ ID NO: 2183557 - RNA, 21 nt, Human
ugauguuuuaaggaugcuugu

SEQ ID NO: 2183558 - RNA, 17 nt, Human
ugauguuuuccaugagu

SEQ ID NO: 2183559 - RNA, 20 nt, Human
ugauuaaccacuucagcuga

SEQ ID NO: 2183560 - RNA, 17 nt, Human
ugauuaaauucuugcaa

SEQ ID NO: 2183561 - RNA, 16 nt, Human
ugauuaaauucuugca

SEQ ID NO: 2183562 - RNA, 13 nt, Human
ugauuaaauucuu

SEQ ID NO: 2183563 - RNA, 16 nt, Human
agccacggccaggcca

SEQ ID NO: 2183564 - RNA, 16 nt, Human
ugauuaaguaaugaua

SEQ ID NO: 2183565 - RNA, 15 nt, Human
ugauuaaguaaugau

SEQ ID NO: 2183566 - RNA, 22 nt, Human
agccacagaagccaggagcaaa

SEQ ID NO: 2183567 - RNA, 22 nt, Human
agccacaggccugagauuucau

SEQ ID NO: 2183568 - RNA, 23 nt, Human
agccacaggccugagauuucauc

SEQ ID NO: 2183569 - RNA, 14 nt, Human
agccacaggccuga

SEQ ID NO: 2183570 - RNA, 16 nt, Human
agccacaggccugaga

SEQ ID NO: 2183571 - RNA, 17 nt, Human
agccacaggccugagau

SEQ ID NO: 2183572 - RNA, 21 nt, Human
agccacaggccugagauuuca

SEQ ID NO: 2183573 - RNA, 23 nt, Human
agccaccaugcccagcucagagg

SEQ ID NO: 2183574 - RNA, 17 nt, Human
agccaccaucuuugcag

SEQ ID NO: 2183575 - RNA, 13 nt, Human
agccaccaucuuu

SEQ ID NO: 2183576 - RNA, 16 nt, Human
agccaccaucuuugca

SEQ ID NO: 2183577 - RNA, 17 nt, Human
agccaccacguccagcu

SEQ ID NO: 2183578 - RNA, 13 nt, Human
agccaccacgccc

SEQ ID NO: 2183579 - RNA, 21 nt, Human
agccacacucugggcuccaga

SEQ ID NO: 2183580 - RNA, 21 nt, Human
agccacacugugggacucuuc

SEQ ID NO: 2183581 - RNA, 23 nt, Human
agccacacacacagaaaauauac

SEQ ID NO: 2183582 - RNA, 22 nt, Human
agccacacacacagaaaauaua

SEQ ID NO: 2183583 - RNA, 13 nt, Human
agccacagcuggu

SEQ ID NO: 2183584 - RNA, 13 nt, Human
agccacaggccug

SEQ ID NO: 2183585 - RNA, 23 nt, Human
agccacagaagccaggagcaaau

SEQ ID NO: 2183586 - RNA, 10 nt, Human
agccacagaa

SEQ ID NO: 2183587 - RNA, 12 nt, Human
agccacagaagc

SEQ ID NO: 2183588 - RNA, 17 nt, Human
agccacagaagccagga

SEQ ID NO: 2183589 - RNA, 18 nt, Human
agccacagaagccaggag

SEQ ID NO: 2183590 - RNA, 19 nt, Human
agccacagaagccaggagc

SEQ ID NO: 2183591 - RNA, 20 nt, Human
agccacagaagccaggagca

SEQ ID NO: 2183592 - RNA, 19 nt, Human
agccacaagaaauuugauu

SEQ ID NO: 2183593 - RNA, 16 nt, Human
agccaauuuuucugca

SEQ ID NO: 2183594 - RNA, 17 nt, Human
agccaauuuuucugcac

SEQ ID NO: 2183595 - RNA, 20 nt, Human
agccaauuuuucugcacuga

SEQ ID NO: 2183596 - RNA, 23 nt, Human
agccaauuuuucugcacugagca

SEQ ID NO: 2183597 - RNA, 13 nt, Human
agccacacacaca

SEQ ID NO: 2183598 - RNA, 12 nt, Human
agccacacacac

SEQ ID NO: 2183599 - RNA, 10 nt, Human
agccacacac

SEQ ID NO: 2183600 - RNA, 19 nt, Human
agccacaaaauaaauguug

SEQ ID NO: 2183601 - RNA, 17 nt, Human
agccacacaaacguuua

SEQ ID NO: 2183602 - RNA, 21 nt, Human
agccacacacacagaaaauau

SEQ ID NO: 2183603 - RNA, 20 nt, Human
agccacacacacagaaaaua

SEQ ID NO: 2183604 - RNA, 19 nt, Human
agccacacacacagaaaau

SEQ ID NO: 2183605 - RNA, 18 nt, Human
agccacacacacagaaaa

SEQ ID NO: 2183606 - RNA, 17 nt, Human
agccacacacacagaaa

SEQ ID NO: 2183607 - RNA, 16 nt, Human
agccacacacacagaa

SEQ ID NO: 2183608 - RNA, 15 nt, Human
agccacacacacaga

SEQ ID NO: 2183609 - RNA, 14 nt, Human
agccacacacacag

SEQ ID NO: 2183610 - RNA, 16 nt, Human
agccaaacccugucug

SEQ ID NO: 2183611 - RNA, 13 nt, Human
agccaaacccuug

SEQ ID NO: 2183612 - RNA, 19 nt, Human
agccaaacccuugucagug

SEQ ID NO: 2183613 - RNA, 21 nt, Human
agccaauccccuccuugggca

SEQ ID NO: 2183614 - RNA, 15 nt, Human
agccaauuauguuaa

SEQ ID NO: 2183615 - RNA, 13 nt, Human
agccaaugcuuac

SEQ ID NO: 2183616 - RNA, 22 nt, Human
agccaauccccuccuugggcac

SEQ ID NO: 2183617 - RNA, 13 nt, Human
agccaaugcuguc

SEQ ID NO: 2183618 - RNA, 18 nt, Human
agccaauucagacaggca

SEQ ID NO: 2183619 - RNA, 17 nt, Human
agccaauucagacaggc

SEQ ID NO: 2183620 - RNA, 13 nt, Human
agccaauuuuucu

SEQ ID NO: 2183621 - RNA, 14 nt, Human
agccaauuuuucug

SEQ ID NO: 2183622 - RNA, 15 nt, Human
agccaauuuuucugc

SEQ ID NO: 2183623 - RNA, 16 nt, Human
agccaauucagacagg

SEQ ID NO: 2183624 - RNA, 20 nt, Human
agccaauuauguuaaacuag

SEQ ID NO: 2183625 - RNA, 16 nt, Human
agccaauuauguuaaa

SEQ ID NO: 2183626 - RNA, 17 nt, Human
agccaauuauguuaaac

SEQ ID NO: 2183627 - RNA, 13 nt, Human
ugaucccagcacu

SEQ ID NO: 2183628 - RNA, 12 nt, Human
ugaucccagcac

SEQ ID NO: 2183629 - RNA, 18 nt, Human
ugauccccaagugugaac

SEQ ID NO: 2183630 - RNA, 19 nt, Human
ugaucccuguguugucucu

SEQ ID NO: 2183631 - RNA, 18 nt, Human
ugauccucccaccucagc

SEQ ID NO: 2183632 - RNA, 22 nt, Human
ugauccguuccauugcaagcuu

SEQ ID NO: 2183633 - RNA, 21 nt, Human
ugaucccuguuacccagagaa

SEQ ID NO: 2183634 - RNA, 20 nt, Human
ugaucccuguguugucucua

SEQ ID NO: 2183635 - RNA, 22 nt, Human
ugaucgugcuaaauuuucagua

SEQ ID NO: 2183636 - RNA, 15 nt, Human
ugaucgugcuaaauu

SEQ ID NO: 2183637 - RNA, 13 nt, Human
ugaucuaggaaga

SEQ ID NO: 2183638 - RNA, 19 nt, Human
ugauccucccaccucagcc

SEQ ID NO: 2183639 - RNA, 20 nt, Human
ugauccucccaccucagccu

SEQ ID NO: 2183640 - RNA, 23 nt, Human
agccaccccgggcucucugcugu

SEQ ID NO: 2183641 - RNA, 21 nt, Human
agccaccccgggcucucugcu

SEQ ID NO: 2183642 - RNA, 20 nt, Human
agccaccccgggcucucugc

SEQ ID NO: 2183643 - RNA, 19 nt, Human
agccaccccgggcucucug

SEQ ID NO: 2183644 - RNA, 20 nt, Human
agccaccccagaaaugguga

SEQ ID NO: 2183645 - RNA, 14 nt, Human
agccaccccgggcu

SEQ ID NO: 2183646 - RNA, 18 nt, Human
agccaccccagaaauggu

SEQ ID NO: 2183647 - RNA, 14 nt, Human
ugauccacucgccu

SEQ ID NO: 2183648 - RNA, 18 nt, Human
ugauccacucgccuucau

SEQ ID NO: 2183649 - RNA, 13 nt, Human
ugauccagaaaga

SEQ ID NO: 2183650 - RNA, 19 nt, Human
ugaucccaagugccagucu

SEQ ID NO: 2183651 - RNA, 15 nt, Human
ugauccagagcacag

SEQ ID NO: 2183652 - RNA, 23 nt, Human
ugauccagaaagaaaacuuguau

SEQ ID NO: 2183653 - RNA, 13 nt, Human
agccaccccugag

SEQ ID NO: 2183654 - RNA, 17 nt, Human
agcaucacuugggauua

SEQ ID NO: 2183655 - RNA, 20 nt, Human
agcaucaccucaggccaggu

SEQ ID NO: 2183656 - RNA, 19 nt, Human
agcaucaccucaggccagg

SEQ ID NO: 2183657 - RNA, 16 nt, Human
agcaucaccucaggcc

SEQ ID NO: 2183658 - RNA, 15 nt, Human
agcaucaccucaggc

SEQ ID NO: 2183659 - RNA, 14 nt, Human
agcaucaccucagg

SEQ ID NO: 2183660 - RNA, 13 nt, Human
agcaucaccucag

SEQ ID NO: 2183661 - RNA, 14 nt, Human
ugaucacagcagcu

SEQ ID NO: 2183662 - RNA, 16 nt, Human
agcauauucaggaagc

SEQ ID NO: 2183663 - RNA, 22 nt, Human
agcaucaggguuaagaagacuu

SEQ ID NO: 2183664 - RNA, 23 nt, Human
agcaucaggccaggcccucugcc

SEQ ID NO: 2183665 - RNA, 22 nt, Human
agcaucaggccaggcccucugc

SEQ ID NO: 2183666 - RNA, 21 nt, Human
agcaucaggccaggcccucug

SEQ ID NO: 2183667 - RNA, 21 nt, Human
agcaucauuauuugcagagac

SEQ ID NO: 2183668 - RNA, 16 nt, Human
agcaucauuuugcauu

SEQ ID NO: 2183669 - RNA, 18 nt, Human
agcaucauuuugcauuca

SEQ ID NO: 2183670 - RNA, 19 nt, Human
agcaucauuuugcauucaa

SEQ ID NO: 2183671 - RNA, 20 nt, Human
agcaucauuuugcauucaaa

SEQ ID NO: 2183672 - RNA, 24 nt, Human
agcauccauguguggacucaaguc

SEQ ID NO: 2183673 - RNA, 20 nt, Human
agcaucccugaggagccagg

SEQ ID NO: 2183674 - RNA, 22 nt, Human
agcaucauuuugcauucaaauu

SEQ ID NO: 2183675 - RNA, 15 nt, Human
agcauccaccuccuu

SEQ ID NO: 2183676 - RNA, 16 nt, Human
agcauccaccuccuuc

SEQ ID NO: 2183677 - RNA, 17 nt, Human
agcauccaccuccuucu

SEQ ID NO: 2183678 - RNA, 18 nt, Human
agcauccaccuccuucuc

SEQ ID NO: 2183679 - RNA, 20 nt, Human
agcauccaccuccuucucug

SEQ ID NO: 2183680 - RNA, 22 nt, Human
agcaucccaggaucgcaagagc

SEQ ID NO: 2183681 - RNA, 21 nt, Human
agcauccugccuuagagccag

SEQ ID NO: 2183682 - RNA, 21 nt, Human
agcaucccuugaccaggccug

SEQ ID NO: 2183683 - RNA, 22 nt, Human
agcaucccuugaccaggccugg

SEQ ID NO: 2183684 - RNA, 23 nt, Human
agcaucccuugaccaggccuggg

SEQ ID NO: 2183685 - RNA, 13 nt, Human
agcauggcugcca

SEQ ID NO: 2183686 - RNA, 21 nt, Human
ugaucaauaaaaugugauuuu

SEQ ID NO: 2183687 - RNA, 19 nt, Human
ugaucaauaaaaugugauu

SEQ ID NO: 2183688 - RNA, 19 nt, Human
ugauaccgaauugugacuc

SEQ ID NO: 2183689 - RNA, 14 nt, Human
ugaucaaugacaga

SEQ ID NO: 2183690 - RNA, 18 nt, Human
ugaucaaugacagagccu

SEQ ID NO: 2183691 - RNA, 19 nt, Human
ugaucaaugacagagccuu

SEQ ID NO: 2183692 - RNA, 17 nt, Human
ugauaccccccucuguc

SEQ ID NO: 2183693 - RNA, 18 nt, Human
ugauaccccccucugucu

SEQ ID NO: 2183694 - RNA, 19 nt, Human
ugauaccccccucugucuu

SEQ ID NO: 2183695 - RNA, 17 nt, Human
ugaucaauuaaauguag

SEQ ID NO: 2183696 - RNA, 16 nt, Human
ugaucaauuaaaugua

SEQ ID NO: 2183697 - RNA, 15 nt, Human
ugaucaauuaaaugu

SEQ ID NO: 2183698 - RNA, 14 nt, Human
ugaucaauuaaaug

SEQ ID NO: 2183699 - RNA, 12 nt, Human
ugaucacacucu

SEQ ID NO: 2183700 - RNA, 13 nt, Human
ugaucacacucug

SEQ ID NO: 2183701 - RNA, 15 nt, Human
ugaucacacucuggg

SEQ ID NO: 2183702 - RNA, 21 nt, Human
ugauacccauagcuuccauga

SEQ ID NO: 2183703 - RNA, 18 nt, Human
ugauacccauagcuucca

SEQ ID NO: 2183704 - RNA, 15 nt, Human
ugauaccccccucug

SEQ ID NO: 2183705 - RNA, 14 nt, Human
ugauaccagcugga

SEQ ID NO: 2183706 - RNA, 13 nt, Human
ugauacccagagc

SEQ ID NO: 2183707 - RNA, 22 nt, Human
ugauacauccaaagcagacagc

SEQ ID NO: 2183708 - RNA, 20 nt, Human
ugauacaaauugcagacugu

SEQ ID NO: 2183709 - RNA, 16 nt, Human
ugauacaagauuagaa

SEQ ID NO: 2183710 - RNA, 17 nt, Human
ugauacaagauuagaag

SEQ ID NO: 2183711 - RNA, 16 nt, Human
ugauacauccaaagca

SEQ ID NO: 2183712 - RNA, 18 nt, Human
ugaucacggcucacugca

SEQ ID NO: 2183713 - RNA, 14 nt, Human
ugaucaccugcccu

SEQ ID NO: 2183714 - RNA, 15 nt, Human
ugaucacggcucacu

SEQ ID NO: 2183715 - RNA, 13 nt, Human
ugaucacggcuca

SEQ ID NO: 2183716 - RNA, 14 nt, Human
ugaucacggcucac

SEQ ID NO: 2183717 - RNA, 17 nt, Human
agcauauucaggaagcu

SEQ ID NO: 2183718 - RNA, 19 nt, Human
agcauauucaggaagcuca

SEQ ID NO: 2183719 - RNA, 20 nt, Human
agcaucacaugaacuuguaa

SEQ ID NO: 2183720 - RNA, 21 nt, Human
agcauauucaggaagcucagg

SEQ ID NO: 2183721 - RNA, 17 nt, Human
agcauggcugugaggau

SEQ ID NO: 2183722 - RNA, 14 nt, Human
agcaugggccuggc

SEQ ID NO: 2183723 - RNA, 22 nt, Human
agcauccugccuuagagccagg

SEQ ID NO: 2183724 - RNA, 23 nt, Human
agcauccugccuuagagccaggc

SEQ ID NO: 2183725 - RNA, 13 nt, Human
agcauggcuguga

SEQ ID NO: 2183726 - RNA, 16 nt, Human
agcauggcugugagga

SEQ ID NO: 2183727 - RNA, 19 nt, Human
agcauggcugccaauggga

SEQ ID NO: 2183728 - RNA, 13 nt, Human
agcauguaauggu

SEQ ID NO: 2183729 - RNA, 19 nt, Human
agcaugggccuggccaccu

SEQ ID NO: 2183730 - RNA, 12 nt, Human
agcauguacagu

SEQ ID NO: 2183731 - RNA, 14 nt, Human
agcauguacagugu

SEQ ID NO: 2183732 - RNA, 15 nt, Human
agcauguacaguguu

SEQ ID NO: 2183733 - RNA, 16 nt, Human
agcauguacaguguuc

SEQ ID NO: 2183734 - RNA, 17 nt, Human
agcauuacaaauugcuu

SEQ ID NO: 2183735 - RNA, 19 nt, Human
agcauuaugauguggguca

SEQ ID NO: 2183736 - RNA, 17 nt, Human
agcauuagauuucucau

SEQ ID NO: 2183737 - RNA, 17 nt, Human
agcauuacgugagccag

SEQ ID NO: 2183738 - RNA, 18 nt, Human
agcauuacgugagccagg

SEQ ID NO: 2183739 - RNA, 19 nt, Human
agcauuacgugagccaggu

SEQ ID NO: 2183740 - RNA, 20 nt, Human
agcauuacgugagccaggua

SEQ ID NO: 2183741 - RNA, 23 nt, Human
agcauucaauuuauucaagaaaa

SEQ ID NO: 2183742 - RNA, 22 nt, Human
agcauucaauuuauucaagaaa

SEQ ID NO: 2183743 - RNA, 18 nt, Human
agcauucacaacuuguuu

SEQ ID NO: 2183744 - RNA, 14 nt, Human
agcauucagagagc

SEQ ID NO: 2183745 - RNA, 15 nt, Human
agcauucagagagca

SEQ ID NO: 2183746 - RNA, 16 nt, Human
agcauucagagagcag

SEQ ID NO: 2183747 - RNA, 17 nt, Human
agcauucagagagcagc

SEQ ID NO: 2183748 - RNA, 13 nt, Human
agcauuccaacaa

SEQ ID NO: 2183749 - RNA, 14 nt, Human
agcauuccaacaaa

SEQ ID NO: 2183750 - RNA, 15 nt, Human
agcauuccaacaaag

SEQ ID NO: 2183751 - RNA, 18 nt, Human
agcauucucacuccuacc

SEQ ID NO: 2183752 - RNA, 20 nt, Human
agcauucucacuccuaccug

SEQ ID NO: 2183753 - RNA, 19 nt, Human
agcauucgagacagaaccu

SEQ ID NO: 2183754 - RNA, 14 nt, Human
agcauuccuuuuga

SEQ ID NO: 2183755 - RNA, 24 nt, Human
agcauuccuucuuugauaauguua

SEQ ID NO: 2183756 - RNA, 19 nt, Human
agcauuccuucuuugauaa

SEQ ID NO: 2183757 - RNA, 21 nt, Human
agcauuccuucuuugauaaug

SEQ ID NO: 2183758 - RNA, 22 nt, Human
agcauuccuucuuugauaaugu

SEQ ID NO: 2183759 - RNA, 23 nt, Human
agcauuccuucuuugauaauguu

SEQ ID NO: 2183760 - RNA, 15 nt, Human
agcauuccuucuuug

SEQ ID NO: 2183761 - RNA, 16 nt, Human
agcauuccuucuuuga

SEQ ID NO: 2183762 - RNA, 17 nt, Human
agcauuccuucuuugau

SEQ ID NO: 2183763 - RNA, 18 nt, Human
agcauuccuucuuugaua

SEQ ID NO: 2183764 - RNA, 16 nt, Human
agcauuccagccccuc

SEQ ID NO: 2183765 - RNA, 17 nt, Human
agcauuccaacaaaggg

SEQ ID NO: 2183766 - RNA, 19 nt, Human
agcauuccaacaaaggguu

SEQ ID NO: 2183767 - RNA, 19 nt, Human
agcauuccagccccucugg

SEQ ID NO: 2183768 - RNA, 20 nt, Human
agcauuccagccccucuggu

SEQ ID NO: 2183769 - RNA, 23 nt, Human
agcauuguuugcuuauuguucca

SEQ ID NO: 2183770 - RNA, 22 nt, Human
agcauuguuugcuuauuguucc

SEQ ID NO: 2183771 - RNA, 21 nt, Human
agcauuguuugcuuauuguuc

SEQ ID NO: 2183772 - RNA, 17 nt, Human
agcauuuaauguagcca

SEQ ID NO: 2183773 - RNA, 22 nt, Human
agcauuuagauguauagguuga

SEQ ID NO: 2183774 - RNA, 22 nt, Human
agcauucucacuccuaccuggu

SEQ ID NO: 2183775 - RNA, 12 nt, Human
agcauucugucu

SEQ ID NO: 2183776 - RNA, 16 nt, Human
agcauuuuugauuuau

SEQ ID NO: 2183777 - RNA, 18 nt, Human
agcauuuuugauuuaugc

SEQ ID NO: 2183778 - RNA, 17 nt, Human
agccaaaauguaggcuu

SEQ ID NO: 2183779 - RNA, 22 nt, Human
agccaaaauguaggcuuaguuu

SEQ ID NO: 2183780 - RNA, 15 nt, Human
agccaaacccugucu

SEQ ID NO: 2183781 - RNA, 14 nt, Human
agccaaacccuguc

SEQ ID NO: 2183782 - RNA, 19 nt, Human
agccaaacccaugaggcaa

SEQ ID NO: 2183783 - RNA, 18 nt, Human
agccaaacccaugaggca

SEQ ID NO: 2183784 - RNA, 18 nt, Human
agccaaacauccuacaag

SEQ ID NO: 2183785 - RNA, 15 nt, Human
agcauuuugcuaaau

SEQ ID NO: 2183786 - RNA, 15 nt, Human
agcauuuuguauuug

SEQ ID NO: 2183787 - RNA, 22 nt, Human
agcauuuugcuaaaugugaaug

SEQ ID NO: 2183788 - RNA, 12 nt, Human
agcauuuuccuc

SEQ ID NO: 2183789 - RNA, 20 nt, Human
agcauuuuauaaaucgcuuu

SEQ ID NO: 2183790 - RNA, 23 nt, Human
agcauuuuagcaauuuauacaau

SEQ ID NO: 2183791 - RNA, 13 nt, Human
agcauuuuauaaa

SEQ ID NO: 2183792 - RNA, 15 nt, Human
agcauuuuauaaauc

SEQ ID NO: 2183793 - RNA, 14 nt, Human
agcauuuuauaaau

SEQ ID NO: 2183794 - RNA, 20 nt, Human
agcauuuaauguagccaugg

SEQ ID NO: 2183795 - RNA, 17 nt, Human
agcauuuacuuugaauu

SEQ ID NO: 2183796 - RNA, 15 nt, Human
agcauuuacuuugaa

SEQ ID NO: 2183797 - RNA, 21 nt, Human
agcauuuaguccaaugucuuu

SEQ ID NO: 2183798 - RNA, 13 nt, Human
agcauuuauguuu

SEQ ID NO: 2183799 - RNA, 16 nt, Human
agcauuugaaugcauu

SEQ ID NO: 2183800 - RNA, 17 nt, Human
agcauuugaaugcauuu

SEQ ID NO: 2183801 - RNA, 20 nt, Human
agcauuuaguccaaugucuu

SEQ ID NO: 2183802 - RNA, 14 nt, Human
agcauuuauaaauu

SEQ ID NO: 2183803 - RNA, 16 nt, Human
agcauuugucaacaaa

SEQ ID NO: 2183804 - RNA, 17 nt, Human
ugaaccugaugcugacu

SEQ ID NO: 2183805 - RNA, 21 nt, Human
ugaacuaggauuguaguccca

SEQ ID NO: 2183806 - RNA, 23 nt, Human
ugaacuaggguggugcauuuuug

SEQ ID NO: 2183807 - RNA, 17 nt, Human
ugaacucaaacugagga

SEQ ID NO: 2183808 - RNA, 16 nt, Human
ugaacucaaacugagg

SEQ ID NO: 2183809 - RNA, 14 nt, Human
ugaacucaaacuga

SEQ ID NO: 2183810 - RNA, 23 nt, Human
ugaacuauuccccagcagggucu

SEQ ID NO: 2183811 - RNA, 14 nt, Human
ugaacuccuggccu

SEQ ID NO: 2183812 - RNA, 15 nt, Human
ugaacuccuggccuc

SEQ ID NO: 2183813 - RNA, 12 nt, Human
ugaacuccuggc

SEQ ID NO: 2183814 - RNA, 18 nt, Human
ugaacucacuuuccuccu

SEQ ID NO: 2183815 - RNA, 17 nt, Human
ugaacucaacuuugaca

SEQ ID NO: 2183816 - RNA, 18 nt, Human
ugaacucaaacugaggaa

SEQ ID NO: 2183817 - RNA, 21 nt, Human
ugaaccuaggagugccccauu

SEQ ID NO: 2183818 - RNA, 22 nt, Human
ugaaccuaggagugccccauuc

SEQ ID NO: 2183819 - RNA, 12 nt, Human
ugaaccuggagg

SEQ ID NO: 2183820 - RNA, 15 nt, Human
ugaaccugaugcuga

SEQ ID NO: 2183821 - RNA, 20 nt, Human
ugaaccuaccuucauuucag

SEQ ID NO: 2183822 - RNA, 22 nt, Human
ugaaccgaugagaaauaaaguu

SEQ ID NO: 2183823 - RNA, 16 nt, Human
ugaaccgcugaauaug

SEQ ID NO: 2183824 - RNA, 14 nt, Human
ugaaccuaccuuca

SEQ ID NO: 2183825 - RNA, 20 nt, Human
ugaaauuuucuagacuuucu

SEQ ID NO: 2183826 - RNA, 18 nt, Human
ugaaauuuucuagacuuu

SEQ ID NO: 2183827 - RNA, 19 nt, Human
ugaaauuuucuagacuuuc

SEQ ID NO: 2183828 - RNA, 15 nt, Human
ugaaauuuuuauuaa

SEQ ID NO: 2183829 - RNA, 18 nt, Human
ugaacaaauuuacagaga

SEQ ID NO: 2183830 - RNA, 20 nt, Human
ugaacaaauuuacagagaca

SEQ ID NO: 2183831 - RNA, 19 nt, Human
ugaacaaauuuacagagac

SEQ ID NO: 2183832 - RNA, 18 nt, Human
ugaagaaaagugggccag

SEQ ID NO: 2183833 - RNA, 15 nt, Human
ugaagaaaagugggc

SEQ ID NO: 2183834 - RNA, 19 nt, Human
ugaagaaaaaauacauuuu

SEQ ID NO: 2183835 - RNA, 17 nt, Human
ugaagaaaacuccuuua

SEQ ID NO: 2183836 - RNA, 18 nt, Human
ugaagaaaaaauacauuu

SEQ ID NO: 2183837 - RNA, 17 nt, Human
ugaagaaaaaauacauu

SEQ ID NO: 2183838 - RNA, 15 nt, Human
ugaagaaaaaauaca

SEQ ID NO: 2183839 - RNA, 21 nt, Human
ugaacuauggacggugcucca

SEQ ID NO: 2183840 - RNA, 16 nt, Human
ugaacuuugcugagcc

SEQ ID NO: 2183841 - RNA, 13 nt, Human
ugaacuuuuugua

SEQ ID NO: 2183842 - RNA, 15 nt, Human
ugaagaaaaucacuu

SEQ ID NO: 2183843 - RNA, 21 nt, Human
ugaagaaaaucacuuaggaaa

SEQ ID NO: 2183844 - RNA, 22 nt, Human
ugaacuuugaccucugcagcaa

SEQ ID NO: 2183845 - RNA, 15 nt, Human
ugaacuuugcugagc

SEQ ID NO: 2183846 - RNA, 11 nt, Human
ugaacuuugcu

SEQ ID NO: 2183847 - RNA, 20 nt, Human
ugaacuuugaccucugcagc

SEQ ID NO: 2183848 - RNA, 19 nt, Human
ugaacuuugaccucugcag

SEQ ID NO: 2183849 - RNA, 23 nt, Human
agagcugcucuggaaaaugugac

SEQ ID NO: 2183850 - RNA, 14 nt, Human
agagcugcucugga

SEQ ID NO: 2183851 - RNA, 15 nt, Human
agagcugcucuggaa

SEQ ID NO: 2183852 - RNA, 16 nt, Human
agagcugcucuggaaa

SEQ ID NO: 2183853 - RNA, 22 nt, Human
agagcugcucuggaaaauguga

SEQ ID NO: 2183854 - RNA, 14 nt, Human
agagcugccucucg

SEQ ID NO: 2183855 - RNA, 21 nt, Human
ugaagaaaccuucagauuugu

SEQ ID NO: 2183856 - RNA, 20 nt, Human
ugaagaaaggguguuuuucu

SEQ ID NO: 2183857 - RNA, 14 nt, Human
agagcugcgggcug

SEQ ID NO: 2183858 - RNA, 15 nt, Human
agagcuggagccugg

SEQ ID NO: 2183859 - RNA, 17 nt, Human
agagcuggagccuggug

SEQ ID NO: 2183860 - RNA, 12 nt, Human
agagcuggagcc

SEQ ID NO: 2183861 - RNA, 12 nt, Human
agagcuggcucu

SEQ ID NO: 2183862 - RNA, 18 nt, Human
agagcuggagccuggugc

SEQ ID NO: 2183863 - RNA, 19 nt, Human
agagcuggagccuggugcc

SEQ ID NO: 2183864 - RNA, 15 nt, Human
agagcuggcaaaggu

SEQ ID NO: 2183865 - RNA, 18 nt, Human
agagcuggcaaagguggc

SEQ ID NO: 2183866 - RNA, 21 nt, Human
agagcuguuuauggccucagc

SEQ ID NO: 2183867 - RNA, 20 nt, Human
agagcuguuuauggccucag

SEQ ID NO: 2183868 - RNA, 19 nt, Human
agagcuguuuauggccuca

SEQ ID NO: 2183869 - RNA, 20 nt, Human
agagcuguucccaaauuuuc

SEQ ID NO: 2183870 - RNA, 21 nt, Human
agagcuguucacagccagacu

SEQ ID NO: 2183871 - RNA, 21 nt, Human
agagcuuaaugauaauauugu

SEQ ID NO: 2183872 - RNA, 15 nt, Human
agagcuuaacagugu

SEQ ID NO: 2183873 - RNA, 22 nt, Human
agagcuucuguugcugccucau

SEQ ID NO: 2183874 - RNA, 15 nt, Human
agagcuucuuccagg

SEQ ID NO: 2183875 - RNA, 15 nt, Human
agaggcagagagcgg

SEQ ID NO: 2183876 - RNA, 24 nt, Human
agaggcagccccauucugccugcc

SEQ ID NO: 2183877 - RNA, 13 nt, Human
agaggcagcccca

SEQ ID NO: 2183878 - RNA, 19 nt, Human
agaggcagccccauucugc

SEQ ID NO: 2183879 - RNA, 17 nt, Human
agaggaaaaaaaugacu

SEQ ID NO: 2183880 - RNA, 16 nt, Human
agaggaaaaaaaugac

SEQ ID NO: 2183881 - RNA, 18 nt, Human
agaggaaaaguaaggugc

SEQ ID NO: 2183882 - RNA, 19 nt, Human
agaggaaaaguaaggugca

SEQ ID NO: 2183883 - RNA, 21 nt, Human
agaggaaaaguaaggugcagu

SEQ ID NO: 2183884 - RNA, 22 nt, Human
agaggaaaaguaaggugcaguu

SEQ ID NO: 2183885 - RNA, 22 nt, Human
agaggcagagaaagaagagaca

SEQ ID NO: 2183886 - RNA, 12 nt, Human
agaggcagagag

SEQ ID NO: 2183887 - RNA, 13 nt, Human
agaggcagagagc

SEQ ID NO: 2183888 - RNA, 14 nt, Human
agaggcagagagcg

SEQ ID NO: 2183889 - RNA, 23 nt, Human
agaggcagagagcggucucaggc

SEQ ID NO: 2183890 - RNA, 22 nt, Human
agagcuuucuucccgaacccca

SEQ ID NO: 2183891 - RNA, 23 nt, Human
agagcuuucuguccuuuuggcac

SEQ ID NO: 2183892 - RNA, 23 nt, Human
agagcuuggacuggaugcauguu

SEQ ID NO: 2183893 - RNA, 22 nt, Human
agagcuuucuguccuuuuggca

SEQ ID NO: 2183894 - RNA, 17 nt, Human
agagcuugaugccagua

SEQ ID NO: 2183895 - RNA, 13 nt, Human
agagcuuggacug

SEQ ID NO: 2183896 - RNA, 14 nt, Human
agagcuuggacugg

SEQ ID NO: 2183897 - RNA, 23 nt, Human
agagcuucuuccaggugcccagc

SEQ ID NO: 2183898 - RNA, 22 nt, Human
agagcuucuuccaggugcccag

SEQ ID NO: 2183899 - RNA, 19 nt, Human
agaggccaugggccuccug

SEQ ID NO: 2183900 - RNA, 22 nt, Human
agaggccauguuccaauaaaca

SEQ ID NO: 2183901 - RNA, 22 nt, Human
agaggcucguugacuggcugug

SEQ ID NO: 2183902 - RNA, 19 nt, Human
agaggcuauuauuuucacu

SEQ ID NO: 2183903 - RNA, 17 nt, Human
agaggcuaugugagcac

SEQ ID NO: 2183904 - RNA, 23 nt, Human
agaggccauggcagaauaaucuu

SEQ ID NO: 2183905 - RNA, 20 nt, Human
agaggccauggcagaauaau

SEQ ID NO: 2183906 - RNA, 16 nt, Human
agaggccauggcagaa

SEQ ID NO: 2183907 - RNA, 15 nt, Human
agaggccauggcaga

SEQ ID NO: 2183908 - RNA, 17 nt, Human
agaggcagggaggggac

SEQ ID NO: 2183909 - RNA, 22 nt, Human
agaggcaggggcuugcuuugca

SEQ ID NO: 2183910 - RNA, 13 nt, Human
agaggcagggagg

SEQ ID NO: 2183911 - RNA, 14 nt, Human
agaggccauggcag

SEQ ID NO: 2183912 - RNA, 19 nt, Human
agaggccaugauucgccca

SEQ ID NO: 2183913 - RNA, 10 nt, Human
agaggcaggg

SEQ ID NO: 2183914 - RNA, 13 nt, Human
agaggcagggucu

SEQ ID NO: 2183915 - RNA, 12 nt, Human
agagguuuuguu

SEQ ID NO: 2183916 - RNA, 19 nt, Human
agagguuuuaaagugauua

SEQ ID NO: 2183917 - RNA, 22 nt, Human
agaguaauccaagcaaauguga

SEQ ID NO: 2183918 - RNA, 18 nt, Human
agagguuuuaaagugauu

SEQ ID NO: 2183919 - RNA, 22 nt, Human
agagguuugacuagaugaugga

SEQ ID NO: 2183920 - RNA, 14 nt, Human
agaguaauggguuu

SEQ ID NO: 2183921 - RNA, 17 nt, Human
agaguaauggguuucau

SEQ ID NO: 2183922 - RNA, 18 nt, Human
agaguaauggguuucaua

SEQ ID NO: 2183923 - RNA, 16 nt, Human
agaguagaauugcauu

SEQ ID NO: 2183924 - RNA, 15 nt, Human
agaguagaauugcau

SEQ ID NO: 2183925 - RNA, 19 nt, Human
agaguacagugagccaaga

SEQ ID NO: 2183926 - RNA, 16 nt, Human
agaguacagugagcca

SEQ ID NO: 2183927 - RNA, 15 nt, Human
ugaagcaaaucagaa

SEQ ID NO: 2183928 - RNA, 14 nt, Human
ugaagcaaaucaga

SEQ ID NO: 2183929 - RNA, 18 nt, Human
ugaagcaaaucagaaacu

SEQ ID NO: 2183930 - RNA, 23 nt, Human
agaguagcaaguucuagagaaga

SEQ ID NO: 2183931 - RNA, 12 nt, Human
agaguagcaagu

SEQ ID NO: 2183932 - RNA, 22 nt, Human
agaguagcaaguucuagagaag

SEQ ID NO: 2183933 - RNA, 17 nt, Human
ugaagcaaagcaccagc

SEQ ID NO: 2183934 - RNA, 18 nt, Human
ugaagcaaagcaccagcu

SEQ ID NO: 2183935 - RNA, 13 nt, Human
agaguagacauuu

SEQ ID NO: 2183936 - RNA, 21 nt, Human
agaguagauggugaaauuuau

SEQ ID NO: 2183937 - RNA, 22 nt, Human
agaguagauggugaaauuuauu

SEQ ID NO: 2183938 - RNA, 18 nt, Human
agaguagaauugcauuga

SEQ ID NO: 2183939 - RNA, 17 nt, Human
agaguagaauugcauug

SEQ ID NO: 2183940 - RNA, 17 nt, Human
agagguucauuucaaau

SEQ ID NO: 2183941 - RNA, 16 nt, Human
agaggucuuuuuuaaa

SEQ ID NO: 2183942 - RNA, 13 nt, Human
agagguuucagug

SEQ ID NO: 2183943 - RNA, 15 nt, Human
agagguugcagugag

SEQ ID NO: 2183944 - RNA, 12 nt, Human
agaggucuuuuu

SEQ ID NO: 2183945 - RNA, 19 nt, Human
agaggucugugcugaggcc

SEQ ID NO: 2183946 - RNA, 16 nt, Human
agaggucugugcugag

SEQ ID NO: 2183947 - RNA, 18 nt, Human
agaggucugugcugaggc

SEQ ID NO: 2183948 - RNA, 22 nt, Human
agaggucucugccggcucuuuc

SEQ ID NO: 2183949 - RNA, 13 nt, Human
agaggucugugcu

SEQ ID NO: 2183950 - RNA, 14 nt, Human
agaggucugugcug

SEQ ID NO: 2183951 - RNA, 19 nt, Human
agagguccacaacacacag

SEQ ID NO: 2183952 - RNA, 16 nt, Human
agagguagggcugcca

SEQ ID NO: 2183953 - RNA, 13 nt, Human
agaggcugaggca

SEQ ID NO: 2183954 - RNA, 20 nt, Human
agaggucaagcccaggagga

SEQ ID NO: 2183955 - RNA, 18 nt, Human
agaggucaagcccaggag

SEQ ID NO: 2183956 - RNA, 16 nt, Human
agaggucaagcccagg

SEQ ID NO: 2183957 - RNA, 17 nt, Human
agagguauuuaucuuua

SEQ ID NO: 2183958 - RNA, 13 nt, Human
agaggcugaggac

SEQ ID NO: 2183959 - RNA, 19 nt, Human
agaggcugaaagaggccaa

SEQ ID NO: 2183960 - RNA, 13 nt, Human
agaggcugaaaga

SEQ ID NO: 2183961 - RNA, 14 nt, Human
agaggcugaggccu

SEQ ID NO: 2183962 - RNA, 17 nt, Human
agaggcugaggccugga

SEQ ID NO: 2183963 - RNA, 18 nt, Human
agaggcugaggccuggac

SEQ ID NO: 2183964 - RNA, 19 nt, Human
agaggcugaggccuggacu

SEQ ID NO: 2183965 - RNA, 18 nt, Human
ugaaauaugcuggcugga

SEQ ID NO: 2183966 - RNA, 12 nt, Human
ugaaauaugcau

SEQ ID NO: 2183967 - RNA, 18 nt, Human
ugaaauauuauguuaaaa

SEQ ID NO: 2183968 - RNA, 15 nt, Human
ugaaauuguauuaca

SEQ ID NO: 2183969 - RNA, 15 nt, Human
ugaaauauacacaca

SEQ ID NO: 2183970 - RNA, 19 nt, Human
ugaaauaguucaaagccaa

SEQ ID NO: 2183971 - RNA, 17 nt, Human
ugaaauauacacacagc

SEQ ID NO: 2183972 - RNA, 16 nt, Human
ugaaauauacacacag

SEQ ID NO: 2183973 - RNA, 15 nt, Human
ugaaauaucuguauu

SEQ ID NO: 2183974 - RNA, 14 nt, Human
ugaaauaauaaauc

SEQ ID NO: 2183975 - RNA, 19 nt, Human
ugaaauacacaaguaaaca

SEQ ID NO: 2183976 - RNA, 22 nt, Human
ugaaauuuuaaccuaugauauu

SEQ ID NO: 2183977 - RNA, 20 nt, Human
ugaaauuuuaaccuaugaua

SEQ ID NO: 2183978 - RNA, 14 nt, Human
ugaaauuuuaaccu

SEQ ID NO: 2183979 - RNA, 19 nt, Human
ugaaauuuuaaaaauuguu

SEQ ID NO: 2183980 - RNA, 22 nt, Human
ugaaauuuuauaugcuuacuga

SEQ ID NO: 2183981 - RNA, 17 nt, Human
ugaaauuuuaaacuaua

SEQ ID NO: 2183982 - RNA, 17 nt, Human
ugaaauuuuccaauguc

SEQ ID NO: 2183983 - RNA, 18 nt, Human
ugaaauuuuauaugcuua

SEQ ID NO: 2183984 - RNA, 16 nt, Human
ugaaauuuuauaugcu

SEQ ID NO: 2183985 - RNA, 18 nt, Human
ugaaauuuuccaaugucu

SEQ ID NO: 2183986 - RNA, 19 nt, Human
ugaaauuuuccaaugucug

SEQ ID NO: 2183987 - RNA, 20 nt, Human
ugaaauuuuccaaugucugc

SEQ ID NO: 2183988 - RNA, 17 nt, Human
ugaaauuuucuagacuu

SEQ ID NO: 2183989 - RNA, 21 nt, Human
ugaaauuuucuagacuuucug

SEQ ID NO: 2183990 - RNA, 23 nt, Human
ugaaauuguuuaaguguuguaaa

SEQ ID NO: 2183991 - RNA, 18 nt, Human
ugaaauuguuuaaguguu

SEQ ID NO: 2183992 - RNA, 23 nt, Human
ugaaauuguacauauuuguggaa

SEQ ID NO: 2183993 - RNA, 22 nt, Human
ugaaauugucuagcagagcagg

SEQ ID NO: 2183994 - RNA, 14 nt, Human
ugaaauuguacaua

SEQ ID NO: 2183995 - RNA, 17 nt, Human
ugaaauuguacauauuu

SEQ ID NO: 2183996 - RNA, 20 nt, Human
agagcugcccuccuugucca

SEQ ID NO: 2183997 - RNA, 21 nt, Human
agagcugcccuccuuguccac

SEQ ID NO: 2183998 - RNA, 13 nt, Human
agagcugcccucc

SEQ ID NO: 2183999 - RNA, 21 nt, Human
agagcuaacccuuaucuguaa

SEQ ID NO: 2184000 - RNA, 18 nt, Human
agagcugccaccugccug

SEQ ID NO: 2184001 - RNA, 23 nt, Human
agagcgccugccccucccagaac

SEQ ID NO: 2184002 - RNA, 21 nt, Human
agagcgccugccccucccaga

SEQ ID NO: 2184003 - RNA, 20 nt, Human
agagcgccugccccucccag

SEQ ID NO: 2184004 - RNA, 15 nt, Human
agagcgccugccccu

SEQ ID NO: 2184005 - RNA, 14 nt, Human
agagcgccugcccc

SEQ ID NO: 2184006 - RNA, 22 nt, Human
agagcgccgugaguucucaggg

SEQ ID NO: 2184007 - RNA, 20 nt, Human
agagcgccgugaguucucag

SEQ ID NO: 2184008 - RNA, 21 nt, Human
agagcgccgugaguucucagg

SEQ ID NO: 2184009 - RNA, 13 nt, Human
agagcgcgucugg

SEQ ID NO: 2184010 - RNA, 14 nt, Human
agagcggucucagg

SEQ ID NO: 2184011 - RNA, 23 nt, Human
agagcggucucaggcugguggga

SEQ ID NO: 2184012 - RNA, 21 nt, Human
agagcgugcuccagccuggcu

SEQ ID NO: 2184013 - RNA, 23 nt, Human
agagccuugguguccaccuggcc

SEQ ID NO: 2184014 - RNA, 22 nt, Human
agagccuugguguccaccuggc

SEQ ID NO: 2184015 - RNA, 21 nt, Human
agagccuuuggaugaccagaa

SEQ ID NO: 2184016 - RNA, 23 nt, Human
agagccuuuggaugaccagaaca

SEQ ID NO: 2184017 - RNA, 18 nt, Human
agagccuuuuucuaggcc

SEQ ID NO: 2184018 - RNA, 17 nt, Human
agagcgagagucugucu

SEQ ID NO: 2184019 - RNA, 13 nt, Human
agagcgccccucc

SEQ ID NO: 2184020 - RNA, 18 nt, Human
agagcgccgugaguucuc

SEQ ID NO: 2184021 - RNA, 11 nt, Human
ugaaagugacu

SEQ ID NO: 2184022 - RNA, 20 nt, Human
ugaaaguuuucagaaccucu

SEQ ID NO: 2184023 - RNA, 18 nt, Human
ugaaaguuuucagaaccu

SEQ ID NO: 2184024 - RNA, 17 nt, Human
ugaaaguuugcacugua

SEQ ID NO: 2184025 - RNA, 15 nt, Human
ugaaaguuaauccac

SEQ ID NO: 2184026 - RNA, 23 nt, Human
ugaaauaagccagacaucaacag

SEQ ID NO: 2184027 - RNA, 20 nt, Human
ugaaauaagccagacaucaa

SEQ ID NO: 2184028 - RNA, 18 nt, Human
ugaaauaagccagacauc

SEQ ID NO: 2184029 - RNA, 17 nt, Human
ugaaauaagccagacau

SEQ ID NO: 2184030 - RNA, 14 nt, Human
agagcaaaauugau

SEQ ID NO: 2184031 - RNA, 23 nt, Human
agagcaagauccugucuuuaagg

SEQ ID NO: 2184032 - RNA, 14 nt, Human
agagcacacuguag

SEQ ID NO: 2184033 - RNA, 20 nt, Human
agagcacacuuggcccaagu

SEQ ID NO: 2184034 - RNA, 11 nt, Human
agagcacagcc

SEQ ID NO: 2184035 - RNA, 13 nt, Human
agagcacagcccu

SEQ ID NO: 2184036 - RNA, 14 nt, Human
agagcacagcccuc

SEQ ID NO: 2184037 - RNA, 15 nt, Human
agagcacagcccucc

SEQ ID NO: 2184038 - RNA, 16 nt, Human
agagcacagcccuccc

SEQ ID NO: 2184039 - RNA, 14 nt, Human
agagcaagucugga

SEQ ID NO: 2184040 - RNA, 16 nt, Human
agagcaagucugcagg

SEQ ID NO: 2184041 - RNA, 14 nt, Human
agagcaagucugca

SEQ ID NO: 2184042 - RNA, 21 nt, Human
agagcaaugcccguaaugcuu

SEQ ID NO: 2184043 - RNA, 15 nt, Human
agagcacuuaagaga

SEQ ID NO: 2184044 - RNA, 21 nt, Human
agagcacuggguugcagggga

SEQ ID NO: 2184045 - RNA, 20 nt, Human
agagcacuggguugcagggg

SEQ ID NO: 2184046 - RNA, 16 nt, Human
agagcaccccucucug

SEQ ID NO: 2184047 - RNA, 17 nt, Human
agagcaccccucucugc

SEQ ID NO: 2184048 - RNA, 18 nt, Human
agagcaccuaguccagug

SEQ ID NO: 2184049 - RNA, 19 nt, Human
agagcaccuaguccaguga

SEQ ID NO: 2184050 - RNA, 19 nt, Human
agagcacuuaagagaauau

SEQ ID NO: 2184051 - RNA, 20 nt, Human
agagcacuuaagagaauauu

SEQ ID NO: 2184052 - RNA, 21 nt, Human
agagcacuuaagagaauauuu

SEQ ID NO: 2184053 - RNA, 22 nt, Human
agagcacuuaagagaauauuuu

SEQ ID NO: 2184054 - RNA, 12 nt, Human
agagcagagacc

SEQ ID NO: 2184055 - RNA, 21 nt, Human
agagacaggaaaauccucugg

SEQ ID NO: 2184056 - RNA, 13 nt, Human
agagacaggaaaa

SEQ ID NO: 2184057 - RNA, 15 nt, Human
ucuuugggaauauuu

SEQ ID NO: 2184058 - RNA, 22 nt, Human
ucuuuggcuccccuguaccuuu

SEQ ID NO: 2184059 - RNA, 14 nt, Human
ucuuuggcuccccu

SEQ ID NO: 2184060 - RNA, 17 nt, Human
ucuuuggacccugaggc

SEQ ID NO: 2184061 - RNA, 21 nt, Human
ucuuuggacccugaggcccag

SEQ ID NO: 2184062 - RNA, 13 nt, Human
agagauuuuucau

SEQ ID NO: 2184063 - RNA, 18 nt, Human
agagcaaaauaauuuuaa

SEQ ID NO: 2184064 - RNA, 12 nt, Human
agagauuucaag

SEQ ID NO: 2184065 - RNA, 13 nt, Human
agagauuuaauua

SEQ ID NO: 2184066 - RNA, 16 nt, Human
agagauuuaauuaauc

SEQ ID NO: 2184067 - RNA, 16 nt, Human
ucuuugggaauauuug

SEQ ID NO: 2184068 - RNA, 18 nt, Human
ucuuugggaauauuugaa

SEQ ID NO: 2184069 - RNA, 20 nt, Human
ucuuugggaauauuugaauc

SEQ ID NO: 2184070 - RNA, 20 nt, Human
agagcauuuccaacaccaca

SEQ ID NO: 2184071 - RNA, 19 nt, Human
agagccaccaagagggacg

SEQ ID NO: 2184072 - RNA, 15 nt, Human
agagccaccaagagg

SEQ ID NO: 2184073 - RNA, 15 nt, Human
agagcauugccauuc

SEQ ID NO: 2184074 - RNA, 18 nt, Human
agagcauugccauucccu

SEQ ID NO: 2184075 - RNA, 19 nt, Human
agagcauugaauuggagag

SEQ ID NO: 2184076 - RNA, 17 nt, Human
agagcauugcauggaca

SEQ ID NO: 2184077 - RNA, 19 nt, Human
agagcauuacgugagccag

SEQ ID NO: 2184078 - RNA, 20 nt, Human
agagcauuacgugagccagg

SEQ ID NO: 2184079 - RNA, 21 nt, Human
agagcauuacgugagccaggu

SEQ ID NO: 2184080 - RNA, 22 nt, Human
agagcauuacgugagccaggua

SEQ ID NO: 2184081 - RNA, 16 nt, Human
agagcagugggccugg

SEQ ID NO: 2184082 - RNA, 21 nt, Human
agagccuugguguccaccugg

SEQ ID NO: 2184083 - RNA, 20 nt, Human
agagccuugguguccaccug

SEQ ID NO: 2184084 - RNA, 19 nt, Human
agagccuugguguccaccu

SEQ ID NO: 2184085 - RNA, 17 nt, Human
agagccuugguguccac

SEQ ID NO: 2184086 - RNA, 18 nt, Human
agagccagagaagugaca

SEQ ID NO: 2184087 - RNA, 21 nt, Human
agagccuugcggaagguucua

SEQ ID NO: 2184088 - RNA, 11 nt, Human
agagccuugcg

SEQ ID NO: 2184089 - RNA, 22 nt, Human
agagccagaaccuggagggcua

SEQ ID NO: 2184090 - RNA, 16 nt, Human
agagccacccuguguu

SEQ ID NO: 2184091 - RNA, 10 nt, Human
agagccagag

SEQ ID NO: 2184092 - RNA, 13 nt, Human
agagccagagaag

SEQ ID NO: 2184093 - RNA, 15 nt, Human
agagccagagaagug

SEQ ID NO: 2184094 - RNA, 16 nt, Human
agagccagagaaguga

SEQ ID NO: 2184095 - RNA, 17 nt, Human
agagccagagaagugac

SEQ ID NO: 2184096 - RNA, 14 nt, Human
agagcagaggcagc

SEQ ID NO: 2184097 - RNA, 12 nt, Human
agagcagaugca

SEQ ID NO: 2184098 - RNA, 20 nt, Human
agagcagaacggagccccag

SEQ ID NO: 2184099 - RNA, 23 nt, Human
agagcagaacggagccccaggcc

SEQ ID NO: 2184100 - RNA, 20 nt, Human
agagcagagaccaucccuga

SEQ ID NO: 2184101 - RNA, 17 nt, Human
agagcagagaccauccc

SEQ ID NO: 2184102 - RNA, 18 nt, Human
agagcagagaccaucccu

SEQ ID NO: 2184103 - RNA, 22 nt, Human
agagcagggguccuugguguga

SEQ ID NO: 2184104 - RNA, 23 nt, Human
agagcaggcuggcagcucuccag

SEQ ID NO: 2184105 - RNA, 24 nt, Human
agagcagggauuaaccucugcacu

SEQ ID NO: 2184106 - RNA, 22 nt, Human
agagcagggauuaaccucugca

SEQ ID NO: 2184107 - RNA, 17 nt, Human
agagcaggcuggcagcu

SEQ ID NO: 2184108 - RNA, 22 nt, Human
agagcaggcuggcagcucucca

SEQ ID NO: 2184109 - RNA, 19 nt, Human
agagcaggcguucagcuca

SEQ ID NO: 2184110 - RNA, 13 nt, Human
agagcaggcuggc

SEQ ID NO: 2184111 - RNA, 20 nt, Human
agagcaggcacauggaggag

SEQ ID NO: 2184112 - RNA, 19 nt, Human
agagcaggcacauggagga

SEQ ID NO: 2184113 - RNA, 18 nt, Human
agagcaggcacauggagg

SEQ ID NO: 2184114 - RNA, 13 nt, Human
agagcaggcacau

SEQ ID NO: 2184115 - RNA, 12 nt, Human
agagcaggcaca

SEQ ID NO: 2184116 - RNA, 22 nt, Human
agagcaggaggccccuggccca

SEQ ID NO: 2184117 - RNA, 23 nt, Human
agagcaggaggccccuggcccag

SEQ ID NO: 2184118 - RNA, 19 nt, Human
agagcagaugcagagagcc

SEQ ID NO: 2184119 - RNA, 15 nt, Human
agagcaggaggcccc

SEQ ID NO: 2184120 - RNA, 20 nt, Human
agagcaggaggccccuggcc

SEQ ID NO: 2184121 - RNA, 14 nt, Human
agagcagaugcaga

SEQ ID NO: 2184122 - RNA, 15 nt, Human
agagcagaugcagag

SEQ ID NO: 2184123 - RNA, 18 nt, Human
agagcagaugcagagagc

SEQ ID NO: 2184124 - RNA, 17 nt, Human
agauaugggacauuuuu

SEQ ID NO: 2184125 - RNA, 17 nt, Human
agauauggcagcgaaag

SEQ ID NO: 2184126 - RNA, 15 nt, Human
agauauuaccaguuu

SEQ ID NO: 2184127 - RNA, 21 nt, Human
agauauugugaaguacauauu

SEQ ID NO: 2184128 - RNA, 23 nt, Human
agauauuuacaugaauugcauuu

SEQ ID NO: 2184129 - RNA, 13 nt, Human
agauauuuauaua

SEQ ID NO: 2184130 - RNA, 19 nt, Human
agauauugugaaguacaua

SEQ ID NO: 2184131 - RNA, 18 nt, Human
agauauugugaaguacau

SEQ ID NO: 2184132 - RNA, 22 nt, Human
agauauugucagaguucugcuc

SEQ ID NO: 2184133 - RNA, 12 nt, Human
agauauucaagu

SEQ ID NO: 2184134 - RNA, 15 nt, Human
agaucaccagaauaa

SEQ ID NO: 2184135 - RNA, 14 nt, Human
agaucaauuuguaa

SEQ ID NO: 2184136 - RNA, 21 nt, Human
agaucaauuuguaauugcuua

SEQ ID NO: 2184137 - RNA, 14 nt, Human
agauauuuauauau

SEQ ID NO: 2184138 - RNA, 12 nt, Human
agaucaagcugu

SEQ ID NO: 2184139 - RNA, 14 nt, Human
agaucaagcuguga

SEQ ID NO: 2184140 - RNA, 18 nt, Human
agaucaagcugugagaca

SEQ ID NO: 2184141 - RNA, 16 nt, Human
agaucaaggagaggag

SEQ ID NO: 2184142 - RNA, 14 nt, Human
agaucacgccacug

SEQ ID NO: 2184143 - RNA, 15 nt, Human
agaucacgccacugc

SEQ ID NO: 2184144 - RNA, 16 nt, Human
agaucacgccacugca

SEQ ID NO: 2184145 - RNA, 15 nt, Human
agaguuuaacacaag

SEQ ID NO: 2184146 - RNA, 14 nt, Human
agauaaauauuaua

SEQ ID NO: 2184147 - RNA, 12 nt, Human
agauaaaugugc

SEQ ID NO: 2184148 - RNA, 18 nt, Human
agauaaagauuucuugag

SEQ ID NO: 2184149 - RNA, 22 nt, Human
agaguuuaacacaaguccugug

SEQ ID NO: 2184150 - RNA, 12 nt, Human
agauaaauauua

SEQ ID NO: 2184151 - RNA, 17 nt, Human
agauaaagguucaugca

SEQ ID NO: 2184152 - RNA, 19 nt, Human
agauacgacuuuauuuucu

SEQ ID NO: 2184153 - RNA, 18 nt, Human
agauaacaagaucuuuca

SEQ ID NO: 2184154 - RNA, 21 nt, Human
agauaacaagaucuuucagga

SEQ ID NO: 2184155 - RNA, 13 nt, Human
agauaaauuauaa

SEQ ID NO: 2184156 - RNA, 14 nt, Human
agauaaaucuagua

SEQ ID NO: 2184157 - RNA, 20 nt, Human
agauacgacuuuauuuucug

SEQ ID NO: 2184158 - RNA, 21 nt, Human
agauacuggaaguuuugcauu

SEQ ID NO: 2184159 - RNA, 20 nt, Human
agauacuggaaguuuugcau

SEQ ID NO: 2184160 - RNA, 19 nt, Human
agauacuggaaguuuugca

SEQ ID NO: 2184161 - RNA, 19 nt, Human
agauacugcuacuguaauu

SEQ ID NO: 2184162 - RNA, 23 nt, Human
agauacugcuacuguaauuuuau

SEQ ID NO: 2184163 - RNA, 23 nt, Human
ugaauuuuuuucaucuucucugg

SEQ ID NO: 2184164 - RNA, 21 nt, Human
ugaauuuuuuucaucuucucu

SEQ ID NO: 2184165 - RNA, 20 nt, Human
ugacacacagcucuguccug

SEQ ID NO: 2184166 - RNA, 19 nt, Human
ugacaaaaaguuuccauau

SEQ ID NO: 2184167 - RNA, 18 nt, Human
ugacaaaaauucaacuca

SEQ ID NO: 2184168 - RNA, 20 nt, Human
ugaauuuuuuuuuccuagcc

SEQ ID NO: 2184169 - RNA, 19 nt, Human
ugaauuuuuuuuuccuagc

SEQ ID NO: 2184170 - RNA, 16 nt, Human
ugaauuuuuuuuuccu

SEQ ID NO: 2184171 - RNA, 13 nt, Human
ugaauuuucacau

SEQ ID NO: 2184172 - RNA, 15 nt, Human
ugaauuuucacauga

SEQ ID NO: 2184173 - RNA, 16 nt, Human
ugaauuuucacaugaa

SEQ ID NO: 2184174 - RNA, 17 nt, Human
ugaauuuucacaugaac

SEQ ID NO: 2184175 - RNA, 18 nt, Human
ugaauuuucacaugaaca

SEQ ID NO: 2184176 - RNA, 19 nt, Human
ugaauuuucacaugaacau

SEQ ID NO: 2184177 - RNA, 22 nt, Human
ugaauuuuucucuaacucagaa

SEQ ID NO: 2184178 - RNA, 23 nt, Human
ugaauuuucuuuuuaauaaaaag

SEQ ID NO: 2184179 - RNA, 15 nt, Human
ugaauuuucuguguu

SEQ ID NO: 2184180 - RNA, 20 nt, Human
ugaauuuucccacugcaccc

SEQ ID NO: 2184181 - RNA, 13 nt, Human
ugaauuuucugug

SEQ ID NO: 2184182 - RNA, 14 nt, Human
ugaauuuucugugu

SEQ ID NO: 2184183 - RNA, 14 nt, Human
ugaauuuucccacu

SEQ ID NO: 2184184 - RNA, 15 nt, Human
ugaauuuucccacug

SEQ ID NO: 2184185 - RNA, 16 nt, Human
ugaauuuucccacugc

SEQ ID NO: 2184186 - RNA, 17 nt, Human
ugaauuuucccacugca

SEQ ID NO: 2184187 - RNA, 20 nt, Human
ugaauuucuucacuguugaa

SEQ ID NO: 2184188 - RNA, 15 nt, Human
agaucacgcuccccg

SEQ ID NO: 2184189 - RNA, 16 nt, Human
agaucacgcuccccgc

SEQ ID NO: 2184190 - RNA, 13 nt, Human
ugaauuucuaaaa

SEQ ID NO: 2184191 - RNA, 15 nt, Human
ugaauuucuuuugcc

SEQ ID NO: 2184192 - RNA, 21 nt, Human
ugaauuucuucacuguugaaa

SEQ ID NO: 2184193 - RNA, 23 nt, Human
ugaauuucuucacuguugaaaau

SEQ ID NO: 2184194 - RNA, 22 nt, Human
agaucacgccacugcacuccag

SEQ ID NO: 2184195 - RNA, 14 nt, Human
agaucaccagcccg

SEQ ID NO: 2184196 - RNA, 15 nt, Human
agaucaccagcccgg

SEQ ID NO: 2184197 - RNA, 16 nt, Human
agaucaccagcccggc

SEQ ID NO: 2184198 - RNA, 21 nt, Human
agaucaccagcccggccugcu

SEQ ID NO: 2184199 - RNA, 17 nt, Human
agaucacgccacugcac

SEQ ID NO: 2184200 - RNA, 18 nt, Human
agaucacgccacugcacu

SEQ ID NO: 2184201 - RNA, 22 nt, Human
agaguuguaaauauauaaauau

SEQ ID NO: 2184202 - RNA, 19 nt, Human
agaguugugcacauggcuu

SEQ ID NO: 2184203 - RNA, 16 nt, Human
agaguuguuacauuuu

SEQ ID NO: 2184204 - RNA, 14 nt, Human
agaguuuaacacaa

SEQ ID NO: 2184205 - RNA, 21 nt, Human
agaguuguuacauuuuuaagu

SEQ ID NO: 2184206 - RNA, 16 nt, Human
agaguuuagcuggaaa

SEQ ID NO: 2184207 - RNA, 17 nt, Human
agaguuuagcuggaaaa

SEQ ID NO: 2184208 - RNA, 16 nt, Human
agaguugcugggagcu

SEQ ID NO: 2184209 - RNA, 16 nt, Human
agagugaaaauugucu

SEQ ID NO: 2184210 - RNA, 20 nt, Human
agaguugaugguuguacaua

SEQ ID NO: 2184211 - RNA, 12 nt, Human
agaguuguuaca

SEQ ID NO: 2184212 - RNA, 13 nt, Human
agaguuguaaaua

SEQ ID NO: 2184213 - RNA, 15 nt, Human
agaguuguaaauaua

SEQ ID NO: 2184214 - RNA, 16 nt, Human
agaguuguaaauauau

SEQ ID NO: 2184215 - RNA, 17 nt, Human
agaguuguaaauauaua

SEQ ID NO: 2184216 - RNA, 18 nt, Human
agaguuguaaauauauaa

SEQ ID NO: 2184217 - RNA, 19 nt, Human
agaguuguaaauauauaaa

SEQ ID NO: 2184218 - RNA, 20 nt, Human
agaguuguaaauauauaaau

SEQ ID NO: 2184219 - RNA, 21 nt, Human
agaguuguaaauauauaaaua

SEQ ID NO: 2184220 - RNA, 12 nt, Human
agagucugucuc

SEQ ID NO: 2184221 - RNA, 23 nt, Human
agagucuggugaagcucacuucu

SEQ ID NO: 2184222 - RNA, 17 nt, Human
agaguugauacuacagu

SEQ ID NO: 2184223 - RNA, 22 nt, Human
agaguugauacuacaguuuguu

SEQ ID NO: 2184224 - RNA, 20 nt, Human
agaguugauacuacaguuug

SEQ ID NO: 2184225 - RNA, 14 nt, Human
agaguccucacucc

SEQ ID NO: 2184226 - RNA, 13 nt, Human
agaguccucacuc

SEQ ID NO: 2184227 - RNA, 12 nt, Human
agaguccuauuu

SEQ ID NO: 2184228 - RNA, 12 nt, Human
agagucugaaca

SEQ ID NO: 2184229 - RNA, 13 nt, Human
agagucugaacag

SEQ ID NO: 2184230 - RNA, 16 nt, Human
agagucugaacagcug

SEQ ID NO: 2184231 - RNA, 17 nt, Human
agagucugaacagcugu

SEQ ID NO: 2184232 - RNA, 18 nt, Human
agagucuggugaagcuca

SEQ ID NO: 2184233 - RNA, 13 nt, Human
ugaaugguaugga

SEQ ID NO: 2184234 - RNA, 19 nt, Human
ugaaugggcaaaacugaau

SEQ ID NO: 2184235 - RNA, 20 nt, Human
ugaaugggcaaaacugaauu

SEQ ID NO: 2184236 - RNA, 17 nt, Human
ugaagcaccaagcucaa

SEQ ID NO: 2184237 - RNA, 17 nt, Human
ugaauggguccauuuug

SEQ ID NO: 2184238 - RNA, 13 nt, Human
ugaauggucagcg

SEQ ID NO: 2184239 - RNA, 20 nt, Human
ugaaugguauggaacucucu

SEQ ID NO: 2184240 - RNA, 21 nt, Human
ugaauggucagcguugcaugu

SEQ ID NO: 2184241 - RNA, 14 nt, Human
ugaaugguccaggg

SEQ ID NO: 2184242 - RNA, 15 nt, Human
ugaaugguccagggu

SEQ ID NO: 2184243 - RNA, 15 nt, Human
ugaaugguguuguau

SEQ ID NO: 2184244 - RNA, 20 nt, Human
ugaaugguuuucaaaauaaa

SEQ ID NO: 2184245 - RNA, 16 nt, Human
ugaaugucauucacaa

SEQ ID NO: 2184246 - RNA, 23 nt, Human
ugaaugucuuuugaauauuccca

SEQ ID NO: 2184247 - RNA, 20 nt, Human
ugaaugucuaaggucacaca

SEQ ID NO: 2184248 - RNA, 15 nt, Human
ugaaugucuuuugaa

SEQ ID NO: 2184249 - RNA, 19 nt, Human
ugaaugucagugugacuga

SEQ ID NO: 2184250 - RNA, 23 nt, Human
ugaaugguuccaugccugagggu

SEQ ID NO: 2184251 - RNA, 21 nt, Human
ugaaugguuccaugccugagg

SEQ ID NO: 2184252 - RNA, 22 nt, Human
ugaaugguuccaugccugaggg

SEQ ID NO: 2184253 - RNA, 18 nt, Human
ugaaugguguuguaugcc

SEQ ID NO: 2184254 - RNA, 20 nt, Human
ugaaugguguuguaugccuu

SEQ ID NO: 2184255 - RNA, 21 nt, Human
ugaaugguguuguaugccuuu

SEQ ID NO: 2184256 - RNA, 19 nt, Human
ugaaugguuccaugccuga

SEQ ID NO: 2184257 - RNA, 16 nt, Human
agagucagcagaacug

SEQ ID NO: 2184258 - RNA, 14 nt, Human
ugaaugugucacua

SEQ ID NO: 2184259 - RNA, 14 nt, Human
ugaauguguguggu

SEQ ID NO: 2184260 - RNA, 18 nt, Human
ugaauguggcuugagaaa

SEQ ID NO: 2184261 - RNA, 18 nt, Human
agagucagccuucccccu

SEQ ID NO: 2184262 - RNA, 15 nt, Human
agagucauauuuuga

SEQ ID NO: 2184263 - RNA, 17 nt, Human
agagucauauuuugauu

SEQ ID NO: 2184264 - RNA, 13 nt, Human
agagucauauuuu

SEQ ID NO: 2184265 - RNA, 18 nt, Human
agagucaucuccaucagc

SEQ ID NO: 2184266 - RNA, 14 nt, Human
agagucaucuccau

SEQ ID NO: 2184267 - RNA, 13 nt, Human
agagucaucucca

SEQ ID NO: 2184268 - RNA, 18 nt, Human
agagucauauuuugauua

SEQ ID NO: 2184269 - RNA, 21 nt, Human
agagucaucuccaucagcugu

SEQ ID NO: 2184270 - RNA, 19 nt, Human
agagucaucuccaucagcu

SEQ ID NO: 2184271 - RNA, 16 nt, Human
agaguccaggccccaa

SEQ ID NO: 2184272 - RNA, 15 nt, Human
agaguccaggcccca

SEQ ID NO: 2184273 - RNA, 14 nt, Human
agaguccaggcccc

SEQ ID NO: 2184274 - RNA, 13 nt, Human
agagucccacugc

SEQ ID NO: 2184275 - RNA, 14 nt, Human
agagucccacugcc

SEQ ID NO: 2184276 - RNA, 15 nt, Human
agagucccacugccu

SEQ ID NO: 2184277 - RNA, 18 nt, Human
agagucccacugccucag

SEQ ID NO: 2184278 - RNA, 21 nt, Human
agagucccagagcaggaggcc

SEQ ID NO: 2184279 - RNA, 19 nt, Human
agagucccacugccucagg

SEQ ID NO: 2184280 - RNA, 20 nt, Human
agagucccacugccucaggu

SEQ ID NO: 2184281 - RNA, 21 nt, Human
agagucccacugccucagguu

SEQ ID NO: 2184282 - RNA, 22 nt, Human
agagucccacugccucagguuc

SEQ ID NO: 2184283 - RNA, 22 nt, Human
agauguucuaagucuuuccauu

SEQ ID NO: 2184284 - RNA, 21 nt, Human
agauguucuaagucuuuccau

SEQ ID NO: 2184285 - RNA, 20 nt, Human
agauguucuaagucuuucca

SEQ ID NO: 2184286 - RNA, 12 nt, Human
agauguucucua

SEQ ID NO: 2184287 - RNA, 15 nt, Human
agauguucucuauca

SEQ ID NO: 2184288 - RNA, 17 nt, Human
agauguucucuaucauu

SEQ ID NO: 2184289 - RNA, 23 nt, Human
ugaccauucuccaccugccaggg

SEQ ID NO: 2184290 - RNA, 18 nt, Human
agauguucucuaucauuu

SEQ ID NO: 2184291 - RNA, 19 nt, Human
agauguucucuaucauuua

SEQ ID NO: 2184292 - RNA, 17 nt, Human
ugacccacaagaaauga

SEQ ID NO: 2184293 - RNA, 16 nt, Human
ugacccaaagaccaau

SEQ ID NO: 2184294 - RNA, 11 nt, Human
ugacccacccc

SEQ ID NO: 2184295 - RNA, 12 nt, Human
ugacccaccccu

SEQ ID NO: 2184296 - RNA, 13 nt, Human
ugacccaccccug

SEQ ID NO: 2184297 - RNA, 15 nt, Human
ugacccaccccugug

SEQ ID NO: 2184298 - RNA, 16 nt, Human
ugacccaccccugugc

SEQ ID NO: 2184299 - RNA, 17 nt, Human
ugacccaccccugugcu

SEQ ID NO: 2184300 - RNA, 18 nt, Human
ugacccaccccugugcuc

SEQ ID NO: 2184301 - RNA, 23 nt, Human
ugacccaccccugugcuccgugc

SEQ ID NO: 2184302 - RNA, 12 nt, Human
ugacccacugcu

SEQ ID NO: 2184303 - RNA, 13 nt, Human
ugacccacugcuu

SEQ ID NO: 2184304 - RNA, 21 nt, Human
agauguggccuuccauuuaua

SEQ ID NO: 2184305 - RNA, 12 nt, Human
agauguuaaaaa

SEQ ID NO: 2184306 - RNA, 17 nt, Human
agauguuagaucagggg

SEQ ID NO: 2184307 - RNA, 21 nt, Human
agauguucagauugcuuugau

SEQ ID NO: 2184308 - RNA, 17 nt, Human
agauguucuaagucuuu

SEQ ID NO: 2184309 - RNA, 17 nt, Human
agauguucagucauuuu

SEQ ID NO: 2184310 - RNA, 18 nt, Human
agauguucagucauuuuu

SEQ ID NO: 2184311 - RNA, 13 nt, Human
agaugugcaccca

SEQ ID NO: 2184312 - RNA, 15 nt, Human
agaugugcacccaug

SEQ ID NO: 2184313 - RNA, 17 nt, Human
agauguggaaaagccaa

SEQ ID NO: 2184314 - RNA, 22 nt, Human
agauguggaaaagccaagaggc

SEQ ID NO: 2184315 - RNA, 15 nt, Human
agaugcuucucacug

SEQ ID NO: 2184316 - RNA, 23 nt, Human
agaugcuggguuggugcacagug

SEQ ID NO: 2184317 - RNA, 12 nt, Human
agaugugauuua

SEQ ID NO: 2184318 - RNA, 20 nt, Human
agaugugauuuaauaguguu

SEQ ID NO: 2184319 - RNA, 16 nt, Human
agaugugcaaaugcaa

SEQ ID NO: 2184320 - RNA, 18 nt, Human
agaugugcaaaugcaagc

SEQ ID NO: 2184321 - RNA, 21 nt, Human
agaugugcacccaugggcucu

SEQ ID NO: 2184322 - RNA, 21 nt, Human
agaucccagaaggaccuccug

SEQ ID NO: 2184323 - RNA, 21 nt, Human
agaugcaccaccaagccaagg

SEQ ID NO: 2184324 - RNA, 23 nt, Human
agaugcaccaccaagccaaggga

SEQ ID NO: 2184325 - RNA, 22 nt, Human
agauccagggacagaggcccca

SEQ ID NO: 2184326 - RNA, 19 nt, Human
agauccagggacagaggcc

SEQ ID NO: 2184327 - RNA, 14 nt, Human
agaucauggcaucc

SEQ ID NO: 2184328 - RNA, 16 nt, Human
agauccagggacugaa

SEQ ID NO: 2184329 - RNA, 14 nt, Human
agaugcaccagccc

SEQ ID NO: 2184330 - RNA, 15 nt, Human
agaugcaccagcccu

SEQ ID NO: 2184331 - RNA, 17 nt, Human
agaugcaguucugaaga

SEQ ID NO: 2184332 - RNA, 12 nt, Human
agaugcagagag

SEQ ID NO: 2184333 - RNA, 13 nt, Human
agaugcagagagc

SEQ ID NO: 2184334 - RNA, 14 nt, Human
agaugcagagagcc

SEQ ID NO: 2184335 - RNA, 15 nt, Human
agaugcagagagcca

SEQ ID NO: 2184336 - RNA, 17 nt, Human
agaugcagagagccauu

SEQ ID NO: 2184337 - RNA, 15 nt, Human
agaugccugaagcca

SEQ ID NO: 2184338 - RNA, 18 nt, Human
agaugcaguucugaagaa

SEQ ID NO: 2184339 - RNA, 19 nt, Human
agaugcaguucugaagaag

SEQ ID NO: 2184340 - RNA, 15 nt, Human
agaugcuagaacucc

SEQ ID NO: 2184341 - RNA, 14 nt, Human
agaugcuagaacuc

SEQ ID NO: 2184342 - RNA, 22 nt, Human
agaugcuggcccagggcccaga

SEQ ID NO: 2184343 - RNA, 21 nt, Human
agaugcuggcccagggcccag

SEQ ID NO: 2184344 - RNA, 20 nt, Human
agaugcuggcccagggccca

SEQ ID NO: 2184345 - RNA, 23 nt, Human
agaugcuggcccagggcccagag

SEQ ID NO: 2184346 - RNA, 18 nt, Human
agaugcagagagccauuu

SEQ ID NO: 2184347 - RNA, 18 nt, Human
agaugcuggguuggugca

SEQ ID NO: 2184348 - RNA, 13 nt, Human
agaugcuggguug

SEQ ID NO: 2184349 - RNA, 21 nt, Human
ugacaguggccgcccaaggcc

SEQ ID NO: 2184350 - RNA, 21 nt, Human
ugacagugccugggaauguau

SEQ ID NO: 2184351 - RNA, 20 nt, Human
ugacagggcacaccgggcac

SEQ ID NO: 2184352 - RNA, 16 nt, Human
ugacaguucugaagaa

SEQ ID NO: 2184353 - RNA, 23 nt, Human
ugacaguuuuccauaaagaagau

SEQ ID NO: 2184354 - RNA, 19 nt, Human
ugacaguguugaaaauguu

SEQ ID NO: 2184355 - RNA, 16 nt, Human
ugacaguguugaaaau

SEQ ID NO: 2184356 - RNA, 23 nt, Human
ugacagggaagcuacagguuaca

SEQ ID NO: 2184357 - RNA, 11 nt, Human
ugacagggcac

SEQ ID NO: 2184358 - RNA, 16 nt, Human
ugacagggcacaccgg

SEQ ID NO: 2184359 - RNA, 20 nt, Human
ugacaggcagccuggacaua

SEQ ID NO: 2184360 - RNA, 15 nt, Human
ugacaggcagcagag

SEQ ID NO: 2184361 - RNA, 16 nt, Human
ugacaggcagcagaga

SEQ ID NO: 2184362 - RNA, 19 nt, Human
ugacaggcagcagagacuu

SEQ ID NO: 2184363 - RNA, 18 nt, Human
ugacaggcagccuggaca

SEQ ID NO: 2184364 - RNA, 12 nt, Human
ugacagggaagc

SEQ ID NO: 2184365 - RNA, 13 nt, Human
ugacagggaagcu

SEQ ID NO: 2184366 - RNA, 14 nt, Human
ugacagggaagcua

SEQ ID NO: 2184367 - RNA, 16 nt, Human
ugacagggaagcuaca

SEQ ID NO: 2184368 - RNA, 17 nt, Human
ugacagggaagcuacag

SEQ ID NO: 2184369 - RNA, 19 nt, Human
ugacagggaagcuacaggu

SEQ ID NO: 2184370 - RNA, 20 nt, Human
ugacagggaagcuacagguu

SEQ ID NO: 2184371 - RNA, 21 nt, Human
ugacagggaagcuacagguua

SEQ ID NO: 2184372 - RNA, 14 nt, Human
ugacagcugucccu

SEQ ID NO: 2184373 - RNA, 12 nt, Human
ugacagcugucc

SEQ ID NO: 2184374 - RNA, 22 nt, Human
ugacagcugcuccuagagggag

SEQ ID NO: 2184375 - RNA, 21 nt, Human
ugacagcugcuccuagaggga

SEQ ID NO: 2184376 - RNA, 18 nt, Human
ugacagcugcuccuagag

SEQ ID NO: 2184377 - RNA, 15 nt, Human
ugacagcugcuccua

SEQ ID NO: 2184378 - RNA, 14 nt, Human
ugacagcugcuccu

SEQ ID NO: 2184379 - RNA, 13 nt, Human
ugacagcugcucc

SEQ ID NO: 2184380 - RNA, 12 nt, Human
ugacagcugcuc

SEQ ID NO: 2184381 - RNA, 21 nt, Human
ugacagcugucccugucacca

SEQ ID NO: 2184382 - RNA, 20 nt, Human
ugacagcugucccugucacc

SEQ ID NO: 2184383 - RNA, 13 nt, Human
ugacaggcagcag

SEQ ID NO: 2184384 - RNA, 14 nt, Human
ugacaggcagcaga

SEQ ID NO: 2184385 - RNA, 18 nt, Human
ugacagcugucccuguca

SEQ ID NO: 2184386 - RNA, 17 nt, Human
ugacagcugucccuguc

SEQ ID NO: 2184387 - RNA, 16 nt, Human
ugacagcugucccugu

SEQ ID NO: 2184388 - RNA, 23 nt, Human
ugacagcugcuccuagagggagg

SEQ ID NO: 2184389 - RNA, 20 nt, Human
ugacaggcaaugcuggcugu

SEQ ID NO: 2184390 - RNA, 19 nt, Human
ugacagccucccaccccca

SEQ ID NO: 2184391 - RNA, 17 nt, Human
ugacagccucccacccc

SEQ ID NO: 2184392 - RNA, 22 nt, Human
ugacagccucccacccccaucu

SEQ ID NO: 2184393 - RNA, 19 nt, Human
ugacacagaaaauguugag

SEQ ID NO: 2184394 - RNA, 18 nt, Human
ugacacagaaaauguuga

SEQ ID NO: 2184395 - RNA, 21 nt, Human
ugacacacagcucuguccugg

SEQ ID NO: 2184396 - RNA, 14 nt, Human
ugacaaaaauucaa

SEQ ID NO: 2184397 - RNA, 17 nt, Human
ugaccaauauuguacag

SEQ ID NO: 2184398 - RNA, 18 nt, Human
ugaccaauauuguacagu

SEQ ID NO: 2184399 - RNA, 23 nt, Human
ugaccaauauuauacuaagaaaa

SEQ ID NO: 2184400 - RNA, 16 nt, Human
ugacauuuauauauug

SEQ ID NO: 2184401 - RNA, 15 nt, Human
ugacauuuauauauu

SEQ ID NO: 2184402 - RNA, 19 nt, Human
ugaccaauauuguacaguu

SEQ ID NO: 2184403 - RNA, 21 nt, Human
ugaccaauauuguacaguuuu

SEQ ID NO: 2184404 - RNA, 18 nt, Human
ugaccaaugauggucacc

SEQ ID NO: 2184405 - RNA, 20 nt, Human
ugacauuguuggccaaagcc

SEQ ID NO: 2184406 - RNA, 21 nt, Human
ugacauuguuggccaaagcca

SEQ ID NO: 2184407 - RNA, 22 nt, Human
ugacauuguagagcuucuggca

SEQ ID NO: 2184408 - RNA, 17 nt, Human
ugacaguucugaagaau

SEQ ID NO: 2184409 - RNA, 20 nt, Human
ugacauuguggcacauucuu

SEQ ID NO: 2184410 - RNA, 15 nt, Human
agaucagccugggca

SEQ ID NO: 2184411 - RNA, 13 nt, Human
agaucagccuggg

SEQ ID NO: 2184412 - RNA, 15 nt, Human
agaucaguguaccau

SEQ ID NO: 2184413 - RNA, 14 nt, Human
ugaccaaugucuug

SEQ ID NO: 2184414 - RNA, 13 nt, Human
ugaccaaugucuu

SEQ ID NO: 2184415 - RNA, 21 nt, Human
agaucaguguaccauuugccu

SEQ ID NO: 2184416 - RNA, 18 nt, Human
agaucaguguaccauuug

SEQ ID NO: 2184417 - RNA, 12 nt, Human
agaucaugaaga

SEQ ID NO: 2184418 - RNA, 18 nt, Human
agaucauccuuuccagca

SEQ ID NO: 2184419 - RNA, 12 nt, Human
agaucauuguga

SEQ ID NO: 2184420 - RNA, 13 nt, Human
agauccaggacua

SEQ ID NO: 2184421 - RNA, 16 nt, Human
agaucauauacgugaa

SEQ ID NO: 2184422 - RNA, 21 nt, Human
agaucauccagaaguuccuca

SEQ ID NO: 2184423 - RNA, 18 nt, Human
agaucauauacgugaaaa

SEQ ID NO: 2184424 - RNA, 13 nt, Human
agaucauccuuuc

SEQ ID NO: 2184425 - RNA, 15 nt, Human
agaucauccuuucca

SEQ ID NO: 2184426 - RNA, 16 nt, Human
agaucauccuuuccag

SEQ ID NO: 2184427 - RNA, 20 nt, Human
agaccucagccugugcugcc

SEQ ID NO: 2184428 - RNA, 18 nt, Human
agaccucagccaugagga

SEQ ID NO: 2184429 - RNA, 15 nt, Human
agaccucaucaggau

SEQ ID NO: 2184430 - RNA, 16 nt, Human
agaccucaucaggaug

SEQ ID NO: 2184431 - RNA, 17 nt, Human
agaccucaucaggauga

SEQ ID NO: 2184432 - RNA, 20 nt, Human
agaccucagugccuuccugu

SEQ ID NO: 2184433 - RNA, 18 nt, Human
agaccucagugccuuccu

SEQ ID NO: 2184434 - RNA, 13 nt, Human
agaccugaagaau

SEQ ID NO: 2184435 - RNA, 18 nt, Human
agaccucaucaggaugaa

SEQ ID NO: 2184436 - RNA, 19 nt, Human
agaccucaucaggaugaac

SEQ ID NO: 2184437 - RNA, 22 nt, Human
agaccucaucaggaugaaccca

SEQ ID NO: 2184438 - RNA, 14 nt, Human
agaccuccccagcc

SEQ ID NO: 2184439 - RNA, 15 nt, Human
agaccuccccagccc

SEQ ID NO: 2184440 - RNA, 17 nt, Human
agaccuccccagccccu

SEQ ID NO: 2184441 - RNA, 20 nt, Human
agaccuccccagccccuagc

SEQ ID NO: 2184442 - RNA, 23 nt, Human
agaccuccccagccccuagccca

SEQ ID NO: 2184443 - RNA, 19 nt, Human
agaccucagccugugcugc

SEQ ID NO: 2184444 - RNA, 17 nt, Human
agaccucagccugugcu

SEQ ID NO: 2184445 - RNA, 16 nt, Human
agaccucagccugugc

SEQ ID NO: 2184446 - RNA, 15 nt, Human
agaccucagccugug

SEQ ID NO: 2184447 - RNA, 14 nt, Human
agaccucagccugu

SEQ ID NO: 2184448 - RNA, 13 nt, Human
agaccucagccug

SEQ ID NO: 2184449 - RNA, 12 nt, Human
agaccucagccu

SEQ ID NO: 2184450 - RNA, 14 nt, Human
agaccucagccaug

SEQ ID NO: 2184451 - RNA, 12 nt, Human
agaccucagcca

SEQ ID NO: 2184452 - RNA, 19 nt, Human
agaccuagggaggaccuua

SEQ ID NO: 2184453 - RNA, 16 nt, Human
agaccuauuccuccug

SEQ ID NO: 2184454 - RNA, 19 nt, Human
agaccuauuccuccugggc

SEQ ID NO: 2184455 - RNA, 11 nt, Human
agaccucagcc

SEQ ID NO: 2184456 - RNA, 16 nt, Human
agaccuauuugacaua

SEQ ID NO: 2184457 - RNA, 15 nt, Human
agaccuagggaggac

SEQ ID NO: 2184458 - RNA, 14 nt, Human
agaccuagggagga

SEQ ID NO: 2184459 - RNA, 20 nt, Human
agaccguccucaccccuguc

SEQ ID NO: 2184460 - RNA, 14 nt, Human
agacccggcugcgu

SEQ ID NO: 2184461 - RNA, 15 nt, Human
agacccgaggaaacu

SEQ ID NO: 2184462 - RNA, 19 nt, Human
agacccuaagccuccuuuu

SEQ ID NO: 2184463 - RNA, 21 nt, Human
agaccccuggcuuuucacugc

SEQ ID NO: 2184464 - RNA, 15 nt, Human
agaccccuggcuuuu

SEQ ID NO: 2184465 - RNA, 14 nt, Human
agaccccuggcuuu

SEQ ID NO: 2184466 - RNA, 13 nt, Human
agaccaaaauaaa

SEQ ID NO: 2184467 - RNA, 18 nt, Human
agaccguccucaccccug

SEQ ID NO: 2184468 - RNA, 19 nt, Human
agaccguccucaccccugu

SEQ ID NO: 2184469 - RNA, 13 nt, Human
agaccguccucac

SEQ ID NO: 2184470 - RNA, 14 nt, Human
agaccguccucacc

SEQ ID NO: 2184471 - RNA, 15 nt, Human
agaccguccucaccc

SEQ ID NO: 2184472 - RNA, 16 nt, Human
agaccguccucacccc

SEQ ID NO: 2184473 - RNA, 17 nt, Human
agaccgaacuguuguau

SEQ ID NO: 2184474 - RNA, 18 nt, Human
agacccuaccccaccacg

SEQ ID NO: 2184475 - RNA, 16 nt, Human
agacccuaccccacca

SEQ ID NO: 2184476 - RNA, 20 nt, Human
agaccgaacuguuguauaaa

SEQ ID NO: 2184477 - RNA, 21 nt, Human
agaccgagcgcuuucuggaaa

SEQ ID NO: 2184478 - RNA, 16 nt, Human
agaccgagugaaccua

SEQ ID NO: 2184479 - RNA, 13 nt, Human
agacucaaaugcu

SEQ ID NO: 2184480 - RNA, 18 nt, Human
agacuauuuaacuugagg

SEQ ID NO: 2184481 - RNA, 13 nt, Human
agaccuggagccc

SEQ ID NO: 2184482 - RNA, 16 nt, Human
agaccuggagccccug

SEQ ID NO: 2184483 - RNA, 19 nt, Human
agaccuggagccccugggu

SEQ ID NO: 2184484 - RNA, 20 nt, Human
agaccuggagccccugggug

SEQ ID NO: 2184485 - RNA, 17 nt, Human
agacuauuuaacuugag

SEQ ID NO: 2184486 - RNA, 20 nt, Human
agacucacaaccugaaccua

SEQ ID NO: 2184487 - RNA, 23 nt, Human
agacucagguuguaguaaagaaa

SEQ ID NO: 2184488 - RNA, 22 nt, Human
agacucagguuguaguaaagaa

SEQ ID NO: 2184489 - RNA, 14 nt, Human
agacucaccucugc

SEQ ID NO: 2184490 - RNA, 12 nt, Human
agacucaccucu

SEQ ID NO: 2184491 - RNA, 21 nt, Human
agacucaagguucccagagau

SEQ ID NO: 2184492 - RNA, 22 nt, Human
agacucaagguucccagagaug

SEQ ID NO: 2184493 - RNA, 20 nt, Human
agaccugcugagggaccagc

SEQ ID NO: 2184494 - RNA, 23 nt, Human
agacuauucaaacagucucagga

SEQ ID NO: 2184495 - RNA, 13 nt, Human
agaccugccccuc

SEQ ID NO: 2184496 - RNA, 15 nt, Human
agaccugaauucuuu

SEQ ID NO: 2184497 - RNA, 16 nt, Human
agaccucgagcagaug

SEQ ID NO: 2184498 - RNA, 16 nt, Human
agaccugccccuccuc

SEQ ID NO: 2184499 - RNA, 23 nt, Human
agaccugccccuccucucugccc

SEQ ID NO: 2184500 - RNA, 22 nt, Human
agaccugccccuccucucugcc

SEQ ID NO: 2184501 - RNA, 22 nt, Human
agaccuggagccccuggguggg

SEQ ID NO: 2184502 - RNA, 21 nt, Human
agacucaguuugucagacuuu

SEQ ID NO: 2184503 - RNA, 17 nt, Human
agacucaguuugucaga

SEQ ID NO: 2184504 - RNA, 16 nt, Human
agacucaguuugucag

SEQ ID NO: 2184505 - RNA, 15 nt, Human
agacucaguuuguca

SEQ ID NO: 2184506 - RNA, 12 nt, Human
agacucaguuug

SEQ ID NO: 2184507 - RNA, 13 nt, Human
agacucaguguuc

SEQ ID NO: 2184508 - RNA, 12 nt, Human
agacucaguguu

SEQ ID NO: 2184509 - RNA, 15 nt, Human
agacucaccucugcc

SEQ ID NO: 2184510 - RNA, 21 nt, Human
agacucaguggggaggggcug

SEQ ID NO: 2184511 - RNA, 15 nt, Human
agacucauucuucug

SEQ ID NO: 2184512 - RNA, 17 nt, Human
ucuugagccuugaacuu

SEQ ID NO: 2184513 - RNA, 21 nt, Human
ucuugaguuuuguuuuaaaau

SEQ ID NO: 2184514 - RNA, 22 nt, Human
ucuugaguuugucgcucaugug

SEQ ID NO: 2184515 - RNA, 14 nt, Human
ucuugauaagacca

SEQ ID NO: 2184516 - RNA, 18 nt, Human
agacucaucuuacuguac

SEQ ID NO: 2184517 - RNA, 22 nt, Human
ucuugauaagaccaccaccuca

SEQ ID NO: 2184518 - RNA, 21 nt, Human
ucuugaguuugucgcucaugu

SEQ ID NO: 2184519 - RNA, 16 nt, Human
agacucaucuuacugu

SEQ ID NO: 2184520 - RNA, 17 nt, Human
agacucaucuuacugua

SEQ ID NO: 2184521 - RNA, 19 nt, Human
ucuugagccuugaacuuug

SEQ ID NO: 2184522 - RNA, 18 nt, Human
ucuugagccuugaacuuu

SEQ ID NO: 2184523 - RNA, 23 nt, Human
agacaugccacaaggacuuccug

SEQ ID NO: 2184524 - RNA, 15 nt, Human
agacaugcugacuuu

SEQ ID NO: 2184525 - RNA, 13 nt, Human
agacauggagacu

SEQ ID NO: 2184526 - RNA, 18 nt, Human
agacauggagacuccugc

SEQ ID NO: 2184527 - RNA, 19 nt, Human
agacauggagacuccugcc

SEQ ID NO: 2184528 - RNA, 17 nt, Human
agacaugaaugcacacu

SEQ ID NO: 2184529 - RNA, 17 nt, Human
agacaugaauaugauua

SEQ ID NO: 2184530 - RNA, 15 nt, Human
agacaugauuuccuu

SEQ ID NO: 2184531 - RNA, 22 nt, Human
agacaugauuuccuugaaugug

SEQ ID NO: 2184532 - RNA, 20 nt, Human
agacaugagugcgugcucag

SEQ ID NO: 2184533 - RNA, 14 nt, Human
agacaugaauauga

SEQ ID NO: 2184534 - RNA, 23 nt, Human
agacauacuugaagggccagagc

SEQ ID NO: 2184535 - RNA, 21 nt, Human
agacauacuugaagggccaga

SEQ ID NO: 2184536 - RNA, 20 nt, Human
agacauacuugaagggccag

SEQ ID NO: 2184537 - RNA, 14 nt, Human
agacauagaauuaa

SEQ ID NO: 2184538 - RNA, 12 nt, Human
agacauggggag

SEQ ID NO: 2184539 - RNA, 22 nt, Human
agacauggcuugccacagcucu

SEQ ID NO: 2184540 - RNA, 15 nt, Human
agacauuuauacucu

SEQ ID NO: 2184541 - RNA, 17 nt, Human
agacauuuauacucuuu

SEQ ID NO: 2184542 - RNA, 21 nt, Human
agacauuuauacucuuuuuuc

SEQ ID NO: 2184543 - RNA, 23 nt, Human
agacauuuauacucuuuuuucau

SEQ ID NO: 2184544 - RNA, 16 nt, Human
agacauggcuugccac

SEQ ID NO: 2184545 - RNA, 22 nt, Human
agacauggagacuccugcccug

SEQ ID NO: 2184546 - RNA, 22 nt, Human
agacauuuguaaauguaaaacu

SEQ ID NO: 2184547 - RNA, 21 nt, Human
agacauuugcuaugagcuggg

SEQ ID NO: 2184548 - RNA, 23 nt, Human
agacauuucucuuacugcaaaug

SEQ ID NO: 2184549 - RNA, 15 nt, Human
ucuucuucuucagaa

SEQ ID NO: 2184550 - RNA, 21 nt, Human
ucuucuugaacacucaugcug

SEQ ID NO: 2184551 - RNA, 22 nt, Human
ucuucuugaacacucaugcuga

SEQ ID NO: 2184552 - RNA, 23 nt, Human
ucuucuugaacacucaugcugaa

SEQ ID NO: 2184553 - RNA, 22 nt, Human
agacauacuccuuccaucaaau

SEQ ID NO: 2184554 - RNA, 13 nt, Human
agacauacuugaa

SEQ ID NO: 2184555 - RNA, 19 nt, Human
agacauacuugaagggcca

SEQ ID NO: 2184556 - RNA, 17 nt, Human
agacauacuugaagggc

SEQ ID NO: 2184557 - RNA, 16 nt, Human
agacauacuugaaggg

SEQ ID NO: 2184558 - RNA, 14 nt, Human
agacauacuugaag

SEQ ID NO: 2184559 - RNA, 14 nt, Human
ucuucuucuucaga

SEQ ID NO: 2184560 - RNA, 22 nt, Human
ucuucuucccucccuaucuaac

SEQ ID NO: 2184561 - RNA, 19 nt, Human
ucuucuuccugaagcugag

SEQ ID NO: 2184562 - RNA, 17 nt, Human
ucuucuugaaauuuuaa

SEQ ID NO: 2184563 - RNA, 13 nt, Human
ucuucuugaaauu

SEQ ID NO: 2184564 - RNA, 23 nt, Human
agacauacuaaccagcagaaaug

SEQ ID NO: 2184565 - RNA, 20 nt, Human
ucuucuguacgucugacagg

SEQ ID NO: 2184566 - RNA, 15 nt, Human
ucuucuuacaugcau

SEQ ID NO: 2184567 - RNA, 23 nt, Human
ucuucuguacgucugacaggcaa

SEQ ID NO: 2184568 - RNA, 16 nt, Human
ucuucuucagaagaca

SEQ ID NO: 2184569 - RNA, 13 nt, Human
ucuucuucccucc

SEQ ID NO: 2184570 - RNA, 14 nt, Human
ucuucuucagaaga

SEQ ID NO: 2184571 - RNA, 15 nt, Human
ucuucuucaccauuu

SEQ ID NO: 2184572 - RNA, 12 nt, Human
ucuucuuaugca

SEQ ID NO: 2184573 - RNA, 14 nt, Human
ucuucuucaccauu

SEQ ID NO: 2184574 - RNA, 13 nt, Human
ucuucuucaccau

SEQ ID NO: 2184575 - RNA, 14 nt, Human
ucuucugacgugcc

SEQ ID NO: 2184576 - RNA, 15 nt, Human
ucuucugacgugccu

SEQ ID NO: 2184577 - RNA, 17 nt, Human
ucuucugacgugccuuu

SEQ ID NO: 2184578 - RNA, 21 nt, Human
ucuucugagcuauuucaucua

SEQ ID NO: 2184579 - RNA, 19 nt, Human
ucuucugagcuauuucauc

SEQ ID NO: 2184580 - RNA, 21 nt, Human
ucuucugacuuaagugugcaa

SEQ ID NO: 2184581 - RNA, 16 nt, Human
ucuuauuucauuucuu

SEQ ID NO: 2184582 - RNA, 11 nt, Human
ucuuauuugcu

SEQ ID NO: 2184583 - RNA, 16 nt, Human
ucuuauuucaugaaaa

SEQ ID NO: 2184584 - RNA, 18 nt, Human
ucuuauuucaugaaaauu

SEQ ID NO: 2184585 - RNA, 17 nt, Human
ucuuauucaguaaaaaa

SEQ ID NO: 2184586 - RNA, 18 nt, Human
ucuuauucaguaaaaaac

SEQ ID NO: 2184587 - RNA, 17 nt, Human
ucuuauuuaaugaaaga

SEQ ID NO: 2184588 - RNA, 22 nt, Human
ucuuauugcaaaauagcauuug

SEQ ID NO: 2184589 - RNA, 15 nt, Human
ucuuauucucacucc

SEQ ID NO: 2184590 - RNA, 13 nt, Human
ucuuauuuauuau

SEQ ID NO: 2184591 - RNA, 14 nt, Human
ucuuauuucaugaa

SEQ ID NO: 2184592 - RNA, 15 nt, Human
ucuuauuucauuucu

SEQ ID NO: 2184593 - RNA, 21 nt, Human
ucuucuguacgucugacaggc

SEQ ID NO: 2184594 - RNA, 22 nt, Human
ucuucuguacgucugacaggca

SEQ ID NO: 2184595 - RNA, 19 nt, Human
ucuucuggagucuccagug

SEQ ID NO: 2184596 - RNA, 17 nt, Human
ucuucuggagucuccag

SEQ ID NO: 2184597 - RNA, 13 nt, Human
ucuucuggcucaa

SEQ ID NO: 2184598 - RNA, 12 nt, Human
ucuucuggcuca

SEQ ID NO: 2184599 - RNA, 21 nt, Human
ucuucuggcucaaaaagagaa

SEQ ID NO: 2184600 - RNA, 18 nt, Human
ucuucuggcucaaaaaga

SEQ ID NO: 2184601 - RNA, 20 nt, Human
ucuucugggagggcagcagg

SEQ ID NO: 2184602 - RNA, 17 nt, Human
ucuucugggagggcagc

SEQ ID NO: 2184603 - RNA, 22 nt, Human
ucuucugcuucagccucccgag

SEQ ID NO: 2184604 - RNA, 13 nt, Human
ucuucugcuccac

SEQ ID NO: 2184605 - RNA, 12 nt, Human
ucuucugcucca

SEQ ID NO: 2184606 - RNA, 11 nt, Human
ucuucugcucc

SEQ ID NO: 2184607 - RNA, 12 nt, Human
ucuucugccugu

SEQ ID NO: 2184608 - RNA, 15 nt, Human
ucuucugccuguuau

SEQ ID NO: 2184609 - RNA, 16 nt, Human
ucuucugccuguuaua

SEQ ID NO: 2184610 - RNA, 22 nt, Human
ucuucugcuaugugacuugcau

SEQ ID NO: 2184611 - RNA, 19 nt, Human
ucuucugccggcccugggg

SEQ ID NO: 2184612 - RNA, 18 nt, Human
ucuucugccggcccuggg

SEQ ID NO: 2184613 - RNA, 20 nt, Human
ucuucugcccaauuggagga

SEQ ID NO: 2184614 - RNA, 18 nt, Human
ucuuguaaauaaagcccu

SEQ ID NO: 2184615 - RNA, 20 nt, Human
ucuuuaaugucacaggcagg

SEQ ID NO: 2184616 - RNA, 13 nt, Human
ucuuguaaauaaa

SEQ ID NO: 2184617 - RNA, 17 nt, Human
ucuuguaaauaaagccc

SEQ ID NO: 2184618 - RNA, 15 nt, Human
ucuugguuuccuucc

SEQ ID NO: 2184619 - RNA, 16 nt, Human
ucuugguuuguaaauu

SEQ ID NO: 2184620 - RNA, 15 nt, Human
ucuuuaguuuuugug

SEQ ID NO: 2184621 - RNA, 19 nt, Human
ucuuguaauccgaaucucu

SEQ ID NO: 2184622 - RNA, 22 nt, Human
ucuuuaaugucacaggcagguc

SEQ ID NO: 2184623 - RNA, 14 nt, Human
ucuuuaauuuuaca

SEQ ID NO: 2184624 - RNA, 14 nt, Human
ucuugguuuguaaa

SEQ ID NO: 2184625 - RNA, 15 nt, Human
ucuugguugaggaaa

SEQ ID NO: 2184626 - RNA, 17 nt, Human
ucuugguuggcuggccu

SEQ ID NO: 2184627 - RNA, 14 nt, Human
ucuugguuuccaaa

SEQ ID NO: 2184628 - RNA, 13 nt, Human
ucuugguugagga

SEQ ID NO: 2184629 - RNA, 23 nt, Human
ucuugguugaaaauaaaaagauc

SEQ ID NO: 2184630 - RNA, 19 nt, Human
ucuugguuccagccugcca

SEQ ID NO: 2184631 - RNA, 19 nt, Human
ucuugguugaaaauaaaaa

SEQ ID NO: 2184632 - RNA, 18 nt, Human
ucuugguucauaaaugaa

SEQ ID NO: 2184633 - RNA, 21 nt, Human
ucuugguucauaaaugaauuu

SEQ ID NO: 2184634 - RNA, 18 nt, Human
ucuugguuccagccugcc

SEQ ID NO: 2184635 - RNA, 17 nt, Human
ucuugguuccagccugc

SEQ ID NO: 2184636 - RNA, 20 nt, Human
ucuugaucaacaucuuuucu

SEQ ID NO: 2184637 - RNA, 23 nt, Human
ucuugaucaacaucuuuucuugc

SEQ ID NO: 2184638 - RNA, 13 nt, Human
ucuugguuccagc

SEQ ID NO: 2184639 - RNA, 15 nt, Human
ucuuggucuucccag

SEQ ID NO: 2184640 - RNA, 17 nt, Human
ucuuggucuucccaggc

SEQ ID NO: 2184641 - RNA, 17 nt, Human
ucuugaucaacaucuuu

SEQ ID NO: 2184642 - RNA, 22 nt, Human
ucuugauaccccccucugucuu

SEQ ID NO: 2184643 - RNA, 18 nt, Human
ucuugaucaacaucuuuu

SEQ ID NO: 2184644 - RNA, 19 nt, Human
ucuugaucaacaucuuuuc

SEQ ID NO: 2184645 - RNA, 17 nt, Human
ucuugauaccccccucu

SEQ ID NO: 2184646 - RNA, 20 nt, Human
ucuugauaccccccucuguc

SEQ ID NO: 2184647 - RNA, 21 nt, Human
ucuugauaccccccucugucu

SEQ ID NO: 2184648 - RNA, 20 nt, Human
agacucgauucauauugaau

SEQ ID NO: 2184649 - RNA, 19 nt, Human
agacucgagaacuuucauu

SEQ ID NO: 2184650 - RNA, 15 nt, Human
agacucgagaacuuu

SEQ ID NO: 2184651 - RNA, 18 nt, Human
agacucgagaacuuucau

SEQ ID NO: 2184652 - RNA, 14 nt, Human
agacucgagaacuu

SEQ ID NO: 2184653 - RNA, 20 nt, Human
agacuccuugagagaccagg

SEQ ID NO: 2184654 - RNA, 16 nt, Human
agacuccugcccuguu

SEQ ID NO: 2184655 - RNA, 14 nt, Human
agacuccugcccug

SEQ ID NO: 2184656 - RNA, 15 nt, Human
agacuccugcccugu

SEQ ID NO: 2184657 - RNA, 17 nt, Human
ucuuucuuccucugcug

SEQ ID NO: 2184658 - RNA, 19 nt, Human
ucuuucuuagaaauuuauu

SEQ ID NO: 2184659 - RNA, 15 nt, Human
ucuuucuuccucugc

SEQ ID NO: 2184660 - RNA, 16 nt, Human
ucuuucuuccucugcu

SEQ ID NO: 2184661 - RNA, 15 nt, Human
agacucgcgacaaug

SEQ ID NO: 2184662 - RNA, 17 nt, Human
agacucgcgacaaugca

SEQ ID NO: 2184663 - RNA, 18 nt, Human
agacucgcgacaaugcaa

SEQ ID NO: 2184664 - RNA, 19 nt, Human
agacucgcgacaaugcaaa

SEQ ID NO: 2184665 - RNA, 22 nt, Human
ucuuucugcagaaacagaaagg

SEQ ID NO: 2184666 - RNA, 21 nt, Human
ucuuucugcagaaacagaaag

SEQ ID NO: 2184667 - RNA, 13 nt, Human
ucuuucuggaguc

SEQ ID NO: 2184668 - RNA, 18 nt, Human
ucuuucuggcuaugcauu

SEQ ID NO: 2184669 - RNA, 14 nt, Human
ucuuucuuccucug

SEQ ID NO: 2184670 - RNA, 19 nt, Human
ucuuucuggcuaugcauuu

SEQ ID NO: 2184671 - RNA, 15 nt, Human
ucuuucuuagaaauu

SEQ ID NO: 2184672 - RNA, 16 nt, Human
ucuuucuuagaaauuu

SEQ ID NO: 2184673 - RNA, 13 nt, Human
ucuuucugcuuug

SEQ ID NO: 2184674 - RNA, 20 nt, Human
ucuuuauacaacagugcuaa

SEQ ID NO: 2184675 - RNA, 21 nt, Human
ucuuuauacaacagugcuaaa

SEQ ID NO: 2184676 - RNA, 16 nt, Human
ucuuuauacuguaauu

SEQ ID NO: 2184677 - RNA, 20 nt, Human
ucuuuauaauucuacuuuga

SEQ ID NO: 2184678 - RNA, 13 nt, Human
ucuuuauacaaca

SEQ ID NO: 2184679 - RNA, 14 nt, Human
ucuuuauacaacag

SEQ ID NO: 2184680 - RNA, 17 nt, Human
ucuuuauacaacagugc

SEQ ID NO: 2184681 - RNA, 15 nt, Human
agagaaaaacaaauu

SEQ ID NO: 2184682 - RNA, 17 nt, Human
agagaauguagauauug

SEQ ID NO: 2184683 - RNA, 13 nt, Human
agagaaaaacaaa

SEQ ID NO: 2184684 - RNA, 19 nt, Human
agagaauuguuugaacccg

SEQ ID NO: 2184685 - RNA, 16 nt, Human
agagaaugucugaucu

SEQ ID NO: 2184686 - RNA, 17 nt, Human
agagaauggaaaacaga

SEQ ID NO: 2184687 - RNA, 21 nt, Human
agagacaaacaccucccagga

SEQ ID NO: 2184688 - RNA, 19 nt, Human
agagacaaacaccucccag

SEQ ID NO: 2184689 - RNA, 23 nt, Human
agagaauuucuaccauuucagag

SEQ ID NO: 2184690 - RNA, 22 nt, Human
agagaauuucuaccauuucaga

SEQ ID NO: 2184691 - RNA, 13 nt, Human
agagacagagagg

SEQ ID NO: 2184692 - RNA, 23 nt, Human
agagacagaagcaggcuggaggu

SEQ ID NO: 2184693 - RNA, 13 nt, Human
agagacagaagca

SEQ ID NO: 2184694 - RNA, 20 nt, Human
agagacaaacaccucccagg

SEQ ID NO: 2184695 - RNA, 14 nt, Human
agagacagaagcag

SEQ ID NO: 2184696 - RNA, 15 nt, Human
agagacagaagcagg

SEQ ID NO: 2184697 - RNA, 17 nt, Human
agagacagaagcaggcu

SEQ ID NO: 2184698 - RNA, 20 nt, Human
agagacagaagcaggcugga

SEQ ID NO: 2184699 - RNA, 24 nt, Human
agagacagaaagcagaacagugau

SEQ ID NO: 2184700 - RNA, 22 nt, Human
agagaaaaaauauuuuccugcc

SEQ ID NO: 2184701 - RNA, 21 nt, Human
agagaaaaaaaguuugccaga

SEQ ID NO: 2184702 - RNA, 19 nt, Human
agacuuuuuuuaaauagua

SEQ ID NO: 2184703 - RNA, 19 nt, Human
agacuuuucuuucagccaa

SEQ ID NO: 2184704 - RNA, 12 nt, Human
agacuuucuguu

SEQ ID NO: 2184705 - RNA, 20 nt, Human
agacuuuacaugacacagcu

SEQ ID NO: 2184706 - RNA, 14 nt, Human
agacuuuaaagaau

SEQ ID NO: 2184707 - RNA, 19 nt, Human
agacuuuacaugacacagc

SEQ ID NO: 2184708 - RNA, 18 nt, Human
agacuuguaugaaagaug

SEQ ID NO: 2184709 - RNA, 19 nt, Human
agacuugguguccuuuccc

SEQ ID NO: 2184710 - RNA, 16 nt, Human
agacuucgacucagga

SEQ ID NO: 2184711 - RNA, 20 nt, Human
agacuucgacucaggaucca

SEQ ID NO: 2184712 - RNA, 23 nt, Human
agacuugguguccuuucccucca

SEQ ID NO: 2184713 - RNA, 22 nt, Human
agacuugguguccuuucccucc

SEQ ID NO: 2184714 - RNA, 23 nt, Human
agacucgauucauauugaauaua

SEQ ID NO: 2184715 - RNA, 20 nt, Human
agacucgcgacaaugcaaac

SEQ ID NO: 2184716 - RNA, 15 nt, Human
agacuggguuucuag

SEQ ID NO: 2184717 - RNA, 15 nt, Human
agacugguccugugu

SEQ ID NO: 2184718 - RNA, 17 nt, Human
agacugguccugugugc

SEQ ID NO: 2184719 - RNA, 18 nt, Human
agacugguccugugugca

SEQ ID NO: 2184720 - RNA, 16 nt, Human
agacuguacaaaguag

SEQ ID NO: 2184721 - RNA, 15 nt, Human
agacuguacaaagua

SEQ ID NO: 2184722 - RNA, 14 nt, Human
agacuguacaaagu

SEQ ID NO: 2184723 - RNA, 22 nt, Human
agacuguaggaagaguagcauu

SEQ ID NO: 2184724 - RNA, 21 nt, Human
agacugucagcuuccaaacau

SEQ ID NO: 2184725 - RNA, 23 nt, Human
agacuguuuuucagggagguggc

SEQ ID NO: 2184726 - RNA, 17 nt, Human
agacuuaauagaaacau

SEQ ID NO: 2184727 - RNA, 18 nt, Human
agacuguagccuggauau

SEQ ID NO: 2184728 - RNA, 20 nt, Human
agacuguaggaagaguagca

SEQ ID NO: 2184729 - RNA, 23 nt, Human
agacuuaauagaaacauugaaga

SEQ ID NO: 2184730 - RNA, 15 nt, Human
agacuuaccaggaag

SEQ ID NO: 2184731 - RNA, 16 nt, Human
agacuuagggcaccag

SEQ ID NO: 2184732 - RNA, 19 nt, Human
agacuuacuuuacucauuu

SEQ ID NO: 2184733 - RNA, 20 nt, Human
agacuuacuuuacucauuuu

SEQ ID NO: 2184734 - RNA, 17 nt, Human
agacuucauuuuuccua

SEQ ID NO: 2184735 - RNA, 19 nt, Human
agacuuccaaaccugacag

SEQ ID NO: 2184736 - RNA, 20 nt, Human
agacuuccaaaccugacaga

SEQ ID NO: 2184737 - RNA, 18 nt, Human
agacuuaguauauuuucu

SEQ ID NO: 2184738 - RNA, 21 nt, Human
agacuuacuuuacucauuuuu

SEQ ID NO: 2184739 - RNA, 17 nt, Human
agacuuagggcaccagg

SEQ ID NO: 2184740 - RNA, 22 nt, Human
agacuuaguauauuuucuuuuc

SEQ ID NO: 2184741 - RNA, 19 nt, Human
agacuuaguauauuuucuu

SEQ ID NO: 2184742 - RNA, 21 nt, Human
agacuuccaaaccugacagau

SEQ ID NO: 2184743 - RNA, 19 nt, Human
agacuucccugaauguauu

SEQ ID NO: 2184744 - RNA, 15 nt, Human
agacuucccugaaug

SEQ ID NO: 2184745 - RNA, 16 nt, Human
agacuuccuugagaca

SEQ ID NO: 2184746 - RNA, 14 nt, Human
agacuuccuugaga

SEQ ID NO: 2184747 - RNA, 14 nt, Human
ucuuacaaacaugu

SEQ ID NO: 2184748 - RNA, 20 nt, Human
ucuuaauuuugguuguauuc

SEQ ID NO: 2184749 - RNA, 21 nt, Human
ucuuaauuuugguuguauucu

SEQ ID NO: 2184750 - RNA, 19 nt, Human
ucuuacaauaauucuauga

SEQ ID NO: 2184751 - RNA, 23 nt, Human
ucuuaauuuaaucuuuuuuaugu

SEQ ID NO: 2184752 - RNA, 17 nt, Human
ucuuaauuuugguugua

SEQ ID NO: 2184753 - RNA, 19 nt, Human
ucuuaauuuugguuguauu

SEQ ID NO: 2184754 - RNA, 23 nt, Human
ucuuaaugaaguuugaauguuaa

SEQ ID NO: 2184755 - RNA, 21 nt, Human
ucuuaaugaaguuugaauguu

SEQ ID NO: 2184756 - RNA, 22 nt, Human
ucuuaaugaaguuugaauguua

SEQ ID NO: 2184757 - RNA, 21 nt, Human
ucuuaaucuuuucacaaauaa

SEQ ID NO: 2184758 - RNA, 22 nt, Human
ucuuaaucuuuucacaaauaaa

SEQ ID NO: 2184759 - RNA, 15 nt, Human
ucuuaaugaaguuug

SEQ ID NO: 2184760 - RNA, 16 nt, Human
ucuuaaugaaguuuga

SEQ ID NO: 2184761 - RNA, 17 nt, Human
ucuuaaugaaguuugaa

SEQ ID NO: 2184762 - RNA, 18 nt, Human
ucuuaaugaaguuugaau

SEQ ID NO: 2184763 - RNA, 19 nt, Human
ucuuaaugaaguuugaaug

SEQ ID NO: 2184764 - RNA, 20 nt, Human
ucuuaaugaaguuugaaugu

SEQ ID NO: 2184765 - RNA, 20 nt, Human
agacaguugggugagaacaa

SEQ ID NO: 2184766 - RNA, 14 nt, Human
agacaguucaagaa

SEQ ID NO: 2184767 - RNA, 15 nt, Human
agacagugggaaaua

SEQ ID NO: 2184768 - RNA, 19 nt, Human
ucuuaaucuuuucacaaau

SEQ ID NO: 2184769 - RNA, 20 nt, Human
ucuuaaucuuuucacaaaua

SEQ ID NO: 2184770 - RNA, 15 nt, Human
agacaguucaagaaa

SEQ ID NO: 2184771 - RNA, 13 nt, Human
agacaguuucuua

SEQ ID NO: 2184772 - RNA, 14 nt, Human
agacaguuucuuag

SEQ ID NO: 2184773 - RNA, 17 nt, Human
agacagucaccccagga

SEQ ID NO: 2184774 - RNA, 15 nt, Human
agacaguccagccug

SEQ ID NO: 2184775 - RNA, 12 nt, Human
agacagugaucu

SEQ ID NO: 2184776 - RNA, 17 nt, Human
agacaguccagccugga

SEQ ID NO: 2184777 - RNA, 13 nt, Human
agacagugggaaa

SEQ ID NO: 2184778 - RNA, 14 nt, Human
agacagugggaaau

SEQ ID NO: 2184779 - RNA, 21 nt, Human
agacagugaucuccauauguu

SEQ ID NO: 2184780 - RNA, 20 nt, Human
agacagugaucuccauaugu

SEQ ID NO: 2184781 - RNA, 18 nt, Human
agacagugaucuccauau

SEQ ID NO: 2184782 - RNA, 17 nt, Human
agacagugaucuccaua

SEQ ID NO: 2184783 - RNA, 15 nt, Human
agacagugaucucca

SEQ ID NO: 2184784 - RNA, 13 nt, Human
agacagucccugc

SEQ ID NO: 2184785 - RNA, 14 nt, Human
agacagucccugcc

SEQ ID NO: 2184786 - RNA, 19 nt, Human
agacagucccugccaaugg

SEQ ID NO: 2184787 - RNA, 20 nt, Human
agacagucaaggaguggcuu

SEQ ID NO: 2184788 - RNA, 17 nt, Human
agacagucaaggagugg

SEQ ID NO: 2184789 - RNA, 18 nt, Human
agacagaagcugaagugc

SEQ ID NO: 2184790 - RNA, 22 nt, Human
agacaguaugagucaaugugca

SEQ ID NO: 2184791 - RNA, 12 nt, Human
agacagucccug

SEQ ID NO: 2184792 - RNA, 15 nt, Human
agacagcugccuggg

SEQ ID NO: 2184793 - RNA, 16 nt, Human
agacagcugccuggga

SEQ ID NO: 2184794 - RNA, 12 nt, Human
ucuuagauguau

SEQ ID NO: 2184795 - RNA, 23 nt, Human
ucuuagaugcaguucugaagaag

SEQ ID NO: 2184796 - RNA, 22 nt, Human
ucuuacuuuccuuuccccagcc

SEQ ID NO: 2184797 - RNA, 23 nt, Human
ucuuacuuuccuuuccccagccc

SEQ ID NO: 2184798 - RNA, 18 nt, Human
ucuuauguaugugaaagu

SEQ ID NO: 2184799 - RNA, 18 nt, Human
ucuuagauggauucucca

SEQ ID NO: 2184800 - RNA, 13 nt, Human
ucuuagaaaugaa

SEQ ID NO: 2184801 - RNA, 22 nt, Human
ucuuagauggauucuccacuca

SEQ ID NO: 2184802 - RNA, 17 nt, Human
ucuuauuagggagaaaa

SEQ ID NO: 2184803 - RNA, 22 nt, Human
ucuuauuagaacaggcaaguga

SEQ ID NO: 2184804 - RNA, 23 nt, Human
ucuuacugaagguaaaauugaaa

SEQ ID NO: 2184805 - RNA, 13 nt, Human
ucuuacugcaaau

SEQ ID NO: 2184806 - RNA, 14 nt, Human
ucuuacugcaaaug

SEQ ID NO: 2184807 - RNA, 15 nt, Human
ucuuacugcaaaugu

SEQ ID NO: 2184808 - RNA, 13 nt, Human
ucuuacugaaggu

SEQ ID NO: 2184809 - RNA, 18 nt, Human
ucuuacuguaccuguucc

SEQ ID NO: 2184810 - RNA, 22 nt, Human
ucuuacugcaaaugucaucaga

SEQ ID NO: 2184811 - RNA, 19 nt, Human
ucuuacugucuuuuuucua

SEQ ID NO: 2184812 - RNA, 16 nt, Human
ucuuacuaaacauuuu

SEQ ID NO: 2184813 - RNA, 24 nt, Human
ucuuacuaaacauuuuguuauugg

SEQ ID NO: 2184814 - RNA, 19 nt, Human
ucuuacgcccaacccuucc

SEQ ID NO: 2184815 - RNA, 18 nt, Human
ucuuacgauggcacccag

SEQ ID NO: 2184816 - RNA, 14 nt, Human
ucuuacuaaacauu

SEQ ID NO: 2184817 - RNA, 21 nt, Human
ucuuaccuguaugucuccagu

SEQ ID NO: 2184818 - RNA, 23 nt, Human
ucuuaccuguaugucuccaguau

SEQ ID NO: 2184819 - RNA, 14 nt, Human
ucuuacauguuuuc

SEQ ID NO: 2184820 - RNA, 17 nt, Human
ucuuacaggcacaaaau

SEQ ID NO: 2184821 - RNA, 19 nt, Human
ucuuacaggcacaaaauga

SEQ ID NO: 2184822 - RNA, 15 nt, Human
ucuuacauguuuucu

SEQ ID NO: 2184823 - RNA, 15 nt, Human
agacacuugccuucu

SEQ ID NO: 2184824 - RNA, 12 nt, Human
agacagaaaaaa

SEQ ID NO: 2184825 - RNA, 21 nt, Human
agacacggagcccagcccucc

SEQ ID NO: 2184826 - RNA, 16 nt, Human
agacacgcucuucuau

SEQ ID NO: 2184827 - RNA, 13 nt, Human
agacagcugccug

SEQ ID NO: 2184828 - RNA, 14 nt, Human
agacagcugccugg

SEQ ID NO: 2184829 - RNA, 18 nt, Human
agacagaaccuuguuauu

SEQ ID NO: 2184830 - RNA, 17 nt, Human
agacagaaccccuacau

SEQ ID NO: 2184831 - RNA, 17 nt, Human
agacagaaccuuguuau

SEQ ID NO: 2184832 - RNA, 15 nt, Human
agacagaagcaggcu

SEQ ID NO: 2184833 - RNA, 16 nt, Human
agacagaagcaggcug

SEQ ID NO: 2184834 - RNA, 17 nt, Human
agacagaagcaggcugg

SEQ ID NO: 2184835 - RNA, 19 nt, Human
agacagaagcaggcuggag

SEQ ID NO: 2184836 - RNA, 20 nt, Human
agacagaagcaggcuggagg

SEQ ID NO: 2184837 - RNA, 17 nt, Human
agacacagaagaggcug

SEQ ID NO: 2184838 - RNA, 13 nt, Human
agacacaggcccu

SEQ ID NO: 2184839 - RNA, 18 nt, Human
agacacagaagaggcugg

SEQ ID NO: 2184840 - RNA, 23 nt, Human
agacacaggcccggcuccaggcu

SEQ ID NO: 2184841 - RNA, 21 nt, Human
agacacauguccaagaagccc

SEQ ID NO: 2184842 - RNA, 22 nt, Human
agacacauguccaagaagccca

SEQ ID NO: 2184843 - RNA, 19 nt, Human
agacaccuugacagggcac

SEQ ID NO: 2184844 - RNA, 24 nt, Human
agacacauguccaagaagcccagg

SEQ ID NO: 2184845 - RNA, 22 nt, Human
agacaccuugacagggcacacc

SEQ ID NO: 2184846 - RNA, 22 nt, Human
agacaccuuggacauccuccuc

SEQ ID NO: 2184847 - RNA, 15 nt, Human
agacacagggacuug

SEQ ID NO: 2184848 - RNA, 22 nt, Human
agaauucugcuaccucacuggg

SEQ ID NO: 2184849 - RNA, 20 nt, Human
agaauucugcuaccucacug

SEQ ID NO: 2184850 - RNA, 13 nt, Human
agaauucugcuac

SEQ ID NO: 2184851 - RNA, 17 nt, Human
agaauucucuuauccaa

SEQ ID NO: 2184852 - RNA, 19 nt, Human
agaauucucuaguuugauu

SEQ ID NO: 2184853 - RNA, 18 nt, Human
agaauucucuaguuugau

SEQ ID NO: 2184854 - RNA, 14 nt, Human
agacacaagccuuc

SEQ ID NO: 2184855 - RNA, 13 nt, Human
agacacaagccuu

SEQ ID NO: 2184856 - RNA, 19 nt, Human
agacacaacuauuuuucca

SEQ ID NO: 2184857 - RNA, 20 nt, Human
agacacaacuauuuuuccaa

SEQ ID NO: 2184858 - RNA, 19 nt, Human
agacacaggcccggcucca

SEQ ID NO: 2184859 - RNA, 20 nt, Human
agacacaggcccggcuccag

SEQ ID NO: 2184860 - RNA, 21 nt, Human
agacacaggcccggcuccagg

SEQ ID NO: 2184861 - RNA, 22 nt, Human
agacacaggcccggcuccaggc

SEQ ID NO: 2184862 - RNA, 18 nt, Human
agacacacgcacacacac

SEQ ID NO: 2184863 - RNA, 17 nt, Human
agacacacgcacacaca

SEQ ID NO: 2184864 - RNA, 11 nt, Human
agacacacaca

SEQ ID NO: 2184865 - RNA, 10 nt, Human
agacacacac

SEQ ID NO: 2184866 - RNA, 16 nt, Human
agacacacugaagaag

SEQ ID NO: 2184867 - RNA, 17 nt, Human
agacacaggcccggcuc

SEQ ID NO: 2184868 - RNA, 17 nt, Human
agacacacugaagaagc

SEQ ID NO: 2184869 - RNA, 16 nt, Human
ucuguauauuuuggga

SEQ ID NO: 2184870 - RNA, 15 nt, Human
ucuguauauuuuggg

SEQ ID NO: 2184871 - RNA, 15 nt, Human
ucuguauauacuuuu

SEQ ID NO: 2184872 - RNA, 15 nt, Human
ucuguauauacaaua

SEQ ID NO: 2184873 - RNA, 17 nt, Human
ucuguagaaaugguugu

SEQ ID NO: 2184874 - RNA, 21 nt, Human
ucuguagaaaugguuguauua

SEQ ID NO: 2184875 - RNA, 12 nt, Human
ucuguagaaaug

SEQ ID NO: 2184876 - RNA, 13 nt, Human
ucuguaucucucu

SEQ ID NO: 2184877 - RNA, 21 nt, Human
ucuguaucggagacagugauc

SEQ ID NO: 2184878 - RNA, 12 nt, Human
ucuguaucucuc

SEQ ID NO: 2184879 - RNA, 19 nt, Human
ucuguaucggagacaguga

SEQ ID NO: 2184880 - RNA, 18 nt, Human
ucuguaucggagacagug

SEQ ID NO: 2184881 - RNA, 20 nt, Human
ucuguaucaggacccagagg

SEQ ID NO: 2184882 - RNA, 15 nt, Human
ucuguauuuaauuuu

SEQ ID NO: 2184883 - RNA, 20 nt, Human
ucugguagauuuuuaacgaa

SEQ ID NO: 2184884 - RNA, 18 nt, Human
ucugguagauagaaauaa

SEQ ID NO: 2184885 - RNA, 16 nt, Human
ucugguagauagaaau

SEQ ID NO: 2184886 - RNA, 18 nt, Human
ucuguacgucugacaggc

SEQ ID NO: 2184887 - RNA, 15 nt, Human
ucugugaauucagau

SEQ ID NO: 2184888 - RNA, 16 nt, Human
ucugugaauaagccau

SEQ ID NO: 2184889 - RNA, 18 nt, Human
ucugugaccaaugucuug

SEQ ID NO: 2184890 - RNA, 16 nt, Human
ucugugaccaaugucu

SEQ ID NO: 2184891 - RNA, 13 nt, Human
ucugugaauaagc

SEQ ID NO: 2184892 - RNA, 12 nt, Human
ucugugaauaag

SEQ ID NO: 2184893 - RNA, 11 nt, Human
ucugugaauaa

SEQ ID NO: 2184894 - RNA, 20 nt, Human
ucugucccgggguccugugg

SEQ ID NO: 2184895 - RNA, 19 nt, Human
ucugucccgggguccugug

SEQ ID NO: 2184896 - RNA, 21 nt, Human
ucuguccccuucucucaucuc

SEQ ID NO: 2184897 - RNA, 22 nt, Human
ucuguccccuucucucaucucu

SEQ ID NO: 2184898 - RNA, 20 nt, Human
ucuguccagggcccugagcu

SEQ ID NO: 2184899 - RNA, 19 nt, Human
ucuguccagggcccugagc

SEQ ID NO: 2184900 - RNA, 17 nt, Human
ucuguccagggcccuga

SEQ ID NO: 2184901 - RNA, 13 nt, Human
ucuguccagggcc

SEQ ID NO: 2184902 - RNA, 23 nt, Human
ucuguauuuaugugugaggagcu

SEQ ID NO: 2184903 - RNA, 20 nt, Human
ucuguauuuccccaacaugu

SEQ ID NO: 2184904 - RNA, 23 nt, Human
ucuguauuuccccaacauguaau

SEQ ID NO: 2184905 - RNA, 13 nt, Human
ucugucccagguu

SEQ ID NO: 2184906 - RNA, 17 nt, Human
ucugucccacuuggcau

SEQ ID NO: 2184907 - RNA, 21 nt, Human
ucugucccacuuggcaucagc

SEQ ID NO: 2184908 - RNA, 15 nt, Human
ucuguccccuucucu

SEQ ID NO: 2184909 - RNA, 19 nt, Human
ucuguccccuucucucauc

SEQ ID NO: 2184910 - RNA, 20 nt, Human
ucuguccccuucucucaucu

SEQ ID NO: 2184911 - RNA, 18 nt, Human
ucuguucuuuaauuuauu

SEQ ID NO: 2184912 - RNA, 13 nt, Human
ucuguucuugaag

SEQ ID NO: 2184913 - RNA, 14 nt, Human
ucuguucuugcuac

SEQ ID NO: 2184914 - RNA, 23 nt, Human
ucuguuuagauaauacaccacua

SEQ ID NO: 2184915 - RNA, 19 nt, Human
ucuguuuagauaauacacc

SEQ ID NO: 2184916 - RNA, 16 nt, Human
ucuguuuagauaauac

SEQ ID NO: 2184917 - RNA, 19 nt, Human
ucuguucugcacacagcac

SEQ ID NO: 2184918 - RNA, 21 nt, Human
ucugugggugacccagguccu

SEQ ID NO: 2184919 - RNA, 12 nt, Human
ucuguucugugg

SEQ ID NO: 2184920 - RNA, 14 nt, Human
ucuguucuguggaa

SEQ ID NO: 2184921 - RNA, 23 nt, Human
ucuguucuguggaaaguguaaag

SEQ ID NO: 2184922 - RNA, 15 nt, Human
ucuguucuguggaaa

SEQ ID NO: 2184923 - RNA, 16 nt, Human
ucuguucuguggaaag

SEQ ID NO: 2184924 - RNA, 19 nt, Human
ucuguucuguggaaagugu

SEQ ID NO: 2184925 - RNA, 22 nt, Human
ucuguucuguggaaaguguaaa

SEQ ID NO: 2184926 - RNA, 18 nt, Human
ucuguucugcacacagca

SEQ ID NO: 2184927 - RNA, 17 nt, Human
ucuguucugcacacagc

SEQ ID NO: 2184928 - RNA, 19 nt, Human
ucugugggugacccagguc

SEQ ID NO: 2184929 - RNA, 21 nt, Human
ucugugggcugcacucugugc

SEQ ID NO: 2184930 - RNA, 23 nt, Human
ucugugggcugcacucugugccc

SEQ ID NO: 2184931 - RNA, 15 nt, Human
ucugugggcugcacu

SEQ ID NO: 2184932 - RNA, 16 nt, Human
ucugugggcugcacuc

SEQ ID NO: 2184933 - RNA, 19 nt, Human
ucugugggcugcacucugu

SEQ ID NO: 2184934 - RNA, 20 nt, Human
ucugugggcugcacucugug

SEQ ID NO: 2184935 - RNA, 15 nt, Human
ucugugcccaugggc

SEQ ID NO: 2184936 - RNA, 22 nt, Human
ucugugcaugguggcaccagcg

SEQ ID NO: 2184937 - RNA, 19 nt, Human
ucugugcacgcaguggccu

SEQ ID NO: 2184938 - RNA, 21 nt, Human
ucugugcacgcaguggccuuc

SEQ ID NO: 2184939 - RNA, 17 nt, Human
ucugugcaugguggcac

SEQ ID NO: 2184940 - RNA, 19 nt, Human
ucugugcaugguggcacca

SEQ ID NO: 2184941 - RNA, 19 nt, Human
ucugugaccaaugucuuga

SEQ ID NO: 2184942 - RNA, 13 nt, Human
ucugugaccucag

SEQ ID NO: 2184943 - RNA, 14 nt, Human
ucugugaccucagg

SEQ ID NO: 2184944 - RNA, 15 nt, Human
ucugugaccucaggc

SEQ ID NO: 2184945 - RNA, 16 nt, Human
ucugugaccucaggca

SEQ ID NO: 2184946 - RNA, 23 nt, Human
ucugugaccucaggcacuagccu

SEQ ID NO: 2184947 - RNA, 16 nt, Human
ucugugaugauccuca

SEQ ID NO: 2184948 - RNA, 17 nt, Human
ucugugccccaugccug

SEQ ID NO: 2184949 - RNA, 12 nt, Human
ucugugcugugu

SEQ ID NO: 2184950 - RNA, 15 nt, Human
ucugugccccaugcc

SEQ ID NO: 2184951 - RNA, 14 nt, Human
ucugugcuuuccag

SEQ ID NO: 2184952 - RNA, 16 nt, Human
ucugugcuuuccagcu

SEQ ID NO: 2184953 - RNA, 17 nt, Human
ucugugcuuuccagcuc

SEQ ID NO: 2184954 - RNA, 14 nt, Human
ucugugccccaugc

SEQ ID NO: 2184955 - RNA, 21 nt, Human
ucugugcccaugggcacugcu

SEQ ID NO: 2184956 - RNA, 22 nt, Human
ucugugcccaugggcacugcug

SEQ ID NO: 2184957 - RNA, 16 nt, Human
ucugugcccaugggca

SEQ ID NO: 2184958 - RNA, 19 nt, Human
ucugugcccaugggcacug

SEQ ID NO: 2184959 - RNA, 20 nt, Human
ucugugcccaugggcacugc

SEQ ID NO: 2184960 - RNA, 22 nt, Human
ucuguggaccacugcaugagcu

SEQ ID NO: 2184961 - RNA, 23 nt, Human
ucugugggaugggaugguggagg

SEQ ID NO: 2184962 - RNA, 12 nt, Human
ucugugggcugc

SEQ ID NO: 2184963 - RNA, 21 nt, Human
ucugugcuuuccagcucaccc

SEQ ID NO: 2184964 - RNA, 20 nt, Human
ucugugcuuugacucaccug

SEQ ID NO: 2184965 - RNA, 22 nt, Human
ucugugcuuugacucaccuguu

SEQ ID NO: 2184966 - RNA, 14 nt, Human
ucuguggaaagugu

SEQ ID NO: 2184967 - RNA, 15 nt, Human
ucuguggaaagugua

SEQ ID NO: 2184968 - RNA, 16 nt, Human
ucuguggaaaguguaa

SEQ ID NO: 2184969 - RNA, 20 nt, Human
ucuguggaaaguguaaagca

SEQ ID NO: 2184970 - RNA, 22 nt, Human
ucuguggaaaguguaaagcauu

SEQ ID NO: 2184971 - RNA, 19 nt, Human
agaauucccucucucugac

SEQ ID NO: 2184972 - RNA, 20 nt, Human
agaauucccucucucugacu

SEQ ID NO: 2184973 - RNA, 22 nt, Human
agaauucccucucucugacucu

SEQ ID NO: 2184974 - RNA, 20 nt, Human
agaauuccaggguauggcca

SEQ ID NO: 2184975 - RNA, 20 nt, Human
agaauuauaauuaguuccuc

SEQ ID NO: 2184976 - RNA, 23 nt, Human
agaauucuagugcugcugaagau

SEQ ID NO: 2184977 - RNA, 14 nt, Human
agaauucuagugcu

SEQ ID NO: 2184978 - RNA, 18 nt, Human
agaauucuagugcugcug

SEQ ID NO: 2184979 - RNA, 12 nt, Human
agaauuccuuca

SEQ ID NO: 2184980 - RNA, 18 nt, Human
agaauuccuucaggguga

SEQ ID NO: 2184981 - RNA, 20 nt, Human
agaauuccuucagggugaug

SEQ ID NO: 2184982 - RNA, 20 nt, Human
agaauucucagaaucucaaa

SEQ ID NO: 2184983 - RNA, 13 nt, Human
ucugggcuccaga

SEQ ID NO: 2184984 - RNA, 14 nt, Human
agaauucucuaguu

SEQ ID NO: 2184985 - RNA, 22 nt, Human
ucugggcugcuacccagaaauc

SEQ ID NO: 2184986 - RNA, 17 nt, Human
ucugggcugcuacccag

SEQ ID NO: 2184987 - RNA, 19 nt, Human
ucugggcugucuauucuag

SEQ ID NO: 2184988 - RNA, 17 nt, Human
ucugggguuaugauggc

SEQ ID NO: 2184989 - RNA, 22 nt, Human
ucuggggucuuuuuaugcauuu

SEQ ID NO: 2184990 - RNA, 19 nt, Human
ucugggcuuggggcuuccu

SEQ ID NO: 2184991 - RNA, 21 nt, Human
ucugggcuuggggcuuccuaa

SEQ ID NO: 2184992 - RNA, 23 nt, Human
ucuggguuccuuccucugagccu

SEQ ID NO: 2184993 - RNA, 15 nt, Human
ucugguacucuccua

SEQ ID NO: 2184994 - RNA, 21 nt, Human
ucugguaauauugacuuguau

SEQ ID NO: 2184995 - RNA, 22 nt, Human
ucugguaauauugacuuguaua

SEQ ID NO: 2184996 - RNA, 23 nt, Human
ucugggguucagccccuccucug

SEQ ID NO: 2184997 - RNA, 15 nt, Human
ucugggucagugguc

SEQ ID NO: 2184998 - RNA, 22 nt, Human
ucuggguuccuuccucugagcc

SEQ ID NO: 2184999 - RNA, 19 nt, Human
ucugggguucagccccucc

SEQ ID NO: 2185000 - RNA, 18 nt, Human
ucugggguucagccccuc

SEQ ID NO: 2185001 - RNA, 17 nt, Human
ucugggguucagccccu

SEQ ID NO: 2185002 - RNA, 16 nt, Human
ucugggguucagcccc

SEQ ID NO: 2185003 - RNA, 22 nt, Human
ucugggguucagccccuccucu

SEQ ID NO: 2185004 - RNA, 21 nt, Human
ucugggguucagccccuccuc

SEQ ID NO: 2185005 - RNA, 18 nt, Human
ucuggguagcuguaaggc

SEQ ID NO: 2185006 - RNA, 19 nt, Human
agaauguuuuacugugaaa

SEQ ID NO: 2185007 - RNA, 19 nt, Human
agaauuaguggcacuugcu

SEQ ID NO: 2185008 - RNA, 18 nt, Human
agaauguuguauucagug

SEQ ID NO: 2185009 - RNA, 18 nt, Human
agaauguuuuacugugaa

SEQ ID NO: 2185010 - RNA, 19 nt, Human
agaauguuguauucaguga

SEQ ID NO: 2185011 - RNA, 15 nt, Human
agaauguuguauuca

SEQ ID NO: 2185012 - RNA, 15 nt, Human
ucugcaggcagacac

SEQ ID NO: 2185013 - RNA, 17 nt, Human
agaauguguuuucugaa

SEQ ID NO: 2185014 - RNA, 18 nt, Human
agaauguguuuucugaau

SEQ ID NO: 2185015 - RNA, 21 nt, Human
agaauguguuuaaacuugguu

SEQ ID NO: 2185016 - RNA, 19 nt, Human
agaaugucaguauguggaa

SEQ ID NO: 2185017 - RNA, 17 nt, Human
agaaugucaguaugugg

SEQ ID NO: 2185018 - RNA, 14 nt, Human
agaaauuuccagag

SEQ ID NO: 2185019 - RNA, 13 nt, Human
agaaauuuauuuc

SEQ ID NO: 2185020 - RNA, 15 nt, Human
agaaauuuauuuccu

SEQ ID NO: 2185021 - RNA, 23 nt, Human
agaaauuuauuuccuaguucugu

SEQ ID NO: 2185022 - RNA, 23 nt, Human
agaaccccaggguccuguagccc

SEQ ID NO: 2185023 - RNA, 15 nt, Human
agaaauuugauuucu

SEQ ID NO: 2185024 - RNA, 16 nt, Human
agaaauuuccagagaa

SEQ ID NO: 2185025 - RNA, 14 nt, Human
agaaccgagcaaag

SEQ ID NO: 2185026 - RNA, 15 nt, Human
agaaccgagcaaaga

SEQ ID NO: 2185027 - RNA, 16 nt, Human
agaaccgagcaaagau

SEQ ID NO: 2185028 - RNA, 16 nt, Human
agaaugucaguaugug

SEQ ID NO: 2185029 - RNA, 15 nt, Human
agaaugucaguaugu

SEQ ID NO: 2185030 - RNA, 22 nt, Human
agaaccccuggcuccaggccag

SEQ ID NO: 2185031 - RNA, 20 nt, Human
agaacccuuggcuugcccac

SEQ ID NO: 2185032 - RNA, 20 nt, Human
agaacccugcguggggacag

SEQ ID NO: 2185033 - RNA, 19 nt, Human
agaaccccuacaugaaaca

SEQ ID NO: 2185034 - RNA, 17 nt, Human
agaaccccuacaugaaa

SEQ ID NO: 2185035 - RNA, 16 nt, Human
agaaauuugauuucua

SEQ ID NO: 2185036 - RNA, 15 nt, Human
agaaacagagacagg

SEQ ID NO: 2185037 - RNA, 19 nt, Human
agaaacagagacaggccca

SEQ ID NO: 2185038 - RNA, 14 nt, Human
agaaacagagacag

SEQ ID NO: 2185039 - RNA, 20 nt, Human
agaaacaguuaacuuucaga

SEQ ID NO: 2185040 - RNA, 17 nt, Human
agaaaccuuaauaugug

SEQ ID NO: 2185041 - RNA, 16 nt, Human
agaaaccuuauuguac

SEQ ID NO: 2185042 - RNA, 18 nt, Human
agaaaccuuauuguaccu

SEQ ID NO: 2185043 - RNA, 13 nt, Human
agaaacaguuaac

SEQ ID NO: 2185044 - RNA, 13 nt, Human
agaaacagugagu

SEQ ID NO: 2185045 - RNA, 12 nt, Human
agaaacagugag

SEQ ID NO: 2185046 - RNA, 15 nt, Human
agaaacgucuucuaa

SEQ ID NO: 2185047 - RNA, 20 nt, Human
agaaaccuuauuguaccucu

SEQ ID NO: 2185048 - RNA, 18 nt, Human
agaaaccuuuuuaaaaau

SEQ ID NO: 2185049 - RNA, 21 nt, Human
agaaacgucuucuaaacuucc

SEQ ID NO: 2185050 - RNA, 19 nt, Human
agaaacguuuggaacaauc

SEQ ID NO: 2185051 - RNA, 18 nt, Human
agaaacgucuucuaaacu

SEQ ID NO: 2185052 - RNA, 16 nt, Human
agaaacgucuucuaaa

SEQ ID NO: 2185053 - RNA, 14 nt, Human
agaaacuuccaaau

SEQ ID NO: 2185054 - RNA, 16 nt, Human
agaaacucuacauaau

SEQ ID NO: 2185055 - RNA, 22 nt, Human
agaaacucacccccaaggggca

SEQ ID NO: 2185056 - RNA, 15 nt, Human
agaaacucaccccca

SEQ ID NO: 2185057 - RNA, 23 nt, Human
agaaacucacccccaaggggcag

SEQ ID NO: 2185058 - RNA, 20 nt, Human
agaaacguuuggaacaaucu

SEQ ID NO: 2185059 - RNA, 21 nt, Human
agaaacguuuggaacaaucua

SEQ ID NO: 2185060 - RNA, 20 nt, Human
agaaaaagcaauaaccucaa

SEQ ID NO: 2185061 - RNA, 17 nt, Human
agaaaaaggaugcacag

SEQ ID NO: 2185062 - RNA, 21 nt, Human
agaaaacuuguauuaugugug

SEQ ID NO: 2185063 - RNA, 19 nt, Human
agaaaacuuguauuaugug

SEQ ID NO: 2185064 - RNA, 23 nt, Human
agaaacacgaacuuuagcugcau

SEQ ID NO: 2185065 - RNA, 17 nt, Human
agaaacacccucacacu

SEQ ID NO: 2185066 - RNA, 17 nt, Human
agaaaagacaugaauau

SEQ ID NO: 2185067 - RNA, 18 nt, Human
agaaaagaaaaaaaaaga

SEQ ID NO: 2185068 - RNA, 17 nt, Human
agaaaagaaaaaaaaag

SEQ ID NO: 2185069 - RNA, 20 nt, Human
agaaaaagcuccuguccucc

SEQ ID NO: 2185070 - RNA, 9 nt, Human
agaaaagaa

SEQ ID NO: 2185071 - RNA, 13 nt, Human
agaaaagaaaaaa

SEQ ID NO: 2185072 - RNA, 12 nt, Human
agaaaagaaaaa

SEQ ID NO: 2185073 - RNA, 11 nt, Human
agaaaagaaaa

SEQ ID NO: 2185074 - RNA, 10 nt, Human
agaaaagaaa

SEQ ID NO: 2185075 - RNA, 20 nt, Human
ucucuuuaaucuucaguuuu

SEQ ID NO: 2185076 - RNA, 17 nt, Human
ucucuuuaaucuucagu

SEQ ID NO: 2185077 - RNA, 16 nt, Human
ucucuuuaaucuucag

SEQ ID NO: 2185078 - RNA, 13 nt, Human
agaaaaagaaaaa

SEQ ID NO: 2185079 - RNA, 20 nt, Human
ucucuuuaaugucacaggca

SEQ ID NO: 2185080 - RNA, 21 nt, Human
ucucuuuaaugucacaggcag

SEQ ID NO: 2185081 - RNA, 22 nt, Human
ucucuugagggagcuuagccaa

SEQ ID NO: 2185082 - RNA, 13 nt, Human
ucucuugagggag

SEQ ID NO: 2185083 - RNA, 14 nt, Human
ucucuugaguuugu

SEQ ID NO: 2185084 - RNA, 12 nt, Human
ucucuugauuuu

SEQ ID NO: 2185085 - RNA, 15 nt, Human
ucucuugaguuuguc

SEQ ID NO: 2185086 - RNA, 17 nt, Human
ucucuugcacccgccuc

SEQ ID NO: 2185087 - RNA, 22 nt, Human
ucucuugcacccgccucucccg

SEQ ID NO: 2185088 - RNA, 12 nt, Human
ucucuugcaccc

SEQ ID NO: 2185089 - RNA, 13 nt, Human
ucucuugcacccg

SEQ ID NO: 2185090 - RNA, 14 nt, Human
ucucuugcacccgc

SEQ ID NO: 2185091 - RNA, 15 nt, Human
ucucuugcacccgcc

SEQ ID NO: 2185092 - RNA, 23 nt, Human
ucucuugggaacugaacucacuu

SEQ ID NO: 2185093 - RNA, 16 nt, Human
ucucuugggaacugaa

SEQ ID NO: 2185094 - RNA, 17 nt, Human
ucucuugagccugggag

SEQ ID NO: 2185095 - RNA, 23 nt, Human
ucucuggccuucggccuccaucc

SEQ ID NO: 2185096 - RNA, 22 nt, Human
ucucuggccuucggccuccauc

SEQ ID NO: 2185097 - RNA, 21 nt, Human
ucucuggccuucggccuccau

SEQ ID NO: 2185098 - RNA, 18 nt, Human
ucucuugaggccaggagu

SEQ ID NO: 2185099 - RNA, 18 nt, Human
ucucuugagccugggagg

SEQ ID NO: 2185100 - RNA, 14 nt, Human
ucucuugauucaua

SEQ ID NO: 2185101 - RNA, 16 nt, Human
ucucuugauucauaau

SEQ ID NO: 2185102 - RNA, 22 nt, Human
ucucuggaaaggggggagcugg

SEQ ID NO: 2185103 - RNA, 19 nt, Human
ucucugcuugagucagguu

SEQ ID NO: 2185104 - RNA, 18 nt, Human
ucucugcuugagucaggu

SEQ ID NO: 2185105 - RNA, 11 nt, Human
ucucugcugua

SEQ ID NO: 2185106 - RNA, 15 nt, Human
ucucuggaauuugaa

SEQ ID NO: 2185107 - RNA, 19 nt, Human
ucucugcuggcccagccaa

SEQ ID NO: 2185108 - RNA, 16 nt, Human
ucucugcuggcccagc

SEQ ID NO: 2185109 - RNA, 15 nt, Human
ucucugcuggcccag

SEQ ID NO: 2185110 - RNA, 14 nt, Human
ucucugcuggccca

SEQ ID NO: 2185111 - RNA, 12 nt, Human
ucucugcuggcc

SEQ ID NO: 2185112 - RNA, 12 nt, Human
ucucugcugccg

SEQ ID NO: 2185113 - RNA, 13 nt, Human
ucucugcugccgc

SEQ ID NO: 2185114 - RNA, 13 nt, Human
ucucugcugaagg

SEQ ID NO: 2185115 - RNA, 11 nt, Human
ucucugcugcc

SEQ ID NO: 2185116 - RNA, 23 nt, Human
ucucugcucugcgugucaccugu

SEQ ID NO: 2185117 - RNA, 19 nt, Human
ucucuggcccuucuugccu

SEQ ID NO: 2185118 - RNA, 11 nt, Human
ucucuggccuc

SEQ ID NO: 2185119 - RNA, 14 nt, Human
ucucuggaugccug

SEQ ID NO: 2185120 - RNA, 15 nt, Human
ucucuggccccaagg

SEQ ID NO: 2185121 - RNA, 15 nt, Human
ucucuggccucccac

SEQ ID NO: 2185122 - RNA, 17 nt, Human
ucucuggccucccaccc

SEQ ID NO: 2185123 - RNA, 18 nt, Human
ucucuggccucccacccg

SEQ ID NO: 2185124 - RNA, 19 nt, Human
ucucuggccucccacccga

SEQ ID NO: 2185125 - RNA, 12 nt, Human
ucucuggccuuc

SEQ ID NO: 2185126 - RNA, 19 nt, Human
ucucuggaauuugaaacac

SEQ ID NO: 2185127 - RNA, 18 nt, Human
ucucuggagccaagucca

SEQ ID NO: 2185128 - RNA, 20 nt, Human
ucucuggagccaaguccaga

SEQ ID NO: 2185129 - RNA, 22 nt, Human
ucucuggagccaaguccagauu

SEQ ID NO: 2185130 - RNA, 22 nt, Human
ucucuggagugagcucuguuuc

SEQ ID NO: 2185131 - RNA, 15 nt, Human
ucucuggaugccuga

SEQ ID NO: 2185132 - RNA, 13 nt, Human
ucucuccucccca

SEQ ID NO: 2185133 - RNA, 20 nt, Human
ucucucccucccuuugaaau

SEQ ID NO: 2185134 - RNA, 21 nt, Human
ucucucccuccccugccauuu

SEQ ID NO: 2185135 - RNA, 14 nt, Human
ucucuccuguaccu

SEQ ID NO: 2185136 - RNA, 11 nt, Human
ucucuccuccu

SEQ ID NO: 2185137 - RNA, 17 nt, Human
ucucuccuguaccucuu

SEQ ID NO: 2185138 - RNA, 16 nt, Human
ucucuccuguaccucu

SEQ ID NO: 2185139 - RNA, 11 nt, Human
ucucugcccuc

SEQ ID NO: 2185140 - RNA, 15 nt, Human
ucucugcccuccaag

SEQ ID NO: 2185141 - RNA, 16 nt, Human
ucucugcccuccaaga

SEQ ID NO: 2185142 - RNA, 17 nt, Human
ucucugcccuccaagac

SEQ ID NO: 2185143 - RNA, 20 nt, Human
ucucucaauaugcuuacaaa

SEQ ID NO: 2185144 - RNA, 13 nt, Human
ucucucacuccuu

SEQ ID NO: 2185145 - RNA, 15 nt, Human
ucucucacuccuuga

SEQ ID NO: 2185146 - RNA, 18 nt, Human
acuuugaccucugcagca

SEQ ID NO: 2185147 - RNA, 16 nt, Human
ucucucaauaugcuua

SEQ ID NO: 2185148 - RNA, 18 nt, Human
acuuucucaguuuucaua

SEQ ID NO: 2185149 - RNA, 22 nt, Human
acuuucuauagcagauugugua

SEQ ID NO: 2185150 - RNA, 19 nt, Human
acuuucucuucauacuuuu

SEQ ID NO: 2185151 - RNA, 16 nt, Human
acuuugaccucugcag

SEQ ID NO: 2185152 - RNA, 15 nt, Human
acuuugaccucugca

SEQ ID NO: 2185153 - RNA, 17 nt, Human
ucucuccagccccugga

SEQ ID NO: 2185154 - RNA, 16 nt, Human
ucucuccagccccugg

SEQ ID NO: 2185155 - RNA, 18 nt, Human
ucucuccagccccuggau

SEQ ID NO: 2185156 - RNA, 19 nt, Human
ucucuccagccccuggaug

SEQ ID NO: 2185157 - RNA, 22 nt, Human
ucucucaugaaccucaagcugc

SEQ ID NO: 2185158 - RNA, 16 nt, Human
ucucucauugucugug

SEQ ID NO: 2185159 - RNA, 22 nt, Human
ucucucaucucuuagcuccccu

SEQ ID NO: 2185160 - RNA, 12 nt, Human
ucucucaugaac

SEQ ID NO: 2185161 - RNA, 17 nt, Human
ucucucaugaaccucaa

SEQ ID NO: 2185162 - RNA, 15 nt, Human
ucucucaugaaccuc

SEQ ID NO: 2185163 - RNA, 14 nt, Human
ucucucaucucuua

SEQ ID NO: 2185164 - RNA, 19 nt, Human
ucucucaucucuuagcucc

SEQ ID NO: 2185165 - RNA, 23 nt, Human
ucucucaucucuuagcuccccuc

SEQ ID NO: 2185166 - RNA, 19 nt, Human
ucugcagccagcccagccc

SEQ ID NO: 2185167 - RNA, 18 nt, Human
ucugcagccagcccagcc

SEQ ID NO: 2185168 - RNA, 13 nt, Human
ucugcagcccagg

SEQ ID NO: 2185169 - RNA, 15 nt, Human
ucugcagcccaggga

SEQ ID NO: 2185170 - RNA, 23 nt, Human
ucugcagcccggcgccaccaucc

SEQ ID NO: 2185171 - RNA, 16 nt, Human
ucugcagccagcccag

SEQ ID NO: 2185172 - RNA, 15 nt, Human
ucugcagccagccca

SEQ ID NO: 2185173 - RNA, 14 nt, Human
ucugcagccagccc

SEQ ID NO: 2185174 - RNA, 20 nt, Human
ucugcagcaugaccugugac

SEQ ID NO: 2185175 - RNA, 16 nt, Human
ucugcagcaugaccug

SEQ ID NO: 2185176 - RNA, 11 nt, Human
ucugauuccac

SEQ ID NO: 2185177 - RNA, 13 nt, Human
ucugauuccacuu

SEQ ID NO: 2185178 - RNA, 20 nt, Human
ucugcacuccccugcugggu

SEQ ID NO: 2185179 - RNA, 18 nt, Human
ucugcagcaauaaagcag

SEQ ID NO: 2185180 - RNA, 22 nt, Human
ucugcaggauugauuaugcaga

SEQ ID NO: 2185181 - RNA, 15 nt, Human
ucugcagcuguuuua

SEQ ID NO: 2185182 - RNA, 14 nt, Human
ucugcaggcaccuu

SEQ ID NO: 2185183 - RNA, 17 nt, Human
ucugcaggcaccuuagu

SEQ ID NO: 2185184 - RNA, 13 nt, Human
ucugcagcugacc

SEQ ID NO: 2185185 - RNA, 14 nt, Human
ucugcagcugaccu

SEQ ID NO: 2185186 - RNA, 20 nt, Human
ucugcagcugaccucuguug

SEQ ID NO: 2185187 - RNA, 15 nt, Human
ucugcaggucccuaa

SEQ ID NO: 2185188 - RNA, 16 nt, Human
ucugcaggucccuaau

SEQ ID NO: 2185189 - RNA, 17 nt, Human
ucugcaggucccuaaua

SEQ ID NO: 2185190 - RNA, 13 nt, Human
agaaauuccugua

SEQ ID NO: 2185191 - RNA, 14 nt, Human
ucugcaggcagaca

SEQ ID NO: 2185192 - RNA, 14 nt, Human
agaaauuauuuaau

SEQ ID NO: 2185193 - RNA, 16 nt, Human
agaaauuauuuaauaa

SEQ ID NO: 2185194 - RNA, 17 nt, Human
agaaauuauuuaauaaa

SEQ ID NO: 2185195 - RNA, 22 nt, Human
agaaauuaugugccagauuuau

SEQ ID NO: 2185196 - RNA, 16 nt, Human
agaaauuuauaaacuu

SEQ ID NO: 2185197 - RNA, 17 nt, Human
agaaauuuauaaacuuu

SEQ ID NO: 2185198 - RNA, 14 nt, Human
ucugcaggucccua

SEQ ID NO: 2185199 - RNA, 22 nt, Human
ucugcaggcaccuuaguggcuu

SEQ ID NO: 2185200 - RNA, 13 nt, Human
ucugcaggcagac

SEQ ID NO: 2185201 - RNA, 18 nt, Human
ucugcaggucccuaauaa

SEQ ID NO: 2185202 - RNA, 13 nt, Human
agaaauuaugugc

SEQ ID NO: 2185203 - RNA, 21 nt, Human
agaaauuaugugccagauuua

SEQ ID NO: 2185204 - RNA, 24 nt, Human
ucugaguguuuuuacuacaguugu

SEQ ID NO: 2185205 - RNA, 14 nt, Human
ucugacucacaaga

SEQ ID NO: 2185206 - RNA, 17 nt, Human
ucugaguuccugcaugc

SEQ ID NO: 2185207 - RNA, 15 nt, Human
ucugaguuucauucu

SEQ ID NO: 2185208 - RNA, 20 nt, Human
ucugaguuucauucuccugc

SEQ ID NO: 2185209 - RNA, 22 nt, Human
ucugaguuucauucuccugccu

SEQ ID NO: 2185210 - RNA, 22 nt, Human
ucugagacucucuuaggagcag

SEQ ID NO: 2185211 - RNA, 20 nt, Human
ucugacgugccuuuugcacc

SEQ ID NO: 2185212 - RNA, 23 nt, Human
ucugacgugccuuuugcaccccu

SEQ ID NO: 2185213 - RNA, 22 nt, Human
ucugacuacugggcaaagagug

SEQ ID NO: 2185214 - RNA, 23 nt, Human
ucugacuacugggcaaagagugu

SEQ ID NO: 2185215 - RNA, 22 nt, Human
ucugagacucgcgacaaugcaa

SEQ ID NO: 2185216 - RNA, 23 nt, Human
ucugagacucgcgacaaugcaaa

SEQ ID NO: 2185217 - RNA, 15 nt, Human
ucugauggcuucucc

SEQ ID NO: 2185218 - RNA, 18 nt, Human
ucugauggcuucuccagg

SEQ ID NO: 2185219 - RNA, 13 nt, Human
ucugauggcuucu

SEQ ID NO: 2185220 - RNA, 23 nt, Human
ucugaugcaagcaagaaacacug

SEQ ID NO: 2185221 - RNA, 22 nt, Human
ucugauaacuagauggugcuga

SEQ ID NO: 2185222 - RNA, 15 nt, Human
ucugauaaugaaaau

SEQ ID NO: 2185223 - RNA, 19 nt, Human
ucugauaagagaaucaaca

SEQ ID NO: 2185224 - RNA, 21 nt, Human
ucugauaacuagauggugcug

SEQ ID NO: 2185225 - RNA, 20 nt, Human
ucugauaacuagauggugcu

SEQ ID NO: 2185226 - RNA, 14 nt, Human
ucugauaacuagau

SEQ ID NO: 2185227 - RNA, 24 nt, Human
ucugaguuucauucuccugccugu

SEQ ID NO: 2185228 - RNA, 18 nt, Human
ucugauucccaagcucug

SEQ ID NO: 2185229 - RNA, 18 nt, Human
ucugauuacacaaaacaa

SEQ ID NO: 2185230 - RNA, 18 nt, Human
ucugcacuccccugcugg

SEQ ID NO: 2185231 - RNA, 19 nt, Human
ucugcacuccccugcuggg

SEQ ID NO: 2185232 - RNA, 20 nt, Human
agaaauaucugaaaauguau

SEQ ID NO: 2185233 - RNA, 17 nt, Human
agaaaucaaagagagaa

SEQ ID NO: 2185234 - RNA, 19 nt, Human
agaaauaucugaaaaugua

SEQ ID NO: 2185235 - RNA, 14 nt, Human
agaaauauaauuga

SEQ ID NO: 2185236 - RNA, 19 nt, Human
agaaaucccuguuuaauau

SEQ ID NO: 2185237 - RNA, 15 nt, Human
agaaaucuaaaaaac

SEQ ID NO: 2185238 - RNA, 17 nt, Human
agaaaugaaaaaauaua

SEQ ID NO: 2185239 - RNA, 21 nt, Human
agaaaucauuuggguuaauau

SEQ ID NO: 2185240 - RNA, 17 nt, Human
agaaaucacagaaucau

SEQ ID NO: 2185241 - RNA, 18 nt, Human
agaaaucaguaauauuua

SEQ ID NO: 2185242 - RNA, 12 nt, Human
agaaaucuaaaa

SEQ ID NO: 2185243 - RNA, 13 nt, Human
agaaacuugugaa

SEQ ID NO: 2185244 - RNA, 19 nt, Human
agaaacuuccaaauccccu

SEQ ID NO: 2185245 - RNA, 23 nt, Human
agaaacuugugaaguggaaaugu

SEQ ID NO: 2185246 - RNA, 13 nt, Human
agaaacuucgccu

SEQ ID NO: 2185247 - RNA, 12 nt, Human
agaaacuuuauu

SEQ ID NO: 2185248 - RNA, 14 nt, Human
agaaagaaaaucag

SEQ ID NO: 2185249 - RNA, 22 nt, Human
agaaacuuuauucaaguaaaaa

SEQ ID NO: 2185250 - RNA, 18 nt, Human
agaaagccugggugacau

SEQ ID NO: 2185251 - RNA, 19 nt, Human
agaaagccugggugacauu

SEQ ID NO: 2185252 - RNA, 20 nt, Human
agaaagccugggugacauuu

SEQ ID NO: 2185253 - RNA, 21 nt, Human
agaaagccugggugacauuug

SEQ ID NO: 2185254 - RNA, 22 nt, Human
agaaagccuguuccccucacug

SEQ ID NO: 2185255 - RNA, 19 nt, Human
agaaagccuguuccccuca

SEQ ID NO: 2185256 - RNA, 20 nt, Human
agaaagccuguuccccucac

SEQ ID NO: 2185257 - RNA, 13 nt, Human
agaaagcugccug

SEQ ID NO: 2185258 - RNA, 16 nt, Human
agaaagcugguaaacu

SEQ ID NO: 2185259 - RNA, 19 nt, Human
agaaagcugguaaacuauu

SEQ ID NO: 2185260 - RNA, 20 nt, Human
agaaagcugguaaacuauuu

SEQ ID NO: 2185261 - RNA, 23 nt, Human
ucugaagucacaucacaggacac

SEQ ID NO: 2185262 - RNA, 22 nt, Human
ucugaagucacaucacaggaca

SEQ ID NO: 2185263 - RNA, 20 nt, Human
ucugaagucacaucacagga

SEQ ID NO: 2185264 - RNA, 17 nt, Human
ucugaagucacaucaca

SEQ ID NO: 2185265 - RNA, 12 nt, Human
ucugaagcagau

SEQ ID NO: 2185266 - RNA, 12 nt, Human
ucugaagcaugu

SEQ ID NO: 2185267 - RNA, 13 nt, Human
ucugaagcauguu

SEQ ID NO: 2185268 - RNA, 14 nt, Human
ucugaagcauguuu

SEQ ID NO: 2185269 - RNA, 21 nt, Human
ucugaagcauguuucauguuu

SEQ ID NO: 2185270 - RNA, 15 nt, Human
ucugaagcauguuuc

SEQ ID NO: 2185271 - RNA, 20 nt, Human
ucugaagcauguuucauguu

SEQ ID NO: 2185272 - RNA, 22 nt, Human
ucugaagaguggguuucacaag

SEQ ID NO: 2185273 - RNA, 22 nt, Human
ucugaagaccucgagcagauga

SEQ ID NO: 2185274 - RNA, 12 nt, Human
ucugaagaagau

SEQ ID NO: 2185275 - RNA, 18 nt, Human
agaaaugaaaaaauauau

SEQ ID NO: 2185276 - RNA, 23 nt, Human
agaaaugaaaaaauauauaucaa

SEQ ID NO: 2185277 - RNA, 16 nt, Human
agaaaugaaaaaauau

SEQ ID NO: 2185278 - RNA, 22 nt, Human
agaaaucccuguuuaauauuua

SEQ ID NO: 2185279 - RNA, 14 nt, Human
agaaaugaaagcag

SEQ ID NO: 2185280 - RNA, 21 nt, Human
ucugaccugcaggccaagagc

SEQ ID NO: 2185281 - RNA, 19 nt, Human
ucugaccugcaggccaaga

SEQ ID NO: 2185282 - RNA, 17 nt, Human
ucugaccugcaggccaa

SEQ ID NO: 2185283 - RNA, 16 nt, Human
ucugaccugcaggcca

SEQ ID NO: 2185284 - RNA, 12 nt, Human
ucugacacacag

SEQ ID NO: 2185285 - RNA, 16 nt, Human
ucugacaacagacuuc

SEQ ID NO: 2185286 - RNA, 15 nt, Human
ucugacaacagacuu

SEQ ID NO: 2185287 - RNA, 15 nt, Human
ucugaagucacugca

SEQ ID NO: 2185288 - RNA, 16 nt, Human
ucugaagucacugcac

SEQ ID NO: 2185289 - RNA, 18 nt, Human
ucugaagucacugcacag

SEQ ID NO: 2185290 - RNA, 16 nt, Human
acuuccuugcucuccc

SEQ ID NO: 2185291 - RNA, 19 nt, Human
acuuccuugcucucccucu

SEQ ID NO: 2185292 - RNA, 15 nt, Human
acuucgacucaggau

SEQ ID NO: 2185293 - RNA, 19 nt, Human
acuucgacucaggauccag

SEQ ID NO: 2185294 - RNA, 22 nt, Human
acuucgggaggucgaggcagga

SEQ ID NO: 2185295 - RNA, 17 nt, Human
acuuccuguccagagag

SEQ ID NO: 2185296 - RNA, 17 nt, Human
acuuccuguuugggccc

SEQ ID NO: 2185297 - RNA, 23 nt, Human
acuuccuguccagcuccaaccug

SEQ ID NO: 2185298 - RNA, 15 nt, Human
acuuccugugacuuc

SEQ ID NO: 2185299 - RNA, 22 nt, Human
acuuccuugagacacggagccc

SEQ ID NO: 2185300 - RNA, 14 nt, Human
acuuccuugagaca

SEQ ID NO: 2185301 - RNA, 18 nt, Human
acuuccuguuugggcccc

SEQ ID NO: 2185302 - RNA, 21 nt, Human
acuuccuguuugggccccucu

SEQ ID NO: 2185303 - RNA, 22 nt, Human
acuuccuuacuaagcauagcaa

SEQ ID NO: 2185304 - RNA, 16 nt, Human
ucucacuauaccagua

SEQ ID NO: 2185305 - RNA, 13 nt, Human
ucucacuccuuga

SEQ ID NO: 2185306 - RNA, 12 nt, Human
ucucacucuguc

SEQ ID NO: 2185307 - RNA, 22 nt, Human
acuuccuguccagcuccaaccu

SEQ ID NO: 2185308 - RNA, 18 nt, Human
acuuccuguccagcucca

SEQ ID NO: 2185309 - RNA, 14 nt, Human
acuucuccacccug

SEQ ID NO: 2185310 - RNA, 23 nt, Human
acuucuacuucugcccuugccaa

SEQ ID NO: 2185311 - RNA, 22 nt, Human
acuucucaaaccuguuuaaaua

SEQ ID NO: 2185312 - RNA, 22 nt, Human
acuucuaauauauuuuuauauu

SEQ ID NO: 2185313 - RNA, 17 nt, Human
acuucuaaaugcauauc

SEQ ID NO: 2185314 - RNA, 11 nt, Human
acuucuaauau

SEQ ID NO: 2185315 - RNA, 15 nt, Human
acuucuaauauauuu

SEQ ID NO: 2185316 - RNA, 18 nt, Human
acuucgucuucuaauuuc

SEQ ID NO: 2185317 - RNA, 15 nt, Human
acuucgucuucuaau

SEQ ID NO: 2185318 - RNA, 19 nt, Human
acuucgucuucuaauuuca

SEQ ID NO: 2185319 - RNA, 20 nt, Human
acuucgucuucuaauuucaa

SEQ ID NO: 2185320 - RNA, 13 nt, Human
acuucgugggauc

SEQ ID NO: 2185321 - RNA, 22 nt, Human
acuucgugggaucugccccucc

SEQ ID NO: 2185322 - RNA, 23 nt, Human
acuucgugggaucugccccuccc

SEQ ID NO: 2185323 - RNA, 16 nt, Human
acuucuaaaugaagug

SEQ ID NO: 2185324 - RNA, 15 nt, Human
acuucuaaaugaagu

SEQ ID NO: 2185325 - RNA, 23 nt, Human
acuucuaaguaaaaccacagcag

SEQ ID NO: 2185326 - RNA, 23 nt, Human
ucucacacccaccguccgcccug

SEQ ID NO: 2185327 - RNA, 14 nt, Human
ucucacacuggcgu

SEQ ID NO: 2185328 - RNA, 21 nt, Human
ucucacacuggcguagaaguu

SEQ ID NO: 2185329 - RNA, 20 nt, Human
ucucacgggcaguagcugug

SEQ ID NO: 2185330 - RNA, 15 nt, Human
ucucaccuguacucu

SEQ ID NO: 2185331 - RNA, 11 nt, Human
ucucacuccuu

SEQ ID NO: 2185332 - RNA, 15 nt, Human
ucucacuaaacuuua

SEQ ID NO: 2185333 - RNA, 17 nt, Human
ucucacuaaacuuuacc

SEQ ID NO: 2185334 - RNA, 21 nt, Human
ucucacgggcaugggcacucc

SEQ ID NO: 2185335 - RNA, 22 nt, Human
ucucacgggcaugggcacuccc

SEQ ID NO: 2185336 - RNA, 23 nt, Human
ucucacgggcaugggcacucccu

SEQ ID NO: 2185337 - RNA, 13 nt, Human
ucucacuaaacuu

SEQ ID NO: 2185338 - RNA, 16 nt, Human
acuucagcugacuuuu

SEQ ID NO: 2185339 - RNA, 11 nt, Human
acuucagcuga

SEQ ID NO: 2185340 - RNA, 14 nt, Human
acuucaggcucuuc

SEQ ID NO: 2185341 - RNA, 17 nt, Human
acuuauaucaucagcau

SEQ ID NO: 2185342 - RNA, 22 nt, Human
acuuauaucaucagcauaccuu

SEQ ID NO: 2185343 - RNA, 15 nt, Human
ucuauuucugagaag

SEQ ID NO: 2185344 - RNA, 13 nt, Human
ucuauuucugaga

SEQ ID NO: 2185345 - RNA, 12 nt, Human
ucuauuucugag

SEQ ID NO: 2185346 - RNA, 17 nt, Human
ucuauuucuaugagaaa

SEQ ID NO: 2185347 - RNA, 20 nt, Human
ucuauuucugagaagguccu

SEQ ID NO: 2185348 - RNA, 11 nt, Human
ucuauuucugc

SEQ ID NO: 2185349 - RNA, 12 nt, Human
ucuauuucugcu

SEQ ID NO: 2185350 - RNA, 23 nt, Human
ucucacacaugagcaucaggcca

SEQ ID NO: 2185351 - RNA, 21 nt, Human
ucuauuucugcugaauuuuca

SEQ ID NO: 2185352 - RNA, 13 nt, Human
ucuauuucugcug

SEQ ID NO: 2185353 - RNA, 14 nt, Human
ucucacacccaccg

SEQ ID NO: 2185354 - RNA, 15 nt, Human
ucuauuuccuggaau

SEQ ID NO: 2185355 - RNA, 11 nt, Human
ucuauuucuag

SEQ ID NO: 2185356 - RNA, 20 nt, Human
ucuauuucuccuccauggga

SEQ ID NO: 2185357 - RNA, 16 nt, Human
ucuauuucuccuccau

SEQ ID NO: 2185358 - RNA, 15 nt, Human
ucuauuucuccucca

SEQ ID NO: 2185359 - RNA, 14 nt, Human
ucuauuucuccucc

SEQ ID NO: 2185360 - RNA, 23 nt, Human
acuugcucucuggccuuuuccua

SEQ ID NO: 2185361 - RNA, 20 nt, Human
acuugccuucuucacccagc

SEQ ID NO: 2185362 - RNA, 23 nt, Human
acuugagcuuuaaaaaucauugu

SEQ ID NO: 2185363 - RNA, 13 nt, Human
acuugccucuucc

SEQ ID NO: 2185364 - RNA, 17 nt, Human
acuugccucuuccuuga

SEQ ID NO: 2185365 - RNA, 14 nt, Human
acuugcucuugaug

SEQ ID NO: 2185366 - RNA, 19 nt, Human
acuuggagccccagugcca

SEQ ID NO: 2185367 - RNA, 11 nt, Human
acuuggagccg

SEQ ID NO: 2185368 - RNA, 20 nt, Human
acuuggaggguugguccucu

SEQ ID NO: 2185369 - RNA, 14 nt, Human
acuuggccucugga

SEQ ID NO: 2185370 - RNA, 10 nt, Human
acuuggccaa

SEQ ID NO: 2185371 - RNA, 19 nt, Human
acuuggccaagcagggagg

SEQ ID NO: 2185372 - RNA, 18 nt, Human
acuuggcaucagcuggcg

SEQ ID NO: 2185373 - RNA, 15 nt, Human
acuuggcaacagaag

SEQ ID NO: 2185374 - RNA, 16 nt, Human
acuuggcaacagaagc

SEQ ID NO: 2185375 - RNA, 16 nt, Human
acuuguggacacagcu

SEQ ID NO: 2185376 - RNA, 22 nt, Human
acuuguccccaaauccgaaccu

SEQ ID NO: 2185377 - RNA, 17 nt, Human
acuuguccccaaauccg

SEQ ID NO: 2185378 - RNA, 18 nt, Human
acuugucccacuaucugg

SEQ ID NO: 2185379 - RNA, 17 nt, Human
acuuguggacacagcuc

SEQ ID NO: 2185380 - RNA, 18 nt, Human
acuuguggacacagcucu

SEQ ID NO: 2185381 - RNA, 13 nt, Human
acuugucauguga

SEQ ID NO: 2185382 - RNA, 20 nt, Human
acuugucaauauuuaaacau

SEQ ID NO: 2185383 - RNA, 16 nt, Human
acuugucaauauuuaa

SEQ ID NO: 2185384 - RNA, 17 nt, Human
acuugucaauauuuaaa

SEQ ID NO: 2185385 - RNA, 21 nt, Human
acuuggcucgaaucucugugc

SEQ ID NO: 2185386 - RNA, 13 nt, Human
acuugucaauauu

SEQ ID NO: 2185387 - RNA, 14 nt, Human
acuugucaauauuu

SEQ ID NO: 2185388 - RNA, 16 nt, Human
acuugucaauaaaauc

SEQ ID NO: 2185389 - RNA, 17 nt, Human
acuuggcuacacaggga

SEQ ID NO: 2185390 - RNA, 18 nt, Human
acuuggcucgaaucucug

SEQ ID NO: 2185391 - RNA, 19 nt, Human
acuuggcucgaaucucugu

SEQ ID NO: 2185392 - RNA, 20 nt, Human
acuuggcucgaaucucugug

SEQ ID NO: 2185393 - RNA, 15 nt, Human
acuugagcuuuaaaa

SEQ ID NO: 2185394 - RNA, 20 nt, Human
acuugagcaccgucauggcu

SEQ ID NO: 2185395 - RNA, 16 nt, Human
acuugagaggaugaau

SEQ ID NO: 2185396 - RNA, 19 nt, Human
acuugagaggaugaaugua

SEQ ID NO: 2185397 - RNA, 16 nt, Human
acuugaaugugucacu

SEQ ID NO: 2185398 - RNA, 12 nt, Human
acuugagaggau

SEQ ID NO: 2185399 - RNA, 19 nt, Human
acuugaauccuagggccug

SEQ ID NO: 2185400 - RNA, 19 nt, Human
acuugagcccagagugaac

SEQ ID NO: 2185401 - RNA, 21 nt, Human
acuugaacccgggaggcagag

SEQ ID NO: 2185402 - RNA, 14 nt, Human
acuugaagggccag

SEQ ID NO: 2185403 - RNA, 15 nt, Human
acuugaagggccaga

SEQ ID NO: 2185404 - RNA, 20 nt, Human
acuugaagggccagagccag

SEQ ID NO: 2185405 - RNA, 19 nt, Human
acuugaagggccagagcca

SEQ ID NO: 2185406 - RNA, 18 nt, Human
acuugaagggccagagcc

SEQ ID NO: 2185407 - RNA, 17 nt, Human
acuugaagggccagagc

SEQ ID NO: 2185408 - RNA, 22 nt, Human
acuugaagggccagagccaggg

SEQ ID NO: 2185409 - RNA, 21 nt, Human
acuugaagggccagagccagg

SEQ ID NO: 2185410 - RNA, 11 nt, Human
acuugaaguug

SEQ ID NO: 2185411 - RNA, 12 nt, Human
acuugaaguugu

SEQ ID NO: 2185412 - RNA, 13 nt, Human
acuugaaguuguu

SEQ ID NO: 2185413 - RNA, 20 nt, Human
acuugaaguuguuacuaacu

SEQ ID NO: 2185414 - RNA, 22 nt, Human
acuugaaguuguuacuaacuaa

SEQ ID NO: 2185415 - RNA, 16 nt, Human
acuugaaucaaagcag

SEQ ID NO: 2185416 - RNA, 15 nt, Human
acuucuccacccugc

SEQ ID NO: 2185417 - RNA, 16 nt, Human
acuucuccacccugcu

SEQ ID NO: 2185418 - RNA, 20 nt, Human
acuugaacccgggaggcaga

SEQ ID NO: 2185419 - RNA, 19 nt, Human
acuugaacccgggaggcag

SEQ ID NO: 2185420 - RNA, 21 nt, Human
acuugaacccauauuuguaca

SEQ ID NO: 2185421 - RNA, 19 nt, Human
ucuccaggucucacgggca

SEQ ID NO: 2185422 - RNA, 19 nt, Human
ucuccaguauccacuuugc

SEQ ID NO: 2185423 - RNA, 23 nt, Human
ucuccaggggcugcuuccuccug

SEQ ID NO: 2185424 - RNA, 17 nt, Human
ucuccaggggcugcuuc

SEQ ID NO: 2185425 - RNA, 18 nt, Human
ucuccaggggcugcuucc

SEQ ID NO: 2185426 - RNA, 20 nt, Human
ucuccaggggcugcuuccuc

SEQ ID NO: 2185427 - RNA, 22 nt, Human
ucuccaggggcugcuuccuccu

SEQ ID NO: 2185428 - RNA, 16 nt, Human
ucuccaggcuguaucc

SEQ ID NO: 2185429 - RNA, 18 nt, Human
ucuccaagaaugcugaaa

SEQ ID NO: 2185430 - RNA, 20 nt, Human
ucuccagggaguccccuccc

SEQ ID NO: 2185431 - RNA, 14 nt, Human
ucuccaagaaugcu

SEQ ID NO: 2185432 - RNA, 15 nt, Human
ucuccaagaaugcug

SEQ ID NO: 2185433 - RNA, 16 nt, Human
ucuccaagaaugcuga

SEQ ID NO: 2185434 - RNA, 17 nt, Human
ucuccaagaaugcugaa

SEQ ID NO: 2185435 - RNA, 14 nt, Human
ucuccauauguuac

SEQ ID NO: 2185436 - RNA, 23 nt, Human
ucuccauaaccccacccuugccc

SEQ ID NO: 2185437 - RNA, 21 nt, Human
ucuccauaaccccacccuugc

SEQ ID NO: 2185438 - RNA, 22 nt, Human
ucuccauaaccccacccuugcc

SEQ ID NO: 2185439 - RNA, 20 nt, Human
ucuccagugguugcuguuga

SEQ ID NO: 2185440 - RNA, 17 nt, Human
ucuccauaaccccaccc

SEQ ID NO: 2185441 - RNA, 18 nt, Human
ucuccauaaccccacccu

SEQ ID NO: 2185442 - RNA, 20 nt, Human
ucuccauaaccccacccuug

SEQ ID NO: 2185443 - RNA, 15 nt, Human
ucuccaguuuucagu

SEQ ID NO: 2185444 - RNA, 21 nt, Human
ucuccagggaguccccucccc

SEQ ID NO: 2185445 - RNA, 18 nt, Human
ucuccagugguugcuguu

SEQ ID NO: 2185446 - RNA, 17 nt, Human
ucuccagugguugcugu

SEQ ID NO: 2185447 - RNA, 13 nt, Human
ucuccaucagcug

SEQ ID NO: 2185448 - RNA, 15 nt, Human
ucuccauauguuaca

SEQ ID NO: 2185449 - RNA, 17 nt, Human
ucuccaucagcuguaag

SEQ ID NO: 2185450 - RNA, 13 nt, Human
ucuccauccacau

SEQ ID NO: 2185451 - RNA, 19 nt, Human
ucuccauccacaugggagc

SEQ ID NO: 2185452 - RNA, 17 nt, Human
ucuccauccuuucugcc

SEQ ID NO: 2185453 - RNA, 19 nt, Human
ucuccauccuuucugccuc

SEQ ID NO: 2185454 - RNA, 22 nt, Human
ucuccauccuuucugccucuca

SEQ ID NO: 2185455 - RNA, 11 nt, Human
ucuccaucucu

SEQ ID NO: 2185456 - RNA, 14 nt, Human
ucuccaucucucug

SEQ ID NO: 2185457 - RNA, 16 nt, Human
ucuccaucucucuggc

SEQ ID NO: 2185458 - RNA, 15 nt, Human
ucuccaaccuggaca

SEQ ID NO: 2185459 - RNA, 23 nt, Human
ucuccaaccccccagcacugagg

SEQ ID NO: 2185460 - RNA, 21 nt, Human
ucuccaaccccccagcacuga

SEQ ID NO: 2185461 - RNA, 22 nt, Human
ucuccaaccccccagcacugag

SEQ ID NO: 2185462 - RNA, 24 nt, Human
ucuccaaaugagaucuaagccuuu

SEQ ID NO: 2185463 - RNA, 12 nt, Human
ucuccaaaugag

SEQ ID NO: 2185464 - RNA, 23 nt, Human
ucuccaaacugaagcagccucuc

SEQ ID NO: 2185465 - RNA, 17 nt, Human
ucuccaaccccccagca

SEQ ID NO: 2185466 - RNA, 18 nt, Human
ucuccaaccccccagcac

SEQ ID NO: 2185467 - RNA, 19 nt, Human
ucuccaaccccccagcacu

SEQ ID NO: 2185468 - RNA, 20 nt, Human
ucuccaaccccccagcacug

SEQ ID NO: 2185469 - RNA, 22 nt, Human
ucuccaaaauaaaacuuuuuaa

SEQ ID NO: 2185470 - RNA, 22 nt, Human
ucuccaaacugaagcagccucu

SEQ ID NO: 2185471 - RNA, 19 nt, Human
ucuccaaaauaaaacuuuu

SEQ ID NO: 2185472 - RNA, 17 nt, Human
ucuccaaaauaaaacuu

SEQ ID NO: 2185473 - RNA, 14 nt, Human
ucucauuccccagg

SEQ ID NO: 2185474 - RNA, 15 nt, Human
ucucauugcuuacaa

SEQ ID NO: 2185475 - RNA, 16 nt, Human
ucucauuccccaggug

SEQ ID NO: 2185476 - RNA, 19 nt, Human
ucucauuggacccuuccau

SEQ ID NO: 2185477 - RNA, 13 nt, Human
ucucauuccccag

SEQ ID NO: 2185478 - RNA, 19 nt, Human
ucucauuccaacagugagu

SEQ ID NO: 2185479 - RNA, 17 nt, Human
ucucauuccaacaguga

SEQ ID NO: 2185480 - RNA, 16 nt, Human
ucucauuccagaggaa

SEQ ID NO: 2185481 - RNA, 13 nt, Human
ucucagggcuccu

SEQ ID NO: 2185482 - RNA, 12 nt, Human
ucucagggcucc

SEQ ID NO: 2185483 - RNA, 16 nt, Human
ucucauuacuuuugaa

SEQ ID NO: 2185484 - RNA, 15 nt, Human
ucucagggccugguc

SEQ ID NO: 2185485 - RNA, 14 nt, Human
ucucagggccuggu

SEQ ID NO: 2185486 - RNA, 19 nt, Human
ucucaggcuggugggaggg

SEQ ID NO: 2185487 - RNA, 11 nt, Human
ucucagggcuc

SEQ ID NO: 2185488 - RNA, 19 nt, Human
ucucagggccuggucguuu

SEQ ID NO: 2185489 - RNA, 13 nt, Human
ucucagccuccca

SEQ ID NO: 2185490 - RNA, 12 nt, Human
ucucagccuccc

SEQ ID NO: 2185491 - RNA, 15 nt, Human
acuuguggacacagc

SEQ ID NO: 2185492 - RNA, 11 nt, Human
ucucagcuccc

SEQ ID NO: 2185493 - RNA, 17 nt, Human
ucucagcucccauuucu

SEQ ID NO: 2185494 - RNA, 18 nt, Human
ucucagcucccauuucua

SEQ ID NO: 2185495 - RNA, 16 nt, Human
ucucagcuccaggugg

SEQ ID NO: 2185496 - RNA, 21 nt, Human
ucucagcuccagguggcucug

SEQ ID NO: 2185497 - RNA, 22 nt, Human
ucucagcucccauuucuacucu

SEQ ID NO: 2185498 - RNA, 17 nt, Human
ucucagcucccccuguc

SEQ ID NO: 2185499 - RNA, 18 nt, Human
ucucagcucccccugucc

SEQ ID NO: 2185500 - RNA, 19 nt, Human
ucucagcucccccuguccc

SEQ ID NO: 2185501 - RNA, 21 nt, Human
ucucagcucccccuguccccu

SEQ ID NO: 2185502 - RNA, 22 nt, Human
ucucagcucccccuguccccuc

SEQ ID NO: 2185503 - RNA, 19 nt, Human
ucucagcucuucugacuua

SEQ ID NO: 2185504 - RNA, 20 nt, Human
ucucaggcucugcccugccc

SEQ ID NO: 2185505 - RNA, 19 nt, Human
ucucaggcucugcccugcc

SEQ ID NO: 2185506 - RNA, 18 nt, Human
ucucaggcuggugggagg

SEQ ID NO: 2185507 - RNA, 17 nt, Human
ucucaggcucugcccug

SEQ ID NO: 2185508 - RNA, 15 nt, Human
ucucaggcucugccc

SEQ ID NO: 2185509 - RNA, 14 nt, Human
ucucaggcucugcc

SEQ ID NO: 2185510 - RNA, 12 nt, Human
ucucaggaaauc

SEQ ID NO: 2185511 - RNA, 13 nt, Human
ucucagggccugg

SEQ ID NO: 2185512 - RNA, 12 nt, Human
ucucagggccug

SEQ ID NO: 2185513 - RNA, 19 nt, Human
ucucccacuagacaagucc

SEQ ID NO: 2185514 - RNA, 23 nt, Human
ucucccagauaaugugaaaaugg

SEQ ID NO: 2185515 - RNA, 21 nt, Human
ucucccagauaaugugaaaau

SEQ ID NO: 2185516 - RNA, 18 nt, Human
ucucccagauaaugugaa

SEQ ID NO: 2185517 - RNA, 16 nt, Human
ucucccagauaaugug

SEQ ID NO: 2185518 - RNA, 14 nt, Human
ucucccaccuagca

SEQ ID NO: 2185519 - RNA, 14 nt, Human
ucucccacguggga

SEQ ID NO: 2185520 - RNA, 15 nt, Human
ucucccacgugggag

SEQ ID NO: 2185521 - RNA, 16 nt, Human
ucucccacgugggaga

SEQ ID NO: 2185522 - RNA, 15 nt, Human
ucucccaccccugcc

SEQ ID NO: 2185523 - RNA, 17 nt, Human
ucuccaucuggcagggu

SEQ ID NO: 2185524 - RNA, 18 nt, Human
ucuccaucucucuggccc

SEQ ID NO: 2185525 - RNA, 14 nt, Human
ucuccaucuguuug

SEQ ID NO: 2185526 - RNA, 14 nt, Human
ucuccauggcccug

SEQ ID NO: 2185527 - RNA, 18 nt, Human
ucuccaucuucagcuucu

SEQ ID NO: 2185528 - RNA, 15 nt, Human
ucuccauggccaccu

SEQ ID NO: 2185529 - RNA, 18 nt, Human
ucuccauggcccugcaaa

SEQ ID NO: 2185530 - RNA, 15 nt, Human
ucuccauggcccugc

SEQ ID NO: 2185531 - RNA, 16 nt, Human
ucuccauguuugaugu

SEQ ID NO: 2185532 - RNA, 17 nt, Human
ucuccauggcuuccucc

SEQ ID NO: 2185533 - RNA, 20 nt, Human
ucuccauggcuuccuccucc

SEQ ID NO: 2185534 - RNA, 20 nt, Human
ucuccauggccaccuuuuca

SEQ ID NO: 2185535 - RNA, 19 nt, Human
ucuccauggcuuccuccuc

SEQ ID NO: 2185536 - RNA, 11 nt, Human
ucucccauccc

SEQ ID NO: 2185537 - RNA, 12 nt, Human
ucucccaucccc

SEQ ID NO: 2185538 - RNA, 13 nt, Human
ucucccauccccc

SEQ ID NO: 2185539 - RNA, 17 nt, Human
ucucccagcucuagaca

SEQ ID NO: 2185540 - RNA, 11 nt, Human
ucucccaggaa

SEQ ID NO: 2185541 - RNA, 23 nt, Human
ucucccauccagugucucacagc

SEQ ID NO: 2185542 - RNA, 13 nt, Human
ucucccauggagc

SEQ ID NO: 2185543 - RNA, 19 nt, Human
ucucccaucccccugcccu

SEQ ID NO: 2185544 - RNA, 20 nt, Human
ucucccaucccccugcccuc

SEQ ID NO: 2185545 - RNA, 14 nt, Human
ucucccaucccccu

SEQ ID NO: 2185546 - RNA, 15 nt, Human
ucucccaucccccug

SEQ ID NO: 2185547 - RNA, 17 nt, Human
ucucccaucccccugcc

SEQ ID NO: 2185548 - RNA, 18 nt, Human
ucucccaucccccugccc

SEQ ID NO: 2185549 - RNA, 10 nt, Human
ucuccccaca

SEQ ID NO: 2185550 - RNA, 19 nt, Human
ucucccauugucccucugc

SEQ ID NO: 2185551 - RNA, 18 nt, Human
ucucccauugucccucug

SEQ ID NO: 2185552 - RNA, 17 nt, Human
ucucccauugucccucu

SEQ ID NO: 2185553 - RNA, 22 nt, Human
ucucccauggcuuaaugcuucu

SEQ ID NO: 2185554 - RNA, 21 nt, Human
ucucccauggagccccagccc

SEQ ID NO: 2185555 - RNA, 22 nt, Human
ucucccauggagccccagcccc

SEQ ID NO: 2185556 - RNA, 22 nt, Human
ucucccaucccccugcccucgu

SEQ ID NO: 2185557 - RNA, 15 nt, Human
ucucccauggagccc

SEQ ID NO: 2185558 - RNA, 18 nt, Human
ucucccauggagccccag

SEQ ID NO: 2185559 - RNA, 20 nt, Human
ucucccauggagccccagcc

SEQ ID NO: 2185560 - RNA, 13 nt, Human
ucuccccacacua

SEQ ID NO: 2185561 - RNA, 11 nt, Human
ucuccccacac

SEQ ID NO: 2185562 - RNA, 20 nt, Human
ucuccguuagcuccuguggc

SEQ ID NO: 2185563 - RNA, 21 nt, Human
ucuccguuagcuccuguggcc

SEQ ID NO: 2185564 - RNA, 22 nt, Human
ucuccguuagcuccuguggccc

SEQ ID NO: 2185565 - RNA, 23 nt, Human
ucuccguuagcuccuguggcccc

SEQ ID NO: 2185566 - RNA, 23 nt, Human
ucuccuagacugacccugaucag

SEQ ID NO: 2185567 - RNA, 19 nt, Human
ucuccuagagacagaagca

SEQ ID NO: 2185568 - RNA, 20 nt, Human
ucuccuagagacagaagcag

SEQ ID NO: 2185569 - RNA, 17 nt, Human
ucuccuagacugacccu

SEQ ID NO: 2185570 - RNA, 23 nt, Human
ucuccuauccugguuuuuguagc

SEQ ID NO: 2185571 - RNA, 18 nt, Human
acuuuaaguuucaggaua

SEQ ID NO: 2185572 - RNA, 19 nt, Human
acuuuaauuaccaaccugu

SEQ ID NO: 2185573 - RNA, 16 nt, Human
acuuuaagcacuacau

SEQ ID NO: 2185574 - RNA, 19 nt, Human
acuuuaagcagcucuugcu

SEQ ID NO: 2185575 - RNA, 23 nt, Human
acuuuaagcagcucuugcuaauc

SEQ ID NO: 2185576 - RNA, 15 nt, Human
acuuuaaguuucagg

SEQ ID NO: 2185577 - RNA, 14 nt, Human
acuuuaagaggaca

SEQ ID NO: 2185578 - RNA, 13 nt, Human
acuuuaagcacua

SEQ ID NO: 2185579 - RNA, 14 nt, Human
acuuuaagcacuac

SEQ ID NO: 2185580 - RNA, 15 nt, Human
acuuuaagcacuaca

SEQ ID NO: 2185581 - RNA, 17 nt, Human
acuuuaagacugagcac

SEQ ID NO: 2185582 - RNA, 21 nt, Human
acuuguucaaaauauguucuu

SEQ ID NO: 2185583 - RNA, 12 nt, Human
acuuuaaaggaa

SEQ ID NO: 2185584 - RNA, 21 nt, Human
acuuuaaaggaaaaaauguug

SEQ ID NO: 2185585 - RNA, 20 nt, Human
acuuuaaaggaaaaaauguu

SEQ ID NO: 2185586 - RNA, 17 nt, Human
acuuucucaguuuucau

SEQ ID NO: 2185587 - RNA, 14 nt, Human
acuuucucaguuuu

SEQ ID NO: 2185588 - RNA, 14 nt, Human
acuuugaccucugc

SEQ ID NO: 2185589 - RNA, 16 nt, Human
acuuucuagccagagg

SEQ ID NO: 2185590 - RNA, 13 nt, Human
acuuucucaguuu

SEQ ID NO: 2185591 - RNA, 17 nt, Human
acuuucuauccucugua

SEQ ID NO: 2185592 - RNA, 17 nt, Human
acuuucuagccagagga

SEQ ID NO: 2185593 - RNA, 15 nt, Human
acuuuaaaauaaaau

SEQ ID NO: 2185594 - RNA, 16 nt, Human
acuuguuccagcucuu

SEQ ID NO: 2185595 - RNA, 15 nt, Human
acuuguuccagcucu

SEQ ID NO: 2185596 - RNA, 16 nt, Human
ucuccucuccccucua

SEQ ID NO: 2185597 - RNA, 16 nt, Human
acuuguguuuugcaag

SEQ ID NO: 2185598 - RNA, 20 nt, Human
ucuccucaaguccccaagau

SEQ ID NO: 2185599 - RNA, 14 nt, Human
ucuccuauguguaa

SEQ ID NO: 2185600 - RNA, 15 nt, Human
ucuccuauguguaag

SEQ ID NO: 2185601 - RNA, 20 nt, Human
ucuccuccaugggagaaaau

SEQ ID NO: 2185602 - RNA, 19 nt, Human
ucuccuauguguaagguga

SEQ ID NO: 2185603 - RNA, 13 nt, Human
ucuccucacuccc

SEQ ID NO: 2185604 - RNA, 12 nt, Human
ucuccucccagg

SEQ ID NO: 2185605 - RNA, 12 nt, Human
ucuccuccccaa

SEQ ID NO: 2185606 - RNA, 15 nt, Human
ucuccuccccacccg

SEQ ID NO: 2185607 - RNA, 18 nt, Human
ucuccuccccacccgccc

SEQ ID NO: 2185608 - RNA, 13 nt, Human
ucuccucccuucc

SEQ ID NO: 2185609 - RNA, 14 nt, Human
ucuccucccuuccu

SEQ ID NO: 2185610 - RNA, 13 nt, Human
ucuccucuccccu

SEQ ID NO: 2185611 - RNA, 16 nt, Human
ucuccucucagccccu

SEQ ID NO: 2185612 - RNA, 14 nt, Human
ucuccucggccccc

SEQ ID NO: 2185613 - RNA, 21 nt, Human
ucuccucggcccccuccaucg

SEQ ID NO: 2185614 - RNA, 16 nt, Human
ucuccucgcaagcugg

SEQ ID NO: 2185615 - RNA, 16 nt, Human
ucuccuccugcccacc

SEQ ID NO: 2185616 - RNA, 14 nt, Human
ucuccuccugccca

SEQ ID NO: 2185617 - RNA, 23 nt, Human
ucuccucccuuccuuuucccugc

SEQ ID NO: 2185618 - RNA, 21 nt, Human
ucuccuccuuuucacaguucu

SEQ ID NO: 2185619 - RNA, 19 nt, Human
acuguuaugaaauaaagaa

SEQ ID NO: 2185620 - RNA, 23 nt, Human
acuguuaugaaauaaagaaauug

SEQ ID NO: 2185621 - RNA, 20 nt, Human
acuguuagaaaauggacacu

SEQ ID NO: 2185622 - RNA, 13 nt, Human
ucuacccaaagga

SEQ ID NO: 2185623 - RNA, 21 nt, Human
ucuacccaaaggauacuguaa

SEQ ID NO: 2185624 - RNA, 22 nt, Human
ucuacccagagaagccccuucc

SEQ ID NO: 2185625 - RNA, 21 nt, Human
acuguuaccugaucaaugaca

SEQ ID NO: 2185626 - RNA, 23 nt, Human
acuguuaccugaucaaugacaga

SEQ ID NO: 2185627 - RNA, 21 nt, Human
ucuaccagacuguguauucau

SEQ ID NO: 2185628 - RNA, 18 nt, Human
ucuaccauuucagagagg

SEQ ID NO: 2185629 - RNA, 15 nt, Human
ucuaccauuucagag

SEQ ID NO: 2185630 - RNA, 14 nt, Human
ucuaccauuucaga

SEQ ID NO: 2185631 - RNA, 19 nt, Human
ucuaccaugaacagaaaac

SEQ ID NO: 2185632 - RNA, 16 nt, Human
ucuaccagacugugua

SEQ ID NO: 2185633 - RNA, 17 nt, Human
ucuaccagacuguguau

SEQ ID NO: 2185634 - RNA, 22 nt, Human
ucuaccagccucccuauuuuuu

SEQ ID NO: 2185635 - RNA, 20 nt, Human
ucuaccaagcuauccuggcu

SEQ ID NO: 2185636 - RNA, 13 nt, Human
ucuaccagacugu

SEQ ID NO: 2185637 - RNA, 22 nt, Human
ucuacauaaguaauucaagaaa

SEQ ID NO: 2185638 - RNA, 23 nt, Human
ucuacagugguuuuauacugaag

SEQ ID NO: 2185639 - RNA, 22 nt, Human
ucuacagugguuuuauacugaa

SEQ ID NO: 2185640 - RNA, 18 nt, Human
acuguucucuucuugaac

SEQ ID NO: 2185641 - RNA, 21 nt, Human
acuguucucugcccuccaaga

SEQ ID NO: 2185642 - RNA, 15 nt, Human
acuguucucugcccu

SEQ ID NO: 2185643 - RNA, 20 nt, Human
acuguucucugcccuccaag

SEQ ID NO: 2185644 - RNA, 20 nt, Human
acuguucccucugcuccugg

SEQ ID NO: 2185645 - RNA, 22 nt, Human
acuguucccucugcuccuggag

SEQ ID NO: 2185646 - RNA, 14 nt, Human
acuguucucugccc

SEQ ID NO: 2185647 - RNA, 13 nt, Human
acuguuauuuaua

SEQ ID NO: 2185648 - RNA, 19 nt, Human
acuguucccugagguggga

SEQ ID NO: 2185649 - RNA, 16 nt, Human
acuguucccugaggug

SEQ ID NO: 2185650 - RNA, 18 nt, Human
ucuaagccuuuccauaag

SEQ ID NO: 2185651 - RNA, 19 nt, Human
ucuaaggaugucacagggc

SEQ ID NO: 2185652 - RNA, 23 nt, Human
ucuaaggaugucacagggccaac

SEQ ID NO: 2185653 - RNA, 20 nt, Human
ucuaaggaugucacagggcc

SEQ ID NO: 2185654 - RNA, 16 nt, Human
ucuaaagcugccagcc

SEQ ID NO: 2185655 - RNA, 18 nt, Human
ucuaaagccuuaagucuu

SEQ ID NO: 2185656 - RNA, 15 nt, Human
ucuaaagcugccagc

SEQ ID NO: 2185657 - RNA, 20 nt, Human
ucuaaagccauuguaguccu

SEQ ID NO: 2185658 - RNA, 13 nt, Human
ucuaaagcugcca

SEQ ID NO: 2185659 - RNA, 14 nt, Human
ucuaaagcugccag

SEQ ID NO: 2185660 - RNA, 16 nt, Human
ucuacauacuauggaa

SEQ ID NO: 2185661 - RNA, 17 nt, Human
ucuacauaaguaauuca

SEQ ID NO: 2185662 - RNA, 20 nt, Human
ucuacauaaguaauucaaga

SEQ ID NO: 2185663 - RNA, 23 nt, Human
ucuaaguaaaaccacagcaguug

SEQ ID NO: 2185664 - RNA, 12 nt, Human
ucuacagugguu

SEQ ID NO: 2185665 - RNA, 13 nt, Human
ucuacagugguuu

SEQ ID NO: 2185666 - RNA, 21 nt, Human
ucuacagugguuuuauacuga

SEQ ID NO: 2185667 - RNA, 22 nt, Human
ucuaaguaaaaccacagcaguu

SEQ ID NO: 2185668 - RNA, 21 nt, Human
ucuaaguaaaaccacagcagu

SEQ ID NO: 2185669 - RNA, 16 nt, Human
acuuaccauaugugcu

SEQ ID NO: 2185670 - RNA, 21 nt, Human
acuuaccgugagcgacaaaga

SEQ ID NO: 2185671 - RNA, 23 nt, Human
acuuacauuguucaauuagaaua

SEQ ID NO: 2185672 - RNA, 14 nt, Human
acuuacaugauuca

SEQ ID NO: 2185673 - RNA, 19 nt, Human
acuuacaugauucauuuua

SEQ ID NO: 2185674 - RNA, 18 nt, Human
acuuacaugauucauuuu

SEQ ID NO: 2185675 - RNA, 17 nt, Human
acuuacaugauucauuu

SEQ ID NO: 2185676 - RNA, 20 nt, Human
acuuaccuucaauaaaguau

SEQ ID NO: 2185677 - RNA, 19 nt, Human
acuuaccuucaauaaagua

SEQ ID NO: 2185678 - RNA, 17 nt, Human
acuuaccuucaauaaag

SEQ ID NO: 2185679 - RNA, 15 nt, Human
acuuacuugcuuauu

SEQ ID NO: 2185680 - RNA, 17 nt, Human
acuuaccuagauuuaca

SEQ ID NO: 2185681 - RNA, 19 nt, Human
acuuaccuaaacagauaua

SEQ ID NO: 2185682 - RNA, 16 nt, Human
acuuaccuucaauaaa

SEQ ID NO: 2185683 - RNA, 15 nt, Human
acuuaccuucaauaa

SEQ ID NO: 2185684 - RNA, 16 nt, Human
acuuaaucuaaaugga

SEQ ID NO: 2185685 - RNA, 15 nt, Human
acuuaaucuaaaugg

SEQ ID NO: 2185686 - RNA, 19 nt, Human
acuuaaucaauuaauuuuu

SEQ ID NO: 2185687 - RNA, 18 nt, Human
acuuaaucaauuaauuuu

SEQ ID NO: 2185688 - RNA, 15 nt, Human
acuuaauagaaacau

SEQ ID NO: 2185689 - RNA, 14 nt, Human
acuuaauagaaaca

SEQ ID NO: 2185690 - RNA, 13 nt, Human
acuuaaucuaaau

SEQ ID NO: 2185691 - RNA, 14 nt, Human
acuucagcucuguu

SEQ ID NO: 2185692 - RNA, 20 nt, Human
acuuagugcggacaaguuuu

SEQ ID NO: 2185693 - RNA, 17 nt, Human
acuuauaauuuuccuaa

SEQ ID NO: 2185694 - RNA, 16 nt, Human
acuuagaaauugcauu

SEQ ID NO: 2185695 - RNA, 16 nt, Human
acuuagaaagcagggg

SEQ ID NO: 2185696 - RNA, 19 nt, Human
acuuagaaagcaggggcua

SEQ ID NO: 2185697 - RNA, 15 nt, Human
acuuagaauaaaauu

SEQ ID NO: 2185698 - RNA, 16 nt, Human
acuuagaauaaaauug

SEQ ID NO: 2185699 - RNA, 15 nt, Human
acuuagaaagcaggg

SEQ ID NO: 2185700 - RNA, 16 nt, Human
acuuacuugcuuauuu

SEQ ID NO: 2185701 - RNA, 22 nt, Human
acuuagaauaaaauuguaaaau

SEQ ID NO: 2185702 - RNA, 17 nt, Human
acuuagaauaaaauugu

SEQ ID NO: 2185703 - RNA, 18 nt, Human
acuuagaauaaaauugua

SEQ ID NO: 2185704 - RNA, 12 nt, Human
acuuagaggaaa

SEQ ID NO: 2185705 - RNA, 13 nt, Human
acuuagaggaaau

SEQ ID NO: 2185706 - RNA, 12 nt, Human
acuguugcccag

SEQ ID NO: 2185707 - RNA, 13 nt, Human
acuguucuguguc

SEQ ID NO: 2185708 - RNA, 15 nt, Human
acuguucugugucuu

SEQ ID NO: 2185709 - RNA, 16 nt, Human
acuguucugugucuuu

SEQ ID NO: 2185710 - RNA, 17 nt, Human
acuguucugugucuuuc

SEQ ID NO: 2185711 - RNA, 13 nt, Human
acuguugcccagg

SEQ ID NO: 2185712 - RNA, 14 nt, Human
acuguugcccaggc

SEQ ID NO: 2185713 - RNA, 17 nt, Human
acuguugcccaggcugg

SEQ ID NO: 2185714 - RNA, 18 nt, Human
acuguugcccaggcuggc

SEQ ID NO: 2185715 - RNA, 18 nt, Human
acuguugggguggguaua

SEQ ID NO: 2185716 - RNA, 21 nt, Human
acuguucucuucuugaacacu

SEQ ID NO: 2185717 - RNA, 12 nt, Human
acuguugcucaa

SEQ ID NO: 2185718 - RNA, 21 nt, Human
acuguugcucaaaucuauuca

SEQ ID NO: 2185719 - RNA, 20 nt, Human
acuguugggguggguauaaa

SEQ ID NO: 2185720 - RNA, 21 nt, Human
acuguugggguggguauaaaa

SEQ ID NO: 2185721 - RNA, 22 nt, Human
acuguugggguggguauaaaag

SEQ ID NO: 2185722 - RNA, 17 nt, Human
acuuaauaaauucagau

SEQ ID NO: 2185723 - RNA, 13 nt, Human
acuuaauaaauuc

SEQ ID NO: 2185724 - RNA, 19 nt, Human
acuuaaguugguccuuuac

SEQ ID NO: 2185725 - RNA, 17 nt, Human
acuuaagggagaaaaaa

SEQ ID NO: 2185726 - RNA, 15 nt, Human
acuuaaguuaaacau

SEQ ID NO: 2185727 - RNA, 13 nt, Human
acuguuguauaaa

SEQ ID NO: 2185728 - RNA, 20 nt, Human
acuguuguaacuaggcucag

SEQ ID NO: 2185729 - RNA, 13 nt, Human
acuuaauaaugug

SEQ ID NO: 2185730 - RNA, 17 nt, Human
acuuaauaauguguaca

SEQ ID NO: 2185731 - RNA, 21 nt, Human
acuuaauacuaccuugaaaau

SEQ ID NO: 2185732 - RNA, 19 nt, Human
acuuaauacuaccuugaaa

SEQ ID NO: 2185733 - RNA, 18 nt, Human
acuuaauacuaccuugaa

SEQ ID NO: 2185734 - RNA, 17 nt, Human
acuuaauacuaccuuga

SEQ ID NO: 2185735 - RNA, 12 nt, Human
acuguuguauaa

SEQ ID NO: 2185736 - RNA, 15 nt, Human
acuuaaauaauguga

SEQ ID NO: 2185737 - RNA, 16 nt, Human
acuuaaauaaugugaa

SEQ ID NO: 2185738 - RNA, 18 nt, Human
acuuaaauaaugugaaac

SEQ ID NO: 2185739 - RNA, 17 nt, Human
acuuaaauaaugugaaa

SEQ ID NO: 2185740 - RNA, 13 nt, Human
ucuaaaaugaguu

SEQ ID NO: 2185741 - RNA, 23 nt, Human
ucuaaaagguucagggaaccguu

SEQ ID NO: 2185742 - RNA, 11 nt, Human
ucuaaaagaaa

SEQ ID NO: 2185743 - RNA, 17 nt, Human
ucuaaaagauccuuuuu

SEQ ID NO: 2185744 - RNA, 16 nt, Human
ucuaaaagguucaggg

SEQ ID NO: 2185745 - RNA, 14 nt, Human
ucuaaaaacaccaa

SEQ ID NO: 2185746 - RNA, 18 nt, Human
ucuaaaaaacagaggcca

SEQ ID NO: 2185747 - RNA, 11 nt, Human
ucuaaaacaau

SEQ ID NO: 2185748 - RNA, 15 nt, Human
ucuaaaacaauaaaa

SEQ ID NO: 2185749 - RNA, 15 nt, Human
ucuaaaacuaaauag

SEQ ID NO: 2185750 - RNA, 21 nt, Human
ucuaaaacuaaauagcaugua

SEQ ID NO: 2185751 - RNA, 17 nt, Human
ucuaaaacuaaauagca

SEQ ID NO: 2185752 - RNA, 20 nt, Human
ucuaaaacuaaauagcaugu

SEQ ID NO: 2185753 - RNA, 17 nt, Human
ucguuugaaucacagua

SEQ ID NO: 2185754 - RNA, 21 nt, Human
ucguuucaaaaacacaguguu

SEQ ID NO: 2185755 - RNA, 12 nt, Human
ucguuucuguau

SEQ ID NO: 2185756 - RNA, 13 nt, Human
ucguuucuguaua

SEQ ID NO: 2185757 - RNA, 22 nt, Human
ucguuuucaaaauuguuacaaa

SEQ ID NO: 2185758 - RNA, 19 nt, Human
ucgguuucuaacuuggagc

SEQ ID NO: 2185759 - RNA, 20 nt, Human
ucguaaccagccagauccuc

SEQ ID NO: 2185760 - RNA, 13 nt, Human
ucgguuucuccaa

SEQ ID NO: 2185761 - RNA, 15 nt, Human
ucgguuccacguccc

SEQ ID NO: 2185762 - RNA, 23 nt, Human
ucgguuccacgucccccuggggc

SEQ ID NO: 2185763 - RNA, 16 nt, Human
ucguaaaauuaagaaa

SEQ ID NO: 2185764 - RNA, 22 nt, Human
ucgguggagacuaucagcccaa

SEQ ID NO: 2185765 - RNA, 13 nt, Human
ucguaaaauuaag

SEQ ID NO: 2185766 - RNA, 13 nt, Human
ucgguacucccau

SEQ ID NO: 2185767 - RNA, 16 nt, Human
ucgguagguucagcca

SEQ ID NO: 2185768 - RNA, 20 nt, Human
ucgguauccccccaucuugc

SEQ ID NO: 2185769 - RNA, 21 nt, Human
ucgggaggucgaggcaggagg

SEQ ID NO: 2185770 - RNA, 19 nt, Human
ucgggaggucgaggcagga

SEQ ID NO: 2185771 - RNA, 14 nt, Human
ucgggaacaguguu

SEQ ID NO: 2185772 - RNA, 17 nt, Human
ucggcuuuucucagcug

SEQ ID NO: 2185773 - RNA, 16 nt, Human
ucggcugaccaugcuc

SEQ ID NO: 2185774 - RNA, 17 nt, Human
ucgggaggucgaggcag

SEQ ID NO: 2185775 - RNA, 15 nt, Human
ucggcugaccaugcu

SEQ ID NO: 2185776 - RNA, 15 nt, Human
ucggcuccugcugca

SEQ ID NO: 2185777 - RNA, 16 nt, Human
ucggcuccugcugcac

SEQ ID NO: 2185778 - RNA, 17 nt, Human
ucggcuccugcugcacc

SEQ ID NO: 2185779 - RNA, 18 nt, Human
ucggcuccugcugcacca

SEQ ID NO: 2185780 - RNA, 19 nt, Human
ucggcuccccauguguccu

SEQ ID NO: 2185781 - RNA, 12 nt, Human
ucggcucccugg

SEQ ID NO: 2185782 - RNA, 14 nt, Human
ucggcucccuggag

SEQ ID NO: 2185783 - RNA, 11 nt, Human
ucggcuccugc

SEQ ID NO: 2185784 - RNA, 12 nt, Human
ucggcuccugcu

SEQ ID NO: 2185785 - RNA, 13 nt, Human
ucggcuccugcug

SEQ ID NO: 2185786 - RNA, 14 nt, Human
ucggcuccugcugc

SEQ ID NO: 2185787 - RNA, 18 nt, Human
acuguguggacugugaug

SEQ ID NO: 2185788 - RNA, 17 nt, Human
acuguguggacugugau

SEQ ID NO: 2185789 - RNA, 19 nt, Human
acugugugcagacucaaua

SEQ ID NO: 2185790 - RNA, 21 nt, Human
acuguguccuggugcucucug

SEQ ID NO: 2185791 - RNA, 19 nt, Human
acuguguggacugugaugc

SEQ ID NO: 2185792 - RNA, 10 nt, Human
acugugugug

SEQ ID NO: 2185793 - RNA, 18 nt, Human
ucggcucacugcauccuc

SEQ ID NO: 2185794 - RNA, 15 nt, Human
ucgggaacaguguuu

SEQ ID NO: 2185795 - RNA, 14 nt, Human
ucgggcccaccugg

SEQ ID NO: 2185796 - RNA, 17 nt, Human
ucgggcccaccuggcca

SEQ ID NO: 2185797 - RNA, 18 nt, Human
ucgggcccaccuggccac

SEQ ID NO: 2185798 - RNA, 15 nt, Human
ucgggcccagccccc

SEQ ID NO: 2185799 - RNA, 17 nt, Human
ucgggcccaggccaucu

SEQ ID NO: 2185800 - RNA, 21 nt, Human
ucgggcccaccuggccaccug

SEQ ID NO: 2185801 - RNA, 11 nt, Human
ucgggcccagc

SEQ ID NO: 2185802 - RNA, 12 nt, Human
ucgggcccagcc

SEQ ID NO: 2185803 - RNA, 14 nt, Human
ucgggcccagcccc

SEQ ID NO: 2185804 - RNA, 11 nt, Human
ucgggcaugac

SEQ ID NO: 2185805 - RNA, 12 nt, Human
ucgggcaugaca

SEQ ID NO: 2185806 - RNA, 13 nt, Human
ucgggcccuuccc

SEQ ID NO: 2185807 - RNA, 16 nt, Human
ucggggggacagcucc

SEQ ID NO: 2185808 - RNA, 12 nt, Human
ucgggcuccugu

SEQ ID NO: 2185809 - RNA, 13 nt, Human
ucgggggcuggcc

SEQ ID NO: 2185810 - RNA, 16 nt, Human
ucgggggcuggccuag

SEQ ID NO: 2185811 - RNA, 21 nt, Human
ucgguaaguugaauggccugc

SEQ ID NO: 2185812 - RNA, 22 nt, Human
ucggguuuuauuguuuaaaauc

SEQ ID NO: 2185813 - RNA, 13 nt, Human
acuguguccuggu

SEQ ID NO: 2185814 - RNA, 21 nt, Human
acuguguauuccaagacaugu

SEQ ID NO: 2185815 - RNA, 14 nt, Human
acuguguccuggug

SEQ ID NO: 2185816 - RNA, 16 nt, Human
acuguguccuggugcu

SEQ ID NO: 2185817 - RNA, 12 nt, Human
acugugugcuca

SEQ ID NO: 2185818 - RNA, 16 nt, Human
acuguguauuccaaga

SEQ ID NO: 2185819 - RNA, 15 nt, Human
acuguguauuccaag

SEQ ID NO: 2185820 - RNA, 12 nt, Human
acuguguauaga

SEQ ID NO: 2185821 - RNA, 17 nt, Human
acuguguacauaacuga

SEQ ID NO: 2185822 - RNA, 23 nt, Human
acuguguacaguaaauggcuuau

SEQ ID NO: 2185823 - RNA, 15 nt, Human
acugugugcucagga

SEQ ID NO: 2185824 - RNA, 19 nt, Human
acugugugcucaggagccc

SEQ ID NO: 2185825 - RNA, 20 nt, Human
acugugugcucaggagcccu

SEQ ID NO: 2185826 - RNA, 21 nt, Human
acugugugcucaggagcccug

SEQ ID NO: 2185827 - RNA, 18 nt, Human
acuguguacauaacugaa

SEQ ID NO: 2185828 - RNA, 16 nt, Human
acuguguacauaacug

SEQ ID NO: 2185829 - RNA, 12 nt, Human
acuguguacaua

SEQ ID NO: 2185830 - RNA, 14 nt, Human
acugugguccuaug

SEQ ID NO: 2185831 - RNA, 18 nt, Human
acuguggguagacacaca

SEQ ID NO: 2185832 - RNA, 12 nt, Human
acuguggaggaa

SEQ ID NO: 2185833 - RNA, 15 nt, Human
acuguggaggaagga

SEQ ID NO: 2185834 - RNA, 16 nt, Human
acuguggaggaaggau

SEQ ID NO: 2185835 - RNA, 17 nt, Human
acuguggaggaaggauu

SEQ ID NO: 2185836 - RNA, 18 nt, Human
acuguggaggaaggauug

SEQ ID NO: 2185837 - RNA, 21 nt, Human
acugucacuguuucucugcug

SEQ ID NO: 2185838 - RNA, 20 nt, Human
acugucacuguuucucugcu

SEQ ID NO: 2185839 - RNA, 16 nt, Human
acugucacuguuucuc

SEQ ID NO: 2185840 - RNA, 15 nt, Human
acugucacuguuucu

SEQ ID NO: 2185841 - RNA, 21 nt, Human
acugucagcuccccucggaga

SEQ ID NO: 2185842 - RNA, 23 nt, Human
acugucacucauugcugagccuc

SEQ ID NO: 2185843 - RNA, 21 nt, Human
acugggaccuuuagugguggc

SEQ ID NO: 2185844 - RNA, 24 nt, Human
acugucacucauugcugagccucu

SEQ ID NO: 2185845 - RNA, 15 nt, Human
acugucacuguuccu

SEQ ID NO: 2185846 - RNA, 16 nt, Human
acugggaagugacuua

SEQ ID NO: 2185847 - RNA, 23 nt, Human
acugggaagauaggcucugcaca

SEQ ID NO: 2185848 - RNA, 22 nt, Human
acugggaagauaggcucugcac

SEQ ID NO: 2185849 - RNA, 19 nt, Human
acugggaagauaggcucug

SEQ ID NO: 2185850 - RNA, 23 nt, Human
acuggcuuuuauuaaugcacuuu

SEQ ID NO: 2185851 - RNA, 20 nt, Human
acuggcuuuuauuaaugcac

SEQ ID NO: 2185852 - RNA, 21 nt, Human
acuggcuuuuauuaaugcacu

SEQ ID NO: 2185853 - RNA, 16 nt, Human
acugggagaaaugaaa

SEQ ID NO: 2185854 - RNA, 18 nt, Human
acugggacaggggagaac

SEQ ID NO: 2185855 - RNA, 18 nt, Human
acuguccuacccacccuc

SEQ ID NO: 2185856 - RNA, 23 nt, Human
acuguccuacccacccuccuuuc

SEQ ID NO: 2185857 - RNA, 17 nt, Human
acuguccuacccacccu

SEQ ID NO: 2185858 - RNA, 16 nt, Human
acugucagccgggccc

SEQ ID NO: 2185859 - RNA, 19 nt, Human
acugucacuuugcucuggg

SEQ ID NO: 2185860 - RNA, 15 nt, Human
acugucacuuugcuc

SEQ ID NO: 2185861 - RNA, 18 nt, Human
acugucacuuugcucugg

SEQ ID NO: 2185862 - RNA, 19 nt, Human
acuguggaaaaauauuuaa

SEQ ID NO: 2185863 - RNA, 17 nt, Human
acuguggaaaaauauuu

SEQ ID NO: 2185864 - RNA, 15 nt, Human
acuguggaaaaauau

SEQ ID NO: 2185865 - RNA, 14 nt, Human
acuguggaaaaaua

SEQ ID NO: 2185866 - RNA, 11 nt, Human
acugugcuuuc

SEQ ID NO: 2185867 - RNA, 12 nt, Human
acugugcuuucu

SEQ ID NO: 2185868 - RNA, 13 nt, Human
acugugcuuucua

SEQ ID NO: 2185869 - RNA, 14 nt, Human
acugugcuuucuau

SEQ ID NO: 2185870 - RNA, 20 nt, Human
acugugcuuucuauuguaca

SEQ ID NO: 2185871 - RNA, 21 nt, Human
acugugcuuucuauuguacag

SEQ ID NO: 2185872 - RNA, 22 nt, Human
acugugcuuucuauuguacaga

SEQ ID NO: 2185873 - RNA, 22 nt, Human
acugugcuggagccacuaacua

SEQ ID NO: 2185874 - RNA, 18 nt, Human
acugugcuggagccacua

SEQ ID NO: 2185875 - RNA, 21 nt, Human
acugugcuggagccacuaacu

SEQ ID NO: 2185876 - RNA, 16 nt, Human
acugucccuugccuca

SEQ ID NO: 2185877 - RNA, 18 nt, Human
acugucagccgggcccug

SEQ ID NO: 2185878 - RNA, 15 nt, Human
acugugcuggagcca

SEQ ID NO: 2185879 - RNA, 23 nt, Human
acugucccucaaaugacccaaag

SEQ ID NO: 2185880 - RNA, 18 nt, Human
acugcuuguguuuuuaac

SEQ ID NO: 2185881 - RNA, 13 nt, Human
acugcuuguuucc

SEQ ID NO: 2185882 - RNA, 16 nt, Human
acugcuuguuuccuag

SEQ ID NO: 2185883 - RNA, 19 nt, Human
acugcuucaugacauuccu

SEQ ID NO: 2185884 - RNA, 23 nt, Human
acugcuuucuuucguuuguuugu

SEQ ID NO: 2185885 - RNA, 17 nt, Human
acugcuuucuuucguuu

SEQ ID NO: 2185886 - RNA, 14 nt, Human
acuggaguuacauu

SEQ ID NO: 2185887 - RNA, 15 nt, Human
acuggaguuacauua

SEQ ID NO: 2185888 - RNA, 16 nt, Human
acuggaguuacauuaa

SEQ ID NO: 2185889 - RNA, 17 nt, Human
acuggaguuacauuaau

SEQ ID NO: 2185890 - RNA, 13 nt, Human
acuggaguucuau

SEQ ID NO: 2185891 - RNA, 15 nt, Human
acuggaguucuaugc

SEQ ID NO: 2185892 - RNA, 16 nt, Human
acugcuuguguuuuua

SEQ ID NO: 2185893 - RNA, 21 nt, Human
acugcuugugaaaggaaagag

SEQ ID NO: 2185894 - RNA, 17 nt, Human
acugcuuccagugaggc

SEQ ID NO: 2185895 - RNA, 20 nt, Human
acugcuuaacuucacauauu

SEQ ID NO: 2185896 - RNA, 18 nt, Human
acuggauacugcccgggg

SEQ ID NO: 2185897 - RNA, 19 nt, Human
acuggaguucuaugcucuc

SEQ ID NO: 2185898 - RNA, 10 nt, Human
acuggaugaa

SEQ ID NO: 2185899 - RNA, 11 nt, Human
acuggaugaaa

SEQ ID NO: 2185900 - RNA, 22 nt, Human
acuggaugaaauaacuccuucu

SEQ ID NO: 2185901 - RNA, 13 nt, Human
acuggaugaagau

SEQ ID NO: 2185902 - RNA, 15 nt, Human
acuggauuaaacuua

SEQ ID NO: 2185903 - RNA, 18 nt, Human
acuggaugcagaaacagu

SEQ ID NO: 2185904 - RNA, 17 nt, Human
acuggaugcagaaacag

SEQ ID NO: 2185905 - RNA, 14 nt, Human
acuggaugaagauu

SEQ ID NO: 2185906 - RNA, 13 nt, Human
acuggcacaguuu

SEQ ID NO: 2185907 - RNA, 16 nt, Human
acuggccacaguuguu

SEQ ID NO: 2185908 - RNA, 14 nt, Human
acuggccaccaggc

SEQ ID NO: 2185909 - RNA, 15 nt, Human
acuggccaccaggcu

SEQ ID NO: 2185910 - RNA, 17 nt, Human
acuggcauugucccugu

SEQ ID NO: 2185911 - RNA, 21 nt, Human
acuggcauugucccugugccu

SEQ ID NO: 2185912 - RNA, 20 nt, Human
acuggcacaguuuucugaga

SEQ ID NO: 2185913 - RNA, 19 nt, Human
acuggcacaguuuucugag

SEQ ID NO: 2185914 - RNA, 23 nt, Human
acugcuacaaauacucuuaggaa

SEQ ID NO: 2185915 - RNA, 20 nt, Human
acugcuaaguauuucccagc

SEQ ID NO: 2185916 - RNA, 17 nt, Human
acugcuaaguauuuccc

SEQ ID NO: 2185917 - RNA, 18 nt, Human
acugcuaaguauuuccca

SEQ ID NO: 2185918 - RNA, 19 nt, Human
acugcuaaguauuucccag

SEQ ID NO: 2185919 - RNA, 13 nt, Human
acugcuacuguaa

SEQ ID NO: 2185920 - RNA, 19 nt, Human
acugcuccccagcccuggc

SEQ ID NO: 2185921 - RNA, 20 nt, Human
acugcuccccagcccuggcu

SEQ ID NO: 2185922 - RNA, 21 nt, Human
acugcuccccagcccuggcuc

SEQ ID NO: 2185923 - RNA, 18 nt, Human
acugcuaagaauauuuga

SEQ ID NO: 2185924 - RNA, 16 nt, Human
acugcuaagaauauuu

SEQ ID NO: 2185925 - RNA, 16 nt, Human
acugcuaaauaaaauu

SEQ ID NO: 2185926 - RNA, 17 nt, Human
acugcuaaauaaaauuu

SEQ ID NO: 2185927 - RNA, 19 nt, Human
acugcuaaauaaaauuugu

SEQ ID NO: 2185928 - RNA, 20 nt, Human
acugcuaaauaaaauuuguu

SEQ ID NO: 2185929 - RNA, 13 nt, Human
acugccuucucaa

SEQ ID NO: 2185930 - RNA, 19 nt, Human
acugccuucucaacuccaa

SEQ ID NO: 2185931 - RNA, 20 nt, Human
acugccuucucaacuccaaa

SEQ ID NO: 2185932 - RNA, 23 nt, Human
acugccuucgcuucuugccucug

SEQ ID NO: 2185933 - RNA, 13 nt, Human
acugcuaaauaaa

SEQ ID NO: 2185934 - RNA, 14 nt, Human
acugcuaaauaaaa

SEQ ID NO: 2185935 - RNA, 15 nt, Human
acugcuaaauaaaau

SEQ ID NO: 2185936 - RNA, 22 nt, Human
acugcuguaaauaaaugcuuua

SEQ ID NO: 2185937 - RNA, 21 nt, Human
acugcugugcugugcccaagu

SEQ ID NO: 2185938 - RNA, 18 nt, Human
acugcuuaacuucacaua

SEQ ID NO: 2185939 - RNA, 19 nt, Human
acugcugggacuggccagg

SEQ ID NO: 2185940 - RNA, 18 nt, Human
acugcugggacuggccag

SEQ ID NO: 2185941 - RNA, 13 nt, Human
acugcugggacug

SEQ ID NO: 2185942 - RNA, 12 nt, Human
acugcugggugg

SEQ ID NO: 2185943 - RNA, 13 nt, Human
acugcuggguggc

SEQ ID NO: 2185944 - RNA, 16 nt, Human
acugcuggguggccca

SEQ ID NO: 2185945 - RNA, 17 nt, Human
acugcuggguggcccau

SEQ ID NO: 2185946 - RNA, 18 nt, Human
acugcuggguggcccauc

SEQ ID NO: 2185947 - RNA, 19 nt, Human
acugcuggguggcccaucc

SEQ ID NO: 2185948 - RNA, 20 nt, Human
acugcuggguggcccauccc

SEQ ID NO: 2185949 - RNA, 14 nt, Human
acugcuggcugccu

SEQ ID NO: 2185950 - RNA, 15 nt, Human
acugcuggcugccuu

SEQ ID NO: 2185951 - RNA, 23 nt, Human
acugcucccugaagccagccuuc

SEQ ID NO: 2185952 - RNA, 15 nt, Human
acugcucccugaagc

SEQ ID NO: 2185953 - RNA, 16 nt, Human
acugcucccugaagcc

SEQ ID NO: 2185954 - RNA, 17 nt, Human
acugcucccugaagcca

SEQ ID NO: 2185955 - RNA, 18 nt, Human
acugcucccugaagccag

SEQ ID NO: 2185956 - RNA, 19 nt, Human
acugcucccugaagccagc

SEQ ID NO: 2185957 - RNA, 20 nt, Human
acugcucccugaagccagcc

SEQ ID NO: 2185958 - RNA, 21 nt, Human
acugcucccugaagccagccu

SEQ ID NO: 2185959 - RNA, 22 nt, Human
acugcucccugaagccagccuu

SEQ ID NO: 2185960 - RNA, 22 nt, Human
acugcauaccaaccugggcaau

SEQ ID NO: 2185961 - RNA, 21 nt, Human
uccuagagggaggggccuagg

SEQ ID NO: 2185962 - RNA, 20 nt, Human
uccuagagggaggggccuag

SEQ ID NO: 2185963 - RNA, 17 nt, Human
uccuagagggaggggcc

SEQ ID NO: 2185964 - RNA, 14 nt, Human
uccuagaggaccug

SEQ ID NO: 2185965 - RNA, 15 nt, Human
uccuagaggaccuga

SEQ ID NO: 2185966 - RNA, 18 nt, Human
uccuagagacagaagcag

SEQ ID NO: 2185967 - RNA, 19 nt, Human
uccuagagacagaagcagg

SEQ ID NO: 2185968 - RNA, 16 nt, Human
acugcauaugaaagga

SEQ ID NO: 2185969 - RNA, 18 nt, Human
acugcauacuuuuuaaau

SEQ ID NO: 2185970 - RNA, 17 nt, Human
acugcauacuuuuuaaa

SEQ ID NO: 2185971 - RNA, 16 nt, Human
acugcauacuuuuuaa

SEQ ID NO: 2185972 - RNA, 13 nt, Human
acugcauacuuuu

SEQ ID NO: 2185973 - RNA, 22 nt, Human
uccuagaaauuccccacccuga

SEQ ID NO: 2185974 - RNA, 21 nt, Human
uccuagaaauuccccacccug

SEQ ID NO: 2185975 - RNA, 19 nt, Human
uccuagaaguuacugaaug

SEQ ID NO: 2185976 - RNA, 20 nt, Human
uccuagaaguuacugaaugc

SEQ ID NO: 2185977 - RNA, 21 nt, Human
uccuagaaguuacugaaugca

SEQ ID NO: 2185978 - RNA, 17 nt, Human
uccuagagaacgcagcc

SEQ ID NO: 2185979 - RNA, 18 nt, Human
uccuagagaacgcagccc

SEQ ID NO: 2185980 - RNA, 19 nt, Human
uccuagagaacgcagcccu

SEQ ID NO: 2185981 - RNA, 23 nt, Human
uccuagagaacgcagcccuagag

SEQ ID NO: 2185982 - RNA, 20 nt, Human
acugcauccuccgccucccg

SEQ ID NO: 2185983 - RNA, 17 nt, Human
acugcauccuccgccuc

SEQ ID NO: 2185984 - RNA, 23 nt, Human
acugcauacuuuuuaaauguaaa

SEQ ID NO: 2185985 - RNA, 20 nt, Human
acugcauacuuuuuaaaugu

SEQ ID NO: 2185986 - RNA, 20 nt, Human
acugcaucaagaugugacau

SEQ ID NO: 2185987 - RNA, 22 nt, Human
acugcaucaagaugugacaugu

SEQ ID NO: 2185988 - RNA, 23 nt, Human
acugcauccuccgccucccgggu

SEQ ID NO: 2185989 - RNA, 14 nt, Human
acugcaugcacuuc

SEQ ID NO: 2185990 - RNA, 12 nt, Human
acugcaugcacu

SEQ ID NO: 2185991 - RNA, 17 nt, Human
acugcaugcugcuggac

SEQ ID NO: 2185992 - RNA, 16 nt, Human
acugcaugcugcugga

SEQ ID NO: 2185993 - RNA, 13 nt, Human
acugcaugcugcu

SEQ ID NO: 2185994 - RNA, 18 nt, Human
acugcaugcacuucuuac

SEQ ID NO: 2185995 - RNA, 16 nt, Human
acugcauguuugugau

SEQ ID NO: 2185996 - RNA, 15 nt, Human
acugcauguuuguga

SEQ ID NO: 2185997 - RNA, 22 nt, Human
acugccucgggaaccucacucu

SEQ ID NO: 2185998 - RNA, 19 nt, Human
acugccucgaaacacagaa

SEQ ID NO: 2185999 - RNA, 17 nt, Human
acugccucgaaacacag

SEQ ID NO: 2186000 - RNA, 15 nt, Human
acugcauugagaacu

SEQ ID NO: 2186001 - RNA, 12 nt, Human
acugccucaggu

SEQ ID NO: 2186002 - RNA, 13 nt, Human
acugccucagguu

SEQ ID NO: 2186003 - RNA, 15 nt, Human
acugccucagguucc

SEQ ID NO: 2186004 - RNA, 16 nt, Human
acugccucagguuccu

SEQ ID NO: 2186005 - RNA, 16 nt, Human
acugccuauuuuaaua

SEQ ID NO: 2186006 - RNA, 21 nt, Human
acugccuauuuuaauaaacac

SEQ ID NO: 2186007 - RNA, 20 nt, Human
acugcauuaccgcguuguaa

SEQ ID NO: 2186008 - RNA, 21 nt, Human
acugcauuaccgcguuguaaa

SEQ ID NO: 2186009 - RNA, 22 nt, Human
acugcauuaccgcguuguaaaa

SEQ ID NO: 2186010 - RNA, 21 nt, Human
acugcauguaccauuugcaug

SEQ ID NO: 2186011 - RNA, 14 nt, Human
acugcauuauauuu

SEQ ID NO: 2186012 - RNA, 16 nt, Human
acugcauuagaaauua

SEQ ID NO: 2186013 - RNA, 23 nt, Human
acugcauuaccgcguuguaaaau

SEQ ID NO: 2186014 - RNA, 15 nt, Human
acugcauuauauuua

SEQ ID NO: 2186015 - RNA, 16 nt, Human
acugccucucccuggc

SEQ ID NO: 2186016 - RNA, 18 nt, Human
acugccucucccuggccc

SEQ ID NO: 2186017 - RNA, 17 nt, Human
acugccucucccuggcc

SEQ ID NO: 2186018 - RNA, 19 nt, Human
acugccucucccuggcccu

SEQ ID NO: 2186019 - RNA, 14 nt, Human
acugccucuuccuc

SEQ ID NO: 2186020 - RNA, 15 nt, Human
acugccucuuccucc

SEQ ID NO: 2186021 - RNA, 23 nt, Human
acugccugcccacccguggagau

SEQ ID NO: 2186022 - RNA, 22 nt, Human
acugccugcccacccguggaga

SEQ ID NO: 2186023 - RNA, 19 nt, Human
acugccugcccacccgugg

SEQ ID NO: 2186024 - RNA, 16 nt, Human
acugccugcccacccg

SEQ ID NO: 2186025 - RNA, 14 nt, Human
acugccugcccacc

SEQ ID NO: 2186026 - RNA, 13 nt, Human
acugccugcccac

SEQ ID NO: 2186027 - RNA, 12 nt, Human
acugccugccca

SEQ ID NO: 2186028 - RNA, 24 nt, Human
acugccugcagaggucugugcuga

SEQ ID NO: 2186029 - RNA, 9 nt, Human
acugccugc

SEQ ID NO: 2186030 - RNA, 22 nt, Human
acugccugcagaggucugugcu

SEQ ID NO: 2186031 - RNA, 23 nt, Human
acugccugcagaggucugugcug

SEQ ID NO: 2186032 - RNA, 17 nt, Human
acugccugauggaccug

SEQ ID NO: 2186033 - RNA, 20 nt, Human
acugccugauggaccuguca

SEQ ID NO: 2186034 - RNA, 14 nt, Human
acugccuuaaaacu

SEQ ID NO: 2186035 - RNA, 14 nt, Human
acugccugggcucc

SEQ ID NO: 2186036 - RNA, 15 nt, Human
acugccuuaaaacuu

SEQ ID NO: 2186037 - RNA, 16 nt, Human
acugccuuaaaacuuu

SEQ ID NO: 2186038 - RNA, 15 nt, Human
acugccuucgcuucu

SEQ ID NO: 2186039 - RNA, 16 nt, Human
acugccuucgcuucuu

SEQ ID NO: 2186040 - RNA, 17 nt, Human
acugccuucgcuucuug

SEQ ID NO: 2186041 - RNA, 21 nt, Human
acugccuucgcuucuugccuc

SEQ ID NO: 2186042 - RNA, 22 nt, Human
acugccuucgcuucuugccucu

SEQ ID NO: 2186043 - RNA, 14 nt, Human
ucgacuugcauuuu

SEQ ID NO: 2186044 - RNA, 16 nt, Human
ucgaauuaauagcuuu

SEQ ID NO: 2186045 - RNA, 21 nt, Human
ucgaauuaauagcuuuuauug

SEQ ID NO: 2186046 - RNA, 14 nt, Human
ucgagaacuuucau

SEQ ID NO: 2186047 - RNA, 20 nt, Human
ucgaaucuacuaauuccaca

SEQ ID NO: 2186048 - RNA, 14 nt, Human
ucgaaucucugugc

SEQ ID NO: 2186049 - RNA, 16 nt, Human
ucgaaucucugugccu

SEQ ID NO: 2186050 - RNA, 17 nt, Human
ucgaaucucugugccuu

SEQ ID NO: 2186051 - RNA, 15 nt, Human
ucgaauuaauagcuu

SEQ ID NO: 2186052 - RNA, 22 nt, Human
ucgaaucucugugccuucgucu

SEQ ID NO: 2186053 - RNA, 13 nt, Human
ucgagaccagccu

SEQ ID NO: 2186054 - RNA, 18 nt, Human
ucgagaccaaccugacca

SEQ ID NO: 2186055 - RNA, 14 nt, Human
ucgagacagaaccu

SEQ ID NO: 2186056 - RNA, 21 nt, Human
ucgagaagcugcucuggaauu

SEQ ID NO: 2186057 - RNA, 16 nt, Human
ucgagacacagugaag

SEQ ID NO: 2186058 - RNA, 14 nt, Human
ucgagacacuugcc

SEQ ID NO: 2186059 - RNA, 22 nt, Human
ucgagaacuuucauuuuuuucc

SEQ ID NO: 2186060 - RNA, 19 nt, Human
ucgagaagcugcucuggaa

SEQ ID NO: 2186061 - RNA, 15 nt, Human
ucgagaacuuucauu

SEQ ID NO: 2186062 - RNA, 16 nt, Human
ucgagaacuuucauuu

SEQ ID NO: 2186063 - RNA, 17 nt, Human
ucgagaccagccuggcc

SEQ ID NO: 2186064 - RNA, 16 nt, Human
ucgagaccagccuggc

SEQ ID NO: 2186065 - RNA, 14 nt, Human
ucgagaccagccug

SEQ ID NO: 2186066 - RNA, 15 nt, Human
ucgagaccagccugg

SEQ ID NO: 2186067 - RNA, 18 nt, Human
ucgagaccagccuggcca

SEQ ID NO: 2186068 - RNA, 19 nt, Human
ucgagaccagccuggccaa

SEQ ID NO: 2186069 - RNA, 22 nt, Human
uccuuuagcgcccaguugggug

SEQ ID NO: 2186070 - RNA, 23 nt, Human
uccuuuagcgcccaguugggugg

SEQ ID NO: 2186071 - RNA, 23 nt, Human
uccuuucucagccgcuucugacu

SEQ ID NO: 2186072 - RNA, 15 nt, Human
uccuuucucauccca

SEQ ID NO: 2186073 - RNA, 16 nt, Human
uccuuucuccagccag

SEQ ID NO: 2186074 - RNA, 14 nt, Human
uccuuucucagccg

SEQ ID NO: 2186075 - RNA, 15 nt, Human
uccuuucuauugaaa

SEQ ID NO: 2186076 - RNA, 13 nt, Human
uccuuucucaccg

SEQ ID NO: 2186077 - RNA, 19 nt, Human
uccuuuacacucaggcuuu

SEQ ID NO: 2186078 - RNA, 21 nt, Human
uccuuucuaucauuuuuguac

SEQ ID NO: 2186079 - RNA, 11 nt, Human
uccuuucuauc

SEQ ID NO: 2186080 - RNA, 19 nt, Human
ucgaagcucagcccacccc

SEQ ID NO: 2186081 - RNA, 18 nt, Human
ucgaagcucagcccaccc

SEQ ID NO: 2186082 - RNA, 20 nt, Human
uccuuucuuuuucuucuucc

SEQ ID NO: 2186083 - RNA, 14 nt, Human
uccuuucuuuuucu

SEQ ID NO: 2186084 - RNA, 16 nt, Human
uccuuucuuuuucuuc

SEQ ID NO: 2186085 - RNA, 17 nt, Human
uccuuucuuuuucuucu

SEQ ID NO: 2186086 - RNA, 17 nt, Human
uccuuucuccagccagc

SEQ ID NO: 2186087 - RNA, 18 nt, Human
uccuuucuccagccagca

SEQ ID NO: 2186088 - RNA, 15 nt, Human
uccuuucuuucuaac

SEQ ID NO: 2186089 - RNA, 22 nt, Human
uccuuucuugguucauaaauga

SEQ ID NO: 2186090 - RNA, 20 nt, Human
uccuuucuugguucauaaau

SEQ ID NO: 2186091 - RNA, 16 nt, Human
ucgcggcggagcuggc

SEQ ID NO: 2186092 - RNA, 18 nt, Human
ucgcggcggagcuggccc

SEQ ID NO: 2186093 - RNA, 19 nt, Human
ucgcggcggagcuggcccc

SEQ ID NO: 2186094 - RNA, 20 nt, Human
ucgcggcggagcuggccccg

SEQ ID NO: 2186095 - RNA, 15 nt, Human
ucgcgcugccugugu

SEQ ID NO: 2186096 - RNA, 16 nt, Human
ucgcgcugccugugug

SEQ ID NO: 2186097 - RNA, 14 nt, Human
ucgcgcucagcaug

SEQ ID NO: 2186098 - RNA, 12 nt, Human
ucgcgcugccug

SEQ ID NO: 2186099 - RNA, 13 nt, Human
ucgcgcugccugu

SEQ ID NO: 2186100 - RNA, 18 nt, Human
ucgcucaaucaagaaaau

SEQ ID NO: 2186101 - RNA, 18 nt, Human
ucgcuauugucaccaggg

SEQ ID NO: 2186102 - RNA, 20 nt, Human
ucgcgugcccucgcugcuuc

SEQ ID NO: 2186103 - RNA, 16 nt, Human
ucgcgugcccucgcug

SEQ ID NO: 2186104 - RNA, 18 nt, Human
ucgcgugcccucgcugcu

SEQ ID NO: 2186105 - RNA, 14 nt, Human
acuggcuuuuauua

SEQ ID NO: 2186106 - RNA, 18 nt, Human
acuggcuuuuauuaaugc

SEQ ID NO: 2186107 - RNA, 19 nt, Human
acuggcuuuuauuaaugca

SEQ ID NO: 2186108 - RNA, 18 nt, Human
acuggcuuuggcuucuug

SEQ ID NO: 2186109 - RNA, 16 nt, Human
acuggcuuuggcuucu

SEQ ID NO: 2186110 - RNA, 15 nt, Human
acuggcuuuggcuuc

SEQ ID NO: 2186111 - RNA, 13 nt, Human
acuggcuuuggcu

SEQ ID NO: 2186112 - RNA, 21 nt, Human
acuggcugucaguaugacauu

SEQ ID NO: 2186113 - RNA, 17 nt, Human
acuggcugucaguauga

SEQ ID NO: 2186114 - RNA, 17 nt, Human
ucgaggaaccagagcca

SEQ ID NO: 2186115 - RNA, 19 nt, Human
ucgcgacaaugcaaaccau

SEQ ID NO: 2186116 - RNA, 16 nt, Human
ucgcgacaaugcaaac

SEQ ID NO: 2186117 - RNA, 16 nt, Human
ucgagcaugccuggau

SEQ ID NO: 2186118 - RNA, 18 nt, Human
ucgagcaugccuggaugg

SEQ ID NO: 2186119 - RNA, 14 nt, Human
ucgagaccagucug

SEQ ID NO: 2186120 - RNA, 12 nt, Human
uccuuccaccuc

SEQ ID NO: 2186121 - RNA, 22 nt, Human
acuggccucgccuggccugagg

SEQ ID NO: 2186122 - RNA, 23 nt, Human
acuggccucgccuggccugaggu

SEQ ID NO: 2186123 - RNA, 14 nt, Human
uccuuccaccuccc

SEQ ID NO: 2186124 - RNA, 13 nt, Human
uccuuccaggccc

SEQ ID NO: 2186125 - RNA, 17 nt, Human
uccuuccaccucccucc

SEQ ID NO: 2186126 - RNA, 16 nt, Human
uccuucagugccuuau

SEQ ID NO: 2186127 - RNA, 17 nt, Human
uccuucagugccuuaug

SEQ ID NO: 2186128 - RNA, 13 nt, Human
uccuuccaugaaa

SEQ ID NO: 2186129 - RNA, 17 nt, Human
uccuuccaucccuaccc

SEQ ID NO: 2186130 - RNA, 16 nt, Human
uccuuccaucccuacc

SEQ ID NO: 2186131 - RNA, 21 nt, Human
uccuuccaggcccccaccacu

SEQ ID NO: 2186132 - RNA, 16 nt, Human
uccuuccaggccccca

SEQ ID NO: 2186133 - RNA, 15 nt, Human
uccuuccaucaaaua

SEQ ID NO: 2186134 - RNA, 21 nt, Human
uccuuccaguguccuuagaac

SEQ ID NO: 2186135 - RNA, 16 nt, Human
uccuuccuucccuggc

SEQ ID NO: 2186136 - RNA, 15 nt, Human
uccuuccuucccugg

SEQ ID NO: 2186137 - RNA, 14 nt, Human
uccuuccuucccug

SEQ ID NO: 2186138 - RNA, 15 nt, Human
uccuuccuucccacc

SEQ ID NO: 2186139 - RNA, 19 nt, Human
uccuuccuguucugaacug

SEQ ID NO: 2186140 - RNA, 14 nt, Human
uccuuccuucccac

SEQ ID NO: 2186141 - RNA, 16 nt, Human
uccuuccuguucugaa

SEQ ID NO: 2186142 - RNA, 23 nt, Human
uccuucccaaaggacuccaccca

SEQ ID NO: 2186143 - RNA, 18 nt, Human
uccuucccaaaggacucc

SEQ ID NO: 2186144 - RNA, 14 nt, Human
acuggccccugggu

SEQ ID NO: 2186145 - RNA, 15 nt, Human
acuggccccuggguc

SEQ ID NO: 2186146 - RNA, 21 nt, Human
acuggccccuagaaucagccu

SEQ ID NO: 2186147 - RNA, 12 nt, Human
acuggccccugg

SEQ ID NO: 2186148 - RNA, 13 nt, Human
acuggccccuggg

SEQ ID NO: 2186149 - RNA, 23 nt, Human
acuggccaguggcuggaucugug

SEQ ID NO: 2186150 - RNA, 13 nt, Human
acuggccaucucc

SEQ ID NO: 2186151 - RNA, 14 nt, Human
acuggccaucucca

SEQ ID NO: 2186152 - RNA, 23 nt, Human
acuggccaccaggcuggcgcagc

SEQ ID NO: 2186153 - RNA, 21 nt, Human
acuggccaccaggcuggcgca

SEQ ID NO: 2186154 - RNA, 22 nt, Human
acuggccaccaggcuggcgcag

SEQ ID NO: 2186155 - RNA, 16 nt, Human
acuggccaccaggcug

SEQ ID NO: 2186156 - RNA, 17 nt, Human
acuggccaccaggcugg

SEQ ID NO: 2186157 - RNA, 18 nt, Human
acuggccaccaggcuggc

SEQ ID NO: 2186158 - RNA, 19 nt, Human
acuggccaccaggcuggcg

SEQ ID NO: 2186159 - RNA, 17 nt, Human
acuggccccugggucag

SEQ ID NO: 2186160 - RNA, 19 nt, Human
acuggccggagucagugcc

SEQ ID NO: 2186161 - RNA, 22 nt, Human
acuggccggucugcaagucaga

SEQ ID NO: 2186162 - RNA, 16 nt, Human
acuggccucgccuggc

SEQ ID NO: 2186163 - RNA, 23 nt, Human
acuggccggucugcaagucagag

SEQ ID NO: 2186164 - RNA, 14 nt, Human
acuggccucugcug

SEQ ID NO: 2186165 - RNA, 17 nt, Human
acuggccucgccuggcc

SEQ ID NO: 2186166 - RNA, 18 nt, Human
acuggccucgccuggccu

SEQ ID NO: 2186167 - RNA, 19 nt, Human
acuggccucgccuggccug

SEQ ID NO: 2186168 - RNA, 14 nt, Human
uccuucagugccuu

SEQ ID NO: 2186169 - RNA, 15 nt, Human
uccuucagugccuua

SEQ ID NO: 2186170 - RNA, 17 nt, Human
uccuucugaccacagca

SEQ ID NO: 2186171 - RNA, 21 nt, Human
uccuuggugugacccucugaa

SEQ ID NO: 2186172 - RNA, 18 nt, Human
uccuucugccugagcuuc

SEQ ID NO: 2186173 - RNA, 13 nt, Human
uccuucuccuccu

SEQ ID NO: 2186174 - RNA, 12 nt, Human
uccuucucuguc

SEQ ID NO: 2186175 - RNA, 15 nt, Human
uccuucucugucuca

SEQ ID NO: 2186176 - RNA, 15 nt, Human
uccuucugaaguguu

SEQ ID NO: 2186177 - RNA, 20 nt, Human
uccuucucucaccuccuaaa

SEQ ID NO: 2186178 - RNA, 12 nt, Human
uccuucucccuu

SEQ ID NO: 2186179 - RNA, 18 nt, Human
uccuucuaguuucccaca

SEQ ID NO: 2186180 - RNA, 16 nt, Human
uccuuccuugaccagc

SEQ ID NO: 2186181 - RNA, 17 nt, Human
uccuucuaguuucccac

SEQ ID NO: 2186182 - RNA, 16 nt, Human
uccuucuaguuuccca

SEQ ID NO: 2186183 - RNA, 19 nt, Human
uccuuccuugcuguccuag

SEQ ID NO: 2186184 - RNA, 12 nt, Human
uccuugugcaug

SEQ ID NO: 2186185 - RNA, 18 nt, Human
uccuuguggccugggccu

SEQ ID NO: 2186186 - RNA, 19 nt, Human
uccuuguggccugggccuc

SEQ ID NO: 2186187 - RNA, 17 nt, Human
uccuugugguuuauguc

SEQ ID NO: 2186188 - RNA, 15 nt, Human
uccuuguauuuaaau

SEQ ID NO: 2186189 - RNA, 13 nt, Human
uccuugucacugg

SEQ ID NO: 2186190 - RNA, 15 nt, Human
uccuuguccacccac

SEQ ID NO: 2186191 - RNA, 16 nt, Human
uccuuguccacccacc

SEQ ID NO: 2186192 - RNA, 13 nt, Human
uccuuguccccac

SEQ ID NO: 2186193 - RNA, 14 nt, Human
uccuuguccccaca

SEQ ID NO: 2186194 - RNA, 16 nt, Human
uccuuguccccacacu

SEQ ID NO: 2186195 - RNA, 17 nt, Human
uccuuguccccacacuc

SEQ ID NO: 2186196 - RNA, 18 nt, Human
uccuuguccccacacucc

SEQ ID NO: 2186197 - RNA, 19 nt, Human
uccuuguccccacacuccu

SEQ ID NO: 2186198 - RNA, 20 nt, Human
uccuuguccccacacuccua

SEQ ID NO: 2186199 - RNA, 22 nt, Human
uccuuguccccacacuccuaca

SEQ ID NO: 2186200 - RNA, 21 nt, Human
uccuuuaauuuuuuacuauuu

SEQ ID NO: 2186201 - RNA, 21 nt, Human
uccuuuaaaaaaauuuaagug

SEQ ID NO: 2186202 - RNA, 12 nt, Human
uccuuuacacau

SEQ ID NO: 2186203 - RNA, 22 nt, Human
uccuuuacacauucggcucccu

SEQ ID NO: 2186204 - RNA, 15 nt, Human
uccuuuagcgcccag

SEQ ID NO: 2186205 - RNA, 19 nt, Human
uccuuuagcgcccaguugg

SEQ ID NO: 2186206 - RNA, 17 nt, Human
uccuuuaaauccuucca

SEQ ID NO: 2186207 - RNA, 22 nt, Human
uccuuguuucaaacacaaaugc

SEQ ID NO: 2186208 - RNA, 16 nt, Human
uccuuuaaaaaaauuu

SEQ ID NO: 2186209 - RNA, 22 nt, Human
uccuuuaaaaaaauuuaagugc

SEQ ID NO: 2186210 - RNA, 14 nt, Human
uccuuguuccuaga

SEQ ID NO: 2186211 - RNA, 19 nt, Human
uccuugugguuuaugucau

SEQ ID NO: 2186212 - RNA, 22 nt, Human
uccuugugguuuaugucaucau

SEQ ID NO: 2186213 - RNA, 13 nt, Human
uccuuguuucaaa

SEQ ID NO: 2186214 - RNA, 14 nt, Human
uccuuguuucaaac

SEQ ID NO: 2186215 - RNA, 23 nt, Human
uccuuguguuacuaaguuuuuau

SEQ ID NO: 2186216 - RNA, 14 nt, Human
uccuuguguuacua

SEQ ID NO: 2186217 - RNA, 14 nt, Human
ucccuggggugggg

SEQ ID NO: 2186218 - RNA, 20 nt, Human
ucccugggggaagcccugga

SEQ ID NO: 2186219 - RNA, 19 nt, Human
ucccugggggaagcccugg

SEQ ID NO: 2186220 - RNA, 18 nt, Human
ucccugggggaagcccug

SEQ ID NO: 2186221 - RNA, 21 nt, Human
acuccugcaggcagccaggcc

SEQ ID NO: 2186222 - RNA, 19 nt, Human
ucccuggucccuuggagac

SEQ ID NO: 2186223 - RNA, 14 nt, Human
ucccuggucccuug

SEQ ID NO: 2186224 - RNA, 21 nt, Human
ucccugguaauaaguacugug

SEQ ID NO: 2186225 - RNA, 13 nt, Human
ucccuggucccuu

SEQ ID NO: 2186226 - RNA, 21 nt, Human
ucccugggggaagcccuggau

SEQ ID NO: 2186227 - RNA, 15 nt, Human
ucccuguccuccucg

SEQ ID NO: 2186228 - RNA, 20 nt, Human
ucccugugccuaacaccagc

SEQ ID NO: 2186229 - RNA, 16 nt, Human
ucccugucggccuggu

SEQ ID NO: 2186230 - RNA, 14 nt, Human
ucccuguccuccuc

SEQ ID NO: 2186231 - RNA, 12 nt, Human
ucccuguccucc

SEQ ID NO: 2186232 - RNA, 14 nt, Human
ucccugucccucua

SEQ ID NO: 2186233 - RNA, 12 nt, Human
ucccugucccag

SEQ ID NO: 2186234 - RNA, 15 nt, Human
ucccugguggcagcu

SEQ ID NO: 2186235 - RNA, 19 nt, Human
ucccuuuccuuccaucccu

SEQ ID NO: 2186236 - RNA, 18 nt, Human
ucccuuuccuuccauccc

SEQ ID NO: 2186237 - RNA, 23 nt, Human
ucccuuuccuuccaucccuaccc

SEQ ID NO: 2186238 - RNA, 14 nt, Human
ucccuuucuccccu

SEQ ID NO: 2186239 - RNA, 15 nt, Human
ucccuuucuccccug

SEQ ID NO: 2186240 - RNA, 16 nt, Human
ucccuuucuccccugc

SEQ ID NO: 2186241 - RNA, 17 nt, Human
ucccuuucuccccugcc

SEQ ID NO: 2186242 - RNA, 18 nt, Human
ucccuuucuccccugccc

SEQ ID NO: 2186243 - RNA, 17 nt, Human
ucccuuuccuuccaucc

SEQ ID NO: 2186244 - RNA, 14 nt, Human
ucccuuuccuucca

SEQ ID NO: 2186245 - RNA, 17 nt, Human
ucccuuacgugaguccu

SEQ ID NO: 2186246 - RNA, 11 nt, Human
ucccuguuuuc

SEQ ID NO: 2186247 - RNA, 15 nt, Human
ucccuguuuucugag

SEQ ID NO: 2186248 - RNA, 18 nt, Human
ucccuguuuucugagccc

SEQ ID NO: 2186249 - RNA, 19 nt, Human
ucccuguuuucugagcccg

SEQ ID NO: 2186250 - RNA, 21 nt, Human
ucccuguuuucugagcccggg

SEQ ID NO: 2186251 - RNA, 20 nt, Human
ucccugugcugacggaagcc

SEQ ID NO: 2186252 - RNA, 22 nt, Human
ucccuuaaacaaaaauuaaaau

SEQ ID NO: 2186253 - RNA, 18 nt, Human
ucccuuaaaauagaaaua

SEQ ID NO: 2186254 - RNA, 15 nt, Human
ucccuuaaacaaaaa

SEQ ID NO: 2186255 - RNA, 22 nt, Human
ucccuguuuucugagcccgggc

SEQ ID NO: 2186256 - RNA, 23 nt, Human
ucccuguuuucugagcccgggcu

SEQ ID NO: 2186257 - RNA, 16 nt, Human
uccuagaaauucccca

SEQ ID NO: 2186258 - RNA, 14 nt, Human
uccuacuuccccuu

SEQ ID NO: 2186259 - RNA, 16 nt, Human
uccuaacacagcaugu

SEQ ID NO: 2186260 - RNA, 16 nt, Human
uccuaagagugcuggg

SEQ ID NO: 2186261 - RNA, 13 nt, Human
uccuaagaaagag

SEQ ID NO: 2186262 - RNA, 20 nt, Human
uccuaagaaagaggagugcu

SEQ ID NO: 2186263 - RNA, 22 nt, Human
uccuaagaaagaggagugcuug

SEQ ID NO: 2186264 - RNA, 19 nt, Human
uccuaaaugcagugaauug

SEQ ID NO: 2186265 - RNA, 15 nt, Human
uccuaaaugcaguga

SEQ ID NO: 2186266 - RNA, 20 nt, Human
uccggguuugagauggacac

SEQ ID NO: 2186267 - RNA, 19 nt, Human
uccuaaauauauuuuaaga

SEQ ID NO: 2186268 - RNA, 17 nt, Human
uccggucccugucccag

SEQ ID NO: 2186269 - RNA, 22 nt, Human
uccgggggcagcucuggagggg

SEQ ID NO: 2186270 - RNA, 22 nt, Human
uccggguuugagauggacacac

SEQ ID NO: 2186271 - RNA, 21 nt, Human
ucccuuucuuggccaguuauc

SEQ ID NO: 2186272 - RNA, 20 nt, Human
ucccuuuuacauacugcugu

SEQ ID NO: 2186273 - RNA, 12 nt, Human
ucccuuuuccuu

SEQ ID NO: 2186274 - RNA, 19 nt, Human
ucccuuuuacauacugcug

SEQ ID NO: 2186275 - RNA, 17 nt, Human
ucccuuuuacauacugc

SEQ ID NO: 2186276 - RNA, 17 nt, Human
ucccuuucuuggccagu

SEQ ID NO: 2186277 - RNA, 16 nt, Human
ucccuuucuuggccag

SEQ ID NO: 2186278 - RNA, 13 nt, Human
ucccuuuuacaua

SEQ ID NO: 2186279 - RNA, 13 nt, Human
ucccuuucuuggc

SEQ ID NO: 2186280 - RNA, 23 nt, Human
ucccuuucuccccugcccccagg

SEQ ID NO: 2186281 - RNA, 19 nt, Human
ucccuuucugcuuguguua

SEQ ID NO: 2186282 - RNA, 20 nt, Human
ucccuuuuuauaucccauuu

SEQ ID NO: 2186283 - RNA, 15 nt, Human
ucccuuuugcaucau

SEQ ID NO: 2186284 - RNA, 23 nt, Human
ucccuuuugcggaugggaggggu

SEQ ID NO: 2186285 - RNA, 14 nt, Human
ucccuuuuuccuug

SEQ ID NO: 2186286 - RNA, 15 nt, Human
ucccuuuuuccuugu

SEQ ID NO: 2186287 - RNA, 16 nt, Human
ucccuuuuuccuuguc

SEQ ID NO: 2186288 - RNA, 17 nt, Human
ucccuuuuuccuugucc

SEQ ID NO: 2186289 - RNA, 21 nt, Human
ucccuuuuuccuuguccccac

SEQ ID NO: 2186290 - RNA, 15 nt, Human
ucccuuuuugaagug

SEQ ID NO: 2186291 - RNA, 16 nt, Human
ucccuuuuugaagugu

SEQ ID NO: 2186292 - RNA, 16 nt, Human
uccggggagcgcccgc

SEQ ID NO: 2186293 - RNA, 23 nt, Human
uccgggagggugcggcugugcag

SEQ ID NO: 2186294 - RNA, 21 nt, Human
uccgggaccuggugcugccuc

SEQ ID NO: 2186295 - RNA, 14 nt, Human
uccggcuccugugc

SEQ ID NO: 2186296 - RNA, 16 nt, Human
uccggcuccugugcuu

SEQ ID NO: 2186297 - RNA, 17 nt, Human
uccggcuccugugcuuu

SEQ ID NO: 2186298 - RNA, 22 nt, Human
uccggcuccugugcuuucccug

SEQ ID NO: 2186299 - RNA, 13 nt, Human
acucauguguaug

SEQ ID NO: 2186300 - RNA, 21 nt, Human
acucauguguaugggcaaaaa

SEQ ID NO: 2186301 - RNA, 10 nt, Human
acucaugugu

SEQ ID NO: 2186302 - RNA, 11 nt, Human
acucaugugua

SEQ ID NO: 2186303 - RNA, 12 nt, Human
acucauguguau

SEQ ID NO: 2186304 - RNA, 15 nt, Human
acucagaaacaucag

SEQ ID NO: 2186305 - RNA, 14 nt, Human
acucagaaacauca

SEQ ID NO: 2186306 - RNA, 15 nt, Human
acucacuuucuagau

SEQ ID NO: 2186307 - RNA, 15 nt, Human
acucauucuucugua

SEQ ID NO: 2186308 - RNA, 14 nt, Human
acucauugaccuga

SEQ ID NO: 2186309 - RNA, 23 nt, Human
acucauucagggauagcacugag

SEQ ID NO: 2186310 - RNA, 13 nt, Human
acucauuccugua

SEQ ID NO: 2186311 - RNA, 19 nt, Human
acucauucugaaggagccc

SEQ ID NO: 2186312 - RNA, 15 nt, Human
acucauucugaagga

SEQ ID NO: 2186313 - RNA, 21 nt, Human
acucauucaaaaguugaaauu

SEQ ID NO: 2186314 - RNA, 13 nt, Human
acucauucaaaag

SEQ ID NO: 2186315 - RNA, 15 nt, Human
acucauugaccugag

SEQ ID NO: 2186316 - RNA, 14 nt, Human
acuccaaagaaaug

SEQ ID NO: 2186317 - RNA, 18 nt, Human
acuccaaagaaauguaag

SEQ ID NO: 2186318 - RNA, 15 nt, Human
acuccaaagaaaugu

SEQ ID NO: 2186319 - RNA, 21 nt, Human
acuccaaagaaauguaaggga

SEQ ID NO: 2186320 - RNA, 15 nt, Human
acuccagaauuuccc

SEQ ID NO: 2186321 - RNA, 17 nt, Human
acuccagaauuucccaa

SEQ ID NO: 2186322 - RNA, 14 nt, Human
acuccagccugggc

SEQ ID NO: 2186323 - RNA, 13 nt, Human
acuccuccuagcc

SEQ ID NO: 2186324 - RNA, 14 nt, Human
acuccuccuagcca

SEQ ID NO: 2186325 - RNA, 13 nt, Human
acuccagccuggg

SEQ ID NO: 2186326 - RNA, 18 nt, Human
acuccuccuagccaccca

SEQ ID NO: 2186327 - RNA, 23 nt, Human
acuccuccuccaaaggcccccua

SEQ ID NO: 2186328 - RNA, 16 nt, Human
acuccuccuagccacc

SEQ ID NO: 2186329 - RNA, 15 nt, Human
acuccuccuagccac

SEQ ID NO: 2186330 - RNA, 19 nt, Human
acuccagccuggcgacaga

SEQ ID NO: 2186331 - RNA, 20 nt, Human
acuccagccugagcaacaga

SEQ ID NO: 2186332 - RNA, 19 nt, Human
acuccagccugagcaacag

SEQ ID NO: 2186333 - RNA, 15 nt, Human
acuccagccugagca

SEQ ID NO: 2186334 - RNA, 12 nt, Human
acuccagccugg

SEQ ID NO: 2186335 - RNA, 14 nt, Human
acuccagccugagc

SEQ ID NO: 2186336 - RNA, 13 nt, Human
acuccagccugag

SEQ ID NO: 2186337 - RNA, 23 nt, Human
acuccagaauuucccaaagcagu

SEQ ID NO: 2186338 - RNA, 14 nt, Human
acuccucuguccag

SEQ ID NO: 2186339 - RNA, 14 nt, Human
acuccucuuauuug

SEQ ID NO: 2186340 - RNA, 16 nt, Human
acuccucuuauuugcu

SEQ ID NO: 2186341 - RNA, 13 nt, Human
acuccucugucca

SEQ ID NO: 2186342 - RNA, 20 nt, Human
acuccucugcagugccuugg

SEQ ID NO: 2186343 - RNA, 20 nt, Human
acuccucugacucagggcuc

SEQ ID NO: 2186344 - RNA, 12 nt, Human
acuccucugcag

SEQ ID NO: 2186345 - RNA, 17 nt, Human
acuccucugcagugccu

SEQ ID NO: 2186346 - RNA, 14 nt, Human
acuccucugacuca

SEQ ID NO: 2186347 - RNA, 21 nt, Human
acuccucuaagccacucuucc

SEQ ID NO: 2186348 - RNA, 23 nt, Human
acuccucuaagccacucuuccaa

SEQ ID NO: 2186349 - RNA, 16 nt, Human
acuccucggccuggcu

SEQ ID NO: 2186350 - RNA, 21 nt, Human
acuccuccuccaaaggccccc

SEQ ID NO: 2186351 - RNA, 22 nt, Human
acuccuccuccaaaggcccccu

SEQ ID NO: 2186352 - RNA, 17 nt, Human
acuccucggccuggcuc

SEQ ID NO: 2186353 - RNA, 19 nt, Human
acuccucggccuggcuccu

SEQ ID NO: 2186354 - RNA, 23 nt, Human
acuccucggccuggcuccuaccc

SEQ ID NO: 2186355 - RNA, 18 nt, Human
acuccucgguacucccau

SEQ ID NO: 2186356 - RNA, 18 nt, Human
acuccugcaggcagccag

SEQ ID NO: 2186357 - RNA, 19 nt, Human
acuccugcaggcagccagg

SEQ ID NO: 2186358 - RNA, 17 nt, Human
acuccugcaggcagcca

SEQ ID NO: 2186359 - RNA, 19 nt, Human
acuccugacagucuugugc

SEQ ID NO: 2186360 - RNA, 21 nt, Human
acuccugacagucuugugcuu

SEQ ID NO: 2186361 - RNA, 15 nt, Human
acuccugacagucuu

SEQ ID NO: 2186362 - RNA, 21 nt, Human
uccccuuuguauuccuuaaau

SEQ ID NO: 2186363 - RNA, 20 nt, Human
uccccuuuucuuuucuaccc

SEQ ID NO: 2186364 - RNA, 20 nt, Human
ucccgaauagcugggacuac

SEQ ID NO: 2186365 - RNA, 15 nt, Human
ucccgaguagcuggg

SEQ ID NO: 2186366 - RNA, 17 nt, Human
uccccuuuuauugcugc

SEQ ID NO: 2186367 - RNA, 19 nt, Human
ucccgagcaaagucuaaag

SEQ ID NO: 2186368 - RNA, 20 nt, Human
ucccgagcaaagucuaaagu

SEQ ID NO: 2186369 - RNA, 22 nt, Human
ucccgagcaccuccacauccuc

SEQ ID NO: 2186370 - RNA, 18 nt, Human
ucccgaguagcugggacu

SEQ ID NO: 2186371 - RNA, 20 nt, Human
ucccgaguagcugagauuau

SEQ ID NO: 2186372 - RNA, 16 nt, Human
ucccgaguagcuggga

SEQ ID NO: 2186373 - RNA, 17 nt, Human
ucccgaguagcugggac

SEQ ID NO: 2186374 - RNA, 17 nt, Human
uccccuugggcggcuga

SEQ ID NO: 2186375 - RNA, 22 nt, Human
uccccuugggcggcugagagcc

SEQ ID NO: 2186376 - RNA, 14 nt, Human
uccccuugggcggc

SEQ ID NO: 2186377 - RNA, 19 nt, Human
uccccuugcccuugcccug

SEQ ID NO: 2186378 - RNA, 20 nt, Human
uccccuugcccuugcccuga

SEQ ID NO: 2186379 - RNA, 21 nt, Human
uccccuugcccuugcccugac

SEQ ID NO: 2186380 - RNA, 23 nt, Human
uccccuugcccuugcccugaccu

SEQ ID NO: 2186381 - RNA, 24 nt, Human
uccccuugcccagggcucagccug

SEQ ID NO: 2186382 - RNA, 14 nt, Human
uccccuugcccuug

SEQ ID NO: 2186383 - RNA, 18 nt, Human
uccccuugcccuugcccu

SEQ ID NO: 2186384 - RNA, 22 nt, Human
uccccuugcccagggcucagcc

SEQ ID NO: 2186385 - RNA, 20 nt, Human
uccccuugcccagggcucag

SEQ ID NO: 2186386 - RNA, 16 nt, Human
uccccucuccuuccug

SEQ ID NO: 2186387 - RNA, 17 nt, Human
uccccuugcccagggcu

SEQ ID NO: 2186388 - RNA, 15 nt, Human
uccccucuccuuccu

SEQ ID NO: 2186389 - RNA, 22 nt, Human
uccccuccuugccuccugugua

SEQ ID NO: 2186390 - RNA, 21 nt, Human
uccccucccuggcucccauga

SEQ ID NO: 2186391 - RNA, 19 nt, Human
uccccucccuggcucccau

SEQ ID NO: 2186392 - RNA, 16 nt, Human
uccccucccuggcucc

SEQ ID NO: 2186393 - RNA, 15 nt, Human
uccccucccuggcuc

SEQ ID NO: 2186394 - RNA, 16 nt, Human
uccccucggagaagag

SEQ ID NO: 2186395 - RNA, 17 nt, Human
uccccucuauuuagcau

SEQ ID NO: 2186396 - RNA, 23 nt, Human
uccccuccuugccuccuguguaa

SEQ ID NO: 2186397 - RNA, 12 nt, Human
uccccuccuugg

SEQ ID NO: 2186398 - RNA, 14 nt, Human
uccccuccuugggc

SEQ ID NO: 2186399 - RNA, 18 nt, Human
uccccuccuugggcacuu

SEQ ID NO: 2186400 - RNA, 17 nt, Human
uccccucggagaagagc

SEQ ID NO: 2186401 - RNA, 17 nt, Human
acuacucagggaaugaa

SEQ ID NO: 2186402 - RNA, 15 nt, Human
acuacucagggaaug

SEQ ID NO: 2186403 - RNA, 20 nt, Human
acuacuccggagacaggguu

SEQ ID NO: 2186404 - RNA, 14 nt, Human
acuacuccucugca

SEQ ID NO: 2186405 - RNA, 19 nt, Human
acuacuccucugcagugcc

SEQ ID NO: 2186406 - RNA, 21 nt, Human
acuacuccucugcagugccuu

SEQ ID NO: 2186407 - RNA, 21 nt, Human
acucacauuuauucugcucac

SEQ ID NO: 2186408 - RNA, 12 nt, Human
acucaccccagc

SEQ ID NO: 2186409 - RNA, 17 nt, Human
acucaccaguguccccu

SEQ ID NO: 2186410 - RNA, 19 nt, Human
acucaccaguguccccucc

SEQ ID NO: 2186411 - RNA, 23 nt, Human
acucaccaguguccccuccacug

SEQ ID NO: 2186412 - RNA, 13 nt, Human
acucaccaucugu

SEQ ID NO: 2186413 - RNA, 15 nt, Human
acucaccaucugugc

SEQ ID NO: 2186414 - RNA, 17 nt, Human
acuacucccccaggugg

SEQ ID NO: 2186415 - RNA, 17 nt, Human
acuaccuccucagggau

SEQ ID NO: 2186416 - RNA, 19 nt, Human
acuaccuccucagggaugg

SEQ ID NO: 2186417 - RNA, 14 nt, Human
acuacuagggaaau

SEQ ID NO: 2186418 - RNA, 21 nt, Human
acuacuagggaaaugccuuug

SEQ ID NO: 2186419 - RNA, 13 nt, Human
uccccuaaugccu

SEQ ID NO: 2186420 - RNA, 17 nt, Human
uccccuaccacugucuu

SEQ ID NO: 2186421 - RNA, 17 nt, Human
uccccuaguaagugccu

SEQ ID NO: 2186422 - RNA, 23 nt, Human
uccccuacccccuccucucugcc

SEQ ID NO: 2186423 - RNA, 12 nt, Human
acucacccaagc

SEQ ID NO: 2186424 - RNA, 17 nt, Human
acucacccaugugccaa

SEQ ID NO: 2186425 - RNA, 15 nt, Human
acucaccauguaaaa

SEQ ID NO: 2186426 - RNA, 14 nt, Human
acucaccaucugug

SEQ ID NO: 2186427 - RNA, 20 nt, Human
uccccuaagcagaccacuga

SEQ ID NO: 2186428 - RNA, 18 nt, Human
acucacccaugugccaag

SEQ ID NO: 2186429 - RNA, 21 nt, Human
acucacccaugugccaaggug

SEQ ID NO: 2186430 - RNA, 17 nt, Human
uccccuauccacccagc

SEQ ID NO: 2186431 - RNA, 16 nt, Human
uccccuauccacccag

SEQ ID NO: 2186432 - RNA, 15 nt, Human
uccccuauccaccca

SEQ ID NO: 2186433 - RNA, 22 nt, Human
uccccuaguaagugccuuccau

SEQ ID NO: 2186434 - RNA, 18 nt, Human
uccccuaguaagugccuu

SEQ ID NO: 2186435 - RNA, 20 nt, Human
uccccuaguaagugccuucc

SEQ ID NO: 2186436 - RNA, 21 nt, Human
uccccuaguaagugccuucca

SEQ ID NO: 2186437 - RNA, 21 nt, Human
uccccuauccacccagcccau

SEQ ID NO: 2186438 - RNA, 20 nt, Human
uccccuauccacccagccca

SEQ ID NO: 2186439 - RNA, 18 nt, Human
uccccuauccacccagcc

SEQ ID NO: 2186440 - RNA, 19 nt, Human
uccccuauggggauggucc

SEQ ID NO: 2186441 - RNA, 14 nt, Human
uccccucaaagucu

SEQ ID NO: 2186442 - RNA, 13 nt, Human
uccccucccuggc

SEQ ID NO: 2186443 - RNA, 16 nt, Human
uccccucccuccucug

SEQ ID NO: 2186444 - RNA, 12 nt, Human
uccccucccugg

SEQ ID NO: 2186445 - RNA, 14 nt, Human
uccccucccuccuc

SEQ ID NO: 2186446 - RNA, 17 nt, Human
uccccuccccugcugca

SEQ ID NO: 2186447 - RNA, 15 nt, Human
uccccuccccugcug

SEQ ID NO: 2186448 - RNA, 16 nt, Human
uccccuccccugcugc

SEQ ID NO: 2186449 - RNA, 14 nt, Human
uccccucccaucug

SEQ ID NO: 2186450 - RNA, 15 nt, Human
uccccucccaucugg

SEQ ID NO: 2186451 - RNA, 17 nt, Human
uccccucccaucuggga

SEQ ID NO: 2186452 - RNA, 18 nt, Human
uccccuccccggcccuac

SEQ ID NO: 2186453 - RNA, 13 nt, Human
uccccuccccugc

SEQ ID NO: 2186454 - RNA, 14 nt, Human
uccccuccccugcu

SEQ ID NO: 2186455 - RNA, 13 nt, Human
uccccucacagcc

SEQ ID NO: 2186456 - RNA, 17 nt, Human
uccccucaaagucugca

SEQ ID NO: 2186457 - RNA, 18 nt, Human
uccccucaaagucugcaa

SEQ ID NO: 2186458 - RNA, 16 nt, Human
uccccucacagccucu

SEQ ID NO: 2186459 - RNA, 21 nt, Human
uccccucaaagucugcaacuu

SEQ ID NO: 2186460 - RNA, 14 nt, Human
uccccucacagccu

SEQ ID NO: 2186461 - RNA, 11 nt, Human
uccccucccau

SEQ ID NO: 2186462 - RNA, 18 nt, Human
ucccuccacguucacccc

SEQ ID NO: 2186463 - RNA, 19 nt, Human
ucccuccacguucaccccu

SEQ ID NO: 2186464 - RNA, 20 nt, Human
ucccuccacguucaccccuc

SEQ ID NO: 2186465 - RNA, 23 nt, Human
ucccuccacuccuuccugccacc

SEQ ID NO: 2186466 - RNA, 13 nt, Human
ucccucccaccuc

SEQ ID NO: 2186467 - RNA, 14 nt, Human
ucccucccaccucu

SEQ ID NO: 2186468 - RNA, 15 nt, Human
ucccucccaccucug

SEQ ID NO: 2186469 - RNA, 16 nt, Human
ucccucccaccucugu

SEQ ID NO: 2186470 - RNA, 19 nt, Human
ucccucccaccucugugac

SEQ ID NO: 2186471 - RNA, 21 nt, Human
ucccucccaccucugugaccu

SEQ ID NO: 2186472 - RNA, 22 nt, Human
ucccggcugcccuuucugggca

SEQ ID NO: 2186473 - RNA, 18 nt, Human
ucccggcugcccuuucug

SEQ ID NO: 2186474 - RNA, 15 nt, Human
ucccggcugcccuuu

SEQ ID NO: 2186475 - RNA, 14 nt, Human
ucccggcugcccuu

SEQ ID NO: 2186476 - RNA, 13 nt, Human
ucccggcugcccu

SEQ ID NO: 2186477 - RNA, 14 nt, Human
ucccucuuucccuc

SEQ ID NO: 2186478 - RNA, 20 nt, Human
ucccucuuucccucccuucc

SEQ ID NO: 2186479 - RNA, 18 nt, Human
ucccucuuucccucccuu

SEQ ID NO: 2186480 - RNA, 21 nt, Human
ucccucuuucccucccuuccu

SEQ ID NO: 2186481 - RNA, 20 nt, Human
ucccugaaggaaccaaagcg

SEQ ID NO: 2186482 - RNA, 20 nt, Human
ucccucccggcaugggaaag

SEQ ID NO: 2186483 - RNA, 11 nt, Human
ucccugaaggc

SEQ ID NO: 2186484 - RNA, 15 nt, Human
ucccugaaggccccg

SEQ ID NO: 2186485 - RNA, 13 nt, Human
acucacuccugag

SEQ ID NO: 2186486 - RNA, 14 nt, Human
acucacuccugaga

SEQ ID NO: 2186487 - RNA, 16 nt, Human
acucacuccugagacc

SEQ ID NO: 2186488 - RNA, 21 nt, Human
acucacuaggcccccacuugc

SEQ ID NO: 2186489 - RNA, 22 nt, Human
acucacuaggcccccacuugcc

SEQ ID NO: 2186490 - RNA, 14 nt, Human
acucacuaggcccc

SEQ ID NO: 2186491 - RNA, 15 nt, Human
acucacuaggccccc

SEQ ID NO: 2186492 - RNA, 17 nt, Human
acucacuaggcccccac

SEQ ID NO: 2186493 - RNA, 22 nt, Human
acucacuggggccuacagcuuu

SEQ ID NO: 2186494 - RNA, 15 nt, Human
acucacugcucaaga

SEQ ID NO: 2186495 - RNA, 22 nt, Human
acucacugcucaagaagacaug

SEQ ID NO: 2186496 - RNA, 22 nt, Human
acucacuccugagaccccuggc

SEQ ID NO: 2186497 - RNA, 20 nt, Human
acucacuccugagaccccug

SEQ ID NO: 2186498 - RNA, 21 nt, Human
acucacuccugagaccccugg

SEQ ID NO: 2186499 - RNA, 23 nt, Human
acucacgauaaauaaucggccca

SEQ ID NO: 2186500 - RNA, 23 nt, Human
acucaccuggggcugcuggccug

SEQ ID NO: 2186501 - RNA, 15 nt, Human
acucaccuguuacuu

SEQ ID NO: 2186502 - RNA, 14 nt, Human
acucaccuggggcu

SEQ ID NO: 2186503 - RNA, 18 nt, Human
acucaccuggggcugcug

SEQ ID NO: 2186504 - RNA, 19 nt, Human
acucaccuggggcugcugg

SEQ ID NO: 2186505 - RNA, 20 nt, Human
acucaccuggggcugcuggc

SEQ ID NO: 2186506 - RNA, 20 nt, Human
acucaccugcuggccccuca

SEQ ID NO: 2186507 - RNA, 12 nt, Human
acucaccugggg

SEQ ID NO: 2186508 - RNA, 19 nt, Human
acucaccugcuggccccuc

SEQ ID NO: 2186509 - RNA, 18 nt, Human
acucaccugcuggccccu

SEQ ID NO: 2186510 - RNA, 17 nt, Human
acucaccugcuggcccc

SEQ ID NO: 2186511 - RNA, 16 nt, Human
acucaccugcuggccc

SEQ ID NO: 2186512 - RNA, 13 nt, Human
acucaccugcugg

SEQ ID NO: 2186513 - RNA, 21 nt, Human
ucccugagucaccaggaaugu

SEQ ID NO: 2186514 - RNA, 17 nt, Human
ucccugagucaccagga

SEQ ID NO: 2186515 - RNA, 19 nt, Human
ucccugauaacaaccugga

SEQ ID NO: 2186516 - RNA, 21 nt, Human
ucccugauaacaaccuggaga

SEQ ID NO: 2186517 - RNA, 15 nt, Human
ucccugcaaccaacu

SEQ ID NO: 2186518 - RNA, 16 nt, Human
ucccugcaaccaacua

SEQ ID NO: 2186519 - RNA, 16 nt, Human
ucccugagucaccagg

SEQ ID NO: 2186520 - RNA, 15 nt, Human
ucccugagucaccag

SEQ ID NO: 2186521 - RNA, 14 nt, Human
ucccugagucacca

SEQ ID NO: 2186522 - RNA, 22 nt, Human
ucccugaggcagguccccagac

SEQ ID NO: 2186523 - RNA, 21 nt, Human
ucccugaggcagguccccaga

SEQ ID NO: 2186524 - RNA, 20 nt, Human
ucccugaggcagguccccag

SEQ ID NO: 2186525 - RNA, 15 nt, Human
ucccugacugggagu

SEQ ID NO: 2186526 - RNA, 11 nt, Human
ucccugaggca

SEQ ID NO: 2186527 - RNA, 18 nt, Human
ucccugacucucugugac

SEQ ID NO: 2186528 - RNA, 17 nt, Human
ucccugacucucuguga

SEQ ID NO: 2186529 - RNA, 20 nt, Human
ucccugacucucugugaccu

SEQ ID NO: 2186530 - RNA, 14 nt, Human
ucccugacugggag

SEQ ID NO: 2186531 - RNA, 11 nt, Human
ucccugagcag

SEQ ID NO: 2186532 - RNA, 16 nt, Human
ucccugacucucugug

SEQ ID NO: 2186533 - RNA, 22 nt, Human
ucccucccggcaugggaaagcc

SEQ ID NO: 2186534 - RNA, 22 nt, Human
ucccugacucauucugaaggag

SEQ ID NO: 2186535 - RNA, 16 nt, Human
ucccugaaggccccgc

SEQ ID NO: 2186536 - RNA, 22 nt, Human
acuacaauuuaaagcaaaggag

SEQ ID NO: 2186537 - RNA, 17 nt, Human
acuacaauuuaaagcaa

SEQ ID NO: 2186538 - RNA, 19 nt, Human
acuacaaccaagcucucug

SEQ ID NO: 2186539 - RNA, 11 nt, Human
acuacaggcac

SEQ ID NO: 2186540 - RNA, 20 nt, Human
acuacacagucugcaagauu

SEQ ID NO: 2186541 - RNA, 20 nt, Human
acuacacaucccuaaugugu

SEQ ID NO: 2186542 - RNA, 15 nt, Human
acuacaggcacccac

SEQ ID NO: 2186543 - RNA, 17 nt, Human
acuacaguccucccauc

SEQ ID NO: 2186544 - RNA, 14 nt, Human
acuacaguuuguua

SEQ ID NO: 2186545 - RNA, 13 nt, Human
acuacaguuuguu

SEQ ID NO: 2186546 - RNA, 21 nt, Human
acguuccuuacugcagaauag

SEQ ID NO: 2186547 - RNA, 15 nt, Human
acguucucacaccca

SEQ ID NO: 2186548 - RNA, 16 nt, Human
acguugagccccugga

SEQ ID NO: 2186549 - RNA, 13 nt, Human
acguugcucccca

SEQ ID NO: 2186550 - RNA, 17 nt, Human
acguucucacacccacc

SEQ ID NO: 2186551 - RNA, 11 nt, Human
acguugcugug

SEQ ID NO: 2186552 - RNA, 12 nt, Human
acguugcugugg

SEQ ID NO: 2186553 - RNA, 14 nt, Human
acguugcuguggga

SEQ ID NO: 2186554 - RNA, 15 nt, Human
acguugcugugggaa

SEQ ID NO: 2186555 - RNA, 17 nt, Human
acuaacagauaagcaag

SEQ ID NO: 2186556 - RNA, 17 nt, Human
acuaacaggauauuuaa

SEQ ID NO: 2186557 - RNA, 15 nt, Human
acuaacauauaaugu

SEQ ID NO: 2186558 - RNA, 17 nt, Human
acuaacauauaauguug

SEQ ID NO: 2186559 - RNA, 12 nt, Human
acuaaccacgcu

SEQ ID NO: 2186560 - RNA, 21 nt, Human
acuacaaacaaaauuucuauu

SEQ ID NO: 2186561 - RNA, 20 nt, Human
acuacaaacaaaauuucuau

SEQ ID NO: 2186562 - RNA, 19 nt, Human
acuacaaaucaaguauuug

SEQ ID NO: 2186563 - RNA, 13 nt, Human
acuacaaaucaag

SEQ ID NO: 2186564 - RNA, 11 nt, Human
acuacaaauca

SEQ ID NO: 2186565 - RNA, 22 nt, Human
acuacaaacaaaauuucuauua

SEQ ID NO: 2186566 - RNA, 23 nt, Human
acuacaaagcuucuaucccagga

SEQ ID NO: 2186567 - RNA, 23 nt, Human
ucccagcacaugaaaccuuauuu

SEQ ID NO: 2186568 - RNA, 13 nt, Human
ucccagcacuuug

SEQ ID NO: 2186569 - RNA, 16 nt, Human
ucccagcacuuuggga

SEQ ID NO: 2186570 - RNA, 18 nt, Human
ucccagcacuuugggagg

SEQ ID NO: 2186571 - RNA, 21 nt, Human
ucccagcacuuugggaggccu

SEQ ID NO: 2186572 - RNA, 23 nt, Human
ucccagcacuuugggaggccaag

SEQ ID NO: 2186573 - RNA, 22 nt, Human
ucccagcacuuugggaggccua

SEQ ID NO: 2186574 - RNA, 21 nt, Human
ucccagcacuuugggaggcca

SEQ ID NO: 2186575 - RNA, 19 nt, Human
ucccagcacuuugggaggc

SEQ ID NO: 2186576 - RNA, 14 nt, Human
acuacauucuguua

SEQ ID NO: 2186577 - RNA, 23 nt, Human
ucccagauuggcucacacugaga

SEQ ID NO: 2186578 - RNA, 13 nt, Human
acuacauucuguu

SEQ ID NO: 2186579 - RNA, 12 nt, Human
acuacauucugu

SEQ ID NO: 2186580 - RNA, 11 nt, Human
acuacauucug

SEQ ID NO: 2186581 - RNA, 15 nt, Human
acuacaguuuguuag

SEQ ID NO: 2186582 - RNA, 21 nt, Human
ucccagcucucccucuggccc

SEQ ID NO: 2186583 - RNA, 19 nt, Human
ucccagcucucccucuggc

SEQ ID NO: 2186584 - RNA, 18 nt, Human
ucccagcucucccucugg

SEQ ID NO: 2186585 - RNA, 16 nt, Human
ucccagcucucccucu

SEQ ID NO: 2186586 - RNA, 14 nt, Human
ucccagcucucccu

SEQ ID NO: 2186587 - RNA, 15 nt, Human
ucccagcccaaagcu

SEQ ID NO: 2186588 - RNA, 12 nt, Human
ucccagccccaa

SEQ ID NO: 2186589 - RNA, 22 nt, Human
ucccagccacucgggaggcuga

SEQ ID NO: 2186590 - RNA, 17 nt, Human
ucccagcugaaauacug

SEQ ID NO: 2186591 - RNA, 16 nt, Human
ucccagcugacagucc

SEQ ID NO: 2186592 - RNA, 23 nt, Human
ucccagcucucccucuggcccug

SEQ ID NO: 2186593 - RNA, 22 nt, Human
ucccagcucucccucuggcccu

SEQ ID NO: 2186594 - RNA, 17 nt, Human
ucccagcugacaguccu

SEQ ID NO: 2186595 - RNA, 18 nt, Human
ucccagcugacaguccuc

SEQ ID NO: 2186596 - RNA, 20 nt, Human
ucccagcugacaguccucuc

SEQ ID NO: 2186597 - RNA, 22 nt, Human
ucccagcugacaguccucucca

SEQ ID NO: 2186598 - RNA, 17 nt, Human
ucccagcugugcucugg

SEQ ID NO: 2186599 - RNA, 24 nt, Human
ucccagccaccccgggcucucugc

SEQ ID NO: 2186600 - RNA, 16 nt, Human
ucccagccacucggga

SEQ ID NO: 2186601 - RNA, 20 nt, Human
ucccagccacucgggaggcu

SEQ ID NO: 2186602 - RNA, 20 nt, Human
ucccagccaccccgggcucu

SEQ ID NO: 2186603 - RNA, 14 nt, Human
ucccagccaccccg

SEQ ID NO: 2186604 - RNA, 13 nt, Human
ucccagccacccc

SEQ ID NO: 2186605 - RNA, 12 nt, Human
ucccagccaccc

SEQ ID NO: 2186606 - RNA, 18 nt, Human
ucccagcagggccacucc

SEQ ID NO: 2186607 - RNA, 20 nt, Human
ucccagcaugcugagauuac

SEQ ID NO: 2186608 - RNA, 13 nt, Human
ucccagcagcccu

SEQ ID NO: 2186609 - RNA, 18 nt, Human
ucccagcagcccuaagga

SEQ ID NO: 2186610 - RNA, 21 nt, Human
ucccagcagcccuaaggaucu

SEQ ID NO: 2186611 - RNA, 18 nt, Human
ucccauccuacccucggg

SEQ ID NO: 2186612 - RNA, 20 nt, Human
ucccauccuacccucgggcc

SEQ ID NO: 2186613 - RNA, 14 nt, Human
ucccauccuacccu

SEQ ID NO: 2186614 - RNA, 15 nt, Human
uccccaccaccccag

SEQ ID NO: 2186615 - RNA, 18 nt, Human
uccccacaggagcccugc

SEQ ID NO: 2186616 - RNA, 13 nt, Human
uccccaccccugc

SEQ ID NO: 2186617 - RNA, 14 nt, Human
uccccaccccugcc

SEQ ID NO: 2186618 - RNA, 13 nt, Human
ucccauccccugg

SEQ ID NO: 2186619 - RNA, 15 nt, Human
ucccauccccuggac

SEQ ID NO: 2186620 - RNA, 16 nt, Human
ucccaucccccugccc

SEQ ID NO: 2186621 - RNA, 17 nt, Human
ucccaucccccugcccu

SEQ ID NO: 2186622 - RNA, 18 nt, Human
ucccaucccccugcccuc

SEQ ID NO: 2186623 - RNA, 19 nt, Human
ucccaucccccugcccucg

SEQ ID NO: 2186624 - RNA, 16 nt, Human
ucccaucccagcugaa

SEQ ID NO: 2186625 - RNA, 18 nt, Human
ucccaucccacugcuccc

SEQ ID NO: 2186626 - RNA, 22 nt, Human
ucccaucccagcugaaauacug

SEQ ID NO: 2186627 - RNA, 13 nt, Human
ucccaucccccug

SEQ ID NO: 2186628 - RNA, 14 nt, Human
ucccaucccccugc

SEQ ID NO: 2186629 - RNA, 15 nt, Human
ucccaucccccugcc

SEQ ID NO: 2186630 - RNA, 14 nt, Human
ucccaucacuggag

SEQ ID NO: 2186631 - RNA, 12 nt, Human
ucccauccaggc

SEQ ID NO: 2186632 - RNA, 22 nt, Human
ucccaucacuggagcaccaggc

SEQ ID NO: 2186633 - RNA, 13 nt, Human
ucccauccagggc

SEQ ID NO: 2186634 - RNA, 13 nt, Human
ucccauccaggca

SEQ ID NO: 2186635 - RNA, 14 nt, Human
ucccauccaggcag

SEQ ID NO: 2186636 - RNA, 14 nt, Human
ucccauccagggcc

SEQ ID NO: 2186637 - RNA, 15 nt, Human
ucccauccaggcagu

SEQ ID NO: 2186638 - RNA, 18 nt, Human
ucccauccagugucucac

SEQ ID NO: 2186639 - RNA, 20 nt, Human
ucccaguccaaauguccucc

SEQ ID NO: 2186640 - RNA, 22 nt, Human
ucccagucaccuuguggcaagc

SEQ ID NO: 2186641 - RNA, 15 nt, Human
ucccagucuacccag

SEQ ID NO: 2186642 - RNA, 17 nt, Human
ucccagucuacccagag

SEQ ID NO: 2186643 - RNA, 18 nt, Human
ucccagucuacccagaga

SEQ ID NO: 2186644 - RNA, 22 nt, Human
ucccauaugccugggcagaagg

SEQ ID NO: 2186645 - RNA, 14 nt, Human
ucccaucaaaacuc

SEQ ID NO: 2186646 - RNA, 22 nt, Human
ucccagucuacccagagaagcc

SEQ ID NO: 2186647 - RNA, 15 nt, Human
ucccaucacccgcua

SEQ ID NO: 2186648 - RNA, 24 nt, Human
ucccagcugacaguccucuccacc

SEQ ID NO: 2186649 - RNA, 18 nt, Human
ucccagcugccauguuuc

SEQ ID NO: 2186650 - RNA, 23 nt, Human
ucccaguaccuccugucucuggc

SEQ ID NO: 2186651 - RNA, 17 nt, Human
ucccaguaccuccuguc

SEQ ID NO: 2186652 - RNA, 22 nt, Human
ucccagucauuuaauaaaugug

SEQ ID NO: 2186653 - RNA, 14 nt, Human
ucccagucauuuaa

SEQ ID NO: 2186654 - RNA, 23 nt, Human
uccccaugggaagacgaggcccu

SEQ ID NO: 2186655 - RNA, 11 nt, Human
uccccauggga

SEQ ID NO: 2186656 - RNA, 16 nt, Human
uccccauggagccagc

SEQ ID NO: 2186657 - RNA, 15 nt, Human
uccccauggagccag

SEQ ID NO: 2186658 - RNA, 21 nt, Human
uccccauuagagucagccuuc

SEQ ID NO: 2186659 - RNA, 19 nt, Human
uccccauuagagucagccu

SEQ ID NO: 2186660 - RNA, 17 nt, Human
uccccaugucucgacuc

SEQ ID NO: 2186661 - RNA, 22 nt, Human
uccccaccgcagacaggaccag

SEQ ID NO: 2186662 - RNA, 19 nt, Human
uccccaucuucuaaaccca

SEQ ID NO: 2186663 - RNA, 13 nt, Human
uccccauggagcc

SEQ ID NO: 2186664 - RNA, 14 nt, Human
uccccaucuucuaa

SEQ ID NO: 2186665 - RNA, 16 nt, Human
uccccaugcagacaug

SEQ ID NO: 2186666 - RNA, 15 nt, Human
uccccaccccugccc

SEQ ID NO: 2186667 - RNA, 16 nt, Human
uccccaccccugcccc

SEQ ID NO: 2186668 - RNA, 18 nt, Human
uccccaccccugccccca

SEQ ID NO: 2186669 - RNA, 22 nt, Human
uccccaccccugcccccagccc

SEQ ID NO: 2186670 - RNA, 17 nt, Human
uccccaccgcagacagg

SEQ ID NO: 2186671 - RNA, 18 nt, Human
uccccaccgcagacagga

SEQ ID NO: 2186672 - RNA, 21 nt, Human
uccccaccgcagacaggacca

SEQ ID NO: 2186673 - RNA, 20 nt, Human
ucccccaacccccaccccac

SEQ ID NO: 2186674 - RNA, 19 nt, Human
ucccccaacccccacccca

SEQ ID NO: 2186675 - RNA, 17 nt, Human
ucccccaacccccaccc

SEQ ID NO: 2186676 - RNA, 16 nt, Human
ucccccaacccccacc

SEQ ID NO: 2186677 - RNA, 15 nt, Human
ucccccaacccccac

SEQ ID NO: 2186678 - RNA, 14 nt, Human
ucccccaaccccca

SEQ ID NO: 2186679 - RNA, 20 nt, Human
uccccauuucccaucugcac

SEQ ID NO: 2186680 - RNA, 12 nt, Human
ucccccaacaga

SEQ ID NO: 2186681 - RNA, 15 nt, Human
ucccccaaccccagc

SEQ ID NO: 2186682 - RNA, 24 nt, Human
uccccauuagcuuucaauuccgua

SEQ ID NO: 2186683 - RNA, 14 nt, Human
uccccauucuuccu

SEQ ID NO: 2186684 - RNA, 22 nt, Human
uccccauucuuccuaguuuucu

SEQ ID NO: 2186685 - RNA, 17 nt, Human
uccccauucuuccuagu

SEQ ID NO: 2186686 - RNA, 19 nt, Human
uccccauuuagguuucuga

SEQ ID NO: 2186687 - RNA, 18 nt, Human
uccccauugccuccuccu

SEQ ID NO: 2186688 - RNA, 15 nt, Human
uccccauuucccauc

SEQ ID NO: 2186689 - RNA, 16 nt, Human
uccccauuucccaucu

SEQ ID NO: 2186690 - RNA, 17 nt, Human
uccccauuucccaucug

SEQ ID NO: 2186691 - RNA, 18 nt, Human
uccccauuucccaucugc

SEQ ID NO: 2186692 - RNA, 19 nt, Human
uccccauuucccaucugca

SEQ ID NO: 2186693 - RNA, 21 nt, Human
ucccccaacccccaccccaca

SEQ ID NO: 2186694 - RNA, 21 nt, Human
acuaccaagaggcccugucug

SEQ ID NO: 2186695 - RNA, 15 nt, Human
acuacauucuguuaa

SEQ ID NO: 2186696 - RNA, 14 nt, Human
acuaccuccucagg

SEQ ID NO: 2186697 - RNA, 15 nt, Human
acuaccuccucaggg

SEQ ID NO: 2186698 - RNA, 18 nt, Human
acuacccuauucucucuu

SEQ ID NO: 2186699 - RNA, 21 nt, Human
acuacccacguucucacaccc

SEQ ID NO: 2186700 - RNA, 23 nt, Human
acuacccacguucucacacccac

SEQ ID NO: 2186701 - RNA, 16 nt, Human
uccaugaaaaugcaac

SEQ ID NO: 2186702 - RNA, 17 nt, Human
uccaucucucuggcccu

SEQ ID NO: 2186703 - RNA, 15 nt, Human
uccaugaaaaugcaa

SEQ ID NO: 2186704 - RNA, 13 nt, Human
uccaugaagaugu

SEQ ID NO: 2186705 - RNA, 15 nt, Human
uccauuccucaggga

SEQ ID NO: 2186706 - RNA, 14 nt, Human
uccauuccucaggg

SEQ ID NO: 2186707 - RNA, 13 nt, Human
uccauuccucagg

SEQ ID NO: 2186708 - RNA, 23 nt, Human
uccaugaagaccacauccacaca

SEQ ID NO: 2186709 - RNA, 12 nt, Human
uccauuccucag

SEQ ID NO: 2186710 - RNA, 20 nt, Human
uccaugaagaccacauccac

SEQ ID NO: 2186711 - RNA, 21 nt, Human
uccaugaagaccacauccaca

SEQ ID NO: 2186712 - RNA, 21 nt, Human
uccaugaagauguagaggaga

SEQ ID NO: 2186713 - RNA, 14 nt, Human
uccauucucccagg

SEQ ID NO: 2186714 - RNA, 15 nt, Human
uccauucucccaggu

SEQ ID NO: 2186715 - RNA, 12 nt, Human
uccauucuggaa

SEQ ID NO: 2186716 - RNA, 16 nt, Human
uccauucucccaggua

SEQ ID NO: 2186717 - RNA, 18 nt, Human
uccauucuuucugauaac

SEQ ID NO: 2186718 - RNA, 14 nt, Human
uccauucuuucuga

SEQ ID NO: 2186719 - RNA, 12 nt, Human
uccauucuuucu

SEQ ID NO: 2186720 - RNA, 14 nt, Human
uccauucuggaagu

SEQ ID NO: 2186721 - RNA, 13 nt, Human
uccauucuggaag

SEQ ID NO: 2186722 - RNA, 19 nt, Human
uccauucuuucugauaacu

SEQ ID NO: 2186723 - RNA, 14 nt, Human
uccauugacaugua

SEQ ID NO: 2186724 - RNA, 15 nt, Human
uccauugacauguac

SEQ ID NO: 2186725 - RNA, 16 nt, Human
uccauugacauguaca

SEQ ID NO: 2186726 - RNA, 17 nt, Human
uccauugacauguacag

SEQ ID NO: 2186727 - RNA, 18 nt, Human
uccauugacauguacaga

SEQ ID NO: 2186728 - RNA, 19 nt, Human
uccauugacauguacagag

SEQ ID NO: 2186729 - RNA, 16 nt, Human
uccaucucgccacccc

SEQ ID NO: 2186730 - RNA, 16 nt, Human
uccaucucucuggccc

SEQ ID NO: 2186731 - RNA, 23 nt, Human
uccaucucgccaccccuccuucc

SEQ ID NO: 2186732 - RNA, 14 nt, Human
uccaucucgccacc

SEQ ID NO: 2186733 - RNA, 21 nt, Human
uccaucuccaagaaugcugaa

SEQ ID NO: 2186734 - RNA, 18 nt, Human
uccaucuaaacugccccc

SEQ ID NO: 2186735 - RNA, 21 nt, Human
uccaucuaaauaccugcccug

SEQ ID NO: 2186736 - RNA, 16 nt, Human
uccaucuccaagaaug

SEQ ID NO: 2186737 - RNA, 18 nt, Human
uccaucuccaagaaugcu

SEQ ID NO: 2186738 - RNA, 20 nt, Human
uccaucuccaagaaugcuga

SEQ ID NO: 2186739 - RNA, 17 nt, Human
uccauccuuucugccuc

SEQ ID NO: 2186740 - RNA, 20 nt, Human
uccauccuugagucaaaaaa

SEQ ID NO: 2186741 - RNA, 16 nt, Human
uccaucuaaacugccc

SEQ ID NO: 2186742 - RNA, 22 nt, Human
acgccagauucuuuccugaggc

SEQ ID NO: 2186743 - RNA, 23 nt, Human
acgccagauucuuuccugaggcu

SEQ ID NO: 2186744 - RNA, 21 nt, Human
uccauccugaggcuccacuug

SEQ ID NO: 2186745 - RNA, 20 nt, Human
uccauccugaggcuccacuu

SEQ ID NO: 2186746 - RNA, 13 nt, Human
ucccaaagugcug

SEQ ID NO: 2186747 - RNA, 14 nt, Human
ucccaaagugcugg

SEQ ID NO: 2186748 - RNA, 21 nt, Human
ucccaaguagcugggauuaca

SEQ ID NO: 2186749 - RNA, 20 nt, Human
ucccaaguagcugggauuac

SEQ ID NO: 2186750 - RNA, 21 nt, Human
ucccaaagcagugcaugcugu

SEQ ID NO: 2186751 - RNA, 16 nt, Human
ucccaaaggacuccac

SEQ ID NO: 2186752 - RNA, 22 nt, Human
ucccaaaggacuccacccaucc

SEQ ID NO: 2186753 - RNA, 19 nt, Human
ucccaaagccagaaccaga

SEQ ID NO: 2186754 - RNA, 22 nt, Human
ucccaaagccuugugucuacag

SEQ ID NO: 2186755 - RNA, 17 nt, Human
ucccaaagcagugcaug

SEQ ID NO: 2186756 - RNA, 18 nt, Human
ucccaaagcagugcaugc

SEQ ID NO: 2186757 - RNA, 14 nt, Human
uccauuugaaagaa

SEQ ID NO: 2186758 - RNA, 14 nt, Human
uccauuucucaugu

SEQ ID NO: 2186759 - RNA, 17 nt, Human
uccauuucucauguuuu

SEQ ID NO: 2186760 - RNA, 23 nt, Human
uccauuuuuucaagguaauuucu

SEQ ID NO: 2186761 - RNA, 20 nt, Human
ucccaaaagcccauucauuc

SEQ ID NO: 2186762 - RNA, 23 nt, Human
uccauuucaucuauuucugagaa

SEQ ID NO: 2186763 - RNA, 21 nt, Human
uccauuucaucuauuucugag

SEQ ID NO: 2186764 - RNA, 20 nt, Human
uccauuucgccccucauuua

SEQ ID NO: 2186765 - RNA, 20 nt, Human
uccauuuaguucuuuguuau

SEQ ID NO: 2186766 - RNA, 14 nt, Human
uccauuuaguucuu

SEQ ID NO: 2186767 - RNA, 14 nt, Human
ucccaaaauuguuu

SEQ ID NO: 2186768 - RNA, 15 nt, Human
ucccaaaauuguuuu

SEQ ID NO: 2186769 - RNA, 22 nt, Human
ucccaaaauuguuuugagcuuu

SEQ ID NO: 2186770 - RNA, 18 nt, Human
ucccaaacccuucagugc

SEQ ID NO: 2186771 - RNA, 21 nt, Human
ucccaaacgccuccccugccc

SEQ ID NO: 2186772 - RNA, 15 nt, Human
ucccaaacgccuccc

SEQ ID NO: 2186773 - RNA, 16 nt, Human
ucccaaagcagugcau

SEQ ID NO: 2186774 - RNA, 20 nt, Human
acguauguuuuuguguauuu

SEQ ID NO: 2186775 - RNA, 16 nt, Human
acguauugguccagcu

SEQ ID NO: 2186776 - RNA, 18 nt, Human
acguacuuagcagcuauc

SEQ ID NO: 2186777 - RNA, 17 nt, Human
acguagcugaggccgga

SEQ ID NO: 2186778 - RNA, 20 nt, Human
acguagcugcaaaggacaga

SEQ ID NO: 2186779 - RNA, 16 nt, Human
acguagcugcaaagga

SEQ ID NO: 2186780 - RNA, 24 nt, Human
acguagcuucuaccaugaacagaa

SEQ ID NO: 2186781 - RNA, 13 nt, Human
acguaugcaugug

SEQ ID NO: 2186782 - RNA, 14 nt, Human
acguaugcauguga

SEQ ID NO: 2186783 - RNA, 18 nt, Human
acguggcuuuuagacaga

SEQ ID NO: 2186784 - RNA, 11 nt, Human
acgugggagac

SEQ ID NO: 2186785 - RNA, 16 nt, Human
acgugggagacaagaa

SEQ ID NO: 2186786 - RNA, 16 nt, Human
acgugggcaaacaggc

SEQ ID NO: 2186787 - RNA, 23 nt, Human
acguggcugcuucaaggauccug

SEQ ID NO: 2186788 - RNA, 17 nt, Human
acgguuuuacugcagcu

SEQ ID NO: 2186789 - RNA, 15 nt, Human
acgguuuuacugcag

SEQ ID NO: 2186790 - RNA, 20 nt, Human
acguacguaucagcggcccc

SEQ ID NO: 2186791 - RNA, 17 nt, Human
acgguuugaagccugga

SEQ ID NO: 2186792 - RNA, 16 nt, Human
acguacuuagcagcua

SEQ ID NO: 2186793 - RNA, 22 nt, Human
acguauaaaagccuguuuaaga

SEQ ID NO: 2186794 - RNA, 16 nt, Human
acguuccuauugucau

SEQ ID NO: 2186795 - RNA, 18 nt, Human
acguuccuauugucauua

SEQ ID NO: 2186796 - RNA, 20 nt, Human
acguuccuauugucauuaaa

SEQ ID NO: 2186797 - RNA, 11 nt, Human
acguuccagcc

SEQ ID NO: 2186798 - RNA, 12 nt, Human
acguuccagccg

SEQ ID NO: 2186799 - RNA, 14 nt, Human
acguuccagccggc

SEQ ID NO: 2186800 - RNA, 14 nt, Human
acguucggggcaug

SEQ ID NO: 2186801 - RNA, 20 nt, Human
acguuccuuacugcagaaua

SEQ ID NO: 2186802 - RNA, 19 nt, Human
acguuccuuacugcagaau

SEQ ID NO: 2186803 - RNA, 18 nt, Human
acguuccuuacugcagaa

SEQ ID NO: 2186804 - RNA, 16 nt, Human
acguuccuuacugcag

SEQ ID NO: 2186805 - RNA, 21 nt, Human
acguuccuauugucauuaaag

SEQ ID NO: 2186806 - RNA, 14 nt, Human
acguucaccccucc

SEQ ID NO: 2186807 - RNA, 16 nt, Human
acguucaccccuccac

SEQ ID NO: 2186808 - RNA, 16 nt, Human
acgugugugacucaga

SEQ ID NO: 2186809 - RNA, 11 nt, Human
acgugugugac

SEQ ID NO: 2186810 - RNA, 12 nt, Human
acgugugauuuu

SEQ ID NO: 2186811 - RNA, 15 nt, Human
acgugugauuuuucu

SEQ ID NO: 2186812 - RNA, 18 nt, Human
acguguacuacaauuuaa

SEQ ID NO: 2186813 - RNA, 14 nt, Human
acguguagcuauau

SEQ ID NO: 2186814 - RNA, 22 nt, Human
acgugggucuucagggggccag

SEQ ID NO: 2186815 - RNA, 14 nt, Human
acguggggcagcac

SEQ ID NO: 2186816 - RNA, 15 nt, Human
acguggggcagcaca

SEQ ID NO: 2186817 - RNA, 19 nt, Human
acguggggcagcacagaga

SEQ ID NO: 2186818 - RNA, 20 nt, Human
acguggggcagcacagagag

SEQ ID NO: 2186819 - RNA, 20 nt, Human
acgugggcggcagagaggac

SEQ ID NO: 2186820 - RNA, 15 nt, Human
acgugggcggcagag

SEQ ID NO: 2186821 - RNA, 19 nt, Human
acgugggcaaacaggcagu

SEQ ID NO: 2186822 - RNA, 22 nt, Human
ucccacacugcuaggugggcca

SEQ ID NO: 2186823 - RNA, 18 nt, Human
ucccacacuggugacugc

SEQ ID NO: 2186824 - RNA, 17 nt, Human
ucccacaccuccacagu

SEQ ID NO: 2186825 - RNA, 18 nt, Human
ucccacaccuccacaguu

SEQ ID NO: 2186826 - RNA, 18 nt, Human
ucccacaccguguaaacc

SEQ ID NO: 2186827 - RNA, 15 nt, Human
ucccacaccuccaca

SEQ ID NO: 2186828 - RNA, 16 nt, Human
ucccacaccuccacag

SEQ ID NO: 2186829 - RNA, 13 nt, Human
ucccacacccugg

SEQ ID NO: 2186830 - RNA, 22 nt, Human
ucccacaaucuuaaggggcagc

SEQ ID NO: 2186831 - RNA, 23 nt, Human
ucccacaaucuuaaggggcagcu

SEQ ID NO: 2186832 - RNA, 16 nt, Human
ucccacaagugguggu

SEQ ID NO: 2186833 - RNA, 23 nt, Human
ucccacaauauaaaacuguacuu

SEQ ID NO: 2186834 - RNA, 14 nt, Human
ucccacaaguggug

SEQ ID NO: 2186835 - RNA, 15 nt, Human
ucccaccccacacac

SEQ ID NO: 2186836 - RNA, 20 nt, Human
ucccaccccacacacgccag

SEQ ID NO: 2186837 - RNA, 17 nt, Human
ucccaagugccagucuu

SEQ ID NO: 2186838 - RNA, 12 nt, Human
ucccaaguggug

SEQ ID NO: 2186839 - RNA, 16 nt, Human
ucccaaguggugccua

SEQ ID NO: 2186840 - RNA, 18 nt, Human
ucccaaguggugccuaaa

SEQ ID NO: 2186841 - RNA, 18 nt, Human
ucccaaguuuuaggacaa

SEQ ID NO: 2186842 - RNA, 14 nt, Human
ucccaagucuacag

SEQ ID NO: 2186843 - RNA, 15 nt, Human
ucccaagucuacaga

SEQ ID NO: 2186844 - RNA, 17 nt, Human
ucccaauaggcagacug

SEQ ID NO: 2186845 - RNA, 23 nt, Human
ucccaaguuuuaggacaaacagc

SEQ ID NO: 2186846 - RNA, 22 nt, Human
ucccaauagcaacguagcuucu

SEQ ID NO: 2186847 - RNA, 16 nt, Human
ucccacaaaggagagc

SEQ ID NO: 2186848 - RNA, 13 nt, Human
ucccaccccaccc

SEQ ID NO: 2186849 - RNA, 12 nt, Human
ucccaccccacc

SEQ ID NO: 2186850 - RNA, 13 nt, Human
ucccacagcgcug

SEQ ID NO: 2186851 - RNA, 22 nt, Human
ucccaccccacccccuucagug

SEQ ID NO: 2186852 - RNA, 20 nt, Human
ucccaccccacccccuucag

SEQ ID NO: 2186853 - RNA, 18 nt, Human
ucccaccccacccccuuc

SEQ ID NO: 2186854 - RNA, 16 nt, Human
ucccaccccacccccu

SEQ ID NO: 2186855 - RNA, 20 nt, Human
ucccaccccauuuucugugg

SEQ ID NO: 2186856 - RNA, 22 nt, Human
ucccaccccauuuucugugggc

SEQ ID NO: 2186857 - RNA, 20 nt, Human
acgggaggguaaggcugugg

SEQ ID NO: 2186858 - RNA, 16 nt, Human
acgggacugacgcaac

SEQ ID NO: 2186859 - RNA, 18 nt, Human
ucccacccccacccccag

SEQ ID NO: 2186860 - RNA, 20 nt, Human
ucccacccccacccccagcu

SEQ ID NO: 2186861 - RNA, 14 nt, Human
acgggcugcccugc

SEQ ID NO: 2186862 - RNA, 16 nt, Human
acgggcaguagcugug

SEQ ID NO: 2186863 - RNA, 18 nt, Human
acgggcaugggcacuccc

SEQ ID NO: 2186864 - RNA, 19 nt, Human
acgguucaccagccucucu

SEQ ID NO: 2186865 - RNA, 16 nt, Human
acgguucaccagccuc

SEQ ID NO: 2186866 - RNA, 23 nt, Human
acgggcuuguugcuguugauguu

SEQ ID NO: 2186867 - RNA, 21 nt, Human
acggugggccuugcuggggac

SEQ ID NO: 2186868 - RNA, 21 nt, Human
acgguggucacuggaacucag

SEQ ID NO: 2186869 - RNA, 13 nt, Human
ucauuaccacagg

SEQ ID NO: 2186870 - RNA, 20 nt, Human
ucauuaccuuuuuugauaaa

SEQ ID NO: 2186871 - RNA, 14 nt, Human
ucauuaauucuaua

SEQ ID NO: 2186872 - RNA, 13 nt, Human
ucauuaauucuau

SEQ ID NO: 2186873 - RNA, 22 nt, Human
ucauuaaugacacuugucccca

SEQ ID NO: 2186874 - RNA, 19 nt, Human
ucauuaaugacacuugucc

SEQ ID NO: 2186875 - RNA, 15 nt, Human
ucauuaaugacacuu

SEQ ID NO: 2186876 - RNA, 14 nt, Human
ucaugauuagcaag

SEQ ID NO: 2186877 - RNA, 16 nt, Human
ucaugauuagcaaguu

SEQ ID NO: 2186878 - RNA, 13 nt, Human
ucauuaaugacac

SEQ ID NO: 2186879 - RNA, 14 nt, Human
ucauuaaugacacu

SEQ ID NO: 2186880 - RNA, 13 nt, Human
ucaugauuagcaa

SEQ ID NO: 2186881 - RNA, 22 nt, Human
ucaugaucucccugccgccuca

SEQ ID NO: 2186882 - RNA, 19 nt, Human
ucaugaucucccugccgcc

SEQ ID NO: 2186883 - RNA, 18 nt, Human
ucaugaucucccugccgc

SEQ ID NO: 2186884 - RNA, 17 nt, Human
ucaugaucucccugccg

SEQ ID NO: 2186885 - RNA, 16 nt, Human
ucaugaucucccugcc

SEQ ID NO: 2186886 - RNA, 15 nt, Human
ucaugaucucccugc

SEQ ID NO: 2186887 - RNA, 14 nt, Human
ucaugaucucccug

SEQ ID NO: 2186888 - RNA, 13 nt, Human
ucaugaucucccu

SEQ ID NO: 2186889 - RNA, 18 nt, Human
ucaugaucuugugacaua

SEQ ID NO: 2186890 - RNA, 17 nt, Human
ucaugaucuugugacau

SEQ ID NO: 2186891 - RNA, 16 nt, Human
ucaugaucuugugaca

SEQ ID NO: 2186892 - RNA, 21 nt, Human
ucaugaauuaguuuuauaugc

SEQ ID NO: 2186893 - RNA, 16 nt, Human
ucaugauccaacuaau

SEQ ID NO: 2186894 - RNA, 13 nt, Human
ucaugauccaacu

SEQ ID NO: 2186895 - RNA, 17 nt, Human
ucauucuugaaagcugu

SEQ ID NO: 2186896 - RNA, 18 nt, Human
ucauucuugaaagcugug

SEQ ID NO: 2186897 - RNA, 12 nt, Human
ucauucuucugu

SEQ ID NO: 2186898 - RNA, 12 nt, Human
ucauugaaaucu

SEQ ID NO: 2186899 - RNA, 13 nt, Human
ucauugaaaucuu

SEQ ID NO: 2186900 - RNA, 18 nt, Human
ucauuacuuuaccacccc

SEQ ID NO: 2186901 - RNA, 21 nt, Human
ucauuaaugacacuugucccc

SEQ ID NO: 2186902 - RNA, 16 nt, Human
ucauucucugucucau

SEQ ID NO: 2186903 - RNA, 15 nt, Human
ucauucucugucuca

SEQ ID NO: 2186904 - RNA, 14 nt, Human
ucauucucugucuc

SEQ ID NO: 2186905 - RNA, 20 nt, Human
ucauuacuuuaccaccccca

SEQ ID NO: 2186906 - RNA, 16 nt, Human
ucauuacuuuugaagu

SEQ ID NO: 2186907 - RNA, 18 nt, Human
ucauucugaaggagcccc

SEQ ID NO: 2186908 - RNA, 19 nt, Human
ucauucucugucucaucca

SEQ ID NO: 2186909 - RNA, 18 nt, Human
ucauucucugucucaucc

SEQ ID NO: 2186910 - RNA, 14 nt, Human
ucauucuuauuuca

SEQ ID NO: 2186911 - RNA, 16 nt, Human
ucauucuuagcucuua

SEQ ID NO: 2186912 - RNA, 18 nt, Human
ucauucuuauuucaugaa

SEQ ID NO: 2186913 - RNA, 13 nt, Human
ucauucuucucua

SEQ ID NO: 2186914 - RNA, 17 nt, Human
ucauucuucucuagcug

SEQ ID NO: 2186915 - RNA, 18 nt, Human
accucuaaaacaguccuu

SEQ ID NO: 2186916 - RNA, 21 nt, Human
accucguccucccccugccag

SEQ ID NO: 2186917 - RNA, 20 nt, Human
accucguccucccccugcca

SEQ ID NO: 2186918 - RNA, 18 nt, Human
accucguccucccccugc

SEQ ID NO: 2186919 - RNA, 15 nt, Human
accucguccuccccc

SEQ ID NO: 2186920 - RNA, 14 nt, Human
accucguccucccc

SEQ ID NO: 2186921 - RNA, 23 nt, Human
accuccuucucugucucaugugu

SEQ ID NO: 2186922 - RNA, 21 nt, Human
accuccuuguaacaucaggga

SEQ ID NO: 2186923 - RNA, 12 nt, Human
accuccuucucu

SEQ ID NO: 2186924 - RNA, 19 nt, Human
accucggugccuuccucuu

SEQ ID NO: 2186925 - RNA, 13 nt, Human
accuccugggcua

SEQ ID NO: 2186926 - RNA, 22 nt, Human
ucauugcugagccucugcuccc

SEQ ID NO: 2186927 - RNA, 17 nt, Human
ucauugcugagccucug

SEQ ID NO: 2186928 - RNA, 23 nt, Human
ucauugcugagccucugcucccc

SEQ ID NO: 2186929 - RNA, 23 nt, Human
ucauugcugaaaaugguauuuuc

SEQ ID NO: 2186930 - RNA, 17 nt, Human
accuccugucucuggcc

SEQ ID NO: 2186931 - RNA, 15 nt, Human
accuccugucucugg

SEQ ID NO: 2186932 - RNA, 16 nt, Human
accuccugucucuggc

SEQ ID NO: 2186933 - RNA, 18 nt, Human
ucauugauugucagcuac

SEQ ID NO: 2186934 - RNA, 18 nt, Human
ucauugcccccagggcac

SEQ ID NO: 2186935 - RNA, 14 nt, Human
ucauugaaguauuu

SEQ ID NO: 2186936 - RNA, 17 nt, Human
ucauugaagucagaugu

SEQ ID NO: 2186937 - RNA, 19 nt, Human
ucauugauaugaaaaauau

SEQ ID NO: 2186938 - RNA, 14 nt, Human
ucauugcugaaaau

SEQ ID NO: 2186939 - RNA, 17 nt, Human
ucauugcugaaaauggu

SEQ ID NO: 2186940 - RNA, 18 nt, Human
ucauugcugaaaauggua

SEQ ID NO: 2186941 - RNA, 16 nt, Human
ucauugcugagccucu

SEQ ID NO: 2186942 - RNA, 15 nt, Human
ucauugcugagccuc

SEQ ID NO: 2186943 - RNA, 20 nt, Human
ucauugccuuaacuggagcc

SEQ ID NO: 2186944 - RNA, 23 nt, Human
ucauugccuuaacuggagcccca

SEQ ID NO: 2186945 - RNA, 17 nt, Human
ucauugccuuaacugga

SEQ ID NO: 2186946 - RNA, 22 nt, Human
ucauugaaaucuuuuugcuuug

SEQ ID NO: 2186947 - RNA, 12 nt, Human
ucauugaccuga

SEQ ID NO: 2186948 - RNA, 14 nt, Human
ucauugaccugagg

SEQ ID NO: 2186949 - RNA, 15 nt, Human
ucauugaccugaggc

SEQ ID NO: 2186950 - RNA, 13 nt, Human
accucucccaggg

SEQ ID NO: 2186951 - RNA, 23 nt, Human
accucuccaucuucagcuucuuc

SEQ ID NO: 2186952 - RNA, 17 nt, Human
accucuccccuggaacu

SEQ ID NO: 2186953 - RNA, 20 nt, Human
accucuccaucuucagcuuc

SEQ ID NO: 2186954 - RNA, 19 nt, Human
accucuuuauuuuuugauu

SEQ ID NO: 2186955 - RNA, 22 nt, Human
accucuuuauuuuuugauugaa

SEQ ID NO: 2186956 - RNA, 15 nt, Human
accugaaaaaaaguu

SEQ ID NO: 2186957 - RNA, 18 nt, Human
accugaaaaaaaguuuac

SEQ ID NO: 2186958 - RNA, 19 nt, Human
accugaaaaaaaguuuaca

SEQ ID NO: 2186959 - RNA, 20 nt, Human
accugaaaacacugugcaca

SEQ ID NO: 2186960 - RNA, 19 nt, Human
accugaaaacacugugcac

SEQ ID NO: 2186961 - RNA, 18 nt, Human
accugaaaacacugugca

SEQ ID NO: 2186962 - RNA, 11 nt, Human
accugaaaaca

SEQ ID NO: 2186963 - RNA, 22 nt, Human
accucguccucccccugccagu

SEQ ID NO: 2186964 - RNA, 15 nt, Human
accucuccaucuuca

SEQ ID NO: 2186965 - RNA, 19 nt, Human
accucuccaucuucagcuu

SEQ ID NO: 2186966 - RNA, 20 nt, Human
accucuccaagggcuucugc

SEQ ID NO: 2186967 - RNA, 22 nt, Human
accucuccaagggcuucugcac

SEQ ID NO: 2186968 - RNA, 18 nt, Human
accucucaucaguguccu

SEQ ID NO: 2186969 - RNA, 10 nt, Human
accucuccaa

SEQ ID NO: 2186970 - RNA, 11 nt, Human
accucuccaag

SEQ ID NO: 2186971 - RNA, 13 nt, Human
accucuccaaggg

SEQ ID NO: 2186972 - RNA, 12 nt, Human
accugaaaagua

SEQ ID NO: 2186973 - RNA, 21 nt, Human
accugaaaacacugugcacau

SEQ ID NO: 2186974 - RNA, 21 nt, Human
accugaaaaaaaguuuacaag

SEQ ID NO: 2186975 - RNA, 23 nt, Human
accugaccccugcucaguaaagc

SEQ ID NO: 2186976 - RNA, 14 nt, Human
accugaccgugggc

SEQ ID NO: 2186977 - RNA, 18 nt, Human
accugaccgugggcgggg

SEQ ID NO: 2186978 - RNA, 17 nt, Human
accugaccccugcucag

SEQ ID NO: 2186979 - RNA, 16 nt, Human
accugaccccugcuca

SEQ ID NO: 2186980 - RNA, 22 nt, Human
accugacucgucugacugugug

SEQ ID NO: 2186981 - RNA, 13 nt, Human
accugacucugaa

SEQ ID NO: 2186982 - RNA, 14 nt, Human
accugacucugaaa

SEQ ID NO: 2186983 - RNA, 15 nt, Human
accugacucugaaau

SEQ ID NO: 2186984 - RNA, 16 nt, Human
accugacucugaaauc

SEQ ID NO: 2186985 - RNA, 17 nt, Human
accugacucugaaaucu

SEQ ID NO: 2186986 - RNA, 18 nt, Human
accugacucugaaaucug

SEQ ID NO: 2186987 - RNA, 19 nt, Human
accugacucugaaaucuga

SEQ ID NO: 2186988 - RNA, 20 nt, Human
accugacuauugaaguugca

SEQ ID NO: 2186989 - RNA, 19 nt, Human
accugacguagcugcaaag

SEQ ID NO: 2186990 - RNA, 20 nt, Human
accugaccgugggcggggcc

SEQ ID NO: 2186991 - RNA, 22 nt, Human
accugacucugaaaucugaaga

SEQ ID NO: 2186992 - RNA, 23 nt, Human
accugacucugaaaucugaagac

SEQ ID NO: 2186993 - RNA, 23 nt, Human
accugagaccaguugggagcacu

SEQ ID NO: 2186994 - RNA, 14 nt, Human
accugagcucccca

SEQ ID NO: 2186995 - RNA, 20 nt, Human
accugagcuagaagcuggag

SEQ ID NO: 2186996 - RNA, 19 nt, Human
accugagcuagaagcugga

SEQ ID NO: 2186997 - RNA, 18 nt, Human
accugagcugccauccag

SEQ ID NO: 2186998 - RNA, 12 nt, Human
accugagcugcc

SEQ ID NO: 2186999 - RNA, 15 nt, Human
accugagcuccccac

SEQ ID NO: 2187000 - RNA, 13 nt, Human
accugaggaagcg

SEQ ID NO: 2187001 - RNA, 14 nt, Human
accugaggcccuuc

SEQ ID NO: 2187002 - RNA, 19 nt, Human
accugcauccguaguuccc

SEQ ID NO: 2187003 - RNA, 22 nt, Human
accugcagguugggccauacug

SEQ ID NO: 2187004 - RNA, 13 nt, Human
accugcagguugg

SEQ ID NO: 2187005 - RNA, 17 nt, Human
accugcagguugggcca

SEQ ID NO: 2187006 - RNA, 22 nt, Human
accugcauccguaguucccuga

SEQ ID NO: 2187007 - RNA, 21 nt, Human
accugcauccguaguucccug

SEQ ID NO: 2187008 - RNA, 19 nt, Human
accugcaggccaagagcag

SEQ ID NO: 2187009 - RNA, 15 nt, Human
accugcaggccaaga

SEQ ID NO: 2187010 - RNA, 21 nt, Human
accugcaccuccccccacugc

SEQ ID NO: 2187011 - RNA, 22 nt, Human
accugcaccuccccccacugca

SEQ ID NO: 2187012 - RNA, 23 nt, Human
accugcacuggggagcccgucuc

SEQ ID NO: 2187013 - RNA, 14 nt, Human
accugauugugucu

SEQ ID NO: 2187014 - RNA, 17 nt, Human
accugaucaaugacaga

SEQ ID NO: 2187015 - RNA, 20 nt, Human
accugaucaaugacagagcc

SEQ ID NO: 2187016 - RNA, 15 nt, Human
accugauuuacaguu

SEQ ID NO: 2187017 - RNA, 21 nt, Human
accugauuuacaguuucaaaa

SEQ ID NO: 2187018 - RNA, 18 nt, Human
accugagucugcuauauu

SEQ ID NO: 2187019 - RNA, 16 nt, Human
accugaucaaugacag

SEQ ID NO: 2187020 - RNA, 14 nt, Human
accugaucaaugac

SEQ ID NO: 2187021 - RNA, 15 nt, Human
accugauugugucuc

SEQ ID NO: 2187022 - RNA, 17 nt, Human
accugauugugucucuu

SEQ ID NO: 2187023 - RNA, 18 nt, Human
accugauugugucucuug

SEQ ID NO: 2187024 - RNA, 22 nt, Human
accugaggcccuucucuccagc

SEQ ID NO: 2187025 - RNA, 21 nt, Human
accugagucguacagaaagcu

SEQ ID NO: 2187026 - RNA, 23 nt, Human
accugagucacccuaccugugcc

SEQ ID NO: 2187027 - RNA, 22 nt, Human
accugagucacccuaccugugc

SEQ ID NO: 2187028 - RNA, 23 nt, Human
accugaggugggcccaggaccag

SEQ ID NO: 2187029 - RNA, 24 nt, Human
accugaggugggcccaggaccagc

SEQ ID NO: 2187030 - RNA, 12 nt, Human
accugagguggg

SEQ ID NO: 2187031 - RNA, 14 nt, Human
accugaggugggcc

SEQ ID NO: 2187032 - RNA, 16 nt, Human
accugaggugggccca

SEQ ID NO: 2187033 - RNA, 17 nt, Human
accugaggugggcccag

SEQ ID NO: 2187034 - RNA, 18 nt, Human
accugaggugggcccagg

SEQ ID NO: 2187035 - RNA, 19 nt, Human
accugaggugggcccagga

SEQ ID NO: 2187036 - RNA, 21 nt, Human
accugaggugggcccaggacc

SEQ ID NO: 2187037 - RNA, 22 nt, Human
accugaggugggcccaggacca

SEQ ID NO: 2187038 - RNA, 15 nt, Human
accugaggcccuucu

SEQ ID NO: 2187039 - RNA, 16 nt, Human
accugaggcccuucuc

SEQ ID NO: 2187040 - RNA, 20 nt, Human
accugaggcccuucucucca

SEQ ID NO: 2187041 - RNA, 21 nt, Human
accugaggcccuucucuccag

SEQ ID NO: 2187042 - RNA, 16 nt, Human
accucaaccaaugcca

SEQ ID NO: 2187043 - RNA, 16 nt, Human
accucaaccugugaug

SEQ ID NO: 2187044 - RNA, 19 nt, Human
accucaacccccauuucua

SEQ ID NO: 2187045 - RNA, 21 nt, Human
accucaacccccauuucuauu

SEQ ID NO: 2187046 - RNA, 20 nt, Human
accucccugaaccaucccug

SEQ ID NO: 2187047 - RNA, 15 nt, Human
accucccugaaccau

SEQ ID NO: 2187048 - RNA, 14 nt, Human
accucccugaacca

SEQ ID NO: 2187049 - RNA, 22 nt, Human
accucaacugccuacuccaaaa

SEQ ID NO: 2187050 - RNA, 15 nt, Human
accucccucccggca

SEQ ID NO: 2187051 - RNA, 22 nt, Human
accucaacccccauuucuauuu

SEQ ID NO: 2187052 - RNA, 16 nt, Human
accucaacugccuacu

SEQ ID NO: 2187053 - RNA, 10 nt, Human
accucccucc

SEQ ID NO: 2187054 - RNA, 13 nt, Human
accuccugccucg

SEQ ID NO: 2187055 - RNA, 12 nt, Human
accuccugccuc

SEQ ID NO: 2187056 - RNA, 14 nt, Human
accucccugccucc

SEQ ID NO: 2187057 - RNA, 13 nt, Human
accucccugccuc

SEQ ID NO: 2187058 - RNA, 14 nt, Human
accucccugcaacc

SEQ ID NO: 2187059 - RNA, 13 nt, Human
accucccugaccc

SEQ ID NO: 2187060 - RNA, 17 nt, Human
accucccugacccgucu

SEQ ID NO: 2187061 - RNA, 17 nt, Human
ucauccccucacuugcc

SEQ ID NO: 2187062 - RNA, 21 nt, Human
ucauccccaggggucccagcc

SEQ ID NO: 2187063 - RNA, 20 nt, Human
ucauccccaggggucccagc

SEQ ID NO: 2187064 - RNA, 12 nt, Human
ucauccccaggg

SEQ ID NO: 2187065 - RNA, 20 nt, Human
ucauccccaccugucuucaa

SEQ ID NO: 2187066 - RNA, 16 nt, Human
accuccgccucccggg

SEQ ID NO: 2187067 - RNA, 18 nt, Human
ucaucccauucugcguca

SEQ ID NO: 2187068 - RNA, 23 nt, Human
accuccugccucgaacuggcugc

SEQ ID NO: 2187069 - RNA, 14 nt, Human
ucaucccauguaca

SEQ ID NO: 2187070 - RNA, 17 nt, Human
ucauccggcagccugga

SEQ ID NO: 2187071 - RNA, 15 nt, Human
ucauccggcagccug

SEQ ID NO: 2187072 - RNA, 19 nt, Human
ucauccggcagccuggaug

SEQ ID NO: 2187073 - RNA, 15 nt, Human
ucauccuaagcuauu

SEQ ID NO: 2187074 - RNA, 21 nt, Human
ucaucccuaugggauucagug

SEQ ID NO: 2187075 - RNA, 17 nt, Human
ucaucccuaaugcugca

SEQ ID NO: 2187076 - RNA, 18 nt, Human
ucaucccuaaugcugcag

SEQ ID NO: 2187077 - RNA, 23 nt, Human
ucaucccgagcaccuccacaucc

SEQ ID NO: 2187078 - RNA, 21 nt, Human
ucaucccgagcaccuccacau

SEQ ID NO: 2187079 - RNA, 15 nt, Human
ucauccgaggcaggg

SEQ ID NO: 2187080 - RNA, 14 nt, Human
ucauccgaggcagg

SEQ ID NO: 2187081 - RNA, 12 nt, Human
ucauccugcagg

SEQ ID NO: 2187082 - RNA, 13 nt, Human
ucauccugcaggc

SEQ ID NO: 2187083 - RNA, 14 nt, Human
ucauccuucuggaa

SEQ ID NO: 2187084 - RNA, 16 nt, Human
ucauccugacucugcc

SEQ ID NO: 2187085 - RNA, 17 nt, Human
ucauccugacucugccc

SEQ ID NO: 2187086 - RNA, 19 nt, Human
ucauccugacucugccccc

SEQ ID NO: 2187087 - RNA, 20 nt, Human
ucauccugacucugcccccu

SEQ ID NO: 2187088 - RNA, 18 nt, Human
ucauccucauacccaccc

SEQ ID NO: 2187089 - RNA, 13 nt, Human
ucauccuccucag

SEQ ID NO: 2187090 - RNA, 19 nt, Human
ucauccuccucagaucuuc

SEQ ID NO: 2187091 - RNA, 17 nt, Human
ucaucuauuucugagaa

SEQ ID NO: 2187092 - RNA, 16 nt, Human
ucaucuauuucugaga

SEQ ID NO: 2187093 - RNA, 15 nt, Human
ucaucuauuucugag

SEQ ID NO: 2187094 - RNA, 14 nt, Human
ucaucuauuucuga

SEQ ID NO: 2187095 - RNA, 11 nt, Human
ucaucuauuuc

SEQ ID NO: 2187096 - RNA, 13 nt, Human
ucaucuauaaaga

SEQ ID NO: 2187097 - RNA, 23 nt, Human
ucaucuauaaagaagaacuugca

SEQ ID NO: 2187098 - RNA, 18 nt, Human
ucaucuauuucugagaag

SEQ ID NO: 2187099 - RNA, 13 nt, Human
ucaugaagcccaa

SEQ ID NO: 2187100 - RNA, 16 nt, Human
ucaugaaucugcaaug

SEQ ID NO: 2187101 - RNA, 16 nt, Human
ucaugaauuaguuuua

SEQ ID NO: 2187102 - RNA, 13 nt, Human
ucaucuaguuuua

SEQ ID NO: 2187103 - RNA, 18 nt, Human
ucaucuagguaaauuaca

SEQ ID NO: 2187104 - RNA, 14 nt, Human
ucaucuaggauuuu

SEQ ID NO: 2187105 - RNA, 22 nt, Human
ucauccuucuggaauaaggaga

SEQ ID NO: 2187106 - RNA, 15 nt, Human
accuaaauggccuca

SEQ ID NO: 2187107 - RNA, 18 nt, Human
accuaacauuauuuauuc

SEQ ID NO: 2187108 - RNA, 16 nt, Human
accuaaccccuuuccu

SEQ ID NO: 2187109 - RNA, 15 nt, Human
accuaaccccuuucc

SEQ ID NO: 2187110 - RNA, 22 nt, Human
accuaaaaggaaaucucacccc

SEQ ID NO: 2187111 - RNA, 21 nt, Human
accuaaaaggaaaucucaccc

SEQ ID NO: 2187112 - RNA, 13 nt, Human
accuaaaagagau

SEQ ID NO: 2187113 - RNA, 21 nt, Human
accuaaaagagauuucaagag

SEQ ID NO: 2187114 - RNA, 16 nt, Human
accuaaaaaagauaua

SEQ ID NO: 2187115 - RNA, 19 nt, Human
accuaaaaaagauauauua

SEQ ID NO: 2187116 - RNA, 23 nt, Human
accuaaacauagaaauugccuga

SEQ ID NO: 2187117 - RNA, 19 nt, Human
accuaaaauuugcccuccc

SEQ ID NO: 2187118 - RNA, 21 nt, Human
accuaaaauuugcccucccau

SEQ ID NO: 2187119 - RNA, 22 nt, Human
accuaaaauuugcccucccauc

SEQ ID NO: 2187120 - RNA, 15 nt, Human
accuaaacagauaua

SEQ ID NO: 2187121 - RNA, 14 nt, Human
accgcuccccagcc

SEQ ID NO: 2187122 - RNA, 15 nt, Human
accuaaaaaagauau

SEQ ID NO: 2187123 - RNA, 13 nt, Human
accgcuccccagc

SEQ ID NO: 2187124 - RNA, 13 nt, Human
accgcguuguaaa

SEQ ID NO: 2187125 - RNA, 15 nt, Human
accgcguuguaaaau

SEQ ID NO: 2187126 - RNA, 18 nt, Human
accgcguuguaaaauaua

SEQ ID NO: 2187127 - RNA, 19 nt, Human
accgcguuguaaaauauag

SEQ ID NO: 2187128 - RNA, 15 nt, Human
accgcgucuggugac

SEQ ID NO: 2187129 - RNA, 20 nt, Human
accgcgacuaauuucaaaau

SEQ ID NO: 2187130 - RNA, 18 nt, Human
ucaggaacagcuauggga

SEQ ID NO: 2187131 - RNA, 17 nt, Human
accgcgacuaauuucaa

SEQ ID NO: 2187132 - RNA, 16 nt, Human
accgcgacuaauuuca

SEQ ID NO: 2187133 - RNA, 16 nt, Human
ucaggaacagaaggau

SEQ ID NO: 2187134 - RNA, 14 nt, Human
ucaggaacagaagg

SEQ ID NO: 2187135 - RNA, 15 nt, Human
ucaggaagcucaggg

SEQ ID NO: 2187136 - RNA, 13 nt, Human
ucaggaagcucag

SEQ ID NO: 2187137 - RNA, 14 nt, Human
ucaggaagcucagg

SEQ ID NO: 2187138 - RNA, 13 nt, Human
ucaggaacagaag

SEQ ID NO: 2187139 - RNA, 21 nt, Human
ucaggaaauauauaugugugu

SEQ ID NO: 2187140 - RNA, 20 nt, Human
ucaggaaauauauaugugug

SEQ ID NO: 2187141 - RNA, 19 nt, Human
ucaggaaauauauaugugu

SEQ ID NO: 2187142 - RNA, 18 nt, Human
ucaggaaauauauaugug

SEQ ID NO: 2187143 - RNA, 22 nt, Human
ucaggaaaggaaucauuucuau

SEQ ID NO: 2187144 - RNA, 12 nt, Human
ucaggaagcuca

SEQ ID NO: 2187145 - RNA, 23 nt, Human
ucaggaaaucaaauaugcaaagc

SEQ ID NO: 2187146 - RNA, 22 nt, Human
ucaggaaaucaaauaugcaaag

SEQ ID NO: 2187147 - RNA, 18 nt, Human
accuauaaaguaaagcua

SEQ ID NO: 2187148 - RNA, 23 nt, Human
accucaaacuuccagucagguag

SEQ ID NO: 2187149 - RNA, 19 nt, Human
accuauaaaguaaagcuaa

SEQ ID NO: 2187150 - RNA, 18 nt, Human
accuauaaaacaggucaa

SEQ ID NO: 2187151 - RNA, 16 nt, Human
accuauaaaguaaagc

SEQ ID NO: 2187152 - RNA, 15 nt, Human
accuauaaaacaggu

SEQ ID NO: 2187153 - RNA, 22 nt, Human
accuaguggcuguccagugccc

SEQ ID NO: 2187154 - RNA, 19 nt, Human
accucaaaaugucuaagau

SEQ ID NO: 2187155 - RNA, 15 nt, Human
accuaguagucauuu

SEQ ID NO: 2187156 - RNA, 13 nt, Human
accuagucuaagg

SEQ ID NO: 2187157 - RNA, 16 nt, Human
accuaccucagguugc

SEQ ID NO: 2187158 - RNA, 14 nt, Human
accuaguuuuccau

SEQ ID NO: 2187159 - RNA, 23 nt, Human
accuaguggcuguccagugccca

SEQ ID NO: 2187160 - RNA, 16 nt, Human
accuaguggcugucca

SEQ ID NO: 2187161 - RNA, 17 nt, Human
accuaguggcuguccag

SEQ ID NO: 2187162 - RNA, 19 nt, Human
accuaguggcuguccagug

SEQ ID NO: 2187163 - RNA, 21 nt, Human
accuaguggcuguccagugcc

SEQ ID NO: 2187164 - RNA, 19 nt, Human
accuaccacagugucugua

SEQ ID NO: 2187165 - RNA, 12 nt, Human
accuaccacaug

SEQ ID NO: 2187166 - RNA, 17 nt, Human
accuaccacagugucug

SEQ ID NO: 2187167 - RNA, 16 nt, Human
accuaccacagugucu

SEQ ID NO: 2187168 - RNA, 16 nt, Human
accuaccaccacgccc

SEQ ID NO: 2187169 - RNA, 20 nt, Human
accuaccaccacgcccggcu

SEQ ID NO: 2187170 - RNA, 15 nt, Human
accuaccacaugcca

SEQ ID NO: 2187171 - RNA, 18 nt, Human
accuaccaccccuuccug

SEQ ID NO: 2187172 - RNA, 19 nt, Human
accuaccaccccuuccugu

SEQ ID NO: 2187173 - RNA, 21 nt, Human
accuaccaccccuuccugucc

SEQ ID NO: 2187174 - RNA, 14 nt, Human
accuaccaucaggg

SEQ ID NO: 2187175 - RNA, 12 nt, Human
accuaccucagg

SEQ ID NO: 2187176 - RNA, 13 nt, Human
accuaccucaggu

SEQ ID NO: 2187177 - RNA, 14 nt, Human
accuaccucagguu

SEQ ID NO: 2187178 - RNA, 15 nt, Human
accuaccucagguug

SEQ ID NO: 2187179 - RNA, 21 nt, Human
accuagggugauauuaaccag

SEQ ID NO: 2187180 - RNA, 15 nt, Human
accuacaguguacag

SEQ ID NO: 2187181 - RNA, 19 nt, Human
accuaauuagagcagauga

SEQ ID NO: 2187182 - RNA, 22 nt, Human
accuacaccauuaucuuggaaa

SEQ ID NO: 2187183 - RNA, 15 nt, Human
accuaauuagagcag

SEQ ID NO: 2187184 - RNA, 16 nt, Human
accuaauuagagcaga

SEQ ID NO: 2187185 - RNA, 20 nt, Human
accuaauguuuaugagccag

SEQ ID NO: 2187186 - RNA, 19 nt, Human
accuaauguuuaugagcca

SEQ ID NO: 2187187 - RNA, 12 nt, Human
accuaauguuua

SEQ ID NO: 2187188 - RNA, 20 nt, Human
accuaaugcuccuuguuccu

SEQ ID NO: 2187189 - RNA, 21 nt, Human
accuaauccaggcagauccag

SEQ ID NO: 2187190 - RNA, 22 nt, Human
accuaauccaggcagauccagg

SEQ ID NO: 2187191 - RNA, 16 nt, Human
accuacaguguacagu

SEQ ID NO: 2187192 - RNA, 17 nt, Human
accuacaguguacaguc

SEQ ID NO: 2187193 - RNA, 18 nt, Human
accuacaguguacagucu

SEQ ID NO: 2187194 - RNA, 20 nt, Human
accuacaguguacagucuug

SEQ ID NO: 2187195 - RNA, 15 nt, Human
accuaccacaguguc

SEQ ID NO: 2187196 - RNA, 14 nt, Human
accuaccaaaaaau

SEQ ID NO: 2187197 - RNA, 15 nt, Human
accuacauguauuug

SEQ ID NO: 2187198 - RNA, 14 nt, Human
accuacauguauuu

SEQ ID NO: 2187199 - RNA, 13 nt, Human
accuacauguauu

SEQ ID NO: 2187200 - RNA, 16 nt, Human
accuuauuuuuuccca

SEQ ID NO: 2187201 - RNA, 20 nt, Human
accuuauuguaccucucuua

SEQ ID NO: 2187202 - RNA, 22 nt, Human
accuuauuguaccucucuuaua

SEQ ID NO: 2187203 - RNA, 18 nt, Human
accuuauuuuuucccaaa

SEQ ID NO: 2187204 - RNA, 19 nt, Human
accuucaaacuagggccaa

SEQ ID NO: 2187205 - RNA, 12 nt, Human
accuucaauaaa

SEQ ID NO: 2187206 - RNA, 23 nt, Human
accuuaucugugcgugaaacaca

SEQ ID NO: 2187207 - RNA, 14 nt, Human
accuuauuguaccu

SEQ ID NO: 2187208 - RNA, 17 nt, Human
accuuauuguaccucuc

SEQ ID NO: 2187209 - RNA, 18 nt, Human
accuuauuguaccucucu

SEQ ID NO: 2187210 - RNA, 22 nt, Human
accuuagauguucuaagucuuu

SEQ ID NO: 2187211 - RNA, 22 nt, Human
accuuaucugugcgugaaacac

SEQ ID NO: 2187212 - RNA, 16 nt, Human
accuucaauuccuggg

SEQ ID NO: 2187213 - RNA, 20 nt, Human
accuucaauaaaguaucuac

SEQ ID NO: 2187214 - RNA, 19 nt, Human
accuucaauaaaguaucua

SEQ ID NO: 2187215 - RNA, 17 nt, Human
accuucaauaaaguauc

SEQ ID NO: 2187216 - RNA, 15 nt, Human
accuucaauaaagua

SEQ ID NO: 2187217 - RNA, 14 nt, Human
accuucaauaaagu

SEQ ID NO: 2187218 - RNA, 13 nt, Human
accuucaauaaag

SEQ ID NO: 2187219 - RNA, 14 nt, Human
accuuuugagugcc

SEQ ID NO: 2187220 - RNA, 17 nt, Human
accuuuugagugccuua

SEQ ID NO: 2187221 - RNA, 20 nt, Human
accuuuugagugccuuacac

SEQ ID NO: 2187222 - RNA, 18 nt, Human
uccacgacugucuccaug

SEQ ID NO: 2187223 - RNA, 17 nt, Human
uccacgacugucuccau

SEQ ID NO: 2187224 - RNA, 18 nt, Human
uccacuccuccuagccac

SEQ ID NO: 2187225 - RNA, 15 nt, Human
uccacuccuccuagc

SEQ ID NO: 2187226 - RNA, 15 nt, Human
uccacucaguugcaa

SEQ ID NO: 2187227 - RNA, 12 nt, Human
uccacucccacu

SEQ ID NO: 2187228 - RNA, 19 nt, Human
uccacgacugucuccaugg

SEQ ID NO: 2187229 - RNA, 13 nt, Human
uccacucccacuu

SEQ ID NO: 2187230 - RNA, 14 nt, Human
uccacucccaggca

SEQ ID NO: 2187231 - RNA, 19 nt, Human
uccacucccaggcagcccu

SEQ ID NO: 2187232 - RNA, 13 nt, Human
uccacucccagug

SEQ ID NO: 2187233 - RNA, 23 nt, Human
accuucaauaaaguaucuacaug

SEQ ID NO: 2187234 - RNA, 21 nt, Human
accuuuugcaccugcucucuu

SEQ ID NO: 2187235 - RNA, 19 nt, Human
accuuuugggaauguuuua

SEQ ID NO: 2187236 - RNA, 16 nt, Human
accuuuugggaauguu

SEQ ID NO: 2187237 - RNA, 22 nt, Human
accuuuugggaauguuuuaaau

SEQ ID NO: 2187238 - RNA, 16 nt, Human
uccaccuucccaugcc

SEQ ID NO: 2187239 - RNA, 18 nt, Human
uccaccuucccaugcccu

SEQ ID NO: 2187240 - RNA, 19 nt, Human
uccaccuucccaugcccug

SEQ ID NO: 2187241 - RNA, 16 nt, Human
uccacgacugucucca

SEQ ID NO: 2187242 - RNA, 15 nt, Human
uccacgacugucucc

SEQ ID NO: 2187243 - RNA, 14 nt, Human
uccacgacugucuc

SEQ ID NO: 2187244 - RNA, 14 nt, Human
uccagagacuggga

SEQ ID NO: 2187245 - RNA, 19 nt, Human
uccagagagagaagugccc

SEQ ID NO: 2187246 - RNA, 20 nt, Human
uccagacuuccuugagacac

SEQ ID NO: 2187247 - RNA, 19 nt, Human
uccagacuuccuugagaca

SEQ ID NO: 2187248 - RNA, 14 nt, Human
uccagacuuccuug

SEQ ID NO: 2187249 - RNA, 23 nt, Human
uccagacugcuuccaauuuucug

SEQ ID NO: 2187250 - RNA, 22 nt, Human
uccagaccugauccuggaggcc

SEQ ID NO: 2187251 - RNA, 19 nt, Human
uccagaccugauccuggag

SEQ ID NO: 2187252 - RNA, 18 nt, Human
uccagaccugauccugga

SEQ ID NO: 2187253 - RNA, 13 nt, Human
uccagaccugauc

SEQ ID NO: 2187254 - RNA, 22 nt, Human
uccagacugcuuccaauuuucu

SEQ ID NO: 2187255 - RNA, 14 nt, Human
uccagacucucugu

SEQ ID NO: 2187256 - RNA, 15 nt, Human
uccagacucucugug

SEQ ID NO: 2187257 - RNA, 21 nt, Human
uccagaccuuguucacacucu

SEQ ID NO: 2187258 - RNA, 18 nt, Human
uccagacguaggggaggg

SEQ ID NO: 2187259 - RNA, 24 nt, Human
uccagacaaaccagaagcaacaga

SEQ ID NO: 2187260 - RNA, 19 nt, Human
uccagacaaaccagaagca

SEQ ID NO: 2187261 - RNA, 11 nt, Human
uccagaccuga

SEQ ID NO: 2187262 - RNA, 16 nt, Human
uccagaccugaagaau

SEQ ID NO: 2187263 - RNA, 15 nt, Human
uccagaccugaagaa

SEQ ID NO: 2187264 - RNA, 19 nt, Human
uccagacccggcugcgugg

SEQ ID NO: 2187265 - RNA, 15 nt, Human
uccagacccggcugc

SEQ ID NO: 2187266 - RNA, 18 nt, Human
uccagacccggcugcgug

SEQ ID NO: 2187267 - RNA, 17 nt, Human
uccacuggacuugagcu

SEQ ID NO: 2187268 - RNA, 22 nt, Human
uccacuggccggagucagugcc

SEQ ID NO: 2187269 - RNA, 18 nt, Human
uccacuggggauugggcc

SEQ ID NO: 2187270 - RNA, 14 nt, Human
uccagacccggcug

SEQ ID NO: 2187271 - RNA, 13 nt, Human
uccagacacaugu

SEQ ID NO: 2187272 - RNA, 20 nt, Human
uccagaauuucccaaagcag

SEQ ID NO: 2187273 - RNA, 22 nt, Human
uccagaauuucccaaagcagug

SEQ ID NO: 2187274 - RNA, 21 nt, Human
uccacuccuccuagccaccca

SEQ ID NO: 2187275 - RNA, 15 nt, Human
uccacugagggcagu

SEQ ID NO: 2187276 - RNA, 13 nt, Human
uccacugccuucg

SEQ ID NO: 2187277 - RNA, 15 nt, Human
uccacugccuucgau

SEQ ID NO: 2187278 - RNA, 22 nt, Human
uccacugccuucgauacaccgg

SEQ ID NO: 2187279 - RNA, 16 nt, Human
uccacuggacuugagc

SEQ ID NO: 2187280 - RNA, 12 nt, Human
uccacuggacuu

SEQ ID NO: 2187281 - RNA, 10 nt, Human
uccacuggac

SEQ ID NO: 2187282 - RNA, 15 nt, Human
uccacucccagugcu

SEQ ID NO: 2187283 - RNA, 12 nt, Human
uccacugccugg

SEQ ID NO: 2187284 - RNA, 16 nt, Human
uccagaauuucccaaa

SEQ ID NO: 2187285 - RNA, 21 nt, Human
uccaggccccaaaaccacagc

SEQ ID NO: 2187286 - RNA, 17 nt, Human
uccaggccauggaggca

SEQ ID NO: 2187287 - RNA, 18 nt, Human
uccaggccagggggccag

SEQ ID NO: 2187288 - RNA, 14 nt, Human
uccaggcuguaucc

SEQ ID NO: 2187289 - RNA, 23 nt, Human
uccaggcacccuucuuuccucuu

SEQ ID NO: 2187290 - RNA, 16 nt, Human
uccaggccagggggcc

SEQ ID NO: 2187291 - RNA, 22 nt, Human
uccaggcagucgggggcuggcc

SEQ ID NO: 2187292 - RNA, 14 nt, Human
uccaggcaggcuaa

SEQ ID NO: 2187293 - RNA, 23 nt, Human
uccaggcagucgggggcuggccu

SEQ ID NO: 2187294 - RNA, 21 nt, Human
uccaggcagauccaggacuau

SEQ ID NO: 2187295 - RNA, 20 nt, Human
uccaggcagauccaggacua

SEQ ID NO: 2187296 - RNA, 19 nt, Human
uccaggcagauccaggacu

SEQ ID NO: 2187297 - RNA, 18 nt, Human
uccaggcagauccaggac

SEQ ID NO: 2187298 - RNA, 17 nt, Human
uccaggcagauccagga

SEQ ID NO: 2187299 - RNA, 16 nt, Human
uccaggcagauccagg

SEQ ID NO: 2187300 - RNA, 15 nt, Human
uccaggcagauccag

SEQ ID NO: 2187301 - RNA, 14 nt, Human
uccaggcagaucca

SEQ ID NO: 2187302 - RNA, 16 nt, Human
uccagagaguggcucc

SEQ ID NO: 2187303 - RNA, 17 nt, Human
uccagagaguggcuccu

SEQ ID NO: 2187304 - RNA, 23 nt, Human
uccagagagagaagugccccugc

SEQ ID NO: 2187305 - RNA, 15 nt, Human
uccagagaguccucu

SEQ ID NO: 2187306 - RNA, 21 nt, Human
uccagagagagaagugccccu

SEQ ID NO: 2187307 - RNA, 15 nt, Human
uccagagaguggcuc

SEQ ID NO: 2187308 - RNA, 12 nt, Human
uccagccccugg

SEQ ID NO: 2187309 - RNA, 14 nt, Human
uccagccccucugg

SEQ ID NO: 2187310 - RNA, 18 nt, Human
uccagagaguccucugga

SEQ ID NO: 2187311 - RNA, 19 nt, Human
uccagagaguccucuggau

SEQ ID NO: 2187312 - RNA, 15 nt, Human
uccagccccucuggu

SEQ ID NO: 2187313 - RNA, 16 nt, Human
uccagccccucugguc

SEQ ID NO: 2187314 - RNA, 18 nt, Human
uccagccccucuggucgc

SEQ ID NO: 2187315 - RNA, 23 nt, Human
uccagccccucuggucgcuccug

SEQ ID NO: 2187316 - RNA, 13 nt, Human
uccagccccugga

SEQ ID NO: 2187317 - RNA, 13 nt, Human
uccaggcagaucc

SEQ ID NO: 2187318 - RNA, 16 nt, Human
uccaggcacugagaua

SEQ ID NO: 2187319 - RNA, 14 nt, Human
uccaggcacugaga

SEQ ID NO: 2187320 - RNA, 20 nt, Human
uccaggcacccuucuuuccu

SEQ ID NO: 2187321 - RNA, 21 nt, Human
uccaggcacccuucuuuccuc

SEQ ID NO: 2187322 - RNA, 15 nt, Human
uccaggcacccuucu

SEQ ID NO: 2187323 - RNA, 16 nt, Human
uccaggcacccuucuu

SEQ ID NO: 2187324 - RNA, 19 nt, Human
uccaggcacccuucuuucc

SEQ ID NO: 2187325 - RNA, 19 nt, Human
acgagaucaagagaucaag

SEQ ID NO: 2187326 - RNA, 21 nt, Human
acgagaggggaagaguguacu

SEQ ID NO: 2187327 - RNA, 18 nt, Human
acgagagguaugccugua

SEQ ID NO: 2187328 - RNA, 20 nt, Human
acgagaggggaagaguguac

SEQ ID NO: 2187329 - RNA, 18 nt, Human
uccagggaagcuggccga

SEQ ID NO: 2187330 - RNA, 15 nt, Human
acgagaaagaucauu

SEQ ID NO: 2187331 - RNA, 17 nt, Human
uccagggaagcuggccg

SEQ ID NO: 2187332 - RNA, 20 nt, Human
acgagacccuacaggagagg

SEQ ID NO: 2187333 - RNA, 19 nt, Human
acgagacccuacaggagag

SEQ ID NO: 2187334 - RNA, 20 nt, Human
acgagcaggcuacugucagc

SEQ ID NO: 2187335 - RNA, 19 nt, Human
acgagcaggcuacugucag

SEQ ID NO: 2187336 - RNA, 12 nt, Human
acgaggaagccc

SEQ ID NO: 2187337 - RNA, 11 nt, Human
acgaggcccuc

SEQ ID NO: 2187338 - RNA, 19 nt, Human
acgagcuguuuacuaggga

SEQ ID NO: 2187339 - RNA, 16 nt, Human
acgagcaggcuucuuc

SEQ ID NO: 2187340 - RNA, 19 nt, Human
acgccagauucuuuccuga

SEQ ID NO: 2187341 - RNA, 17 nt, Human
acgccagauucuuuccu

SEQ ID NO: 2187342 - RNA, 13 nt, Human
acgaggcccucgg

SEQ ID NO: 2187343 - RNA, 16 nt, Human
acgaggcccucgggcc

SEQ ID NO: 2187344 - RNA, 18 nt, Human
acgaggcccucgggccca

SEQ ID NO: 2187345 - RNA, 19 nt, Human
acgaggcccucgggcccag

SEQ ID NO: 2187346 - RNA, 21 nt, Human
uccaggcuguaucccaugagc

SEQ ID NO: 2187347 - RNA, 20 nt, Human
uccaggcugucuuucacuga

SEQ ID NO: 2187348 - RNA, 17 nt, Human
uccaggcuuggauguaa

SEQ ID NO: 2187349 - RNA, 12 nt, Human
uccagggaagcu

SEQ ID NO: 2187350 - RNA, 20 nt, Human
accuuuuuuauacauaaaca

SEQ ID NO: 2187351 - RNA, 19 nt, Human
accuuuuuuauacauaaac

SEQ ID NO: 2187352 - RNA, 16 nt, Human
uccagggaagcuggcc

SEQ ID NO: 2187353 - RNA, 14 nt, Human
uccagggaagcugg

SEQ ID NO: 2187354 - RNA, 22 nt, Human
accuuuuuuauacauaaacaag

SEQ ID NO: 2187355 - RNA, 21 nt, Human
accuuuuuuauacauaaacaa

SEQ ID NO: 2187356 - RNA, 14 nt, Human
acgagaaaacaaua

SEQ ID NO: 2187357 - RNA, 20 nt, Human
accuguuuuuaagcuguuuc

SEQ ID NO: 2187358 - RNA, 16 nt, Human
accuguuuuuaagcug

SEQ ID NO: 2187359 - RNA, 18 nt, Human
accuguuuucgcaccuac

SEQ ID NO: 2187360 - RNA, 18 nt, Human
accuguuuuuaagcuguu

SEQ ID NO: 2187361 - RNA, 19 nt, Human
accuguuuuuaagcuguuu

SEQ ID NO: 2187362 - RNA, 21 nt, Human
accuggucacaggacucugcc

SEQ ID NO: 2187363 - RNA, 19 nt, Human
accuguuucugcagccacu

SEQ ID NO: 2187364 - RNA, 18 nt, Human
accuuagacagucccugc

SEQ ID NO: 2187365 - RNA, 19 nt, Human
accuuagacagucccugcc

SEQ ID NO: 2187366 - RNA, 20 nt, Human
accuuagacagucccugcca

SEQ ID NO: 2187367 - RNA, 22 nt, Human
accuggguucccuuuccuucca

SEQ ID NO: 2187368 - RNA, 17 nt, Human
accuggguucccuuucc

SEQ ID NO: 2187369 - RNA, 15 nt, Human
accuggguccuuuuc

SEQ ID NO: 2187370 - RNA, 16 nt, Human
accugguacccuccug

SEQ ID NO: 2187371 - RNA, 18 nt, Human
accugguacccuccuggc

SEQ ID NO: 2187372 - RNA, 19 nt, Human
accugguacccuccuggcu

SEQ ID NO: 2187373 - RNA, 23 nt, Human
accuggguccaaauaaaaacuaa

SEQ ID NO: 2187374 - RNA, 20 nt, Human
accuggguccaaauaaaaac

SEQ ID NO: 2187375 - RNA, 21 nt, Human
accuggguccaaauaaaaacu

SEQ ID NO: 2187376 - RNA, 15 nt, Human
accuggguccaaaua

SEQ ID NO: 2187377 - RNA, 16 nt, Human
accuggguccaaauaa

SEQ ID NO: 2187378 - RNA, 17 nt, Human
accuggguccaaauaaa

SEQ ID NO: 2187379 - RNA, 18 nt, Human
accuggguccaaauaaaa

SEQ ID NO: 2187380 - RNA, 19 nt, Human
accuggcugagccuggcug

SEQ ID NO: 2187381 - RNA, 13 nt, Human
accuggcugaggu

SEQ ID NO: 2187382 - RNA, 19 nt, Human
accuggcugagguuccucu

SEQ ID NO: 2187383 - RNA, 21 nt, Human
accuggcugagguuccucugc

SEQ ID NO: 2187384 - RNA, 23 nt, Human
accuggcugagguuccucugccu

SEQ ID NO: 2187385 - RNA, 22 nt, Human
accuggcugagguuccucugcc

SEQ ID NO: 2187386 - RNA, 14 nt, Human
accuggguccaaau

SEQ ID NO: 2187387 - RNA, 23 nt, Human
accuggccucugcacuccccugc

SEQ ID NO: 2187388 - RNA, 18 nt, Human
accuggccucugcacucc

SEQ ID NO: 2187389 - RNA, 20 nt, Human
accuggccucugcacucccc

SEQ ID NO: 2187390 - RNA, 17 nt, Human
uccacccagcccauucu

SEQ ID NO: 2187391 - RNA, 15 nt, Human
uccacccagcccauu

SEQ ID NO: 2187392 - RNA, 14 nt, Human
uccacccagcccau

SEQ ID NO: 2187393 - RNA, 13 nt, Human
uccacccagccca

SEQ ID NO: 2187394 - RNA, 18 nt, Human
accuggagccccugggug

SEQ ID NO: 2187395 - RNA, 13 nt, Human
accuggagggcua

SEQ ID NO: 2187396 - RNA, 21 nt, Human
accuggagggcuagaaccuag

SEQ ID NO: 2187397 - RNA, 20 nt, Human
accuggagggcuagaaccug

SEQ ID NO: 2187398 - RNA, 22 nt, Human
accuggagggcuagaaccugga

SEQ ID NO: 2187399 - RNA, 23 nt, Human
accuggagggcuagaaccuggag

SEQ ID NO: 2187400 - RNA, 22 nt, Human
accuggagggcuagaaccuggc

SEQ ID NO: 2187401 - RNA, 15 nt, Human
accuggagggcugga

SEQ ID NO: 2187402 - RNA, 14 nt, Human
accuggaggggcua

SEQ ID NO: 2187403 - RNA, 19 nt, Human
accuggaguuccugaaccu

SEQ ID NO: 2187404 - RNA, 22 nt, Human
accuggaggggcuagaaccuag

SEQ ID NO: 2187405 - RNA, 16 nt, Human
accuggaguuccugaa

SEQ ID NO: 2187406 - RNA, 14 nt, Human
accuggcagcucug

SEQ ID NO: 2187407 - RNA, 15 nt, Human
accuggcacugcugu

SEQ ID NO: 2187408 - RNA, 17 nt, Human
accuggcacugcugugc

SEQ ID NO: 2187409 - RNA, 20 nt, Human
accuggcaagcuagaaccug

SEQ ID NO: 2187410 - RNA, 22 nt, Human
accuggcaagcuagaaccugga

SEQ ID NO: 2187411 - RNA, 23 nt, Human
accuggcaagcuagaaccuggag

SEQ ID NO: 2187412 - RNA, 14 nt, Human
accuggcacugcug

SEQ ID NO: 2187413 - RNA, 14 nt, Human
accuggccucugca

SEQ ID NO: 2187414 - RNA, 17 nt, Human
accuggcagcucuggac

SEQ ID NO: 2187415 - RNA, 21 nt, Human
accuggcaucgcaccauucug

SEQ ID NO: 2187416 - RNA, 18 nt, Human
accuggcacugcugugcu

SEQ ID NO: 2187417 - RNA, 13 nt, Human
accuggccaccug

SEQ ID NO: 2187418 - RNA, 16 nt, Human
accuggccaccugagg

SEQ ID NO: 2187419 - RNA, 18 nt, Human
accuggccaccugaggug

SEQ ID NO: 2187420 - RNA, 16 nt, Human
accuggccucugcacu

SEQ ID NO: 2187421 - RNA, 17 nt, Human
accuggccucugcacuc

SEQ ID NO: 2187422 - RNA, 15 nt, Human
uccaaucucauggag

SEQ ID NO: 2187423 - RNA, 17 nt, Human
uccacccaccucagccu

SEQ ID NO: 2187424 - RNA, 18 nt, Human
uccacccaccucagccuc

SEQ ID NO: 2187425 - RNA, 19 nt, Human
uccacccaccucagccucc

SEQ ID NO: 2187426 - RNA, 12 nt, Human
uccacccagccc

SEQ ID NO: 2187427 - RNA, 12 nt, Human
uccacccagcaa

SEQ ID NO: 2187428 - RNA, 17 nt, Human
uccacccaccuuggccu

SEQ ID NO: 2187429 - RNA, 12 nt, Human
uccacccaggag

SEQ ID NO: 2187430 - RNA, 14 nt, Human
uccacccaggagcc

SEQ ID NO: 2187431 - RNA, 15 nt, Human
uccacccaggagccc

SEQ ID NO: 2187432 - RNA, 13 nt, Human
accugccacucac

SEQ ID NO: 2187433 - RNA, 14 nt, Human
accugccacucaca

SEQ ID NO: 2187434 - RNA, 16 nt, Human
accugccacucacaca

SEQ ID NO: 2187435 - RNA, 17 nt, Human
accugccacucacacag

SEQ ID NO: 2187436 - RNA, 15 nt, Human
accugccagccuggc

SEQ ID NO: 2187437 - RNA, 14 nt, Human
accugccagccugg

SEQ ID NO: 2187438 - RNA, 19 nt, Human
accugccacucacacagcc

SEQ ID NO: 2187439 - RNA, 20 nt, Human
accugccacucacacagcca

SEQ ID NO: 2187440 - RNA, 21 nt, Human
accugccacucacacagccag

SEQ ID NO: 2187441 - RNA, 22 nt, Human
accugccacucacacagccagg

SEQ ID NO: 2187442 - RNA, 12 nt, Human
accugccaggaa

SEQ ID NO: 2187443 - RNA, 14 nt, Human
accugccaggaagc

SEQ ID NO: 2187444 - RNA, 22 nt, Human
uccaacccaugaugagcuccuc

SEQ ID NO: 2187445 - RNA, 17 nt, Human
uccaacccauuagccau

SEQ ID NO: 2187446 - RNA, 14 nt, Human
uccaaccccaacuc

SEQ ID NO: 2187447 - RNA, 15 nt, Human
uccaaccccaacucc

SEQ ID NO: 2187448 - RNA, 16 nt, Human
uccaaccccaacucca

SEQ ID NO: 2187449 - RNA, 18 nt, Human
uccaaccccaacuccagu

SEQ ID NO: 2187450 - RNA, 19 nt, Human
uccaaccccaacuccagua

SEQ ID NO: 2187451 - RNA, 17 nt, Human
uccaaccccccaccugc

SEQ ID NO: 2187452 - RNA, 14 nt, Human
uccaaccccccagc

SEQ ID NO: 2187453 - RNA, 17 nt, Human
uccaaccccccagcacu

SEQ ID NO: 2187454 - RNA, 18 nt, Human
uccaaccccccagcacug

SEQ ID NO: 2187455 - RNA, 15 nt, Human
uccaacccaugauga

SEQ ID NO: 2187456 - RNA, 21 nt, Human
accugccagccuggcuucugg

SEQ ID NO: 2187457 - RNA, 18 nt, Human
accugccagccuggcuuc

SEQ ID NO: 2187458 - RNA, 16 nt, Human
accugccagccuggcu

SEQ ID NO: 2187459 - RNA, 15 nt, Human
accugccaggaagcc

SEQ ID NO: 2187460 - RNA, 16 nt, Human
uccaacccgaggcccg

SEQ ID NO: 2187461 - RNA, 23 nt, Human
uccaaccccccagcacugaggaa

SEQ ID NO: 2187462 - RNA, 19 nt, Human
uccaaccccccagcacuga

SEQ ID NO: 2187463 - RNA, 20 nt, Human
uccaaccccccagcacugag

SEQ ID NO: 2187464 - RNA, 21 nt, Human
uccaaccccccagcacugagg

SEQ ID NO: 2187465 - RNA, 22 nt, Human
uccaaccccccagcacugagga

SEQ ID NO: 2187466 - RNA, 14 nt, Human
uccaacccucauca

SEQ ID NO: 2187467 - RNA, 23 nt, Human
uccaacccucaucaccaacgucu

SEQ ID NO: 2187468 - RNA, 16 nt, Human
uccaacccucaucacc

SEQ ID NO: 2187469 - RNA, 17 nt, Human
uccaacccucaucacca

SEQ ID NO: 2187470 - RNA, 17 nt, Human
uccaagucucaguggcu

SEQ ID NO: 2187471 - RNA, 15 nt, Human
uccaagguggucugc

SEQ ID NO: 2187472 - RNA, 20 nt, Human
uccaaggaaaccacagcugc

SEQ ID NO: 2187473 - RNA, 21 nt, Human
uccaaggaaaccacagcugcu

SEQ ID NO: 2187474 - RNA, 23 nt, Human
uccaagguggucugcucgggccc

SEQ ID NO: 2187475 - RNA, 21 nt, Human
uccaagcuggucccacucagu

SEQ ID NO: 2187476 - RNA, 18 nt, Human
uccaaggguacuaaggaa

SEQ ID NO: 2187477 - RNA, 12 nt, Human
uccaagcuuuug

SEQ ID NO: 2187478 - RNA, 19 nt, Human
uccaaggaaaccacagcug

SEQ ID NO: 2187479 - RNA, 18 nt, Human
uccaaucccaccaacccu

SEQ ID NO: 2187480 - RNA, 21 nt, Human
uccaagugaacacuagccaga

SEQ ID NO: 2187481 - RNA, 15 nt, Human
uccaagugccaauau

SEQ ID NO: 2187482 - RNA, 17 nt, Human
uccaagugccagaggug

SEQ ID NO: 2187483 - RNA, 18 nt, Human
uccaagugccagaggugg

SEQ ID NO: 2187484 - RNA, 17 nt, Human
uccaagugaacacuagc

SEQ ID NO: 2187485 - RNA, 20 nt, Human
uccaagugaacacuagccag

SEQ ID NO: 2187486 - RNA, 18 nt, Human
uccaauccugcccccuga

SEQ ID NO: 2187487 - RNA, 19 nt, Human
uccaaucuaaccacaucaa

SEQ ID NO: 2187488 - RNA, 18 nt, Human
uccaauccucacugggug

SEQ ID NO: 2187489 - RNA, 13 nt, Human
uccaauccugccc

SEQ ID NO: 2187490 - RNA, 14 nt, Human
uccaauccugcccc

SEQ ID NO: 2187491 - RNA, 16 nt, Human
uccaauccugcccccu

SEQ ID NO: 2187492 - RNA, 17 nt, Human
uccaauccucacugggu

SEQ ID NO: 2187493 - RNA, 16 nt, Human
uccaauccucacuggg

SEQ ID NO: 2187494 - RNA, 15 nt, Human
uccaauccucacugg

SEQ ID NO: 2187495 - RNA, 14 nt, Human
uccaauccucacug

SEQ ID NO: 2187496 - RNA, 22 nt, Human
uccaaucccauagaugggucug

SEQ ID NO: 2187497 - RNA, 16 nt, Human
uccaauccuauguuuu

SEQ ID NO: 2187498 - RNA, 17 nt, Human
uccaaccuggacaacaa

SEQ ID NO: 2187499 - RNA, 14 nt, Human
uccaaccuggacaa

SEQ ID NO: 2187500 - RNA, 21 nt, Human
uccaaccugcaaagaucuguc

SEQ ID NO: 2187501 - RNA, 13 nt, Human
uccaaccuuccca

SEQ ID NO: 2187502 - RNA, 23 nt, Human
uccaaccuaaccccuuuccugcg

SEQ ID NO: 2187503 - RNA, 21 nt, Human
uccaaccuaaccccuuuccug

SEQ ID NO: 2187504 - RNA, 20 nt, Human
uccaaccuaaccccuuuccu

SEQ ID NO: 2187505 - RNA, 18 nt, Human
uccaaccuaaccccuuuc

SEQ ID NO: 2187506 - RNA, 13 nt, Human
uccaacuccagga

SEQ ID NO: 2187507 - RNA, 21 nt, Human
uccaaccuggggggcaguggu

SEQ ID NO: 2187508 - RNA, 21 nt, Human
uccaacuggauuauaaauaaa

SEQ ID NO: 2187509 - RNA, 15 nt, Human
uccaacuucauuuga

SEQ ID NO: 2187510 - RNA, 18 nt, Human
uccaacuguguucauuag

SEQ ID NO: 2187511 - RNA, 20 nt, Human
uccaacuguauauauuccca

SEQ ID NO: 2187512 - RNA, 19 nt, Human
uccaacuguguucauuaga

SEQ ID NO: 2187513 - RNA, 12 nt, Human
uccaagaagccc

SEQ ID NO: 2187514 - RNA, 16 nt, Human
uccaagcuggucccac

SEQ ID NO: 2187515 - RNA, 20 nt, Human
uccaagcuggucccacucag

SEQ ID NO: 2187516 - RNA, 15 nt, Human
uaugaagaagagagu

SEQ ID NO: 2187517 - RNA, 17 nt, Human
uaugaagaacugaggag

SEQ ID NO: 2187518 - RNA, 16 nt, Human
uaugaagaacugagga

SEQ ID NO: 2187519 - RNA, 13 nt, Human
uauuucauuucuu

SEQ ID NO: 2187520 - RNA, 21 nt, Human
uaugaagcuaccucaaacuuc

SEQ ID NO: 2187521 - RNA, 14 nt, Human
uaugaagacauaaa

SEQ ID NO: 2187522 - RNA, 19 nt, Human
uaugaagauaaguguauuu

SEQ ID NO: 2187523 - RNA, 17 nt, Human
uaugaagcucaccuguu

SEQ ID NO: 2187524 - RNA, 18 nt, Human
uauuuccauucaacaaga

SEQ ID NO: 2187525 - RNA, 16 nt, Human
uaugaagaaaaaauac

SEQ ID NO: 2187526 - RNA, 15 nt, Human
uaugaagaaaaaaua

SEQ ID NO: 2187527 - RNA, 13 nt, Human
uaugaagaaaaaa

SEQ ID NO: 2187528 - RNA, 20 nt, Human
uaugaagaaaaaauacauuu

SEQ ID NO: 2187529 - RNA, 14 nt, Human
uaugaagaacugag

SEQ ID NO: 2187530 - RNA, 21 nt, Human
uaugaaauauuauguuaaaac

SEQ ID NO: 2187531 - RNA, 14 nt, Human
uaugaaauaaagaa

SEQ ID NO: 2187532 - RNA, 19 nt, Human
uaugaaauaaagaaauugc

SEQ ID NO: 2187533 - RNA, 22 nt, Human
uauuucccucaccuuucccauc

SEQ ID NO: 2187534 - RNA, 22 nt, Human
uauuucccugaaggaaccaaag

SEQ ID NO: 2187535 - RNA, 15 nt, Human
uauuucccuccccug

SEQ ID NO: 2187536 - RNA, 20 nt, Human
uauuucccuccccuggggac

SEQ ID NO: 2187537 - RNA, 21 nt, Human
uauuuccccaggggaaaauga

SEQ ID NO: 2187538 - RNA, 22 nt, Human
uauuuccccaggggaaaaugaa

SEQ ID NO: 2187539 - RNA, 21 nt, Human
uauuuccauuccagaauaucu

SEQ ID NO: 2187540 - RNA, 21 nt, Human
uauuuccccaacauguaauaa

SEQ ID NO: 2187541 - RNA, 23 nt, Human
uauuuccuauauuguuuucagug

SEQ ID NO: 2187542 - RNA, 18 nt, Human
uauuucccucucauuuug

SEQ ID NO: 2187543 - RNA, 19 nt, Human
uauuuccuuaaacugugug

SEQ ID NO: 2187544 - RNA, 15 nt, Human
uauuuccuuaaacug

SEQ ID NO: 2187545 - RNA, 19 nt, Human
uauuuccucaugugaucac

SEQ ID NO: 2187546 - RNA, 15 nt, Human
uauuucgaaagcugc

SEQ ID NO: 2187547 - RNA, 16 nt, Human
uauuucuaggaagaau

SEQ ID NO: 2187548 - RNA, 17 nt, Human
uauuucuaggaagaauu

SEQ ID NO: 2187549 - RNA, 19 nt, Human
uauuucuaggaagaauuuu

SEQ ID NO: 2187550 - RNA, 19 nt, Human
acaguuucuuuuuucuuac

SEQ ID NO: 2187551 - RNA, 22 nt, Human
acaguuucuuagcuuuuuaauu

SEQ ID NO: 2187552 - RNA, 15 nt, Human
acaguuugaacaaaa

SEQ ID NO: 2187553 - RNA, 14 nt, Human
acaguuugcucuag

SEQ ID NO: 2187554 - RNA, 12 nt, Human
acaguuugcugu

SEQ ID NO: 2187555 - RNA, 13 nt, Human
acaguuugcugua

SEQ ID NO: 2187556 - RNA, 12 nt, Human
acaguuucuuag

SEQ ID NO: 2187557 - RNA, 14 nt, Human
acaguuucuuagcu

SEQ ID NO: 2187558 - RNA, 16 nt, Human
acaguuucuuagcuuu

SEQ ID NO: 2187559 - RNA, 17 nt, Human
acaguuucuuagcuuuu

SEQ ID NO: 2187560 - RNA, 18 nt, Human
acaguuucuuagcuuuuu

SEQ ID NO: 2187561 - RNA, 20 nt, Human
acaguuucuuagcuuuuuaa

SEQ ID NO: 2187562 - RNA, 20 nt, Human
acaguuuaauaccacagcuu

SEQ ID NO: 2187563 - RNA, 15 nt, Human
acaguuguuggccuc

SEQ ID NO: 2187564 - RNA, 14 nt, Human
acaguugggugaga

SEQ ID NO: 2187565 - RNA, 22 nt, Human
acaguuguuugaugcauuaaaa

SEQ ID NO: 2187566 - RNA, 15 nt, Human
acaguuguuugaugc

SEQ ID NO: 2187567 - RNA, 13 nt, Human
acaguuguuugau

SEQ ID NO: 2187568 - RNA, 12 nt, Human
acaguuguuuga

SEQ ID NO: 2187569 - RNA, 11 nt, Human
acaguuguuug

SEQ ID NO: 2187570 - RNA, 16 nt, Human
acaguugaaaaacagc

SEQ ID NO: 2187571 - RNA, 15 nt, Human
acaguugaaaaacag

SEQ ID NO: 2187572 - RNA, 21 nt, Human
acaguucuuugggccagacau

SEQ ID NO: 2187573 - RNA, 22 nt, Human
uauuucuaggaagaauuuuaaa

SEQ ID NO: 2187574 - RNA, 22 nt, Human
acaguugcugucauaagaauga

SEQ ID NO: 2187575 - RNA, 16 nt, Human
acaguuggccuucaga

SEQ ID NO: 2187576 - RNA, 21 nt, Human
acaguugcugucauaagaaug

SEQ ID NO: 2187577 - RNA, 15 nt, Human
acaguugcugucaua

SEQ ID NO: 2187578 - RNA, 18 nt, Human
acaguuggaaauccaucc

SEQ ID NO: 2187579 - RNA, 20 nt, Human
acaguugaaaaacagcugag

SEQ ID NO: 2187580 - RNA, 22 nt, Human
acaguucuuugggccagacaug

SEQ ID NO: 2187581 - RNA, 20 nt, Human
acaguucuuugggccagaca

SEQ ID NO: 2187582 - RNA, 21 nt, Human
acauacccuggccgcccccug

SEQ ID NO: 2187583 - RNA, 13 nt, Human
acauacuaaccag

SEQ ID NO: 2187584 - RNA, 15 nt, Human
acauaccagcuuaga

SEQ ID NO: 2187585 - RNA, 14 nt, Human
acauacccuccccc

SEQ ID NO: 2187586 - RNA, 20 nt, Human
acauacccuggccgcccccu

SEQ ID NO: 2187587 - RNA, 13 nt, Human
acauacucccauc

SEQ ID NO: 2187588 - RNA, 22 nt, Human
acauacuaaccagcagaaaugc

SEQ ID NO: 2187589 - RNA, 21 nt, Human
acauacuaaccagcagaaaug

SEQ ID NO: 2187590 - RNA, 12 nt, Human
acauacugcugu

SEQ ID NO: 2187591 - RNA, 24 nt, Human
acauacuccuuccaucaaauagaa

SEQ ID NO: 2187592 - RNA, 12 nt, Human
acauacuucagc

SEQ ID NO: 2187593 - RNA, 16 nt, Human
acauacuggcugguga

SEQ ID NO: 2187594 - RNA, 15 nt, Human
acauacuugaagggc

SEQ ID NO: 2187595 - RNA, 18 nt, Human
acauacuggccuggacug

SEQ ID NO: 2187596 - RNA, 19 nt, Human
acauacuggccuggacugu

SEQ ID NO: 2187597 - RNA, 14 nt, Human
acauacucugcuua

SEQ ID NO: 2187598 - RNA, 17 nt, Human
acauacucccaucugug

SEQ ID NO: 2187599 - RNA, 23 nt, Human
acauacuugaagggccagagcca

SEQ ID NO: 2187600 - RNA, 22 nt, Human
acauacuugaagggccagagcc

SEQ ID NO: 2187601 - RNA, 21 nt, Human
acauacuugaagggccagagc

SEQ ID NO: 2187602 - RNA, 20 nt, Human
acauacuugaagggccagag

SEQ ID NO: 2187603 - RNA, 19 nt, Human
acauacuugaagggccaga

SEQ ID NO: 2187604 - RNA, 18 nt, Human
acauacuugaagggccag

SEQ ID NO: 2187605 - RNA, 17 nt, Human
acauacuugaagggcca

SEQ ID NO: 2187606 - RNA, 16 nt, Human
acauacuugaagggcc

SEQ ID NO: 2187607 - RNA, 21 nt, Human
acauagaaauugccugacgaa

SEQ ID NO: 2187608 - RNA, 16 nt, Human
acauagaaauugccug

SEQ ID NO: 2187609 - RNA, 22 nt, Human
acauacuuucauccugacucug

SEQ ID NO: 2187610 - RNA, 12 nt, Human
acauagaaaguu

SEQ ID NO: 2187611 - RNA, 23 nt, Human
acauacuuucauccugacucugc

SEQ ID NO: 2187612 - RNA, 23 nt, Human
acaguuuugucagucuuucuuag

SEQ ID NO: 2187613 - RNA, 24 nt, Human
acaguuuugguugcuuuaauauca

SEQ ID NO: 2187614 - RNA, 19 nt, Human
acaguuuugguugcuuuaa

SEQ ID NO: 2187615 - RNA, 18 nt, Human
acaguuuugguugcuuua

SEQ ID NO: 2187616 - RNA, 22 nt, Human
acaguuuuccuucucaucugug

SEQ ID NO: 2187617 - RNA, 14 nt, Human
acaguuuuccuucu

SEQ ID NO: 2187618 - RNA, 21 nt, Human
acaguuuucuggcuggagccu

SEQ ID NO: 2187619 - RNA, 15 nt, Human
acaguuuuuauugcu

SEQ ID NO: 2187620 - RNA, 21 nt, Human
acaguuuucugagaaagacua

SEQ ID NO: 2187621 - RNA, 20 nt, Human
acaguuuucugagaaagacu

SEQ ID NO: 2187622 - RNA, 19 nt, Human
acaguuuucugagaaagac

SEQ ID NO: 2187623 - RNA, 18 nt, Human
acaguuuucugagaaaga

SEQ ID NO: 2187624 - RNA, 23 nt, Human
acaguuuuccaugaaaacguuuu

SEQ ID NO: 2187625 - RNA, 21 nt, Human
acaguuuuccaugaaaacguu

SEQ ID NO: 2187626 - RNA, 19 nt, Human
acaguuuuccaugaaaacg

SEQ ID NO: 2187627 - RNA, 18 nt, Human
acaguuuuccaugaaaac

SEQ ID NO: 2187628 - RNA, 17 nt, Human
acaguuuuccaugaaaa

SEQ ID NO: 2187629 - RNA, 16 nt, Human
acaguuuuccaugaaa

SEQ ID NO: 2187630 - RNA, 15 nt, Human
acaguuuuccaugaa

SEQ ID NO: 2187631 - RNA, 14 nt, Human
acaguuuuccauga

SEQ ID NO: 2187632 - RNA, 15 nt, Human
acaguuuucugagaa

SEQ ID NO: 2187633 - RNA, 17 nt, Human
acaguuuucugagaaag

SEQ ID NO: 2187634 - RNA, 16 nt, Human
acaguuuucugagaaa

SEQ ID NO: 2187635 - RNA, 12 nt, Human
acaguuuuccau

SEQ ID NO: 2187636 - RNA, 22 nt, Human
acaguuuguuuacacacgugca

SEQ ID NO: 2187637 - RNA, 14 nt, Human
acaguuugucacau

SEQ ID NO: 2187638 - RNA, 14 nt, Human
acaguuuguuuaca

SEQ ID NO: 2187639 - RNA, 15 nt, Human
acaguuuguuuacac

SEQ ID NO: 2187640 - RNA, 16 nt, Human
acaguuuguuuacaca

SEQ ID NO: 2187641 - RNA, 20 nt, Human
acaguuuguuaguaugaggc

SEQ ID NO: 2187642 - RNA, 16 nt, Human
acaguuuguuaguaug

SEQ ID NO: 2187643 - RNA, 11 nt, Human
acaucugccuu

SEQ ID NO: 2187644 - RNA, 12 nt, Human
acaucugccuua

SEQ ID NO: 2187645 - RNA, 13 nt, Human
acaucugaaagcc

SEQ ID NO: 2187646 - RNA, 23 nt, Human
acaucucuuugaauuuucugugu

SEQ ID NO: 2187647 - RNA, 15 nt, Human
acaucuguccuguga

SEQ ID NO: 2187648 - RNA, 16 nt, Human
acaucugugucuuguu

SEQ ID NO: 2187649 - RNA, 15 nt, Human
acaucugugucuugu

SEQ ID NO: 2187650 - RNA, 20 nt, Human
acaucucuuugaugucauau

SEQ ID NO: 2187651 - RNA, 14 nt, Human
acaucucuuugaau

SEQ ID NO: 2187652 - RNA, 17 nt, Human
acaucucuuugaauuuu

SEQ ID NO: 2187653 - RNA, 15 nt, Human
acaucucugcuugag

SEQ ID NO: 2187654 - RNA, 12 nt, Human
acaucucugcuu

SEQ ID NO: 2187655 - RNA, 13 nt, Human
acaucucuuccuc

SEQ ID NO: 2187656 - RNA, 23 nt, Human
acaucucuuccuccgaggccagu

SEQ ID NO: 2187657 - RNA, 21 nt, Human
acaucuccuccauacucagga

SEQ ID NO: 2187658 - RNA, 22 nt, Human
acaucucugcacccuggggccu

SEQ ID NO: 2187659 - RNA, 13 nt, Human
acaucuugcucug

SEQ ID NO: 2187660 - RNA, 20 nt, Human
acaucuugaucugcucagcc

SEQ ID NO: 2187661 - RNA, 21 nt, Human
acaucuugaucugcucagccc

SEQ ID NO: 2187662 - RNA, 22 nt, Human
acaucuugaucugcucagcccu

SEQ ID NO: 2187663 - RNA, 23 nt, Human
acaucuugaucugcucagcccug

SEQ ID NO: 2187664 - RNA, 13 nt, Human
acaucuucaaagc

SEQ ID NO: 2187665 - RNA, 16 nt, Human
acaucuucagcaaaua

SEQ ID NO: 2187666 - RNA, 23 nt, Human
acaucuucccuagaggguuccug

SEQ ID NO: 2187667 - RNA, 14 nt, Human
acaucuugaucugc

SEQ ID NO: 2187668 - RNA, 17 nt, Human
acaucuguuuuaaauuu

SEQ ID NO: 2187669 - RNA, 16 nt, Human
acaucuguuuuaaauu

SEQ ID NO: 2187670 - RNA, 23 nt, Human
acaucugccuuaaaaccaaagag

SEQ ID NO: 2187671 - RNA, 17 nt, Human
acaucuguguuucaagu

SEQ ID NO: 2187672 - RNA, 18 nt, Human
acaucuuaguauuugcau

SEQ ID NO: 2187673 - RNA, 14 nt, Human
acaucuuaguauuu

SEQ ID NO: 2187674 - RNA, 17 nt, Human
uauuugguacuguauuu

SEQ ID NO: 2187675 - RNA, 16 nt, Human
acaugaaaacacauuu

SEQ ID NO: 2187676 - RNA, 23 nt, Human
uauuuguaaaagaacaguaaaca

SEQ ID NO: 2187677 - RNA, 21 nt, Human
uauuugguuuggccaucucug

SEQ ID NO: 2187678 - RNA, 19 nt, Human
acaugaaaacacauuuuuc

SEQ ID NO: 2187679 - RNA, 18 nt, Human
acaugaaaacacauuuuu

SEQ ID NO: 2187680 - RNA, 21 nt, Human
acaucuugcucugcugacaga

SEQ ID NO: 2187681 - RNA, 17 nt, Human
acaugaaaacacauuuu

SEQ ID NO: 2187682 - RNA, 18 nt, Human
acaucuugcucugcugac

SEQ ID NO: 2187683 - RNA, 19 nt, Human
acaucuugcucugcugaca

SEQ ID NO: 2187684 - RNA, 13 nt, Human
acaucacaggaca

SEQ ID NO: 2187685 - RNA, 13 nt, Human
acaucacacacac

SEQ ID NO: 2187686 - RNA, 16 nt, Human
acaucaccacaguuua

SEQ ID NO: 2187687 - RNA, 22 nt, Human
acaucacccuuaccaugugccu

SEQ ID NO: 2187688 - RNA, 20 nt, Human
acaucaccgacgcgucuccu

SEQ ID NO: 2187689 - RNA, 21 nt, Human
acaucaccgacgcgucuccug

SEQ ID NO: 2187690 - RNA, 23 nt, Human
acaucaccgacgcgucuccuguu

SEQ ID NO: 2187691 - RNA, 22 nt, Human
acaucaccgacgcgucuccugu

SEQ ID NO: 2187692 - RNA, 16 nt, Human
acaucacucugcugcu

SEQ ID NO: 2187693 - RNA, 19 nt, Human
acaucacucugcugcuuag

SEQ ID NO: 2187694 - RNA, 19 nt, Human
acaucacuuguacaaaaua

SEQ ID NO: 2187695 - RNA, 11 nt, Human
acaucagaaag

SEQ ID NO: 2187696 - RNA, 13 nt, Human
acaucagaaagga

SEQ ID NO: 2187697 - RNA, 16 nt, Human
acaucacuuguacaaa

SEQ ID NO: 2187698 - RNA, 15 nt, Human
acaucacuuguacaa

SEQ ID NO: 2187699 - RNA, 20 nt, Human
acaucucaggggccagagga

SEQ ID NO: 2187700 - RNA, 19 nt, Human
acaucucaggggccagagg

SEQ ID NO: 2187701 - RNA, 23 nt, Human
acaucuauuuuggauuguauauu

SEQ ID NO: 2187702 - RNA, 12 nt, Human
acaucucagacc

SEQ ID NO: 2187703 - RNA, 22 nt, Human
acaucucagacccuuuagccaa

SEQ ID NO: 2187704 - RNA, 15 nt, Human
acaucagaaaggaau

SEQ ID NO: 2187705 - RNA, 21 nt, Human
acaucuaagccugaaggggcg

SEQ ID NO: 2187706 - RNA, 19 nt, Human
acaucuauuuuggauugua

SEQ ID NO: 2187707 - RNA, 18 nt, Human
acaucuauuuuggauugu

SEQ ID NO: 2187708 - RNA, 14 nt, Human
acaucuauucucuc

SEQ ID NO: 2187709 - RNA, 12 nt, Human
acauauucauuu

SEQ ID NO: 2187710 - RNA, 18 nt, Human
acauauuuccaagaaguu

SEQ ID NO: 2187711 - RNA, 20 nt, Human
acauauucauuuggaaauaa

SEQ ID NO: 2187712 - RNA, 15 nt, Human
acauauuuguggaau

SEQ ID NO: 2187713 - RNA, 16 nt, Human
acauauuuguggaaua

SEQ ID NO: 2187714 - RNA, 17 nt, Human
acauauuuguggaauaa

SEQ ID NO: 2187715 - RNA, 19 nt, Human
acauauuuguggaauaaug

SEQ ID NO: 2187716 - RNA, 19 nt, Human
acauauuuguuaaauauuu

SEQ ID NO: 2187717 - RNA, 14 nt, Human
acauauuuguuaaa

SEQ ID NO: 2187718 - RNA, 16 nt, Human
acauauuuuauagaac

SEQ ID NO: 2187719 - RNA, 18 nt, Human
acauauuuuauagaacuu

SEQ ID NO: 2187720 - RNA, 20 nt, Human
acauauuuguuaaauauuua

SEQ ID NO: 2187721 - RNA, 12 nt, Human
acaucaaagagg

SEQ ID NO: 2187722 - RNA, 13 nt, Human
acaucaacagaua

SEQ ID NO: 2187723 - RNA, 16 nt, Human
acaucaauguucauug

SEQ ID NO: 2187724 - RNA, 15 nt, Human
acaucaauguucauu

SEQ ID NO: 2187725 - RNA, 14 nt, Human
acaucaauguucau

SEQ ID NO: 2187726 - RNA, 23 nt, Human
acaucaauauugucauuccugua

SEQ ID NO: 2187727 - RNA, 18 nt, Human
acaucaauguucauugua

SEQ ID NO: 2187728 - RNA, 17 nt, Human
acaucaauguucauugu

SEQ ID NO: 2187729 - RNA, 20 nt, Human
acaucaauguucauuguaau

SEQ ID NO: 2187730 - RNA, 13 nt, Human
acaucaauguuca

SEQ ID NO: 2187731 - RNA, 18 nt, Human
acaucaauauugucauuc

SEQ ID NO: 2187732 - RNA, 20 nt, Human
acaucaauauugucauuccu

SEQ ID NO: 2187733 - RNA, 18 nt, Human
acaucaagcacagaagga

SEQ ID NO: 2187734 - RNA, 14 nt, Human
acaucaagcacaga

SEQ ID NO: 2187735 - RNA, 18 nt, Human
acaucaacccgagucauu

SEQ ID NO: 2187736 - RNA, 18 nt, Human
acaucaacaucuugguca

SEQ ID NO: 2187737 - RNA, 16 nt, Human
acaucaacaucuuggu

SEQ ID NO: 2187738 - RNA, 19 nt, Human
acauagcgaauacaaaauu

SEQ ID NO: 2187739 - RNA, 19 nt, Human
acauagccuauauuuacag

SEQ ID NO: 2187740 - RNA, 20 nt, Human
acauagccuauauuuacagu

SEQ ID NO: 2187741 - RNA, 22 nt, Human
acauagcccaucccugccuggu

SEQ ID NO: 2187742 - RNA, 13 nt, Human
acauagccuauau

SEQ ID NO: 2187743 - RNA, 16 nt, Human
acauagccuauauuua

SEQ ID NO: 2187744 - RNA, 17 nt, Human
acauagccuauauuuac

SEQ ID NO: 2187745 - RNA, 21 nt, Human
acauagcuuacaagccagcug

SEQ ID NO: 2187746 - RNA, 19 nt, Human
acauagcuaucaagugugc

SEQ ID NO: 2187747 - RNA, 15 nt, Human
acauagaugucccuu

SEQ ID NO: 2187748 - RNA, 21 nt, Human
acauagcaugacauuucuuug

SEQ ID NO: 2187749 - RNA, 19 nt, Human
acauagcaugacauuucuu

SEQ ID NO: 2187750 - RNA, 18 nt, Human
acauagcaugacauuucu

SEQ ID NO: 2187751 - RNA, 16 nt, Human
acauagcaugacauuu

SEQ ID NO: 2187752 - RNA, 14 nt, Human
acauagcccauccc

SEQ ID NO: 2187753 - RNA, 18 nt, Human
acauagcccaucccugcc

SEQ ID NO: 2187754 - RNA, 19 nt, Human
acauagcccaucccugccu

SEQ ID NO: 2187755 - RNA, 13 nt, Human
acauagauguccc

SEQ ID NO: 2187756 - RNA, 20 nt, Human
acauagagagggagaagaag

SEQ ID NO: 2187757 - RNA, 23 nt, Human
acauagagagggagaagaaguca

SEQ ID NO: 2187758 - RNA, 22 nt, Human
acauagagaucauccuuuccag

SEQ ID NO: 2187759 - RNA, 18 nt, Human
acauagaauuaacacaug

SEQ ID NO: 2187760 - RNA, 14 nt, Human
acauagaauuaaca

SEQ ID NO: 2187761 - RNA, 22 nt, Human
acauagcuugauaaagggccaa

SEQ ID NO: 2187762 - RNA, 16 nt, Human
acauaggacucaaagu

SEQ ID NO: 2187763 - RNA, 16 nt, Human
acauagugaugguucc

SEQ ID NO: 2187764 - RNA, 21 nt, Human
acauagugaugguuccccugu

SEQ ID NO: 2187765 - RNA, 23 nt, Human
acauauaauguuguuauuuaaag

SEQ ID NO: 2187766 - RNA, 19 nt, Human
acauauauaacaaugcugu

SEQ ID NO: 2187767 - RNA, 15 nt, Human
acauaguuauuuauu

SEQ ID NO: 2187768 - RNA, 20 nt, Human
acauauaaacaucacacaca

SEQ ID NO: 2187769 - RNA, 13 nt, Human
acauaguuuuuaa

SEQ ID NO: 2187770 - RNA, 21 nt, Human
acauauaaagcacuauacaga

SEQ ID NO: 2187771 - RNA, 15 nt, Human
acauaugaaaauaca

SEQ ID NO: 2187772 - RNA, 18 nt, Human
acauaucuuuauuaauca

SEQ ID NO: 2187773 - RNA, 16 nt, Human
acauaucuuuauuaau

SEQ ID NO: 2187774 - RNA, 18 nt, Human
acauaugaaauuuaauau

SEQ ID NO: 2187775 - RNA, 15 nt, Human
acauaugaaauuuaa

SEQ ID NO: 2187776 - RNA, 19 nt, Human
acauaucuuuauuaaucac

SEQ ID NO: 2187777 - RNA, 14 nt, Human
acauaugaggggga

SEQ ID NO: 2187778 - RNA, 19 nt, Human
acauaugaguguggaagcc

SEQ ID NO: 2187779 - RNA, 21 nt, Human
acauaugaguguggaagccgg

SEQ ID NO: 2187780 - RNA, 23 nt, Human
acauauggacucugcacaugaau

SEQ ID NO: 2187781 - RNA, 19 nt, Human
acauaugcaccuugugucu

SEQ ID NO: 2187782 - RNA, 20 nt, Human
acauaugcaccuugugucug

SEQ ID NO: 2187783 - RNA, 15 nt, Human
acauaugcaccuugu

SEQ ID NO: 2187784 - RNA, 16 nt, Human
acauaugcaccuugug

SEQ ID NO: 2187785 - RNA, 17 nt, Human
acauaugcaccuugugu

SEQ ID NO: 2187786 - RNA, 18 nt, Human
acauaugcaccuuguguc

SEQ ID NO: 2187787 - RNA, 15 nt, Human
acauaucuuuauuaa

SEQ ID NO: 2187788 - RNA, 14 nt, Human
acauauuaugucuu

SEQ ID NO: 2187789 - RNA, 18 nt, Human
acauauuaggaaaauaug

SEQ ID NO: 2187790 - RNA, 23 nt, Human
acauauugauuuccguuaaaaua

SEQ ID NO: 2187791 - RNA, 22 nt, Human
acauauugauuuccguuaaaau

SEQ ID NO: 2187792 - RNA, 18 nt, Human
acauauugauuuccguua

SEQ ID NO: 2187793 - RNA, 14 nt, Human
acauauguaaaaua

SEQ ID NO: 2187794 - RNA, 13 nt, Human
acauauguaaaau

SEQ ID NO: 2187795 - RNA, 13 nt, Human
acauaugugaaua

SEQ ID NO: 2187796 - RNA, 21 nt, Human
acauaugugcuggaauucuaa

SEQ ID NO: 2187797 - RNA, 16 nt, Human
acauauugauuuccgu

SEQ ID NO: 2187798 - RNA, 14 nt, Human
acauauugauuucc

SEQ ID NO: 2187799 - RNA, 18 nt, Human
ucaaagggcccacaguga

SEQ ID NO: 2187800 - RNA, 13 nt, Human
ucaaaguuuugaa

SEQ ID NO: 2187801 - RNA, 14 nt, Human
ucaaaguuuugaaa

SEQ ID NO: 2187802 - RNA, 15 nt, Human
ucaaaguuuugaaaa

SEQ ID NO: 2187803 - RNA, 17 nt, Human
ucaaaguuuugaaaagc

SEQ ID NO: 2187804 - RNA, 18 nt, Human
ucaaaguuuugaaaagcu

SEQ ID NO: 2187805 - RNA, 19 nt, Human
ucaaaguuuugaaaagcua

SEQ ID NO: 2187806 - RNA, 20 nt, Human
ucaaaguuuugaaaagcuau

SEQ ID NO: 2187807 - RNA, 23 nt, Human
ucaaagccagcguccuccucugu

SEQ ID NO: 2187808 - RNA, 22 nt, Human
ucaaagccagcguccuccucug

SEQ ID NO: 2187809 - RNA, 12 nt, Human
ucaaagccagcg

SEQ ID NO: 2187810 - RNA, 19 nt, Human
ucaaaggcacagugaaggc

SEQ ID NO: 2187811 - RNA, 15 nt, Human
ucaaaggacaaagug

SEQ ID NO: 2187812 - RNA, 16 nt, Human
ucaaagcuuuuuccag

SEQ ID NO: 2187813 - RNA, 14 nt, Human
ucaaagcuugaaga

SEQ ID NO: 2187814 - RNA, 20 nt, Human
ucaaagcuugaagaucguua

SEQ ID NO: 2187815 - RNA, 15 nt, Human
ucaaagcuuuuucca

SEQ ID NO: 2187816 - RNA, 15 nt, Human
ucaaagccacacucu

SEQ ID NO: 2187817 - RNA, 18 nt, Human
ucaaagccaaguuuauau

SEQ ID NO: 2187818 - RNA, 19 nt, Human
ucaaagcaggggaguaugc

SEQ ID NO: 2187819 - RNA, 16 nt, Human
ucaaacacugcaggca

SEQ ID NO: 2187820 - RNA, 20 nt, Human
ucaaacacaguuacacuugu

SEQ ID NO: 2187821 - RNA, 14 nt, Human
ucaaacacugcagg

SEQ ID NO: 2187822 - RNA, 10 nt, Human
ucaaagcaga

SEQ ID NO: 2187823 - RNA, 14 nt, Human
ucaaagcugaaaug

SEQ ID NO: 2187824 - RNA, 19 nt, Human
ucaaacaaacucucugaac

SEQ ID NO: 2187825 - RNA, 17 nt, Human
ucaaacaaagccagaag

SEQ ID NO: 2187826 - RNA, 16 nt, Human
ucaaacaaagccagaa

SEQ ID NO: 2187827 - RNA, 15 nt, Human
ucaaacaaagccaga

SEQ ID NO: 2187828 - RNA, 14 nt, Human
ucaaacaaagccag

SEQ ID NO: 2187829 - RNA, 16 nt, Human
ucaaaauuugaagaau

SEQ ID NO: 2187830 - RNA, 24 nt, Human
ucaaaauuagugcuuuuuguguca

SEQ ID NO: 2187831 - RNA, 21 nt, Human
ucaaacaaagccagaagcuga

SEQ ID NO: 2187832 - RNA, 15 nt, Human
ucaaacaacacuggu

SEQ ID NO: 2187833 - RNA, 17 nt, Human
ucaaacaacacuggugu

SEQ ID NO: 2187834 - RNA, 14 nt, Human
ucaaacacaaaugc

SEQ ID NO: 2187835 - RNA, 12 nt, Human
ucaaacacugca

SEQ ID NO: 2187836 - RNA, 11 nt, Human
ucaaacacagu

SEQ ID NO: 2187837 - RNA, 17 nt, Human
ucaaacacaguuacacu

SEQ ID NO: 2187838 - RNA, 15 nt, Human
ucaaacacaaaugca

SEQ ID NO: 2187839 - RNA, 16 nt, Human
ucaaacacaaaugcag

SEQ ID NO: 2187840 - RNA, 17 nt, Human
ucaaacacaaaugcagg

SEQ ID NO: 2187841 - RNA, 17 nt, Human
acaugaucuucuuuaua

SEQ ID NO: 2187842 - RNA, 15 nt, Human
acaugaucuucuuua

SEQ ID NO: 2187843 - RNA, 18 nt, Human
acaugagucccaguggga

SEQ ID NO: 2187844 - RNA, 20 nt, Human
acaugagcaucaggccaggc

SEQ ID NO: 2187845 - RNA, 22 nt, Human
acaugcuacacacugcauguuu

SEQ ID NO: 2187846 - RNA, 17 nt, Human
acaugagcaucaggcca

SEQ ID NO: 2187847 - RNA, 18 nt, Human
acaugagcaucaggccag

SEQ ID NO: 2187848 - RNA, 19 nt, Human
acaugagcaucaggccagg

SEQ ID NO: 2187849 - RNA, 19 nt, Human
acaugauccugcaauucca

SEQ ID NO: 2187850 - RNA, 18 nt, Human
ucaaauaacuaaaaggua

SEQ ID NO: 2187851 - RNA, 22 nt, Human
ucaaaguuuugaaaagcuauua

SEQ ID NO: 2187852 - RNA, 11 nt, Human
ucaaauaaaca

SEQ ID NO: 2187853 - RNA, 13 nt, Human
ucaaauaaacacu

SEQ ID NO: 2187854 - RNA, 14 nt, Human
ucaaauaaacacug

SEQ ID NO: 2187855 - RNA, 15 nt, Human
ucaaauaaacacugu

SEQ ID NO: 2187856 - RNA, 13 nt, Human
ucaaauacaucuu

SEQ ID NO: 2187857 - RNA, 16 nt, Human
ucaaauaaacacugug

SEQ ID NO: 2187858 - RNA, 13 nt, Human
acaugaagaagcu

SEQ ID NO: 2187859 - RNA, 16 nt, Human
acaugaagaagcuaaa

SEQ ID NO: 2187860 - RNA, 18 nt, Human
acaugaagauucuuuccc

SEQ ID NO: 2187861 - RNA, 17 nt, Human
acaugaagauucuuucc

SEQ ID NO: 2187862 - RNA, 15 nt, Human
acaugaagauucuuu

SEQ ID NO: 2187863 - RNA, 22 nt, Human
acaugaagauucuuucccaauu

SEQ ID NO: 2187864 - RNA, 16 nt, Human
acaugaaguccaagca

SEQ ID NO: 2187865 - RNA, 18 nt, Human
uauuugugaugacaacug

SEQ ID NO: 2187866 - RNA, 18 nt, Human
uauuugugauagcacuuu

SEQ ID NO: 2187867 - RNA, 21 nt, Human
uauuugugacuaauuguauaa

SEQ ID NO: 2187868 - RNA, 19 nt, Human
uauuugugacuaauuguau

SEQ ID NO: 2187869 - RNA, 20 nt, Human
uauuugugacuaauuguaua

SEQ ID NO: 2187870 - RNA, 12 nt, Human
uauuugugacua

SEQ ID NO: 2187871 - RNA, 14 nt, Human
uauuugugacuaau

SEQ ID NO: 2187872 - RNA, 17 nt, Human
uauuugugacuaauugu

SEQ ID NO: 2187873 - RNA, 22 nt, Human
uauuugugacuaauuguauaac

SEQ ID NO: 2187874 - RNA, 16 nt, Human
uauuuguaaauuuaug

SEQ ID NO: 2187875 - RNA, 22 nt, Human
uauuuguaaauuuaugugaugg

SEQ ID NO: 2187876 - RNA, 17 nt, Human
uauuuguaaauuuaugu

SEQ ID NO: 2187877 - RNA, 13 nt, Human
uauuuguguauuu

SEQ ID NO: 2187878 - RNA, 15 nt, Human
uauuuguguauuuaa

SEQ ID NO: 2187879 - RNA, 12 nt, Human
uauuuguggaau

SEQ ID NO: 2187880 - RNA, 14 nt, Human
uauuuguggaauaa

SEQ ID NO: 2187881 - RNA, 13 nt, Human
uauuuguguaaua

SEQ ID NO: 2187882 - RNA, 14 nt, Human
uauuuguguaauag

SEQ ID NO: 2187883 - RNA, 17 nt, Human
uauuuguguauuuaaca

SEQ ID NO: 2187884 - RNA, 18 nt, Human
uauuuguguauuuaacag

SEQ ID NO: 2187885 - RNA, 17 nt, Human
uauuuuuaauuaaauaa

SEQ ID NO: 2187886 - RNA, 17 nt, Human
uauuuguguaauagaaa

SEQ ID NO: 2187887 - RNA, 18 nt, Human
uauuuuuacugccacucu

SEQ ID NO: 2187888 - RNA, 19 nt, Human
uauuuuuauagauuugacc

SEQ ID NO: 2187889 - RNA, 18 nt, Human
uauuuuuacauucugaau

SEQ ID NO: 2187890 - RNA, 12 nt, Human
uauuuuuacugc

SEQ ID NO: 2187891 - RNA, 15 nt, Human
uauuuuuacugccac

SEQ ID NO: 2187892 - RNA, 16 nt, Human
uauuuuuacugccacu

SEQ ID NO: 2187893 - RNA, 21 nt, Human
uauuuuuauauuuaguuauag

SEQ ID NO: 2187894 - RNA, 14 nt, Human
uauuuuucuaaggu

SEQ ID NO: 2187895 - RNA, 12 nt, Human
uauuuuuaucuu

SEQ ID NO: 2187896 - RNA, 14 nt, Human
uauuuuucucauga

SEQ ID NO: 2187897 - RNA, 19 nt, Human
ucaaaagaaucagaaacag

SEQ ID NO: 2187898 - RNA, 18 nt, Human
ucaaaagaaaaggcaaaa

SEQ ID NO: 2187899 - RNA, 12 nt, Human
ucaaaagacaau

SEQ ID NO: 2187900 - RNA, 14 nt, Human
ucaaaagacaauuc

SEQ ID NO: 2187901 - RNA, 15 nt, Human
ucaaaagacaauucu

SEQ ID NO: 2187902 - RNA, 16 nt, Human
ucaaaagacaauucuu

SEQ ID NO: 2187903 - RNA, 18 nt, Human
ucaaaagacaauucuuua

SEQ ID NO: 2187904 - RNA, 19 nt, Human
ucaaaagacaauucuuuau

SEQ ID NO: 2187905 - RNA, 18 nt, Human
ucaaaagaaagaaaauca

SEQ ID NO: 2187906 - RNA, 22 nt, Human
uauuuuugaaaggcauguuccu

SEQ ID NO: 2187907 - RNA, 12 nt, Human
uauuuuugcaug

SEQ ID NO: 2187908 - RNA, 17 nt, Human
uauuuuugcauggcacu

SEQ ID NO: 2187909 - RNA, 13 nt, Human
uauuuuugcccug

SEQ ID NO: 2187910 - RNA, 14 nt, Human
ucaaaaugucugua

SEQ ID NO: 2187911 - RNA, 14 nt, Human
ucaaaaugucuaag

SEQ ID NO: 2187912 - RNA, 19 nt, Human
ucaaaaugcuuuuuauuuc

SEQ ID NO: 2187913 - RNA, 17 nt, Human
ucaaaaugcuuuuuauu

SEQ ID NO: 2187914 - RNA, 12 nt, Human
ucaaaaugcuuu

SEQ ID NO: 2187915 - RNA, 16 nt, Human
ucaaaauuguuacaaa

SEQ ID NO: 2187916 - RNA, 19 nt, Human
ucaaaauuguuacaaauug

SEQ ID NO: 2187917 - RNA, 15 nt, Human
ucaaaaugacagcca

SEQ ID NO: 2187918 - RNA, 18 nt, Human
ucaaaauauuuguacaua

SEQ ID NO: 2187919 - RNA, 19 nt, Human
ucaaaauauuuguacauag

SEQ ID NO: 2187920 - RNA, 17 nt, Human
ucaaaauauuuguacau

SEQ ID NO: 2187921 - RNA, 16 nt, Human
ucaaaauauuuguaca

SEQ ID NO: 2187922 - RNA, 16 nt, Human
ucaaaaguugaaauua

SEQ ID NO: 2187923 - RNA, 15 nt, Human
ucaaaaguugaaauu

SEQ ID NO: 2187924 - RNA, 14 nt, Human
ucaaaaguugaaau

SEQ ID NO: 2187925 - RNA, 18 nt, Human
ucaaaagcaaaugagauc

SEQ ID NO: 2187926 - RNA, 15 nt, Human
ucaaaagcuggauua

SEQ ID NO: 2187927 - RNA, 23 nt, Human
ucaaaagacaauucuuuauacaa

SEQ ID NO: 2187928 - RNA, 12 nt, Human
ucaaaauaaaaa

SEQ ID NO: 2187929 - RNA, 21 nt, Human
ucaaaauaccaugccauuuaa

SEQ ID NO: 2187930 - RNA, 23 nt, Human
ucaaaauaaaaagugacacagca

SEQ ID NO: 2187931 - RNA, 14 nt, Human
ucaaaauaauuuua

SEQ ID NO: 2187932 - RNA, 20 nt, Human
ucaaaauaaaaaccaagaag

SEQ ID NO: 2187933 - RNA, 13 nt, Human
ucaaaauaaaaac

SEQ ID NO: 2187934 - RNA, 20 nt, Human
ucaaaauaaaaagugacaca

SEQ ID NO: 2187935 - RNA, 21 nt, Human
ucaaaauaaaaagugacacag

SEQ ID NO: 2187936 - RNA, 23 nt, Human
ucaaaauaccaugccauuuaaag

SEQ ID NO: 2187937 - RNA, 15 nt, Human
ucaaaauauguucuu

SEQ ID NO: 2187938 - RNA, 21 nt, Human
ucaaaauaugccccauucaac

SEQ ID NO: 2187939 - RNA, 15 nt, Human
acauucaugccuggc

SEQ ID NO: 2187940 - RNA, 23 nt, Human
acauucaauaagcaucaaacucu

SEQ ID NO: 2187941 - RNA, 16 nt, Human
acauucaggaagauga

SEQ ID NO: 2187942 - RNA, 12 nt, Human
acauucaauguu

SEQ ID NO: 2187943 - RNA, 13 nt, Human
acauucaccugcc

SEQ ID NO: 2187944 - RNA, 20 nt, Human
acauucaccugccccaacuc

SEQ ID NO: 2187945 - RNA, 14 nt, Human
acauucaccugccc

SEQ ID NO: 2187946 - RNA, 15 nt, Human
acauucaauaagcau

SEQ ID NO: 2187947 - RNA, 18 nt, Human
acauucaacccuggagag

SEQ ID NO: 2187948 - RNA, 13 nt, Human
acauucaaggcau

SEQ ID NO: 2187949 - RNA, 20 nt, Human
acauuaacaguuuuccauga

SEQ ID NO: 2187950 - RNA, 18 nt, Human
acauuaacaguuuuccau

SEQ ID NO: 2187951 - RNA, 17 nt, Human
acauuaacaguuuucca

SEQ ID NO: 2187952 - RNA, 16 nt, Human
acauuaacaguuuucc

SEQ ID NO: 2187953 - RNA, 22 nt, Human
acauuaacaguuuuccaugaaa

SEQ ID NO: 2187954 - RNA, 12 nt, Human
acauuaagaaaa

SEQ ID NO: 2187955 - RNA, 13 nt, Human
acauuaagaaaau

SEQ ID NO: 2187956 - RNA, 14 nt, Human
acauuaagaaaauc

SEQ ID NO: 2187957 - RNA, 16 nt, Human
acauuaagaaaaucau

SEQ ID NO: 2187958 - RNA, 17 nt, Human
acauuaagaaaaucaua

SEQ ID NO: 2187959 - RNA, 21 nt, Human
acauuaagaaaaucauauugc

SEQ ID NO: 2187960 - RNA, 18 nt, Human
acauuagcaguuugcuuu

SEQ ID NO: 2187961 - RNA, 22 nt, Human
acauuagcaguuugcuuuguau

SEQ ID NO: 2187962 - RNA, 14 nt, Human
acaugcugagucuc

SEQ ID NO: 2187963 - RNA, 21 nt, Human
acaugcugagucucccaaggc

SEQ ID NO: 2187964 - RNA, 19 nt, Human
acaugcucuuagaaaauuc

SEQ ID NO: 2187965 - RNA, 14 nt, Human
acaugcugaagcca

SEQ ID NO: 2187966 - RNA, 17 nt, Human
acaugcugaagccaaag

SEQ ID NO: 2187967 - RNA, 21 nt, Human
acauguccaagaagcccagga

SEQ ID NO: 2187968 - RNA, 19 nt, Human
acauguccaagaagcccag

SEQ ID NO: 2187969 - RNA, 12 nt, Human
acauuaacaguu

SEQ ID NO: 2187970 - RNA, 11 nt, Human
acauuaacagu

SEQ ID NO: 2187971 - RNA, 12 nt, Human
acaugucuuaau

SEQ ID NO: 2187972 - RNA, 18 nt, Human
acaugucuguucuacaua

SEQ ID NO: 2187973 - RNA, 15 nt, Human
acaugucccuacacc

SEQ ID NO: 2187974 - RNA, 21 nt, Human
acauguccuuguguguuuuga

SEQ ID NO: 2187975 - RNA, 16 nt, Human
acauguccuugugugu

SEQ ID NO: 2187976 - RNA, 17 nt, Human
acaugucuguucuacau

SEQ ID NO: 2187977 - RNA, 16 nt, Human
acaugucuccuauccu

SEQ ID NO: 2187978 - RNA, 18 nt, Human
acaugucuccuauccugg

SEQ ID NO: 2187979 - RNA, 10 nt, Human
acauucuuau

SEQ ID NO: 2187980 - RNA, 23 nt, Human
acauucugucgccuuagcauguu

SEQ ID NO: 2187981 - RNA, 14 nt, Human
acauucuuauaaau

SEQ ID NO: 2187982 - RNA, 14 nt, Human
ucaaauuucuaaau

SEQ ID NO: 2187983 - RNA, 15 nt, Human
acauucuguuaauca

SEQ ID NO: 2187984 - RNA, 16 nt, Human
ucaaauuucuaaaucu

SEQ ID NO: 2187985 - RNA, 15 nt, Human
ucaaauuucuaaauc

SEQ ID NO: 2187986 - RNA, 12 nt, Human
acauucugcuuu

SEQ ID NO: 2187987 - RNA, 16 nt, Human
acauucugccaggccc

SEQ ID NO: 2187988 - RNA, 19 nt, Human
acauucugauuuggaaaaa

SEQ ID NO: 2187989 - RNA, 15 nt, Human
acauuccaagacagu

SEQ ID NO: 2187990 - RNA, 17 nt, Human
acauuccaagacaguau

SEQ ID NO: 2187991 - RNA, 11 nt, Human
acauuccaaga

SEQ ID NO: 2187992 - RNA, 13 nt, Human
acauuccaagaca

SEQ ID NO: 2187993 - RNA, 14 nt, Human
acauuccaagacag

SEQ ID NO: 2187994 - RNA, 16 nt, Human
acauucaugccuggcu

SEQ ID NO: 2187995 - RNA, 14 nt, Human
acauucuguaaaau

SEQ ID NO: 2187996 - RNA, 22 nt, Human
acauucugucgccuuagcaugu

SEQ ID NO: 2187997 - RNA, 18 nt, Human
acauucugcuuucaucuu

SEQ ID NO: 2187998 - RNA, 20 nt, Human
acauucuggcucagggaggu

SEQ ID NO: 2187999 - RNA, 12 nt, Human
acauucuguuaa

SEQ ID NO: 2188000 - RNA, 23 nt, Human
ucaacacuuaaggguuuuagaaa

SEQ ID NO: 2188001 - RNA, 20 nt, Human
ucaacaagggagagaccuca

SEQ ID NO: 2188002 - RNA, 19 nt, Human
ucaacaagggagagaccuc

SEQ ID NO: 2188003 - RNA, 22 nt, Human
ucaacaagggagagaccucauc

SEQ ID NO: 2188004 - RNA, 15 nt, Human
acauucuuauaaaua

SEQ ID NO: 2188005 - RNA, 16 nt, Human
acauucuuauaaauau

SEQ ID NO: 2188006 - RNA, 17 nt, Human
ucaaauuucuaaaucuc

SEQ ID NO: 2188007 - RNA, 18 nt, Human
ucaacaggagaauuuuac

SEQ ID NO: 2188008 - RNA, 18 nt, Human
ucaacagcuaugcuggua

SEQ ID NO: 2188009 - RNA, 15 nt, Human
ucaacagcuccccau

SEQ ID NO: 2188010 - RNA, 16 nt, Human
ucaacagguuuuccug

SEQ ID NO: 2188011 - RNA, 22 nt, Human
ucaacagagaaggcaggaaugu

SEQ ID NO: 2188012 - RNA, 19 nt, Human
ucaacagagaaggcaggaa

SEQ ID NO: 2188013 - RNA, 17 nt, Human
ucaacagagaaggcagg

SEQ ID NO: 2188014 - RNA, 12 nt, Human
ucaacagagaag

SEQ ID NO: 2188015 - RNA, 18 nt, Human
ucaacacucccuucccau

SEQ ID NO: 2188016 - RNA, 16 nt, Human
ucaacagcuaugcugg

SEQ ID NO: 2188017 - RNA, 15 nt, Human
ucaaguauuauaccu

SEQ ID NO: 2188018 - RNA, 11 nt, Human
ucaaguauuau

SEQ ID NO: 2188019 - RNA, 12 nt, Human
ucaaguauuugg

SEQ ID NO: 2188020 - RNA, 23 nt, Human
ucaaguauuauaccuuuuuuaga

SEQ ID NO: 2188021 - RNA, 21 nt, Human
ucaaguauuauaccuuuuuua

SEQ ID NO: 2188022 - RNA, 16 nt, Human
ucaaguauuauaccuu

SEQ ID NO: 2188023 - RNA, 20 nt, Human
ucaagauguccuccuuguuc

SEQ ID NO: 2188024 - RNA, 15 nt, Human
ucaagaucauguacc

SEQ ID NO: 2188025 - RNA, 18 nt, Human
ucaagaugucagacuggc

SEQ ID NO: 2188026 - RNA, 17 nt, Human
ucaaggcugcuuagaau

SEQ ID NO: 2188027 - RNA, 18 nt, Human
ucaaggcugcuuagaauc

SEQ ID NO: 2188028 - RNA, 21 nt, Human
ucaagggaauguaacugcuga

SEQ ID NO: 2188029 - RNA, 19 nt, Human
ucaagggaauguaacugcu

SEQ ID NO: 2188030 - RNA, 20 nt, Human
ucaagggaauguaacugcug

SEQ ID NO: 2188031 - RNA, 16 nt, Human
ucaagggggacugucu

SEQ ID NO: 2188032 - RNA, 17 nt, Human
ucaagaugucagacugg

SEQ ID NO: 2188033 - RNA, 22 nt, Human
ucaagaucaaugaaaugauguc

SEQ ID NO: 2188034 - RNA, 16 nt, Human
ucaagaucaaugaaau

SEQ ID NO: 2188035 - RNA, 22 nt, Human
ucaagaugaugaugaucuuuaa

SEQ ID NO: 2188036 - RNA, 15 nt, Human
ucaagagcacacuug

SEQ ID NO: 2188037 - RNA, 22 nt, Human
ucaagauacugcuacuguaauu

SEQ ID NO: 2188038 - RNA, 21 nt, Human
ucaagauacugcuacuguaau

SEQ ID NO: 2188039 - RNA, 17 nt, Human
ucaagagcugcccuccu

SEQ ID NO: 2188040 - RNA, 19 nt, Human
ucaagauacugcuacugua

SEQ ID NO: 2188041 - RNA, 13 nt, Human
ucaagagcugccc

SEQ ID NO: 2188042 - RNA, 16 nt, Human
ucaagagcugcccucc

SEQ ID NO: 2188043 - RNA, 16 nt, Human
ucaagaccuucucccc

SEQ ID NO: 2188044 - RNA, 15 nt, Human
ucaagagauuuaauu

SEQ ID NO: 2188045 - RNA, 18 nt, Human
ucaagagauuuaauuaau

SEQ ID NO: 2188046 - RNA, 19 nt, Human
ucaagagaguaauggguuu

SEQ ID NO: 2188047 - RNA, 19 nt, Human
ucaagacuggaaggugggg

SEQ ID NO: 2188048 - RNA, 20 nt, Human
ucaagacuggaaggugggga

SEQ ID NO: 2188049 - RNA, 20 nt, Human
ucaagacauuaaaucuauga

SEQ ID NO: 2188050 - RNA, 17 nt, Human
ucaagacauuaaaucua

SEQ ID NO: 2188051 - RNA, 21 nt, Human
ucaagaauaaucacgcuuucc

SEQ ID NO: 2188052 - RNA, 22 nt, Human
ucaagaauggggaucacagaga

SEQ ID NO: 2188053 - RNA, 21 nt, Human
ucaagaaagcuucaaacugca

SEQ ID NO: 2188054 - RNA, 21 nt, Human
ucaagaaauaaaaggaagcca

SEQ ID NO: 2188055 - RNA, 20 nt, Human
ucaagaaauaaaaggaagcc

SEQ ID NO: 2188056 - RNA, 22 nt, Human
ucaagaaauaaaaggaagccaa

SEQ ID NO: 2188057 - RNA, 23 nt, Human
ucaagaagaagauggauuggugu

SEQ ID NO: 2188058 - RNA, 12 nt, Human
ucaagaagacau

SEQ ID NO: 2188059 - RNA, 19 nt, Human
ucaagaagacauggagacu

SEQ ID NO: 2188060 - RNA, 23 nt, Human
ucaagaagcaggcuacacugaca

SEQ ID NO: 2188061 - RNA, 21 nt, Human
ucaacauguuacugaccagca

SEQ ID NO: 2188062 - RNA, 20 nt, Human
ucaacauguuacugaccagc

SEQ ID NO: 2188063 - RNA, 22 nt, Human
ucaacauguuacugaccagcaa

SEQ ID NO: 2188064 - RNA, 15 nt, Human
ucaacaucuuuuaca

SEQ ID NO: 2188065 - RNA, 21 nt, Human
ucaacaucaauguucauugua

SEQ ID NO: 2188066 - RNA, 19 nt, Human
ucaacauguuacugaccag

SEQ ID NO: 2188067 - RNA, 15 nt, Human
ucaacauguuacuga

SEQ ID NO: 2188068 - RNA, 23 nt, Human
ucaagaaacugaggaauuuucuu

SEQ ID NO: 2188069 - RNA, 22 nt, Human
ucaagaaacugaggaauuuucu

SEQ ID NO: 2188070 - RNA, 20 nt, Human
ucaagaaacugaggaauuuu

SEQ ID NO: 2188071 - RNA, 18 nt, Human
ucaagaaacugaggaauu

SEQ ID NO: 2188072 - RNA, 17 nt, Human
ucaagaaacugaggaau

SEQ ID NO: 2188073 - RNA, 13 nt, Human
ucaagaaacugag

SEQ ID NO: 2188074 - RNA, 12 nt, Human
ucaagaaacuga

SEQ ID NO: 2188075 - RNA, 23 nt, Human
ucaacaucaauguucauuguaau

SEQ ID NO: 2188076 - RNA, 20 nt, Human
ucaacaucaauguucauugu

SEQ ID NO: 2188077 - RNA, 19 nt, Human
ucaacaucaauguucauug

SEQ ID NO: 2188078 - RNA, 12 nt, Human
ucaacaucuuuu

SEQ ID NO: 2188079 - RNA, 18 nt, Human
ucaacaucaauguucauu

SEQ ID NO: 2188080 - RNA, 17 nt, Human
ucaacaucaauguucau

SEQ ID NO: 2188081 - RNA, 16 nt, Human
ucaacaucaauguuca

SEQ ID NO: 2188082 - RNA, 15 nt, Human
ucaacaucaauguuc

SEQ ID NO: 2188083 - RNA, 14 nt, Human
ucaacaucaauguu

SEQ ID NO: 2188084 - RNA, 15 nt, Human
accccugguucucau

SEQ ID NO: 2188085 - RNA, 16 nt, Human
accccugguucucauc

SEQ ID NO: 2188086 - RNA, 20 nt, Human
accccugguucucaucuuuc

SEQ ID NO: 2188087 - RNA, 22 nt, Human
accccugguucucaucuuucuu

SEQ ID NO: 2188088 - RNA, 14 nt, Human
accccugguucuca

SEQ ID NO: 2188089 - RNA, 21 nt, Human
acccccgcccaggcuggccag

SEQ ID NO: 2188090 - RNA, 23 nt, Human
acccccgcccaggcuggccagcc

SEQ ID NO: 2188091 - RNA, 15 nt, Human
acccccgcccaggcu

SEQ ID NO: 2188092 - RNA, 16 nt, Human
acccccgcccaggcug

SEQ ID NO: 2188093 - RNA, 19 nt, Human
acccccgcccaggcuggcc

SEQ ID NO: 2188094 - RNA, 20 nt, Human
acccccgcccaggcuggcca

SEQ ID NO: 2188095 - RNA, 22 nt, Human
acccccgaguuuggucccuggg

SEQ ID NO: 2188096 - RNA, 13 nt, Human
acccccgcccagg

SEQ ID NO: 2188097 - RNA, 20 nt, Human
accccccagaaccuguccuu

SEQ ID NO: 2188098 - RNA, 19 nt, Human
accccccagcacugaggaa

SEQ ID NO: 2188099 - RNA, 15 nt, Human
accccccagcacuga

SEQ ID NO: 2188100 - RNA, 17 nt, Human
accccccagcacugagg

SEQ ID NO: 2188101 - RNA, 15 nt, Human
accccccugggcuga

SEQ ID NO: 2188102 - RNA, 12 nt, Human
accccccugggc

SEQ ID NO: 2188103 - RNA, 11 nt, Human
accccccucug

SEQ ID NO: 2188104 - RNA, 12 nt, Human
accccccucauu

SEQ ID NO: 2188105 - RNA, 14 nt, Human
acccccaccccaca

SEQ ID NO: 2188106 - RNA, 12 nt, Human
acccccacccca

SEQ ID NO: 2188107 - RNA, 13 nt, Human
accccccagcacu

SEQ ID NO: 2188108 - RNA, 14 nt, Human
accccccagcacug

SEQ ID NO: 2188109 - RNA, 12 nt, Human
acccccacccaa

SEQ ID NO: 2188110 - RNA, 22 nt, Human
ucagccuuggauaaugcuguug

SEQ ID NO: 2188111 - RNA, 18 nt, Human
ucagcgauguaugcagcu

SEQ ID NO: 2188112 - RNA, 23 nt, Human
ucagcgacuccguuggccacucc

SEQ ID NO: 2188113 - RNA, 21 nt, Human
ucagcgauguaugcagcuauc

SEQ ID NO: 2188114 - RNA, 22 nt, Human
ucagcggccccuugacucuggg

SEQ ID NO: 2188115 - RNA, 17 nt, Human
ucagccuugccagagau

SEQ ID NO: 2188116 - RNA, 16 nt, Human
ucagccuugccagaga

SEQ ID NO: 2188117 - RNA, 19 nt, Human
ucagcgacuccguuggcca

SEQ ID NO: 2188118 - RNA, 20 nt, Human
ucagcgacuccguuggccac

SEQ ID NO: 2188119 - RNA, 16 nt, Human
accccuucgcuccugu

SEQ ID NO: 2188120 - RNA, 14 nt, Human
accccuuccugucc

SEQ ID NO: 2188121 - RNA, 12 nt, Human
accccuuccugu

SEQ ID NO: 2188122 - RNA, 15 nt, Human
ucagccuugccagag

SEQ ID NO: 2188123 - RNA, 14 nt, Human
ucagccuugccaga

SEQ ID NO: 2188124 - RNA, 14 nt, Human
accccuucgcuccu

SEQ ID NO: 2188125 - RNA, 15 nt, Human
accccuucgcuccug

SEQ ID NO: 2188126 - RNA, 18 nt, Human
accccuguggagcccgca

SEQ ID NO: 2188127 - RNA, 13 nt, Human
accccuguggagc

SEQ ID NO: 2188128 - RNA, 21 nt, Human
accccugugcuccgugccucc

SEQ ID NO: 2188129 - RNA, 22 nt, Human
accccugugcuccgugccucca

SEQ ID NO: 2188130 - RNA, 19 nt, Human
accccuguggagcccgcac

SEQ ID NO: 2188131 - RNA, 23 nt, Human
accccuuccccacugccugccca

SEQ ID NO: 2188132 - RNA, 15 nt, Human
accccuguccucacu

SEQ ID NO: 2188133 - RNA, 16 nt, Human
accccuguccucacug

SEQ ID NO: 2188134 - RNA, 17 nt, Human
accccuguccucacugc

SEQ ID NO: 2188135 - RNA, 18 nt, Human
accccuguccucacugcu

SEQ ID NO: 2188136 - RNA, 19 nt, Human
accccuguccucacugcuc

SEQ ID NO: 2188137 - RNA, 21 nt, Human
accccuguccucacugcuccc

SEQ ID NO: 2188138 - RNA, 17 nt, Human
accccugucucuagcca

SEQ ID NO: 2188139 - RNA, 14 nt, Human
accccugugcuccg

SEQ ID NO: 2188140 - RNA, 14 nt, Human
ucagcuucuuaaua

SEQ ID NO: 2188141 - RNA, 23 nt, Human
ucagcuucugcugggcuggggcc

SEQ ID NO: 2188142 - RNA, 14 nt, Human
ucagcuucuucauc

SEQ ID NO: 2188143 - RNA, 20 nt, Human
ucagcuuuuugucuuuucug

SEQ ID NO: 2188144 - RNA, 22 nt, Human
ucaggaaaacugacagaggagg

SEQ ID NO: 2188145 - RNA, 21 nt, Human
ucaggaaaacugacagaggag

SEQ ID NO: 2188146 - RNA, 20 nt, Human
ucaggaaaacugacagagga

SEQ ID NO: 2188147 - RNA, 15 nt, Human
ucagcuugcugcccu

SEQ ID NO: 2188148 - RNA, 16 nt, Human
ucaggaaaagccucug

SEQ ID NO: 2188149 - RNA, 17 nt, Human
ucaggaaaagccucugu

SEQ ID NO: 2188150 - RNA, 18 nt, Human
ucaggaaaagccucugug

SEQ ID NO: 2188151 - RNA, 19 nt, Human
ucaggaaaagccucugugu

SEQ ID NO: 2188152 - RNA, 13 nt, Human
ucaggaaagagaa

SEQ ID NO: 2188153 - RNA, 14 nt, Human
ucaggaaagacgga

SEQ ID NO: 2188154 - RNA, 15 nt, Human
ucaggaaaggaauca

SEQ ID NO: 2188155 - RNA, 19 nt, Human
ucaggaaagagaacuucca

SEQ ID NO: 2188156 - RNA, 21 nt, Human
ucaggaaaucaaauaugcaaa

SEQ ID NO: 2188157 - RNA, 20 nt, Human
ucaggaaaucaaauaugcaa

SEQ ID NO: 2188158 - RNA, 13 nt, Human
ucagcuucuuaau

SEQ ID NO: 2188159 - RNA, 21 nt, Human
ucagcuucugcugggcugggg

SEQ ID NO: 2188160 - RNA, 22 nt, Human
ucagcuucugcugggcuggggc

SEQ ID NO: 2188161 - RNA, 16 nt, Human
ucagcuucugcugggc

SEQ ID NO: 2188162 - RNA, 17 nt, Human
ucagcuucugcugggcu

SEQ ID NO: 2188163 - RNA, 18 nt, Human
ucagcuucugcugggcug

SEQ ID NO: 2188164 - RNA, 19 nt, Human
ucagcuucugcugggcugg

SEQ ID NO: 2188165 - RNA, 20 nt, Human
ucagcuuguaaauagcucag

SEQ ID NO: 2188166 - RNA, 14 nt, Human
ucagcucacuguuc

SEQ ID NO: 2188167 - RNA, 18 nt, Human
ucagcucagcgccagccu

SEQ ID NO: 2188168 - RNA, 23 nt, Human
ucagcuuccuacccacaccucug

SEQ ID NO: 2188169 - RNA, 20 nt, Human
ucagcuucuauccuugacuu

SEQ ID NO: 2188170 - RNA, 14 nt, Human
ucagcuucugcugg

SEQ ID NO: 2188171 - RNA, 15 nt, Human
ucagcuucugcuggg

SEQ ID NO: 2188172 - RNA, 21 nt, Human
ucagcuucguuuauuuucaag

SEQ ID NO: 2188173 - RNA, 19 nt, Human
ucagcuucguuuauuuuca

SEQ ID NO: 2188174 - RNA, 14 nt, Human
ucagcggggacagc

SEQ ID NO: 2188175 - RNA, 19 nt, Human
ucagcuacugauuuuugug

SEQ ID NO: 2188176 - RNA, 19 nt, Human
ucagcuauuuacugccaaa

SEQ ID NO: 2188177 - RNA, 22 nt, Human
ucagcuauuuaaaaaaaaaaga

SEQ ID NO: 2188178 - RNA, 20 nt, Human
ucagcuauuuacugccaaag

SEQ ID NO: 2188179 - RNA, 23 nt, Human
ucagcuauuuaaaaaaaaaagag

SEQ ID NO: 2188180 - RNA, 16 nt, Human
ucagcucacugcaacc

SEQ ID NO: 2188181 - RNA, 13 nt, Human
ucagcucacugca

SEQ ID NO: 2188182 - RNA, 18 nt, Human
ucagccaucaacaagagu

SEQ ID NO: 2188183 - RNA, 23 nt, Human
ucagccaugaggaguugcuguuu

SEQ ID NO: 2188184 - RNA, 14 nt, Human
ucagccauguauuu

SEQ ID NO: 2188185 - RNA, 19 nt, Human
ucagccaggagcugggcag

SEQ ID NO: 2188186 - RNA, 20 nt, Human
ucagccaagcacaguggugg

SEQ ID NO: 2188187 - RNA, 12 nt, Human
ucagccagggcc

SEQ ID NO: 2188188 - RNA, 13 nt, Human
ucagccagggcca

SEQ ID NO: 2188189 - RNA, 14 nt, Human
ucagccagggccag

SEQ ID NO: 2188190 - RNA, 16 nt, Human
ucagccagggccaggg

SEQ ID NO: 2188191 - RNA, 18 nt, Human
ucagccagggccaggggu

SEQ ID NO: 2188192 - RNA, 23 nt, Human
ucagccaaauguaauugaauaaa

SEQ ID NO: 2188193 - RNA, 12 nt, Human
ucagccaagcac

SEQ ID NO: 2188194 - RNA, 14 nt, Human
ucagccaagcacag

SEQ ID NO: 2188195 - RNA, 15 nt, Human
ucagccaagcacagu

SEQ ID NO: 2188196 - RNA, 22 nt, Human
ucagccaagguuuuauaaggcu

SEQ ID NO: 2188197 - RNA, 23 nt, Human
ucagccaagguuuuauaaggcug

SEQ ID NO: 2188198 - RNA, 22 nt, Human
ucagccaagaauucuuaaauau

SEQ ID NO: 2188199 - RNA, 19 nt, Human
ucagcauuuccacaccaag

SEQ ID NO: 2188200 - RNA, 18 nt, Human
ucagagcugacacaggau

SEQ ID NO: 2188201 - RNA, 21 nt, Human
ucagccaacgaguaauuuauu

SEQ ID NO: 2188202 - RNA, 22 nt, Human
ucagccaaauguaauugaauaa

SEQ ID NO: 2188203 - RNA, 16 nt, Human
ucagccaaauguaauu

SEQ ID NO: 2188204 - RNA, 14 nt, Human
ucagccaaauguaa

SEQ ID NO: 2188205 - RNA, 11 nt, Human
ucagagagggu

SEQ ID NO: 2188206 - RNA, 22 nt, Human
ucagagaggccuuuuggaaugu

SEQ ID NO: 2188207 - RNA, 21 nt, Human
ucagagaggccuuuuggaaug

SEQ ID NO: 2188208 - RNA, 16 nt, Human
ucagagcuacuugggc

SEQ ID NO: 2188209 - RNA, 17 nt, Human
ucagagcuacuugggcc

SEQ ID NO: 2188210 - RNA, 18 nt, Human
ucagagcuacuugggcca

SEQ ID NO: 2188211 - RNA, 14 nt, Human
ucagagcugacaca

SEQ ID NO: 2188212 - RNA, 21 nt, Human
ucagccaugaggaguugcugu

SEQ ID NO: 2188213 - RNA, 14 nt, Human
ucagccaugugcug

SEQ ID NO: 2188214 - RNA, 16 nt, Human
ucagccauucacugcc

SEQ ID NO: 2188215 - RNA, 16 nt, Human
ucagcccaagaugcuu

SEQ ID NO: 2188216 - RNA, 13 nt, Human
ucagcccaccccc

SEQ ID NO: 2188217 - RNA, 12 nt, Human
ucagcccacccc

SEQ ID NO: 2188218 - RNA, 22 nt, Human
ucagcccaaaccaccagaagcc

SEQ ID NO: 2188219 - RNA, 21 nt, Human
ucagcccaaaccaccagaagc

SEQ ID NO: 2188220 - RNA, 23 nt, Human
ucagcccugggccccaccaccua

SEQ ID NO: 2188221 - RNA, 22 nt, Human
ucagcccugggccccaccaccu

SEQ ID NO: 2188222 - RNA, 21 nt, Human
ucagcccugggccccaccacc

SEQ ID NO: 2188223 - RNA, 14 nt, Human
ucagcccacccccc

SEQ ID NO: 2188224 - RNA, 18 nt, Human
ucagccgagccgggccug

SEQ ID NO: 2188225 - RNA, 19 nt, Human
ucagccgagccgggccugg

SEQ ID NO: 2188226 - RNA, 20 nt, Human
ucagccgagccgggccuggg

SEQ ID NO: 2188227 - RNA, 21 nt, Human
ucagccgagccgggccugggg

SEQ ID NO: 2188228 - RNA, 23 nt, Human
ucagccguguaaccauggaccca

SEQ ID NO: 2188229 - RNA, 19 nt, Human
acccagcgagcccuggugg

SEQ ID NO: 2188230 - RNA, 23 nt, Human
acccagcgagcccugguggcagu

SEQ ID NO: 2188231 - RNA, 22 nt, Human
ucagccuagccgaccucagccu

SEQ ID NO: 2188232 - RNA, 21 nt, Human
ucagccuagccgaccucagcc

SEQ ID NO: 2188233 - RNA, 20 nt, Human
ucagccuagccgaccucagc

SEQ ID NO: 2188234 - RNA, 19 nt, Human
ucagccuagccgaccucag

SEQ ID NO: 2188235 - RNA, 18 nt, Human
ucagccuagccgaccuca

SEQ ID NO: 2188236 - RNA, 16 nt, Human
ucagccgggcccugag

SEQ ID NO: 2188237 - RNA, 22 nt, Human
ucagccgagccgggccuggggc

SEQ ID NO: 2188238 - RNA, 16 nt, Human
acccccaaauuuucuu

SEQ ID NO: 2188239 - RNA, 13 nt, Human
acccccacacaca

SEQ ID NO: 2188240 - RNA, 12 nt, Human
acccccacacac

SEQ ID NO: 2188241 - RNA, 20 nt, Human
accccaggcugaagcagguu

SEQ ID NO: 2188242 - RNA, 10 nt, Human
accccagggc

SEQ ID NO: 2188243 - RNA, 16 nt, Human
acccccaaggggcagu

SEQ ID NO: 2188244 - RNA, 10 nt, Human
acccccacca

SEQ ID NO: 2188245 - RNA, 13 nt, Human
acccccaccaagg

SEQ ID NO: 2188246 - RNA, 15 nt, Human
acccccaccaagggc

SEQ ID NO: 2188247 - RNA, 17 nt, Human
acccccacaccucaguu

SEQ ID NO: 2188248 - RNA, 15 nt, Human
acccccacaccucag

SEQ ID NO: 2188249 - RNA, 21 nt, Human
acccccacacacacacacaug

SEQ ID NO: 2188250 - RNA, 20 nt, Human
acccccacacacacacacau

SEQ ID NO: 2188251 - RNA, 15 nt, Human
acccccacacacaca

SEQ ID NO: 2188252 - RNA, 14 nt, Human
acccccacacacac

SEQ ID NO: 2188253 - RNA, 18 nt, Human
accccagacgaugucuuc

SEQ ID NO: 2188254 - RNA, 23 nt, Human
accccagcuggggccaggcuggg

SEQ ID NO: 2188255 - RNA, 17 nt, Human
accccacuuaucccucu

SEQ ID NO: 2188256 - RNA, 18 nt, Human
accccacuuaucccucuc

SEQ ID NO: 2188257 - RNA, 17 nt, Human
accccagcugugagccu

SEQ ID NO: 2188258 - RNA, 18 nt, Human
accccagcugugagccuu

SEQ ID NO: 2188259 - RNA, 19 nt, Human
accccagcugugagccuug

SEQ ID NO: 2188260 - RNA, 20 nt, Human
accccagcugugagccuugg

SEQ ID NO: 2188261 - RNA, 21 nt, Human
accccagcugugagccuuggc

SEQ ID NO: 2188262 - RNA, 22 nt, Human
accccagcugugagccuuggcu

SEQ ID NO: 2188263 - RNA, 12 nt, Human
accccaggcccc

SEQ ID NO: 2188264 - RNA, 13 nt, Human
accccaggccccg

SEQ ID NO: 2188265 - RNA, 14 nt, Human
accccaggccccga

SEQ ID NO: 2188266 - RNA, 15 nt, Human
accccaggccccgag

SEQ ID NO: 2188267 - RNA, 19 nt, Human
acccaggcuggagugcagu

SEQ ID NO: 2188268 - RNA, 12 nt, Human
acccaggcuggg

SEQ ID NO: 2188269 - RNA, 13 nt, Human
acccaggcugggc

SEQ ID NO: 2188270 - RNA, 14 nt, Human
acccaggcugggca

SEQ ID NO: 2188271 - RNA, 20 nt, Human
acccaggcugggcaaggagg

SEQ ID NO: 2188272 - RNA, 22 nt, Human
acccaggcugggcaaggaggcc

SEQ ID NO: 2188273 - RNA, 20 nt, Human
acccaggcuggagugcaaug

SEQ ID NO: 2188274 - RNA, 23 nt, Human
acccaggccgcagcucuugcccu

SEQ ID NO: 2188275 - RNA, 20 nt, Human
acccaggcuggaguacagug

SEQ ID NO: 2188276 - RNA, 17 nt, Human
acccaggaguguggcca

SEQ ID NO: 2188277 - RNA, 15 nt, Human
acccaggccgcagcu

SEQ ID NO: 2188278 - RNA, 15 nt, Human
acccaggcaccugca

SEQ ID NO: 2188279 - RNA, 22 nt, Human
acccaggccgcagcucuugccc

SEQ ID NO: 2188280 - RNA, 24 nt, Human
acccagcgagcccugguggcagug

SEQ ID NO: 2188281 - RNA, 13 nt, Human
accccacccuucc

SEQ ID NO: 2188282 - RNA, 20 nt, Human
accccacccucccuggagug

SEQ ID NO: 2188283 - RNA, 21 nt, Human
acccagggcccaggcaaauca

SEQ ID NO: 2188284 - RNA, 16 nt, Human
accccacccucccugg

SEQ ID NO: 2188285 - RNA, 17 nt, Human
accccacccucccugga

SEQ ID NO: 2188286 - RNA, 18 nt, Human
accccacccucccuggag

SEQ ID NO: 2188287 - RNA, 14 nt, Human
acccagggccugca

SEQ ID NO: 2188288 - RNA, 13 nt, Human
acccagggccugc

SEQ ID NO: 2188289 - RNA, 12 nt, Human
acccagggccug

SEQ ID NO: 2188290 - RNA, 19 nt, Human
accccacccuuccccuccu

SEQ ID NO: 2188291 - RNA, 19 nt, Human
accccacccucccuggagu

SEQ ID NO: 2188292 - RNA, 15 nt, Human
accccacccuugccc

SEQ ID NO: 2188293 - RNA, 16 nt, Human
accccacccuugccca

SEQ ID NO: 2188294 - RNA, 17 nt, Human
accccacccuugcccac

SEQ ID NO: 2188295 - RNA, 18 nt, Human
accccacccuugcccacc

SEQ ID NO: 2188296 - RNA, 20 nt, Human
accccacccuugcccacccc

SEQ ID NO: 2188297 - RNA, 14 nt, Human
accccacuacacag

SEQ ID NO: 2188298 - RNA, 22 nt, Human
accccacccuugcccaccccac

SEQ ID NO: 2188299 - RNA, 16 nt, Human
ucacucuugccaaccu

SEQ ID NO: 2188300 - RNA, 22 nt, Human
accauggucggaaaacaugcua

SEQ ID NO: 2188301 - RNA, 21 nt, Human
accauguaaagaacauaaaua

SEQ ID NO: 2188302 - RNA, 14 nt, Human
accauguacauagc

SEQ ID NO: 2188303 - RNA, 11 nt, Human
accauguacau

SEQ ID NO: 2188304 - RNA, 17 nt, Human
accauguacaugaagaa

SEQ ID NO: 2188305 - RNA, 17 nt, Human
accauguagaaaauuug

SEQ ID NO: 2188306 - RNA, 18 nt, Human
ucacucuuccugcaagga

SEQ ID NO: 2188307 - RNA, 19 nt, Human
ucacucuuccugcaaggac

SEQ ID NO: 2188308 - RNA, 13 nt, Human
ucacucuuggagc

SEQ ID NO: 2188309 - RNA, 15 nt, Human
ucacuccuaccuggu

SEQ ID NO: 2188310 - RNA, 21 nt, Human
ucacucccuucuaccugccac

SEQ ID NO: 2188311 - RNA, 15 nt, Human
ucacucuuccagaau

SEQ ID NO: 2188312 - RNA, 17 nt, Human
ucacucuuccagaaucc

SEQ ID NO: 2188313 - RNA, 21 nt, Human
ucacucuuccagaaucccaag

SEQ ID NO: 2188314 - RNA, 21 nt, Human
ucacucuuauugcccacgcug

SEQ ID NO: 2188315 - RNA, 23 nt, Human
ucacucuuauugcccacgcugga

SEQ ID NO: 2188316 - RNA, 24 nt, Human
accauucugacucgguuucuccaa

SEQ ID NO: 2188317 - RNA, 21 nt, Human
accauucagugauuacuguca

SEQ ID NO: 2188318 - RNA, 18 nt, Human
accauugaauucuugguu

SEQ ID NO: 2188319 - RNA, 18 nt, Human
accauuaugaagaagaga

SEQ ID NO: 2188320 - RNA, 12 nt, Human
accauuaaaacu

SEQ ID NO: 2188321 - RNA, 21 nt, Human
accauguuugagcucagaccc

SEQ ID NO: 2188322 - RNA, 20 nt, Human
accauguuugagcucagacc

SEQ ID NO: 2188323 - RNA, 13 nt, Human
accauuaaaacug

SEQ ID NO: 2188324 - RNA, 20 nt, Human
accauuaaaacugaagucug

SEQ ID NO: 2188325 - RNA, 21 nt, Human
accauuaaaacugaagucuga

SEQ ID NO: 2188326 - RNA, 22 nt, Human
accauuaaaacugaagucugaa

SEQ ID NO: 2188327 - RNA, 23 nt, Human
accauuaaaacugaagucugaaa

SEQ ID NO: 2188328 - RNA, 22 nt, Human
acccagaccuguuagcagacag

SEQ ID NO: 2188329 - RNA, 20 nt, Human
acccacucuccucugccuca

SEQ ID NO: 2188330 - RNA, 10 nt, Human
acccagaccc

SEQ ID NO: 2188331 - RNA, 13 nt, Human
acccagacccagu

SEQ ID NO: 2188332 - RNA, 14 nt, Human
acccagacccagug

SEQ ID NO: 2188333 - RNA, 15 nt, Human
acccagacccagugg

SEQ ID NO: 2188334 - RNA, 17 nt, Human
acccagagaggaaucag

SEQ ID NO: 2188335 - RNA, 18 nt, Human
acccagagaauauauaca

SEQ ID NO: 2188336 - RNA, 23 nt, Human
acccagagcauuacgugagccag

SEQ ID NO: 2188337 - RNA, 24 nt, Human
acccagagcauuacgugagccagg

SEQ ID NO: 2188338 - RNA, 14 nt, Human
acccagcccauucu

SEQ ID NO: 2188339 - RNA, 15 nt, Human
acccagacucagaca

SEQ ID NO: 2188340 - RNA, 17 nt, Human
acccagagaagccccuu

SEQ ID NO: 2188341 - RNA, 18 nt, Human
acccagagaagccccuuc

SEQ ID NO: 2188342 - RNA, 19 nt, Human
acccagagaagccccuucc

SEQ ID NO: 2188343 - RNA, 22 nt, Human
acccagagaagccccuucccca

SEQ ID NO: 2188344 - RNA, 14 nt, Human
acccagagaauaua

SEQ ID NO: 2188345 - RNA, 16 nt, Human
acccagagaauauaua

SEQ ID NO: 2188346 - RNA, 13 nt, Human
acccacugcucug

SEQ ID NO: 2188347 - RNA, 14 nt, Human
acccacugcucugg

SEQ ID NO: 2188348 - RNA, 15 nt, Human
acccacugcucuggu

SEQ ID NO: 2188349 - RNA, 11 nt, Human
acccacugcuu

SEQ ID NO: 2188350 - RNA, 10 nt, Human
acccacugcu

SEQ ID NO: 2188351 - RNA, 11 nt, Human
acccacugcuc

SEQ ID NO: 2188352 - RNA, 18 nt, Human
acccacucuccucugccu

SEQ ID NO: 2188353 - RNA, 15 nt, Human
acccacucaucagaa

SEQ ID NO: 2188354 - RNA, 13 nt, Human
acccacucagcuc

SEQ ID NO: 2188355 - RNA, 23 nt, Human
acccaccuuguuggagccugcag

SEQ ID NO: 2188356 - RNA, 20 nt, Human
acccacguguaacugucagc

SEQ ID NO: 2188357 - RNA, 21 nt, Human
acccacguucucacacccacc

SEQ ID NO: 2188358 - RNA, 14 nt, Human
accauugucuuguu

SEQ ID NO: 2188359 - RNA, 22 nt, Human
accauuugcauggcuccagaaa

SEQ ID NO: 2188360 - RNA, 23 nt, Human
accauuucuugagguaaaagcau

SEQ ID NO: 2188361 - RNA, 12 nt, Human
ucagaagggagg

SEQ ID NO: 2188362 - RNA, 20 nt, Human
ucagaaggcucuucugacua

SEQ ID NO: 2188363 - RNA, 13 nt, Human
ucagaagggaggc

SEQ ID NO: 2188364 - RNA, 19 nt, Human
ucagaaggagaaggaagga

SEQ ID NO: 2188365 - RNA, 12 nt, Human
ucagaaggcucu

SEQ ID NO: 2188366 - RNA, 20 nt, Human
ucagaaggggaggggagaca

SEQ ID NO: 2188367 - RNA, 16 nt, Human
ucagaagggaggcugg

SEQ ID NO: 2188368 - RNA, 15 nt, Human
ucagaaggggagggg

SEQ ID NO: 2188369 - RNA, 18 nt, Human
ucagaaggagaaggaagg

SEQ ID NO: 2188370 - RNA, 16 nt, Human
ucagaaggagaaggaa

SEQ ID NO: 2188371 - RNA, 14 nt, Human
ucagaaggagaagg

SEQ ID NO: 2188372 - RNA, 13 nt, Human
ucagaaggagaag

SEQ ID NO: 2188373 - RNA, 12 nt, Human
ucagaaggagaa

SEQ ID NO: 2188374 - RNA, 14 nt, Human
ucagaagccuuugg

SEQ ID NO: 2188375 - RNA, 23 nt, Human
ucagaaggagaaggaaggagacu

SEQ ID NO: 2188376 - RNA, 18 nt, Human
ucagaaggcaaaugacuu

SEQ ID NO: 2188377 - RNA, 22 nt, Human
ucagaaggcaaaugacuuugga

SEQ ID NO: 2188378 - RNA, 19 nt, Human
ucagaaggcaaaugacuuu

SEQ ID NO: 2188379 - RNA, 19 nt, Human
ucagaaguuucucagcucc

SEQ ID NO: 2188380 - RNA, 21 nt, Human
ucagaagugagcuuugcugcu

SEQ ID NO: 2188381 - RNA, 19 nt, Human
ucagaagugagcuuugcug

SEQ ID NO: 2188382 - RNA, 15 nt, Human
ucagaagugagcuuu

SEQ ID NO: 2188383 - RNA, 19 nt, Human
ucagaaguuucugccgcag

SEQ ID NO: 2188384 - RNA, 22 nt, Human
ucagaaguuucugccgcagccc

SEQ ID NO: 2188385 - RNA, 23 nt, Human
acccagcccauucucucuccugu

SEQ ID NO: 2188386 - RNA, 22 nt, Human
acccagcccauucucucuccug

SEQ ID NO: 2188387 - RNA, 14 nt, Human
acccagccccaggg

SEQ ID NO: 2188388 - RNA, 19 nt, Human
acccagcccauucucucuc

SEQ ID NO: 2188389 - RNA, 19 nt, Human
acccagaguuuuuauguag

SEQ ID NO: 2188390 - RNA, 22 nt, Human
acccagaggaaggggccagagg

SEQ ID NO: 2188391 - RNA, 16 nt, Human
acccagccccuugaga

SEQ ID NO: 2188392 - RNA, 17 nt, Human
acccagccccuugagaa

SEQ ID NO: 2188393 - RNA, 20 nt, Human
acccagccccuugagaaacc

SEQ ID NO: 2188394 - RNA, 21 nt, Human
acccagccccuugagaaaccu

SEQ ID NO: 2188395 - RNA, 16 nt, Human
acccagcccucauccc

SEQ ID NO: 2188396 - RNA, 15 nt, Human
acccagcccucaucc

SEQ ID NO: 2188397 - RNA, 12 nt, Human
acccagcccugg

SEQ ID NO: 2188398 - RNA, 13 nt, Human
acccagcccuggu

SEQ ID NO: 2188399 - RNA, 14 nt, Human
acccagcccugguc

SEQ ID NO: 2188400 - RNA, 15 nt, Human
acccagcccuggucu

SEQ ID NO: 2188401 - RNA, 16 nt, Human
acccagcccuggucuc

SEQ ID NO: 2188402 - RNA, 19 nt, Human
acccagcccuggucucagc

SEQ ID NO: 2188403 - RNA, 21 nt, Human
acccagcccuggucucagcag

SEQ ID NO: 2188404 - RNA, 13 nt, Human
acccagccgcugc

SEQ ID NO: 2188405 - RNA, 14 nt, Human
acccagccgcugcc

SEQ ID NO: 2188406 - RNA, 16 nt, Human
acccagccgcugcccg

SEQ ID NO: 2188407 - RNA, 18 nt, Human
acccagccgcugcccggc

SEQ ID NO: 2188408 - RNA, 12 nt, Human
acccagccucag

SEQ ID NO: 2188409 - RNA, 20 nt, Human
ucagaagccugaggcuggga

SEQ ID NO: 2188410 - RNA, 15 nt, Human
ucagaagccugaggc

SEQ ID NO: 2188411 - RNA, 13 nt, Human
ucagaagccugag

SEQ ID NO: 2188412 - RNA, 16 nt, Human
ucagaagccucugggu

SEQ ID NO: 2188413 - RNA, 14 nt, Human
ucagaagauaacuu

SEQ ID NO: 2188414 - RNA, 13 nt, Human
acccagccucagu

SEQ ID NO: 2188415 - RNA, 17 nt, Human
acccagccucaguccuc

SEQ ID NO: 2188416 - RNA, 12 nt, Human
ucagaagauaac

SEQ ID NO: 2188417 - RNA, 14 nt, Human
ucagaagacacuga

SEQ ID NO: 2188418 - RNA, 17 nt, Human
ucagaaucucucuucuu

SEQ ID NO: 2188419 - RNA, 19 nt, Human
ucagaaucucaaauaacua

SEQ ID NO: 2188420 - RNA, 18 nt, Human
ucagaaucucaaauaacu

SEQ ID NO: 2188421 - RNA, 21 nt, Human
ucagagacuccugcaggcagc

SEQ ID NO: 2188422 - RNA, 16 nt, Human
ucagagaggccuuuug

SEQ ID NO: 2188423 - RNA, 16 nt, Human
ucagagacuccugcag

SEQ ID NO: 2188424 - RNA, 17 nt, Human
ucagagacuccugcagg

SEQ ID NO: 2188425 - RNA, 20 nt, Human
ucagagacuccugcaggcag

SEQ ID NO: 2188426 - RNA, 12 nt, Human
ucagagccugca

SEQ ID NO: 2188427 - RNA, 23 nt, Human
ucagagagggugggagugggccc

SEQ ID NO: 2188428 - RNA, 16 nt, Human
ucagagagggugggag

SEQ ID NO: 2188429 - RNA, 21 nt, Human
ucagagagggugggagugggc

SEQ ID NO: 2188430 - RNA, 13 nt, Human
ucagagccugcag

SEQ ID NO: 2188431 - RNA, 14 nt, Human
ucagagccugcagu

SEQ ID NO: 2188432 - RNA, 15 nt, Human
ucagagccugcaguu

SEQ ID NO: 2188433 - RNA, 18 nt, Human
ucagagccugcaguuauu

SEQ ID NO: 2188434 - RNA, 20 nt, Human
ucacuaccuccucagggaug

SEQ ID NO: 2188435 - RNA, 19 nt, Human
ucacuacucacagucucuu

SEQ ID NO: 2188436 - RNA, 21 nt, Human
ucaccuucguuuacuaugccu

SEQ ID NO: 2188437 - RNA, 14 nt, Human
ucacuaccuccuca

SEQ ID NO: 2188438 - RNA, 15 nt, Human
ucacuaccuccucag

SEQ ID NO: 2188439 - RNA, 16 nt, Human
ucacuaccuccucagg

SEQ ID NO: 2188440 - RNA, 18 nt, Human
ucacuaccuccucaggga

SEQ ID NO: 2188441 - RNA, 19 nt, Human
ucacuaccuccucagggau

SEQ ID NO: 2188442 - RNA, 22 nt, Human
ucacuacucacagucucuuuaa

SEQ ID NO: 2188443 - RNA, 21 nt, Human
ucacuacucacagucucuuua

SEQ ID NO: 2188444 - RNA, 12 nt, Human
ucacuacugcag

SEQ ID NO: 2188445 - RNA, 17 nt, Human
ucacuagauggcgagca

SEQ ID NO: 2188446 - RNA, 14 nt, Human
ucacuacugcaguc

SEQ ID NO: 2188447 - RNA, 14 nt, Human
ucacuagccaugau

SEQ ID NO: 2188448 - RNA, 19 nt, Human
ucacuaggcccccacuugc

SEQ ID NO: 2188449 - RNA, 21 nt, Human
ucacuaggcccccacuugccu

SEQ ID NO: 2188450 - RNA, 20 nt, Human
ucaccuuaggcagggaagug

SEQ ID NO: 2188451 - RNA, 18 nt, Human
ucaccuuaggcagggaag

SEQ ID NO: 2188452 - RNA, 15 nt, Human
ucaccuuaggcaggg

SEQ ID NO: 2188453 - RNA, 21 nt, Human
ucaccuguuuuuaagcuguuu

SEQ ID NO: 2188454 - RNA, 22 nt, Human
ucaccuguuuuuaagcuguuuc

SEQ ID NO: 2188455 - RNA, 23 nt, Human
ucaccugcccagaucccagaagg

SEQ ID NO: 2188456 - RNA, 14 nt, Human
ucaccuguugcuua

SEQ ID NO: 2188457 - RNA, 18 nt, Human
ucaccuguugcuuacaau

SEQ ID NO: 2188458 - RNA, 19 nt, Human
ucaccuguugcuuacaauu

SEQ ID NO: 2188459 - RNA, 21 nt, Human
ucaccugugcuucgggcccuu

SEQ ID NO: 2188460 - RNA, 20 nt, Human
ucaccugugcuucgggcccu

SEQ ID NO: 2188461 - RNA, 18 nt, Human
ucaccuguuuuuaagcug

SEQ ID NO: 2188462 - RNA, 20 nt, Human
ucaccuguugcuuacaauuu

SEQ ID NO: 2188463 - RNA, 21 nt, Human
ucaccuguugcuuacaauuuu

SEQ ID NO: 2188464 - RNA, 19 nt, Human
ucaccuguuuuuaagcugu

SEQ ID NO: 2188465 - RNA, 20 nt, Human
ucaccuguuuuuaagcuguu

SEQ ID NO: 2188466 - RNA, 23 nt, Human
ucacuccggugugccugcagccc

SEQ ID NO: 2188467 - RNA, 22 nt, Human
ucacuccggugugccugcagcc

SEQ ID NO: 2188468 - RNA, 21 nt, Human
ucacuccggugugccugcagc

SEQ ID NO: 2188469 - RNA, 20 nt, Human
ucacuccggugugccugcag

SEQ ID NO: 2188470 - RNA, 19 nt, Human
ucacuccggugugccugca

SEQ ID NO: 2188471 - RNA, 17 nt, Human
ucacuccggugugccug

SEQ ID NO: 2188472 - RNA, 14 nt, Human
ucacuccggugugc

SEQ ID NO: 2188473 - RNA, 14 nt, Human
ucacucccagucca

SEQ ID NO: 2188474 - RNA, 22 nt, Human
ucacuaggcccccacuugccuc

SEQ ID NO: 2188475 - RNA, 15 nt, Human
ucacucccuccauca

SEQ ID NO: 2188476 - RNA, 13 nt, Human
ucacuccccucca

SEQ ID NO: 2188477 - RNA, 15 nt, Human
ucacucccuucuacc

SEQ ID NO: 2188478 - RNA, 19 nt, Human
ucacucccuucuaccugcc

SEQ ID NO: 2188479 - RNA, 20 nt, Human
ucacucccuucuaccugcca

SEQ ID NO: 2188480 - RNA, 18 nt, Human
ucacuauguugcccaggc

SEQ ID NO: 2188481 - RNA, 17 nt, Human
ucacuauguugcccagg

SEQ ID NO: 2188482 - RNA, 19 nt, Human
ucacuauguugcccaggca

SEQ ID NO: 2188483 - RNA, 20 nt, Human
ucacuauguugcccaggcag

SEQ ID NO: 2188484 - RNA, 18 nt, Human
accaggcuugccugcagg

SEQ ID NO: 2188485 - RNA, 17 nt, Human
accaggcuggcgcagcc

SEQ ID NO: 2188486 - RNA, 19 nt, Human
accaggcuggcgcagccaa

SEQ ID NO: 2188487 - RNA, 20 nt, Human
accaggcuggcgcagccaag

SEQ ID NO: 2188488 - RNA, 22 nt, Human
accaggcuggcgcagccaaggc

SEQ ID NO: 2188489 - RNA, 14 nt, Human
accagggacugagg

SEQ ID NO: 2188490 - RNA, 23 nt, Human
accagccucucuugguuuccuuc

SEQ ID NO: 2188491 - RNA, 16 nt, Human
accaggccguccuccc

SEQ ID NO: 2188492 - RNA, 19 nt, Human
accagccucgucuucauua

SEQ ID NO: 2188493 - RNA, 18 nt, Human
accaggccguccucccgg

SEQ ID NO: 2188494 - RNA, 20 nt, Human
accagccuccguauuucaga

SEQ ID NO: 2188495 - RNA, 17 nt, Human
accagccucgucuucau

SEQ ID NO: 2188496 - RNA, 23 nt, Human
accaggcgagagacuuguggccu

SEQ ID NO: 2188497 - RNA, 12 nt, Human
accaggccuggg

SEQ ID NO: 2188498 - RNA, 19 nt, Human
accaggccguccucccggg

SEQ ID NO: 2188499 - RNA, 20 nt, Human
accaggccguccucccgggc

SEQ ID NO: 2188500 - RNA, 19 nt, Human
accaggcugcucagggcug

SEQ ID NO: 2188501 - RNA, 16 nt, Human
accaggcuggcgcagc

SEQ ID NO: 2188502 - RNA, 17 nt, Human
accagagcccaccuugg

SEQ ID NO: 2188503 - RNA, 21 nt, Human
accagacuguggagaaauaaa

SEQ ID NO: 2188504 - RNA, 13 nt, Human
accagacugugga

SEQ ID NO: 2188505 - RNA, 18 nt, Human
accagacuguggagaaau

SEQ ID NO: 2188506 - RNA, 20 nt, Human
accagacuguggagaaauaa

SEQ ID NO: 2188507 - RNA, 14 nt, Human
accagccuccaugc

SEQ ID NO: 2188508 - RNA, 19 nt, Human
accagccuccaugcugccu

SEQ ID NO: 2188509 - RNA, 20 nt, Human
accagccuccaugcugccuc

SEQ ID NO: 2188510 - RNA, 21 nt, Human
accagccuccaugcugccucc

SEQ ID NO: 2188511 - RNA, 20 nt, Human
ucaccucuaaaacaguccuu

SEQ ID NO: 2188512 - RNA, 19 nt, Human
accaggcuugccugcaggc

SEQ ID NO: 2188513 - RNA, 15 nt, Human
ucaccucucccuugg

SEQ ID NO: 2188514 - RNA, 15 nt, Human
ucaccucugccucaa

SEQ ID NO: 2188515 - RNA, 14 nt, Human
ucaccucugccuca

SEQ ID NO: 2188516 - RNA, 13 nt, Human
ucaccucugccuc

SEQ ID NO: 2188517 - RNA, 12 nt, Human
ucaccucugccu

SEQ ID NO: 2188518 - RNA, 23 nt, Human
accaggcuggcgcagccaaggcc

SEQ ID NO: 2188519 - RNA, 19 nt, Human
ucaccucuggacuggcuag

SEQ ID NO: 2188520 - RNA, 18 nt, Human
ucaccucuggacuggcua

SEQ ID NO: 2188521 - RNA, 16 nt, Human
ucaccugaagacucau

SEQ ID NO: 2188522 - RNA, 17 nt, Human
ucaccucuuaaagaaaa

SEQ ID NO: 2188523 - RNA, 17 nt, Human
ucaccugaggucgggag

SEQ ID NO: 2188524 - RNA, 18 nt, Human
ucaccugauucaacuaaa

SEQ ID NO: 2188525 - RNA, 12 nt, Human
ucaccugauuca

SEQ ID NO: 2188526 - RNA, 19 nt, Human
ucaccugagucacccuacc

SEQ ID NO: 2188527 - RNA, 13 nt, Human
ucaccugccccuc

SEQ ID NO: 2188528 - RNA, 15 nt, Human
ucaccugccccucaa

SEQ ID NO: 2188529 - RNA, 16 nt, Human
ucaccugccccaacuc

SEQ ID NO: 2188530 - RNA, 21 nt, Human
ucaccugauucaacuaaaaaa

SEQ ID NO: 2188531 - RNA, 19 nt, Human
ucaccugauucaacuaaaa

SEQ ID NO: 2188532 - RNA, 14 nt, Human
accacuggccacca

SEQ ID NO: 2188533 - RNA, 12 nt, Human
accacuggccac

SEQ ID NO: 2188534 - RNA, 23 nt, Human
accacugcucugaugaagaggag

SEQ ID NO: 2188535 - RNA, 17 nt, Human
accacugcucugaugaa

SEQ ID NO: 2188536 - RNA, 15 nt, Human
accacugcucugaug

SEQ ID NO: 2188537 - RNA, 18 nt, Human
accacugcacuccagccu

SEQ ID NO: 2188538 - RNA, 21 nt, Human
accacugcacuccagccuggg

SEQ ID NO: 2188539 - RNA, 20 nt, Human
accacugcacuccagccugg

SEQ ID NO: 2188540 - RNA, 17 nt, Human
accacugcacuccagcc

SEQ ID NO: 2188541 - RNA, 17 nt, Human
ucaccccggccaccugc

SEQ ID NO: 2188542 - RNA, 18 nt, Human
ucaccccggccaccugcg

SEQ ID NO: 2188543 - RNA, 20 nt, Human
accacuguaaaaugaaauua

SEQ ID NO: 2188544 - RNA, 13 nt, Human
accacugucuucu

SEQ ID NO: 2188545 - RNA, 19 nt, Human
accacuguaaaaugaaauu

SEQ ID NO: 2188546 - RNA, 21 nt, Human
accacuggccaccaggcuggc

SEQ ID NO: 2188547 - RNA, 16 nt, Human
accacuguguauuuaa

SEQ ID NO: 2188548 - RNA, 16 nt, Human
accacuggucuguagg

SEQ ID NO: 2188549 - RNA, 19 nt, Human
accacuggccaccaggcug

SEQ ID NO: 2188550 - RNA, 20 nt, Human
accacuggccaccaggcugg

SEQ ID NO: 2188551 - RNA, 15 nt, Human
accacuggccaccag

SEQ ID NO: 2188552 - RNA, 16 nt, Human
accacuggccaccagg

SEQ ID NO: 2188553 - RNA, 17 nt, Human
accacuggccaccaggc

SEQ ID NO: 2188554 - RNA, 18 nt, Human
accacuggccaccaggcu

SEQ ID NO: 2188555 - RNA, 17 nt, Human
accacuucuuuuauaac

SEQ ID NO: 2188556 - RNA, 16 nt, Human
accacuucuuuuauaa

SEQ ID NO: 2188557 - RNA, 15 nt, Human
accacuucuuuuaua

SEQ ID NO: 2188558 - RNA, 13 nt, Human
accacuucgaaac

SEQ ID NO: 2188559 - RNA, 13 nt, Human
accacuucauucu

SEQ ID NO: 2188560 - RNA, 17 nt, Human
accacuucauucuugaa

SEQ ID NO: 2188561 - RNA, 15 nt, Human
accacugucuucuuc

SEQ ID NO: 2188562 - RNA, 21 nt, Human
accacuuuuguucuugguuug

SEQ ID NO: 2188563 - RNA, 16 nt, Human
accacuuuuguucuug

SEQ ID NO: 2188564 - RNA, 15 nt, Human
accacuuuuguucuu

SEQ ID NO: 2188565 - RNA, 18 nt, Human
accacuuguguuuugcaa

SEQ ID NO: 2188566 - RNA, 14 nt, Human
accagaagccaaag

SEQ ID NO: 2188567 - RNA, 15 nt, Human
accagaagcaacaga

SEQ ID NO: 2188568 - RNA, 15 nt, Human
accagacacccagga

SEQ ID NO: 2188569 - RNA, 14 nt, Human
accagacacccagg

SEQ ID NO: 2188570 - RNA, 13 nt, Human
accagaagcccag

SEQ ID NO: 2188571 - RNA, 16 nt, Human
accagaagcccagaau

SEQ ID NO: 2188572 - RNA, 14 nt, Human
accagaagcccaga

SEQ ID NO: 2188573 - RNA, 13 nt, Human
accagaacaaggu

SEQ ID NO: 2188574 - RNA, 22 nt, Human
accacuuuuguucuugguuugu

SEQ ID NO: 2188575 - RNA, 12 nt, Human
accagagcccac

SEQ ID NO: 2188576 - RNA, 14 nt, Human
accagagcccaccu

SEQ ID NO: 2188577 - RNA, 16 nt, Human
accagagcccaccuug

SEQ ID NO: 2188578 - RNA, 20 nt, Human
accagacgguucaccagccu

SEQ ID NO: 2188579 - RNA, 19 nt, Human
accagacgguucaccagcc

SEQ ID NO: 2188580 - RNA, 17 nt, Human
accagacacccaggacu

SEQ ID NO: 2188581 - RNA, 16 nt, Human
accagacacccaggac

SEQ ID NO: 2188582 - RNA, 14 nt, Human
accagacaccuuga

SEQ ID NO: 2188583 - RNA, 11 nt, Human
accagacaggu

SEQ ID NO: 2188584 - RNA, 16 nt, Human
accaauugguuaaucu

SEQ ID NO: 2188585 - RNA, 16 nt, Human
accaauucaacccuuu

SEQ ID NO: 2188586 - RNA, 14 nt, Human
accaauugccaaag

SEQ ID NO: 2188587 - RNA, 13 nt, Human
accaaucauuuua

SEQ ID NO: 2188588 - RNA, 14 nt, Human
accacaaaaaugaa

SEQ ID NO: 2188589 - RNA, 15 nt, Human
accacacccagccuc

SEQ ID NO: 2188590 - RNA, 16 nt, Human
accacacccagccuca

SEQ ID NO: 2188591 - RNA, 17 nt, Human
accacacccagccucag

SEQ ID NO: 2188592 - RNA, 22 nt, Human
accacacccagccucaguccuc

SEQ ID NO: 2188593 - RNA, 17 nt, Human
accaauugauuuuaaac

SEQ ID NO: 2188594 - RNA, 14 nt, Human
accacaaaaauuga

SEQ ID NO: 2188595 - RNA, 16 nt, Human
accacacuggacuccg

SEQ ID NO: 2188596 - RNA, 15 nt, Human
ucaauuccucuggga

SEQ ID NO: 2188597 - RNA, 13 nt, Human
accacacuggacu

SEQ ID NO: 2188598 - RNA, 22 nt, Human
accacaccucccugaaccaucc

SEQ ID NO: 2188599 - RNA, 17 nt, Human
ucaauuccugggcccca

SEQ ID NO: 2188600 - RNA, 12 nt, Human
ucaauucucaaa

SEQ ID NO: 2188601 - RNA, 13 nt, Human
ucaauuccugggc

SEQ ID NO: 2188602 - RNA, 16 nt, Human
ucaauuccucugggaa

SEQ ID NO: 2188603 - RNA, 15 nt, Human
accacaccucccuga

SEQ ID NO: 2188604 - RNA, 16 nt, Human
accacaccgcagaagc

SEQ ID NO: 2188605 - RNA, 17 nt, Human
accacacccuguacugu

SEQ ID NO: 2188606 - RNA, 24 nt, Human
accacacccagccucaguccuccc

SEQ ID NO: 2188607 - RNA, 13 nt, Human
accacacccugua

SEQ ID NO: 2188608 - RNA, 14 nt, Human
accacacuccagcu

SEQ ID NO: 2188609 - RNA, 22 nt, Human
accacacguaaugaaacuugga

SEQ ID NO: 2188610 - RNA, 16 nt, Human
accacaccucccugaa

SEQ ID NO: 2188611 - RNA, 20 nt, Human
ucaauuuuugguugaauaaa

SEQ ID NO: 2188612 - RNA, 11 nt, Human
ucacaaauaaa

SEQ ID NO: 2188613 - RNA, 23 nt, Human
ucaauuuuucuuauuucauuucu

SEQ ID NO: 2188614 - RNA, 20 nt, Human
ucaauuuuucuuauuucauu

SEQ ID NO: 2188615 - RNA, 15 nt, Human
ucaauucuugccaaa

SEQ ID NO: 2188616 - RNA, 19 nt, Human
ucaauucuucccuaucuuu

SEQ ID NO: 2188617 - RNA, 17 nt, Human
ucaauucuucccuaucu

SEQ ID NO: 2188618 - RNA, 23 nt, Human
ucaauucuucccuaucuuugcca

SEQ ID NO: 2188619 - RNA, 16 nt, Human
ucaauuuuaucccuca

SEQ ID NO: 2188620 - RNA, 21 nt, Human
ucaauuuuaucccucaccugu

SEQ ID NO: 2188621 - RNA, 22 nt, Human
ucaauuuuaucccucaccugua

SEQ ID NO: 2188622 - RNA, 18 nt, Human
accaauauuguacaguuu

SEQ ID NO: 2188623 - RNA, 18 nt, Human
accaacaucccauugccc

SEQ ID NO: 2188624 - RNA, 19 nt, Human
accaauauuguacaguuuu

SEQ ID NO: 2188625 - RNA, 15 nt, Human
accaauauuguacag

SEQ ID NO: 2188626 - RNA, 14 nt, Human
accaauauuguaca

SEQ ID NO: 2188627 - RNA, 16 nt, Human
accaauauuguacagu

SEQ ID NO: 2188628 - RNA, 17 nt, Human
accaauauuguacaguu

SEQ ID NO: 2188629 - RNA, 16 nt, Human
accaauauuuguagaa

SEQ ID NO: 2188630 - RNA, 13 nt, Human
accaauauuugua

SEQ ID NO: 2188631 - RNA, 11 nt, Human
accaauauuug

SEQ ID NO: 2188632 - RNA, 13 nt, Human
accaaucaugaau

SEQ ID NO: 2188633 - RNA, 15 nt, Human
accaauguucucucu

SEQ ID NO: 2188634 - RNA, 15 nt, Human
accaaucaugaauua

SEQ ID NO: 2188635 - RNA, 23 nt, Human
ucaagugaaaaaggaggaagaga

SEQ ID NO: 2188636 - RNA, 19 nt, Human
ucaagugaaucuaaaagcu

SEQ ID NO: 2188637 - RNA, 15 nt, Human
ucaagugaaucuaaa

SEQ ID NO: 2188638 - RNA, 15 nt, Human
ucaagucacucccaa

SEQ ID NO: 2188639 - RNA, 17 nt, Human
ucaagugauucucaugc

SEQ ID NO: 2188640 - RNA, 15 nt, Human
ucaagucaccuccuu

SEQ ID NO: 2188641 - RNA, 15 nt, Human
ucaagucaaauuaau

SEQ ID NO: 2188642 - RNA, 15 nt, Human
ucaagugaaaaagga

SEQ ID NO: 2188643 - RNA, 17 nt, Human
accaacauacucccauc

SEQ ID NO: 2188644 - RNA, 20 nt, Human
ucaagugauucucaugccuc

SEQ ID NO: 2188645 - RNA, 19 nt, Human
accaacauacucccaucug

SEQ ID NO: 2188646 - RNA, 21 nt, Human
accaacauacucccaucugug

SEQ ID NO: 2188647 - RNA, 22 nt, Human
accaacauacucccaucuguga

SEQ ID NO: 2188648 - RNA, 12 nt, Human
ucaccccacccu

SEQ ID NO: 2188649 - RNA, 12 nt, Human
ucacccaugugc

SEQ ID NO: 2188650 - RNA, 22 nt, Human
ucaccccacuuaucccucucca

SEQ ID NO: 2188651 - RNA, 13 nt, Human
ucaccccagcccc

SEQ ID NO: 2188652 - RNA, 14 nt, Human
ucaccccagcccca

SEQ ID NO: 2188653 - RNA, 20 nt, Human
ucaccccagccccaaaacuc

SEQ ID NO: 2188654 - RNA, 13 nt, Human
ucaccccacccuu

SEQ ID NO: 2188655 - RNA, 12 nt, Human
ucaccccagggc

SEQ ID NO: 2188656 - RNA, 15 nt, Human
ucaccccagggccug

SEQ ID NO: 2188657 - RNA, 13 nt, Human
ucaccccagggcc

SEQ ID NO: 2188658 - RNA, 21 nt, Human
ucaccccagggccugagccug

SEQ ID NO: 2188659 - RNA, 20 nt, Human
ucaccccagggccugagccu

SEQ ID NO: 2188660 - RNA, 19 nt, Human
ucaccccagggccugagcc

SEQ ID NO: 2188661 - RNA, 16 nt, Human
ucaccccagggccuga

SEQ ID NO: 2188662 - RNA, 13 nt, Human
ucaccccauccca

SEQ ID NO: 2188663 - RNA, 12 nt, Human
ucaccccauccc

SEQ ID NO: 2188664 - RNA, 22 nt, Human
ucaccccaccccaccccaccuc

SEQ ID NO: 2188665 - RNA, 21 nt, Human
ucaccccaguggccacucagc

SEQ ID NO: 2188666 - RNA, 15 nt, Human
ucaccccggccaccu

SEQ ID NO: 2188667 - RNA, 16 nt, Human
ucaccaucucaggcca

SEQ ID NO: 2188668 - RNA, 15 nt, Human
ucaccaucucaggcc

SEQ ID NO: 2188669 - RNA, 16 nt, Human
ucacccagccccaggg

SEQ ID NO: 2188670 - RNA, 17 nt, Human
ucacccagcuaaucugu

SEQ ID NO: 2188671 - RNA, 21 nt, Human
ucacccagcuaaucuguaggg

SEQ ID NO: 2188672 - RNA, 17 nt, Human
ucacccaugaagacagg

SEQ ID NO: 2188673 - RNA, 17 nt, Human
ucaccaguguccccucc

SEQ ID NO: 2188674 - RNA, 20 nt, Human
ucaccaguguccccuccacu

SEQ ID NO: 2188675 - RNA, 14 nt, Human
ucaccaucucaggc

SEQ ID NO: 2188676 - RNA, 21 nt, Human
ucaccaguguccccuccacug

SEQ ID NO: 2188677 - RNA, 19 nt, Human
ucaccagugcgauucugga

SEQ ID NO: 2188678 - RNA, 13 nt, Human
ucaccaguguccc

SEQ ID NO: 2188679 - RNA, 22 nt, Human
ucaccaggggcaggcacagcac

SEQ ID NO: 2188680 - RNA, 22 nt, Human
ucaccaggaauguuaaagucag

SEQ ID NO: 2188681 - RNA, 20 nt, Human
ucaccagcugccucuucugu

SEQ ID NO: 2188682 - RNA, 15 nt, Human
ucaccagcugccucu

SEQ ID NO: 2188683 - RNA, 17 nt, Human
ucaccagcugccucuuc

SEQ ID NO: 2188684 - RNA, 20 nt, Human
ucacaugaccacauagcaug

SEQ ID NO: 2188685 - RNA, 18 nt, Human
ucacaugaccacauagca

SEQ ID NO: 2188686 - RNA, 23 nt, Human
ucacaugagcuauuuccauucca

SEQ ID NO: 2188687 - RNA, 18 nt, Human
ucaccaggggcaggcaca

SEQ ID NO: 2188688 - RNA, 19 nt, Human
ucaccaggggcaggcacag

SEQ ID NO: 2188689 - RNA, 21 nt, Human
ucaccaggggcaggcacagca

SEQ ID NO: 2188690 - RNA, 15 nt, Human
ucaccaggggcaggc

SEQ ID NO: 2188691 - RNA, 17 nt, Human
ucacaucuuucacacuu

SEQ ID NO: 2188692 - RNA, 14 nt, Human
ucacaucuuucaca

SEQ ID NO: 2188693 - RNA, 15 nt, Human
ucacaucuuggcaca

SEQ ID NO: 2188694 - RNA, 22 nt, Human
ucacaucuuucacacuuccacc

SEQ ID NO: 2188695 - RNA, 20 nt, Human
ucacaucuuucacacuucca

SEQ ID NO: 2188696 - RNA, 21 nt, Human
ucacaugaacauacuggcugg

SEQ ID NO: 2188697 - RNA, 13 nt, Human
ucacaugaccaca

SEQ ID NO: 2188698 - RNA, 14 nt, Human
ucacaugaccacau

SEQ ID NO: 2188699 - RNA, 14 nt, Human
ucacaguguuucga

SEQ ID NO: 2188700 - RNA, 13 nt, Human
ucacacucugggu

SEQ ID NO: 2188701 - RNA, 11 nt, Human
ucacaguguuu

SEQ ID NO: 2188702 - RNA, 14 nt, Human
ucacaguguuugca

SEQ ID NO: 2188703 - RNA, 18 nt, Human
ucacaguguuugcaaugg

SEQ ID NO: 2188704 - RNA, 22 nt, Human
ucacaguguuugcaaugguguu

SEQ ID NO: 2188705 - RNA, 23 nt, Human
ucacaguguuugcaaugguguug

SEQ ID NO: 2188706 - RNA, 17 nt, Human
ucacaguguugcccagg

SEQ ID NO: 2188707 - RNA, 23 nt, Human
ucacacugagaauguaagaacua

SEQ ID NO: 2188708 - RNA, 20 nt, Human
ucacacugagaauguaagaa

SEQ ID NO: 2188709 - RNA, 21 nt, Human
ucacacugagaauguaagaac

SEQ ID NO: 2188710 - RNA, 11 nt, Human
ucacacugaga

SEQ ID NO: 2188711 - RNA, 16 nt, Human
ucacacucucacaugu

SEQ ID NO: 2188712 - RNA, 17 nt, Human
ucacacucucacauguu

SEQ ID NO: 2188713 - RNA, 12 nt, Human
ucacacugagaa

SEQ ID NO: 2188714 - RNA, 19 nt, Human
ucacacugagaauguaaga

SEQ ID NO: 2188715 - RNA, 17 nt, Human
ucacacgggggcagcug

SEQ ID NO: 2188716 - RNA, 18 nt, Human
ucacacgggggcagcuga

SEQ ID NO: 2188717 - RNA, 17 nt, Human
ucacacgggguauuuua

SEQ ID NO: 2188718 - RNA, 22 nt, Human
ucacacgucuggcuucacagau

SEQ ID NO: 2188719 - RNA, 19 nt, Human
ucacaccuguaaucccaac

SEQ ID NO: 2188720 - RNA, 19 nt, Human
ucacacgaggggccccgug

SEQ ID NO: 2188721 - RNA, 12 nt, Human
ucacaacagauc

SEQ ID NO: 2188722 - RNA, 21 nt, Human
ucacaacagauuauuaccuua

SEQ ID NO: 2188723 - RNA, 16 nt, Human
ucacaacaaccugguc

SEQ ID NO: 2188724 - RNA, 20 nt, Human
ucacaaauccuaaaagaagc

SEQ ID NO: 2188725 - RNA, 12 nt, Human
ucacauaucugu

SEQ ID NO: 2188726 - RNA, 15 nt, Human
ucacauaucugucau

SEQ ID NO: 2188727 - RNA, 17 nt, Human
ucacauccuguguuucu

SEQ ID NO: 2188728 - RNA, 18 nt, Human
ucacauccuggccuggca

SEQ ID NO: 2188729 - RNA, 19 nt, Human
ucacauccuggccuggcac

SEQ ID NO: 2188730 - RNA, 10 nt, Human
ucacauccug

SEQ ID NO: 2188731 - RNA, 11 nt, Human
ucacauccugg

SEQ ID NO: 2188732 - RNA, 15 nt, Human
ucacauccuggccug

SEQ ID NO: 2188733 - RNA, 19 nt, Human
ucacauccuguguuucuag

SEQ ID NO: 2188734 - RNA, 18 nt, Human
ucacauccuguguuucua

SEQ ID NO: 2188735 - RNA, 23 nt, Human
ucacauccuggccuggcacauca

SEQ ID NO: 2188736 - RNA, 22 nt, Human
ucacaguuccucgcccuggguc

SEQ ID NO: 2188737 - RNA, 21 nt, Human
ucacaguuccucgcccugggu

SEQ ID NO: 2188738 - RNA, 20 nt, Human
ucacaguuccucgcccuggg

SEQ ID NO: 2188739 - RNA, 19 nt, Human
ucacaguuccucgcccugg

SEQ ID NO: 2188740 - RNA, 18 nt, Human
ucacaguuccucgcccug

SEQ ID NO: 2188741 - RNA, 17 nt, Human
ucacaguuccucgcccu

SEQ ID NO: 2188742 - RNA, 16 nt, Human
ucacaguuccucgccc

SEQ ID NO: 2188743 - RNA, 14 nt, Human
ucacaguuccucgc

SEQ ID NO: 2188744 - RNA, 13 nt, Human
ucacaguuccucg

SEQ ID NO: 2188745 - RNA, 22 nt, Human
ucacaguuacccuaaacucucu

SEQ ID NO: 2188746 - RNA, 15 nt, Human
ucacaguucucuccu

SEQ ID NO: 2188747 - RNA, 21 nt, Human
acaauggcuaauucccagagu

SEQ ID NO: 2188748 - RNA, 17 nt, Human
acaauggggauguugug

SEQ ID NO: 2188749 - RNA, 18 nt, Human
acaaugcuguauuuuaaa

SEQ ID NO: 2188750 - RNA, 15 nt, Human
acaaugguuuucuug

SEQ ID NO: 2188751 - RNA, 14 nt, Human
acaaugcuguauuu

SEQ ID NO: 2188752 - RNA, 17 nt, Human
acaaugcuguauuuuaa

SEQ ID NO: 2188753 - RNA, 19 nt, Human
uagcuuagaccucagccug

SEQ ID NO: 2188754 - RNA, 18 nt, Human
uagcuuagaccucagccu

SEQ ID NO: 2188755 - RNA, 17 nt, Human
uagcuuagaccucagcc

SEQ ID NO: 2188756 - RNA, 16 nt, Human
uagcuuagaccucagc

SEQ ID NO: 2188757 - RNA, 23 nt, Human
uagcuuagaccucagccugugcu

SEQ ID NO: 2188758 - RNA, 20 nt, Human
uagcuuagaccucagccugu

SEQ ID NO: 2188759 - RNA, 13 nt, Human
uagcuuagagccu

SEQ ID NO: 2188760 - RNA, 17 nt, Human
uagcuuagagccucccu

SEQ ID NO: 2188761 - RNA, 19 nt, Human
uagcuuagagccucccuca

SEQ ID NO: 2188762 - RNA, 17 nt, Human
acaaugcugauuuggug

SEQ ID NO: 2188763 - RNA, 21 nt, Human
acaaugguuuucuuguguguu

SEQ ID NO: 2188764 - RNA, 14 nt, Human
acacaacuauauug

SEQ ID NO: 2188765 - RNA, 17 nt, Human
acacaacuauauuguuu

SEQ ID NO: 2188766 - RNA, 18 nt, Human
acacaacuauuuuuccaa

SEQ ID NO: 2188767 - RNA, 19 nt, Human
acaauguauuuauuuaaaa

SEQ ID NO: 2188768 - RNA, 14 nt, Human
acaauguauuuauu

SEQ ID NO: 2188769 - RNA, 17 nt, Human
acaauguauuuauuuaa

SEQ ID NO: 2188770 - RNA, 22 nt, Human
acacaagaagaagggcacccua

SEQ ID NO: 2188771 - RNA, 16 nt, Human
acacacacagaaaaua

SEQ ID NO: 2188772 - RNA, 16 nt, Human
acacacacacgcacgc

SEQ ID NO: 2188773 - RNA, 15 nt, Human
acacacacagaaaau

SEQ ID NO: 2188774 - RNA, 14 nt, Human
acacacacagaaaa

SEQ ID NO: 2188775 - RNA, 13 nt, Human
acacacacagaaa

SEQ ID NO: 2188776 - RNA, 12 nt, Human
acacacacagaa

SEQ ID NO: 2188777 - RNA, 17 nt, Human
acacacacacaugcaua

SEQ ID NO: 2188778 - RNA, 13 nt, Human
acacacacacgca

SEQ ID NO: 2188779 - RNA, 14 nt, Human
acacacacacgcac

SEQ ID NO: 2188780 - RNA, 15 nt, Human
acacacaugcauaca

SEQ ID NO: 2188781 - RNA, 14 nt, Human
acacacaugcauac

SEQ ID NO: 2188782 - RNA, 19 nt, Human
acacacaugcauacacaca

SEQ ID NO: 2188783 - RNA, 18 nt, Human
acacacaugcauacacac

SEQ ID NO: 2188784 - RNA, 17 nt, Human
acacacaugcauacaca

SEQ ID NO: 2188785 - RNA, 16 nt, Human
acacacaugcauacac

SEQ ID NO: 2188786 - RNA, 22 nt, Human
acacaccaggcugugggccuca

SEQ ID NO: 2188787 - RNA, 16 nt, Human
acacaccaggcugugg

SEQ ID NO: 2188788 - RNA, 12 nt, Human
acacaccaggcu

SEQ ID NO: 2188789 - RNA, 15 nt, Human
acacaccacacauac

SEQ ID NO: 2188790 - RNA, 21 nt, Human
acacacaugcauacacacaca

SEQ ID NO: 2188791 - RNA, 20 nt, Human
acacacaugcauacacacac

SEQ ID NO: 2188792 - RNA, 23 nt, Human
acacacgcacacacacacacagg

SEQ ID NO: 2188793 - RNA, 13 nt, Human
acacacgcacgca

SEQ ID NO: 2188794 - RNA, 24 nt, Human
acacaccuguagucccagcuacuc

SEQ ID NO: 2188795 - RNA, 14 nt, Human
acacacgcacgcac

SEQ ID NO: 2188796 - RNA, 15 nt, Human
acacacgcacgcaca

SEQ ID NO: 2188797 - RNA, 16 nt, Human
acacacgcacgcacac

SEQ ID NO: 2188798 - RNA, 17 nt, Human
acacacgcacgcacaca

SEQ ID NO: 2188799 - RNA, 18 nt, Human
acacaccaggcugugggc

SEQ ID NO: 2188800 - RNA, 17 nt, Human
acacaccuaagggacau

SEQ ID NO: 2188801 - RNA, 21 nt, Human
acacaccuaagggacauguuu

SEQ ID NO: 2188802 - RNA, 22 nt, Human
acacaccuaagggacauguuuu

SEQ ID NO: 2188803 - RNA, 11 nt, Human
acacaccugua

SEQ ID NO: 2188804 - RNA, 20 nt, Human
acacaccuguagcacuuacu

SEQ ID NO: 2188805 - RNA, 13 nt, Human
acacacugaagaa

SEQ ID NO: 2188806 - RNA, 20 nt, Human
acacacucaaaucaagaaac

SEQ ID NO: 2188807 - RNA, 13 nt, Human
acacacaggagga

SEQ ID NO: 2188808 - RNA, 12 nt, Human
acacacagcucc

SEQ ID NO: 2188809 - RNA, 20 nt, Human
acacacagcuaacacacagc

SEQ ID NO: 2188810 - RNA, 19 nt, Human
acacacagcucuguccugg

SEQ ID NO: 2188811 - RNA, 17 nt, Human
acacacaggcaacugag

SEQ ID NO: 2188812 - RNA, 21 nt, Human
acacacauauaaacaucacac

SEQ ID NO: 2188813 - RNA, 11 nt, Human
acacacagcuc

SEQ ID NO: 2188814 - RNA, 12 nt, Human
acacacagcucu

SEQ ID NO: 2188815 - RNA, 14 nt, Human
acacacacaggagg

SEQ ID NO: 2188816 - RNA, 13 nt, Human
acacacagccaca

SEQ ID NO: 2188817 - RNA, 15 nt, Human
acacacagccacaca

SEQ ID NO: 2188818 - RNA, 14 nt, Human
acacacagccacac

SEQ ID NO: 2188819 - RNA, 22 nt, Human
acacacagccacacacacagaa

SEQ ID NO: 2188820 - RNA, 21 nt, Human
acacacagccacacacacaga

SEQ ID NO: 2188821 - RNA, 18 nt, Human
acacacagccacacacac

SEQ ID NO: 2188822 - RNA, 17 nt, Human
acacacagccacacaca

SEQ ID NO: 2188823 - RNA, 11 nt, Human
acacacacagg

SEQ ID NO: 2188824 - RNA, 16 nt, Human
acacacacagccacac

SEQ ID NO: 2188825 - RNA, 15 nt, Human
acacacacagccaca

SEQ ID NO: 2188826 - RNA, 14 nt, Human
acacacacagccac

SEQ ID NO: 2188827 - RNA, 13 nt, Human
acacacacagcca

SEQ ID NO: 2188828 - RNA, 12 nt, Human
acacacacagcc

SEQ ID NO: 2188829 - RNA, 13 nt, Human
uaguaaggcugug

SEQ ID NO: 2188830 - RNA, 14 nt, Human
uaguaaggcugugu

SEQ ID NO: 2188831 - RNA, 14 nt, Human
uaguaagugccuuc

SEQ ID NO: 2188832 - RNA, 14 nt, Human
uaguaauagagcaa

SEQ ID NO: 2188833 - RNA, 16 nt, Human
uaguaagaaaacauca

SEQ ID NO: 2188834 - RNA, 15 nt, Human
uagguuuaacucaga

SEQ ID NO: 2188835 - RNA, 17 nt, Human
uagguuuaacucagauc

SEQ ID NO: 2188836 - RNA, 19 nt, Human
uagguuuaacucagaucac

SEQ ID NO: 2188837 - RNA, 21 nt, Human
uagguuuaacucagaucacua

SEQ ID NO: 2188838 - RNA, 20 nt, Human
uagguugccaauaauacacu

SEQ ID NO: 2188839 - RNA, 15 nt, Human
acacagucugcaaga

SEQ ID NO: 2188840 - RNA, 16 nt, Human
acacagucugcaagau

SEQ ID NO: 2188841 - RNA, 24 nt, Human
uagguuggaagcuagcuccccucc

SEQ ID NO: 2188842 - RNA, 15 nt, Human
uagguuggacuggaa

SEQ ID NO: 2188843 - RNA, 21 nt, Human
uagguuggcaaaaaggcagga

SEQ ID NO: 2188844 - RNA, 17 nt, Human
acacagugaccauacua

SEQ ID NO: 2188845 - RNA, 19 nt, Human
acacagucuuggcucacug

SEQ ID NO: 2188846 - RNA, 23 nt, Human
acacagucucacccagacuccag

SEQ ID NO: 2188847 - RNA, 14 nt, Human
acacaggaggagaa

SEQ ID NO: 2188848 - RNA, 11 nt, Human
acacagugagu

SEQ ID NO: 2188849 - RNA, 20 nt, Human
acacaggcaacugaggcaga

SEQ ID NO: 2188850 - RNA, 19 nt, Human
acacaggcaacugaggcag

SEQ ID NO: 2188851 - RNA, 16 nt, Human
acacaggcaacugagg

SEQ ID NO: 2188852 - RNA, 15 nt, Human
acacaggcaacugag

SEQ ID NO: 2188853 - RNA, 24 nt, Human
acacaggauccuauucucaccagg

SEQ ID NO: 2188854 - RNA, 17 nt, Human
acacaggacccccuucc

SEQ ID NO: 2188855 - RNA, 18 nt, Human
acacaggacccccuuccc

SEQ ID NO: 2188856 - RNA, 20 nt, Human
acacaggacccccuuccccu

SEQ ID NO: 2188857 - RNA, 19 nt, Human
acacagcugcagagacaga

SEQ ID NO: 2188858 - RNA, 22 nt, Human
acacagcugagagacuuuuaau

SEQ ID NO: 2188859 - RNA, 18 nt, Human
acacacugaggcagggaa

SEQ ID NO: 2188860 - RNA, 12 nt, Human
acacagcugggc

SEQ ID NO: 2188861 - RNA, 16 nt, Human
acacagcugggcugug

SEQ ID NO: 2188862 - RNA, 15 nt, Human
acacagcugggcugu

SEQ ID NO: 2188863 - RNA, 20 nt, Human
acacagcuuuaucaccagag

SEQ ID NO: 2188864 - RNA, 21 nt, Human
acacagcuuuaucaccagaga

SEQ ID NO: 2188865 - RNA, 22 nt, Human
acacagcuuuaucaccagagag

SEQ ID NO: 2188866 - RNA, 16 nt, Human
acacacugaggcaggg

SEQ ID NO: 2188867 - RNA, 15 nt, Human
acacacugaggcagg

SEQ ID NO: 2188868 - RNA, 18 nt, Human
acacacgcacgcacacac

SEQ ID NO: 2188869 - RNA, 14 nt, Human
acacacgcaggaac

SEQ ID NO: 2188870 - RNA, 16 nt, Human
acacacgcaggaacuc

SEQ ID NO: 2188871 - RNA, 20 nt, Human
acacacgcaggaacucccag

SEQ ID NO: 2188872 - RNA, 14 nt, Human
acacacugaagaag

SEQ ID NO: 2188873 - RNA, 19 nt, Human
uagucuucucauagcauua

SEQ ID NO: 2188874 - RNA, 14 nt, Human
uagucuuuugcuuu

SEQ ID NO: 2188875 - RNA, 18 nt, Human
uagucuucucauagcauu

SEQ ID NO: 2188876 - RNA, 14 nt, Human
uagucuucucauag

SEQ ID NO: 2188877 - RNA, 12 nt, Human
uagucuucucau

SEQ ID NO: 2188878 - RNA, 17 nt, Human
uagucuucaagcagauu

SEQ ID NO: 2188879 - RNA, 15 nt, Human
uagucuucaagcaga

SEQ ID NO: 2188880 - RNA, 12 nt, Human
uagucucaggac

SEQ ID NO: 2188881 - RNA, 19 nt, Human
uagucuagauggcuccucu

SEQ ID NO: 2188882 - RNA, 17 nt, Human
uagucuuaagaacugcu

SEQ ID NO: 2188883 - RNA, 12 nt, Human
uaguguuggaga

SEQ ID NO: 2188884 - RNA, 15 nt, Human
uagucuuuugcuuuu

SEQ ID NO: 2188885 - RNA, 16 nt, Human
uagucuuuugcuuuug

SEQ ID NO: 2188886 - RNA, 21 nt, Human
uagucuuuugcuuuuggcaaa

SEQ ID NO: 2188887 - RNA, 13 nt, Human
uaguguucauaaa

SEQ ID NO: 2188888 - RNA, 16 nt, Human
uaguguuggagaagaa

SEQ ID NO: 2188889 - RNA, 17 nt, Human
uaguguuggagaagaac

SEQ ID NO: 2188890 - RNA, 21 nt, Human
uagucguggagaugucuucgu

SEQ ID NO: 2188891 - RNA, 23 nt, Human
uagucuaaggaugcuaaaccuua

SEQ ID NO: 2188892 - RNA, 21 nt, Human
uagucgugagcucuugugagg

SEQ ID NO: 2188893 - RNA, 19 nt, Human
uagucguggagaugucuuc

SEQ ID NO: 2188894 - RNA, 20 nt, Human
uagucguggagaugucuucg

SEQ ID NO: 2188895 - RNA, 14 nt, Human
uagucuauuagcca

SEQ ID NO: 2188896 - RNA, 20 nt, Human
uagucuagauggcuccucuc

SEQ ID NO: 2188897 - RNA, 18 nt, Human
uagucuagauggcuccuc

SEQ ID NO: 2188898 - RNA, 22 nt, Human
uagucuacucuuaagccaucuu

SEQ ID NO: 2188899 - RNA, 20 nt, Human
uagucuacucuuaagccauc

SEQ ID NO: 2188900 - RNA, 21 nt, Human
uagucuacucuuaagccaucu

SEQ ID NO: 2188901 - RNA, 11 nt, Human
uaguccuguga

SEQ ID NO: 2188902 - RNA, 22 nt, Human
uaguccuauucuauugcaguua

SEQ ID NO: 2188903 - RNA, 12 nt, Human
uagucgugagcu

SEQ ID NO: 2188904 - RNA, 12 nt, Human
uaguccugugaa

SEQ ID NO: 2188905 - RNA, 22 nt, Human
uaguccugugaaugccacugcc

SEQ ID NO: 2188906 - RNA, 13 nt, Human
uaguagagacagg

SEQ ID NO: 2188907 - RNA, 22 nt, Human
uaguacuugaaaucuaggauua

SEQ ID NO: 2188908 - RNA, 20 nt, Human
uaguacuccugcaaaauuuu

SEQ ID NO: 2188909 - RNA, 19 nt, Human
uaguacuccugcaaaauuu

SEQ ID NO: 2188910 - RNA, 17 nt, Human
uaguacuccugcaaaau

SEQ ID NO: 2188911 - RNA, 20 nt, Human
uaguaauagagcaaaauuga

SEQ ID NO: 2188912 - RNA, 21 nt, Human
uaguacuccugcaaaauuuua

SEQ ID NO: 2188913 - RNA, 15 nt, Human
uaguacugcucuugu

SEQ ID NO: 2188914 - RNA, 13 nt, Human
uaguacugcucuu

SEQ ID NO: 2188915 - RNA, 22 nt, Human
uaguuuugauuuaauguuuuca

SEQ ID NO: 2188916 - RNA, 13 nt, Human
uaguuuugucaaa

SEQ ID NO: 2188917 - RNA, 21 nt, Human
uaguuuuuaaaauaucuuuug

SEQ ID NO: 2188918 - RNA, 10 nt, Human
uaguuuuugu

SEQ ID NO: 2188919 - RNA, 17 nt, Human
uaguuuuucuucaacau

SEQ ID NO: 2188920 - RNA, 13 nt, Human
uaguuuuuguucu

SEQ ID NO: 2188921 - RNA, 17 nt, Human
uaguuuuuguaauuuau

SEQ ID NO: 2188922 - RNA, 18 nt, Human
uaguuuuuaccuaccaca

SEQ ID NO: 2188923 - RNA, 15 nt, Human
uaguuuugucaaacu

SEQ ID NO: 2188924 - RNA, 22 nt, Human
uaguuuuuaaaauaucuuuuga

SEQ ID NO: 2188925 - RNA, 18 nt, Human
uaguucagguaacaggca

SEQ ID NO: 2188926 - RNA, 16 nt, Human
uaguuauaguuucaga

SEQ ID NO: 2188927 - RNA, 14 nt, Human
uauaaaagacugac

SEQ ID NO: 2188928 - RNA, 12 nt, Human
uauaaaacuucu

SEQ ID NO: 2188929 - RNA, 19 nt, Human
uauaaaacuguacuucacu

SEQ ID NO: 2188930 - RNA, 15 nt, Human
uauaaaacuuuccuc

SEQ ID NO: 2188931 - RNA, 14 nt, Human
uauaaaaucagcca

SEQ ID NO: 2188932 - RNA, 23 nt, Human
uauaaaauaugaagacauaaacc

SEQ ID NO: 2188933 - RNA, 21 nt, Human
uauaaaauaugaagacauaaa

SEQ ID NO: 2188934 - RNA, 16 nt, Human
uauaaaaucagccaau

SEQ ID NO: 2188935 - RNA, 17 nt, Human
uauaaaaucagccaauu

SEQ ID NO: 2188936 - RNA, 19 nt, Human
uauaaaaucagccaauuau

SEQ ID NO: 2188937 - RNA, 20 nt, Human
uauaaaaucagccaauuaug

SEQ ID NO: 2188938 - RNA, 17 nt, Human
uauaaaacaggucaaua

SEQ ID NO: 2188939 - RNA, 19 nt, Human
uauaaaacugcguuaaagg

SEQ ID NO: 2188940 - RNA, 22 nt, Human
uauaaaacugcguuaaaggcuc

SEQ ID NO: 2188941 - RNA, 16 nt, Human
uauaaaacuguacuuc

SEQ ID NO: 2188942 - RNA, 15 nt, Human
uaguuuuuguucuua

SEQ ID NO: 2188943 - RNA, 21 nt, Human
uaguuuuuguucuuaauugca

SEQ ID NO: 2188944 - RNA, 20 nt, Human
uauaaaaauaaaaaacacug

SEQ ID NO: 2188945 - RNA, 21 nt, Human
uauaaaaauaaaaaacacugg

SEQ ID NO: 2188946 - RNA, 19 nt, Human
acacaugcauacacacaca

SEQ ID NO: 2188947 - RNA, 18 nt, Human
acacaugcauacacacac

SEQ ID NO: 2188948 - RNA, 17 nt, Human
acacaugcauacacaca

SEQ ID NO: 2188949 - RNA, 16 nt, Human
acacaugcauacacac

SEQ ID NO: 2188950 - RNA, 15 nt, Human
acacaugcauacaca

SEQ ID NO: 2188951 - RNA, 15 nt, Human
uauaaaauuaagcaa

SEQ ID NO: 2188952 - RNA, 14 nt, Human
acacaugcauacac

SEQ ID NO: 2188953 - RNA, 13 nt, Human
acacaugcauaca

SEQ ID NO: 2188954 - RNA, 15 nt, Human
uauaaaauauuuuca

SEQ ID NO: 2188955 - RNA, 21 nt, Human
uauaaaaucagccaauuaugu

SEQ ID NO: 2188956 - RNA, 13 nt, Human
acacauguccaag

SEQ ID NO: 2188957 - RNA, 18 nt, Human
acacauguccaagaagcc

SEQ ID NO: 2188958 - RNA, 19 nt, Human
acacauguccaagaagccc

SEQ ID NO: 2188959 - RNA, 20 nt, Human
acacauuaucgggagcagug

SEQ ID NO: 2188960 - RNA, 23 nt, Human
acacauuaucgggagcagugucu

SEQ ID NO: 2188961 - RNA, 16 nt, Human
acacauucaauaagca

SEQ ID NO: 2188962 - RNA, 17 nt, Human
acacauucaauaagcau

SEQ ID NO: 2188963 - RNA, 18 nt, Human
acacauucggcucccugg

SEQ ID NO: 2188964 - RNA, 21 nt, Human
acacauguccaagaagcccag

SEQ ID NO: 2188965 - RNA, 22 nt, Human
acacauguccaagaagcccagg

SEQ ID NO: 2188966 - RNA, 12 nt, Human
acacccagccca

SEQ ID NO: 2188967 - RNA, 13 nt, Human
acacccagcccac

SEQ ID NO: 2188968 - RNA, 17 nt, Human
acacccaccguccgccc

SEQ ID NO: 2188969 - RNA, 15 nt, Human
acacccacucagcuc

SEQ ID NO: 2188970 - RNA, 21 nt, Human
acacccaccguccgcccugcu

SEQ ID NO: 2188971 - RNA, 22 nt, Human
acacccaccguccgcccugcuc

SEQ ID NO: 2188972 - RNA, 15 nt, Human
acacuagccucucca

SEQ ID NO: 2188973 - RNA, 13 nt, Human
acacuagccucuc

SEQ ID NO: 2188974 - RNA, 22 nt, Human
acacuagcuaauaucaauagaa

SEQ ID NO: 2188975 - RNA, 20 nt, Human
acacuagcccaaugaaauga

SEQ ID NO: 2188976 - RNA, 17 nt, Human
acacuagcccaaugaaa

SEQ ID NO: 2188977 - RNA, 22 nt, Human
uauaaccaguguuguggauuua

SEQ ID NO: 2188978 - RNA, 14 nt, Human
acacuacauuagaa

SEQ ID NO: 2188979 - RNA, 19 nt, Human
acacuagccagacacucug

SEQ ID NO: 2188980 - RNA, 21 nt, Human
acacuagccagacacucugcu

SEQ ID NO: 2188981 - RNA, 23 nt, Human
uauaaggaaagcaauaaaugaau

SEQ ID NO: 2188982 - RNA, 22 nt, Human
uauaaggaaagcaauaaaugaa

SEQ ID NO: 2188983 - RNA, 18 nt, Human
uauaacuaguccuuuacu

SEQ ID NO: 2188984 - RNA, 16 nt, Human
uauaaggaaagcaaua

SEQ ID NO: 2188985 - RNA, 19 nt, Human
uauaacuauguugauaaaa

SEQ ID NO: 2188986 - RNA, 14 nt, Human
uauaacuaguccuu

SEQ ID NO: 2188987 - RNA, 19 nt, Human
uauaacuacuccggagaca

SEQ ID NO: 2188988 - RNA, 15 nt, Human
uauaaccccagcucc

SEQ ID NO: 2188989 - RNA, 16 nt, Human
acacuaaccacgcugg

SEQ ID NO: 2188990 - RNA, 17 nt, Human
acacuaaccacgcugga

SEQ ID NO: 2188991 - RNA, 19 nt, Human
acacuaaccacgcuggacc

SEQ ID NO: 2188992 - RNA, 17 nt, Human
acacuaagagagaauga

SEQ ID NO: 2188993 - RNA, 18 nt, Human
acacuaagagagaaugag

SEQ ID NO: 2188994 - RNA, 19 nt, Human
acacuaagagagaaugaga

SEQ ID NO: 2188995 - RNA, 20 nt, Human
acaccuuggacauccuccuc

SEQ ID NO: 2188996 - RNA, 24 nt, Human
acaccugcaccuccccccacugca

SEQ ID NO: 2188997 - RNA, 19 nt, Human
acaccugcaccucccccca

SEQ ID NO: 2188998 - RNA, 18 nt, Human
acaccugcaccucccccc

SEQ ID NO: 2188999 - RNA, 16 nt, Human
acaccugcaccucccc

SEQ ID NO: 2189000 - RNA, 15 nt, Human
acaccugcaccuccc

SEQ ID NO: 2189001 - RNA, 14 nt, Human
acaccugcaccucc

SEQ ID NO: 2189002 - RNA, 12 nt, Human
acaccugcaccu

SEQ ID NO: 2189003 - RNA, 11 nt, Human
acaccugcacc

SEQ ID NO: 2189004 - RNA, 17 nt, Human
acaccugauguguacau

SEQ ID NO: 2189005 - RNA, 18 nt, Human
acaccugauguguacauc

SEQ ID NO: 2189006 - RNA, 15 nt, Human
acaccugauguguac

SEQ ID NO: 2189007 - RNA, 14 nt, Human
acaccugcccugcc

SEQ ID NO: 2189008 - RNA, 13 nt, Human
acaccugcccugc

SEQ ID NO: 2189009 - RNA, 14 nt, Human
acaccuugacaggg

SEQ ID NO: 2189010 - RNA, 14 nt, Human
acaccuucucugga

SEQ ID NO: 2189011 - RNA, 15 nt, Human
acaccuugacagggc

SEQ ID NO: 2189012 - RNA, 16 nt, Human
acaccuugacagggca

SEQ ID NO: 2189013 - RNA, 18 nt, Human
acaccucugcacaagcug

SEQ ID NO: 2189014 - RNA, 12 nt, Human
acaccucgcccc

SEQ ID NO: 2189015 - RNA, 16 nt, Human
acaccccuccccugcc

SEQ ID NO: 2189016 - RNA, 14 nt, Human
acacccccaccccu

SEQ ID NO: 2189017 - RNA, 23 nt, Human
acaccccuccccugcccuagagc

SEQ ID NO: 2189018 - RNA, 13 nt, Human
acaccucccagga

SEQ ID NO: 2189019 - RNA, 13 nt, Human
acaccucccugaa

SEQ ID NO: 2189020 - RNA, 17 nt, Human
acaccccuuauccagga

SEQ ID NO: 2189021 - RNA, 19 nt, Human
acaccucccaggagacagu

SEQ ID NO: 2189022 - RNA, 22 nt, Human
acaccucccugaaccaucccug

SEQ ID NO: 2189023 - RNA, 16 nt, Human
acaccucccugaacca

SEQ ID NO: 2189024 - RNA, 13 nt, Human
acacccauguuuc

SEQ ID NO: 2189025 - RNA, 15 nt, Human
acacccaucuguuuu

SEQ ID NO: 2189026 - RNA, 20 nt, Human
acaccccauugguggacuac

SEQ ID NO: 2189027 - RNA, 21 nt, Human
acaccccagacgaugucuuca

SEQ ID NO: 2189028 - RNA, 23 nt, Human
acacccagccucaguccuccccu

SEQ ID NO: 2189029 - RNA, 17 nt, Human
acacccagccucagucc

SEQ ID NO: 2189030 - RNA, 20 nt, Human
acacccagccucaguccucc

SEQ ID NO: 2189031 - RNA, 23 nt, Human
acacccaccguccgcccugcucc

SEQ ID NO: 2189032 - RNA, 13 nt, Human
acacccagccuca

SEQ ID NO: 2189033 - RNA, 14 nt, Human
acacccagccucag

SEQ ID NO: 2189034 - RNA, 16 nt, Human
acacccagccucaguc

SEQ ID NO: 2189035 - RNA, 17 nt, Human
acacccacucagcuccg

SEQ ID NO: 2189036 - RNA, 20 nt, Human
acacucugggcuccagagug

SEQ ID NO: 2189037 - RNA, 14 nt, Human
acacucuggcuggu

SEQ ID NO: 2189038 - RNA, 16 nt, Human
acacucugcucugccc

SEQ ID NO: 2189039 - RNA, 13 nt, Human
acacucugcucug

SEQ ID NO: 2189040 - RNA, 14 nt, Human
acacucugcucugc

SEQ ID NO: 2189041 - RNA, 12 nt, Human
acacucuuugua

SEQ ID NO: 2189042 - RNA, 16 nt, Human
acacucuuuguaagag

SEQ ID NO: 2189043 - RNA, 21 nt, Human
acacugaaauauacacacagc

SEQ ID NO: 2189044 - RNA, 20 nt, Human
acacugaaauauacacacag

SEQ ID NO: 2189045 - RNA, 18 nt, Human
acacugaaauauacacac

SEQ ID NO: 2189046 - RNA, 17 nt, Human
acacugaaauauacaca

SEQ ID NO: 2189047 - RNA, 21 nt, Human
acacucuuuugcuuuauucca

SEQ ID NO: 2189048 - RNA, 23 nt, Human
acacugaaaaaucuaagugauau

SEQ ID NO: 2189049 - RNA, 14 nt, Human
acacuguucucugc

SEQ ID NO: 2189050 - RNA, 15 nt, Human
acacuguucucugcc

SEQ ID NO: 2189051 - RNA, 12 nt, Human
acacugaagaag

SEQ ID NO: 2189052 - RNA, 14 nt, Human
acacugaagaagca

SEQ ID NO: 2189053 - RNA, 22 nt, Human
acacugaaauauacacacagca

SEQ ID NO: 2189054 - RNA, 14 nt, Human
acacuguucugaaa

SEQ ID NO: 2189055 - RNA, 20 nt, Human
acacuguucugaaagugacu

SEQ ID NO: 2189056 - RNA, 22 nt, Human
acacuguucucugcccuccaag

SEQ ID NO: 2189057 - RNA, 23 nt, Human
acacuguucucugcccuccaaga

SEQ ID NO: 2189058 - RNA, 16 nt, Human
acacuguucucugccc

SEQ ID NO: 2189059 - RNA, 17 nt, Human
acacuguucucugcccu

SEQ ID NO: 2189060 - RNA, 18 nt, Human
acacuguucucugcccuc

SEQ ID NO: 2189061 - RNA, 20 nt, Human
acacuguucucugcccucca

SEQ ID NO: 2189062 - RNA, 21 nt, Human
acacucacuccugagaccccu

SEQ ID NO: 2189063 - RNA, 18 nt, Human
acacucaccucuaaaaca

SEQ ID NO: 2189064 - RNA, 16 nt, Human
uauaaguagcaggcca

SEQ ID NO: 2189065 - RNA, 19 nt, Human
acacucaccucuaaaacag

SEQ ID NO: 2189066 - RNA, 16 nt, Human
acacucacuccugaga

SEQ ID NO: 2189067 - RNA, 16 nt, Human
acacucagcacaaggc

SEQ ID NO: 2189068 - RNA, 17 nt, Human
acacuccaauuaaggau

SEQ ID NO: 2189069 - RNA, 18 nt, Human
acacuccaauuaaggauu

SEQ ID NO: 2189070 - RNA, 13 nt, Human
acacucagcacaa

SEQ ID NO: 2189071 - RNA, 14 nt, Human
acacucagaccuga

SEQ ID NO: 2189072 - RNA, 19 nt, Human
acacucagaccugaauucu

SEQ ID NO: 2189073 - RNA, 16 nt, Human
uauaacuagcuagaag

SEQ ID NO: 2189074 - RNA, 15 nt, Human
uauaagguuuuaagu

SEQ ID NO: 2189075 - RNA, 17 nt, Human
uauaagguuuaaaaaga

SEQ ID NO: 2189076 - RNA, 16 nt, Human
acacucacccaacaau

SEQ ID NO: 2189077 - RNA, 14 nt, Human
uauaaguaagaaaa

SEQ ID NO: 2189078 - RNA, 15 nt, Human
uauaaguaagaaaau

SEQ ID NO: 2189079 - RNA, 16 nt, Human
uauaaguaagaaaaua

SEQ ID NO: 2189080 - RNA, 18 nt, Human
uauaaguaagaaaauauu

SEQ ID NO: 2189081 - RNA, 17 nt, Human
acacuccagccugagca

SEQ ID NO: 2189082 - RNA, 15 nt, Human
acacuccagccuggg

SEQ ID NO: 2189083 - RNA, 16 nt, Human
acacuccagccugagc

SEQ ID NO: 2189084 - RNA, 15 nt, Human
acacuccagccugag

SEQ ID NO: 2189085 - RNA, 14 nt, Human
acacuccagccuga

SEQ ID NO: 2189086 - RNA, 12 nt, Human
acacuccagccu

SEQ ID NO: 2189087 - RNA, 21 nt, Human
acacuccaauuaaggauuuua

SEQ ID NO: 2189088 - RNA, 13 nt, Human
acacuccuucaca

SEQ ID NO: 2189089 - RNA, 13 nt, Human
acacuccagugcc

SEQ ID NO: 2189090 - RNA, 14 nt, Human
acacuccagugcca

SEQ ID NO: 2189091 - RNA, 14 nt, Human
acacuccagugaga

SEQ ID NO: 2189092 - RNA, 11 nt, Human
acacucugaga

SEQ ID NO: 2189093 - RNA, 13 nt, Human
acacucugagacu

SEQ ID NO: 2189094 - RNA, 16 nt, Human
acacucgcccgcccac

SEQ ID NO: 2189095 - RNA, 23 nt, Human
acacucgcccgcccacuguccug

SEQ ID NO: 2189096 - RNA, 24 nt, Human
acacucgcccgcccacuguccugg

SEQ ID NO: 2189097 - RNA, 14 nt, Human
acagaaacauuuuc

SEQ ID NO: 2189098 - RNA, 20 nt, Human
acagaaaccuuuuuaaaaau

SEQ ID NO: 2189099 - RNA, 15 nt, Human
acagaaaccuuuuua

SEQ ID NO: 2189100 - RNA, 18 nt, Human
acagaaaccucuacuaaa

SEQ ID NO: 2189101 - RNA, 23 nt, Human
acacuuugaaauguguuucugua

SEQ ID NO: 2189102 - RNA, 18 nt, Human
acagaaaauucuucucca

SEQ ID NO: 2189103 - RNA, 17 nt, Human
acagaaacaaaaacacu

SEQ ID NO: 2189104 - RNA, 12 nt, Human
acagaaacaaaa

SEQ ID NO: 2189105 - RNA, 23 nt, Human
acacuuuaugccggaugugcuuu

SEQ ID NO: 2189106 - RNA, 17 nt, Human
acacuuugaaauguguu

SEQ ID NO: 2189107 - RNA, 18 nt, Human
acacuuugaaauguguuu

SEQ ID NO: 2189108 - RNA, 17 nt, Human
acacuuugcacugauau

SEQ ID NO: 2189109 - RNA, 20 nt, Human
acacuuugaaauguguuucu

SEQ ID NO: 2189110 - RNA, 21 nt, Human
acacuuugaaauguguuucug

SEQ ID NO: 2189111 - RNA, 19 nt, Human
acacuuugccauauuuuca

SEQ ID NO: 2189112 - RNA, 19 nt, Human
acacuuugcacugauauau

SEQ ID NO: 2189113 - RNA, 22 nt, Human
acacuuugcacugauauaucau

SEQ ID NO: 2189114 - RNA, 23 nt, Human
acacuugugugugggcugugagu

SEQ ID NO: 2189115 - RNA, 22 nt, Human
acacuuuaauuaccaaccuguu

SEQ ID NO: 2189116 - RNA, 12 nt, Human
acacuuuacaau

SEQ ID NO: 2189117 - RNA, 13 nt, Human
acacuuuacaaug

SEQ ID NO: 2189118 - RNA, 21 nt, Human
acacuuuaugccggaugugcu

SEQ ID NO: 2189119 - RNA, 22 nt, Human
acacuuuaugccggaugugcuu

SEQ ID NO: 2189120 - RNA, 23 nt, Human
acacuuguugauuaauggaaaug

SEQ ID NO: 2189121 - RNA, 20 nt, Human
acacuuguugauuaauggaa

SEQ ID NO: 2189122 - RNA, 23 nt, Human
acacuguuuacaagaaaaaauga

SEQ ID NO: 2189123 - RNA, 21 nt, Human
acacuguuuacaagaaaaaau

SEQ ID NO: 2189124 - RNA, 16 nt, Human
acacuguuucaaacuu

SEQ ID NO: 2189125 - RNA, 15 nt, Human
acacuguuucaaacu

SEQ ID NO: 2189126 - RNA, 15 nt, Human
acacuuaaaaauggu

SEQ ID NO: 2189127 - RNA, 13 nt, Human
acacuuaaaaaug

SEQ ID NO: 2189128 - RNA, 11 nt, Human
acacuuaacag

SEQ ID NO: 2189129 - RNA, 13 nt, Human
acacuuaacagau

SEQ ID NO: 2189130 - RNA, 23 nt, Human
acacuguuucaaacuuuacuaug

SEQ ID NO: 2189131 - RNA, 19 nt, Human
acacuuguccccaaauccg

SEQ ID NO: 2189132 - RNA, 20 nt, Human
acacuuguuccagcucuuug

SEQ ID NO: 2189133 - RNA, 19 nt, Human
acacuuguuccagcucuuu

SEQ ID NO: 2189134 - RNA, 22 nt, Human
acacuugugugugggcugugag

SEQ ID NO: 2189135 - RNA, 18 nt, Human
acacuugugugugggcug

SEQ ID NO: 2189136 - RNA, 16 nt, Human
acacuugugugugggc

SEQ ID NO: 2189137 - RNA, 13 nt, Human
acacuugugugug

SEQ ID NO: 2189138 - RNA, 17 nt, Human
acagacuggaagcacag

SEQ ID NO: 2189139 - RNA, 19 nt, Human
acagacuggaagcacagcu

SEQ ID NO: 2189140 - RNA, 21 nt, Human
acagacuggaagcacagcuuc

SEQ ID NO: 2189141 - RNA, 22 nt, Human
uauauuaucaugcaaaugcugu

SEQ ID NO: 2189142 - RNA, 18 nt, Human
acagacacaggcccggcu

SEQ ID NO: 2189143 - RNA, 22 nt, Human
acagacacaggcccggcuccag

SEQ ID NO: 2189144 - RNA, 17 nt, Human
acagacacaggcccggc

SEQ ID NO: 2189145 - RNA, 19 nt, Human
acagaaagcagaacaguga

SEQ ID NO: 2189146 - RNA, 14 nt, Human
uauauuuaaaagaa

SEQ ID NO: 2189147 - RNA, 15 nt, Human
uauauuuaaugauaa

SEQ ID NO: 2189148 - RNA, 15 nt, Human
uauauuuaacaagau

SEQ ID NO: 2189149 - RNA, 12 nt, Human
uauauuuacaaa

SEQ ID NO: 2189150 - RNA, 16 nt, Human
uauauuauuucuagga

SEQ ID NO: 2189151 - RNA, 22 nt, Human
uauauuauuucuaggaagaauu

SEQ ID NO: 2189152 - RNA, 23 nt, Human
uauauuauuucuaggaagaauuu

SEQ ID NO: 2189153 - RNA, 14 nt, Human
uauauucauauauu

SEQ ID NO: 2189154 - RNA, 21 nt, Human
uauauuccauauauuagcauu

SEQ ID NO: 2189155 - RNA, 19 nt, Human
uauauuccauauauuagca

SEQ ID NO: 2189156 - RNA, 18 nt, Human
uauauucccaauagcaac

SEQ ID NO: 2189157 - RNA, 14 nt, Human
acagagcugggaug

SEQ ID NO: 2189158 - RNA, 18 nt, Human
acagagcucuccagcucc

SEQ ID NO: 2189159 - RNA, 15 nt, Human
acagagcucuccagc

SEQ ID NO: 2189160 - RNA, 10 nt, Human
acagagcugg

SEQ ID NO: 2189161 - RNA, 18 nt, Human
acagagcugggauguuuc

SEQ ID NO: 2189162 - RNA, 21 nt, Human
acagagcugggauguuucugu

SEQ ID NO: 2189163 - RNA, 21 nt, Human
acagagcugguugggaagaca

SEQ ID NO: 2189164 - RNA, 16 nt, Human
acagaguuguuacauu

SEQ ID NO: 2189165 - RNA, 16 nt, Human
acagagcuucccugac

SEQ ID NO: 2189166 - RNA, 19 nt, Human
acagaggaagaauuuguua

SEQ ID NO: 2189167 - RNA, 20 nt, Human
acagaggaagaauuuguuau

SEQ ID NO: 2189168 - RNA, 15 nt, Human
acagagcuucccuga

SEQ ID NO: 2189169 - RNA, 14 nt, Human
acagagcuucccug

SEQ ID NO: 2189170 - RNA, 20 nt, Human
acagaguuguuacauuuuua

SEQ ID NO: 2189171 - RNA, 19 nt, Human
acagaguuguuacauuuuu

SEQ ID NO: 2189172 - RNA, 18 nt, Human
acagaguuguuacauuuu

SEQ ID NO: 2189173 - RNA, 17 nt, Human
acagaguuguuacauuu

SEQ ID NO: 2189174 - RNA, 15 nt, Human
acagagcaagacucu

SEQ ID NO: 2189175 - RNA, 14 nt, Human
acagagcaggacug

SEQ ID NO: 2189176 - RNA, 11 nt, Human
acagagccagu

SEQ ID NO: 2189177 - RNA, 21 nt, Human
acagagcaagugagacccugu

SEQ ID NO: 2189178 - RNA, 16 nt, Human
uaucucgugggagagc

SEQ ID NO: 2189179 - RNA, 16 nt, Human
uaucucuauuuaauau

SEQ ID NO: 2189180 - RNA, 17 nt, Human
uaucucuauuuaauauu

SEQ ID NO: 2189181 - RNA, 18 nt, Human
uaucucuauuuaauauuu

SEQ ID NO: 2189182 - RNA, 20 nt, Human
uaucucuauuuaauauuuau

SEQ ID NO: 2189183 - RNA, 20 nt, Human
uaucucucucucuuuuugga

SEQ ID NO: 2189184 - RNA, 12 nt, Human
uaucucucugug

SEQ ID NO: 2189185 - RNA, 13 nt, Human
uaucucucugugc

SEQ ID NO: 2189186 - RNA, 15 nt, Human
uaucucugaagcaug

SEQ ID NO: 2189187 - RNA, 16 nt, Human
uaucucugaagcaugu

SEQ ID NO: 2189188 - RNA, 17 nt, Human
uaucucugaagcauguu

SEQ ID NO: 2189189 - RNA, 23 nt, Human
uaucucugaagcauguuucaugu

SEQ ID NO: 2189190 - RNA, 18 nt, Human
uaucucugaagcauguuu

SEQ ID NO: 2189191 - RNA, 22 nt, Human
acagagagucccacugccucag

SEQ ID NO: 2189192 - RNA, 23 nt, Human
uaucucugugugcacaaauauuu

SEQ ID NO: 2189193 - RNA, 12 nt, Human
uaucucuguguu

SEQ ID NO: 2189194 - RNA, 18 nt, Human
uaucucugugugcacaaa

SEQ ID NO: 2189195 - RNA, 17 nt, Human
uaucucugugugcacaa

SEQ ID NO: 2189196 - RNA, 16 nt, Human
uaucucugugugcaca

SEQ ID NO: 2189197 - RNA, 11 nt, Human
uaucucugugu

SEQ ID NO: 2189198 - RNA, 16 nt, Human
uauauuuauacuguau

SEQ ID NO: 2189199 - RNA, 24 nt, Human
uauauuuauaacucaucauaaaau

SEQ ID NO: 2189200 - RNA, 19 nt, Human
uauauuuauuacuguaaga

SEQ ID NO: 2189201 - RNA, 23 nt, Human
uauauuuauaacucaucauaaaa

SEQ ID NO: 2189202 - RNA, 22 nt, Human
uauauuuauaacucaucauaaa

SEQ ID NO: 2189203 - RNA, 15 nt, Human
uauauuuauuacugu

SEQ ID NO: 2189204 - RNA, 12 nt, Human
uaucccucucca

SEQ ID NO: 2189205 - RNA, 16 nt, Human
uaucccggcugcccuu

SEQ ID NO: 2189206 - RNA, 15 nt, Human
uaucccuacauguau

SEQ ID NO: 2189207 - RNA, 15 nt, Human
uaucccucaccugua

SEQ ID NO: 2189208 - RNA, 20 nt, Human
uaucccuacuguaauuugug

SEQ ID NO: 2189209 - RNA, 19 nt, Human
uaucccuacuguaauuugu

SEQ ID NO: 2189210 - RNA, 15 nt, Human
uaucucagggccugg

SEQ ID NO: 2189211 - RNA, 13 nt, Human
uaucucagggccu

SEQ ID NO: 2189212 - RNA, 16 nt, Human
uaucucacuugugcca

SEQ ID NO: 2189213 - RNA, 22 nt, Human
uauccuccagguuuuucaauua

SEQ ID NO: 2189214 - RNA, 12 nt, Human
uauccuacuucu

SEQ ID NO: 2189215 - RNA, 17 nt, Human
uauccuacuuccccuuc

SEQ ID NO: 2189216 - RNA, 14 nt, Human
uauccuacuucccc

SEQ ID NO: 2189217 - RNA, 12 nt, Human
uauccuccaggu

SEQ ID NO: 2189218 - RNA, 15 nt, Human
uauccuacaacaaga

SEQ ID NO: 2189219 - RNA, 19 nt, Human
uauccuacaacaagaguuu

SEQ ID NO: 2189220 - RNA, 13 nt, Human
uauccuccagguu

SEQ ID NO: 2189221 - RNA, 14 nt, Human
uauccuccagguuu

SEQ ID NO: 2189222 - RNA, 15 nt, Human
uauccuccagguuuu

SEQ ID NO: 2189223 - RNA, 17 nt, Human
uauccuccagguuuuuc

SEQ ID NO: 2189224 - RNA, 18 nt, Human
uauccuccagguuuuuca

SEQ ID NO: 2189225 - RNA, 19 nt, Human
uauccuccagguuuuucaa

SEQ ID NO: 2189226 - RNA, 20 nt, Human
uauccuccagguuuuucaau

SEQ ID NO: 2189227 - RNA, 21 nt, Human
uauccuccagguuuuucaauu

SEQ ID NO: 2189228 - RNA, 23 nt, Human
uauccuccagguuuuucaauuaa

SEQ ID NO: 2189229 - RNA, 20 nt, Human
acagauguaaaagacuuuuu

SEQ ID NO: 2189230 - RNA, 16 nt, Human
acagaugggcaaauua

SEQ ID NO: 2189231 - RNA, 22 nt, Human
acagauggcacuuugaaggggc

SEQ ID NO: 2189232 - RNA, 23 nt, Human
acagaugggugcuuggaggaagg

SEQ ID NO: 2189233 - RNA, 22 nt, Human
acagaugccccagagcuguuua

SEQ ID NO: 2189234 - RNA, 21 nt, Human
acagaugccccagagcuguuu

SEQ ID NO: 2189235 - RNA, 12 nt, Human
acagaugccucc

SEQ ID NO: 2189236 - RNA, 17 nt, Human
acagauggauuugccug

SEQ ID NO: 2189237 - RNA, 16 nt, Human
acagauggauuugccu

SEQ ID NO: 2189238 - RNA, 21 nt, Human
acagaugcuuuucugucucug

SEQ ID NO: 2189239 - RNA, 14 nt, Human
acagaugcuuuucu

SEQ ID NO: 2189240 - RNA, 12 nt, Human
acagauguugaa

SEQ ID NO: 2189241 - RNA, 23 nt, Human
acagauguuucuuuuguauguaa

SEQ ID NO: 2189242 - RNA, 15 nt, Human
acagauucacacugu

SEQ ID NO: 2189243 - RNA, 19 nt, Human
acagauucacacugucugg

SEQ ID NO: 2189244 - RNA, 20 nt, Human
acagaugucagccgagccgg

SEQ ID NO: 2189245 - RNA, 18 nt, Human
acagcaaaacuccaucuc

SEQ ID NO: 2189246 - RNA, 17 nt, Human
acagauucacacugucu

SEQ ID NO: 2189247 - RNA, 24 nt, Human
acagauguuucuuuuguauguaaa

SEQ ID NO: 2189248 - RNA, 16 nt, Human
acagauucacacuguc

SEQ ID NO: 2189249 - RNA, 16 nt, Human
acagauuuuuacaaau

SEQ ID NO: 2189250 - RNA, 17 nt, Human
acagauuuuuacaaaug

SEQ ID NO: 2189251 - RNA, 21 nt, Human
acagauaagcaagagagaugu

SEQ ID NO: 2189252 - RNA, 16 nt, Human
acagaggaagagcagg

SEQ ID NO: 2189253 - RNA, 14 nt, Human
acagaggaagagca

SEQ ID NO: 2189254 - RNA, 15 nt, Human
acagaguuguuacau

SEQ ID NO: 2189255 - RNA, 14 nt, Human
acagauaaucagug

SEQ ID NO: 2189256 - RNA, 20 nt, Human
acagauaagcaagagagaug

SEQ ID NO: 2189257 - RNA, 22 nt, Human
acagaguuguuacauuuuuaag

SEQ ID NO: 2189258 - RNA, 21 nt, Human
acagaguuguuacauuuuuaa

SEQ ID NO: 2189259 - RNA, 19 nt, Human
acagaugccccagagcugu

SEQ ID NO: 2189260 - RNA, 18 nt, Human
acagaugccccagagcug

SEQ ID NO: 2189261 - RNA, 17 nt, Human
acagaugccccagagcu

SEQ ID NO: 2189262 - RNA, 16 nt, Human
acagaugccccagagc

SEQ ID NO: 2189263 - RNA, 14 nt, Human
acagaugccccaga

SEQ ID NO: 2189264 - RNA, 13 nt, Human
acagaugccccag

SEQ ID NO: 2189265 - RNA, 21 nt, Human
acagauacuggaaguuuugca

SEQ ID NO: 2189266 - RNA, 22 nt, Human
acagauacuggaaguuuugcau

SEQ ID NO: 2189267 - RNA, 20 nt, Human
acagauagauauaugcucug

SEQ ID NO: 2189268 - RNA, 20 nt, Human
acagauacuccuccaagguu

SEQ ID NO: 2189269 - RNA, 17 nt, Human
acagcaacaauuuauga

SEQ ID NO: 2189270 - RNA, 20 nt, Human
acagcaacaauuuaugaauu

SEQ ID NO: 2189271 - RNA, 21 nt, Human
acagcccgggcucugccuccc

SEQ ID NO: 2189272 - RNA, 22 nt, Human
acagcccgggcucugccuccca

SEQ ID NO: 2189273 - RNA, 23 nt, Human
acagcccgggcucugccucccau

SEQ ID NO: 2189274 - RNA, 14 nt, Human
acagcaaccccagg

SEQ ID NO: 2189275 - RNA, 20 nt, Human
acagcccuucuuuccacaga

SEQ ID NO: 2189276 - RNA, 21 nt, Human
acagcccuucuuuccacagaa

SEQ ID NO: 2189277 - RNA, 15 nt, Human
uaucuugucucuggg

SEQ ID NO: 2189278 - RNA, 23 nt, Human
uaucuuggugaauuuuuuuuucc

SEQ ID NO: 2189279 - RNA, 18 nt, Human
uaucuuguuuuuccacua

SEQ ID NO: 2189280 - RNA, 14 nt, Human
uaucuuguuuuucc

SEQ ID NO: 2189281 - RNA, 17 nt, Human
uaucuugucucugggcu

SEQ ID NO: 2189282 - RNA, 13 nt, Human
acagccgcagccu

SEQ ID NO: 2189283 - RNA, 19 nt, Human
acagccgauucaccugagc

SEQ ID NO: 2189284 - RNA, 20 nt, Human
acagccgcagccucccucug

SEQ ID NO: 2189285 - RNA, 22 nt, Human
uaucuuguuuuuccacuacugc

SEQ ID NO: 2189286 - RNA, 15 nt, Human
uaucuuuauuaauca

SEQ ID NO: 2189287 - RNA, 14 nt, Human
uaucuuuauuaauc

SEQ ID NO: 2189288 - RNA, 19 nt, Human
uaucuuucgcacagcaguu

SEQ ID NO: 2189289 - RNA, 23 nt, Human
uaucuuucgugauaaacuuugcu

SEQ ID NO: 2189290 - RNA, 16 nt, Human
uaucuuugauucuccu

SEQ ID NO: 2189291 - RNA, 12 nt, Human
uaucuuucuaca

SEQ ID NO: 2189292 - RNA, 13 nt, Human
uaucuuucuacag

SEQ ID NO: 2189293 - RNA, 17 nt, Human
uaucuuugauucuccuu

SEQ ID NO: 2189294 - RNA, 18 nt, Human
uaucuuugauucuccuuc

SEQ ID NO: 2189295 - RNA, 20 nt, Human
uaugaaagauggcugugccu

SEQ ID NO: 2189296 - RNA, 22 nt, Human
uaugaaagauggcugugccucu

SEQ ID NO: 2189297 - RNA, 23 nt, Human
uaugaaagauggcugugccucug

SEQ ID NO: 2189298 - RNA, 13 nt, Human
uaugaaauaaaga

SEQ ID NO: 2189299 - RNA, 18 nt, Human
aauuuaguuuuuguucuu

SEQ ID NO: 2189300 - RNA, 20 nt, Human
aauuuaguuuuuguucuuaa

SEQ ID NO: 2189301 - RNA, 17 nt, Human
aauuuaguuuuuguucu

SEQ ID NO: 2189302 - RNA, 16 nt, Human
aauuuaguuuuuguuc

SEQ ID NO: 2189303 - RNA, 15 nt, Human
aauuuauacaauauc

SEQ ID NO: 2189304 - RNA, 22 nt, Human
aauuuauaaacuuuuuucuuac

SEQ ID NO: 2189305 - RNA, 20 nt, Human
aauuuauauacaaccugcuu

SEQ ID NO: 2189306 - RNA, 17 nt, Human
aauuuauacaauaucau

SEQ ID NO: 2189307 - RNA, 17 nt, Human
aauuuaucacacuucug

SEQ ID NO: 2189308 - RNA, 19 nt, Human
aauuuauuaauugcuuuga

SEQ ID NO: 2189309 - RNA, 17 nt, Human
aauuuauuaguuaauau

SEQ ID NO: 2189310 - RNA, 18 nt, Human
aauuuauuaguuaauaua

SEQ ID NO: 2189311 - RNA, 18 nt, Human
aauuuauuaauugcuuug

SEQ ID NO: 2189312 - RNA, 15 nt, Human
aauuuauuaaaauga

SEQ ID NO: 2189313 - RNA, 17 nt, Human
aauuuauuaauugcuuu

SEQ ID NO: 2189314 - RNA, 17 nt, Human
aauuucuugguaagaag

SEQ ID NO: 2189315 - RNA, 20 nt, Human
aauuucuugguaagaagccg

SEQ ID NO: 2189316 - RNA, 22 nt, Human
aauuucuuuauguaaucuaugu

SEQ ID NO: 2189317 - RNA, 20 nt, Human
aauuucuuacuaaacauuuu

SEQ ID NO: 2189318 - RNA, 20 nt, Human
aauuucuucacuguugaaaa

SEQ ID NO: 2189319 - RNA, 21 nt, Human
aauuucuuacuaaacauuuug

SEQ ID NO: 2189320 - RNA, 19 nt, Human
aauuucucccagucauuua

SEQ ID NO: 2189321 - RNA, 13 nt, Human
aauuucuauuaaa

SEQ ID NO: 2189322 - RNA, 19 nt, Human
aauuuauuaguuaauauau

SEQ ID NO: 2189323 - RNA, 14 nt, Human
aauuuauuauggca

SEQ ID NO: 2189324 - RNA, 13 nt, Human
aauuuauuauggc

SEQ ID NO: 2189325 - RNA, 22 nt, Human
aauugcuugaaagaaaauaugc

SEQ ID NO: 2189326 - RNA, 17 nt, Human
aauugcuugaaagaaaa

SEQ ID NO: 2189327 - RNA, 15 nt, Human
aauugcuugaaagaa

SEQ ID NO: 2189328 - RNA, 22 nt, Human
aauugcuuuaccuuuuuucuua

SEQ ID NO: 2189329 - RNA, 10 nt, Human
aauugcuuug

SEQ ID NO: 2189330 - RNA, 11 nt, Human
aauugcuuuga

SEQ ID NO: 2189331 - RNA, 20 nt, Human
aauuggaagcugcccugccc

SEQ ID NO: 2189332 - RNA, 20 nt, Human
aauuggaacagaauguuuua

SEQ ID NO: 2189333 - RNA, 15 nt, Human
aauuggagcucgugg

SEQ ID NO: 2189334 - RNA, 18 nt, Human
aauuggaccauccuauuu

SEQ ID NO: 2189335 - RNA, 16 nt, Human
aauuuaaauauaauuc

SEQ ID NO: 2189336 - RNA, 19 nt, Human
aauuuaaauauaauucugu

SEQ ID NO: 2189337 - RNA, 20 nt, Human
aauuuaaauauaauucugua

SEQ ID NO: 2189338 - RNA, 23 nt, Human
aauuuaaauauaauucuguaaau

SEQ ID NO: 2189339 - RNA, 16 nt, Human
aauuuaagcauuguuu

SEQ ID NO: 2189340 - RNA, 15 nt, Human
aauuuaagcauuguu

SEQ ID NO: 2189341 - RNA, 14 nt, Human
aauuuaagcauugu

SEQ ID NO: 2189342 - RNA, 13 nt, Human
aauuuaagcauug

SEQ ID NO: 2189343 - RNA, 12 nt, Human
aauuuaagcauu

SEQ ID NO: 2189344 - RNA, 11 nt, Human
aauuuaagcau

SEQ ID NO: 2189345 - RNA, 23 nt, Human
aauuuaagcauuguuugcuuauu

SEQ ID NO: 2189346 - RNA, 21 nt, Human
aauuuaagcauuguuugcuua

SEQ ID NO: 2189347 - RNA, 14 nt, Human
aauuuaaguaucuu

SEQ ID NO: 2189348 - RNA, 14 nt, Human
aauuuaagugcgug

SEQ ID NO: 2189349 - RNA, 16 nt, Human
aauuuaagugcgugug

SEQ ID NO: 2189350 - RNA, 18 nt, Human
aauuuacaaaguguguau

SEQ ID NO: 2189351 - RNA, 15 nt, Human
aauuuaguuauugau

SEQ ID NO: 2189352 - RNA, 19 nt, Human
aauuuacaaaguguguauu

SEQ ID NO: 2189353 - RNA, 21 nt, Human
aauuuacaaaguguguauuaa

SEQ ID NO: 2189354 - RNA, 14 nt, Human
aauuuacuugccau

SEQ ID NO: 2189355 - RNA, 15 nt, Human
aauuuacauacucug

SEQ ID NO: 2189356 - RNA, 17 nt, Human
aauuuaccugaagucuu

SEQ ID NO: 2189357 - RNA, 18 nt, Human
aauuuacagagacagaaa

SEQ ID NO: 2189358 - RNA, 17 nt, Human
aauuuacagagacagaa

SEQ ID NO: 2189359 - RNA, 16 nt, Human
uacuuccuccucccca

SEQ ID NO: 2189360 - RNA, 17 nt, Human
uacuucgucuucuaauu

SEQ ID NO: 2189361 - RNA, 18 nt, Human
uacuucgucuucuaauuu

SEQ ID NO: 2189362 - RNA, 19 nt, Human
uacuuccuaucaagccagu

SEQ ID NO: 2189363 - RNA, 14 nt, Human
uacuuccuccuccc

SEQ ID NO: 2189364 - RNA, 23 nt, Human
uacuuccugugacuucagcucug

SEQ ID NO: 2189365 - RNA, 13 nt, Human
uacuucuccaccc

SEQ ID NO: 2189366 - RNA, 18 nt, Human
uacuucuccacccugcuc

SEQ ID NO: 2189367 - RNA, 23 nt, Human
uacuucccauuuuggaaguuuuc

SEQ ID NO: 2189368 - RNA, 19 nt, Human
uacuuauuuuugacagugu

SEQ ID NO: 2189369 - RNA, 17 nt, Human
uacuuauuuuugacagu

SEQ ID NO: 2189370 - RNA, 20 nt, Human
uacuuccccuuccuaauucc

SEQ ID NO: 2189371 - RNA, 18 nt, Human
uacuuccccuuccuaauu

SEQ ID NO: 2189372 - RNA, 15 nt, Human
uacuuccccuuccua

SEQ ID NO: 2189373 - RNA, 14 nt, Human
uacuuccccuuccu

SEQ ID NO: 2189374 - RNA, 13 nt, Human
uacuuauuccaga

SEQ ID NO: 2189375 - RNA, 20 nt, Human
uacuuaucauccacauuguu

SEQ ID NO: 2189376 - RNA, 14 nt, Human
uacuuauuacugcu

SEQ ID NO: 2189377 - RNA, 15 nt, Human
uacuuauuacugcua

SEQ ID NO: 2189378 - RNA, 20 nt, Human
aauuugauugauuugaagaa

SEQ ID NO: 2189379 - RNA, 17 nt, Human
aauuugauugauuugaa

SEQ ID NO: 2189380 - RNA, 15 nt, Human
aauuugauuucuauu

SEQ ID NO: 2189381 - RNA, 19 nt, Human
aauuugaaaauaauuguuc

SEQ ID NO: 2189382 - RNA, 23 nt, Human
aauuugaaaacauaaucugcaaa

SEQ ID NO: 2189383 - RNA, 18 nt, Human
aauuugaaaauaauuguu

SEQ ID NO: 2189384 - RNA, 18 nt, Human
aauuucuuugccuguuca

SEQ ID NO: 2189385 - RNA, 21 nt, Human
aauuucuucacuguugaaaau

SEQ ID NO: 2189386 - RNA, 15 nt, Human
aauuucuuugccugu

SEQ ID NO: 2189387 - RNA, 12 nt, Human
aauuugauugau

SEQ ID NO: 2189388 - RNA, 17 nt, Human
aauuugauuauuaacau

SEQ ID NO: 2189389 - RNA, 16 nt, Human
aauuugauugauuuga

SEQ ID NO: 2189390 - RNA, 15 nt, Human
aauuugauugauuug

SEQ ID NO: 2189391 - RNA, 14 nt, Human
aauuugauugauuu

SEQ ID NO: 2189392 - RNA, 13 nt, Human
aauuugauugauu

SEQ ID NO: 2189393 - RNA, 18 nt, Human
aauuugcaagucauggcu

SEQ ID NO: 2189394 - RNA, 18 nt, Human
uacuucuucauucaauac

SEQ ID NO: 2189395 - RNA, 16 nt, Human
uacuucuuugcuuugc

SEQ ID NO: 2189396 - RNA, 15 nt, Human
uacuugaaaauuaac

SEQ ID NO: 2189397 - RNA, 20 nt, Human
uacuuuccuuuccccagccc

SEQ ID NO: 2189398 - RNA, 17 nt, Human
uacuuucguacauuggc

SEQ ID NO: 2189399 - RNA, 19 nt, Human
uacuuuccuuuccccagcc

SEQ ID NO: 2189400 - RNA, 22 nt, Human
uacuuuccacuugauuuugcaa

SEQ ID NO: 2189401 - RNA, 20 nt, Human
uacuugaaaucuaggauuau

SEQ ID NO: 2189402 - RNA, 20 nt, Human
uacuuuguccuuuuuguuau

SEQ ID NO: 2189403 - RNA, 23 nt, Human
uacuuugauauuuucaacgcagc

SEQ ID NO: 2189404 - RNA, 11 nt, Human
uacuuugucag

SEQ ID NO: 2189405 - RNA, 14 nt, Human
uacuuugucugaaa

SEQ ID NO: 2189406 - RNA, 16 nt, Human
uacuuugucugaaaaa

SEQ ID NO: 2189407 - RNA, 19 nt, Human
uacuuugaaaccagaaaau

SEQ ID NO: 2189408 - RNA, 18 nt, Human
uacuuugaagucauacca

SEQ ID NO: 2189409 - RNA, 14 nt, Human
uacuuugaagucau

SEQ ID NO: 2189410 - RNA, 14 nt, Human
uacuuugacuuuuu

SEQ ID NO: 2189411 - RNA, 15 nt, Human
uacuucuuauacauu

SEQ ID NO: 2189412 - RNA, 14 nt, Human
uacuucuuauacau

SEQ ID NO: 2189413 - RNA, 16 nt, Human
uacuucuuauacauuu

SEQ ID NO: 2189414 - RNA, 14 nt, Human
uacuucuugaaggu

SEQ ID NO: 2189415 - RNA, 14 nt, Human
uacuucuccagccu

SEQ ID NO: 2189416 - RNA, 21 nt, Human
uacuucuagagauaguacaua

SEQ ID NO: 2189417 - RNA, 22 nt, Human
uacuucguguccgacucuucug

SEQ ID NO: 2189418 - RNA, 21 nt, Human
uacuucugagggcaucuuggu

SEQ ID NO: 2189419 - RNA, 13 nt, Human
uacuucugaggua

SEQ ID NO: 2189420 - RNA, 20 nt, Human
uacuucuccacccugcucuc

SEQ ID NO: 2189421 - RNA, 15 nt, Human
uacuucugcuacaua

SEQ ID NO: 2189422 - RNA, 19 nt, Human
uacuucuuaggguuaugau

SEQ ID NO: 2189423 - RNA, 18 nt, Human
uacuagggagaagguuuc

SEQ ID NO: 2189424 - RNA, 23 nt, Human
uacuaggcuuaauaccuggguga

SEQ ID NO: 2189425 - RNA, 17 nt, Human
uacuagcauaugaguuu

SEQ ID NO: 2189426 - RNA, 18 nt, Human
uacuagggaaaugccuuu

SEQ ID NO: 2189427 - RNA, 13 nt, Human
uacuagguaacuu

SEQ ID NO: 2189428 - RNA, 21 nt, Human
uacuauuuaaagccuccucau

SEQ ID NO: 2189429 - RNA, 22 nt, Human
uacuauuuaaagccuccucauc

SEQ ID NO: 2189430 - RNA, 21 nt, Human
uacuagggaucccucaucugu

SEQ ID NO: 2189431 - RNA, 12 nt, Human
uacuauuuaaag

SEQ ID NO: 2189432 - RNA, 19 nt, Human
uacuauuuaaagccuccuc

SEQ ID NO: 2189433 - RNA, 18 nt, Human
uacuauuuuacuucuaga

SEQ ID NO: 2189434 - RNA, 13 nt, Human
uacuauuuuuacu

SEQ ID NO: 2189435 - RNA, 19 nt, Human
uacuauuuuacuucuagag

SEQ ID NO: 2189436 - RNA, 14 nt, Human
uacuauuuuacuuc

SEQ ID NO: 2189437 - RNA, 13 nt, Human
uacuauuuagaua

SEQ ID NO: 2189438 - RNA, 22 nt, Human
uacucuacccucuuagaaaaac

SEQ ID NO: 2189439 - RNA, 14 nt, Human
uacuauuuuuacug

SEQ ID NO: 2189440 - RNA, 15 nt, Human
uacuauuuuuacugc

SEQ ID NO: 2189441 - RNA, 18 nt, Human
uacuauuuuuacugccac

SEQ ID NO: 2189442 - RNA, 19 nt, Human
uacuauuuuuacugccacu

SEQ ID NO: 2189443 - RNA, 14 nt, Human
uacuaaaaaugcaa

SEQ ID NO: 2189444 - RNA, 14 nt, Human
uacgucugggagaa

SEQ ID NO: 2189445 - RNA, 14 nt, Human
uacgugagccaggu

SEQ ID NO: 2189446 - RNA, 20 nt, Human
uacuaaaaguucuucuccaa

SEQ ID NO: 2189447 - RNA, 18 nt, Human
uacuaaaaauacaaaaaa

SEQ ID NO: 2189448 - RNA, 14 nt, Human
uacuagaugucuuu

SEQ ID NO: 2189449 - RNA, 19 nt, Human
uacuagagucugaacagcu

SEQ ID NO: 2189450 - RNA, 19 nt, Human
uacuagaugucuuuaggca

SEQ ID NO: 2189451 - RNA, 15 nt, Human
uacuagaugucuuua

SEQ ID NO: 2189452 - RNA, 22 nt, Human
uacuagaagaugaauacaaaca

SEQ ID NO: 2189453 - RNA, 16 nt, Human
uacgucugacaggcaa

SEQ ID NO: 2189454 - RNA, 13 nt, Human
uacgucugggaga

SEQ ID NO: 2189455 - RNA, 21 nt, Human
uacgucugggagaaauugaca

SEQ ID NO: 2189456 - RNA, 13 nt, Human
uacgugaguccug

SEQ ID NO: 2189457 - RNA, 14 nt, Human
uacuaaaaauacaa

SEQ ID NO: 2189458 - RNA, 13 nt, Human
uacggacaccccc

SEQ ID NO: 2189459 - RNA, 14 nt, Human
uacggacacccccu

SEQ ID NO: 2189460 - RNA, 15 nt, Human
uacgucugacaggca

SEQ ID NO: 2189461 - RNA, 21 nt, Human
uacgcucuccuuucuuucuaa

SEQ ID NO: 2189462 - RNA, 22 nt, Human
uacgcugaagauggcauccugu

SEQ ID NO: 2189463 - RNA, 19 nt, Human
uacgcucuccuuucuuucu

SEQ ID NO: 2189464 - RNA, 15 nt, Human
uacgcucuccuuucu

SEQ ID NO: 2189465 - RNA, 15 nt, Human
uacgcuuugauucau

SEQ ID NO: 2189466 - RNA, 14 nt, Human
uacgcuuugauuca

SEQ ID NO: 2189467 - RNA, 13 nt, Human
uacgcugaagaug

SEQ ID NO: 2189468 - RNA, 18 nt, Human
aauugacagaucaagcug

SEQ ID NO: 2189469 - RNA, 19 nt, Human
aauugaauggucagcguug

SEQ ID NO: 2189470 - RNA, 19 nt, Human
aauugacagaucaagcugu

SEQ ID NO: 2189471 - RNA, 21 nt, Human
aauugacagaucaagcuguga

SEQ ID NO: 2189472 - RNA, 21 nt, Human
aauugaaucaguauaaacaaa

SEQ ID NO: 2189473 - RNA, 13 nt, Human
uacgcucuccuuu

SEQ ID NO: 2189474 - RNA, 14 nt, Human
aauugacauugcuu

SEQ ID NO: 2189475 - RNA, 24 nt, Human
uacgcuccaucgcugucaucucag

SEQ ID NO: 2189476 - RNA, 23 nt, Human
aauugacagaucaagcugugaga

SEQ ID NO: 2189477 - RNA, 19 nt, Human
aaugugugccauagaguuu

SEQ ID NO: 2189478 - RNA, 16 nt, Human
aauguguggccugcac

SEQ ID NO: 2189479 - RNA, 22 nt, Human
aaugugugugguuuuuuuucua

SEQ ID NO: 2189480 - RNA, 23 nt, Human
aauugaauaaugguaccagauaa

SEQ ID NO: 2189481 - RNA, 17 nt, Human
aaugugugugguuuuuu

SEQ ID NO: 2189482 - RNA, 14 nt, Human
aauugaauaauggu

SEQ ID NO: 2189483 - RNA, 21 nt, Human
aauugaauaaugguaccagau

SEQ ID NO: 2189484 - RNA, 22 nt, Human
aauugaauaaugguaccagaua

SEQ ID NO: 2189485 - RNA, 19 nt, Human
aauguguaucggaugcuuu

SEQ ID NO: 2189486 - RNA, 16 nt, Human
aauguguacaacuuaa

SEQ ID NO: 2189487 - RNA, 22 nt, Human
aauguguauuacaaauauuuug

SEQ ID NO: 2189488 - RNA, 21 nt, Human
aaugugguuauuucucugauu

SEQ ID NO: 2189489 - RNA, 23 nt, Human
aaugugguuauuucucugauuug

SEQ ID NO: 2189490 - RNA, 15 nt, Human
aauguguaauuuugu

SEQ ID NO: 2189491 - RNA, 16 nt, Human
aauguguaauuuuguu

SEQ ID NO: 2189492 - RNA, 19 nt, Human
aauguguaauuuuguucua

SEQ ID NO: 2189493 - RNA, 18 nt, Human
aaugugguuauuucucug

SEQ ID NO: 2189494 - RNA, 19 nt, Human
aaugugguuauuucucuga

SEQ ID NO: 2189495 - RNA, 14 nt, Human
aaugugggcagaga

SEQ ID NO: 2189496 - RNA, 18 nt, Human
uacugguccaaaagauug

SEQ ID NO: 2189497 - RNA, 13 nt, Human
uacugguccaaaa

SEQ ID NO: 2189498 - RNA, 19 nt, Human
uacugagagugaacaaauu

SEQ ID NO: 2189499 - RNA, 16 nt, Human
uacugggagccuaccc

SEQ ID NO: 2189500 - RNA, 20 nt, Human
uacugagaaaagccucucca

SEQ ID NO: 2189501 - RNA, 15 nt, Human
uacuguaauuuguga

SEQ ID NO: 2189502 - RNA, 18 nt, Human
uacuggucuuguggaauu

SEQ ID NO: 2189503 - RNA, 23 nt, Human
uacugguccaaaagauugcugaa

SEQ ID NO: 2189504 - RNA, 17 nt, Human
uacuguaauuugugaua

SEQ ID NO: 2189505 - RNA, 16 nt, Human
uacuguaauuugugau

SEQ ID NO: 2189506 - RNA, 17 nt, Human
uacugacugagaauaua

SEQ ID NO: 2189507 - RNA, 14 nt, Human
uacugacuuucuca

SEQ ID NO: 2189508 - RNA, 17 nt, Human
uacugagagugaacaaa

SEQ ID NO: 2189509 - RNA, 20 nt, Human
uacugaaagguuacccugua

SEQ ID NO: 2189510 - RNA, 22 nt, Human
uacugacauguggggccagguc

SEQ ID NO: 2189511 - RNA, 22 nt, Human
uacugaacaaucaaagcacuug

SEQ ID NO: 2189512 - RNA, 17 nt, Human
uacucuuugagauagaa

SEQ ID NO: 2189513 - RNA, 14 nt, Human
uacucuccuagaga

SEQ ID NO: 2189514 - RNA, 16 nt, Human
uacucuuucuguauau

SEQ ID NO: 2189515 - RNA, 14 nt, Human
uacucuuuuuguuu

SEQ ID NO: 2189516 - RNA, 22 nt, Human
uacucuuugagauagaagaacu

SEQ ID NO: 2189517 - RNA, 15 nt, Human
uacucuuucuguaua

SEQ ID NO: 2189518 - RNA, 14 nt, Human
uacucuuucuguau

SEQ ID NO: 2189519 - RNA, 13 nt, Human
uacucuuucugua

SEQ ID NO: 2189520 - RNA, 12 nt, Human
uacucuccuaga

SEQ ID NO: 2189521 - RNA, 16 nt, Human
uacucuccaaccugga

SEQ ID NO: 2189522 - RNA, 14 nt, Human
uacucuccaaccug

SEQ ID NO: 2189523 - RNA, 18 nt, Human
uacucuccaaccuggaca

SEQ ID NO: 2189524 - RNA, 16 nt, Human
uacucucccauggcuu

SEQ ID NO: 2189525 - RNA, 13 nt, Human
uacucuacugaua

SEQ ID NO: 2189526 - RNA, 14 nt, Human
uacucuagaugaag

SEQ ID NO: 2189527 - RNA, 12 nt, Human
uacucuagauuu

SEQ ID NO: 2189528 - RNA, 15 nt, Human
uacucuagauuuugu

SEQ ID NO: 2189529 - RNA, 16 nt, Human
uacucuagauuuuguu

SEQ ID NO: 2189530 - RNA, 15 nt, Human
aauugagauuagagg

SEQ ID NO: 2189531 - RNA, 22 nt, Human
aauugagagaauggaaaacaga

SEQ ID NO: 2189532 - RNA, 18 nt, Human
aauugaggacacugauau

SEQ ID NO: 2189533 - RNA, 21 nt, Human
aauugacuuauuuauauaaau

SEQ ID NO: 2189534 - RNA, 18 nt, Human
aauugacuucgacuguga

SEQ ID NO: 2189535 - RNA, 19 nt, Human
uacuguacaaugacuuuau

SEQ ID NO: 2189536 - RNA, 20 nt, Human
uacuguaauuuuauaugaag

SEQ ID NO: 2189537 - RNA, 14 nt, Human
uacuguaauuuuau

SEQ ID NO: 2189538 - RNA, 12 nt, Human
uacuguaauuuu

SEQ ID NO: 2189539 - RNA, 23 nt, Human
uacuguacagacagaaaaaacug

SEQ ID NO: 2189540 - RNA, 19 nt, Human
uacuguacagacagaaaaa

SEQ ID NO: 2189541 - RNA, 16 nt, Human
uacuguaauuccucaa

SEQ ID NO: 2189542 - RNA, 15 nt, Human
uacuguaauuccuca

SEQ ID NO: 2189543 - RNA, 13 nt, Human
uacuguaauuccu

SEQ ID NO: 2189544 - RNA, 15 nt, Human
aauugauuucaagac

SEQ ID NO: 2189545 - RNA, 13 nt, Human
aauugauuugcau

SEQ ID NO: 2189546 - RNA, 22 nt, Human
aauugauuugcauugaacacaa

SEQ ID NO: 2189547 - RNA, 20 nt, Human
aauugauuugcauugaacac

SEQ ID NO: 2189548 - RNA, 16 nt, Human
aauugauuugcauuga

SEQ ID NO: 2189549 - RNA, 14 nt, Human
aauugauuugcauu

SEQ ID NO: 2189550 - RNA, 14 nt, Human
aauugauuauucug

SEQ ID NO: 2189551 - RNA, 22 nt, Human
aauugauuauucugauuccacu

SEQ ID NO: 2189552 - RNA, 23 nt, Human
aauugauuauucugauuccacuu

SEQ ID NO: 2189553 - RNA, 17 nt, Human
aauugaggggauuaaua

SEQ ID NO: 2189554 - RNA, 19 nt, Human
aauugaggacuauggaaau

SEQ ID NO: 2189555 - RNA, 23 nt, Human
aauugcuuacuuuggaauacauu

SEQ ID NO: 2189556 - RNA, 11 nt, Human
aauugcauuga

SEQ ID NO: 2189557 - RNA, 13 nt, Human
aauugcagacugu

SEQ ID NO: 2189558 - RNA, 14 nt, Human
aauugcagaacuaa

SEQ ID NO: 2189559 - RNA, 18 nt, Human
aauugcacuuuuaaaccu

SEQ ID NO: 2189560 - RNA, 15 nt, Human
aauugcacucuaaaa

SEQ ID NO: 2189561 - RNA, 14 nt, Human
aauugcacuuuuaa

SEQ ID NO: 2189562 - RNA, 21 nt, Human
aauugcacaauauugaacuuu

SEQ ID NO: 2189563 - RNA, 14 nt, Human
aauugcacucuaaa

SEQ ID NO: 2189564 - RNA, 18 nt, Human
aauugcaaaucuugaaau

SEQ ID NO: 2189565 - RNA, 14 nt, Human
aauugcaaaucuug

SEQ ID NO: 2189566 - RNA, 23 nt, Human
aauugauuugcauugaacacaaa

SEQ ID NO: 2189567 - RNA, 20 nt, Human
acaagauuuuaaagacaugu

SEQ ID NO: 2189568 - RNA, 17 nt, Human
acaagcccccccuucca

SEQ ID NO: 2189569 - RNA, 18 nt, Human
acaagcccccccuuccac

SEQ ID NO: 2189570 - RNA, 14 nt, Human
acaagcccccccuu

SEQ ID NO: 2189571 - RNA, 17 nt, Human
acaagccccaggcaggc

SEQ ID NO: 2189572 - RNA, 16 nt, Human
acaagccccaggcagg

SEQ ID NO: 2189573 - RNA, 17 nt, Human
acaagauucccagagac

SEQ ID NO: 2189574 - RNA, 16 nt, Human
acaagauucccagaga

SEQ ID NO: 2189575 - RNA, 15 nt, Human
acaagauucccagag

SEQ ID NO: 2189576 - RNA, 20 nt, Human
acaagaucuuucaggaaaga

SEQ ID NO: 2189577 - RNA, 16 nt, Human
acaagaucuuucagga

SEQ ID NO: 2189578 - RNA, 15 nt, Human
acaagaucuuucagg

SEQ ID NO: 2189579 - RNA, 14 nt, Human
acaagauucccaga

SEQ ID NO: 2189580 - RNA, 21 nt, Human
acaagauucccagagacagga

SEQ ID NO: 2189581 - RNA, 18 nt, Human
acaagauucccagagaca

SEQ ID NO: 2189582 - RNA, 19 nt, Human
acaagccccaggcaggcug

SEQ ID NO: 2189583 - RNA, 17 nt, Human
acaagcgugagccacug

SEQ ID NO: 2189584 - RNA, 13 nt, Human
acaagcuccaagc

SEQ ID NO: 2189585 - RNA, 22 nt, Human
acaagcucacagaccuuugaac

SEQ ID NO: 2189586 - RNA, 18 nt, Human
acaagauagagagcuauu

SEQ ID NO: 2189587 - RNA, 18 nt, Human
acaagaguuuauuuccaa

SEQ ID NO: 2189588 - RNA, 17 nt, Human
acaagagcgaaacuccg

SEQ ID NO: 2189589 - RNA, 16 nt, Human
acaagagcgaaacucc

SEQ ID NO: 2189590 - RNA, 14 nt, Human
acaagaucuuucag

SEQ ID NO: 2189591 - RNA, 13 nt, Human
acaagaucuuuca

SEQ ID NO: 2189592 - RNA, 22 nt, Human
acaagaguuuauuuccaaauaa

SEQ ID NO: 2189593 - RNA, 19 nt, Human
acaagagcuuaacagugug

SEQ ID NO: 2189594 - RNA, 18 nt, Human
acaagagcuuaacagugu

SEQ ID NO: 2189595 - RNA, 22 nt, Human
acaagagcccaggccuccuaca

SEQ ID NO: 2189596 - RNA, 17 nt, Human
acaagaccacguuucua

SEQ ID NO: 2189597 - RNA, 14 nt, Human
acaagacacaguga

SEQ ID NO: 2189598 - RNA, 15 nt, Human
acaagacagaagcug

SEQ ID NO: 2189599 - RNA, 19 nt, Human
acaagaccaccacuucgaa

SEQ ID NO: 2189600 - RNA, 16 nt, Human
acaagaccacguuucu

SEQ ID NO: 2189601 - RNA, 13 nt, Human
acaaauguaugau

SEQ ID NO: 2189602 - RNA, 12 nt, Human
acaaauucuguu

SEQ ID NO: 2189603 - RNA, 16 nt, Human
acaaauucuguuucuu

SEQ ID NO: 2189604 - RNA, 15 nt, Human
acaaauucuguuucu

SEQ ID NO: 2189605 - RNA, 22 nt, Human
acaaauugaacucuuugaauga

SEQ ID NO: 2189606 - RNA, 20 nt, Human
acaaauugcuuacuuuggaa

SEQ ID NO: 2189607 - RNA, 18 nt, Human
acaaauugcuugaaagaa

SEQ ID NO: 2189608 - RNA, 16 nt, Human
acaacagauuugugaa

SEQ ID NO: 2189609 - RNA, 17 nt, Human
acaacagauuugugaac

SEQ ID NO: 2189610 - RNA, 17 nt, Human
acaaauuuacagagaca

SEQ ID NO: 2189611 - RNA, 13 nt, Human
acaagacacagug

SEQ ID NO: 2189612 - RNA, 17 nt, Human
acaacaucuuuuucuac

SEQ ID NO: 2189613 - RNA, 17 nt, Human
acaacagugcuaaaaau

SEQ ID NO: 2189614 - RNA, 23 nt, Human
acaacagugcuaaaaaugggacu

SEQ ID NO: 2189615 - RNA, 18 nt, Human
acaacagauuugugaacu

SEQ ID NO: 2189616 - RNA, 16 nt, Human
acaaauggaggccugu

SEQ ID NO: 2189617 - RNA, 22 nt, Human
acaaaugcugcgcccuucccca

SEQ ID NO: 2189618 - RNA, 15 nt, Human
acaaauggacauagg

SEQ ID NO: 2189619 - RNA, 20 nt, Human
acaaaugccacacaucaccc

SEQ ID NO: 2189620 - RNA, 16 nt, Human
acaaaugccacacauc

SEQ ID NO: 2189621 - RNA, 21 nt, Human
acaaauucugucucuggauua

SEQ ID NO: 2189622 - RNA, 15 nt, Human
acaaaugccacacau

SEQ ID NO: 2189623 - RNA, 17 nt, Human
uagcaagacacaucccu

SEQ ID NO: 2189624 - RNA, 12 nt, Human
uagcaagacaca

SEQ ID NO: 2189625 - RNA, 17 nt, Human
uagcaaauguuuugaca

SEQ ID NO: 2189626 - RNA, 21 nt, Human
uagcaaauguuuugacaugaa

SEQ ID NO: 2189627 - RNA, 23 nt, Human
uagcaaauaauuuccugguguga

SEQ ID NO: 2189628 - RNA, 12 nt, Human
uagcaaauacau

SEQ ID NO: 2189629 - RNA, 24 nt, Human
uagcaagauugcuuaaaauagcaa

SEQ ID NO: 2189630 - RNA, 20 nt, Human
uagcaagauugcuuaaaaua

SEQ ID NO: 2189631 - RNA, 18 nt, Human
uagcaagacacaucccua

SEQ ID NO: 2189632 - RNA, 18 nt, Human
uagcaagugaauuuuucu

SEQ ID NO: 2189633 - RNA, 16 nt, Human
uagcaaggcaugaugu

SEQ ID NO: 2189634 - RNA, 22 nt, Human
uagcaagugaauuuuucucuaa

SEQ ID NO: 2189635 - RNA, 18 nt, Human
acaauacucauaauguga

SEQ ID NO: 2189636 - RNA, 21 nt, Human
acaauaaaauuuuuuuucaug

SEQ ID NO: 2189637 - RNA, 19 nt, Human
acaauacucauaaugugaa

SEQ ID NO: 2189638 - RNA, 20 nt, Human
acaauacucauaaugugaag

SEQ ID NO: 2189639 - RNA, 20 nt, Human
acaauaaaauuuuuuuucau

SEQ ID NO: 2189640 - RNA, 20 nt, Human
acaauaaaaauggcucagau

SEQ ID NO: 2189641 - RNA, 20 nt, Human
acaauagcuuuacccucagg

SEQ ID NO: 2189642 - RNA, 19 nt, Human
acaauagcuuuacccucag

SEQ ID NO: 2189643 - RNA, 18 nt, Human
acaauaguaaccugggua

SEQ ID NO: 2189644 - RNA, 21 nt, Human
acaauacucauaaugugaagu

SEQ ID NO: 2189645 - RNA, 15 nt, Human
acaaguuuuucuguc

SEQ ID NO: 2189646 - RNA, 16 nt, Human
acaaguuuuucuguca

SEQ ID NO: 2189647 - RNA, 22 nt, Human
acaaguuuuucugucaagaaga

SEQ ID NO: 2189648 - RNA, 15 nt, Human
acaaguuguguuuga

SEQ ID NO: 2189649 - RNA, 14 nt, Human
acaaguuuuaaaua

SEQ ID NO: 2189650 - RNA, 16 nt, Human
acaauaaaaauguuua

SEQ ID NO: 2189651 - RNA, 14 nt, Human
acaauaaaaauguu

SEQ ID NO: 2189652 - RNA, 12 nt, Human
acaauaaaacau

SEQ ID NO: 2189653 - RNA, 16 nt, Human
acaauaaaacauuaau

SEQ ID NO: 2189654 - RNA, 15 nt, Human
acaauauugacuuug

SEQ ID NO: 2189655 - RNA, 18 nt, Human
acaauauugacuuugucu

SEQ ID NO: 2189656 - RNA, 14 nt, Human
acaauauugaacuu

SEQ ID NO: 2189657 - RNA, 12 nt, Human
acaaucucaaau

SEQ ID NO: 2189658 - RNA, 20 nt, Human
acaaucucggcucacugcau

SEQ ID NO: 2189659 - RNA, 18 nt, Human
acaaucucggcucacugc

SEQ ID NO: 2189660 - RNA, 21 nt, Human
acaauaugaauacagggcaug

SEQ ID NO: 2189661 - RNA, 14 nt, Human
acaauaugcaaugu

SEQ ID NO: 2189662 - RNA, 15 nt, Human
acaauaugaauacag

SEQ ID NO: 2189663 - RNA, 19 nt, Human
acaauaugcaaugugaagc

SEQ ID NO: 2189664 - RNA, 18 nt, Human
acaauauaaaacuguacu

SEQ ID NO: 2189665 - RNA, 19 nt, Human
acaauauaaaacuguacuu

SEQ ID NO: 2189666 - RNA, 21 nt, Human
acaauauaaccacaaagcaca

SEQ ID NO: 2189667 - RNA, 16 nt, Human
acaagcuccuggucuu

SEQ ID NO: 2189668 - RNA, 22 nt, Human
acaagcugcaaaucagccaugu

SEQ ID NO: 2189669 - RNA, 15 nt, Human
acaagcucccaggcc

SEQ ID NO: 2189670 - RNA, 14 nt, Human
acaaguuguguuug

SEQ ID NO: 2189671 - RNA, 22 nt, Human
acaagcuccaagcucccaggca

SEQ ID NO: 2189672 - RNA, 15 nt, Human
acaagcuccaagcuc

SEQ ID NO: 2189673 - RNA, 16 nt, Human
acaagcuccaagcucc

SEQ ID NO: 2189674 - RNA, 17 nt, Human
acaagcuccaagcuccc

SEQ ID NO: 2189675 - RNA, 19 nt, Human
acaagcuccaagcucccag

SEQ ID NO: 2189676 - RNA, 18 nt, Human
acaaucugacauucucag

SEQ ID NO: 2189677 - RNA, 20 nt, Human
acaaucuuaaggggcagcuu

SEQ ID NO: 2189678 - RNA, 18 nt, Human
acaaucuuaaggggcagc

SEQ ID NO: 2189679 - RNA, 19 nt, Human
acaaucuuaaggggcagcu

SEQ ID NO: 2189680 - RNA, 18 nt, Human
acaaugaagauaaaaaga

SEQ ID NO: 2189681 - RNA, 13 nt, Human
uagccuuccucca

SEQ ID NO: 2189682 - RNA, 15 nt, Human
uagccuucucuguuc

SEQ ID NO: 2189683 - RNA, 14 nt, Human
uagccuucucuguu

SEQ ID NO: 2189684 - RNA, 13 nt, Human
uagccuucucugu

SEQ ID NO: 2189685 - RNA, 18 nt, Human
uagccuuccuccacaucc

SEQ ID NO: 2189686 - RNA, 23 nt, Human
uagccuuccuccacauccuuucu

SEQ ID NO: 2189687 - RNA, 22 nt, Human
uagccuugcccggauucuggga

SEQ ID NO: 2189688 - RNA, 22 nt, Human
uagccuucucuguucauuuccu

SEQ ID NO: 2189689 - RNA, 20 nt, Human
uagccuucucuguucauuuc

SEQ ID NO: 2189690 - RNA, 16 nt, Human
uagccuucucuguuca

SEQ ID NO: 2189691 - RNA, 16 nt, Human
uagccuuuggcucugg

SEQ ID NO: 2189692 - RNA, 18 nt, Human
uagccuuuggcucuggag

SEQ ID NO: 2189693 - RNA, 16 nt, Human
uagcuacuaauuuuaa

SEQ ID NO: 2189694 - RNA, 21 nt, Human
uagcuuacaagccagcuggag

SEQ ID NO: 2189695 - RNA, 15 nt, Human
uagcuuagaccucag

SEQ ID NO: 2189696 - RNA, 16 nt, Human
uagcuuaccagaagcu

SEQ ID NO: 2189697 - RNA, 16 nt, Human
uagcucaggugucccu

SEQ ID NO: 2189698 - RNA, 22 nt, Human
uagcucaggaccugggaccucc

SEQ ID NO: 2189699 - RNA, 19 nt, Human
uagcuauuuuuauggaauu

SEQ ID NO: 2189700 - RNA, 17 nt, Human
uagcuauuuuuauggaa

SEQ ID NO: 2189701 - RNA, 16 nt, Human
uagcuauuuuuaugga

SEQ ID NO: 2189702 - RNA, 11 nt, Human
uagcuauuuuu

SEQ ID NO: 2189703 - RNA, 17 nt, Human
uagcucaaacguggcuu

SEQ ID NO: 2189704 - RNA, 18 nt, Human
uagcucaaacguggcuuu

SEQ ID NO: 2189705 - RNA, 20 nt, Human
uagcuagaagugggccagga

SEQ ID NO: 2189706 - RNA, 13 nt, Human
uagcuauuacugu

SEQ ID NO: 2189707 - RNA, 14 nt, Human
uagcuauuacuguc

SEQ ID NO: 2189708 - RNA, 15 nt, Human
uagcuauuacugucu

SEQ ID NO: 2189709 - RNA, 21 nt, Human
uagcuaucagaagaccacaaa

SEQ ID NO: 2189710 - RNA, 23 nt, Human
uagcuacaggaagcaccccaugc

SEQ ID NO: 2189711 - RNA, 19 nt, Human
uagcuagaagugggccagg

SEQ ID NO: 2189712 - RNA, 14 nt, Human
uagcuagaaguggg

SEQ ID NO: 2189713 - RNA, 19 nt, Human
uagcuagaaauaugauuuu

SEQ ID NO: 2189714 - RNA, 20 nt, Human
aauuuuuuuuuuuuaacuuu

SEQ ID NO: 2189715 - RNA, 15 nt, Human
aauuuuuuuucaugu

SEQ ID NO: 2189716 - RNA, 19 nt, Human
aauuuuuuuuuccuagccc

SEQ ID NO: 2189717 - RNA, 23 nt, Human
aauuuuuuuucauguuuuaacaa

SEQ ID NO: 2189718 - RNA, 23 nt, Human
acaaaacuacaugagaacaaaca

SEQ ID NO: 2189719 - RNA, 17 nt, Human
acaaaacuacaugagaa

SEQ ID NO: 2189720 - RNA, 16 nt, Human
acaaaacuagagacuc

SEQ ID NO: 2189721 - RNA, 14 nt, Human
acaaaacuuuucua

SEQ ID NO: 2189722 - RNA, 11 nt, Human
acaaaacuucc

SEQ ID NO: 2189723 - RNA, 19 nt, Human
acaaagccaaacucugcca

SEQ ID NO: 2189724 - RNA, 23 nt, Human
acaaaagcaagacuguugcucaa

SEQ ID NO: 2189725 - RNA, 11 nt, Human
acaaagccaga

SEQ ID NO: 2189726 - RNA, 17 nt, Human
acaaagccaacagucaa

SEQ ID NO: 2189727 - RNA, 14 nt, Human
acaaagcagccacg

SEQ ID NO: 2189728 - RNA, 20 nt, Human
acaaagccagaagcugagca

SEQ ID NO: 2189729 - RNA, 16 nt, Human
acaaagccagaagcug

SEQ ID NO: 2189730 - RNA, 13 nt, Human
acaaagcccaagg

SEQ ID NO: 2189731 - RNA, 11 nt, Human
acaaagcccaa

SEQ ID NO: 2189732 - RNA, 18 nt, Human
acaaagcccuuccauguc

SEQ ID NO: 2189733 - RNA, 20 nt, Human
acaaagcccaagggaucugg

SEQ ID NO: 2189734 - RNA, 18 nt, Human
acaaagccuuaucaagug

SEQ ID NO: 2189735 - RNA, 21 nt, Human
acaaagcgugguggacaugca

SEQ ID NO: 2189736 - RNA, 23 nt, Human
acaaaguuacuagguaacuucau

SEQ ID NO: 2189737 - RNA, 21 nt, Human
acaaaguuacuagguaacuuc

SEQ ID NO: 2189738 - RNA, 15 nt, Human
acaaaguuguaugug

SEQ ID NO: 2189739 - RNA, 16 nt, Human
acaaaguguguauuaa

SEQ ID NO: 2189740 - RNA, 17 nt, Human
acaaaguguguauuaaa

SEQ ID NO: 2189741 - RNA, 18 nt, Human
acaaaguguguauuaaaa

SEQ ID NO: 2189742 - RNA, 19 nt, Human
acaaaguguguauuaaaaa

SEQ ID NO: 2189743 - RNA, 18 nt, Human
acaaagugagacagucca

SEQ ID NO: 2189744 - RNA, 12 nt, Human
acaaagugugua

SEQ ID NO: 2189745 - RNA, 13 nt, Human
acaaaguguguau

SEQ ID NO: 2189746 - RNA, 15 nt, Human
acaaaguguguauua

SEQ ID NO: 2189747 - RNA, 19 nt, Human
acaaagccuuaucaagugu

SEQ ID NO: 2189748 - RNA, 23 nt, Human
acaaagccuuaucaagugucuuc

SEQ ID NO: 2189749 - RNA, 16 nt, Human
acaaagcuuagcagga

SEQ ID NO: 2189750 - RNA, 19 nt, Human
acaaagcuuagcaggagag

SEQ ID NO: 2189751 - RNA, 21 nt, Human
acaaagcuuagcaggagagga

SEQ ID NO: 2189752 - RNA, 20 nt, Human
acaaagcuucuaucccagga

SEQ ID NO: 2189753 - RNA, 21 nt, Human
acaaagcuucuaucccaggag

SEQ ID NO: 2189754 - RNA, 22 nt, Human
acaaagcuucuaucccaggagg

SEQ ID NO: 2189755 - RNA, 23 nt, Human
acaaagcuuggaagagccugcag

SEQ ID NO: 2189756 - RNA, 23 nt, Human
acaaagcuucuaucccaggaggu

SEQ ID NO: 2189757 - RNA, 16 nt, Human
uagauccacacacaga

SEQ ID NO: 2189758 - RNA, 16 nt, Human
uagauagguaaauacc

SEQ ID NO: 2189759 - RNA, 17 nt, Human
uagauaguuagaaccug

SEQ ID NO: 2189760 - RNA, 17 nt, Human
uagauaggccaugggca

SEQ ID NO: 2189761 - RNA, 22 nt, Human
uagauaggucagugcaaauacu

SEQ ID NO: 2189762 - RNA, 11 nt, Human
acaaauaugca

SEQ ID NO: 2189763 - RNA, 19 nt, Human
acaaauauaagaauaaaau

SEQ ID NO: 2189764 - RNA, 19 nt, Human
acaaauaugcaaaagguuc

SEQ ID NO: 2189765 - RNA, 14 nt, Human
acaaauauaagaau

SEQ ID NO: 2189766 - RNA, 15 nt, Human
acaaauauaagaaua

SEQ ID NO: 2189767 - RNA, 16 nt, Human
acaaauauaagaauaa

SEQ ID NO: 2189768 - RNA, 17 nt, Human
acaaauauaagaauaaa

SEQ ID NO: 2189769 - RNA, 12 nt, Human
acaaauaugcaa

SEQ ID NO: 2189770 - RNA, 23 nt, Human
acaaauauuuauuuucuuucugu

SEQ ID NO: 2189771 - RNA, 22 nt, Human
acaaauauuuauuuucuuucug

SEQ ID NO: 2189772 - RNA, 18 nt, Human
acaaauauuuauuuucuu

SEQ ID NO: 2189773 - RNA, 12 nt, Human
acaaauauuuau

SEQ ID NO: 2189774 - RNA, 19 nt, Human
uagcaaagauaucucaucu

SEQ ID NO: 2189775 - RNA, 17 nt, Human
uagcaaagauaucucau

SEQ ID NO: 2189776 - RNA, 22 nt, Human
uagaugcucuaugugcuuguaa

SEQ ID NO: 2189777 - RNA, 10 nt, Human
uagaugcuga

SEQ ID NO: 2189778 - RNA, 21 nt, Human
uagaugcaguucugaagaaga

SEQ ID NO: 2189779 - RNA, 20 nt, Human
uagaugcaguucugaagaag

SEQ ID NO: 2189780 - RNA, 19 nt, Human
uagaucuccaggagaacug

SEQ ID NO: 2189781 - RNA, 18 nt, Human
uagauccacacacagagg

SEQ ID NO: 2189782 - RNA, 15 nt, Human
uagaucccccagacu

SEQ ID NO: 2189783 - RNA, 16 nt, Human
uagaugaaguuuuaca

SEQ ID NO: 2189784 - RNA, 15 nt, Human
uagaugaacucaacu

SEQ ID NO: 2189785 - RNA, 22 nt, Human
uagaugaaaaagcauguacagu

SEQ ID NO: 2189786 - RNA, 23 nt, Human
uagaugaaaaagcauguacagug

SEQ ID NO: 2189787 - RNA, 13 nt, Human
uagaugaaaaagc

SEQ ID NO: 2189788 - RNA, 17 nt, Human
uagaugaaaaagcaugu

SEQ ID NO: 2189789 - RNA, 18 nt, Human
uagaugaaaaagcaugua

SEQ ID NO: 2189790 - RNA, 19 nt, Human
uagaugaaaaagcauguac

SEQ ID NO: 2189791 - RNA, 20 nt, Human
uagaugaaaaagcauguaca

SEQ ID NO: 2189792 - RNA, 21 nt, Human
uagaugaaaaagcauguacag

SEQ ID NO: 2189793 - RNA, 20 nt, Human
aauuuuuaaaguauauauuu

SEQ ID NO: 2189794 - RNA, 19 nt, Human
aauuuuuaaaguauauauu

SEQ ID NO: 2189795 - RNA, 13 nt, Human
aauuuuuaaagua

SEQ ID NO: 2189796 - RNA, 22 nt, Human
aauuuuuaaucuuuaauuuuac

SEQ ID NO: 2189797 - RNA, 14 nt, Human
aauuuguuugugcu

SEQ ID NO: 2189798 - RNA, 15 nt, Human
aauuuguuugugcuu

SEQ ID NO: 2189799 - RNA, 16 nt, Human
aauuuguuugugcuuc

SEQ ID NO: 2189800 - RNA, 18 nt, Human
aauuuguugaaauuaugu

SEQ ID NO: 2189801 - RNA, 12 nt, Human
aauuuguugcau

SEQ ID NO: 2189802 - RNA, 17 nt, Human
aauuuguuugaaaucuu

SEQ ID NO: 2189803 - RNA, 13 nt, Human
aauuuguuugugc

SEQ ID NO: 2189804 - RNA, 22 nt, Human
aauuuuuaaaguauauauuuau

SEQ ID NO: 2189805 - RNA, 20 nt, Human
aauuuuuaaauguaaaacau

SEQ ID NO: 2189806 - RNA, 13 nt, Human
aauuuuuaagcaa

SEQ ID NO: 2189807 - RNA, 21 nt, Human
aauuuuucuuauuucauuucu

SEQ ID NO: 2189808 - RNA, 20 nt, Human
aauuuuugccuucauuaccu

SEQ ID NO: 2189809 - RNA, 17 nt, Human
aauuuuugccuucauua

SEQ ID NO: 2189810 - RNA, 16 nt, Human
aauuuuugccuucauu

SEQ ID NO: 2189811 - RNA, 14 nt, Human
aauuuuuuuucaug

SEQ ID NO: 2189812 - RNA, 22 nt, Human
aauuuuuuuaucgucacugcuu

SEQ ID NO: 2189813 - RNA, 18 nt, Human
aauuuuuuuagaaagcau

SEQ ID NO: 2189814 - RNA, 20 nt, Human
aauuuuuuuagaaagcauuu

SEQ ID NO: 2189815 - RNA, 19 nt, Human
aauuuuuuuaaccaaaggu

SEQ ID NO: 2189816 - RNA, 20 nt, Human
aauuuuuuuaaccaaaggug

SEQ ID NO: 2189817 - RNA, 15 nt, Human
aauuuuuuuagaaag

SEQ ID NO: 2189818 - RNA, 18 nt, Human
aauuuuuuuaauuuugua

SEQ ID NO: 2189819 - RNA, 20 nt, Human
aauuuuuuuaauuuuguauu

SEQ ID NO: 2189820 - RNA, 19 nt, Human
aauuuuuuuaauuuacaaa

SEQ ID NO: 2189821 - RNA, 16 nt, Human
aauuuuuuuaauuuug

SEQ ID NO: 2189822 - RNA, 17 nt, Human
aauuuuuuuaauuuugu

SEQ ID NO: 2189823 - RNA, 16 nt, Human
aauuuuugguugaaua

SEQ ID NO: 2189824 - RNA, 14 nt, Human
aauuuuugguugaa

SEQ ID NO: 2189825 - RNA, 18 nt, Human
aauuuuugguugaauaaa

SEQ ID NO: 2189826 - RNA, 14 nt, Human
aauuuuuguaauuu

SEQ ID NO: 2189827 - RNA, 22 nt, Human
aauuuuuucucuaggaaauauu

SEQ ID NO: 2189828 - RNA, 23 nt, Human
uacuuuguugcaaguacugcugu

SEQ ID NO: 2189829 - RNA, 21 nt, Human
uacuuuuaaacagugagccug

SEQ ID NO: 2189830 - RNA, 13 nt, Human
uacuuuuuccugg

SEQ ID NO: 2189831 - RNA, 15 nt, Human
uacuuuuaaacugug

SEQ ID NO: 2189832 - RNA, 14 nt, Human
uacuuuuaaacugu

SEQ ID NO: 2189833 - RNA, 17 nt, Human
aauuugcauuaaauuca

SEQ ID NO: 2189834 - RNA, 21 nt, Human
aauuugcauuaaauucacaaa

SEQ ID NO: 2189835 - RNA, 18 nt, Human
aauuugcauuaaauucac

SEQ ID NO: 2189836 - RNA, 14 nt, Human
uacuuuuuuucaca

SEQ ID NO: 2189837 - RNA, 15 nt, Human
aauuugcauuaaauu

SEQ ID NO: 2189838 - RNA, 14 nt, Human
uacuuuuuucuuau

SEQ ID NO: 2189839 - RNA, 18 nt, Human
uacuuuuuucuuauuuaa

SEQ ID NO: 2189840 - RNA, 13 nt, Human
uacuuuuuguuau

SEQ ID NO: 2189841 - RNA, 15 nt, Human
aauuugcccucccau

SEQ ID NO: 2189842 - RNA, 23 nt, Human
aauuugcauuaaauucacaaacu

SEQ ID NO: 2189843 - RNA, 16 nt, Human
aauuugcuucacucaa

SEQ ID NO: 2189844 - RNA, 16 nt, Human
aauuugguucuaauag

SEQ ID NO: 2189845 - RNA, 21 nt, Human
aauuugggggacuuacaugau

SEQ ID NO: 2189846 - RNA, 18 nt, Human
aauuugggggacuuacau

SEQ ID NO: 2189847 - RNA, 22 nt, Human
aauuugguucuaauagaacuca

SEQ ID NO: 2189848 - RNA, 17 nt, Human
aauuugguucuaggccg

SEQ ID NO: 2189849 - RNA, 24 nt, Human
aauuuguaaaaacagcauugcuuu

SEQ ID NO: 2189850 - RNA, 23 nt, Human
aauuuguaaaaacagcauugcuu

SEQ ID NO: 2189851 - RNA, 22 nt, Human
aauuuguaaaaacagcauugcu

SEQ ID NO: 2189852 - RNA, 16 nt, Human
aauuuguuauaaugaa

SEQ ID NO: 2189853 - RNA, 18 nt, Human
aauuuguuauuuugcaac

SEQ ID NO: 2189854 - RNA, 21 nt, Human
aauaaccacuuaaaaaauguc

SEQ ID NO: 2189855 - RNA, 14 nt, Human
aauaaccacuuaaa

SEQ ID NO: 2189856 - RNA, 14 nt, Human
aauaacauuaccuu

SEQ ID NO: 2189857 - RNA, 15 nt, Human
aauaacauuaccuua

SEQ ID NO: 2189858 - RNA, 20 nt, Human
aauaacauuaccuuacugug

SEQ ID NO: 2189859 - RNA, 13 nt, Human
aauaacauuugug

SEQ ID NO: 2189860 - RNA, 20 nt, Human
aauaacacacauauaaacau

SEQ ID NO: 2189861 - RNA, 12 nt, Human
aauaacacacau

SEQ ID NO: 2189862 - RNA, 15 nt, Human
aauaacacacagcua

SEQ ID NO: 2189863 - RNA, 13 nt, Human
aauaacauuaccu

SEQ ID NO: 2189864 - RNA, 13 nt, Human
aauaaauuguuug

SEQ ID NO: 2189865 - RNA, 13 nt, Human
aauaacaaugugc

SEQ ID NO: 2189866 - RNA, 13 nt, Human
aauaacaauguua

SEQ ID NO: 2189867 - RNA, 19 nt, Human
aauaacaaugugcucucgg

SEQ ID NO: 2189868 - RNA, 14 nt, Human
aauaacaauguuaa

SEQ ID NO: 2189869 - RNA, 15 nt, Human
aauaacaauguuaag

SEQ ID NO: 2189870 - RNA, 20 nt, Human
aauaacaauguuaaggaaac

SEQ ID NO: 2189871 - RNA, 24 nt, Human
aauaacaauguuaaggaaacucuu

SEQ ID NO: 2189872 - RNA, 18 nt, Human
aauaacccuuugguuuuu

SEQ ID NO: 2189873 - RNA, 22 nt, Human
aauaaccacuuaaaaaaugucc

SEQ ID NO: 2189874 - RNA, 18 nt, Human
aauaaccucaaagugacu

SEQ ID NO: 2189875 - RNA, 17 nt, Human
aauaaccggauauauac

SEQ ID NO: 2189876 - RNA, 15 nt, Human
aauaacgauaaaaga

SEQ ID NO: 2189877 - RNA, 19 nt, Human
aauaacucuguggcauuau

SEQ ID NO: 2189878 - RNA, 21 nt, Human
aauaacuccuucuuguaguag

SEQ ID NO: 2189879 - RNA, 13 nt, Human
aauaacugugaag

SEQ ID NO: 2189880 - RNA, 17 nt, Human
aauaaaugucauuaaaa

SEQ ID NO: 2189881 - RNA, 13 nt, Human
aauaaaugucauu

SEQ ID NO: 2189882 - RNA, 20 nt, Human
aauaaauguaucuuauucac

SEQ ID NO: 2189883 - RNA, 21 nt, Human
aauaaauguaucuuauucaca

SEQ ID NO: 2189884 - RNA, 17 nt, Human
aauaaaugguauagcaa

SEQ ID NO: 2189885 - RNA, 21 nt, Human
aauaaaugguauagcaaaugu

SEQ ID NO: 2189886 - RNA, 22 nt, Human
aauaaaugguauagcaaauguu

SEQ ID NO: 2189887 - RNA, 23 nt, Human
aauaaaugguauagcaaauguuu

SEQ ID NO: 2189888 - RNA, 13 nt, Human
aauaaaugucuuu

SEQ ID NO: 2189889 - RNA, 23 nt, Human
aauaaaugucuuuuuuuuaaugu

SEQ ID NO: 2189890 - RNA, 12 nt, Human
aauaaaugucuu

SEQ ID NO: 2189891 - RNA, 14 nt, Human
aauaaaugucuugc

SEQ ID NO: 2189892 - RNA, 16 nt, Human
aauaaauugcuccuug

SEQ ID NO: 2189893 - RNA, 20 nt, Human
aauaaauugcuccuugacau

SEQ ID NO: 2189894 - RNA, 20 nt, Human
aauaaauuguaauuguaaag

SEQ ID NO: 2189895 - RNA, 12 nt, Human
aauaaauuguau

SEQ ID NO: 2189896 - RNA, 13 nt, Human
aauaaauuguaua

SEQ ID NO: 2189897 - RNA, 15 nt, Human
aauaaauuguauauu

SEQ ID NO: 2189898 - RNA, 16 nt, Human
aauaaauuguauauuc

SEQ ID NO: 2189899 - RNA, 17 nt, Human
aauaaauuguauauuca

SEQ ID NO: 2189900 - RNA, 18 nt, Human
aauaaauuguauauucac

SEQ ID NO: 2189901 - RNA, 21 nt, Human
aauaacaaugaaaguugauaa

SEQ ID NO: 2189902 - RNA, 14 nt, Human
aauaaauauuuaug

SEQ ID NO: 2189903 - RNA, 21 nt, Human
aauaaaucauuaauacucuuc

SEQ ID NO: 2189904 - RNA, 15 nt, Human
aauaaaucugaccca

SEQ ID NO: 2189905 - RNA, 16 nt, Human
aauaaaucauaaaacu

SEQ ID NO: 2189906 - RNA, 19 nt, Human
aauaaaugcaauauguauu

SEQ ID NO: 2189907 - RNA, 17 nt, Human
aauaaaugcaauaugua

SEQ ID NO: 2189908 - RNA, 22 nt, Human
aauaaaugagcuauguauuaac

SEQ ID NO: 2189909 - RNA, 16 nt, Human
aauaaaugagcuaugu

SEQ ID NO: 2189910 - RNA, 18 nt, Human
aauaaaugagcuauguau

SEQ ID NO: 2189911 - RNA, 20 nt, Human
aauaaaucugguagaaaaau

SEQ ID NO: 2189912 - RNA, 22 nt, Human
aauaaaucuguugccaagcugg

SEQ ID NO: 2189913 - RNA, 20 nt, Human
aauaaaucugacccagugcc

SEQ ID NO: 2189914 - RNA, 17 nt, Human
aauaaaucugacccagu

SEQ ID NO: 2189915 - RNA, 16 nt, Human
aauaaaucugacccag

SEQ ID NO: 2189916 - RNA, 19 nt, Human
aauaaauaugccucuccuu

SEQ ID NO: 2189917 - RNA, 20 nt, Human
aauaaauaugccucuccuuu

SEQ ID NO: 2189918 - RNA, 13 nt, Human
aauaaauaugagu

SEQ ID NO: 2189919 - RNA, 11 nt, Human
aauaaauaugc

SEQ ID NO: 2189920 - RNA, 13 nt, Human
aauaaauaugccu

SEQ ID NO: 2189921 - RNA, 16 nt, Human
aauaaauaugccucuc

SEQ ID NO: 2189922 - RNA, 19 nt, Human
aauaaaguucugaguguuu

SEQ ID NO: 2189923 - RNA, 15 nt, Human
aauaaauaucuguac

SEQ ID NO: 2189924 - RNA, 10 nt, Human
aauaaauaug

SEQ ID NO: 2189925 - RNA, 11 nt, Human
aauaaauauga

SEQ ID NO: 2189926 - RNA, 20 nt, Human
aauaaaguauuuaauuagug

SEQ ID NO: 2189927 - RNA, 21 nt, Human
aauaaaguauuuaauuagugc

SEQ ID NO: 2189928 - RNA, 22 nt, Human
aauaaaguauuuaauuagugcu

SEQ ID NO: 2189929 - RNA, 23 nt, Human
aauaaaguauuuaauuagugcua

SEQ ID NO: 2189930 - RNA, 22 nt, Human
aauaaaaccuuucaaauuucac

SEQ ID NO: 2189931 - RNA, 21 nt, Human
aauaaaaccuuucaaauuuca

SEQ ID NO: 2189932 - RNA, 16 nt, Human
aauaaaaccuuucaaa

SEQ ID NO: 2189933 - RNA, 15 nt, Human
aauaaaaccuuucaa

SEQ ID NO: 2189934 - RNA, 12 nt, Human
aauaaaacuuuu

SEQ ID NO: 2189935 - RNA, 15 nt, Human
aauaaaacuuuuuaa

SEQ ID NO: 2189936 - RNA, 14 nt, Human
aauaaaacuuuuua

SEQ ID NO: 2189937 - RNA, 16 nt, Human
aauaaaguaucuacau

SEQ ID NO: 2189938 - RNA, 15 nt, Human
aauaaaguaucuaca

SEQ ID NO: 2189939 - RNA, 14 nt, Human
aauaaaguaucuac

SEQ ID NO: 2189940 - RNA, 13 nt, Human
aauaaaguauuua

SEQ ID NO: 2189941 - RNA, 14 nt, Human
aauaaaguauuuaa

SEQ ID NO: 2189942 - RNA, 15 nt, Human
aauaaaguauuuaau

SEQ ID NO: 2189943 - RNA, 16 nt, Human
aauaaaguauuuaauu

SEQ ID NO: 2189944 - RNA, 19 nt, Human
aauaaaguauuuaauuagu

SEQ ID NO: 2189945 - RNA, 23 nt, Human
aauaaaaccuuucaaauuucaca

SEQ ID NO: 2189946 - RNA, 15 nt, Human
aauaaaacuggcuuu

SEQ ID NO: 2189947 - RNA, 18 nt, Human
aauaaaacuuuuuaaaau

SEQ ID NO: 2189948 - RNA, 19 nt, Human
aauaaaacauuuucacaca

SEQ ID NO: 2189949 - RNA, 17 nt, Human
aauaaaacauuuucaca

SEQ ID NO: 2189950 - RNA, 11 nt, Human
aauaaaacauu

SEQ ID NO: 2189951 - RNA, 12 nt, Human
aauaaaacauuu

SEQ ID NO: 2189952 - RNA, 13 nt, Human
aauaaaacauuuu

SEQ ID NO: 2189953 - RNA, 23 nt, Human
aauaaaacauuuuaaauggacag

SEQ ID NO: 2189954 - RNA, 14 nt, Human
aauaaaaccuuuca

SEQ ID NO: 2189955 - RNA, 13 nt, Human
aauaaaaccuuuc

SEQ ID NO: 2189956 - RNA, 12 nt, Human
aauaaaaccuuu

SEQ ID NO: 2189957 - RNA, 13 nt, Human
aauaaaaccagcu

SEQ ID NO: 2189958 - RNA, 15 nt, Human
aauaaaaaguuaaaa

SEQ ID NO: 2189959 - RNA, 20 nt, Human
aauaaaaagugacacagcag

SEQ ID NO: 2189960 - RNA, 14 nt, Human
aauaaaaaguuaaa

SEQ ID NO: 2189961 - RNA, 13 nt, Human
aauaaaaaguuaa

SEQ ID NO: 2189962 - RNA, 12 nt, Human
aauaaaaaguua

SEQ ID NO: 2189963 - RNA, 13 nt, Human
aauaaaaagugac

SEQ ID NO: 2189964 - RNA, 19 nt, Human
aauaaaaagugacacagca

SEQ ID NO: 2189965 - RNA, 18 nt, Human
aauaaaaaggcaccuaua

SEQ ID NO: 2189966 - RNA, 13 nt, Human
aauaaaaaggcac

SEQ ID NO: 2189967 - RNA, 11 nt, Human
aauaaaaaggc

SEQ ID NO: 2189968 - RNA, 15 nt, Human
aauaaaaaaaagaaa

SEQ ID NO: 2189969 - RNA, 23 nt, Human
aauaaaaagaucacuuucucagu

SEQ ID NO: 2189970 - RNA, 12 nt, Human
aaguuuuuguac

SEQ ID NO: 2189971 - RNA, 13 nt, Human
aaguuuuuguacu

SEQ ID NO: 2189972 - RNA, 14 nt, Human
aaguuuuuguacug

SEQ ID NO: 2189973 - RNA, 17 nt, Human
aaguuuuuguacuguaa

SEQ ID NO: 2189974 - RNA, 14 nt, Human
aauaaaaaaaagaa

SEQ ID NO: 2189975 - RNA, 13 nt, Human
aauaaaaaaaaga

SEQ ID NO: 2189976 - RNA, 19 nt, Human
aauaaaaagaucacuuucu

SEQ ID NO: 2189977 - RNA, 17 nt, Human
aauaaaaagaucacuuu

SEQ ID NO: 2189978 - RNA, 13 nt, Human
aaguuuuguacag

SEQ ID NO: 2189979 - RNA, 14 nt, Human
aaguuuuguacaga

SEQ ID NO: 2189980 - RNA, 19 nt, Human
uaaaguauuuaauuagugc

SEQ ID NO: 2189981 - RNA, 21 nt, Human
uaaaguauuuaauuagugcua

SEQ ID NO: 2189982 - RNA, 22 nt, Human
uaaaguauuuaauuagugcuaa

SEQ ID NO: 2189983 - RNA, 20 nt, Human
aaguuuuuauggcuuuugug

SEQ ID NO: 2189984 - RNA, 13 nt, Human
uaaaguauucuuc

SEQ ID NO: 2189985 - RNA, 14 nt, Human
uaaaguauucuucu

SEQ ID NO: 2189986 - RNA, 18 nt, Human
uaaaguauucuucucuuc

SEQ ID NO: 2189987 - RNA, 12 nt, Human
uaaaguauuuaa

SEQ ID NO: 2189988 - RNA, 14 nt, Human
uaaaguauuuaauu

SEQ ID NO: 2189989 - RNA, 16 nt, Human
uaaaguauuuaauuag

SEQ ID NO: 2189990 - RNA, 17 nt, Human
uaaaguauuuaauuagu

SEQ ID NO: 2189991 - RNA, 21 nt, Human
uaaaguauguaaaguauguaa

SEQ ID NO: 2189992 - RNA, 22 nt, Human
uaaaguauguaaaguauguaaa

SEQ ID NO: 2189993 - RNA, 13 nt, Human
uaaaguauguaaa

SEQ ID NO: 2189994 - RNA, 15 nt, Human
uaaaguauguaaaca

SEQ ID NO: 2189995 - RNA, 16 nt, Human
uaaaguauguaaacag

SEQ ID NO: 2189996 - RNA, 22 nt, Human
uaaaguauguaaacaggagaca

SEQ ID NO: 2189997 - RNA, 15 nt, Human
uaaaguaucaugcau

SEQ ID NO: 2189998 - RNA, 16 nt, Human
uaaaguaucaugcauu

SEQ ID NO: 2189999 - RNA, 17 nt, Human
uaaaguaucaugcauuc

SEQ ID NO: 2190000 - RNA, 14 nt, Human
uaaaguaugaaucu

SEQ ID NO: 2190001 - RNA, 15 nt, Human
uaaaguaugaaucua

SEQ ID NO: 2190002 - RNA, 16 nt, Human
uaaaguaugaaucuau

SEQ ID NO: 2190003 - RNA, 19 nt, Human
uaaaguaugaaucuaugcc

SEQ ID NO: 2190004 - RNA, 19 nt, Human
uaaaguaugguauugaaac

SEQ ID NO: 2190005 - RNA, 23 nt, Human
guuuugaacuaauaaaagcauaa

SEQ ID NO: 2190006 - RNA, 19 nt, Human
guuuugaagcuacugugug

SEQ ID NO: 2190007 - RNA, 18 nt, Human
uaaaggguguacuuauau

SEQ ID NO: 2190008 - RNA, 20 nt, Human
uaaagguggugaggcaauaa

SEQ ID NO: 2190009 - RNA, 23 nt, Human
uaaaggugguauguguguguaug

SEQ ID NO: 2190010 - RNA, 22 nt, Human
uaaaggugguauguguguguau

SEQ ID NO: 2190011 - RNA, 21 nt, Human
uaaaggugguaugugugugua

SEQ ID NO: 2190012 - RNA, 17 nt, Human
uaaaggugguaugugug

SEQ ID NO: 2190013 - RNA, 21 nt, Human
uaaagguggugaggcaauaaa

SEQ ID NO: 2190014 - RNA, 17 nt, Human
uaaaggugucuuccucc

SEQ ID NO: 2190015 - RNA, 19 nt, Human
uaaaggugucuuccuccca

SEQ ID NO: 2190016 - RNA, 20 nt, Human
uaaaggugucuuccucccaa

SEQ ID NO: 2190017 - RNA, 22 nt, Human
uaaagguuacaagccugcacaa

SEQ ID NO: 2190018 - RNA, 22 nt, Human
guuuugaacuaauaaaagcaua

SEQ ID NO: 2190019 - RNA, 17 nt, Human
guuuugaacuaauaaaa

SEQ ID NO: 2190020 - RNA, 13 nt, Human
guuuugaaaugcu

SEQ ID NO: 2190021 - RNA, 13 nt, Human
guuuugaaaagcu

SEQ ID NO: 2190022 - RNA, 14 nt, Human
guuuugaaaagcua

SEQ ID NO: 2190023 - RNA, 15 nt, Human
guuuugaaaagcuau

SEQ ID NO: 2190024 - RNA, 21 nt, Human
guuuugaaaagcuauuagcca

SEQ ID NO: 2190025 - RNA, 18 nt, Human
guuuugaagcuacugugu

SEQ ID NO: 2190026 - RNA, 14 nt, Human
guuuucuuugaaug

SEQ ID NO: 2190027 - RNA, 14 nt, Human
uaaaguauauauuu

SEQ ID NO: 2190028 - RNA, 19 nt, Human
uaaaguauauauagaaucu

SEQ ID NO: 2190029 - RNA, 17 nt, Human
uaaaguauauauuuauu

SEQ ID NO: 2190030 - RNA, 14 nt, Human
uaaaguaucaugca

SEQ ID NO: 2190031 - RNA, 20 nt, Human
uaaaguaucaggauacuaua

SEQ ID NO: 2190032 - RNA, 21 nt, Human
uaaaguagauuagaucuuuua

SEQ ID NO: 2190033 - RNA, 19 nt, Human
uaaaguaguaaaaauuaaa

SEQ ID NO: 2190034 - RNA, 17 nt, Human
uaaaguaguccugugaa

SEQ ID NO: 2190035 - RNA, 20 nt, Human
uaaagguugacaauaaaugu

SEQ ID NO: 2190036 - RNA, 13 nt, Human
uaaaguaaagcua

SEQ ID NO: 2190037 - RNA, 14 nt, Human
uaaaguaaagcuaa

SEQ ID NO: 2190038 - RNA, 15 nt, Human
uaaaguaaagcuaaa

SEQ ID NO: 2190039 - RNA, 17 nt, Human
uaaaguaaagcuaaaau

SEQ ID NO: 2190040 - RNA, 22 nt, Human
uaaagguucaugcaaacuuuau

SEQ ID NO: 2190041 - RNA, 19 nt, Human
uaaaguaaaaacaaagaaa

SEQ ID NO: 2190042 - RNA, 21 nt, Human
uaaaguaaaaacaaagaaauu

SEQ ID NO: 2190043 - RNA, 22 nt, Human
uaaaguaaaaacaaagaaauua

SEQ ID NO: 2190044 - RNA, 12 nt, Human
aauaacuuuuuu

SEQ ID NO: 2190045 - RNA, 12 nt, Human
aauaagaaaaga

SEQ ID NO: 2190046 - RNA, 13 nt, Human
aauaagaauagaa

SEQ ID NO: 2190047 - RNA, 22 nt, Human
aauaagaaacaacucuuugaga

SEQ ID NO: 2190048 - RNA, 15 nt, Human
aauaagaaaguuuca

SEQ ID NO: 2190049 - RNA, 20 nt, Human
aauaacugugaaguuuacau

SEQ ID NO: 2190050 - RNA, 14 nt, Human
aauaacugugaagu

SEQ ID NO: 2190051 - RNA, 16 nt, Human
aauaacugugaaguuu

SEQ ID NO: 2190052 - RNA, 20 nt, Human
aauaauugauuucaagaccu

SEQ ID NO: 2190053 - RNA, 16 nt, Human
aauaauugcagaacua

SEQ ID NO: 2190054 - RNA, 21 nt, Human
aauaauugcagaacuaaacuc

SEQ ID NO: 2190055 - RNA, 14 nt, Human
aauaauugguucuu

SEQ ID NO: 2190056 - RNA, 21 nt, Human
aauaauugaucaaauucauuu

SEQ ID NO: 2190057 - RNA, 18 nt, Human
aauaauuauuuauuuaau

SEQ ID NO: 2190058 - RNA, 20 nt, Human
aauaagagagucauaaaccu

SEQ ID NO: 2190059 - RNA, 15 nt, Human
aauaagagaaagaaa

SEQ ID NO: 2190060 - RNA, 17 nt, Human
aauaagacauaacguuu

SEQ ID NO: 2190061 - RNA, 14 nt, Human
aauaagagaaagaa

SEQ ID NO: 2190062 - RNA, 18 nt, Human
aauaagaauagaaauaaa

SEQ ID NO: 2190063 - RNA, 14 nt, Human
aauaagaaugauuu

SEQ ID NO: 2190064 - RNA, 14 nt, Human
aauaagaauuuagg

SEQ ID NO: 2190065 - RNA, 16 nt, Human
aauaauuuuuauauuu

SEQ ID NO: 2190066 - RNA, 17 nt, Human
aauaauuuuuauauuug

SEQ ID NO: 2190067 - RNA, 19 nt, Human
aauaauuuuuauauuugaa

SEQ ID NO: 2190068 - RNA, 22 nt, Human
aauaauuucccaauuaggaagu

SEQ ID NO: 2190069 - RNA, 20 nt, Human
aauaauuuccuggugugaag

SEQ ID NO: 2190070 - RNA, 21 nt, Human
aauaauuuccuggugugaagg

SEQ ID NO: 2190071 - RNA, 16 nt, Human
aauaauuuuaaacaaa

SEQ ID NO: 2190072 - RNA, 21 nt, Human
aauaauuuuaagaaaucaaag

SEQ ID NO: 2190073 - RNA, 13 nt, Human
uaaauaacuuuuu

SEQ ID NO: 2190074 - RNA, 15 nt, Human
uaaauaaauauauau

SEQ ID NO: 2190075 - RNA, 16 nt, Human
uaaauaaaucauuaau

SEQ ID NO: 2190076 - RNA, 22 nt, Human
uaaauaagaaacaacucuuuga

SEQ ID NO: 2190077 - RNA, 21 nt, Human
uaaauaagaaacaacucuuug

SEQ ID NO: 2190078 - RNA, 20 nt, Human
uaaauaaguuugcaauuugg

SEQ ID NO: 2190079 - RNA, 19 nt, Human
uaaauaaugugaaacugga

SEQ ID NO: 2190080 - RNA, 22 nt, Human
uaaauaccucaaccuaugguau

SEQ ID NO: 2190081 - RNA, 13 nt, Human
uaaauaccucuua

SEQ ID NO: 2190082 - RNA, 23 nt, Human
uaaauaccucuuagcugagugga

SEQ ID NO: 2190083 - RNA, 17 nt, Human
uaaauaccagacacgua

SEQ ID NO: 2190084 - RNA, 23 nt, Human
uaaauacagucuuccauuugcaa

SEQ ID NO: 2190085 - RNA, 22 nt, Human
uaaauacagucuuccauuugca

SEQ ID NO: 2190086 - RNA, 20 nt, Human
uaaauacagucuuccauuug

SEQ ID NO: 2190087 - RNA, 18 nt, Human
uaaauacagacacuaagu

SEQ ID NO: 2190088 - RNA, 19 nt, Human
uaaauacagacacuaaguu

SEQ ID NO: 2190089 - RNA, 22 nt, Human
uaaauacagacacuaaguuaua

SEQ ID NO: 2190090 - RNA, 17 nt, Human
uaaauacagucuuccau

SEQ ID NO: 2190091 - RNA, 13 nt, Human
uaaauacagucuu

SEQ ID NO: 2190092 - RNA, 18 nt, Human
aauacaacuuaaauaaua

SEQ ID NO: 2190093 - RNA, 20 nt, Human
aauacaaacauauuuguuaa

SEQ ID NO: 2190094 - RNA, 17 nt, Human
aauacaaacauauuugu

SEQ ID NO: 2190095 - RNA, 21 nt, Human
aauacaaacauauuuguuaaa

SEQ ID NO: 2190096 - RNA, 13 nt, Human
aauacaaacaaug

SEQ ID NO: 2190097 - RNA, 17 nt, Human
aauacaaacaccuggac

SEQ ID NO: 2190098 - RNA, 13 nt, Human
aauacaaaacuuc

SEQ ID NO: 2190099 - RNA, 21 nt, Human
aauacaaaaaauuagccgggc

SEQ ID NO: 2190100 - RNA, 20 nt, Human
aauacaaaaauuagccgggc

SEQ ID NO: 2190101 - RNA, 12 nt, Human
aauacaaaacuu

SEQ ID NO: 2190102 - RNA, 20 nt, Human
aauaauuuuuauauuugaaa

SEQ ID NO: 2190103 - RNA, 12 nt, Human
uaaauaaaguuu

SEQ ID NO: 2190104 - RNA, 21 nt, Human
uaaauaaaguuuguugaaaca

SEQ ID NO: 2190105 - RNA, 21 nt, Human
uaaauaaaguaucaugcauuc

SEQ ID NO: 2190106 - RNA, 12 nt, Human
uaaauaaauaua

SEQ ID NO: 2190107 - RNA, 13 nt, Human
uaaauaaauauau

SEQ ID NO: 2190108 - RNA, 14 nt, Human
uaaauaaauauaua

SEQ ID NO: 2190109 - RNA, 22 nt, Human
aauacaacauguagcugaguuu

SEQ ID NO: 2190110 - RNA, 14 nt, Human
uaaauaaaguauca

SEQ ID NO: 2190111 - RNA, 15 nt, Human
uaaauaaaguaucau

SEQ ID NO: 2190112 - RNA, 20 nt, Human
uaaauaaaguaucaugcauu

SEQ ID NO: 2190113 - RNA, 24 nt, Human
uaaauguuuuuuuuuaaagacuuu

SEQ ID NO: 2190114 - RNA, 14 nt, Human
uaaauuaacuuuua

SEQ ID NO: 2190115 - RNA, 12 nt, Human
uaaauuaacuuu

SEQ ID NO: 2190116 - RNA, 16 nt, Human
uaaauuaacuuuuaua

SEQ ID NO: 2190117 - RNA, 15 nt, Human
uaaauuaacuuuuau

SEQ ID NO: 2190118 - RNA, 17 nt, Human
uaaauuaacuuuuauaa

SEQ ID NO: 2190119 - RNA, 18 nt, Human
uaaauuaacuuuuauaaa

SEQ ID NO: 2190120 - RNA, 17 nt, Human
uaaauuuugaguucuac

SEQ ID NO: 2190121 - RNA, 20 nt, Human
uaaauguugaaagaucaaaa

SEQ ID NO: 2190122 - RNA, 23 nt, Human
uaaauguuuuuuuuuaaagacuu

SEQ ID NO: 2190123 - RNA, 15 nt, Human
uaaauguugaaagau

SEQ ID NO: 2190124 - RNA, 18 nt, Human
uaaaugcaauauguauua

SEQ ID NO: 2190125 - RNA, 19 nt, Human
uaaaugcaauauuaaugcc

SEQ ID NO: 2190126 - RNA, 15 nt, Human
uaaaugcaauaugua

SEQ ID NO: 2190127 - RNA, 14 nt, Human
uaaaugcaauaugu

SEQ ID NO: 2190128 - RNA, 14 nt, Human
uaaaucuuuuacaa

SEQ ID NO: 2190129 - RNA, 23 nt, Human
uaaaugcaccuggaauauauaac

SEQ ID NO: 2190130 - RNA, 21 nt, Human
uaaaugcauauccugagccau

SEQ ID NO: 2190131 - RNA, 20 nt, Human
uaaaugcauauccugagcca

SEQ ID NO: 2190132 - RNA, 16 nt, Human
uaaaugcauaaaugca

SEQ ID NO: 2190133 - RNA, 14 nt, Human
uaaaugcauuauag

SEQ ID NO: 2190134 - RNA, 22 nt, Human
uaaaugcagcgaaccaauauuu

SEQ ID NO: 2190135 - RNA, 10 nt, Human
uaaaugcaua

SEQ ID NO: 2190136 - RNA, 14 nt, Human
uaaaucucuaauau

SEQ ID NO: 2190137 - RNA, 15 nt, Human
uaaaucucuaauaug

SEQ ID NO: 2190138 - RNA, 18 nt, Human
uaaaucucuaauauggca

SEQ ID NO: 2190139 - RNA, 14 nt, Human
uaaaucugacccag

SEQ ID NO: 2190140 - RNA, 20 nt, Human
uaaaucuaugaaguauauaa

SEQ ID NO: 2190141 - RNA, 22 nt, Human
uaaaucuccaaaauaaaacuuu

SEQ ID NO: 2190142 - RNA, 20 nt, Human
uaaaucugcuggaguuucau

SEQ ID NO: 2190143 - RNA, 17 nt, Human
uaaaucugacccagugc

SEQ ID NO: 2190144 - RNA, 16 nt, Human
uaaaucugacccagug

SEQ ID NO: 2190145 - RNA, 15 nt, Human
uaaaucugacccagu

SEQ ID NO: 2190146 - RNA, 15 nt, Human
uaaaucugugaugau

SEQ ID NO: 2190147 - RNA, 13 nt, Human
uaaaucugugaug

SEQ ID NO: 2190148 - RNA, 14 nt, Human
uaaaucugugauga

SEQ ID NO: 2190149 - RNA, 18 nt, Human
uaaaucuguugccaagcu

SEQ ID NO: 2190150 - RNA, 20 nt, Human
uaaaucuguugccaagcugg

SEQ ID NO: 2190151 - RNA, 12 nt, Human
uaaaucugugau

SEQ ID NO: 2190152 - RNA, 18 nt, Human
uaaauagaguuugcuauu

SEQ ID NO: 2190153 - RNA, 18 nt, Human
uaaauagaguauaugcac

SEQ ID NO: 2190154 - RNA, 12 nt, Human
uaaauagcaugu

SEQ ID NO: 2190155 - RNA, 13 nt, Human
uaaauagcaugua

SEQ ID NO: 2190156 - RNA, 14 nt, Human
uaaauagcauguau

SEQ ID NO: 2190157 - RNA, 15 nt, Human
uaaauagcauguauu

SEQ ID NO: 2190158 - RNA, 18 nt, Human
uaaauagcauguauugug

SEQ ID NO: 2190159 - RNA, 18 nt, Human
uaaaucuccaaaauaaaa

SEQ ID NO: 2190160 - RNA, 15 nt, Human
uaaaucuccaaaaua

SEQ ID NO: 2190161 - RNA, 14 nt, Human
uaaaucuccaaaau

SEQ ID NO: 2190162 - RNA, 21 nt, Human
uaaaucuaguauacauugucu

SEQ ID NO: 2190163 - RNA, 19 nt, Human
uaaauagcauguauugugu

SEQ ID NO: 2190164 - RNA, 21 nt, Human
uaaauagcauguauugugucu

SEQ ID NO: 2190165 - RNA, 15 nt, Human
uaaauagcauucucu

SEQ ID NO: 2190166 - RNA, 19 nt, Human
uaaaucuaugaaguauaua

SEQ ID NO: 2190167 - RNA, 21 nt, Human
uaaaucuaugaaguauauaau

SEQ ID NO: 2190168 - RNA, 21 nt, Human
aauagcuuuacccucaggcau

SEQ ID NO: 2190169 - RNA, 17 nt, Human
aauagcuuuuauuguau

SEQ ID NO: 2190170 - RNA, 19 nt, Human
aauaggaaaaacugauuuu

SEQ ID NO: 2190171 - RNA, 17 nt, Human
aauaggaaaaacugauu

SEQ ID NO: 2190172 - RNA, 18 nt, Human
aauaggaaaaacugauuu

SEQ ID NO: 2190173 - RNA, 23 nt, Human
aauagcuauauccauguacugua

SEQ ID NO: 2190174 - RNA, 19 nt, Human
aauagcucuuucagggggg

SEQ ID NO: 2190175 - RNA, 22 nt, Human
aauagcuauauccauguacugu

SEQ ID NO: 2190176 - RNA, 14 nt, Human
aauagcuuguauag

SEQ ID NO: 2190177 - RNA, 19 nt, Human
aauagcuuguauaguguaa

SEQ ID NO: 2190178 - RNA, 15 nt, Human
aauaggaaaaacuga

SEQ ID NO: 2190179 - RNA, 16 nt, Human
aauaggaaaaacugau

SEQ ID NO: 2190180 - RNA, 13 nt, Human
aauaggcaaaggg

SEQ ID NO: 2190181 - RNA, 23 nt, Human
aauaggagaggaugagagcccag

SEQ ID NO: 2190182 - RNA, 20 nt, Human
aauaggagaggaugagagcc

SEQ ID NO: 2190183 - RNA, 13 nt, Human
aauaggagaggau

SEQ ID NO: 2190184 - RNA, 15 nt, Human
aauaggagaggauga

SEQ ID NO: 2190185 - RNA, 18 nt, Human
aauaggcguaacuaauuu

SEQ ID NO: 2190186 - RNA, 13 nt, Human
aauaguaauguuu

SEQ ID NO: 2190187 - RNA, 14 nt, Human
aauaguauccucca

SEQ ID NO: 2190188 - RNA, 22 nt, Human
aauaguaaaagauaacaagauc

SEQ ID NO: 2190189 - RNA, 22 nt, Human
aauaggcgaucacaacgugcau

SEQ ID NO: 2190190 - RNA, 21 nt, Human
aauagggcugagcucucugug

SEQ ID NO: 2190191 - RNA, 21 nt, Human
aauagauauccacuugagaca

SEQ ID NO: 2190192 - RNA, 22 nt, Human
aauagaguuugcuauuagagca

SEQ ID NO: 2190193 - RNA, 20 nt, Human
aauagauaagaguagaaacu

SEQ ID NO: 2190194 - RNA, 20 nt, Human
aauagacaguauauuuauag

SEQ ID NO: 2190195 - RNA, 15 nt, Human
aauagacaguauauu

SEQ ID NO: 2190196 - RNA, 18 nt, Human
aauagacccacaagaggc

SEQ ID NO: 2190197 - RNA, 23 nt, Human
aauagacaauuuauuauggcaca

SEQ ID NO: 2190198 - RNA, 23 nt, Human
aauagacacuccccgaagucuuu

SEQ ID NO: 2190199 - RNA, 22 nt, Human
aauagacacuccccgaagucuu

SEQ ID NO: 2190200 - RNA, 14 nt, Human
uaaauuuuuuuccu

SEQ ID NO: 2190201 - RNA, 18 nt, Human
uaaauuaaaacugaauug

SEQ ID NO: 2190202 - RNA, 20 nt, Human
uaaauuuugucuuuaacuca

SEQ ID NO: 2190203 - RNA, 18 nt, Human
uaaauuuugaguucuaca

SEQ ID NO: 2190204 - RNA, 19 nt, Human
uaaauuuugaguucuacau

SEQ ID NO: 2190205 - RNA, 15 nt, Human
uaaauuuugugucuc

SEQ ID NO: 2190206 - RNA, 17 nt, Human
uaaauuuuguaugaaaa

SEQ ID NO: 2190207 - RNA, 13 nt, Human
uaaauuuugugau

SEQ ID NO: 2190208 - RNA, 18 nt, Human
aauagacaauuuauuaug

SEQ ID NO: 2190209 - RNA, 23 nt, Human
aauagccacugcauaccaaccug

SEQ ID NO: 2190210 - RNA, 20 nt, Human
aauagccacuuaccuucaau

SEQ ID NO: 2190211 - RNA, 22 nt, Human
aauagccaacacccaucuguuu

SEQ ID NO: 2190212 - RNA, 22 nt, Human
aauagccacuuaccuucaauaa

SEQ ID NO: 2190213 - RNA, 20 nt, Human
aauagccugccucuucucua

SEQ ID NO: 2190214 - RNA, 13 nt, Human
aauagcugggacu

SEQ ID NO: 2190215 - RNA, 14 nt, Human
aauagcugggacua

SEQ ID NO: 2190216 - RNA, 23 nt, Human
aauagccacauuuggaauacuuu

SEQ ID NO: 2190217 - RNA, 22 nt, Human
aauagccacauuuggaauacuu

SEQ ID NO: 2190218 - RNA, 20 nt, Human
aauagccacauuuggaauac

SEQ ID NO: 2190219 - RNA, 21 nt, Human
aauagccaacacccaucuguu

SEQ ID NO: 2190220 - RNA, 16 nt, Human
aauagaugcugacugu

SEQ ID NO: 2190221 - RNA, 15 nt, Human
aauagauuauaguug

SEQ ID NO: 2190222 - RNA, 16 nt, Human
uaacauaauuuguaca

SEQ ID NO: 2190223 - RNA, 14 nt, Human
uaacaugauuuggg

SEQ ID NO: 2190224 - RNA, 19 nt, Human
uaacauaauuuguacauau

SEQ ID NO: 2190225 - RNA, 14 nt, Human
uaacauggaaguac

SEQ ID NO: 2190226 - RNA, 19 nt, Human
uaaccugccagggagacag

SEQ ID NO: 2190227 - RNA, 20 nt, Human
uaaccugaccgugggcgggg

SEQ ID NO: 2190228 - RNA, 17 nt, Human
uaaccucuucagaggcc

SEQ ID NO: 2190229 - RNA, 14 nt, Human
uaaccucugcacua

SEQ ID NO: 2190230 - RNA, 16 nt, Human
uaacauggaaguacua

SEQ ID NO: 2190231 - RNA, 15 nt, Human
uaacauggaaguacu

SEQ ID NO: 2190232 - RNA, 15 nt, Human
uaacuaaaagguaug

SEQ ID NO: 2190233 - RNA, 19 nt, Human
uaaccuguacuucaaguua

SEQ ID NO: 2190234 - RNA, 23 nt, Human
uaaccuggugcuggauauuuuca

SEQ ID NO: 2190235 - RNA, 22 nt, Human
uaaccuggugcuggauauuuuc

SEQ ID NO: 2190236 - RNA, 19 nt, Human
uaaccuggugcuggauauu

SEQ ID NO: 2190237 - RNA, 18 nt, Human
uaaccuggugcuggauau

SEQ ID NO: 2190238 - RNA, 15 nt, Human
uaaccuggugcugga

SEQ ID NO: 2190239 - RNA, 12 nt, Human
uaaccuggugcu

SEQ ID NO: 2190240 - RNA, 14 nt, Human
uaacuaaaagguau

SEQ ID NO: 2190241 - RNA, 18 nt, Human
aauaucaucaguauugaa

SEQ ID NO: 2190242 - RNA, 15 nt, Human
aauaucacuugucaa

SEQ ID NO: 2190243 - RNA, 23 nt, Human
aauaucauuuauuuuuuacauua

SEQ ID NO: 2190244 - RNA, 13 nt, Human
aauaucauuuauu

SEQ ID NO: 2190245 - RNA, 16 nt, Human
aauauccccucccagu

SEQ ID NO: 2190246 - RNA, 16 nt, Human
aauaucccuacaugua

SEQ ID NO: 2190247 - RNA, 17 nt, Human
aauaucccuacauguau

SEQ ID NO: 2190248 - RNA, 18 nt, Human
aauaucccuacauguauu

SEQ ID NO: 2190249 - RNA, 19 nt, Human
aauaucccuacauguauug

SEQ ID NO: 2190250 - RNA, 13 nt, Human
aauauauguuuac

SEQ ID NO: 2190251 - RNA, 20 nt, Human
aauauauguuuaccuuuuaa

SEQ ID NO: 2190252 - RNA, 12 nt, Human
aauauauguuua

SEQ ID NO: 2190253 - RNA, 16 nt, Human
aauauauuauaaucuu

SEQ ID NO: 2190254 - RNA, 13 nt, Human
aauauauuauaau

SEQ ID NO: 2190255 - RNA, 23 nt, Human
aauauauguuuaccuuuuaauua

SEQ ID NO: 2190256 - RNA, 12 nt, Human
aauaucacuugu

SEQ ID NO: 2190257 - RNA, 13 nt, Human
aauaguauuuaug

SEQ ID NO: 2190258 - RNA, 21 nt, Human
aauaguauccuccagguuuuu

SEQ ID NO: 2190259 - RNA, 23 nt, Human
aauaguauccuccagguuuuuca

SEQ ID NO: 2190260 - RNA, 15 nt, Human
aauaguauccuccag

SEQ ID NO: 2190261 - RNA, 17 nt, Human
aauaguauccuccaggu

SEQ ID NO: 2190262 - RNA, 18 nt, Human
aauaguauccuccagguu

SEQ ID NO: 2190263 - RNA, 20 nt, Human
aauaguauccuccagguuuu

SEQ ID NO: 2190264 - RNA, 18 nt, Human
aauaguauuuaugaaaug

SEQ ID NO: 2190265 - RNA, 21 nt, Human
aauauauggcagaguuguaaa

SEQ ID NO: 2190266 - RNA, 22 nt, Human
aauauauggcagaguuguaaau

SEQ ID NO: 2190267 - RNA, 15 nt, Human
aauaguauuugagag

SEQ ID NO: 2190268 - RNA, 23 nt, Human
aauauauggcagaguuguaaaua

SEQ ID NO: 2190269 - RNA, 12 nt, Human
aauauccuuugc

SEQ ID NO: 2190270 - RNA, 11 nt, Human
uaagaccuggc

SEQ ID NO: 2190271 - RNA, 13 nt, Human
uaagaccuggcag

SEQ ID NO: 2190272 - RNA, 18 nt, Human
aauaucuaauaaaaaguc

SEQ ID NO: 2190273 - RNA, 19 nt, Human
aauaucugaaaauguaugu

SEQ ID NO: 2190274 - RNA, 18 nt, Human
aauaucugaaaauguaug

SEQ ID NO: 2190275 - RNA, 17 nt, Human
aauaucugaaaauguau

SEQ ID NO: 2190276 - RNA, 16 nt, Human
aauaucugaaaaugua

SEQ ID NO: 2190277 - RNA, 16 nt, Human
aauaugagaaucagau

SEQ ID NO: 2190278 - RNA, 19 nt, Human
aauaugaggcauuuggcau

SEQ ID NO: 2190279 - RNA, 21 nt, Human
aauaugacggaagaacauaga

SEQ ID NO: 2190280 - RNA, 17 nt, Human
aauaugacggaagaaca

SEQ ID NO: 2190281 - RNA, 22 nt, Human
aauaugacagcugucccuguca

SEQ ID NO: 2190282 - RNA, 16 nt, Human
aauaugacagcugucc

SEQ ID NO: 2190283 - RNA, 22 nt, Human
aauaugaaugcccccagcuggc

SEQ ID NO: 2190284 - RNA, 12 nt, Human
aauaugaagcuc

SEQ ID NO: 2190285 - RNA, 12 nt, Human
aauaugaaugcc

SEQ ID NO: 2190286 - RNA, 18 nt, Human
aauaugaauacagggcau

SEQ ID NO: 2190287 - RNA, 18 nt, Human
aauaugaagcucaccugu

SEQ ID NO: 2190288 - RNA, 19 nt, Human
aauaugaacggugagcauu

SEQ ID NO: 2190289 - RNA, 14 nt, Human
aauaugaaaacuua

SEQ ID NO: 2190290 - RNA, 13 nt, Human
aauaugaaaacuu

SEQ ID NO: 2190291 - RNA, 15 nt, Human
aauaucuuuugaccu

SEQ ID NO: 2190292 - RNA, 19 nt, Human
aauaucuuuuuuuuaauaa

SEQ ID NO: 2190293 - RNA, 13 nt, Human
aauaucugggauu

SEQ ID NO: 2190294 - RNA, 21 nt, Human
aauaucugggauucuacuuua

SEQ ID NO: 2190295 - RNA, 13 nt, Human
aauaucugaaaug

SEQ ID NO: 2190296 - RNA, 20 nt, Human
aauaucugaaaauguaugug

SEQ ID NO: 2190297 - RNA, 13 nt, Human
aauaucuguauuu

SEQ ID NO: 2190298 - RNA, 14 nt, Human
aauaucuguauuua

SEQ ID NO: 2190299 - RNA, 20 nt, Human
aauaucuguauuuaauuuug

SEQ ID NO: 2190300 - RNA, 21 nt, Human
aauaucuguauuuaauuuuga

SEQ ID NO: 2190301 - RNA, 22 nt, Human
aauaucuguauuuaauuuugac

SEQ ID NO: 2190302 - RNA, 23 nt, Human
aauaucuguauuuaauuuugaca

SEQ ID NO: 2190303 - RNA, 17 nt, Human
uaacuacuguguuccug

SEQ ID NO: 2190304 - RNA, 16 nt, Human
uaacuacuguguuccu

SEQ ID NO: 2190305 - RNA, 15 nt, Human
uaacuacuguguucc

SEQ ID NO: 2190306 - RNA, 14 nt, Human
uaacuacuguguuc

SEQ ID NO: 2190307 - RNA, 12 nt, Human
uaacuacugugu

SEQ ID NO: 2190308 - RNA, 21 nt, Human
uaacuacuccggagacagggu

SEQ ID NO: 2190309 - RNA, 17 nt, Human
uaacuacuccggagaca

SEQ ID NO: 2190310 - RNA, 15 nt, Human
uaacuuuuauaaacu

SEQ ID NO: 2190311 - RNA, 18 nt, Human
uaacuuuuauaaacuuua

SEQ ID NO: 2190312 - RNA, 17 nt, Human
uaacuuuuauaaacuuu

SEQ ID NO: 2190313 - RNA, 16 nt, Human
uaacuaaauuaacauu

SEQ ID NO: 2190314 - RNA, 14 nt, Human
uaacuaaauuaaca

SEQ ID NO: 2190315 - RNA, 14 nt, Human
uaacuaaacucucu

SEQ ID NO: 2190316 - RNA, 17 nt, Human
uaacuaaacucucuuug

SEQ ID NO: 2190317 - RNA, 22 nt, Human
uaacuaaucuauuggguucauu

SEQ ID NO: 2190318 - RNA, 19 nt, Human
uaacuaaucuauuggguuc

SEQ ID NO: 2190319 - RNA, 23 nt, Human
uaacuaaucuauuggguucauua

SEQ ID NO: 2190320 - RNA, 23 nt, Human
uaacuaauaugggcauuguaguu

SEQ ID NO: 2190321 - RNA, 13 nt, Human
uaagaaugaaaua

SEQ ID NO: 2190322 - RNA, 14 nt, Human
uaagaaucuuuaga

SEQ ID NO: 2190323 - RNA, 15 nt, Human
uaagaaugcugguuu

SEQ ID NO: 2190324 - RNA, 21 nt, Human
uaagaaugaaauacuguuuga

SEQ ID NO: 2190325 - RNA, 15 nt, Human
uaagaaugaaauacu

SEQ ID NO: 2190326 - RNA, 18 nt, Human
uaagaauauuugaaugua

SEQ ID NO: 2190327 - RNA, 15 nt, Human
uaagaauauuugaau

SEQ ID NO: 2190328 - RNA, 19 nt, Human
uaagaccauaacagccaac

SEQ ID NO: 2190329 - RNA, 21 nt, Human
uaagacaugcacuaugaggaa

SEQ ID NO: 2190330 - RNA, 17 nt, Human
uaagaccaccaccucag

SEQ ID NO: 2190331 - RNA, 18 nt, Human
uaagaccaccaccucaga

SEQ ID NO: 2190332 - RNA, 22 nt, Human
uaagaaugcugguuuuccuaaa

SEQ ID NO: 2190333 - RNA, 17 nt, Human
uaagaaugguugccuua

SEQ ID NO: 2190334 - RNA, 23 nt, Human
uaagaaugcugguuuuccuaaau

SEQ ID NO: 2190335 - RNA, 21 nt, Human
uaagaaugcugguuuuccuaa

SEQ ID NO: 2190336 - RNA, 17 nt, Human
uaagacauuuuuggaag

SEQ ID NO: 2190337 - RNA, 21 nt, Human
uaagacaugauuuccuugaau

SEQ ID NO: 2190338 - RNA, 20 nt, Human
uaagacaugauuuccuugaa

SEQ ID NO: 2190339 - RNA, 21 nt, Human
aauauuuuccaugaaaaugca

SEQ ID NO: 2190340 - RNA, 17 nt, Human
aauauuuuauuauauau

SEQ ID NO: 2190341 - RNA, 11 nt, Human
aauauuuucau

SEQ ID NO: 2190342 - RNA, 18 nt, Human
aauauuuucauacagcau

SEQ ID NO: 2190343 - RNA, 16 nt, Human
aaucacuuaggaaaug

SEQ ID NO: 2190344 - RNA, 11 nt, Human
aaucagaacuc

SEQ ID NO: 2190345 - RNA, 23 nt, Human
aaucagaacucaaauggggccag

SEQ ID NO: 2190346 - RNA, 12 nt, Human
aaucagaacuca

SEQ ID NO: 2190347 - RNA, 13 nt, Human
aauauuuuaagua

SEQ ID NO: 2190348 - RNA, 12 nt, Human
aauauuugaauc

SEQ ID NO: 2190349 - RNA, 13 nt, Human
aauauuugaaucu

SEQ ID NO: 2190350 - RNA, 21 nt, Human
aauauuuccuuaaacugugug

SEQ ID NO: 2190351 - RNA, 15 nt, Human
aauauuuuaaguauu

SEQ ID NO: 2190352 - RNA, 14 nt, Human
aauauuugaaucuu

SEQ ID NO: 2190353 - RNA, 17 nt, Human
aauauuuuaaguauugc

SEQ ID NO: 2190354 - RNA, 18 nt, Human
aauauuuuaaguauugca

SEQ ID NO: 2190355 - RNA, 13 nt, Human
aauauuguacagu

SEQ ID NO: 2190356 - RNA, 18 nt, Human
aauauuguguugugaaug

SEQ ID NO: 2190357 - RNA, 20 nt, Human
aauauugcuuuggucauaug

SEQ ID NO: 2190358 - RNA, 13 nt, Human
aauauuguuucua

SEQ ID NO: 2190359 - RNA, 20 nt, Human
aauauuuaaaauuuauugcu

SEQ ID NO: 2190360 - RNA, 12 nt, Human
aauauuuaaaca

SEQ ID NO: 2190361 - RNA, 14 nt, Human
aauauuuaaacagc

SEQ ID NO: 2190362 - RNA, 15 nt, Human
aauauuucagauaau

SEQ ID NO: 2190363 - RNA, 19 nt, Human
aauauuuccuuaaacugug

SEQ ID NO: 2190364 - RNA, 23 nt, Human
aauauuuccauauggauuuucua

SEQ ID NO: 2190365 - RNA, 11 nt, Human
aauauuugaau

SEQ ID NO: 2190366 - RNA, 17 nt, Human
aauauuuaaacagcagu

SEQ ID NO: 2190367 - RNA, 16 nt, Human
aauauuuaaacagcag

SEQ ID NO: 2190368 - RNA, 13 nt, Human
aauauuuccauau

SEQ ID NO: 2190369 - RNA, 16 nt, Human
aauauuuccauaugga

SEQ ID NO: 2190370 - RNA, 18 nt, Human
aauaugcacacagugcuu

SEQ ID NO: 2190371 - RNA, 17 nt, Human
aauauugauaugcuuau

SEQ ID NO: 2190372 - RNA, 18 nt, Human
aauauugauaugcuuaua

SEQ ID NO: 2190373 - RNA, 15 nt, Human
aauaugcacacauuu

SEQ ID NO: 2190374 - RNA, 24 nt, Human
aauaugcaaagcacugacuucuaa

SEQ ID NO: 2190375 - RNA, 17 nt, Human
aauaugauauugcauau

SEQ ID NO: 2190376 - RNA, 19 nt, Human
aauaugacggaagaacaua

SEQ ID NO: 2190377 - RNA, 11 nt, Human
aauaugaugac

SEQ ID NO: 2190378 - RNA, 22 nt, Human
aauaugauuaguaaagaaauga

SEQ ID NO: 2190379 - RNA, 20 nt, Human
aauaugauuaguaaagaaau

SEQ ID NO: 2190380 - RNA, 12 nt, Human
aauaugauuuua

SEQ ID NO: 2190381 - RNA, 19 nt, Human
aauaugauuaguaaagaaa

SEQ ID NO: 2190382 - RNA, 18 nt, Human
aauaugauuaguaaagaa

SEQ ID NO: 2190383 - RNA, 17 nt, Human
aauaugcaaagcacuga

SEQ ID NO: 2190384 - RNA, 15 nt, Human
aauaugcaaagcacu

SEQ ID NO: 2190385 - RNA, 11 nt, Human
aauauugcuga

SEQ ID NO: 2190386 - RNA, 17 nt, Human
aauaugcaaugugaagc

SEQ ID NO: 2190387 - RNA, 20 nt, Human
aauauugauuucugccuucc

SEQ ID NO: 2190388 - RNA, 12 nt, Human
aauauugcugau

SEQ ID NO: 2190389 - RNA, 13 nt, Human
aauauugcugaug

SEQ ID NO: 2190390 - RNA, 15 nt, Human
aauauugcugauggu

SEQ ID NO: 2190391 - RNA, 18 nt, Human
aauauugcugauggugca

SEQ ID NO: 2190392 - RNA, 21 nt, Human
aauauugcugauggugcaaug

SEQ ID NO: 2190393 - RNA, 22 nt, Human
aauauugcugauggugcaauga

SEQ ID NO: 2190394 - RNA, 16 nt, Human
aaucuagcuuauuuug

SEQ ID NO: 2190395 - RNA, 19 nt, Human
aaucuaguauuucaugcug

SEQ ID NO: 2190396 - RNA, 17 nt, Human
aaucuacuaauuccaca

SEQ ID NO: 2190397 - RNA, 22 nt, Human
aaucuagauaucgacuuguuuu

SEQ ID NO: 2190398 - RNA, 15 nt, Human
aaucucaaauaacua

SEQ ID NO: 2190399 - RNA, 12 nt, Human
aaucucaaauuu

SEQ ID NO: 2190400 - RNA, 22 nt, Human
aaucugucacguagaacuugga

SEQ ID NO: 2190401 - RNA, 14 nt, Human
aaucucaaauuucu

SEQ ID NO: 2190402 - RNA, 21 nt, Human
aaucuguccaaaggaggcugg

SEQ ID NO: 2190403 - RNA, 20 nt, Human
aaucuguccaaaggaggcug

SEQ ID NO: 2190404 - RNA, 20 nt, Human
aaucucaaauucucaaccua

SEQ ID NO: 2190405 - RNA, 16 nt, Human
aaucuuauaauuuaaa

SEQ ID NO: 2190406 - RNA, 14 nt, Human
aaucuuauaauuua

SEQ ID NO: 2190407 - RNA, 16 nt, Human
aauccucacugggugg

SEQ ID NO: 2190408 - RNA, 15 nt, Human
aauccucacugggug

SEQ ID NO: 2190409 - RNA, 21 nt, Human
aauccuaugugauuuuaacuc

SEQ ID NO: 2190410 - RNA, 20 nt, Human
aauccuauucucgggcugag

SEQ ID NO: 2190411 - RNA, 20 nt, Human
aauccuaugugauuuuaacu

SEQ ID NO: 2190412 - RNA, 14 nt, Human
aauccuaugugauu

SEQ ID NO: 2190413 - RNA, 24 nt, Human
aauccuaauuucuccucccuuccu

SEQ ID NO: 2190414 - RNA, 19 nt, Human
aauccuaauuucuccuccc

SEQ ID NO: 2190415 - RNA, 21 nt, Human
aauccuaauuucuccucccuu

SEQ ID NO: 2190416 - RNA, 16 nt, Human
aauccuaauuucuccu

SEQ ID NO: 2190417 - RNA, 16 nt, Human
aauccuaacacauuau

SEQ ID NO: 2190418 - RNA, 17 nt, Human
aauccuaccuguuuugu

SEQ ID NO: 2190419 - RNA, 15 nt, Human
aauccuaccuguuuu

SEQ ID NO: 2190420 - RNA, 12 nt, Human
aaucauuguaca

SEQ ID NO: 2190421 - RNA, 22 nt, Human
aaucauugcuuugaagcaguug

SEQ ID NO: 2190422 - RNA, 13 nt, Human
aaucauuguacag

SEQ ID NO: 2190423 - RNA, 15 nt, Human
aaucauuguacaguu

SEQ ID NO: 2190424 - RNA, 16 nt, Human
aaucauuguacaguuu

SEQ ID NO: 2190425 - RNA, 17 nt, Human
aaucauuguacaguuug

SEQ ID NO: 2190426 - RNA, 18 nt, Human
aaucauuguacaguuugu

SEQ ID NO: 2190427 - RNA, 20 nt, Human
aaucauuguacaguuuguuu

SEQ ID NO: 2190428 - RNA, 14 nt, Human
aaucauugcuuuga

SEQ ID NO: 2190429 - RNA, 19 nt, Human
aaucauugcuuugaagcag

SEQ ID NO: 2190430 - RNA, 21 nt, Human
aaucauugcuuugaagcaguu

SEQ ID NO: 2190431 - RNA, 17 nt, Human
aaucauucucgauuuaa

SEQ ID NO: 2190432 - RNA, 15 nt, Human
aaucauucucgauuu

SEQ ID NO: 2190433 - RNA, 20 nt, Human
aaucauugcugaaaauggua

SEQ ID NO: 2190434 - RNA, 22 nt, Human
aaucauuguacaguuuguuuac

SEQ ID NO: 2190435 - RNA, 19 nt, Human
aaucauuucuauuucuccu

SEQ ID NO: 2190436 - RNA, 12 nt, Human
aaucauuucuau

SEQ ID NO: 2190437 - RNA, 20 nt, Human
aaucauuucuauuucuccuc

SEQ ID NO: 2190438 - RNA, 13 nt, Human
aauccuucuaguu

SEQ ID NO: 2190439 - RNA, 14 nt, Human
aauccuucuaguuu

SEQ ID NO: 2190440 - RNA, 16 nt, Human
aauccuucuaguuucc

SEQ ID NO: 2190441 - RNA, 20 nt, Human
aauccuucuaguuucccaca

SEQ ID NO: 2190442 - RNA, 13 nt, Human
aauccuugaagau

SEQ ID NO: 2190443 - RNA, 12 nt, Human
aaucuaaaugga

SEQ ID NO: 2190444 - RNA, 18 nt, Human
aauccuugcuuaugacau

SEQ ID NO: 2190445 - RNA, 17 nt, Human
aauccuugcuuaugaca

SEQ ID NO: 2190446 - RNA, 13 nt, Human
aauccuugcuuau

SEQ ID NO: 2190447 - RNA, 21 nt, Human
aauccuucuaguuucccacaa

SEQ ID NO: 2190448 - RNA, 20 nt, Human
aaucuaaccacaucaauauu

SEQ ID NO: 2190449 - RNA, 16 nt, Human
aaucuacuaauuccac

SEQ ID NO: 2190450 - RNA, 15 nt, Human
aaucuacuaauucca

SEQ ID NO: 2190451 - RNA, 18 nt, Human
aaucuaaauggaaccacu

SEQ ID NO: 2190452 - RNA, 15 nt, Human
aaucuaaauggaacc

SEQ ID NO: 2190453 - RNA, 13 nt, Human
aaucuaaauggaa

SEQ ID NO: 2190454 - RNA, 17 nt, Human
uaauaaaaguacauguu

SEQ ID NO: 2190455 - RNA, 14 nt, Human
uaauaaaaggaaaa

SEQ ID NO: 2190456 - RNA, 20 nt, Human
uaauaaaaggaaaagcaaau

SEQ ID NO: 2190457 - RNA, 13 nt, Human
uaauaaaauaauu

SEQ ID NO: 2190458 - RNA, 19 nt, Human
uaauaaaauaauucuaaag

SEQ ID NO: 2190459 - RNA, 16 nt, Human
uaauaaaauaauucua

SEQ ID NO: 2190460 - RNA, 18 nt, Human
uaauaaaauaauucuaaa

SEQ ID NO: 2190461 - RNA, 13 nt, Human
uaauaaaaggaaa

SEQ ID NO: 2190462 - RNA, 18 nt, Human
uaaguuugaaggaaacag

SEQ ID NO: 2190463 - RNA, 15 nt, Human
aaucaucaagucuuu

SEQ ID NO: 2190464 - RNA, 15 nt, Human
aaucauccaaugcuc

SEQ ID NO: 2190465 - RNA, 15 nt, Human
aaucaucuauaaaga

SEQ ID NO: 2190466 - RNA, 18 nt, Human
aaucaucuauaaagaaga

SEQ ID NO: 2190467 - RNA, 23 nt, Human
aaucaugaauuaguuuuauaugc

SEQ ID NO: 2190468 - RNA, 19 nt, Human
aaucaugaauuaguuuuau

SEQ ID NO: 2190469 - RNA, 17 nt, Human
aaucaugaauuaguuuu

SEQ ID NO: 2190470 - RNA, 19 nt, Human
aaucauguacauuucugaa

SEQ ID NO: 2190471 - RNA, 16 nt, Human
aaucauguacauuucu

SEQ ID NO: 2190472 - RNA, 14 nt, Human
aaucauguacauuu

SEQ ID NO: 2190473 - RNA, 15 nt, Human
aaucaugguuuuucu

SEQ ID NO: 2190474 - RNA, 21 nt, Human
aaucauggaaugguuauaaaa

SEQ ID NO: 2190475 - RNA, 15 nt, Human
aaucaucugugugaa

SEQ ID NO: 2190476 - RNA, 18 nt, Human
aaucauggaaugguuaua

SEQ ID NO: 2190477 - RNA, 17 nt, Human
aaucauggugcucagag

SEQ ID NO: 2190478 - RNA, 15 nt, Human
aaucaugugaacccg

SEQ ID NO: 2190479 - RNA, 16 nt, Human
aaucaugugaacccgg

SEQ ID NO: 2190480 - RNA, 13 nt, Human
aaucauguaguau

SEQ ID NO: 2190481 - RNA, 18 nt, Human
aaucauguaguaucaaau

SEQ ID NO: 2190482 - RNA, 22 nt, Human
aaucauguaguaucaaauauua

SEQ ID NO: 2190483 - RNA, 23 nt, Human
aaucauguaguaucaaauauuag

SEQ ID NO: 2190484 - RNA, 16 nt, Human
aaucaugucaggccug

SEQ ID NO: 2190485 - RNA, 14 nt, Human
uaaguacuguguac

SEQ ID NO: 2190486 - RNA, 14 nt, Human
aaucagcaagaaga

SEQ ID NO: 2190487 - RNA, 16 nt, Human
uaaguaucugacaucu

SEQ ID NO: 2190488 - RNA, 15 nt, Human
uaaguaucugacauc

SEQ ID NO: 2190489 - RNA, 20 nt, Human
uaaguauguguaaaauguga

SEQ ID NO: 2190490 - RNA, 20 nt, Human
aaucagacccuaccccacca

SEQ ID NO: 2190491 - RNA, 13 nt, Human
aaucagacaaagu

SEQ ID NO: 2190492 - RNA, 14 nt, Human
aaucagaucauuuc

SEQ ID NO: 2190493 - RNA, 15 nt, Human
aaucagaucauuuca

SEQ ID NO: 2190494 - RNA, 15 nt, Human
aaucagaucuuuauu

SEQ ID NO: 2190495 - RNA, 14 nt, Human
aaucagacuaugaa

SEQ ID NO: 2190496 - RNA, 17 nt, Human
aaucagacuaugaaguu

SEQ ID NO: 2190497 - RNA, 14 nt, Human
uaaguauguuauuu

SEQ ID NO: 2190498 - RNA, 17 nt, Human
uaaguaucuucauguau

SEQ ID NO: 2190499 - RNA, 12 nt, Human
uaaguuauugca

SEQ ID NO: 2190500 - RNA, 14 nt, Human
uaaguuauugcagu

SEQ ID NO: 2190501 - RNA, 15 nt, Human
uaaguuauugcaguu

SEQ ID NO: 2190502 - RNA, 16 nt, Human
uaaguuauugcaguuu

SEQ ID NO: 2190503 - RNA, 20 nt, Human
uaaguuauugcaguuuauca

SEQ ID NO: 2190504 - RNA, 20 nt, Human
uaaguuauuuuuacauucug

SEQ ID NO: 2190505 - RNA, 19 nt, Human
uaaguucaaauucuucuga

SEQ ID NO: 2190506 - RNA, 20 nt, Human
uaaguucaaauucuucugaa

SEQ ID NO: 2190507 - RNA, 20 nt, Human
uaaguuuuuauggcuuuugu

SEQ ID NO: 2190508 - RNA, 18 nt, Human
uaaguuuuuuuuuaaaaa

SEQ ID NO: 2190509 - RNA, 14 nt, Human
uaaguuucugggac

SEQ ID NO: 2190510 - RNA, 19 nt, Human
uaaguuucucagcucccau

SEQ ID NO: 2190511 - RNA, 23 nt, Human
uaaguuucucagcucccauuucu

SEQ ID NO: 2190512 - RNA, 16 nt, Human
uaaguuugauuucauu

SEQ ID NO: 2190513 - RNA, 12 nt, Human
uaaguuugaagg

SEQ ID NO: 2190514 - RNA, 18 nt, Human
uaaguuucucagcuccca

SEQ ID NO: 2190515 - RNA, 20 nt, Human
aaugacucaggacauccccc

SEQ ID NO: 2190516 - RNA, 15 nt, Human
aaugacauuuugcca

SEQ ID NO: 2190517 - RNA, 16 nt, Human
aaugacagagccagug

SEQ ID NO: 2190518 - RNA, 22 nt, Human
aaugacaucucaggggccagag

SEQ ID NO: 2190519 - RNA, 13 nt, Human
aaugacaucuuca

SEQ ID NO: 2190520 - RNA, 18 nt, Human
aaugacauuuauaucaca

SEQ ID NO: 2190521 - RNA, 18 nt, Human
aaugacaucuucaaagcu

SEQ ID NO: 2190522 - RNA, 18 nt, Human
aaugacaucaccacaguu

SEQ ID NO: 2190523 - RNA, 11 nt, Human
aaugacagagc

SEQ ID NO: 2190524 - RNA, 22 nt, Human
aaugacagguuugggaccccug

SEQ ID NO: 2190525 - RNA, 20 nt, Human
aaugaaaaugucagaaacca

SEQ ID NO: 2190526 - RNA, 14 nt, Human
aaugaaaaugucag

SEQ ID NO: 2190527 - RNA, 13 nt, Human
aaugaaaauguca

SEQ ID NO: 2190528 - RNA, 12 nt, Human
aaugaaaauguc

SEQ ID NO: 2190529 - RNA, 14 nt, Human
aaugaaaauaagaa

SEQ ID NO: 2190530 - RNA, 23 nt, Human
aaugaaaaugucagaaaccaguu

SEQ ID NO: 2190531 - RNA, 13 nt, Human
aaugacacagucu

SEQ ID NO: 2190532 - RNA, 17 nt, Human
aaugacacuugucccca

SEQ ID NO: 2190533 - RNA, 15 nt, Human
aaugaaaaccacauu

SEQ ID NO: 2190534 - RNA, 17 nt, Human
aaugaaaagcugaaucc

SEQ ID NO: 2190535 - RNA, 15 nt, Human
aaugagccuggcaag

SEQ ID NO: 2190536 - RNA, 21 nt, Human
aaugagagacacacugaagaa

SEQ ID NO: 2190537 - RNA, 19 nt, Human
aaugagacccucguggccu

SEQ ID NO: 2190538 - RNA, 14 nt, Human
aaugagacuaugcg

SEQ ID NO: 2190539 - RNA, 15 nt, Human
aaugagacuugcucu

SEQ ID NO: 2190540 - RNA, 16 nt, Human
aaugagacuugcucuc

SEQ ID NO: 2190541 - RNA, 14 nt, Human
aaugaccaauauua

SEQ ID NO: 2190542 - RNA, 17 nt, Human
aaugagaaggcagccac

SEQ ID NO: 2190543 - RNA, 13 nt, Human
aaugagaaucuac

SEQ ID NO: 2190544 - RNA, 18 nt, Human
aaugacuuacuguacaug

SEQ ID NO: 2190545 - RNA, 17 nt, Human
aaugacuuacuguacau

SEQ ID NO: 2190546 - RNA, 14 nt, Human
aaugacuuacugua

SEQ ID NO: 2190547 - RNA, 15 nt, Human
uaaugguuugaauau

SEQ ID NO: 2190548 - RNA, 18 nt, Human
uaauggugccuucauuug

SEQ ID NO: 2190549 - RNA, 16 nt, Human
uaauggugccuucauu

SEQ ID NO: 2190550 - RNA, 14 nt, Human
uaaugguguuuuaa

SEQ ID NO: 2190551 - RNA, 15 nt, Human
uaaugguuucaaaga

SEQ ID NO: 2190552 - RNA, 14 nt, Human
uaauguaaaauguu

SEQ ID NO: 2190553 - RNA, 17 nt, Human
uaauguaaaauguugaa

SEQ ID NO: 2190554 - RNA, 15 nt, Human
aaucuugucucaaug

SEQ ID NO: 2190555 - RNA, 17 nt, Human
aaucuugucucaaugcu

SEQ ID NO: 2190556 - RNA, 13 nt, Human
aaucuugucucaa

SEQ ID NO: 2190557 - RNA, 15 nt, Human
uaaugagggacugga

SEQ ID NO: 2190558 - RNA, 16 nt, Human
uaaugaggaugauuau

SEQ ID NO: 2190559 - RNA, 20 nt, Human
uaauggucccauccaggcag

SEQ ID NO: 2190560 - RNA, 21 nt, Human
uaauggucccauccaggcagu

SEQ ID NO: 2190561 - RNA, 14 nt, Human
uaauggucccaucc

SEQ ID NO: 2190562 - RNA, 15 nt, Human
uaauggucccaucca

SEQ ID NO: 2190563 - RNA, 16 nt, Human
uaauggucccauccag

SEQ ID NO: 2190564 - RNA, 18 nt, Human
uaauggucccauccaggc

SEQ ID NO: 2190565 - RNA, 13 nt, Human
uaaugaggaaacu

SEQ ID NO: 2190566 - RNA, 16 nt, Human
uaaugauaacuggaaa

SEQ ID NO: 2190567 - RNA, 21 nt, Human
aaugaaaaauuuaagcauugu

SEQ ID NO: 2190568 - RNA, 22 nt, Human
aaugaaaaauuuaagcauuguu

SEQ ID NO: 2190569 - RNA, 19 nt, Human
aaugaaaaauuuaagcauu

SEQ ID NO: 2190570 - RNA, 21 nt, Human
aaucuuuuacaacugccucga

SEQ ID NO: 2190571 - RNA, 12 nt, Human
aaucuuuuacaa

SEQ ID NO: 2190572 - RNA, 21 nt, Human
aaucuuuuaaaaauucaaaug

SEQ ID NO: 2190573 - RNA, 22 nt, Human
aaucuuucuuuugauucuuccu

SEQ ID NO: 2190574 - RNA, 14 nt, Human
aaucuuucuuucuu

SEQ ID NO: 2190575 - RNA, 16 nt, Human
aaucuuucuuucuuag

SEQ ID NO: 2190576 - RNA, 17 nt, Human
aaucuuucuuucuuaga

SEQ ID NO: 2190577 - RNA, 18 nt, Human
aaucuuucuuucuuagaa

SEQ ID NO: 2190578 - RNA, 19 nt, Human
aaucuuucuuucuuagaaa

SEQ ID NO: 2190579 - RNA, 20 nt, Human
aaucuuucuuucuuagaaau

SEQ ID NO: 2190580 - RNA, 21 nt, Human
aaucuuucuuucuuagaaauu

SEQ ID NO: 2190581 - RNA, 22 nt, Human
aaucuuucuuucuuagaaauuu

SEQ ID NO: 2190582 - RNA, 21 nt, Human
aaucuugucucaaugcucaua

SEQ ID NO: 2190583 - RNA, 18 nt, Human
aaucuugucucaaugcuc

SEQ ID NO: 2190584 - RNA, 20 nt, Human
aaucuugucucaaugcucau

SEQ ID NO: 2190585 - RNA, 15 nt, Human
aaucuuucuuuaccu

SEQ ID NO: 2190586 - RNA, 17 nt, Human
aaucuuucuuuaccuga

SEQ ID NO: 2190587 - RNA, 19 nt, Human
aaucuuucuuuaccugaga

SEQ ID NO: 2190588 - RNA, 21 nt, Human
aaucuuucuuuaccugagacc

SEQ ID NO: 2190589 - RNA, 22 nt, Human
aaucuuucuuuaccugagacca

SEQ ID NO: 2190590 - RNA, 12 nt, Human
uaauacuauauu

SEQ ID NO: 2190591 - RNA, 23 nt, Human
uaauacuaguugugaccuuagug

SEQ ID NO: 2190592 - RNA, 15 nt, Human
uaauacuaguuguga

SEQ ID NO: 2190593 - RNA, 18 nt, Human
uaauacuaguugugaccu

SEQ ID NO: 2190594 - RNA, 22 nt, Human
uaauacuaguugugaccuuagu

SEQ ID NO: 2190595 - RNA, 15 nt, Human
uaauacuaccuugaa

SEQ ID NO: 2190596 - RNA, 14 nt, Human
uaauacuaccuuga

SEQ ID NO: 2190597 - RNA, 12 nt, Human
uaauacuguauu

SEQ ID NO: 2190598 - RNA, 22 nt, Human
aaucuucaguuuuaucuuuaau

SEQ ID NO: 2190599 - RNA, 20 nt, Human
aaucuucaguuuuaucuuua

SEQ ID NO: 2190600 - RNA, 20 nt, Human
aaucuuauuagggagaaaau

SEQ ID NO: 2190601 - RNA, 13 nt, Human
aaucuucugaacu

SEQ ID NO: 2190602 - RNA, 20 nt, Human
aaucuucugaacuuggcgcu

SEQ ID NO: 2190603 - RNA, 14 nt, Human
uaauacuguauuug

SEQ ID NO: 2190604 - RNA, 18 nt, Human
uaauagcuuuuauuguau

SEQ ID NO: 2190605 - RNA, 21 nt, Human
uaauagcuuuuauuguauaaa

SEQ ID NO: 2190606 - RNA, 21 nt, Human
uaauaguguuaaucaauuuaa

SEQ ID NO: 2190607 - RNA, 17 nt, Human
uaauaguguuaaucaau

SEQ ID NO: 2190608 - RNA, 20 nt, Human
uaauaguguuaaucaauuua

SEQ ID NO: 2190609 - RNA, 21 nt, Human
uaauagugcuuaaaaaucauu

SEQ ID NO: 2190610 - RNA, 13 nt, Human
uaauaguguuaau

SEQ ID NO: 2190611 - RNA, 15 nt, Human
uaauaguguuaauca

SEQ ID NO: 2190612 - RNA, 21 nt, Human
uaaucaacugggcugaacacu

SEQ ID NO: 2190613 - RNA, 14 nt, Human
uaaucaagccucug

SEQ ID NO: 2190614 - RNA, 14 nt, Human
uaaucaaguugaau

SEQ ID NO: 2190615 - RNA, 16 nt, Human
uaaucaauaaacgauu

SEQ ID NO: 2190616 - RNA, 22 nt, Human
uaaucaauaaacgauuuaauuc

SEQ ID NO: 2190617 - RNA, 17 nt, Human
uaaucaaucaucugugu

SEQ ID NO: 2190618 - RNA, 15 nt, Human
uaaucacgcuuuccu

SEQ ID NO: 2190619 - RNA, 23 nt, Human
uaaucagugugucuaaauuugaa

SEQ ID NO: 2190620 - RNA, 18 nt, Human
uaaucaauguuucuucua

SEQ ID NO: 2190621 - RNA, 22 nt, Human
uaaucaauuaauuuuuuuauug

SEQ ID NO: 2190622 - RNA, 23 nt, Human
uaaucaauuaauuuuuuuauugu

SEQ ID NO: 2190623 - RNA, 13 nt, Human
uaaucaauuuaaa

SEQ ID NO: 2190624 - RNA, 20 nt, Human
uaaucaauuuaaacccauuu

SEQ ID NO: 2190625 - RNA, 16 nt, Human
uaaugaauuuuuauga

SEQ ID NO: 2190626 - RNA, 15 nt, Human
uaaugaaacuuggau

SEQ ID NO: 2190627 - RNA, 21 nt, Human
uaaugaauuuuuaugauauuc

SEQ ID NO: 2190628 - RNA, 15 nt, Human
uaaugacacuugucc

SEQ ID NO: 2190629 - RNA, 17 nt, Human
uaaucaugaaauuacuu

SEQ ID NO: 2190630 - RNA, 23 nt, Human
uaaugaaagacuguacaaaguag

SEQ ID NO: 2190631 - RNA, 22 nt, Human
uaaugaaagacuguacaaagua

SEQ ID NO: 2190632 - RNA, 15 nt, Human
uaaugacagagccag

SEQ ID NO: 2190633 - RNA, 20 nt, Human
uaaugacaucaccacaguuu

SEQ ID NO: 2190634 - RNA, 15 nt, Human
uaaugacuuaagcac

SEQ ID NO: 2190635 - RNA, 21 nt, Human
uaaugacuuaagcacacuuga

SEQ ID NO: 2190636 - RNA, 19 nt, Human
uaaugaaagacuguacaaa

SEQ ID NO: 2190637 - RNA, 18 nt, Human
uaaugaaagacuguacaa

SEQ ID NO: 2190638 - RNA, 17 nt, Human
uaaugaaagacuguaca

SEQ ID NO: 2190639 - RNA, 14 nt, Human
uaaugaaagacugu

SEQ ID NO: 2190640 - RNA, 17 nt, Human
uaaucauccaaugcuca

SEQ ID NO: 2190641 - RNA, 16 nt, Human
uaaucaucuauaaaga

SEQ ID NO: 2190642 - RNA, 17 nt, Human
uaaucaucuauaaagaa

SEQ ID NO: 2190643 - RNA, 14 nt, Human
uaaugaaacuugga

SEQ ID NO: 2190644 - RNA, 20 nt, Human
uaaugaaacaccuucucugg

SEQ ID NO: 2190645 - RNA, 13 nt, Human
uaaucaugaaauu

SEQ ID NO: 2190646 - RNA, 16 nt, Human
uaaucaugaaauuacu

SEQ ID NO: 2190647 - RNA, 15 nt, Human
uaaucauauaauaaa

SEQ ID NO: 2190648 - RNA, 20 nt, Human
uaaucauauaauaaauguac

SEQ ID NO: 2190649 - RNA, 22 nt, Human
uaaucauauaauaaauguacau

SEQ ID NO: 2190650 - RNA, 17 nt, Human
uaaucacgcuuuccuga

SEQ ID NO: 2190651 - RNA, 17 nt, Human
aaugcagugaauuguga

SEQ ID NO: 2190652 - RNA, 13 nt, Human
aaugcauaaaaug

SEQ ID NO: 2190653 - RNA, 20 nt, Human
uacaaguagggguugugggu

SEQ ID NO: 2190654 - RNA, 19 nt, Human
uacaaaauuugaaauuuag

SEQ ID NO: 2190655 - RNA, 16 nt, Human
uacaaacaaaauuucu

SEQ ID NO: 2190656 - RNA, 20 nt, Human
uacaaaauaaacaaauaaca

SEQ ID NO: 2190657 - RNA, 18 nt, Human
uacaagggucuagggaga

SEQ ID NO: 2190658 - RNA, 17 nt, Human
uacaaggaagguggugg

SEQ ID NO: 2190659 - RNA, 14 nt, Human
uacaaggcaacaua

SEQ ID NO: 2190660 - RNA, 14 nt, Human
uacaaggacagccc

SEQ ID NO: 2190661 - RNA, 23 nt, Human
aaugccaacuuguccuuuuguac

SEQ ID NO: 2190662 - RNA, 22 nt, Human
aaugcauuguaucgauguuaug

SEQ ID NO: 2190663 - RNA, 23 nt, Human
aaugcauuuuguuugguauugua

SEQ ID NO: 2190664 - RNA, 14 nt, Human
aaugcccagccccu

SEQ ID NO: 2190665 - RNA, 15 nt, Human
aaugcccagccccuu

SEQ ID NO: 2190666 - RNA, 18 nt, Human
aaugcauauccugagcca

SEQ ID NO: 2190667 - RNA, 17 nt, Human
aaugcauuauuuugaau

SEQ ID NO: 2190668 - RNA, 23 nt, Human
aaugcauuauaggaucauuuguu

SEQ ID NO: 2190669 - RNA, 22 nt, Human
aaugcauuauaggaucauuugu

SEQ ID NO: 2190670 - RNA, 16 nt, Human
aaugcauaaaauguua

SEQ ID NO: 2190671 - RNA, 14 nt, Human
aaugcauaaaugca

SEQ ID NO: 2190672 - RNA, 21 nt, Human
aaugcauuguaucgauguuau

SEQ ID NO: 2190673 - RNA, 18 nt, Human
aaugcauuguaucgaugu

SEQ ID NO: 2190674 - RNA, 12 nt, Human
aaugcauuguau

SEQ ID NO: 2190675 - RNA, 12 nt, Human
aaugcauuuugu

SEQ ID NO: 2190676 - RNA, 18 nt, Human
aaugcauuuuguuuggua

SEQ ID NO: 2190677 - RNA, 20 nt, Human
aaugcauuuuguuugguauu

SEQ ID NO: 2190678 - RNA, 21 nt, Human
aaugcauuuuguuugguauug

SEQ ID NO: 2190679 - RNA, 19 nt, Human
aaugcuuugugugauugaa

SEQ ID NO: 2190680 - RNA, 13 nt, Human
aaugcuuuuaaaa

SEQ ID NO: 2190681 - RNA, 20 nt, Human
aaugcuuuuuauuucugcau

SEQ ID NO: 2190682 - RNA, 19 nt, Human
aaugcuuuuuauuucugca

SEQ ID NO: 2190683 - RNA, 11 nt, Human
aaugcuuuuug

SEQ ID NO: 2190684 - RNA, 14 nt, Human
aaugcuuuuugaau

SEQ ID NO: 2190685 - RNA, 17 nt, Human
aaugcuuuuugaauguu

SEQ ID NO: 2190686 - RNA, 15 nt, Human
aaugcuuuccaaaac

SEQ ID NO: 2190687 - RNA, 12 nt, Human
aaugcuuucgau

SEQ ID NO: 2190688 - RNA, 12 nt, Human
aaugcuguguua

SEQ ID NO: 2190689 - RNA, 12 nt, Human
aauggaaacuga

SEQ ID NO: 2190690 - RNA, 14 nt, Human
aauggaauacugaa

SEQ ID NO: 2190691 - RNA, 19 nt, Human
aauggacauaggacucaaa

SEQ ID NO: 2190692 - RNA, 16 nt, Human
aauggacguguuauga

SEQ ID NO: 2190693 - RNA, 19 nt, Human
aauggaaaacagacucagg

SEQ ID NO: 2190694 - RNA, 13 nt, Human
aauggaaacugaa

SEQ ID NO: 2190695 - RNA, 20 nt, Human
aauggaagguuuguauauug

SEQ ID NO: 2190696 - RNA, 18 nt, Human
aauggaagguuuguauau

SEQ ID NO: 2190697 - RNA, 13 nt, Human
aaugcugugcccu

SEQ ID NO: 2190698 - RNA, 15 nt, Human
aaugcccccagcugg

SEQ ID NO: 2190699 - RNA, 17 nt, Human
aaugcccccagcuggcc

SEQ ID NO: 2190700 - RNA, 18 nt, Human
aaugcccccagcuggccc

SEQ ID NO: 2190701 - RNA, 21 nt, Human
aaugcugugcccuaaagugua

SEQ ID NO: 2190702 - RNA, 20 nt, Human
aaugcugugcccuaaagugu

SEQ ID NO: 2190703 - RNA, 20 nt, Human
aaugcccagccccuucugac

SEQ ID NO: 2190704 - RNA, 22 nt, Human
aaugcccagccccuucugaccc

SEQ ID NO: 2190705 - RNA, 23 nt, Human
aaugcccagccccuucugaccca

SEQ ID NO: 2190706 - RNA, 24 nt, Human
aaugcccagccccuucugacccau

SEQ ID NO: 2190707 - RNA, 15 nt, Human
uaauuuaaaaaauaa

SEQ ID NO: 2190708 - RNA, 14 nt, Human
uaauuuaugaguuu

SEQ ID NO: 2190709 - RNA, 23 nt, Human
uaauuuaucuugucucugggcuu

SEQ ID NO: 2190710 - RNA, 16 nt, Human
uaauuuaaaauuguga

SEQ ID NO: 2190711 - RNA, 15 nt, Human
uaauuuaaaauugug

SEQ ID NO: 2190712 - RNA, 23 nt, Human
uaauuguuguuuguauguauaau

SEQ ID NO: 2190713 - RNA, 22 nt, Human
uaauuguuguuuguauguauaa

SEQ ID NO: 2190714 - RNA, 17 nt, Human
uaauuguuugucuuuaa

SEQ ID NO: 2190715 - RNA, 16 nt, Human
uaauuguuuugcacuu

SEQ ID NO: 2190716 - RNA, 18 nt, Human
uaauuguuuugcacuuuu

SEQ ID NO: 2190717 - RNA, 10 nt, Human
uaauuccaug

SEQ ID NO: 2190718 - RNA, 11 nt, Human
uaauuccauga

SEQ ID NO: 2190719 - RNA, 17 nt, Human
uaauuccacaccuuuua

SEQ ID NO: 2190720 - RNA, 16 nt, Human
uaauucccauuuugca

SEQ ID NO: 2190721 - RNA, 16 nt, Human
uaauuguuguuucuuu

SEQ ID NO: 2190722 - RNA, 19 nt, Human
uaauuguuguuuguaugua

SEQ ID NO: 2190723 - RNA, 18 nt, Human
uaauuguuguuuguaugu

SEQ ID NO: 2190724 - RNA, 15 nt, Human
uaauuguuguuugua

SEQ ID NO: 2190725 - RNA, 19 nt, Human
uaauuguuguuucuuucua

SEQ ID NO: 2190726 - RNA, 22 nt, Human
uaauuguuguuucuuucuagug

SEQ ID NO: 2190727 - RNA, 17 nt, Human
uaauuccacagcugcuc

SEQ ID NO: 2190728 - RNA, 14 nt, Human
uaauuccacagcug

SEQ ID NO: 2190729 - RNA, 13 nt, Human
uaauuccacagcu

SEQ ID NO: 2190730 - RNA, 15 nt, Human
uaauuccacaccuuu

SEQ ID NO: 2190731 - RNA, 19 nt, Human
uaauuccaauaugaugacu

SEQ ID NO: 2190732 - RNA, 20 nt, Human
uaauuccaauaugaugacuc

SEQ ID NO: 2190733 - RNA, 15 nt, Human
uaauucauguuucuu

SEQ ID NO: 2190734 - RNA, 15 nt, Human
uaauuccaauaugau

SEQ ID NO: 2190735 - RNA, 16 nt, Human
uaauuccaauaugaug

SEQ ID NO: 2190736 - RNA, 18 nt, Human
uaauuccaauaugaugac

SEQ ID NO: 2190737 - RNA, 13 nt, Human
uaauucaagaaaa

SEQ ID NO: 2190738 - RNA, 13 nt, Human
uaauuauuuuggu

SEQ ID NO: 2190739 - RNA, 16 nt, Human
uaauuauuuugguacu

SEQ ID NO: 2190740 - RNA, 20 nt, Human
uaauuauuuugguacuuuua

SEQ ID NO: 2190741 - RNA, 21 nt, Human
uaauucaaagcaccaaaauaa

SEQ ID NO: 2190742 - RNA, 21 nt, Human
uaauuauuuugguacuuuuau

SEQ ID NO: 2190743 - RNA, 22 nt, Human
uaauucaaagcucuauuaagau

SEQ ID NO: 2190744 - RNA, 19 nt, Human
uaauucaaagcaccaaaau

SEQ ID NO: 2190745 - RNA, 12 nt, Human
uaauucaaagca

SEQ ID NO: 2190746 - RNA, 22 nt, Human
aaugagcucgcauuugucaaug

SEQ ID NO: 2190747 - RNA, 18 nt, Human
aaugagagaauaagucau

SEQ ID NO: 2190748 - RNA, 23 nt, Human
aaugagagaauaagucauguucc

SEQ ID NO: 2190749 - RNA, 16 nt, Human
aaugagcuauguauua

SEQ ID NO: 2190750 - RNA, 16 nt, Human
aaugaggacauguuuu

SEQ ID NO: 2190751 - RNA, 13 nt, Human
aaugaggaaugua

SEQ ID NO: 2190752 - RNA, 14 nt, Human
aaugaggacauguu

SEQ ID NO: 2190753 - RNA, 19 nt, Human
uacaaaaaaaaaguuuuau

SEQ ID NO: 2190754 - RNA, 20 nt, Human
uaauuucaaaaugcuuuuua

SEQ ID NO: 2190755 - RNA, 16 nt, Human
uaauuucaaaaugcuu

SEQ ID NO: 2190756 - RNA, 15 nt, Human
uaauuucaaaaugcu

SEQ ID NO: 2190757 - RNA, 14 nt, Human
uacaaaaacacagc

SEQ ID NO: 2190758 - RNA, 13 nt, Human
uacaaaaacacag

SEQ ID NO: 2190759 - RNA, 17 nt, Human
uaauuuauuaauugcuu

SEQ ID NO: 2190760 - RNA, 19 nt, Human
uaauuuauuaauugcuuug

SEQ ID NO: 2190761 - RNA, 18 nt, Human
uaauuuauuaauugcuuu

SEQ ID NO: 2190762 - RNA, 20 nt, Human
uaauuuaugaguuuuugaua

SEQ ID NO: 2190763 - RNA, 20 nt, Human
uaauuuauuguuuuuccuug

SEQ ID NO: 2190764 - RNA, 18 nt, Human
uaauuuauuauugaaauu

SEQ ID NO: 2190765 - RNA, 20 nt, Human
uaauuuauuauugaaauugu

SEQ ID NO: 2190766 - RNA, 20 nt, Human
uaauuuauuaauugcuuuga

SEQ ID NO: 2190767 - RNA, 17 nt, Human
uaauuuauuauugaaau

SEQ ID NO: 2190768 - RNA, 14 nt, Human
uaauuuauuauuga

SEQ ID NO: 2190769 - RNA, 18 nt, Human
uaauuuauuuauuaagau

SEQ ID NO: 2190770 - RNA, 14 nt, Human
uaauuuauuuuguc

SEQ ID NO: 2190771 - RNA, 19 nt, Human
uaauuuauuuauuaagaug

SEQ ID NO: 2190772 - RNA, 17 nt, Human
uaauuuauuuauuaaga

SEQ ID NO: 2190773 - RNA, 14 nt, Human
uaauuuauuuauua

SEQ ID NO: 2190774 - RNA, 12 nt, Human
uaauuuauuuau

SEQ ID NO: 2190775 - RNA, 12 nt, Human
uaauuucaaaau

SEQ ID NO: 2190776 - RNA, 20 nt, Human
uaauuucaaaaauauaacuu

SEQ ID NO: 2190777 - RNA, 21 nt, Human
uaauuucaaaaauauaacuua

SEQ ID NO: 2190778 - RNA, 18 nt, Human
uaauuuauuuuugcaugg

SEQ ID NO: 2190779 - RNA, 17 nt, Human
uaauuucaaaaauauaa

SEQ ID NO: 2190780 - RNA, 18 nt, Human
uaauuucaaaaauauaac

SEQ ID NO: 2190781 - RNA, 19 nt, Human
uaauuucaaaaauauaacu

SEQ ID NO: 2190782 - RNA, 15 nt, Human
uacaaaaagcauaaa

SEQ ID NO: 2190783 - RNA, 16 nt, Human
uacaaaaacacagcaa

SEQ ID NO: 2190784 - RNA, 15 nt, Human
uacaaaaacacagca

SEQ ID NO: 2190785 - RNA, 20 nt, Human
uacaaaaagcauaaaaauua

SEQ ID NO: 2190786 - RNA, 14 nt, Human
uacaaaaauauaaa

SEQ ID NO: 2190787 - RNA, 17 nt, Human
uacaaaaauauaaaaua

SEQ ID NO: 2190788 - RNA, 18 nt, Human
uacaaaaauauaaaauau

SEQ ID NO: 2190789 - RNA, 19 nt, Human
uacaaaauaaacaaauaac

SEQ ID NO: 2190790 - RNA, 12 nt, Human
uacaaaacuucc

SEQ ID NO: 2190791 - RNA, 15 nt, Human
uacaaaagcauguga

SEQ ID NO: 2190792 - RNA, 20 nt, Human
uacaaaaaaaaaguuuuauu

SEQ ID NO: 2190793 - RNA, 20 nt, Human
uacaaaaauauaaaauauga

SEQ ID NO: 2190794 - RNA, 19 nt, Human
uacaaaaccugauguuaaa

SEQ ID NO: 2190795 - RNA, 12 nt, Human
aauguacugaga

SEQ ID NO: 2190796 - RNA, 21 nt, Human
uacauauuugcauauguauga

SEQ ID NO: 2190797 - RNA, 16 nt, Human
uacauauuuguggaau

SEQ ID NO: 2190798 - RNA, 17 nt, Human
uacauauuuguggaaua

SEQ ID NO: 2190799 - RNA, 12 nt, Human
aauguacugcau

SEQ ID NO: 2190800 - RNA, 19 nt, Human
uacauauuugcauauguau

SEQ ID NO: 2190801 - RNA, 13 nt, Human
uacauauuuccaa

SEQ ID NO: 2190802 - RNA, 17 nt, Human
uacauauuugagacuag

SEQ ID NO: 2190803 - RNA, 15 nt, Human
uacauauucuuuaaa

SEQ ID NO: 2190804 - RNA, 23 nt, Human
uacauauuaggaaaauauggguu

SEQ ID NO: 2190805 - RNA, 19 nt, Human
uacauauaagugauugcug

SEQ ID NO: 2190806 - RNA, 14 nt, Human
uacauauucuuuaa

SEQ ID NO: 2190807 - RNA, 19 nt, Human
uacauauuaggaaaauaug

SEQ ID NO: 2190808 - RNA, 18 nt, Human
uacauauuaggaaaauau

SEQ ID NO: 2190809 - RNA, 21 nt, Human
uacauaugugcuggaauucua

SEQ ID NO: 2190810 - RNA, 15 nt, Human
uacaguacaggcagc

SEQ ID NO: 2190811 - RNA, 15 nt, Human
uacaguaucucaggg

SEQ ID NO: 2190812 - RNA, 17 nt, Human
uacauaaugcgugcaua

SEQ ID NO: 2190813 - RNA, 20 nt, Human
uacauaaugcgugcauacca

SEQ ID NO: 2190814 - RNA, 19 nt, Human
uacauaaugcgugcauacc

SEQ ID NO: 2190815 - RNA, 23 nt, Human
uacauagcaugacauuucuuugu

SEQ ID NO: 2190816 - RNA, 13 nt, Human
uacauagccuaua

SEQ ID NO: 2190817 - RNA, 15 nt, Human
uacauagccuauauu

SEQ ID NO: 2190818 - RNA, 20 nt, Human
uacauagccuauauuuacag

SEQ ID NO: 2190819 - RNA, 21 nt, Human
uacauagccuauauuuacagu

SEQ ID NO: 2190820 - RNA, 17 nt, Human
uacauagaugcuuaguc

SEQ ID NO: 2190821 - RNA, 23 nt, Human
aauguauuuuauuguaacagaca

SEQ ID NO: 2190822 - RNA, 17 nt, Human
aauguauuuuauuguaa

SEQ ID NO: 2190823 - RNA, 21 nt, Human
aauguauuuuauuguaacaga

SEQ ID NO: 2190824 - RNA, 19 nt, Human
aauguauuguugguaauua

SEQ ID NO: 2190825 - RNA, 15 nt, Human
aauguauuuuauugu

SEQ ID NO: 2190826 - RNA, 16 nt, Human
aauguauuuuauugua

SEQ ID NO: 2190827 - RNA, 15 nt, Human
aauguauuguaccuu

SEQ ID NO: 2190828 - RNA, 16 nt, Human
aauguauuguaccuuu

SEQ ID NO: 2190829 - RNA, 22 nt, Human
aauguauuguaccuuuuaacac

SEQ ID NO: 2190830 - RNA, 23 nt, Human
aauguauuguaccuuuuaacacc

SEQ ID NO: 2190831 - RNA, 21 nt, Human
aauguauuuauuuaaaagauu

SEQ ID NO: 2190832 - RNA, 18 nt, Human
aaugugggagcagcgguu

SEQ ID NO: 2190833 - RNA, 21 nt, Human
aauguggcuugagaaauaugg

SEQ ID NO: 2190834 - RNA, 16 nt, Human
aauguggcuugagaaa

SEQ ID NO: 2190835 - RNA, 12 nt, Human
aauguggcuuga

SEQ ID NO: 2190836 - RNA, 14 nt, Human
aauguggcuccugg

SEQ ID NO: 2190837 - RNA, 16 nt, Human
aaugugaugaauacug

SEQ ID NO: 2190838 - RNA, 11 nt, Human
aaugugauaug

SEQ ID NO: 2190839 - RNA, 20 nt, Human
aaugugaugaauacuguauu

SEQ ID NO: 2190840 - RNA, 12 nt, Human
aaugugaugaau

SEQ ID NO: 2190841 - RNA, 16 nt, Human
aaugugauauuauaca

SEQ ID NO: 2190842 - RNA, 14 nt, Human
aauguauguguaag

SEQ ID NO: 2190843 - RNA, 12 nt, Human
aauguaugugua

SEQ ID NO: 2190844 - RNA, 18 nt, Human
aauguauuauucugcagc

SEQ ID NO: 2190845 - RNA, 20 nt, Human
aauguaugugcacugucacu

SEQ ID NO: 2190846 - RNA, 21 nt, Human
aauguaugugcacugucacuu

SEQ ID NO: 2190847 - RNA, 22 nt, Human
aauguauuauucugcagcauga

SEQ ID NO: 2190848 - RNA, 19 nt, Human
aauguauugaacuuggaaa

SEQ ID NO: 2190849 - RNA, 13 nt, Human
aauguauuguacc

SEQ ID NO: 2190850 - RNA, 14 nt, Human
aauguauuguaccu

SEQ ID NO: 2190851 - RNA, 18 nt, Human
aauguauugaacuuggaa

SEQ ID NO: 2190852 - RNA, 18 nt, Human
aauguacugcauaugaaa

SEQ ID NO: 2190853 - RNA, 14 nt, Human
aauguacugcauau

SEQ ID NO: 2190854 - RNA, 21 nt, Human
aauguaugcuucauacaggga

SEQ ID NO: 2190855 - RNA, 13 nt, Human
aauguaugugcac

SEQ ID NO: 2190856 - RNA, 18 nt, Human
aauguaugugcacuguca

SEQ ID NO: 2190857 - RNA, 18 nt, Human
aauguaugcuucauacag

SEQ ID NO: 2190858 - RNA, 15 nt, Human
aauguacugagauuu

SEQ ID NO: 2190859 - RNA, 15 nt, Human
uacacauuuuucaga

SEQ ID NO: 2190860 - RNA, 17 nt, Human
uacacauuuuucagaua

SEQ ID NO: 2190861 - RNA, 15 nt, Human
aauggaggaauauga

SEQ ID NO: 2190862 - RNA, 20 nt, Human
aauggagauucaguuuucau

SEQ ID NO: 2190863 - RNA, 20 nt, Human
aauggagauuugaaggucug

SEQ ID NO: 2190864 - RNA, 21 nt, Human
uacacauuuuucagauauaaa

SEQ ID NO: 2190865 - RNA, 19 nt, Human
uacacauuuuucagauaua

SEQ ID NO: 2190866 - RNA, 18 nt, Human
uacaccaccucacuccug

SEQ ID NO: 2190867 - RNA, 19 nt, Human
aauggacuuuuguacauag

SEQ ID NO: 2190868 - RNA, 19 nt, Human
uacaccagagauaauauga

SEQ ID NO: 2190869 - RNA, 19 nt, Human
uacaccaccucacuccugu

SEQ ID NO: 2190870 - RNA, 20 nt, Human
uacaccagagauaauaugag

SEQ ID NO: 2190871 - RNA, 17 nt, Human
uacaccagcauuccuuu

SEQ ID NO: 2190872 - RNA, 19 nt, Human
uacaccauguuugagcuca

SEQ ID NO: 2190873 - RNA, 18 nt, Human
uacaccagcauuccuuuu

SEQ ID NO: 2190874 - RNA, 20 nt, Human
uacaccagcauuccuuuuga

SEQ ID NO: 2190875 - RNA, 20 nt, Human
uacaccacuacauucuguua

SEQ ID NO: 2190876 - RNA, 19 nt, Human
uacaccacuacauucuguu

SEQ ID NO: 2190877 - RNA, 18 nt, Human
uacaccacuacauucugu

SEQ ID NO: 2190878 - RNA, 17 nt, Human
uacaccacuacauucug

SEQ ID NO: 2190879 - RNA, 16 nt, Human
uacaccacuacauucu

SEQ ID NO: 2190880 - RNA, 15 nt, Human
uacaccacuacauuc

SEQ ID NO: 2190881 - RNA, 20 nt, Human
uacacuaaggguguaaguaa

SEQ ID NO: 2190882 - RNA, 14 nt, Human
uacacuaguuguuu

SEQ ID NO: 2190883 - RNA, 19 nt, Human
uacaccauuaucuuggaaa

SEQ ID NO: 2190884 - RNA, 24 nt, Human
uacaccauguuugagcucagaccc

SEQ ID NO: 2190885 - RNA, 19 nt, Human
uacacuaagagagaaugag

SEQ ID NO: 2190886 - RNA, 16 nt, Human
uacacuccagccugag

SEQ ID NO: 2190887 - RNA, 15 nt, Human
uacacuccagccuga

SEQ ID NO: 2190888 - RNA, 13 nt, Human
uacacuaucuuaa

SEQ ID NO: 2190889 - RNA, 16 nt, Human
uacacucaggcuuuca

SEQ ID NO: 2190890 - RNA, 18 nt, Human
uacacucaggcuuucacu

SEQ ID NO: 2190891 - RNA, 18 nt, Human
uacacuccagccugagca

SEQ ID NO: 2190892 - RNA, 17 nt, Human
uacacuccagccugagc

SEQ ID NO: 2190893 - RNA, 14 nt, Human
uacacuccagugag

SEQ ID NO: 2190894 - RNA, 15 nt, Human
uacaggcauagaguu

SEQ ID NO: 2190895 - RNA, 18 nt, Human
uacagaggacaguauuug

SEQ ID NO: 2190896 - RNA, 18 nt, Human
uacagaggccaugggccu

SEQ ID NO: 2190897 - RNA, 15 nt, Human
uacagagcuucccug

SEQ ID NO: 2190898 - RNA, 23 nt, Human
uacagagcccacgcccccacugg

SEQ ID NO: 2190899 - RNA, 14 nt, Human
uacagaggacagua

SEQ ID NO: 2190900 - RNA, 16 nt, Human
uacagagcuucccuga

SEQ ID NO: 2190901 - RNA, 22 nt, Human
uacaggcgugagccaccgugcc

SEQ ID NO: 2190902 - RNA, 15 nt, Human
uacaggcuccugcca

SEQ ID NO: 2190903 - RNA, 14 nt, Human
uacaggcuccugcc

SEQ ID NO: 2190904 - RNA, 17 nt, Human
uacaggcuccugccacc

SEQ ID NO: 2190905 - RNA, 16 nt, Human
uacagggaaugccuga

SEQ ID NO: 2190906 - RNA, 20 nt, Human
uacagggaaugccugagugc

SEQ ID NO: 2190907 - RNA, 13 nt, Human
uacagggagccuc

SEQ ID NO: 2190908 - RNA, 16 nt, Human
uacaguaacuuuaugu

SEQ ID NO: 2190909 - RNA, 17 nt, Human
uacaguaacuuuaugug

SEQ ID NO: 2190910 - RNA, 18 nt, Human
uacaguaacuuuaugugu

SEQ ID NO: 2190911 - RNA, 20 nt, Human
uacaguaacuuuauguguaa

SEQ ID NO: 2190912 - RNA, 23 nt, Human
uacaguaacuuuauguguaaaua

SEQ ID NO: 2190913 - RNA, 18 nt, Human
uacaguaggagcccagcu

SEQ ID NO: 2190914 - RNA, 15 nt, Human
uacaguaggagccca

SEQ ID NO: 2190915 - RNA, 14 nt, Human
uacaguaggagccc

SEQ ID NO: 2190916 - RNA, 13 nt, Human
uacaguaggagcc

SEQ ID NO: 2190917 - RNA, 17 nt, Human
uacaguagauuuuccaa

SEQ ID NO: 2190918 - RNA, 21 nt, Human
uacaguagauuuuccaaaugu

SEQ ID NO: 2190919 - RNA, 14 nt, Human
uacaguaagcugcu

SEQ ID NO: 2190920 - RNA, 18 nt, Human
uacaguaagcugcucuau

SEQ ID NO: 2190921 - RNA, 21 nt, Human
uacaguaagcugcucuauugu

SEQ ID NO: 2190922 - RNA, 22 nt, Human
uacaguaggagcccagcucuga

SEQ ID NO: 2190923 - RNA, 20 nt, Human
uacaguaggagcccagcucu

SEQ ID NO: 2190924 - RNA, 19 nt, Human
aacuuggggaacaagggug

SEQ ID NO: 2190925 - RNA, 15 nt, Human
aacuuuaagaggaca

SEQ ID NO: 2190926 - RNA, 13 nt, Human
aacuuuaagagga

SEQ ID NO: 2190927 - RNA, 16 nt, Human
aacuuuaagcagcucu

SEQ ID NO: 2190928 - RNA, 18 nt, Human
aacuuuaagcagcucuug

SEQ ID NO: 2190929 - RNA, 18 nt, Human
aacuuuaaguuucaggau

SEQ ID NO: 2190930 - RNA, 21 nt, Human
aacuuuaaguuucaggauaca

SEQ ID NO: 2190931 - RNA, 20 nt, Human
aacuuuaauucucuuucaaa

SEQ ID NO: 2190932 - RNA, 21 nt, Human
aacuuuaauucucuuucaaag

SEQ ID NO: 2190933 - RNA, 13 nt, Human
aacuuuaccuuuu

SEQ ID NO: 2190934 - RNA, 16 nt, Human
aagaaaaaaaaaauau

SEQ ID NO: 2190935 - RNA, 19 nt, Human
aagaaaaaaaaagaaaaaa

SEQ ID NO: 2190936 - RNA, 18 nt, Human
aagaaaaaaaaagaaaaa

SEQ ID NO: 2190937 - RNA, 15 nt, Human
aagaaaaaaaaagaa

SEQ ID NO: 2190938 - RNA, 14 nt, Human
aagaaaaaaaaaga

SEQ ID NO: 2190939 - RNA, 20 nt, Human
aacuuuacccaaaaacuaaa

SEQ ID NO: 2190940 - RNA, 17 nt, Human
aagaaaaaaaagaaagc

SEQ ID NO: 2190941 - RNA, 19 nt, Human
aacuugucuaaauaaguuu

SEQ ID NO: 2190942 - RNA, 22 nt, Human
aacuugucuuuggacccugagg

SEQ ID NO: 2190943 - RNA, 18 nt, Human
aacuugucuuuggacccu

SEQ ID NO: 2190944 - RNA, 15 nt, Human
aacuuguauuaugug

SEQ ID NO: 2190945 - RNA, 23 nt, Human
aacuuggggaguuaagaccuggc

SEQ ID NO: 2190946 - RNA, 16 nt, Human
aacuuguauuaugugu

SEQ ID NO: 2190947 - RNA, 21 nt, Human
aacuuggcucgaaucucugug

SEQ ID NO: 2190948 - RNA, 22 nt, Human
aacuuggcucgaaucucugugc

SEQ ID NO: 2190949 - RNA, 23 nt, Human
aacuuggcucgaaucucugugcc

SEQ ID NO: 2190950 - RNA, 11 nt, Human
gugccuuaugg

SEQ ID NO: 2190951 - RNA, 17 nt, Human
aacuuggcgcugccccu

SEQ ID NO: 2190952 - RNA, 13 nt, Human
aacuuggggaaca

SEQ ID NO: 2190953 - RNA, 22 nt, Human
aacuuggggaguuaagaccugg

SEQ ID NO: 2190954 - RNA, 21 nt, Human
aacuuggggaguuaagaccug

SEQ ID NO: 2190955 - RNA, 12 nt, Human
aacuugggaacu

SEQ ID NO: 2190956 - RNA, 21 nt, Human
gugaaccaccacacccagccc

SEQ ID NO: 2190957 - RNA, 22 nt, Human
gugaaccaaagagacuggagca

SEQ ID NO: 2190958 - RNA, 23 nt, Human
gugaaccaaagagacuggagcau

SEQ ID NO: 2190959 - RNA, 23 nt, Human
gugccgccugcccgucucucucc

SEQ ID NO: 2190960 - RNA, 17 nt, Human
gugccgccgccucgccc

SEQ ID NO: 2190961 - RNA, 18 nt, Human
gugccgccgccucgccca

SEQ ID NO: 2190962 - RNA, 20 nt, Human
gugccgccgccucgcccacc

SEQ ID NO: 2190963 - RNA, 22 nt, Human
gugccgccgccucgcccaccgc

SEQ ID NO: 2190964 - RNA, 23 nt, Human
gugccgccgccucgcccaccgca

SEQ ID NO: 2190965 - RNA, 13 nt, Human
gugccgccugccc

SEQ ID NO: 2190966 - RNA, 14 nt, Human
gugccgccugcccg

SEQ ID NO: 2190967 - RNA, 15 nt, Human
gugccucaagagaag

SEQ ID NO: 2190968 - RNA, 21 nt, Human
gugccguuacucuccaaccug

SEQ ID NO: 2190969 - RNA, 18 nt, Human
gugccguuacucuccaac

SEQ ID NO: 2190970 - RNA, 15 nt, Human
gugccguuacucucc

SEQ ID NO: 2190971 - RNA, 22 nt, Human
gugccguuacucuccaaccugg

SEQ ID NO: 2190972 - RNA, 21 nt, Human
gugccuaggauugugccugua

SEQ ID NO: 2190973 - RNA, 15 nt, Human
gugccucugccuguc

SEQ ID NO: 2190974 - RNA, 14 nt, Human
gugccuuauggaac

SEQ ID NO: 2190975 - RNA, 21 nt, Human
gugccuuauggaacacucuga

SEQ ID NO: 2190976 - RNA, 23 nt, Human
gugccuuauggaacacucugaga

SEQ ID NO: 2190977 - RNA, 13 nt, Human
gugccucugggac

SEQ ID NO: 2190978 - RNA, 12 nt, Human
gugccucuggga

SEQ ID NO: 2190979 - RNA, 13 nt, Human
gugccucugccug

SEQ ID NO: 2190980 - RNA, 20 nt, Human
gugccuccaccaccacuggc

SEQ ID NO: 2190981 - RNA, 21 nt, Human
gugccuccaccaccacuggcc

SEQ ID NO: 2190982 - RNA, 22 nt, Human
gugccuccaccaccacuggcca

SEQ ID NO: 2190983 - RNA, 23 nt, Human
gugccuccaccaccacuggccac

SEQ ID NO: 2190984 - RNA, 14 nt, Human
gugccucauugcuu

SEQ ID NO: 2190985 - RNA, 15 nt, Human
gugccuccaccacca

SEQ ID NO: 2190986 - RNA, 17 nt, Human
gugccuccaccaccacu

SEQ ID NO: 2190987 - RNA, 17 nt, Human
aagaaggaaaaggcagg

SEQ ID NO: 2190988 - RNA, 23 nt, Human
aagaaggaaaaugaucugagucc

SEQ ID NO: 2190989 - RNA, 16 nt, Human
aagaagcuuaggcagg

SEQ ID NO: 2190990 - RNA, 21 nt, Human
aagaagcuuuaauauuuaaau

SEQ ID NO: 2190991 - RNA, 11 nt, Human
aagaaggaagu

SEQ ID NO: 2190992 - RNA, 16 nt, Human
aagaaggaaaaugauc

SEQ ID NO: 2190993 - RNA, 14 nt, Human
aagaaggcaaaaau

SEQ ID NO: 2190994 - RNA, 14 nt, Human
aagaaaucccuguu

SEQ ID NO: 2190995 - RNA, 13 nt, Human
aagaaaucccugu

SEQ ID NO: 2190996 - RNA, 14 nt, Human
aagaaaucacagaa

SEQ ID NO: 2190997 - RNA, 18 nt, Human
aagaaaucacagaaucau

SEQ ID NO: 2190998 - RNA, 23 nt, Human
aagaaaucccuguuuaauauuua

SEQ ID NO: 2190999 - RNA, 16 nt, Human
aagaagcuguuguaca

SEQ ID NO: 2191000 - RNA, 17 nt, Human
aagaagcuguuguacau

SEQ ID NO: 2191001 - RNA, 18 nt, Human
aagaagcuguuguacauu

SEQ ID NO: 2191002 - RNA, 19 nt, Human
aagaagcuguuguacauuu

SEQ ID NO: 2191003 - RNA, 21 nt, Human
aagaagcuguuguacauuuau

SEQ ID NO: 2191004 - RNA, 22 nt, Human
aagaagcuguuguacauuuaug

SEQ ID NO: 2191005 - RNA, 23 nt, Human
aagaagcuguuguacauuuauga

SEQ ID NO: 2191006 - RNA, 16 nt, Human
aagaaggcaaaaaugu

SEQ ID NO: 2191007 - RNA, 14 nt, Human
aagaauacagaaag

SEQ ID NO: 2191008 - RNA, 22 nt, Human
aagaauacaaacauauuuguua

SEQ ID NO: 2191009 - RNA, 18 nt, Human
aagaauacaaacauauuu

SEQ ID NO: 2191010 - RNA, 19 nt, Human
aagaagugugucacccuua

SEQ ID NO: 2191011 - RNA, 22 nt, Human
aagaagugaaaaucuacacucc

SEQ ID NO: 2191012 - RNA, 16 nt, Human
aagaagugaaaaucua

SEQ ID NO: 2191013 - RNA, 13 nt, Human
aagaauacagaaa

SEQ ID NO: 2191014 - RNA, 18 nt, Human
gugcuaggaacacuccuu

SEQ ID NO: 2191015 - RNA, 22 nt, Human
gugcuaggaacacuccuucaca

SEQ ID NO: 2191016 - RNA, 20 nt, Human
gugcuagggaaacuucccgu

SEQ ID NO: 2191017 - RNA, 21 nt, Human
gugcuaucucccccagcccca

SEQ ID NO: 2191018 - RNA, 18 nt, Human
gugcuaguaauuggaaag

SEQ ID NO: 2191019 - RNA, 13 nt, Human
aagaaauauaccu

SEQ ID NO: 2191020 - RNA, 15 nt, Human
aagaaagaaggaagu

SEQ ID NO: 2191021 - RNA, 17 nt, Human
aagaaagagaaggagcc

SEQ ID NO: 2191022 - RNA, 13 nt, Human
aagaaauacugua

SEQ ID NO: 2191023 - RNA, 15 nt, Human
aagaaauacuguaca

SEQ ID NO: 2191024 - RNA, 22 nt, Human
aagaaagacuaucuaaauguug

SEQ ID NO: 2191025 - RNA, 20 nt, Human
aagaaagacuaucuaaaugu

SEQ ID NO: 2191026 - RNA, 14 nt, Human
aagaaagaaggaag

SEQ ID NO: 2191027 - RNA, 13 nt, Human
aagaaagaaggaa

SEQ ID NO: 2191028 - RNA, 20 nt, Human
aagaaaaaagagaaaagaaa

SEQ ID NO: 2191029 - RNA, 18 nt, Human
aagaaaaaagagaaaaga

SEQ ID NO: 2191030 - RNA, 11 nt, Human
aagaaaaaagu

SEQ ID NO: 2191031 - RNA, 15 nt, Human
aagaaaaagaagaac

SEQ ID NO: 2191032 - RNA, 17 nt, Human
aagaaaaaggaugcaca

SEQ ID NO: 2191033 - RNA, 15 nt, Human
aagaaaaaggaugca

SEQ ID NO: 2191034 - RNA, 16 nt, Human
aagaaacucaccccca

SEQ ID NO: 2191035 - RNA, 17 nt, Human
aagaaacuauacaucau

SEQ ID NO: 2191036 - RNA, 21 nt, Human
aagaaacgucuauguguacag

SEQ ID NO: 2191037 - RNA, 18 nt, Human
aagaaaaaggaugcacag

SEQ ID NO: 2191038 - RNA, 16 nt, Human
aagaaacugaggaauu

SEQ ID NO: 2191039 - RNA, 20 nt, Human
aagaaacugaggaauuuucu

SEQ ID NO: 2191040 - RNA, 19 nt, Human
aagaaacugaggaauuuuc

SEQ ID NO: 2191041 - RNA, 21 nt, Human
aagaaacugaggaauuuucuu

SEQ ID NO: 2191042 - RNA, 19 nt, Human
guggaugucuuccuuggag

SEQ ID NO: 2191043 - RNA, 13 nt, Human
guggaugucuucc

SEQ ID NO: 2191044 - RNA, 15 nt, Human
guggaugucuuccuu

SEQ ID NO: 2191045 - RNA, 16 nt, Human
guggaugucuuccuug

SEQ ID NO: 2191046 - RNA, 15 nt, Human
guggauggccccagc

SEQ ID NO: 2191047 - RNA, 16 nt, Human
guggauggccccagca

SEQ ID NO: 2191048 - RNA, 19 nt, Human
guggauggccccagcacag

SEQ ID NO: 2191049 - RNA, 22 nt, Human
guggauggccccagcacagcuu

SEQ ID NO: 2191050 - RNA, 21 nt, Human
guggaugccugguggcagcug

SEQ ID NO: 2191051 - RNA, 21 nt, Human
guggauggaaggggcugacag

SEQ ID NO: 2191052 - RNA, 13 nt, Human
guggauggcccca

SEQ ID NO: 2191053 - RNA, 14 nt, Human
guggaccuuccugc

SEQ ID NO: 2191054 - RNA, 22 nt, Human
guggacccagggaugacauguc

SEQ ID NO: 2191055 - RNA, 18 nt, Human
guggaccaggacaggacc

SEQ ID NO: 2191056 - RNA, 14 nt, Human
guggaccaggacag

SEQ ID NO: 2191057 - RNA, 13 nt, Human
guggaccaggaca

SEQ ID NO: 2191058 - RNA, 15 nt, Human
guggacaguccuggg

SEQ ID NO: 2191059 - RNA, 14 nt, Human
guggacaguccugg

SEQ ID NO: 2191060 - RNA, 16 nt, Human
guggacaguccuggga

SEQ ID NO: 2191061 - RNA, 13 nt, Human
guggaccuuccug

SEQ ID NO: 2191062 - RNA, 21 nt, Human
guggaccuuaggccuuccucu

SEQ ID NO: 2191063 - RNA, 15 nt, Human
guggaccuuccugcc

SEQ ID NO: 2191064 - RNA, 18 nt, Human
guggaccuuaggccuucc

SEQ ID NO: 2191065 - RNA, 17 nt, Human
guggaccuuaggccuuc

SEQ ID NO: 2191066 - RNA, 18 nt, Human
guggaauauaaggaaagc

SEQ ID NO: 2191067 - RNA, 13 nt, Human
guggaauauaaag

SEQ ID NO: 2191068 - RNA, 15 nt, Human
guggaauuauuuuaa

SEQ ID NO: 2191069 - RNA, 18 nt, Human
guggaauuauuuuaaaag

SEQ ID NO: 2191070 - RNA, 16 nt, Human
guggaauuauuuuaaa

SEQ ID NO: 2191071 - RNA, 22 nt, Human
guggaagugugggucugugugu

SEQ ID NO: 2191072 - RNA, 21 nt, Human
guggaagugugggucugugug

SEQ ID NO: 2191073 - RNA, 14 nt, Human
guggaauaaaauac

SEQ ID NO: 2191074 - RNA, 18 nt, Human
guggaauaguauccucca

SEQ ID NO: 2191075 - RNA, 19 nt, Human
guggaauaguauccuccag

SEQ ID NO: 2191076 - RNA, 20 nt, Human
guggaauaguauccuccagg

SEQ ID NO: 2191077 - RNA, 21 nt, Human
guggaauaguauccuccaggu

SEQ ID NO: 2191078 - RNA, 22 nt, Human
guggaauaguauccuccagguu

SEQ ID NO: 2191079 - RNA, 23 nt, Human
guggaauaguauccuccagguuu

SEQ ID NO: 2191080 - RNA, 13 nt, Human
guggacaguccug

SEQ ID NO: 2191081 - RNA, 19 nt, Human
guggaauuauuuuaaaaga

SEQ ID NO: 2191082 - RNA, 23 nt, Human
guggacacagcucuucuccaggc

SEQ ID NO: 2191083 - RNA, 18 nt, Human
guggacacagcucuucuc

SEQ ID NO: 2191084 - RNA, 22 nt, Human
guggacacagcucuucuccagg

SEQ ID NO: 2191085 - RNA, 20 nt, Human
gugcugggauuacaggcgug

SEQ ID NO: 2191086 - RNA, 20 nt, Human
gugcugggauuacaggugug

SEQ ID NO: 2191087 - RNA, 20 nt, Human
guggaagugugggucugugu

SEQ ID NO: 2191088 - RNA, 19 nt, Human
guggaagugugggucugug

SEQ ID NO: 2191089 - RNA, 15 nt, Human
guggaaguguggguc

SEQ ID NO: 2191090 - RNA, 14 nt, Human
guggaagugugggu

SEQ ID NO: 2191091 - RNA, 15 nt, Human
gugcugggagggaua

SEQ ID NO: 2191092 - RNA, 23 nt, Human
gugcugggaggagggagagggag

SEQ ID NO: 2191093 - RNA, 18 nt, Human
gugcugggaggagggaga

SEQ ID NO: 2191094 - RNA, 19 nt, Human
gugcugggaggagggagag

SEQ ID NO: 2191095 - RNA, 23 nt, Human
gugcugggagcuccacucugcuu

SEQ ID NO: 2191096 - RNA, 15 nt, Human
gugcugggaggaggg

SEQ ID NO: 2191097 - RNA, 17 nt, Human
gugcugggaggagggag

SEQ ID NO: 2191098 - RNA, 22 nt, Human
gugcugggacugagccaguccc

SEQ ID NO: 2191099 - RNA, 16 nt, Human
gugcugggagcuccac

SEQ ID NO: 2191100 - RNA, 22 nt, Human
gugcugggagcuccacucugcu

SEQ ID NO: 2191101 - RNA, 21 nt, Human
gugcugggauuacaagcguga

SEQ ID NO: 2191102 - RNA, 22 nt, Human
gugcugggauuacaagcgugag

SEQ ID NO: 2191103 - RNA, 13 nt, Human
gugcuaugaauuu

SEQ ID NO: 2191104 - RNA, 19 nt, Human
gugcuauggauggcuucua

SEQ ID NO: 2191105 - RNA, 22 nt, Human
gugcuaucucccccagccccau

SEQ ID NO: 2191106 - RNA, 12 nt, Human
gugcuauguucu

SEQ ID NO: 2191107 - RNA, 23 nt, Human
gugcuauuguagagccagagguc

SEQ ID NO: 2191108 - RNA, 15 nt, Human
gugcuggcugcccag

SEQ ID NO: 2191109 - RNA, 13 nt, Human
gugcugggacuga

SEQ ID NO: 2191110 - RNA, 18 nt, Human
gugcuggcugcccagacc

SEQ ID NO: 2191111 - RNA, 17 nt, Human
gugcugggacugagcca

SEQ ID NO: 2191112 - RNA, 18 nt, Human
gugcugggacugagccag

SEQ ID NO: 2191113 - RNA, 19 nt, Human
gugcugggacugagccagu

SEQ ID NO: 2191114 - RNA, 20 nt, Human
gugcugggacugagccaguc

SEQ ID NO: 2191115 - RNA, 22 nt, Human
gugcucaggacucagaagccuc

SEQ ID NO: 2191116 - RNA, 18 nt, Human
gugcucaggacucagaag

SEQ ID NO: 2191117 - RNA, 21 nt, Human
gugcuauuuuguuuguuuugu

SEQ ID NO: 2191118 - RNA, 15 nt, Human
gugcucaggagcccu

SEQ ID NO: 2191119 - RNA, 20 nt, Human
aagaauugaacccaggaggu

SEQ ID NO: 2191120 - RNA, 19 nt, Human
aagaauugaacccaggagg

SEQ ID NO: 2191121 - RNA, 20 nt, Human
aagaauugucuuucugucuc

SEQ ID NO: 2191122 - RNA, 15 nt, Human
aagaauuuagggaga

SEQ ID NO: 2191123 - RNA, 14 nt, Human
aagacaaacugcau

SEQ ID NO: 2191124 - RNA, 17 nt, Human
aagacaaaucaaagcag

SEQ ID NO: 2191125 - RNA, 17 nt, Human
aagacaaagguuuuccu

SEQ ID NO: 2191126 - RNA, 13 nt, Human
aagacccuucucg

SEQ ID NO: 2191127 - RNA, 13 nt, Human
aagacccuccccg

SEQ ID NO: 2191128 - RNA, 18 nt, Human
aagacaaauucuguuucu

SEQ ID NO: 2191129 - RNA, 16 nt, Human
aagacaaauucuguuu

SEQ ID NO: 2191130 - RNA, 12 nt, Human
aagacaacauua

SEQ ID NO: 2191131 - RNA, 22 nt, Human
aagaaugcugguuuuccuaaau

SEQ ID NO: 2191132 - RNA, 18 nt, Human
aagaaugggcaguuacau

SEQ ID NO: 2191133 - RNA, 17 nt, Human
aagaaugggcaguuaca

SEQ ID NO: 2191134 - RNA, 16 nt, Human
aagaauugaagcagga

SEQ ID NO: 2191135 - RNA, 20 nt, Human
aagaaugggcaguuacaugc

SEQ ID NO: 2191136 - RNA, 21 nt, Human
aagaaugggcaguuacaugca

SEQ ID NO: 2191137 - RNA, 20 nt, Human
aagaauggggaucacagaga

SEQ ID NO: 2191138 - RNA, 19 nt, Human
aagaaugcugguuuuccua

SEQ ID NO: 2191139 - RNA, 18 nt, Human
aagaaugcugguuuuccu

SEQ ID NO: 2191140 - RNA, 15 nt, Human
aagaaugcugguuuu

SEQ ID NO: 2191141 - RNA, 16 nt, Human
aagaaugcugaaacca

SEQ ID NO: 2191142 - RNA, 9 nt, Human
aagaaugcu

SEQ ID NO: 2191143 - RNA, 12 nt, Human
aagaaugcugaa

SEQ ID NO: 2191144 - RNA, 13 nt, Human
aagaaugcugaaa

SEQ ID NO: 2191145 - RNA, 14 nt, Human
aagaaugcugaaac

SEQ ID NO: 2191146 - RNA, 18 nt, Human
aagaaugauuaugaauua

SEQ ID NO: 2191147 - RNA, 14 nt, Human
guggcagcccugua

SEQ ID NO: 2191148 - RNA, 23 nt, Human
aagaaucagucuauccacagaga

SEQ ID NO: 2191149 - RNA, 20 nt, Human
guggcagcucaccucucccu

SEQ ID NO: 2191150 - RNA, 14 nt, Human
guggcagcucaccu

SEQ ID NO: 2191151 - RNA, 16 nt, Human
guggcagcucaccucu

SEQ ID NO: 2191152 - RNA, 16 nt, Human
aagaaucuaucugcuu

SEQ ID NO: 2191153 - RNA, 17 nt, Human
aagaaucuaucugcuua

SEQ ID NO: 2191154 - RNA, 19 nt, Human
aagaaucuaucugcuuaug

SEQ ID NO: 2191155 - RNA, 15 nt, Human
aagaaucuuuagaga

SEQ ID NO: 2191156 - RNA, 14 nt, Human
aagaaugaaagagu

SEQ ID NO: 2191157 - RNA, 21 nt, Human
aagaaugagaaggagucagaa

SEQ ID NO: 2191158 - RNA, 22 nt, Human
aagaaugagccuacgcugaaga

SEQ ID NO: 2191159 - RNA, 19 nt, Human
aagaaugaacaaauugaac

SEQ ID NO: 2191160 - RNA, 16 nt, Human
aagaaugauuaugaau

SEQ ID NO: 2191161 - RNA, 13 nt, Human
guggcagcccugu

SEQ ID NO: 2191162 - RNA, 12 nt, Human
guggcagcccug

SEQ ID NO: 2191163 - RNA, 14 nt, Human
guggcacugagccc

SEQ ID NO: 2191164 - RNA, 15 nt, Human
guggcacugagcccc

SEQ ID NO: 2191165 - RNA, 16 nt, Human
guggcacugagccccc

SEQ ID NO: 2191166 - RNA, 12 nt, Human
guggcacugcca

SEQ ID NO: 2191167 - RNA, 18 nt, Human
guggcaccagcagccugg

SEQ ID NO: 2191168 - RNA, 19 nt, Human
guggauugcacguggccuc

SEQ ID NO: 2191169 - RNA, 13 nt, Human
guggauugagggu

SEQ ID NO: 2191170 - RNA, 20 nt, Human
guggcaccagcgaagggagu

SEQ ID NO: 2191171 - RNA, 19 nt, Human
guggcacgucaucuaguuu

SEQ ID NO: 2191172 - RNA, 16 nt, Human
guggcacucaacauga

SEQ ID NO: 2191173 - RNA, 19 nt, Human
guggcaccagcagccugga

SEQ ID NO: 2191174 - RNA, 19 nt, Human
guggauuuaacagaaaugu

SEQ ID NO: 2191175 - RNA, 18 nt, Human
guggauuuaacagaaaug

SEQ ID NO: 2191176 - RNA, 17 nt, Human
aagaccucaccuagaaa

SEQ ID NO: 2191177 - RNA, 16 nt, Human
aagaccucaccuagaa

SEQ ID NO: 2191178 - RNA, 17 nt, Human
aagaccuguugguucca

SEQ ID NO: 2191179 - RNA, 17 nt, Human
aagaccuggcagcucug

SEQ ID NO: 2191180 - RNA, 12 nt, Human
aagaccuggcaa

SEQ ID NO: 2191181 - RNA, 21 nt, Human
aagaccuggcaaggacacaga

SEQ ID NO: 2191182 - RNA, 17 nt, Human
aagacuaucuaaauguu

SEQ ID NO: 2191183 - RNA, 16 nt, Human
aagacuaucuaaaugu

SEQ ID NO: 2191184 - RNA, 22 nt, Human
aagacccuuguggucccacccc

SEQ ID NO: 2191185 - RNA, 18 nt, Human
aagacccuugugguccca

SEQ ID NO: 2191186 - RNA, 21 nt, Human
aagacccuuguggucccaccc

SEQ ID NO: 2191187 - RNA, 21 nt, Human
aagaccuucuccaaaugagau

SEQ ID NO: 2191188 - RNA, 19 nt, Human
aagaccuguugguuccaag

SEQ ID NO: 2191189 - RNA, 13 nt, Human
aagacuauucaaa

SEQ ID NO: 2191190 - RNA, 18 nt, Human
aagacuaucuaaauguug

SEQ ID NO: 2191191 - RNA, 17 nt, Human
aagacugaguacguugu

SEQ ID NO: 2191192 - RNA, 22 nt, Human
aagacucuaccagacuguguau

SEQ ID NO: 2191193 - RNA, 15 nt, Human
aagacuguggcugcu

SEQ ID NO: 2191194 - RNA, 12 nt, Human
aagacuguggcu

SEQ ID NO: 2191195 - RNA, 15 nt, Human
aagacugagcaccug

SEQ ID NO: 2191196 - RNA, 19 nt, Human
aagacugagcaccugcuuc

SEQ ID NO: 2191197 - RNA, 17 nt, Human
aagacuguacaaaguag

SEQ ID NO: 2191198 - RNA, 22 nt, Human
aagacugaguacguugugcauu

SEQ ID NO: 2191199 - RNA, 21 nt, Human
aagacugaguacguugugcau

SEQ ID NO: 2191200 - RNA, 18 nt, Human
guggcccgacagccuggc

SEQ ID NO: 2191201 - RNA, 19 nt, Human
guggcccgacagccuggca

SEQ ID NO: 2191202 - RNA, 13 nt, Human
aagaggaaaauga

SEQ ID NO: 2191203 - RNA, 14 nt, Human
aagaggaaaaugaa

SEQ ID NO: 2191204 - RNA, 21 nt, Human
aagaggaaaaugaauaauaca

SEQ ID NO: 2191205 - RNA, 14 nt, Human
aagaggaaagaaug

SEQ ID NO: 2191206 - RNA, 15 nt, Human
aagaggaaagaauga

SEQ ID NO: 2191207 - RNA, 16 nt, Human
aagagcuuaacagugu

SEQ ID NO: 2191208 - RNA, 22 nt, Human
aagagccuugguguccaccugg

SEQ ID NO: 2191209 - RNA, 21 nt, Human
aagagccuugguguccaccug

SEQ ID NO: 2191210 - RNA, 20 nt, Human
aagagccuugguguccaccu

SEQ ID NO: 2191211 - RNA, 17 nt, Human
aagagccuggagaagcu

SEQ ID NO: 2191212 - RNA, 21 nt, Human
aagagccuggagaagcugaug

SEQ ID NO: 2191213 - RNA, 18 nt, Human
aagacuguggcugcuagc

SEQ ID NO: 2191214 - RNA, 16 nt, Human
aagacuguugcucaaa

SEQ ID NO: 2191215 - RNA, 24 nt, Human
aagacuguugcucaaaucuauuca

SEQ ID NO: 2191216 - RNA, 17 nt, Human
aagacuguugcucaaau

SEQ ID NO: 2191217 - RNA, 18 nt, Human
aagacuucaguauguugu

SEQ ID NO: 2191218 - RNA, 20 nt, Human
aagacuucaguauguuguca

SEQ ID NO: 2191219 - RNA, 17 nt, Human
aagagauuguuguuugc

SEQ ID NO: 2191220 - RNA, 14 nt, Human
aagagauuuaauua

SEQ ID NO: 2191221 - RNA, 16 nt, Human
aagagauuuaauuaau

SEQ ID NO: 2191222 - RNA, 13 nt, Human
aagagauuuuuca

SEQ ID NO: 2191223 - RNA, 13 nt, Human
aagagauuucaag

SEQ ID NO: 2191224 - RNA, 14 nt, Human
aagagauuucaaga

SEQ ID NO: 2191225 - RNA, 14 nt, Human
aagagauuuuucau

SEQ ID NO: 2191226 - RNA, 15 nt, Human
aagagauuuuucaug

SEQ ID NO: 2191227 - RNA, 17 nt, Human
aagagauuuuucaugau

SEQ ID NO: 2191228 - RNA, 15 nt, Human
aagagauuucaagag

SEQ ID NO: 2191229 - RNA, 15 nt, Human
aagagcaagucugga

SEQ ID NO: 2191230 - RNA, 13 nt, Human
aagagcacacuug

SEQ ID NO: 2191231 - RNA, 12 nt, Human
aagagcacagcc

SEQ ID NO: 2191232 - RNA, 13 nt, Human
aagagcacagccc

SEQ ID NO: 2191233 - RNA, 14 nt, Human
aagagcacagcccu

SEQ ID NO: 2191234 - RNA, 15 nt, Human
aagagcacagcccuc

SEQ ID NO: 2191235 - RNA, 19 nt, Human
aagagcacagcccucccgc

SEQ ID NO: 2191236 - RNA, 19 nt, Human
aagagcaccuuccucacuu

SEQ ID NO: 2191237 - RNA, 16 nt, Human
aagagcacuuaagaga

SEQ ID NO: 2191238 - RNA, 17 nt, Human
aagagcacuuaagagaa

SEQ ID NO: 2191239 - RNA, 21 nt, Human
aagagcacuuaagagaauauu

SEQ ID NO: 2191240 - RNA, 14 nt, Human
aagagcccuugccu

SEQ ID NO: 2191241 - RNA, 16 nt, Human
aagagcccuugccucc

SEQ ID NO: 2191242 - RNA, 18 nt, Human
aagagcccuugccucccc

SEQ ID NO: 2191243 - RNA, 14 nt, Human
aagagccggagccu

SEQ ID NO: 2191244 - RNA, 19 nt, Human
aagagccggagccuccagc

SEQ ID NO: 2191245 - RNA, 12 nt, Human
aagagccugcag

SEQ ID NO: 2191246 - RNA, 16 nt, Human
aagagccugcaggugc

SEQ ID NO: 2191247 - RNA, 20 nt, Human
aagagccugcaggugcugcu

SEQ ID NO: 2191248 - RNA, 22 nt, Human
aagagccugcaggugcugcugc

SEQ ID NO: 2191249 - RNA, 11 nt, Human
aagagccugga

SEQ ID NO: 2191250 - RNA, 13 nt, Human
aagagccuggaga

SEQ ID NO: 2191251 - RNA, 14 nt, Human
aagagccuggagaa

SEQ ID NO: 2191252 - RNA, 16 nt, Human
aagagccuggagaagc

SEQ ID NO: 2191253 - RNA, 21 nt, Human
gugggaggggcgcccaccucc

SEQ ID NO: 2191254 - RNA, 16 nt, Human
gugggaggggcaggcu

SEQ ID NO: 2191255 - RNA, 17 nt, Human
gugggaggggcaggcug

SEQ ID NO: 2191256 - RNA, 12 nt, Human
gugggaggggca

SEQ ID NO: 2191257 - RNA, 13 nt, Human
gugggaggggcag

SEQ ID NO: 2191258 - RNA, 14 nt, Human
gugggaggggcagg

SEQ ID NO: 2191259 - RNA, 15 nt, Human
gugggaggggcaggc

SEQ ID NO: 2191260 - RNA, 17 nt, Human
gugggagguggaagaag

SEQ ID NO: 2191261 - RNA, 13 nt, Human
gugggagggagca

SEQ ID NO: 2191262 - RNA, 14 nt, Human
gugggagggagcag

SEQ ID NO: 2191263 - RNA, 15 nt, Human
gugggagggagcaga

SEQ ID NO: 2191264 - RNA, 19 nt, Human
gugggagggagcagacagg

SEQ ID NO: 2191265 - RNA, 23 nt, Human
gugggaggaucucuugagccugg

SEQ ID NO: 2191266 - RNA, 19 nt, Human
gugggacggugcccaagcc

SEQ ID NO: 2191267 - RNA, 20 nt, Human
gugggacggugcccaagcca

SEQ ID NO: 2191268 - RNA, 13 nt, Human
gugggagugggcc

SEQ ID NO: 2191269 - RNA, 14 nt, Human
gugggagugggccc

SEQ ID NO: 2191270 - RNA, 13 nt, Human
gugggauccucca

SEQ ID NO: 2191271 - RNA, 14 nt, Human
gugggaguguguaa

SEQ ID NO: 2191272 - RNA, 13 nt, Human
gugggagugugua

SEQ ID NO: 2191273 - RNA, 15 nt, Human
gugggacagagucug

SEQ ID NO: 2191274 - RNA, 21 nt, Human
gugggacagucaccucaugga

SEQ ID NO: 2191275 - RNA, 17 nt, Human
guggcggugccugggug

SEQ ID NO: 2191276 - RNA, 14 nt, Human
guggcggugccugg

SEQ ID NO: 2191277 - RNA, 13 nt, Human
guggcggugccug

SEQ ID NO: 2191278 - RNA, 15 nt, Human
guggcgggcgccugu

SEQ ID NO: 2191279 - RNA, 22 nt, Human
gugggacacccugugauggggc

SEQ ID NO: 2191280 - RNA, 19 nt, Human
guggcccuggccugcuggg

SEQ ID NO: 2191281 - RNA, 18 nt, Human
guggcccuggccugcugg

SEQ ID NO: 2191282 - RNA, 16 nt, Human
guggcccugucccucc

SEQ ID NO: 2191283 - RNA, 17 nt, Human
guggcccugucccuccc

SEQ ID NO: 2191284 - RNA, 21 nt, Human
guggcccugucccucccaccu

SEQ ID NO: 2191285 - RNA, 17 nt, Human
guggcccuggccugcug

SEQ ID NO: 2191286 - RNA, 16 nt, Human
guggcccuggccugcu

SEQ ID NO: 2191287 - RNA, 13 nt, Human
guggcccuggccu

SEQ ID NO: 2191288 - RNA, 21 nt, Human
guggcccugccaucuucccag

SEQ ID NO: 2191289 - RNA, 13 nt, Human
guggcccugccau

SEQ ID NO: 2191290 - RNA, 17 nt, Human
guggcccugccaucuuc

SEQ ID NO: 2191291 - RNA, 22 nt, Human
guggcccugccaucuucccagc

SEQ ID NO: 2191292 - RNA, 23 nt, Human
guggcgcagcauauucaggaagc

SEQ ID NO: 2191293 - RNA, 22 nt, Human
guggcgccgucuccaggggcug

SEQ ID NO: 2191294 - RNA, 17 nt, Human
guggcgccgucuccagg

SEQ ID NO: 2191295 - RNA, 21 nt, Human
guggcgccgucuccaggggcu

SEQ ID NO: 2191296 - RNA, 13 nt, Human
gugggucuucagg

SEQ ID NO: 2191297 - RNA, 17 nt, Human
guggguacuauucugau

SEQ ID NO: 2191298 - RNA, 16 nt, Human
gugggucugugugugu

SEQ ID NO: 2191299 - RNA, 13 nt, Human
gugggucugugug

SEQ ID NO: 2191300 - RNA, 17 nt, Human
gugggucuucagggggc

SEQ ID NO: 2191301 - RNA, 21 nt, Human
gugggucuucagggggccagg

SEQ ID NO: 2191302 - RNA, 15 nt, Human
gugggugagaugcug

SEQ ID NO: 2191303 - RNA, 20 nt, Human
gugggugagaugcuggagaa

SEQ ID NO: 2191304 - RNA, 19 nt, Human
guggguggaaccaggaacc

SEQ ID NO: 2191305 - RNA, 23 nt, Human
gugggugagaugcuggagaagag

SEQ ID NO: 2191306 - RNA, 18 nt, Human
guggguggauauaaauau

SEQ ID NO: 2191307 - RNA, 20 nt, Human
guggguggauauaaauauau

SEQ ID NO: 2191308 - RNA, 21 nt, Human
guggguggauauaaauauaua

SEQ ID NO: 2191309 - RNA, 18 nt, Human
guggugggacagggaccc

SEQ ID NO: 2191310 - RNA, 12 nt, Human
gugguggggagg

SEQ ID NO: 2191311 - RNA, 16 nt, Human
guggugguaacccugg

SEQ ID NO: 2191312 - RNA, 22 nt, Human
gugguggguucuuuggaaggag

SEQ ID NO: 2191313 - RNA, 20 nt, Human
gugguggggaggggcgcugg

SEQ ID NO: 2191314 - RNA, 22 nt, Human
gugguggggaggggcgcuggcc

SEQ ID NO: 2191315 - RNA, 20 nt, Human
guggugguaacccugguggu

SEQ ID NO: 2191316 - RNA, 19 nt, Human
guggugguaacccuggugg

SEQ ID NO: 2191317 - RNA, 14 nt, Human
guggugguuuucug

SEQ ID NO: 2191318 - RNA, 16 nt, Human
gugguuucagaaaugu

SEQ ID NO: 2191319 - RNA, 22 nt, Human
gugggggcagagggcagaggcu

SEQ ID NO: 2191320 - RNA, 15 nt, Human
guggggggcuucaua

SEQ ID NO: 2191321 - RNA, 16 nt, Human
guggggggcuucauac

SEQ ID NO: 2191322 - RNA, 20 nt, Human
gugggggaucacagccucug

SEQ ID NO: 2191323 - RNA, 18 nt, Human
gugggggcagagggcaga

SEQ ID NO: 2191324 - RNA, 17 nt, Human
gugggggcagagggcag

SEQ ID NO: 2191325 - RNA, 14 nt, Human
gugggggcagaggg

SEQ ID NO: 2191326 - RNA, 17 nt, Human
gugggauaucccuaugc

SEQ ID NO: 2191327 - RNA, 15 nt, Human
gugggagucaucuca

SEQ ID NO: 2191328 - RNA, 15 nt, Human
guggguacagagagg

SEQ ID NO: 2191329 - RNA, 22 nt, Human
gugggguguguuccaacugccc

SEQ ID NO: 2191330 - RNA, 14 nt, Human
guggguacgggagg

SEQ ID NO: 2191331 - RNA, 17 nt, Human
guggggugaggaccacu

SEQ ID NO: 2191332 - RNA, 12 nt, Human
gugggggcugca

SEQ ID NO: 2191333 - RNA, 13 nt, Human
guggggugugcug

SEQ ID NO: 2191334 - RNA, 16 nt, Human
guggggugugcuggga

SEQ ID NO: 2191335 - RNA, 19 nt, Human
guggggugugcugggagcu

SEQ ID NO: 2191336 - RNA, 11 nt, Human
aagcaaaggug

SEQ ID NO: 2191337 - RNA, 17 nt, Human
aagcaaaggugaagaga

SEQ ID NO: 2191338 - RNA, 18 nt, Human
aagcaaccuggguccaaa

SEQ ID NO: 2191339 - RNA, 20 nt, Human
aagcaaccuggguccaaaua

SEQ ID NO: 2191340 - RNA, 21 nt, Human
aagcaaccuggguccaaauaa

SEQ ID NO: 2191341 - RNA, 22 nt, Human
aagcaaccuggguccaaauaaa

SEQ ID NO: 2191342 - RNA, 12 nt, Human
aagcaaaggaga

SEQ ID NO: 2191343 - RNA, 13 nt, Human
aagcaaaggagau

SEQ ID NO: 2191344 - RNA, 15 nt, Human
aagcaagaaagaaac

SEQ ID NO: 2191345 - RNA, 14 nt, Human
aagcaacuguuaug

SEQ ID NO: 2191346 - RNA, 18 nt, Human
aagcaagagagauguuuu

SEQ ID NO: 2191347 - RNA, 15 nt, Human
aagcaagagagaugu

SEQ ID NO: 2191348 - RNA, 16 nt, Human
aagcaacugucuauuu

SEQ ID NO: 2191349 - RNA, 23 nt, Human
aagcaaccuggguccaaauaaaa

SEQ ID NO: 2191350 - RNA, 17 nt, Human
aagcaacugucuauuuc

SEQ ID NO: 2191351 - RNA, 18 nt, Human
aagcaacugucuauuucu

SEQ ID NO: 2191352 - RNA, 21 nt, Human
aagcaacugucuauuucugcu

SEQ ID NO: 2191353 - RNA, 22 nt, Human
aagcaacugucuauuucugcug

SEQ ID NO: 2191354 - RNA, 23 nt, Human
aagcaacugucuauuucugcuga

SEQ ID NO: 2191355 - RNA, 15 nt, Human
aagcaagauuucaga

SEQ ID NO: 2191356 - RNA, 17 nt, Human
aagcaagagagauguuu

SEQ ID NO: 2191357 - RNA, 17 nt, Human
aagcaauaaagaagagu

SEQ ID NO: 2191358 - RNA, 16 nt, Human
aagcaauaaaugaaug

SEQ ID NO: 2191359 - RNA, 14 nt, Human
aagcaauaaaugaa

SEQ ID NO: 2191360 - RNA, 20 nt, Human
aagcaauaauggucccaucc

SEQ ID NO: 2191361 - RNA, 21 nt, Human
aagcaauaauggucccaucca

SEQ ID NO: 2191362 - RNA, 22 nt, Human
aagcaauaauggucccauccag

SEQ ID NO: 2191363 - RNA, 21 nt, Human
aagaugcugaaacaggagaga

SEQ ID NO: 2191364 - RNA, 17 nt, Human
aagaugcucuucugugg

SEQ ID NO: 2191365 - RNA, 10 nt, Human
aagaugcugg

SEQ ID NO: 2191366 - RNA, 22 nt, Human
aagaugcuggaugucugccaau

SEQ ID NO: 2191367 - RNA, 11 nt, Human
aagaugcuggg

SEQ ID NO: 2191368 - RNA, 14 nt, Human
aagaugcuggguug

SEQ ID NO: 2191369 - RNA, 16 nt, Human
aagaugcuggguuggu

SEQ ID NO: 2191370 - RNA, 20 nt, Human
aagaugcuggguuggugcac

SEQ ID NO: 2191371 - RNA, 20 nt, Human
aagauguccuccuuguucua

SEQ ID NO: 2191372 - RNA, 15 nt, Human
aagaugcucuuuuaa

SEQ ID NO: 2191373 - RNA, 22 nt, Human
aagaugcucuaucuugcucugu

SEQ ID NO: 2191374 - RNA, 15 nt, Human
aagaugcucuucugu

SEQ ID NO: 2191375 - RNA, 24 nt, Human
aagaugcccacugaggaaugauga

SEQ ID NO: 2191376 - RNA, 15 nt, Human
aagaugcucuaucuu

SEQ ID NO: 2191377 - RNA, 21 nt, Human
aagaugcucuaucuugcucug

SEQ ID NO: 2191378 - RNA, 22 nt, Human
aagcaaagacuuuccucuuagu

SEQ ID NO: 2191379 - RNA, 17 nt, Human
aagcaaagcaccagcuu

SEQ ID NO: 2191380 - RNA, 14 nt, Human
aagaugugacaugu

SEQ ID NO: 2191381 - RNA, 18 nt, Human
aagaugugacauguuuua

SEQ ID NO: 2191382 - RNA, 20 nt, Human
aagauauauuaaaaauauaa

SEQ ID NO: 2191383 - RNA, 19 nt, Human
aagauaugggacauuuuug

SEQ ID NO: 2191384 - RNA, 16 nt, Human
aagauaugggacauuu

SEQ ID NO: 2191385 - RNA, 12 nt, Human
aagauauggaca

SEQ ID NO: 2191386 - RNA, 21 nt, Human
aagauauauacacaggauccu

SEQ ID NO: 2191387 - RNA, 11 nt, Human
aagauauauua

SEQ ID NO: 2191388 - RNA, 14 nt, Human
aagauauauuaaaa

SEQ ID NO: 2191389 - RNA, 15 nt, Human
aagauauauuaaaaa

SEQ ID NO: 2191390 - RNA, 19 nt, Human
aagauauauuaaaaauaua

SEQ ID NO: 2191391 - RNA, 21 nt, Human
aagauauauuaaaaauauaaa

SEQ ID NO: 2191392 - RNA, 13 nt, Human
aagauauuuauau

SEQ ID NO: 2191393 - RNA, 19 nt, Human
aagauauuuuaaaaucugu

SEQ ID NO: 2191394 - RNA, 18 nt, Human
aagauauuuauauauauu

SEQ ID NO: 2191395 - RNA, 15 nt, Human
aagauauuuauauau

SEQ ID NO: 2191396 - RNA, 18 nt, Human
aagaucuguccucagccu

SEQ ID NO: 2191397 - RNA, 20 nt, Human
aagaucuguccucagccuug

SEQ ID NO: 2191398 - RNA, 19 nt, Human
aagaucuguccucagccuu

SEQ ID NO: 2191399 - RNA, 13 nt, Human
aagaucuuucagg

SEQ ID NO: 2191400 - RNA, 12 nt, Human
aagaugcagccg

SEQ ID NO: 2191401 - RNA, 22 nt, Human
aagaucuguuuugaaggcaaaa

SEQ ID NO: 2191402 - RNA, 21 nt, Human
aagaucuguuuugaaggcaaa

SEQ ID NO: 2191403 - RNA, 20 nt, Human
aagaucuguuuugaaggcaa

SEQ ID NO: 2191404 - RNA, 17 nt, Human
aagaucugugcagcccc

SEQ ID NO: 2191405 - RNA, 19 nt, Human
aagaucugugcagccccgc

SEQ ID NO: 2191406 - RNA, 17 nt, Human
aagaucuuaaauuuugu

SEQ ID NO: 2191407 - RNA, 14 nt, Human
aagaucuuaaauuu

SEQ ID NO: 2191408 - RNA, 15 nt, Human
aagaucuuaaauuuu

SEQ ID NO: 2191409 - RNA, 16 nt, Human
gugguuugagacacug

SEQ ID NO: 2191410 - RNA, 20 nt, Human
guggugguuuucuguucuuu

SEQ ID NO: 2191411 - RNA, 16 nt, Human
gugguuugguguguuc

SEQ ID NO: 2191412 - RNA, 20 nt, Human
gugguuuuauacugaaggaa

SEQ ID NO: 2191413 - RNA, 16 nt, Human
gugguuuuccccuccc

SEQ ID NO: 2191414 - RNA, 18 nt, Human
gugguuuuccccucccug

SEQ ID NO: 2191415 - RNA, 19 nt, Human
gugguuuuccccucccugg

SEQ ID NO: 2191416 - RNA, 17 nt, Human
aagagguguuuuuucua

SEQ ID NO: 2191417 - RNA, 20 nt, Human
gugguuuuccccucccuggg

SEQ ID NO: 2191418 - RNA, 21 nt, Human
gugguuuuccccucccugggu

SEQ ID NO: 2191419 - RNA, 24 nt, Human
gugguuuuccccucccuggguuca

SEQ ID NO: 2191420 - RNA, 17 nt, Human
gugguuuucuguucuuu

SEQ ID NO: 2191421 - RNA, 18 nt, Human
aagagguuuuaaaaaaau

SEQ ID NO: 2191422 - RNA, 20 nt, Human
aagauauaagugcuguauaa

SEQ ID NO: 2191423 - RNA, 21 nt, Human
aagauauaagugcuguauaaa

SEQ ID NO: 2191424 - RNA, 19 nt, Human
aagauauaagugcuguaua

SEQ ID NO: 2191425 - RNA, 13 nt, Human
aagaguagaaacu

SEQ ID NO: 2191426 - RNA, 16 nt, Human
aagagguuuuucuuaa

SEQ ID NO: 2191427 - RNA, 17 nt, Human
aagaguaaaggaaauga

SEQ ID NO: 2191428 - RNA, 18 nt, Human
aagaguaaaggaaaugau

SEQ ID NO: 2191429 - RNA, 21 nt, Human
gugucuuuucuguagagcaua

SEQ ID NO: 2191430 - RNA, 18 nt, Human
gugucuuucacagcuccu

SEQ ID NO: 2191431 - RNA, 17 nt, Human
gugucuuuccacuccuc

SEQ ID NO: 2191432 - RNA, 20 nt, Human
gugucuucuccaccacgcug

SEQ ID NO: 2191433 - RNA, 17 nt, Human
gugucuugcaauggcag

SEQ ID NO: 2191434 - RNA, 18 nt, Human
gugucuugcaauggcagc

SEQ ID NO: 2191435 - RNA, 15 nt, Human
gugucuuccauaaug

SEQ ID NO: 2191436 - RNA, 13 nt, Human
gugucuuccauaa

SEQ ID NO: 2191437 - RNA, 14 nt, Human
gugucuuccuccca

SEQ ID NO: 2191438 - RNA, 15 nt, Human
gugucuuccucccaa

SEQ ID NO: 2191439 - RNA, 19 nt, Human
gugucuuccucccaagugg

SEQ ID NO: 2191440 - RNA, 12 nt, Human
gugucuuccugu

SEQ ID NO: 2191441 - RNA, 13 nt, Human
gugucuuccugug

SEQ ID NO: 2191442 - RNA, 14 nt, Human
gugucuuccugugg

SEQ ID NO: 2191443 - RNA, 12 nt, Human
gugucuuccaua

SEQ ID NO: 2191444 - RNA, 16 nt, Human
aagcaauuuuccuuga

SEQ ID NO: 2191445 - RNA, 17 nt, Human
aagcaauuuuccuugaa

SEQ ID NO: 2191446 - RNA, 16 nt, Human
aagcaauuccaaccuu

SEQ ID NO: 2191447 - RNA, 13 nt, Human
aagcaauuuuccu

SEQ ID NO: 2191448 - RNA, 14 nt, Human
aagcaauuuuccuu

SEQ ID NO: 2191449 - RNA, 11 nt, Human
aagcaaugcau

SEQ ID NO: 2191450 - RNA, 13 nt, Human
aagcaaugcauuu

SEQ ID NO: 2191451 - RNA, 16 nt, Human
aagcaaugcauuuugg

SEQ ID NO: 2191452 - RNA, 15 nt, Human
aagcaauuagacaag

SEQ ID NO: 2191453 - RNA, 15 nt, Human
aagcaauuccaaccu

SEQ ID NO: 2191454 - RNA, 15 nt, Human
aagcaauccuaggua

SEQ ID NO: 2191455 - RNA, 19 nt, Human
aagcaauaugcauuuaaau

SEQ ID NO: 2191456 - RNA, 13 nt, Human
aagcaauaugcau

SEQ ID NO: 2191457 - RNA, 19 nt, Human
gugugaggagcugcuggcu

SEQ ID NO: 2191458 - RNA, 18 nt, Human
gugugaggagcugcuggc

SEQ ID NO: 2191459 - RNA, 16 nt, Human
gugugaggagcugcug

SEQ ID NO: 2191460 - RNA, 13 nt, Human
gugugagcaguga

SEQ ID NO: 2191461 - RNA, 21 nt, Human
gugugagaagugaaugcuggg

SEQ ID NO: 2191462 - RNA, 22 nt, Human
gugugagaagugaaugcuggga

SEQ ID NO: 2191463 - RNA, 13 nt, Human
gugugaccugagg

SEQ ID NO: 2191464 - RNA, 14 nt, Human
guguguagccaagg

SEQ ID NO: 2191465 - RNA, 21 nt, Human
guguguagaguuaagaagcug

SEQ ID NO: 2191466 - RNA, 19 nt, Human
guguguagacaaauauuug

SEQ ID NO: 2191467 - RNA, 13 nt, Human
guguguagaguua

SEQ ID NO: 2191468 - RNA, 16 nt, Human
guguguagaguuaaga

SEQ ID NO: 2191469 - RNA, 17 nt, Human
guguguagaguuaagaa

SEQ ID NO: 2191470 - RNA, 15 nt, Human
gugugaccugagggc

SEQ ID NO: 2191471 - RNA, 17 nt, Human
guguguagacaaauauu

SEQ ID NO: 2191472 - RNA, 14 nt, Human
guguguaauuuaaa

SEQ ID NO: 2191473 - RNA, 17 nt, Human
gugugacuacuccccca

SEQ ID NO: 2191474 - RNA, 21 nt, Human
gugugaaaggaagcuccacug

SEQ ID NO: 2191475 - RNA, 18 nt, Human
gugucuuuuuucacuaca

SEQ ID NO: 2191476 - RNA, 17 nt, Human
gugugaaaaugugugug

SEQ ID NO: 2191477 - RNA, 13 nt, Human
gugugaaaauggg

SEQ ID NO: 2191478 - RNA, 15 nt, Human
gugucuuuugcauga

SEQ ID NO: 2191479 - RNA, 16 nt, Human
gugucuuuugcaugau

SEQ ID NO: 2191480 - RNA, 14 nt, Human
guguuguaugccuu

SEQ ID NO: 2191481 - RNA, 21 nt, Human
guguuggcuaaugaagggaaa

SEQ ID NO: 2191482 - RNA, 21 nt, Human
guguugggauacugcagggcc

SEQ ID NO: 2191483 - RNA, 22 nt, Human
guguugguuuugacuggauauu

SEQ ID NO: 2191484 - RNA, 20 nt, Human
guguugcccaggcuggucuc

SEQ ID NO: 2191485 - RNA, 21 nt, Human
guguugccuugaaccacuucc

SEQ ID NO: 2191486 - RNA, 18 nt, Human
guguugccacaggacaca

SEQ ID NO: 2191487 - RNA, 17 nt, Human
guguugccacaggacac

SEQ ID NO: 2191488 - RNA, 15 nt, Human
guguugccacaggac

SEQ ID NO: 2191489 - RNA, 18 nt, Human
guguugcgugucgugggu

SEQ ID NO: 2191490 - RNA, 16 nt, Human
guguuggcccaagcuc

SEQ ID NO: 2191491 - RNA, 17 nt, Human
guguuggcccaagcucu

SEQ ID NO: 2191492 - RNA, 18 nt, Human
guguuggcccaagcucuu

SEQ ID NO: 2191493 - RNA, 23 nt, Human
guguuuccuggcacugcuuccag

SEQ ID NO: 2191494 - RNA, 18 nt, Human
guguuuccauauuuuaua

SEQ ID NO: 2191495 - RNA, 20 nt, Human
guguuuauuuuucauauugu

SEQ ID NO: 2191496 - RNA, 18 nt, Human
guguuucacuuuuaggga

SEQ ID NO: 2191497 - RNA, 15 nt, Human
guguuguguguggga

SEQ ID NO: 2191498 - RNA, 20 nt, Human
guguugugauagcuaacauu

SEQ ID NO: 2191499 - RNA, 18 nt, Human
guguugucuugaaagauu

SEQ ID NO: 2191500 - RNA, 16 nt, Human
guguuuauuuuucaua

SEQ ID NO: 2191501 - RNA, 14 nt, Human
guguugucccuucu

SEQ ID NO: 2191502 - RNA, 12 nt, Human
guguugucucua

SEQ ID NO: 2191503 - RNA, 15 nt, Human
guguugucucuugag

SEQ ID NO: 2191504 - RNA, 14 nt, Human
guguugggauacug

SEQ ID NO: 2191505 - RNA, 16 nt, Human
guguugucuugaaaga

SEQ ID NO: 2191506 - RNA, 13 nt, Human
guguugcagaagg

SEQ ID NO: 2191507 - RNA, 19 nt, Human
guguugauuuucuguugua

SEQ ID NO: 2191508 - RNA, 17 nt, Human
guguugccaaauauguc

SEQ ID NO: 2191509 - RNA, 15 nt, Human
guguugaucccaaga

SEQ ID NO: 2191510 - RNA, 19 nt, Human
guguugccaaauauguccu

SEQ ID NO: 2191511 - RNA, 20 nt, Human
guguugccaaauauguccug

SEQ ID NO: 2191512 - RNA, 14 nt, Human
guguugccaagcuc

SEQ ID NO: 2191513 - RNA, 18 nt, Human
guguugccaagcuccaag

SEQ ID NO: 2191514 - RNA, 22 nt, Human
gugugucuguucacuuuuccuc

SEQ ID NO: 2191515 - RNA, 15 nt, Human
gugugucuguucacu

SEQ ID NO: 2191516 - RNA, 16 nt, Human
gugugucugcucagua

SEQ ID NO: 2191517 - RNA, 15 nt, Human
gugugucugcucagu

SEQ ID NO: 2191518 - RNA, 14 nt, Human
gugugucuuaauua

SEQ ID NO: 2191519 - RNA, 21 nt, Human
gugugucuuaauuauuauuug

SEQ ID NO: 2191520 - RNA, 20 nt, Human
guguguccuugugcaugagc

SEQ ID NO: 2191521 - RNA, 12 nt, Human
guguguccuugu

SEQ ID NO: 2191522 - RNA, 18 nt, Human
guguguccuugugcauga

SEQ ID NO: 2191523 - RNA, 18 nt, Human
gugugucccccucugucc

SEQ ID NO: 2191524 - RNA, 10 nt, Human
guguguccuu

SEQ ID NO: 2191525 - RNA, 11 nt, Human
guguguccuug

SEQ ID NO: 2191526 - RNA, 17 nt, Human
gugugucccccucuguc

SEQ ID NO: 2191527 - RNA, 16 nt, Human
gugugucccccucugu

SEQ ID NO: 2191528 - RNA, 20 nt, Human
guguguccacgacugucucc

SEQ ID NO: 2191529 - RNA, 19 nt, Human
guguguccacgacugucuc

SEQ ID NO: 2191530 - RNA, 20 nt, Human
guguguaugugcgugugugc

SEQ ID NO: 2191531 - RNA, 18 nt, Human
guguguaugggugugugu

SEQ ID NO: 2191532 - RNA, 19 nt, Human
guguguccaaaacugccuc

SEQ ID NO: 2191533 - RNA, 12 nt, Human
guguguaugugg

SEQ ID NO: 2191534 - RNA, 21 nt, Human
guguguaugacuaaagagaga

SEQ ID NO: 2191535 - RNA, 20 nt, Human
guguguagaguuaagaagcu

SEQ ID NO: 2191536 - RNA, 18 nt, Human
guguguaugcgugugugu

SEQ ID NO: 2191537 - RNA, 21 nt, Human
guuugggcagaagggagaagg

SEQ ID NO: 2191538 - RNA, 22 nt, Human
guuugggaccccuggugguuca

SEQ ID NO: 2191539 - RNA, 23 nt, Human
guuuggcugugucuaaacugcau

SEQ ID NO: 2191540 - RNA, 16 nt, Human
guuugggaccccuggu

SEQ ID NO: 2191541 - RNA, 13 nt, Human
guuugccucugcc

SEQ ID NO: 2191542 - RNA, 16 nt, Human
guuugccucugccucu

SEQ ID NO: 2191543 - RNA, 22 nt, Human
guuugccauacuuugucugaaa

SEQ ID NO: 2191544 - RNA, 14 nt, Human
guuugccauacuuu

SEQ ID NO: 2191545 - RNA, 15 nt, Human
guuugccauacuuug

SEQ ID NO: 2191546 - RNA, 21 nt, Human
guuugauuuuagcugcagaac

SEQ ID NO: 2191547 - RNA, 12 nt, Human
guuugcauuccu

SEQ ID NO: 2191548 - RNA, 15 nt, Human
guuugcacacuugug

SEQ ID NO: 2191549 - RNA, 20 nt, Human
guuugccacuuugcaaagga

SEQ ID NO: 2191550 - RNA, 17 nt, Human
guuugcaaggaagccac

SEQ ID NO: 2191551 - RNA, 22 nt, Human
guuugcaaggaagccacagcug

SEQ ID NO: 2191552 - RNA, 22 nt, Human
guuugcacguuaugguguuucu

SEQ ID NO: 2191553 - RNA, 13 nt, Human
guuugcaaggaag

SEQ ID NO: 2191554 - RNA, 14 nt, Human
guuugcaaggaagc

SEQ ID NO: 2191555 - RNA, 15 nt, Human
guuugcaaggaagcc

SEQ ID NO: 2191556 - RNA, 13 nt, Human
guuucugugcaug

SEQ ID NO: 2191557 - RNA, 17 nt, Human
guuucugugcauggugg

SEQ ID NO: 2191558 - RNA, 16 nt, Human
guuucuguccugcugg

SEQ ID NO: 2191559 - RNA, 14 nt, Human
guuucuguuauuaa

SEQ ID NO: 2191560 - RNA, 14 nt, Human
guuucuguucugug

SEQ ID NO: 2191561 - RNA, 15 nt, Human
guuucuguucugugg

SEQ ID NO: 2191562 - RNA, 20 nt, Human
guuucuguucuguggaaagu

SEQ ID NO: 2191563 - RNA, 15 nt, Human
guuugauuucauuaa

SEQ ID NO: 2191564 - RNA, 17 nt, Human
guuucuguucuguggaa

SEQ ID NO: 2191565 - RNA, 18 nt, Human
guuucuguucuguggaaa

SEQ ID NO: 2191566 - RNA, 22 nt, Human
guuucuguucuguggaaagugu

SEQ ID NO: 2191567 - RNA, 22 nt, Human
guuugauucagacagcugccug

SEQ ID NO: 2191568 - RNA, 17 nt, Human
guuucuguccugcuggu

SEQ ID NO: 2191569 - RNA, 17 nt, Human
guuucugucaggagagc

SEQ ID NO: 2191570 - RNA, 21 nt, Human
guuucugucaggagagcagcg

SEQ ID NO: 2191571 - RNA, 23 nt, Human
guuucuaaaggcuaccuuuguau

SEQ ID NO: 2191572 - RNA, 22 nt, Human
guuucuaaaggcuaccuuugua

SEQ ID NO: 2191573 - RNA, 20 nt, Human
guuuggggagcagagacacu

SEQ ID NO: 2191574 - RNA, 23 nt, Human
guuuuacaauaaaaucuugaaaa

SEQ ID NO: 2191575 - RNA, 18 nt, Human
guuuggggaugagaaagg

SEQ ID NO: 2191576 - RNA, 15 nt, Human
guuuggggagcagag

SEQ ID NO: 2191577 - RNA, 22 nt, Human
guuuggggaaugcggccgcauu

SEQ ID NO: 2191578 - RNA, 16 nt, Human
guuugggccccucucc

SEQ ID NO: 2191579 - RNA, 20 nt, Human
guuugggccccagaggcugg

SEQ ID NO: 2191580 - RNA, 21 nt, Human
guuuuaggacaaacagcucag

SEQ ID NO: 2191581 - RNA, 20 nt, Human
guuuuagccauuguuggcuu

SEQ ID NO: 2191582 - RNA, 20 nt, Human
guuuuagcuccuugacuccu

SEQ ID NO: 2191583 - RNA, 21 nt, Human
guuuuagcuccuugacuccuu

SEQ ID NO: 2191584 - RNA, 17 nt, Human
guuuuagacaaauacuc

SEQ ID NO: 2191585 - RNA, 16 nt, Human
guuuuagaagguucuc

SEQ ID NO: 2191586 - RNA, 18 nt, Human
guuuuagacaaauacuca

SEQ ID NO: 2191587 - RNA, 19 nt, Human
guuuuagaguuaacaauga

SEQ ID NO: 2191588 - RNA, 22 nt, Human
guuuuagacaaauacucaugug

SEQ ID NO: 2191589 - RNA, 23 nt, Human
guuuuagacaaauacucaugugu

SEQ ID NO: 2191590 - RNA, 14 nt, Human
guuuuacuaaagaa

SEQ ID NO: 2191591 - RNA, 13 nt, Human
guuuuagaaaaca

SEQ ID NO: 2191592 - RNA, 21 nt, Human
guuuuacauuguugagcuauu

SEQ ID NO: 2191593 - RNA, 12 nt, Human
guuuuacauugu

SEQ ID NO: 2191594 - RNA, 21 nt, Human
guuuuaguugcagaaacauuu

SEQ ID NO: 2191595 - RNA, 15 nt, Human
guuuuaguuaaauuu

SEQ ID NO: 2191596 - RNA, 23 nt, Human
guuuucugagaaagacuauucaa

SEQ ID NO: 2191597 - RNA, 14 nt, Human
guuuuaguugcaga

SEQ ID NO: 2191598 - RNA, 13 nt, Human
guuuucugagccc

SEQ ID NO: 2191599 - RNA, 14 nt, Human
guuuucugagcccg

SEQ ID NO: 2191600 - RNA, 15 nt, Human
guuuucugagcccgg

SEQ ID NO: 2191601 - RNA, 17 nt, Human
guuuucugagcccgggc

SEQ ID NO: 2191602 - RNA, 11 nt, Human
guuuucuguuc

SEQ ID NO: 2191603 - RNA, 20 nt, Human
guuuucuucccaucacugga

SEQ ID NO: 2191604 - RNA, 15 nt, Human
guuuucuucccauca

SEQ ID NO: 2191605 - RNA, 12 nt, Human
guuuucuuccca

SEQ ID NO: 2191606 - RNA, 17 nt, Human
guuuucuuaaccaucuu

SEQ ID NO: 2191607 - RNA, 16 nt, Human
guuuucuuaacuuaaa

SEQ ID NO: 2191608 - RNA, 16 nt, Human
guuuucuuaaccaucu

SEQ ID NO: 2191609 - RNA, 17 nt, Human
guuuucuggguguccaa

SEQ ID NO: 2191610 - RNA, 19 nt, Human
guuuucuguucuuucuggc

SEQ ID NO: 2191611 - RNA, 20 nt, Human
guuuucuuaaccagaucauu

SEQ ID NO: 2191612 - RNA, 12 nt, Human
guuuucuguucu

SEQ ID NO: 2191613 - RNA, 19 nt, Human
guuuucugagcccgggcug

SEQ ID NO: 2191614 - RNA, 17 nt, Human
guuuucuggcuggagcc

SEQ ID NO: 2191615 - RNA, 18 nt, Human
guuuucuggcuggagccu

SEQ ID NO: 2191616 - RNA, 16 nt, Human
guuuucugggugucca

SEQ ID NO: 2191617 - RNA, 22 nt, Human
aaggggaauguuugccucugcc

SEQ ID NO: 2191618 - RNA, 23 nt, Human
aaggggaauguuugccucugccu

SEQ ID NO: 2191619 - RNA, 14 nt, Human
aaggggugcuuuua

SEQ ID NO: 2191620 - RNA, 17 nt, Human
aaggggugcuuuuauag

SEQ ID NO: 2191621 - RNA, 21 nt, Human
aagggguaggauuacuaggug

SEQ ID NO: 2191622 - RNA, 17 nt, Human
aagggcuagaaccugga

SEQ ID NO: 2191623 - RNA, 19 nt, Human
aagggcuagaaccuggaga

SEQ ID NO: 2191624 - RNA, 22 nt, Human
aagggcuucugcacccuccacc

SEQ ID NO: 2191625 - RNA, 23 nt, Human
aagggcuucugcacccuccaccc

SEQ ID NO: 2191626 - RNA, 18 nt, Human
aagggcuuuguuuugcac

SEQ ID NO: 2191627 - RNA, 19 nt, Human
aagggccuggccugagcug

SEQ ID NO: 2191628 - RNA, 14 nt, Human
aagggccuggccug

SEQ ID NO: 2191629 - RNA, 17 nt, Human
aagggccuggccugagc

SEQ ID NO: 2191630 - RNA, 13 nt, Human
aagggccuggccu

SEQ ID NO: 2191631 - RNA, 12 nt, Human
aaggcuucucuc

SEQ ID NO: 2191632 - RNA, 14 nt, Human
aaggcuucucucuc

SEQ ID NO: 2191633 - RNA, 17 nt, Human
aaggcuucucucugugg

SEQ ID NO: 2191634 - RNA, 15 nt, Human
aaggcuucucucuca

SEQ ID NO: 2191635 - RNA, 16 nt, Human
aaggcuucucucucac

SEQ ID NO: 2191636 - RNA, 18 nt, Human
aaggcuucucucuguggg

SEQ ID NO: 2191637 - RNA, 17 nt, Human
aaggcuucucucucacc

SEQ ID NO: 2191638 - RNA, 23 nt, Human
guuucaaaauaaaaaccaagaag

SEQ ID NO: 2191639 - RNA, 18 nt, Human
guuucaaacacaaaugca

SEQ ID NO: 2191640 - RNA, 19 nt, Human
guuucaaacacaaaugcag

SEQ ID NO: 2191641 - RNA, 21 nt, Human
guuucaaacauauauaacaau

SEQ ID NO: 2191642 - RNA, 19 nt, Human
guuucaaaauaaaaaccaa

SEQ ID NO: 2191643 - RNA, 16 nt, Human
guuucaaaauaaaaac

SEQ ID NO: 2191644 - RNA, 15 nt, Human
guuucaaaauaaaaa

SEQ ID NO: 2191645 - RNA, 19 nt, Human
guuucaaaaacuguauuga

SEQ ID NO: 2191646 - RNA, 16 nt, Human
guuuauuuuucauauu

SEQ ID NO: 2191647 - RNA, 18 nt, Human
guuuauuuuucauauugu

SEQ ID NO: 2191648 - RNA, 17 nt, Human
guuuauuuuucauauug

SEQ ID NO: 2191649 - RNA, 19 nt, Human
guuucaaaaacacaguguu

SEQ ID NO: 2191650 - RNA, 20 nt, Human
guuucaaaaacacaguguuu

SEQ ID NO: 2191651 - RNA, 17 nt, Human
guuucaaaaacuguauu

SEQ ID NO: 2191652 - RNA, 16 nt, Human
aagguaaaauugaaag

SEQ ID NO: 2191653 - RNA, 17 nt, Human
aagguaauuucuugugc

SEQ ID NO: 2191654 - RNA, 13 nt, Human
aagguacuucaaa

SEQ ID NO: 2191655 - RNA, 14 nt, Human
aagguuuucuccac

SEQ ID NO: 2191656 - RNA, 20 nt, Human
aagguuuuccucuucuauuu

SEQ ID NO: 2191657 - RNA, 16 nt, Human
aagguuuuauuuugua

SEQ ID NO: 2191658 - RNA, 13 nt, Human
aagguuuucucca

SEQ ID NO: 2191659 - RNA, 15 nt, Human
aagguuuuauuuugu

SEQ ID NO: 2191660 - RNA, 16 nt, Human
aaggguaucaggugcu

SEQ ID NO: 2191661 - RNA, 20 nt, Human
aagggguugguugaggugga

SEQ ID NO: 2191662 - RNA, 21 nt, Human
aaggguuuuccacccuggaau

SEQ ID NO: 2191663 - RNA, 13 nt, Human
aaggguaaagaag

SEQ ID NO: 2191664 - RNA, 19 nt, Human
aaggguuuuccacccugga

SEQ ID NO: 2191665 - RNA, 12 nt, Human
aagguaaaauug

SEQ ID NO: 2191666 - RNA, 13 nt, Human
aaguaaaaacaaa

SEQ ID NO: 2191667 - RNA, 20 nt, Human
aaguaaaaacaaagaaauua

SEQ ID NO: 2191668 - RNA, 22 nt, Human
aaguaaaaacaaagaaauuaug

SEQ ID NO: 2191669 - RNA, 12 nt, Human
aaguaauaugca

SEQ ID NO: 2191670 - RNA, 19 nt, Human
guuucuaaaggcuaccuuu

SEQ ID NO: 2191671 - RNA, 16 nt, Human
aaguaauaugcacaca

SEQ ID NO: 2191672 - RNA, 15 nt, Human
aaguaauaugcacac

SEQ ID NO: 2191673 - RNA, 20 nt, Human
guuguagaauguauuguacc

SEQ ID NO: 2191674 - RNA, 18 nt, Human
guuguaucagcacgugug

SEQ ID NO: 2191675 - RNA, 21 nt, Human
guuguauaaauuuauuuacug

SEQ ID NO: 2191676 - RNA, 19 nt, Human
guuguauaaauuuauuuac

SEQ ID NO: 2191677 - RNA, 17 nt, Human
guuguauaaauuuauuu

SEQ ID NO: 2191678 - RNA, 16 nt, Human
guuguauaaauuuauu

SEQ ID NO: 2191679 - RNA, 15 nt, Human
guuguauuagauguu

SEQ ID NO: 2191680 - RNA, 14 nt, Human
guuguauuagaugu

SEQ ID NO: 2191681 - RNA, 23 nt, Human
guuguaugccuuuaaaucuguga

SEQ ID NO: 2191682 - RNA, 22 nt, Human
guuguauucuuugauguuaaca

SEQ ID NO: 2191683 - RNA, 16 nt, Human
guugucaaagagaggg

SEQ ID NO: 2191684 - RNA, 14 nt, Human
guuguaugccuuua

SEQ ID NO: 2191685 - RNA, 13 nt, Human
guuguauucuuug

SEQ ID NO: 2191686 - RNA, 14 nt, Human
guuguauucuuuga

SEQ ID NO: 2191687 - RNA, 20 nt, Human
guuguauucuuugauguuaa

SEQ ID NO: 2191688 - RNA, 13 nt, Human
guuguagaaugua

SEQ ID NO: 2191689 - RNA, 14 nt, Human
guuguaguaaagaa

SEQ ID NO: 2191690 - RNA, 16 nt, Human
guuguacauuuaugau

SEQ ID NO: 2191691 - RNA, 18 nt, Human
guuguacauuuaugauuu

SEQ ID NO: 2191692 - RNA, 20 nt, Human
guuguacauuuaugauuuaa

SEQ ID NO: 2191693 - RNA, 23 nt, Human
guuguacauuuaugauuuaauaa

SEQ ID NO: 2191694 - RNA, 15 nt, Human
guugguguugcagaa

SEQ ID NO: 2191695 - RNA, 18 nt, Human
guugguguuccacguguu

SEQ ID NO: 2191696 - RNA, 23 nt, Human
guuguacaaauaaagucccaggu

SEQ ID NO: 2191697 - RNA, 18 nt, Human
guuguaccgcaaugugac

SEQ ID NO: 2191698 - RNA, 19 nt, Human
guugcugucauaagaauga

SEQ ID NO: 2191699 - RNA, 14 nt, Human
guugcugugggaac

SEQ ID NO: 2191700 - RNA, 16 nt, Human
guugcugugugguuug

SEQ ID NO: 2191701 - RNA, 19 nt, Human
guugcuguuuuccucccuu

SEQ ID NO: 2191702 - RNA, 18 nt, Human
guugcuguuuuccucccu

SEQ ID NO: 2191703 - RNA, 17 nt, Human
guugcuguuuuccuccc

SEQ ID NO: 2191704 - RNA, 22 nt, Human
guugcugugggaacgagagggg

SEQ ID NO: 2191705 - RNA, 19 nt, Human
guugcugguugcugugugg

SEQ ID NO: 2191706 - RNA, 17 nt, Human
guugcugguugcugugu

SEQ ID NO: 2191707 - RNA, 18 nt, Human
guugcugguugcugugug

SEQ ID NO: 2191708 - RNA, 15 nt, Human
guugcugguugcugu

SEQ ID NO: 2191709 - RNA, 16 nt, Human
guugcugguugcugug

SEQ ID NO: 2191710 - RNA, 12 nt, Human
guugcugccuca

SEQ ID NO: 2191711 - RNA, 16 nt, Human
guugcugggagcugaa

SEQ ID NO: 2191712 - RNA, 22 nt, Human
guugcugggagcugaaaaauca

SEQ ID NO: 2191713 - RNA, 16 nt, Human
guuggucgguggguug

SEQ ID NO: 2191714 - RNA, 18 nt, Human
guuggucccccuuccaug

SEQ ID NO: 2191715 - RNA, 13 nt, Human
guugguaguuucu

SEQ ID NO: 2191716 - RNA, 15 nt, Human
guuggguucaucuga

SEQ ID NO: 2191717 - RNA, 23 nt, Human
guugcuguuuuccucccuucugc

SEQ ID NO: 2191718 - RNA, 21 nt, Human
guugcuguuuuccucccuucu

SEQ ID NO: 2191719 - RNA, 14 nt, Human
guugcuuacaauuu

SEQ ID NO: 2191720 - RNA, 15 nt, Human
guugcuuacaauuuu

SEQ ID NO: 2191721 - RNA, 13 nt, Human
guuggguggaugc

SEQ ID NO: 2191722 - RNA, 22 nt, Human
guuuacaagcccccccuuccac

SEQ ID NO: 2191723 - RNA, 16 nt, Human
guuuacaaguguauau

SEQ ID NO: 2191724 - RNA, 18 nt, Human
guuuacaaguguauauca

SEQ ID NO: 2191725 - RNA, 19 nt, Human
guuuacaaguguauaucag

SEQ ID NO: 2191726 - RNA, 23 nt, Human
guuuacaaguguauaucagaaaa

SEQ ID NO: 2191727 - RNA, 15 nt, Human
guuuacaauuuacaa

SEQ ID NO: 2191728 - RNA, 21 nt, Human
guuuacacacgugcaauuugu

SEQ ID NO: 2191729 - RNA, 19 nt, Human
guuuaugucccuucacaua

SEQ ID NO: 2191730 - RNA, 16 nt, Human
guuuacaauuuacaaa

SEQ ID NO: 2191731 - RNA, 18 nt, Human
guuuacaauuuacaaagu

SEQ ID NO: 2191732 - RNA, 19 nt, Human
guuuacaauuuacaaagug

SEQ ID NO: 2191733 - RNA, 23 nt, Human
guuuacaauuuacaaagugugua

SEQ ID NO: 2191734 - RNA, 18 nt, Human
guuuacaagcccccccuu

SEQ ID NO: 2191735 - RNA, 19 nt, Human
guuuacaagcccccccuuc

SEQ ID NO: 2191736 - RNA, 20 nt, Human
guuuacaaauggacauagga

SEQ ID NO: 2191737 - RNA, 14 nt, Human
guuuauuuuucaua

SEQ ID NO: 2191738 - RNA, 23 nt, Human
guuuauuaacaaauuauguuaca

SEQ ID NO: 2191739 - RNA, 18 nt, Human
guuuauuaacaaauuaug

SEQ ID NO: 2191740 - RNA, 13 nt, Human
guuuauuaacaaa

SEQ ID NO: 2191741 - RNA, 13 nt, Human
guuuaugucuaaa

SEQ ID NO: 2191742 - RNA, 15 nt, Human
guuuaugucuaaaga

SEQ ID NO: 2191743 - RNA, 16 nt, Human
guuuaugugugugugu

SEQ ID NO: 2191744 - RNA, 13 nt, Human
guuuaugugugug

SEQ ID NO: 2191745 - RNA, 21 nt, Human
guuuaaacugauucauaauaa

SEQ ID NO: 2191746 - RNA, 17 nt, Human
guuuaaacuucucugaa

SEQ ID NO: 2191747 - RNA, 16 nt, Human
guuuaaacugauucau

SEQ ID NO: 2191748 - RNA, 12 nt, Human
guuuaaacugau

SEQ ID NO: 2191749 - RNA, 18 nt, Human
guuuaaacuucucugaag

SEQ ID NO: 2191750 - RNA, 23 nt, Human
guuuaaacuucucugaagggagg

SEQ ID NO: 2191751 - RNA, 23 nt, Human
guuguauuuuaacucauaccuuu

SEQ ID NO: 2191752 - RNA, 16 nt, Human
guuuaaaaucauuucu

SEQ ID NO: 2191753 - RNA, 10 nt, Human
guuuaaaauc

SEQ ID NO: 2191754 - RNA, 12 nt, Human
guuuaacucaga

SEQ ID NO: 2191755 - RNA, 23 nt, Human
guuuaaccaaaaagaccagacua

SEQ ID NO: 2191756 - RNA, 14 nt, Human
guuuaacucagauc

SEQ ID NO: 2191757 - RNA, 15 nt, Human
guuuaacucagauca

SEQ ID NO: 2191758 - RNA, 22 nt, Human
guuuaaccaaaaagaccagacu

SEQ ID NO: 2191759 - RNA, 23 nt, Human
guuuaagaaaaaauaacacacau

SEQ ID NO: 2191760 - RNA, 16 nt, Human
guuuaacucagaucac

SEQ ID NO: 2191761 - RNA, 17 nt, Human
guuuaacucagaucacu

SEQ ID NO: 2191762 - RNA, 19 nt, Human
guuuaacucagaucacuac

SEQ ID NO: 2191763 - RNA, 22 nt, Human
guuuaacucagaucacuacugc

SEQ ID NO: 2191764 - RNA, 20 nt, Human
guuuaagacuguaaugaauc

SEQ ID NO: 2191765 - RNA, 23 nt, Human
guuuaacucagaucacuacugca

SEQ ID NO: 2191766 - RNA, 22 nt, Human
guuuaacuuaaucaauuaauuu

SEQ ID NO: 2191767 - RNA, 20 nt, Human
guuuaagacauuuuuggaag

SEQ ID NO: 2191768 - RNA, 23 nt, Human
guuuaaggaauaugggagaaaua

SEQ ID NO: 2191769 - RNA, 19 nt, Human
aaggccaagaggcuguucc

SEQ ID NO: 2191770 - RNA, 16 nt, Human
aaggaugugggggaag

SEQ ID NO: 2191771 - RNA, 21 nt, Human
aaggccaauuccuauacgcag

SEQ ID NO: 2191772 - RNA, 17 nt, Human
aaggaugucacagggcc

SEQ ID NO: 2191773 - RNA, 21 nt, Human
aaggccaauaaagaguuagaa

SEQ ID NO: 2191774 - RNA, 18 nt, Human
aaggccaaaggaagcaca

SEQ ID NO: 2191775 - RNA, 22 nt, Human
aaggaugugauuguggaaugga

SEQ ID NO: 2191776 - RNA, 17 nt, Human
aaggaugugauugugga

SEQ ID NO: 2191777 - RNA, 15 nt, Human
aaggaugugauugug

SEQ ID NO: 2191778 - RNA, 15 nt, Human
aaggaugucacaggg

SEQ ID NO: 2191779 - RNA, 16 nt, Human
aaggaugucacagggc

SEQ ID NO: 2191780 - RNA, 17 nt, Human
aaggcucagucucagga

SEQ ID NO: 2191781 - RNA, 16 nt, Human
aaggcucagucucagg

SEQ ID NO: 2191782 - RNA, 15 nt, Human
aaggcuauacuuguc

SEQ ID NO: 2191783 - RNA, 23 nt, Human
aaggccagaguggccuggccagg

SEQ ID NO: 2191784 - RNA, 22 nt, Human
aaggccagaguggccuggccag

SEQ ID NO: 2191785 - RNA, 23 nt, Human
aaggcuauggggauagaugugug

SEQ ID NO: 2191786 - RNA, 21 nt, Human
aaggccagaguggccuggcca

SEQ ID NO: 2191787 - RNA, 20 nt, Human
aaggccagaguggccuggcc

SEQ ID NO: 2191788 - RNA, 19 nt, Human
aaggccagaguggccuggc

SEQ ID NO: 2191789 - RNA, 17 nt, Human
aaggccagaguggccug

SEQ ID NO: 2191790 - RNA, 19 nt, Human
aaggcuaccuuuguauucu

SEQ ID NO: 2191791 - RNA, 17 nt, Human
guugcccaggcaggucu

SEQ ID NO: 2191792 - RNA, 14 nt, Human
aaggcuccaggagc

SEQ ID NO: 2191793 - RNA, 18 nt, Human
guugcccaggcaggucuu

SEQ ID NO: 2191794 - RNA, 19 nt, Human
guugcccaggcaggucuug

SEQ ID NO: 2191795 - RNA, 21 nt, Human
guugcccaggcuggcgugcag

SEQ ID NO: 2191796 - RNA, 15 nt, Human
guugcccaggcaggu

SEQ ID NO: 2191797 - RNA, 17 nt, Human
guugcccaggcuggcgu

SEQ ID NO: 2191798 - RNA, 23 nt, Human
aaggaugaaugaggucccaggca

SEQ ID NO: 2191799 - RNA, 18 nt, Human
aaggaugcacagaguugu

SEQ ID NO: 2191800 - RNA, 16 nt, Human
aaggaugcuuguacau

SEQ ID NO: 2191801 - RNA, 15 nt, Human
aaggaugcuuguaca

SEQ ID NO: 2191802 - RNA, 16 nt, Human
aaggauguacauuucc

SEQ ID NO: 2191803 - RNA, 14 nt, Human
aaggaugucacagg

SEQ ID NO: 2191804 - RNA, 15 nt, Human
aaggauguacauuuc

SEQ ID NO: 2191805 - RNA, 23 nt, Human
aaggauguaaacagugccugcug

SEQ ID NO: 2191806 - RNA, 20 nt, Human
aaggauguaaacagugccug

SEQ ID NO: 2191807 - RNA, 19 nt, Human
aaggauguaaacagugccu

SEQ ID NO: 2191808 - RNA, 17 nt, Human
aaggauguaaacagugc

SEQ ID NO: 2191809 - RNA, 19 nt, Human
aaggaugccccgucccccu

SEQ ID NO: 2191810 - RNA, 19 nt, Human
aaggaugcuuguacauaau

SEQ ID NO: 2191811 - RNA, 17 nt, Human
aaggaugcuuguacaua

SEQ ID NO: 2191812 - RNA, 23 nt, Human
guugaugaucuuugcagacaggc

SEQ ID NO: 2191813 - RNA, 21 nt, Human
guugaugccugugaacugaac

SEQ ID NO: 2191814 - RNA, 22 nt, Human
guugaucuggaacccagacuca

SEQ ID NO: 2191815 - RNA, 13 nt, Human
guugauaacuuug

SEQ ID NO: 2191816 - RNA, 15 nt, Human
guugaugaggccucu

SEQ ID NO: 2191817 - RNA, 16 nt, Human
guugaugaggccucuu

SEQ ID NO: 2191818 - RNA, 14 nt, Human
aaggauccugagcc

SEQ ID NO: 2191819 - RNA, 13 nt, Human
aaggauccugagc

SEQ ID NO: 2191820 - RNA, 15 nt, Human
aaggauccugagcca

SEQ ID NO: 2191821 - RNA, 17 nt, Human
aaggauccugagccaga

SEQ ID NO: 2191822 - RNA, 18 nt, Human
aaggaugaucuaggaaga

SEQ ID NO: 2191823 - RNA, 23 nt, Human
aaggaugaucuaggaagacuuug

SEQ ID NO: 2191824 - RNA, 21 nt, Human
guuaagcauuaccacucaggc

SEQ ID NO: 2191825 - RNA, 16 nt, Human
guuaagccuuuggaaa

SEQ ID NO: 2191826 - RNA, 13 nt, Human
guuaagccuuugg

SEQ ID NO: 2191827 - RNA, 12 nt, Human
guuaagccuuug

SEQ ID NO: 2191828 - RNA, 11 nt, Human
guguuuguguu

SEQ ID NO: 2191829 - RNA, 12 nt, Human
guguuuguguga

SEQ ID NO: 2191830 - RNA, 22 nt, Human
guguuuuaauuccaauaugaug

SEQ ID NO: 2191831 - RNA, 12 nt, Human
guguuuguuccu

SEQ ID NO: 2191832 - RNA, 15 nt, Human
guguuuuaauuccaa

SEQ ID NO: 2191833 - RNA, 13 nt, Human
guguuuuaauuua

SEQ ID NO: 2191834 - RNA, 20 nt, Human
guuaagcauuaccacucagg

SEQ ID NO: 2191835 - RNA, 15 nt, Human
guguuucuagggaaa

SEQ ID NO: 2191836 - RNA, 12 nt, Human
guguuugucauu

SEQ ID NO: 2191837 - RNA, 13 nt, Human
guguuugucauua

SEQ ID NO: 2191838 - RNA, 15 nt, Human
guguuugucauuagc

SEQ ID NO: 2191839 - RNA, 18 nt, Human
guguuuuaaaaugagaaa

SEQ ID NO: 2191840 - RNA, 11 nt, Human
guguuucuagg

SEQ ID NO: 2191841 - RNA, 19 nt, Human
guguuucuagcacuggccu

SEQ ID NO: 2191842 - RNA, 22 nt, Human
guguuucuagcacuggccugca

SEQ ID NO: 2191843 - RNA, 21 nt, Human
guguuugggucaccccuccag

SEQ ID NO: 2191844 - RNA, 12 nt, Human
guguuucccaua

SEQ ID NO: 2191845 - RNA, 18 nt, Human
guguuuccacagccugca

SEQ ID NO: 2191846 - RNA, 16 nt, Human
guguuucuagcacugg

SEQ ID NO: 2191847 - RNA, 15 nt, Human
guguuucccauaauu

SEQ ID NO: 2191848 - RNA, 12 nt, Human
guuaaggaaacu

SEQ ID NO: 2191849 - RNA, 14 nt, Human
guuaaggaaacucu

SEQ ID NO: 2191850 - RNA, 21 nt, Human
guuaaggaaacucuuaucuca

SEQ ID NO: 2191851 - RNA, 16 nt, Human
guuaaggaaacucuua

SEQ ID NO: 2191852 - RNA, 19 nt, Human
guuaaggaaacucuuaucu

SEQ ID NO: 2191853 - RNA, 16 nt, Human
guuaaggcugaggaaa

SEQ ID NO: 2191854 - RNA, 17 nt, Human
guuaaggcugaggaaag

SEQ ID NO: 2191855 - RNA, 22 nt, Human
guuaagggaaggaacucuggcu

SEQ ID NO: 2191856 - RNA, 13 nt, Human
guuaagggaagga

SEQ ID NO: 2191857 - RNA, 14 nt, Human
guuaagggaaggaa

SEQ ID NO: 2191858 - RNA, 22 nt, Human
guuaagucuaaauauuuccuua

SEQ ID NO: 2191859 - RNA, 13 nt, Human
guuaagucuguuu

SEQ ID NO: 2191860 - RNA, 14 nt, Human
guuaaguaugugua

SEQ ID NO: 2191861 - RNA, 22 nt, Human
guuaaguugauggugaugaaau

SEQ ID NO: 2191862 - RNA, 22 nt, Human
guuaagucuguuuuaugacuuc

SEQ ID NO: 2191863 - RNA, 15 nt, Human
guuaagucuguuuua

SEQ ID NO: 2191864 - RNA, 20 nt, Human
guuaauguaaucugauggcu

SEQ ID NO: 2191865 - RNA, 17 nt, Human
guuaaugaaaaugucag

SEQ ID NO: 2191866 - RNA, 22 nt, Human
guuaaugaugguugauggguuc

SEQ ID NO: 2191867 - RNA, 23 nt, Human
guuaaugaugguugauggguucu

SEQ ID NO: 2191868 - RNA, 18 nt, Human
guuaaugauagcuacugu

SEQ ID NO: 2191869 - RNA, 16 nt, Human
guuaaugaaaauguca

SEQ ID NO: 2191870 - RNA, 12 nt, Human
guuaaucuuagg

SEQ ID NO: 2191871 - RNA, 22 nt, Human
guuaaguuacuucacuuuaauu

SEQ ID NO: 2191872 - RNA, 21 nt, Human
guuacacacuuuuuaagaaau

SEQ ID NO: 2191873 - RNA, 21 nt, Human
guuacacaaaggaccucagcu

SEQ ID NO: 2191874 - RNA, 22 nt, Human
guuagaguccaacguggggcag

SEQ ID NO: 2191875 - RNA, 20 nt, Human
guuagcucaggaggcuugga

SEQ ID NO: 2191876 - RNA, 21 nt, Human
guuagauuuuguauucagggg

SEQ ID NO: 2191877 - RNA, 12 nt, Human
guuagcuccugu

SEQ ID NO: 2191878 - RNA, 13 nt, Human
guuagcagacagg

SEQ ID NO: 2191879 - RNA, 15 nt, Human
guuagcaaacuuugu

SEQ ID NO: 2191880 - RNA, 18 nt, Human
guuagcagacaggccccg

SEQ ID NO: 2191881 - RNA, 17 nt, Human
guuagccaauauuuuuc

SEQ ID NO: 2191882 - RNA, 18 nt, Human
guuaauucagcacugauu

SEQ ID NO: 2191883 - RNA, 13 nt, Human
guuacaacagauu

SEQ ID NO: 2191884 - RNA, 14 nt, Human
guuacaacagauuu

SEQ ID NO: 2191885 - RNA, 18 nt, Human
guuacaacagauuuguga

SEQ ID NO: 2191886 - RNA, 19 nt, Human
guuacaacagauuugugaa

SEQ ID NO: 2191887 - RNA, 20 nt, Human
guuacaacagauuugugaac

SEQ ID NO: 2191888 - RNA, 21 nt, Human
guuacaacagauuugugaacu

SEQ ID NO: 2191889 - RNA, 18 nt, Human
guuacaaucauugcugaa

SEQ ID NO: 2191890 - RNA, 22 nt, Human
guuacaacagauuugugaacuc

SEQ ID NO: 2191891 - RNA, 23 nt, Human
guuacaacagauuugugaacuca

SEQ ID NO: 2191892 - RNA, 17 nt, Human
guuacacaaaggaccuc

SEQ ID NO: 2191893 - RNA, 18 nt, Human
guuagguagagggaguug

SEQ ID NO: 2191894 - RNA, 23 nt, Human
guuagggugcucuggaagagagg

SEQ ID NO: 2191895 - RNA, 21 nt, Human
guuagguagagggaguuguca

SEQ ID NO: 2191896 - RNA, 13 nt, Human
guuagggaggggu

SEQ ID NO: 2191897 - RNA, 11 nt, Human
guuagggaggg

SEQ ID NO: 2191898 - RNA, 14 nt, Human
guuagcuccugugg

SEQ ID NO: 2191899 - RNA, 15 nt, Human
guuagcuccuguggc

SEQ ID NO: 2191900 - RNA, 16 nt, Human
guuaguagcauguuga

SEQ ID NO: 2191901 - RNA, 17 nt, Human
guuaguaucuaacaugu

SEQ ID NO: 2191902 - RNA, 16 nt, Human
guuaguaucuaacaug

SEQ ID NO: 2191903 - RNA, 21 nt, Human
guuaguagcauguugagccag

SEQ ID NO: 2191904 - RNA, 23 nt, Human
guuaguaacaugaggggacauuu

SEQ ID NO: 2191905 - RNA, 17 nt, Human
guuaguaugaggcauuu

SEQ ID NO: 2191906 - RNA, 20 nt, Human
guuaguaugaggcauuuguu

SEQ ID NO: 2191907 - RNA, 22 nt, Human
guuagucauuugcugagcaugu

SEQ ID NO: 2191908 - RNA, 18 nt, Human
guuagucgugagcucuug

SEQ ID NO: 2191909 - RNA, 12 nt, Human
guuagucauuug

SEQ ID NO: 2191910 - RNA, 22 nt, Human
guuagucucuuguauuaaacuc

SEQ ID NO: 2191911 - RNA, 20 nt, Human
guuagucgugagcucuugug

SEQ ID NO: 2191912 - RNA, 22 nt, Human
guuagucgugagcucuugugag

SEQ ID NO: 2191913 - RNA, 16 nt, Human
guuagucuacucuuaa

SEQ ID NO: 2191914 - RNA, 21 nt, Human
guuagucuacucuuaagccau

SEQ ID NO: 2191915 - RNA, 22 nt, Human
guuagucuacucuuaagccauc

SEQ ID NO: 2191916 - RNA, 13 nt, Human
guucauaaaugaa

SEQ ID NO: 2191917 - RNA, 12 nt, Human
guucaguuacag

SEQ ID NO: 2191918 - RNA, 13 nt, Human
guucaguuacaga

SEQ ID NO: 2191919 - RNA, 14 nt, Human
guucaguuacagaa

SEQ ID NO: 2191920 - RNA, 15 nt, Human
guucaguuacagaaa

SEQ ID NO: 2191921 - RNA, 16 nt, Human
guucaguuacagaaag

SEQ ID NO: 2191922 - RNA, 17 nt, Human
guucaguuacagaaagu

SEQ ID NO: 2191923 - RNA, 20 nt, Human
guucaguuccucuuugcaug

SEQ ID NO: 2191924 - RNA, 12 nt, Human
guucauaaauga

SEQ ID NO: 2191925 - RNA, 17 nt, Human
guucaggguuggccccu

SEQ ID NO: 2191926 - RNA, 18 nt, Human
guucaggguuggccccug

SEQ ID NO: 2191927 - RNA, 19 nt, Human
guucaggguuggccccugc

SEQ ID NO: 2191928 - RNA, 11 nt, Human
guucaguuaca

SEQ ID NO: 2191929 - RNA, 16 nt, Human
guucagugucccgggc

SEQ ID NO: 2191930 - RNA, 20 nt, Human
guuauuuguacaguucaguu

SEQ ID NO: 2191931 - RNA, 19 nt, Human
guucaguguaauuucuuug

SEQ ID NO: 2191932 - RNA, 13 nt, Human
guuauuuaaauga

SEQ ID NO: 2191933 - RNA, 23 nt, Human
guuagucuacucuuaagccaucu

SEQ ID NO: 2191934 - RNA, 17 nt, Human
guuaguuauagaugucu

SEQ ID NO: 2191935 - RNA, 11 nt, Human
guuauuuaaau

SEQ ID NO: 2191936 - RNA, 15 nt, Human
guuauuuaaaugagu

SEQ ID NO: 2191937 - RNA, 23 nt, Human
guuauuuaacagcugaauuaucu

SEQ ID NO: 2191938 - RNA, 19 nt, Human
guuaguuauagaugucuag

SEQ ID NO: 2191939 - RNA, 20 nt, Human
guuauuuauaaucacuuuuu

SEQ ID NO: 2191940 - RNA, 13 nt, Human
guuauuuguacag

SEQ ID NO: 2191941 - RNA, 14 nt, Human
guuauuucuuacag

SEQ ID NO: 2191942 - RNA, 19 nt, Human
guuauuucuuacaggcaca

SEQ ID NO: 2191943 - RNA, 17 nt, Human
guuauuuauuuaaaugu

SEQ ID NO: 2191944 - RNA, 14 nt, Human
guuauuuauaauca

SEQ ID NO: 2191945 - RNA, 12 nt, Human
guuauuuagacu

SEQ ID NO: 2191946 - RNA, 14 nt, Human
guuauuuauauauu

SEQ ID NO: 2191947 - RNA, 20 nt, Human
guucaggggacucagcccug

SEQ ID NO: 2191948 - RNA, 14 nt, Human
guuauuuguacagu

SEQ ID NO: 2191949 - RNA, 18 nt, Human
guuauuuguuauuuucag

SEQ ID NO: 2191950 - RNA, 15 nt, Human
guucagcuccagcuc

SEQ ID NO: 2191951 - RNA, 18 nt, Human
guucagcuccagcucacc

SEQ ID NO: 2191952 - RNA, 16 nt, Human
guucagcuccagcuca

SEQ ID NO: 2191953 - RNA, 17 nt, Human
guucagcuccagcucac

SEQ ID NO: 2191954 - RNA, 17 nt, Human
aagcuaggccuggccag

SEQ ID NO: 2191955 - RNA, 18 nt, Human
aagcuaggccuggccaga

SEQ ID NO: 2191956 - RNA, 20 nt, Human
aagcuauagacccgaggaaa

SEQ ID NO: 2191957 - RNA, 21 nt, Human
aagcuauaaauuccucuuugc

SEQ ID NO: 2191958 - RNA, 17 nt, Human
aagccuggucagcccaa

SEQ ID NO: 2191959 - RNA, 16 nt, Human
aagcuaggccuggcca

SEQ ID NO: 2191960 - RNA, 22 nt, Human
aagcuaggccuggccagaugca

SEQ ID NO: 2191961 - RNA, 23 nt, Human
aagccugccuaggaauucccagc

SEQ ID NO: 2191962 - RNA, 21 nt, Human
aagccugccuaggaauuccca

SEQ ID NO: 2191963 - RNA, 20 nt, Human
aagccugcccuugucugaga

SEQ ID NO: 2191964 - RNA, 11 nt, Human
aagccugcccu

SEQ ID NO: 2191965 - RNA, 15 nt, Human
aagccugcccuuguc

SEQ ID NO: 2191966 - RNA, 17 nt, Human
aagccugcccuugucug

SEQ ID NO: 2191967 - RNA, 18 nt, Human
aagccugcccuugucuga

SEQ ID NO: 2191968 - RNA, 19 nt, Human
aagccugcuuuuuaagugu

SEQ ID NO: 2191969 - RNA, 21 nt, Human
aagccuggccuacaugguuga

SEQ ID NO: 2191970 - RNA, 17 nt, Human
aagccugggauugacag

SEQ ID NO: 2191971 - RNA, 15 nt, Human
aagccuggucagccc

SEQ ID NO: 2191972 - RNA, 18 nt, Human
guucauagggucucuuca

SEQ ID NO: 2191973 - RNA, 17 nt, Human
guucauagggucucuuc

SEQ ID NO: 2191974 - RNA, 14 nt, Human
guucauagcccagu

SEQ ID NO: 2191975 - RNA, 22 nt, Human
guucauagggucucuucagguu

SEQ ID NO: 2191976 - RNA, 20 nt, Human
guucauagggucucuucagg

SEQ ID NO: 2191977 - RNA, 19 nt, Human
guucauauguaccauguac

SEQ ID NO: 2191978 - RNA, 19 nt, Human
aagccuccuccagccgcca

SEQ ID NO: 2191979 - RNA, 13 nt, Human
guucauagcccag

SEQ ID NO: 2191980 - RNA, 14 nt, Human
guucauacauuuga

SEQ ID NO: 2191981 - RNA, 17 nt, Human
guucauagacccucuca

SEQ ID NO: 2191982 - RNA, 16 nt, Human
guucauacauuugagg

SEQ ID NO: 2191983 - RNA, 23 nt, Human
aagccucuggcuagaggccagcc

SEQ ID NO: 2191984 - RNA, 20 nt, Human
guucauaggucacuggcucu

SEQ ID NO: 2191985 - RNA, 12 nt, Human
aagccucuggga

SEQ ID NO: 2191986 - RNA, 13 nt, Human
aagccucuguguc

SEQ ID NO: 2191987 - RNA, 17 nt, Human
aagccucugugucacug

SEQ ID NO: 2191988 - RNA, 18 nt, Human
aagccucugugucacugg

SEQ ID NO: 2191989 - RNA, 20 nt, Human
aagccucugugucacuggcu

SEQ ID NO: 2191990 - RNA, 14 nt, Human
aagccugcaggagu

SEQ ID NO: 2191991 - RNA, 10 nt, Human
aagccugccc

SEQ ID NO: 2191992 - RNA, 21 nt, Human
aagccugaaggggcgucuguu

SEQ ID NO: 2191993 - RNA, 22 nt, Human
aagccugcacaauaaaaauguu

SEQ ID NO: 2191994 - RNA, 21 nt, Human
aagccucugugucacuggcug

SEQ ID NO: 2191995 - RNA, 22 nt, Human
aagccucugugucacuggcugc

SEQ ID NO: 2191996 - RNA, 23 nt, Human
aagccucugugucacuggcugcc

SEQ ID NO: 2191997 - RNA, 24 nt, Human
aagccucugugucacuggcugccu

SEQ ID NO: 2191998 - RNA, 14 nt, Human
aagccucuggcuag

SEQ ID NO: 2191999 - RNA, 12 nt, Human
aagccucuggcu

SEQ ID NO: 2192000 - RNA, 14 nt, Human
aagccucugcugcc

SEQ ID NO: 2192001 - RNA, 11 nt, Human
aagccucugcu

SEQ ID NO: 2192002 - RNA, 15 nt, Human
aagccucgacacaga

SEQ ID NO: 2192003 - RNA, 22 nt, Human
guucauauguaccauguacaug

SEQ ID NO: 2192004 - RNA, 19 nt, Human
aagcuuuauacguguagcu

SEQ ID NO: 2192005 - RNA, 16 nt, Human
aagcuuccaugauucu

SEQ ID NO: 2192006 - RNA, 12 nt, Human
aagcuuguguau

SEQ ID NO: 2192007 - RNA, 13 nt, Human
aagcuuguguauc

SEQ ID NO: 2192008 - RNA, 16 nt, Human
aagcuuguguauccau

SEQ ID NO: 2192009 - RNA, 21 nt, Human
aagcuuguguauccauuauca

SEQ ID NO: 2192010 - RNA, 22 nt, Human
aagcuuguguauccauuaucau

SEQ ID NO: 2192011 - RNA, 23 nt, Human
aagcuuguguauccauuaucaug

SEQ ID NO: 2192012 - RNA, 23 nt, Human
aagcuuucauguaaacugugcac

SEQ ID NO: 2192013 - RNA, 22 nt, Human
aagcuuucauguaaacugugca

SEQ ID NO: 2192014 - RNA, 21 nt, Human
aagcuuucaguauuagugaug

SEQ ID NO: 2192015 - RNA, 20 nt, Human
aagcuuuauacguguagcua

SEQ ID NO: 2192016 - RNA, 22 nt, Human
aagcuuuauacguguagcuaua

SEQ ID NO: 2192017 - RNA, 12 nt, Human
aagcuuuccugc

SEQ ID NO: 2192018 - RNA, 23 nt, Human
guuccaugaagaccacauccaca

SEQ ID NO: 2192019 - RNA, 16 nt, Human
guuccaugaugcuggg

SEQ ID NO: 2192020 - RNA, 14 nt, Human
guuccaugccugag

SEQ ID NO: 2192021 - RNA, 15 nt, Human
guuccaugccugagg

SEQ ID NO: 2192022 - RNA, 17 nt, Human
guucccauguagccccc

SEQ ID NO: 2192023 - RNA, 22 nt, Human
guucccagugacacuucagaga

SEQ ID NO: 2192024 - RNA, 21 nt, Human
guucccagugacacuucagag

SEQ ID NO: 2192025 - RNA, 15 nt, Human
guucccagaaucaaa

SEQ ID NO: 2192026 - RNA, 14 nt, Human
guucccacuuggag

SEQ ID NO: 2192027 - RNA, 19 nt, Human
guucccaccaggcugcuca

SEQ ID NO: 2192028 - RNA, 19 nt, Human
guucccaagcucagaggcg

SEQ ID NO: 2192029 - RNA, 20 nt, Human
guuccauggccucuucagau

SEQ ID NO: 2192030 - RNA, 17 nt, Human
guuccaugccugagggu

SEQ ID NO: 2192031 - RNA, 20 nt, Human
guuccaugccugagggugga

SEQ ID NO: 2192032 - RNA, 21 nt, Human
guuccauuguuuggagacauu

SEQ ID NO: 2192033 - RNA, 19 nt, Human
guuccauuguuuggagaca

SEQ ID NO: 2192034 - RNA, 14 nt, Human
guucccauguuaaa

SEQ ID NO: 2192035 - RNA, 16 nt, Human
guucccauuucagcug

SEQ ID NO: 2192036 - RNA, 19 nt, Human
guucccauguagcccccug

SEQ ID NO: 2192037 - RNA, 18 nt, Human
guucccauguagcccccu

SEQ ID NO: 2192038 - RNA, 16 nt, Human
guucccauuugcuccu

SEQ ID NO: 2192039 - RNA, 22 nt, Human
guuccccuuccacugagggcag

SEQ ID NO: 2192040 - RNA, 15 nt, Human
guuccccuuccacug

SEQ ID NO: 2192041 - RNA, 20 nt, Human
guucccauuugcuccuuucu

SEQ ID NO: 2192042 - RNA, 19 nt, Human
guucccuuuccuuccaucc

SEQ ID NO: 2192043 - RNA, 19 nt, Human
guucccuuggccucagaau

SEQ ID NO: 2192044 - RNA, 18 nt, Human
guucccuuggccucagaa

SEQ ID NO: 2192045 - RNA, 22 nt, Human
guucccucugagaauuccaagg

SEQ ID NO: 2192046 - RNA, 17 nt, Human
guucccucucccuguug

SEQ ID NO: 2192047 - RNA, 12 nt, Human
guucccucugag

SEQ ID NO: 2192048 - RNA, 14 nt, Human
guucccucugagaa

SEQ ID NO: 2192049 - RNA, 15 nt, Human
guucccucucccugu

SEQ ID NO: 2192050 - RNA, 20 nt, Human
guucccuacuuccugugacu

SEQ ID NO: 2192051 - RNA, 21 nt, Human
guucccuaggggacacuuccc

SEQ ID NO: 2192052 - RNA, 19 nt, Human
guucccguuucuccaccua

SEQ ID NO: 2192053 - RNA, 14 nt, Human
guucccguuucucc

SEQ ID NO: 2192054 - RNA, 16 nt, Human
guucccguuucuccac

SEQ ID NO: 2192055 - RNA, 18 nt, Human
guucccguuucuccaccu

SEQ ID NO: 2192056 - RNA, 19 nt, Human
aagcuccuggucuugagau

SEQ ID NO: 2192057 - RNA, 23 nt, Human
aagcuccucuccccagcccagag

SEQ ID NO: 2192058 - RNA, 16 nt, Human
aagcuccucuccccag

SEQ ID NO: 2192059 - RNA, 13 nt, Human
aagcuccuguccu

SEQ ID NO: 2192060 - RNA, 14 nt, Human
aagcuccuguccuc

SEQ ID NO: 2192061 - RNA, 15 nt, Human
aagcuccuguccucc

SEQ ID NO: 2192062 - RNA, 22 nt, Human
aagcuccucuccccagcccaga

SEQ ID NO: 2192063 - RNA, 21 nt, Human
aagcuccucuccccagcccag

SEQ ID NO: 2192064 - RNA, 20 nt, Human
aagcuccucuccccagccca

SEQ ID NO: 2192065 - RNA, 19 nt, Human
aagcuccucuccccagccc

SEQ ID NO: 2192066 - RNA, 21 nt, Human
aagcucuacugaggugcuaug

SEQ ID NO: 2192067 - RNA, 17 nt, Human
aagcuccuguccuccca

SEQ ID NO: 2192068 - RNA, 20 nt, Human
aagcuccuguccucccaucc

SEQ ID NO: 2192069 - RNA, 22 nt, Human
aagcuccuguccucccaucccc

SEQ ID NO: 2192070 - RNA, 18 nt, Human
aagcucgaaaacaauugu

SEQ ID NO: 2192071 - RNA, 22 nt, Human
aagcuauucaguaauaacucua

SEQ ID NO: 2192072 - RNA, 18 nt, Human
aagcuccucuccccagcc

SEQ ID NO: 2192073 - RNA, 21 nt, Human
aagcuauuagccaggaucaug

SEQ ID NO: 2192074 - RNA, 22 nt, Human
aagcuauggugagaugcagcug

SEQ ID NO: 2192075 - RNA, 23 nt, Human
aagcuauggugagaugcagcugg

SEQ ID NO: 2192076 - RNA, 16 nt, Human
aagcuauuagccagga

SEQ ID NO: 2192077 - RNA, 19 nt, Human
aagcuauuagccaggauca

SEQ ID NO: 2192078 - RNA, 17 nt, Human
aagcuaucguaaaauua

SEQ ID NO: 2192079 - RNA, 22 nt, Human
aagcuauaucaaucucucuuag

SEQ ID NO: 2192080 - RNA, 17 nt, Human
aagcuauccaaauaacu

SEQ ID NO: 2192081 - RNA, 17 nt, Human
aagcuauccuggcucuu

SEQ ID NO: 2192082 - RNA, 12 nt, Human
aagcuaugguga

SEQ ID NO: 2192083 - RNA, 15 nt, Human
aagcuauggugagau

SEQ ID NO: 2192084 - RNA, 18 nt, Human
aagcuauggugagaugca

SEQ ID NO: 2192085 - RNA, 21 nt, Human
aagcuauggugagaugcagcu

SEQ ID NO: 2192086 - RNA, 23 nt, Human
aagcugaauacauucugcuuuca

SEQ ID NO: 2192087 - RNA, 13 nt, Human
aagcugaauacau

SEQ ID NO: 2192088 - RNA, 14 nt, Human
aagcugaagugcau

SEQ ID NO: 2192089 - RNA, 17 nt, Human
aagcugaagugcaucca

SEQ ID NO: 2192090 - RNA, 19 nt, Human
aagcugaagugcauccaaa

SEQ ID NO: 2192091 - RNA, 21 nt, Human
aagcugaagugcauccaaagg

SEQ ID NO: 2192092 - RNA, 17 nt, Human
aagcugacgaacuucca

SEQ ID NO: 2192093 - RNA, 17 nt, Human
aagcugaccacaggcag

SEQ ID NO: 2192094 - RNA, 22 nt, Human
aagcugaaguuucacuccggag

SEQ ID NO: 2192095 - RNA, 20 nt, Human
aagcugacgaacuuccaugg

SEQ ID NO: 2192096 - RNA, 19 nt, Human
aagcugacgaacuuccaug

SEQ ID NO: 2192097 - RNA, 22 nt, Human
aagcugacgaacuuccauggcc

SEQ ID NO: 2192098 - RNA, 14 nt, Human
aagcugaggcggga

SEQ ID NO: 2192099 - RNA, 17 nt, Human
aagcugaggcgggagaa

SEQ ID NO: 2192100 - RNA, 19 nt, Human
aagcuuccaguccaaucuc

SEQ ID NO: 2192101 - RNA, 15 nt, Human
aagcuucaguuuccu

SEQ ID NO: 2192102 - RNA, 15 nt, Human
aagcuuccaugauuc

SEQ ID NO: 2192103 - RNA, 21 nt, Human
aagcuuccaguccaaucucau

SEQ ID NO: 2192104 - RNA, 20 nt, Human
aagcuuccaugauucuauuu

SEQ ID NO: 2192105 - RNA, 14 nt, Human
aagcuuauuuaauu

SEQ ID NO: 2192106 - RNA, 18 nt, Human
aagcuucaaacugcauga

SEQ ID NO: 2192107 - RNA, 22 nt, Human
guucucuaaguuccacugagcu

SEQ ID NO: 2192108 - RNA, 18 nt, Human
guucuccuuuuccucucu

SEQ ID NO: 2192109 - RNA, 22 nt, Human
guucuccuuuuccucucucccg

SEQ ID NO: 2192110 - RNA, 18 nt, Human
guucuccucuccccucua

SEQ ID NO: 2192111 - RNA, 17 nt, Human
guucuccucuccccucu

SEQ ID NO: 2192112 - RNA, 13 nt, Human
guucuccuuuucc

SEQ ID NO: 2192113 - RNA, 17 nt, Human
guucucuaucauuuaau

SEQ ID NO: 2192114 - RNA, 18 nt, Human
guucucuaucauuuaaua

SEQ ID NO: 2192115 - RNA, 22 nt, Human
guucucuaucauuuaauaauau

SEQ ID NO: 2192116 - RNA, 21 nt, Human
guucucucccaggggcuggcu

SEQ ID NO: 2192117 - RNA, 16 nt, Human
guucucuccuccccaa

SEQ ID NO: 2192118 - RNA, 15 nt, Human
guucuggggccccuu

SEQ ID NO: 2192119 - RNA, 14 nt, Human
guucuggggccccu

SEQ ID NO: 2192120 - RNA, 15 nt, Human
guucuggugaggccu

SEQ ID NO: 2192121 - RNA, 14 nt, Human
guucuggugaggcc

SEQ ID NO: 2192122 - RNA, 15 nt, Human
guucuggugugaacu

SEQ ID NO: 2192123 - RNA, 16 nt, Human
guucuggugaggccuu

SEQ ID NO: 2192124 - RNA, 19 nt, Human
guucuggugaggccuugcu

SEQ ID NO: 2192125 - RNA, 22 nt, Human
guucugguuuuuaaccauuguc

SEQ ID NO: 2192126 - RNA, 14 nt, Human
guucuguagaaaug

SEQ ID NO: 2192127 - RNA, 20 nt, Human
guucuggugaggccuugcuc

SEQ ID NO: 2192128 - RNA, 18 nt, Human
guucuggugugaacuaaa

SEQ ID NO: 2192129 - RNA, 22 nt, Human
guucuguagaaaugguuguauu

SEQ ID NO: 2192130 - RNA, 22 nt, Human
guucuuaccuguaugucuccag

SEQ ID NO: 2192131 - RNA, 19 nt, Human
guucuuaauugcacucuaa

SEQ ID NO: 2192132 - RNA, 16 nt, Human
guucuacacucaucuu

SEQ ID NO: 2192133 - RNA, 22 nt, Human
guucccuuuccuuccaucccua

SEQ ID NO: 2192134 - RNA, 20 nt, Human
guucuaccucaggcagcuca

SEQ ID NO: 2192135 - RNA, 21 nt, Human
guucuaccucaggcagcucaa

SEQ ID NO: 2192136 - RNA, 21 nt, Human
guucuccguuagcuccugugg

SEQ ID NO: 2192137 - RNA, 15 nt, Human
guucuagagaagagg

SEQ ID NO: 2192138 - RNA, 23 nt, Human
guucuagagaagaggcuggugcu

SEQ ID NO: 2192139 - RNA, 22 nt, Human
guucuccguuagcuccuguggc

SEQ ID NO: 2192140 - RNA, 23 nt, Human
guucuccguuagcuccuguggcc

SEQ ID NO: 2192141 - RNA, 20 nt, Human
guucccuuugacgccauccc

SEQ ID NO: 2192142 - RNA, 21 nt, Human
guucccuuugacgccauccca

SEQ ID NO: 2192143 - RNA, 22 nt, Human
guucccuuugacgccaucccag

SEQ ID NO: 2192144 - RNA, 16 nt, Human
guucuacccaggugcu

SEQ ID NO: 2192145 - RNA, 19 nt, Human
guucuuaguugcuguaugu

SEQ ID NO: 2192146 - RNA, 17 nt, Human
guucuuaguucucacug

SEQ ID NO: 2192147 - RNA, 21 nt, Human
guucuugguuuguaaauuaac

SEQ ID NO: 2192148 - RNA, 17 nt, Human
guucuuaguuugcaguu

SEQ ID NO: 2192149 - RNA, 17 nt, Human
guucuuguauuaagaau

SEQ ID NO: 2192150 - RNA, 12 nt, Human
guucuugucuga

SEQ ID NO: 2192151 - RNA, 21 nt, Human
guucuuguauuaagaaugaaa

SEQ ID NO: 2192152 - RNA, 18 nt, Human
guucuuguauuaagaaug

SEQ ID NO: 2192153 - RNA, 13 nt, Human
guugacaugggac

SEQ ID NO: 2192154 - RNA, 23 nt, Human
guugagguggucugaauguucug

SEQ ID NO: 2192155 - RNA, 23 nt, Human
guugagguggaagcccuccuucc

SEQ ID NO: 2192156 - RNA, 20 nt, Human
guugagguggaagcccuccu

SEQ ID NO: 2192157 - RNA, 18 nt, Human
guugaggggcuccuggaa

SEQ ID NO: 2192158 - RNA, 21 nt, Human
guugagguccagcccuggcug

SEQ ID NO: 2192159 - RNA, 22 nt, Human
guugagguccagcccuggcuga

SEQ ID NO: 2192160 - RNA, 17 nt, Human
guugaggggcuccugga

SEQ ID NO: 2192161 - RNA, 16 nt, Human
guugaggggcuccugg

SEQ ID NO: 2192162 - RNA, 23 nt, Human
guugagggaacagacaggagaaa

SEQ ID NO: 2192163 - RNA, 22 nt, Human
guugagggaacagacaggagaa

SEQ ID NO: 2192164 - RNA, 19 nt, Human
guugagggaacagacagga

SEQ ID NO: 2192165 - RNA, 21 nt, Human
guugauaaauuccacuggacu

SEQ ID NO: 2192166 - RNA, 18 nt, Human
guugauaaauuccacugg

SEQ ID NO: 2192167 - RNA, 22 nt, Human
guugaguucagguagcugcccc

SEQ ID NO: 2192168 - RNA, 21 nt, Human
guugaguucagguagcugccc

SEQ ID NO: 2192169 - RNA, 16 nt, Human
guugagguggucugaa

SEQ ID NO: 2192170 - RNA, 22 nt, Human
guugaugaucuuugcagacagg

SEQ ID NO: 2192171 - RNA, 17 nt, Human
guugagggaacagacag

SEQ ID NO: 2192172 - RNA, 21 nt, Human
guugagcuucauauaccagca

SEQ ID NO: 2192173 - RNA, 16 nt, Human
guucuuuaggagauuu

SEQ ID NO: 2192174 - RNA, 14 nt, Human
guucuuuaauuuau

SEQ ID NO: 2192175 - RNA, 15 nt, Human
guucuuuaggagauu

SEQ ID NO: 2192176 - RNA, 14 nt, Human
guugacaugggaca

SEQ ID NO: 2192177 - RNA, 18 nt, Human
guugacaugggacauuug

SEQ ID NO: 2192178 - RNA, 21 nt, Human
aaccucuccucauguucugcu

SEQ ID NO: 2192179 - RNA, 18 nt, Human
aaccucucacuucacccu

SEQ ID NO: 2192180 - RNA, 23 nt, Human
aaccucuacuaaaaagaaggaaa

SEQ ID NO: 2192181 - RNA, 20 nt, Human
aaccucuaauuuauuuuguc

SEQ ID NO: 2192182 - RNA, 21 nt, Human
aaccucuaauuuauuuugucg

SEQ ID NO: 2192183 - RNA, 13 nt, Human
aaccucuguucag

SEQ ID NO: 2192184 - RNA, 12 nt, Human
aaccucuguuca

SEQ ID NO: 2192185 - RNA, 16 nt, Human
aaccucuguucagugu

SEQ ID NO: 2192186 - RNA, 15 nt, Human
aaccucuguucagug

SEQ ID NO: 2192187 - RNA, 18 nt, Human
aaccucuucagaggcccu

SEQ ID NO: 2192188 - RNA, 12 nt, Human
aaccucuucccc

SEQ ID NO: 2192189 - RNA, 11 nt, Human
aaccucuuccc

SEQ ID NO: 2192190 - RNA, 14 nt, Human
aaccucuuccccag

SEQ ID NO: 2192191 - RNA, 18 nt, Human
aaccucuguucaguguaa

SEQ ID NO: 2192192 - RNA, 17 nt, Human
aaccucuucuggcucaa

SEQ ID NO: 2192193 - RNA, 23 nt, Human
gucugcucagacagaaccccuac

SEQ ID NO: 2192194 - RNA, 19 nt, Human
gucugcugcccuccauccc

SEQ ID NO: 2192195 - RNA, 18 nt, Human
gucugcugcccuccaucc

SEQ ID NO: 2192196 - RNA, 16 nt, Human
gucugcugcccuccau

SEQ ID NO: 2192197 - RNA, 15 nt, Human
gucugcugcccucca

SEQ ID NO: 2192198 - RNA, 13 nt, Human
gucugcugcccuc

SEQ ID NO: 2192199 - RNA, 17 nt, Human
gucugcugaauaauaaa

SEQ ID NO: 2192200 - RNA, 19 nt, Human
gucugcugaauaauaaacu

SEQ ID NO: 2192201 - RNA, 16 nt, Human
gucuggcugagcccug

SEQ ID NO: 2192202 - RNA, 15 nt, Human
gucuggcugagcuga

SEQ ID NO: 2192203 - RNA, 17 nt, Human
gucugcucgggcccagg

SEQ ID NO: 2192204 - RNA, 19 nt, Human
gucugcucgggcccaggcc

SEQ ID NO: 2192205 - RNA, 15 nt, Human
gucugcucuuucucu

SEQ ID NO: 2192206 - RNA, 21 nt, Human
gucugcucgggcccaggccau

SEQ ID NO: 2192207 - RNA, 22 nt, Human
gucugcucgggcccaggccauc

SEQ ID NO: 2192208 - RNA, 17 nt, Human
gucugcucuuucucugc

SEQ ID NO: 2192209 - RNA, 19 nt, Human
gucugcucuuucucugcca

SEQ ID NO: 2192210 - RNA, 20 nt, Human
gucugcucuuucucugccag

SEQ ID NO: 2192211 - RNA, 22 nt, Human
gucugcucuuucucugccagug

SEQ ID NO: 2192212 - RNA, 20 nt, Human
gucugggaggaauggacaga

SEQ ID NO: 2192213 - RNA, 21 nt, Human
gucugggacuuccuugcucuc

SEQ ID NO: 2192214 - RNA, 24 nt, Human
gucugggacuuccuugcucucccu

SEQ ID NO: 2192215 - RNA, 16 nt, Human
gucugggagaaauuga

SEQ ID NO: 2192216 - RNA, 21 nt, Human
gucugggagaaauugacagau

SEQ ID NO: 2192217 - RNA, 15 nt, Human
gucuggcuucacaga

SEQ ID NO: 2192218 - RNA, 18 nt, Human
gucugggacuuccuugcu

SEQ ID NO: 2192219 - RNA, 20 nt, Human
gucugggacuuccuugcucu

SEQ ID NO: 2192220 - RNA, 14 nt, Human
gucuggcugcagag

SEQ ID NO: 2192221 - RNA, 13 nt, Human
gucuggcugcaga

SEQ ID NO: 2192222 - RNA, 12 nt, Human
gucuggcugcag

SEQ ID NO: 2192223 - RNA, 21 nt, Human
gucuuaauuaaaagaauauuu

SEQ ID NO: 2192224 - RNA, 19 nt, Human
gucuuaauuaaaagaauau

SEQ ID NO: 2192225 - RNA, 22 nt, Human
gucuuaauuaaaagaauauuuu

SEQ ID NO: 2192226 - RNA, 13 nt, Human
gucuuaauuauua

SEQ ID NO: 2192227 - RNA, 18 nt, Human
gucuuaauuauuauuugu

SEQ ID NO: 2192228 - RNA, 21 nt, Human
gucuuaauuauuauuuguguu

SEQ ID NO: 2192229 - RNA, 17 nt, Human
gucuuuggacccugagg

SEQ ID NO: 2192230 - RNA, 14 nt, Human
gucuuuggacccug

SEQ ID NO: 2192231 - RNA, 15 nt, Human
gucuuuggacccuga

SEQ ID NO: 2192232 - RNA, 14 nt, Human
gucuuuugaauauu

SEQ ID NO: 2192233 - RNA, 19 nt, Human
gucuuuugaauauucccaa

SEQ ID NO: 2192234 - RNA, 24 nt, Human
gucuuuucuugcaugaggcuagug

SEQ ID NO: 2192235 - RNA, 14 nt, Human
gucuuuucuugcau

SEQ ID NO: 2192236 - RNA, 19 nt, Human
gucuuuucuugcaugaggc

SEQ ID NO: 2192237 - RNA, 23 nt, Human
gucuuagaaguggaccaggacag

SEQ ID NO: 2192238 - RNA, 22 nt, Human
gucuuagaaguggaccaggaca

SEQ ID NO: 2192239 - RNA, 20 nt, Human
gucuuagaaguggaccagga

SEQ ID NO: 2192240 - RNA, 19 nt, Human
gucuuagaaguggaccagg

SEQ ID NO: 2192241 - RNA, 11 nt, Human
gucugggcuga

SEQ ID NO: 2192242 - RNA, 19 nt, Human
gucuuaauuauuauuugug

SEQ ID NO: 2192243 - RNA, 15 nt, Human
gucuuagauguauau

SEQ ID NO: 2192244 - RNA, 16 nt, Human
gucuucccuaccucag

SEQ ID NO: 2192245 - RNA, 15 nt, Human
gucuuaguuguacaa

SEQ ID NO: 2192246 - RNA, 23 nt, Human
gucuuagacuugaaauacuacuu

SEQ ID NO: 2192247 - RNA, 18 nt, Human
gucuuagacuugaaauac

SEQ ID NO: 2192248 - RNA, 24 nt, Human
gucuuagacuugaaauacuacuua

SEQ ID NO: 2192249 - RNA, 18 nt, Human
gucuuccugaaaugcagu

SEQ ID NO: 2192250 - RNA, 13 nt, Human
gucuuccucccaa

SEQ ID NO: 2192251 - RNA, 14 nt, Human
gucuuccucccaag

SEQ ID NO: 2192252 - RNA, 23 nt, Human
gucuuccucccaaguggugccua

SEQ ID NO: 2192253 - RNA, 19 nt, Human
gucuuccugacacuuuaau

SEQ ID NO: 2192254 - RNA, 12 nt, Human
gucuuccugagu

SEQ ID NO: 2192255 - RNA, 18 nt, Human
gucuuccugacacuuuaa

SEQ ID NO: 2192256 - RNA, 14 nt, Human
gucuuccugacacu

SEQ ID NO: 2192257 - RNA, 21 nt, Human
gucuucccuaccucaggcagg

SEQ ID NO: 2192258 - RNA, 18 nt, Human
gucuucccuaccucaggc

SEQ ID NO: 2192259 - RNA, 22 nt, Human
aacuacaaccaagcucucugca

SEQ ID NO: 2192260 - RNA, 13 nt, Human
aacuacaaaucaa

SEQ ID NO: 2192261 - RNA, 20 nt, Human
aacuagauggugcugagaag

SEQ ID NO: 2192262 - RNA, 17 nt, Human
aacuagauggugcugag

SEQ ID NO: 2192263 - RNA, 14 nt, Human
aacuagauggugcu

SEQ ID NO: 2192264 - RNA, 13 nt, Human
aacuacaugagaa

SEQ ID NO: 2192265 - RNA, 22 nt, Human
aacuaaucuauuggguucauua

SEQ ID NO: 2192266 - RNA, 20 nt, Human
aacuaaucuauuggguucau

SEQ ID NO: 2192267 - RNA, 19 nt, Human
aacuaaucuauuggguuca

SEQ ID NO: 2192268 - RNA, 15 nt, Human
aacuaaugccuuacu

SEQ ID NO: 2192269 - RNA, 12 nt, Human
aacuaaugccuu

SEQ ID NO: 2192270 - RNA, 15 nt, Human
aacuacaaacaaaau

SEQ ID NO: 2192271 - RNA, 19 nt, Human
aacuacaaacaaaauuucu

SEQ ID NO: 2192272 - RNA, 15 nt, Human
aacuaaauagcaugu

SEQ ID NO: 2192273 - RNA, 17 nt, Human
aacuaaauagcauguau

SEQ ID NO: 2192274 - RNA, 22 nt, Human
aacuaauaugggcauuguaguu

SEQ ID NO: 2192275 - RNA, 20 nt, Human
aacuaaauagcauguauugu

SEQ ID NO: 2192276 - RNA, 16 nt, Human
aacuaaauuguaaacu

SEQ ID NO: 2192277 - RNA, 15 nt, Human
aacuaaacuuucaca

SEQ ID NO: 2192278 - RNA, 17 nt, Human
aacuaaacuuucacacc

SEQ ID NO: 2192279 - RNA, 18 nt, Human
aacuaaacucauuuauaa

SEQ ID NO: 2192280 - RNA, 17 nt, Human
aacuaaacucauuuaua

SEQ ID NO: 2192281 - RNA, 16 nt, Human
aacuaaacucucuuug

SEQ ID NO: 2192282 - RNA, 13 nt, Human
aacuaaacuuuca

SEQ ID NO: 2192283 - RNA, 19 nt, Human
aaccuggagagcuagaacc

SEQ ID NO: 2192284 - RNA, 10 nt, Human
aaccuggaga

SEQ ID NO: 2192285 - RNA, 16 nt, Human
aacuaaacucauuuau

SEQ ID NO: 2192286 - RNA, 15 nt, Human
aacuaaacucauuua

SEQ ID NO: 2192287 - RNA, 10 nt, Human
aaccuggagg

SEQ ID NO: 2192288 - RNA, 22 nt, Human
aacguggcugcuucaaggaucc

SEQ ID NO: 2192289 - RNA, 16 nt, Human
aacguggcugcuucaa

SEQ ID NO: 2192290 - RNA, 19 nt, Human
aacguggcugcuucaagga

SEQ ID NO: 2192291 - RNA, 22 nt, Human
aaccugcuuggguggagaagcc

SEQ ID NO: 2192292 - RNA, 23 nt, Human
aaccugcuuggguggagaagcca

SEQ ID NO: 2192293 - RNA, 20 nt, Human
aaccugcucuccucuugcca

SEQ ID NO: 2192294 - RNA, 15 nt, Human
aacguggcugcuuca

SEQ ID NO: 2192295 - RNA, 11 nt, Human
aaccugcucuc

SEQ ID NO: 2192296 - RNA, 19 nt, Human
aaccugccugacauuugga

SEQ ID NO: 2192297 - RNA, 17 nt, Human
aaccugcccugccugag

SEQ ID NO: 2192298 - RNA, 19 nt, Human
aaccugcccugccugaggg

SEQ ID NO: 2192299 - RNA, 15 nt, Human
aaccugcucuccucu

SEQ ID NO: 2192300 - RNA, 18 nt, Human
aacuagcuuggaaacugg

SEQ ID NO: 2192301 - RNA, 20 nt, Human
aacuagcucuauguuuacaa

SEQ ID NO: 2192302 - RNA, 14 nt, Human
aacuccagaaagug

SEQ ID NO: 2192303 - RNA, 20 nt, Human
aacuagauuacauucaguug

SEQ ID NO: 2192304 - RNA, 14 nt, Human
aacuagcauaucug

SEQ ID NO: 2192305 - RNA, 17 nt, Human
aacuagcauaucugccu

SEQ ID NO: 2192306 - RNA, 18 nt, Human
aacuagcauaucugccuu

SEQ ID NO: 2192307 - RNA, 19 nt, Human
aacuagcauaucugccuuu

SEQ ID NO: 2192308 - RNA, 14 nt, Human
aacuagcaccaggg

SEQ ID NO: 2192309 - RNA, 15 nt, Human
aacuagccaccaacu

SEQ ID NO: 2192310 - RNA, 18 nt, Human
aacuagccaccaacucuu

SEQ ID NO: 2192311 - RNA, 22 nt, Human
aacucccagcaacacaagcugg

SEQ ID NO: 2192312 - RNA, 19 nt, Human
aacuccccuuccucacugc

SEQ ID NO: 2192313 - RNA, 19 nt, Human
aacucccugccccccagcc

SEQ ID NO: 2192314 - RNA, 13 nt, Human
aacucccugcccc

SEQ ID NO: 2192315 - RNA, 13 nt, Human
aacuccaguagcu

SEQ ID NO: 2192316 - RNA, 21 nt, Human
aacuccagaaagugacaagcu

SEQ ID NO: 2192317 - RNA, 22 nt, Human
aacucuaauucccauuuugcaa

SEQ ID NO: 2192318 - RNA, 13 nt, Human
aacucuaauucua

SEQ ID NO: 2192319 - RNA, 19 nt, Human
aacucuagcuggggguggg

SEQ ID NO: 2192320 - RNA, 12 nt, Human
aacucuagcugg

SEQ ID NO: 2192321 - RNA, 21 nt, Human
aacucuaauucccauuuugca

SEQ ID NO: 2192322 - RNA, 15 nt, Human
aacucuaauagugcu

SEQ ID NO: 2192323 - RNA, 15 nt, Human
gugaacacaucagcu

SEQ ID NO: 2192324 - RNA, 19 nt, Human
gugaaccaccacacccagc

SEQ ID NO: 2192325 - RNA, 23 nt, Human
aacucuagcugggggugggccag

SEQ ID NO: 2192326 - RNA, 21 nt, Human
gugaacacuagccagacacuc

SEQ ID NO: 2192327 - RNA, 24 nt, Human
gugaacauuuaucaaucaguauaa

SEQ ID NO: 2192328 - RNA, 12 nt, Human
gugaaccaaaga

SEQ ID NO: 2192329 - RNA, 14 nt, Human
aacucccuuucaac

SEQ ID NO: 2192330 - RNA, 13 nt, Human
aacucccuuucaa

SEQ ID NO: 2192331 - RNA, 18 nt, Human
aacucguuaauuuguagu

SEQ ID NO: 2192332 - RNA, 14 nt, Human
aacucuaaaagauc

SEQ ID NO: 2192333 - RNA, 23 nt, Human
aacuccccuuccucacugcccaa

SEQ ID NO: 2192334 - RNA, 19 nt, Human
aacucuaaaagauccuuuu

SEQ ID NO: 2192335 - RNA, 15 nt, Human
aacccaguugccauc

SEQ ID NO: 2192336 - RNA, 12 nt, Human
aacccaggaggu

SEQ ID NO: 2192337 - RNA, 17 nt, Human
aacccaggacgcuucug

SEQ ID NO: 2192338 - RNA, 18 nt, Human
aacccaggacgcuucuga

SEQ ID NO: 2192339 - RNA, 19 nt, Human
aacccaggacgcuucugaa

SEQ ID NO: 2192340 - RNA, 13 nt, Human
aacccaggagcau

SEQ ID NO: 2192341 - RNA, 16 nt, Human
aacccaggacgcuucu

SEQ ID NO: 2192342 - RNA, 17 nt, Human
aacccagcucuggucca

SEQ ID NO: 2192343 - RNA, 20 nt, Human
aacccaucaacaaaaauugu

SEQ ID NO: 2192344 - RNA, 20 nt, Human
aacccaggagcauccaccuc

SEQ ID NO: 2192345 - RNA, 22 nt, Human
aacccaggagcauccaccuccu

SEQ ID NO: 2192346 - RNA, 20 nt, Human
aacccauauuuguacaccaa

SEQ ID NO: 2192347 - RNA, 19 nt, Human
aacccaucagaaggagaag

SEQ ID NO: 2192348 - RNA, 17 nt, Human
aacccaucagaaggaga

SEQ ID NO: 2192349 - RNA, 15 nt, Human
aacccaucagaagga

SEQ ID NO: 2192350 - RNA, 11 nt, Human
aacccaggagg

SEQ ID NO: 2192351 - RNA, 15 nt, Human
aacccaugagauuca

SEQ ID NO: 2192352 - RNA, 16 nt, Human
aaccccaacuccagua

SEQ ID NO: 2192353 - RNA, 13 nt, Human
aacccauuuuagu

SEQ ID NO: 2192354 - RNA, 20 nt, Human
aaccccacccuugcccaccc

SEQ ID NO: 2192355 - RNA, 22 nt, Human
aaccauggcugaaggaaaccag

SEQ ID NO: 2192356 - RNA, 16 nt, Human
aaccauggcugaagga

SEQ ID NO: 2192357 - RNA, 17 nt, Human
aaccauguagaaaauuu

SEQ ID NO: 2192358 - RNA, 20 nt, Human
aaccauguaaagaacauaaa

SEQ ID NO: 2192359 - RNA, 23 nt, Human
aaccaugucagcaaaaagcaaaa

SEQ ID NO: 2192360 - RNA, 17 nt, Human
aaccaugucagcaaaaa

SEQ ID NO: 2192361 - RNA, 21 nt, Human
aaccaugucagcaaaaagcaa

SEQ ID NO: 2192362 - RNA, 20 nt, Human
aaccauuuuuuuucagcaga

SEQ ID NO: 2192363 - RNA, 23 nt, Human
aaccauuuugcugucccuuuucc

SEQ ID NO: 2192364 - RNA, 13 nt, Human
aacccaaauguuc

SEQ ID NO: 2192365 - RNA, 13 nt, Human
aacccagcucugg

SEQ ID NO: 2192366 - RNA, 14 nt, Human
aacccagcucuggu

SEQ ID NO: 2192367 - RNA, 11 nt, Human
aacccagcucu

SEQ ID NO: 2192368 - RNA, 18 nt, Human
aacccaaauguucaucaa

SEQ ID NO: 2192369 - RNA, 23 nt, Human
aaccuauuuugaaaaauuccuau

SEQ ID NO: 2192370 - RNA, 21 nt, Human
aaccuauuuugaaaaauuccu

SEQ ID NO: 2192371 - RNA, 22 nt, Human
aaccuauuuugaaaaauuccua

SEQ ID NO: 2192372 - RNA, 17 nt, Human
aaccucaaaaugucuaa

SEQ ID NO: 2192373 - RNA, 16 nt, Human
aaccuauuuugaaaaa

SEQ ID NO: 2192374 - RNA, 22 nt, Human
aaccuaugauauuuucugugcc

SEQ ID NO: 2192375 - RNA, 16 nt, Human
aaccuauaugauuuau

SEQ ID NO: 2192376 - RNA, 20 nt, Human
aaccuagggugauauuaacc

SEQ ID NO: 2192377 - RNA, 19 nt, Human
aacccccagcacccgggcu

SEQ ID NO: 2192378 - RNA, 11 nt, Human
aaccccagccg

SEQ ID NO: 2192379 - RNA, 13 nt, Human
aaccccaggcccc

SEQ ID NO: 2192380 - RNA, 12 nt, Human
aaccccagcucc

SEQ ID NO: 2192381 - RNA, 14 nt, Human
aaccccagcauccu

SEQ ID NO: 2192382 - RNA, 13 nt, Human
aacccccagccug

SEQ ID NO: 2192383 - RNA, 14 nt, Human
aacccccagccugc

SEQ ID NO: 2192384 - RNA, 15 nt, Human
aacccccagccugcu

SEQ ID NO: 2192385 - RNA, 22 nt, Human
aaccucacgcaccucccauccu

SEQ ID NO: 2192386 - RNA, 19 nt, Human
aaccucacgcaccucccau

SEQ ID NO: 2192387 - RNA, 12 nt, Human
aaccucacucuu

SEQ ID NO: 2192388 - RNA, 13 nt, Human
aaccucacucuug

SEQ ID NO: 2192389 - RNA, 21 nt, Human
aaccucacccgaggcugccca

SEQ ID NO: 2192390 - RNA, 15 nt, Human
aaccucaaagugacu

SEQ ID NO: 2192391 - RNA, 16 nt, Human
aaccucaacugccuac

SEQ ID NO: 2192392 - RNA, 18 nt, Human
aaccucaacugccuacuc

SEQ ID NO: 2192393 - RNA, 17 nt, Human
aaccucaacugccuacu

SEQ ID NO: 2192394 - RNA, 12 nt, Human
aaccucagccug

SEQ ID NO: 2192395 - RNA, 11 nt, Human
aaccucagccu

SEQ ID NO: 2192396 - RNA, 15 nt, Human
aaccucacucuugcc

SEQ ID NO: 2192397 - RNA, 16 nt, Human
aaccucacucuugcca

SEQ ID NO: 2192398 - RNA, 17 nt, Human
aaccucacucuugccaa

SEQ ID NO: 2192399 - RNA, 19 nt, Human
aaccucagacuuaccagga

SEQ ID NO: 2192400 - RNA, 14 nt, Human
aaccucagccuggc

SEQ ID NO: 2192401 - RNA, 13 nt, Human
aaccucagccugg

SEQ ID NO: 2192402 - RNA, 16 nt, Human
aaccucagccuggcca

SEQ ID NO: 2192403 - RNA, 22 nt, Human
aaccucagacuuaccaggaagc

SEQ ID NO: 2192404 - RNA, 17 nt, Human
aaccuccgccucuuggg

SEQ ID NO: 2192405 - RNA, 13 nt, Human
aaccuccucugug

SEQ ID NO: 2192406 - RNA, 12 nt, Human
aaccuccucugu

SEQ ID NO: 2192407 - RNA, 19 nt, Human
aaccuccgccucccggguu

SEQ ID NO: 2192408 - RNA, 14 nt, Human
aaccuccugggcua

SEQ ID NO: 2192409 - RNA, 19 nt, Human
aaccucuaauuuauuuugu

SEQ ID NO: 2192410 - RNA, 15 nt, Human
aaccuccucugugaa

SEQ ID NO: 2192411 - RNA, 14 nt, Human
aaccuccucuguga

SEQ ID NO: 2192412 - RNA, 13 nt, Human
aaccuccuggaca

SEQ ID NO: 2192413 - RNA, 13 nt, Human
aaccaauccugga

SEQ ID NO: 2192414 - RNA, 15 nt, Human
aaccaauauuuguag

SEQ ID NO: 2192415 - RNA, 19 nt, Human
aaccaaagcgaauuuuaaa

SEQ ID NO: 2192416 - RNA, 21 nt, Human
aaccaaaagaacaagaauuuc

SEQ ID NO: 2192417 - RNA, 19 nt, Human
aaccaaaaagaccagacua

SEQ ID NO: 2192418 - RNA, 20 nt, Human
aaccaaaaagaccagacuaa

SEQ ID NO: 2192419 - RNA, 13 nt, Human
aaccaaagaagaa

SEQ ID NO: 2192420 - RNA, 19 nt, Human
aaccaaagagacuggagca

SEQ ID NO: 2192421 - RNA, 23 nt, Human
aaccaaagagacuggagcaucug

SEQ ID NO: 2192422 - RNA, 19 nt, Human
aaccaaagagggcuuccuc

SEQ ID NO: 2192423 - RNA, 16 nt, Human
aaccaaagagacugga

SEQ ID NO: 2192424 - RNA, 13 nt, Human
aaccacaccacau

SEQ ID NO: 2192425 - RNA, 23 nt, Human
aaccacaccacaucuaagccuga

SEQ ID NO: 2192426 - RNA, 21 nt, Human
aaccacaccacaucuaagccu

SEQ ID NO: 2192427 - RNA, 18 nt, Human
aaccacaucuugcucugc

SEQ ID NO: 2192428 - RNA, 12 nt, Human
aaccacagcagu

SEQ ID NO: 2192429 - RNA, 20 nt, Human
aaccacaucuugcucugcug

SEQ ID NO: 2192430 - RNA, 22 nt, Human
aaccacaucuugcucugcugac

SEQ ID NO: 2192431 - RNA, 19 nt, Human
aaccaucauugaaaucuuu

SEQ ID NO: 2192432 - RNA, 20 nt, Human
aaccaucauugaaaucuuuu

SEQ ID NO: 2192433 - RNA, 23 nt, Human
aaccaucauugaaaucuuuuugc

SEQ ID NO: 2192434 - RNA, 21 nt, Human
aaccaucauugaaaucuuuuu

SEQ ID NO: 2192435 - RNA, 18 nt, Human
aaccaaaaagaccagacu

SEQ ID NO: 2192436 - RNA, 22 nt, Human
aacauuuuguggucauuaagca

SEQ ID NO: 2192437 - RNA, 23 nt, Human
gucuccucuuaaaaaauaaaaac

SEQ ID NO: 2192438 - RNA, 22 nt, Human
gucuccucuuaaaaaauaaaaa

SEQ ID NO: 2192439 - RNA, 14 nt, Human
gucuccucuuaaaa

SEQ ID NO: 2192440 - RNA, 15 nt, Human
gucuccucucagccc

SEQ ID NO: 2192441 - RNA, 14 nt, Human
gucuccuccaccgc

SEQ ID NO: 2192442 - RNA, 12 nt, Human
gucuccuccacc

SEQ ID NO: 2192443 - RNA, 21 nt, Human
gucuccuccaccgccauggcu

SEQ ID NO: 2192444 - RNA, 23 nt, Human
gucuccucagccuccucaucugg

SEQ ID NO: 2192445 - RNA, 14 nt, Human
gucuccucagccuc

SEQ ID NO: 2192446 - RNA, 17 nt, Human
gucuccucagccuccuc

SEQ ID NO: 2192447 - RNA, 16 nt, Human
gucucccucccuuggg

SEQ ID NO: 2192448 - RNA, 14 nt, Human
gucuccuauccugg

SEQ ID NO: 2192449 - RNA, 18 nt, Human
gucuccuauccugguuuu

SEQ ID NO: 2192450 - RNA, 14 nt, Human
gucuccucacuccc

SEQ ID NO: 2192451 - RNA, 15 nt, Human
gucuccucacucccu

SEQ ID NO: 2192452 - RNA, 21 nt, Human
gucuccucacucccuucuacc

SEQ ID NO: 2192453 - RNA, 13 nt, Human
gucuccucagccu

SEQ ID NO: 2192454 - RNA, 21 nt, Human
guccuucccucuccccaagac

SEQ ID NO: 2192455 - RNA, 12 nt, Human
guccuucccucu

SEQ ID NO: 2192456 - RNA, 22 nt, Human
guccuuccaggcccccaccacu

SEQ ID NO: 2192457 - RNA, 14 nt, Human
guccuuccaggccc

SEQ ID NO: 2192458 - RNA, 17 nt, Human
guccuucucucaccucc

SEQ ID NO: 2192459 - RNA, 18 nt, Human
guccuucucucaccuccu

SEQ ID NO: 2192460 - RNA, 19 nt, Human
guccuucucucaccuccua

SEQ ID NO: 2192461 - RNA, 14 nt, Human
guccuugaaaauau

SEQ ID NO: 2192462 - RNA, 15 nt, Human
gucucaguuucacuu

SEQ ID NO: 2192463 - RNA, 22 nt, Human
gucucaguggcuucaucuguca

SEQ ID NO: 2192464 - RNA, 18 nt, Human
gucucaguggcuucaucu

SEQ ID NO: 2192465 - RNA, 11 nt, Human
guccuugaaaa

SEQ ID NO: 2192466 - RNA, 21 nt, Human
gucucaguuugugugucuuaa

SEQ ID NO: 2192467 - RNA, 18 nt, Human
gucucaguuugugugucu

SEQ ID NO: 2192468 - RNA, 19 nt, Human
gucucaguuugugugucuu

SEQ ID NO: 2192469 - RNA, 15 nt, Human
gucucauccccaggg

SEQ ID NO: 2192470 - RNA, 14 nt, Human
gucucauccccagg

SEQ ID NO: 2192471 - RNA, 16 nt, Human
gucucauccccagggg

SEQ ID NO: 2192472 - RNA, 13 nt, Human
gucucauccccag

SEQ ID NO: 2192473 - RNA, 11 nt, Human
gucucauccca

SEQ ID NO: 2192474 - RNA, 12 nt, Human
gucucaucccau

SEQ ID NO: 2192475 - RNA, 16 nt, Human
gucucauccaucauca

SEQ ID NO: 2192476 - RNA, 15 nt, Human
gucucauccaucauc

SEQ ID NO: 2192477 - RNA, 17 nt, Human
gucucccacgugggaga

SEQ ID NO: 2192478 - RNA, 12 nt, Human
gucucccaaggc

SEQ ID NO: 2192479 - RNA, 11 nt, Human
gucucaugugu

SEQ ID NO: 2192480 - RNA, 16 nt, Human
aacacugucuugaaga

SEQ ID NO: 2192481 - RNA, 22 nt, Human
aacacugugcacaucugugucu

SEQ ID NO: 2192482 - RNA, 20 nt, Human
aacacugugcacaucugugu

SEQ ID NO: 2192483 - RNA, 18 nt, Human
aacacugugcccuggugg

SEQ ID NO: 2192484 - RNA, 21 nt, Human
aacacugugcccugguggaga

SEQ ID NO: 2192485 - RNA, 12 nt, Human
aacacugugaaa

SEQ ID NO: 2192486 - RNA, 13 nt, Human
aacacugugcccu

SEQ ID NO: 2192487 - RNA, 15 nt, Human
aacacugugcccugg

SEQ ID NO: 2192488 - RNA, 16 nt, Human
aacacugugcccuggu

SEQ ID NO: 2192489 - RNA, 15 nt, Human
aacacuguucucugc

SEQ ID NO: 2192490 - RNA, 20 nt, Human
aacacuguucucugcccucc

SEQ ID NO: 2192491 - RNA, 15 nt, Human
aacacugagcuguca

SEQ ID NO: 2192492 - RNA, 19 nt, Human
aacacucuuuugcuuuauu

SEQ ID NO: 2192493 - RNA, 16 nt, Human
aacacucuuuugcuuu

SEQ ID NO: 2192494 - RNA, 17 nt, Human
aacacugcuuguguuuu

SEQ ID NO: 2192495 - RNA, 14 nt, Human
aacacugcaggcau

SEQ ID NO: 2192496 - RNA, 22 nt, Human
aacacugccaucuuaguuugga

SEQ ID NO: 2192497 - RNA, 14 nt, Human
aacacugcuugugu

SEQ ID NO: 2192498 - RNA, 13 nt, Human
aacacucuauauu

SEQ ID NO: 2192499 - RNA, 12 nt, Human
aacacucuuuug

SEQ ID NO: 2192500 - RNA, 14 nt, Human
aacacucugagacu

SEQ ID NO: 2192501 - RNA, 12 nt, Human
aacacucugaga

SEQ ID NO: 2192502 - RNA, 13 nt, Human
aacacucugagac

SEQ ID NO: 2192503 - RNA, 12 nt, Human
aacacuccuuca

SEQ ID NO: 2192504 - RNA, 11 nt, Human
aacacucugag

SEQ ID NO: 2192505 - RNA, 21 nt, Human
aacacucauugaccugaggcc

SEQ ID NO: 2192506 - RNA, 17 nt, Human
aacacuccaauuaagga

SEQ ID NO: 2192507 - RNA, 17 nt, Human
aacacucauugaccuga

SEQ ID NO: 2192508 - RNA, 17 nt, Human
guccaagugugugugcg

SEQ ID NO: 2192509 - RNA, 16 nt, Human
guccaagugugugugc

SEQ ID NO: 2192510 - RNA, 15 nt, Human
guccaagugugugug

SEQ ID NO: 2192511 - RNA, 19 nt, Human
guccaagugugugugcgug

SEQ ID NO: 2192512 - RNA, 12 nt, Human
guccaauccuau

SEQ ID NO: 2192513 - RNA, 17 nt, Human
guccaauccuauguuuu

SEQ ID NO: 2192514 - RNA, 22 nt, Human
guccaaggaaacuugaaucaaa

SEQ ID NO: 2192515 - RNA, 15 nt, Human
guccaagcugggaga

SEQ ID NO: 2192516 - RNA, 17 nt, Human
guccaaggaaaccacag

SEQ ID NO: 2192517 - RNA, 22 nt, Human
guccaaggaaaccacagcugcu

SEQ ID NO: 2192518 - RNA, 21 nt, Human
guccaagcauuuagauguaua

SEQ ID NO: 2192519 - RNA, 16 nt, Human
guccacagaugccucc

SEQ ID NO: 2192520 - RNA, 22 nt, Human
guccauugacauguacagagaa

SEQ ID NO: 2192521 - RNA, 16 nt, Human
guccauuguccaaucc

SEQ ID NO: 2192522 - RNA, 21 nt, Human
guccauuguccaauccuaugu

SEQ ID NO: 2192523 - RNA, 22 nt, Human
guccauuuggcagggguggcug

SEQ ID NO: 2192524 - RNA, 19 nt, Human
guccaauuuguaaaaacag

SEQ ID NO: 2192525 - RNA, 20 nt, Human
guccacaaaauaaccaaucc

SEQ ID NO: 2192526 - RNA, 12 nt, Human
guccaauguggc

SEQ ID NO: 2192527 - RNA, 17 nt, Human
guccacagaugccucca

SEQ ID NO: 2192528 - RNA, 15 nt, Human
guccacagaugccuc

SEQ ID NO: 2192529 - RNA, 15 nt, Human
guccacaacacacag

SEQ ID NO: 2192530 - RNA, 22 nt, Human
aacacuuaaggguuuuagaaaa

SEQ ID NO: 2192531 - RNA, 21 nt, Human
aacacuguucucugcccucca

SEQ ID NO: 2192532 - RNA, 21 nt, Human
gucauuugagcagggcucagc

SEQ ID NO: 2192533 - RNA, 11 nt, Human
aacacuuccau

SEQ ID NO: 2192534 - RNA, 22 nt, Human
gucauuugagcagggcucagcg

SEQ ID NO: 2192535 - RNA, 21 nt, Human
gucauuugcugagcauguacu

SEQ ID NO: 2192536 - RNA, 21 nt, Human
gucauuuuaacuuuaucacau

SEQ ID NO: 2192537 - RNA, 22 nt, Human
gucauuugcugagcauguacug

SEQ ID NO: 2192538 - RNA, 24 nt, Human
guccaagcauaccaacacgagcag

SEQ ID NO: 2192539 - RNA, 14 nt, Human
aacaaugauauaug

SEQ ID NO: 2192540 - RNA, 15 nt, Human
aacaaugauauaugg

SEQ ID NO: 2192541 - RNA, 15 nt, Human
aacaaugacauuuau

SEQ ID NO: 2192542 - RNA, 17 nt, Human
aacaauccuagugcuuu

SEQ ID NO: 2192543 - RNA, 18 nt, Human
aacaaugaagauaaaaag

SEQ ID NO: 2192544 - RNA, 14 nt, Human
aacaaugaagauaa

SEQ ID NO: 2192545 - RNA, 14 nt, Human
aacaauugugaagu

SEQ ID NO: 2192546 - RNA, 13 nt, Human
aacaauuuaugaa

SEQ ID NO: 2192547 - RNA, 20 nt, Human
aacaauuuccuuuauauuua

SEQ ID NO: 2192548 - RNA, 16 nt, Human
aacaauuuaugaauug

SEQ ID NO: 2192549 - RNA, 21 nt, Human
aacaauuuccuuuauauuuag

SEQ ID NO: 2192550 - RNA, 22 nt, Human
aacaauuuccuuuauauuuagu

SEQ ID NO: 2192551 - RNA, 13 nt, Human
aacaauuucuguc

SEQ ID NO: 2192552 - RNA, 13 nt, Human
aacaauuuuaaug

SEQ ID NO: 2192553 - RNA, 23 nt, Human
aacaauuuuaggaggaccagagc

SEQ ID NO: 2192554 - RNA, 20 nt, Human
aacaauuugagauguauuuc

SEQ ID NO: 2192555 - RNA, 23 nt, Human
aacaaucaaagcacuuggacucu

SEQ ID NO: 2192556 - RNA, 22 nt, Human
aacaauccuagugcuuuccuuu

SEQ ID NO: 2192557 - RNA, 16 nt, Human
aacaauauuguuucua

SEQ ID NO: 2192558 - RNA, 21 nt, Human
aacaauacucauaaugugaag

SEQ ID NO: 2192559 - RNA, 20 nt, Human
aacaauacucauaaugugaa

SEQ ID NO: 2192560 - RNA, 18 nt, Human
aacaauaggcuguuccca

SEQ ID NO: 2192561 - RNA, 18 nt, Human
aacaauaguaauucucag

SEQ ID NO: 2192562 - RNA, 21 nt, Human
aacaauaacuacuguguuccu

SEQ ID NO: 2192563 - RNA, 20 nt, Human
aacaauaacuacuguguucc

SEQ ID NO: 2192564 - RNA, 19 nt, Human
aacaauaacuacuguguuc

SEQ ID NO: 2192565 - RNA, 18 nt, Human
aacaauaacuacuguguu

SEQ ID NO: 2192566 - RNA, 17 nt, Human
aacaauaacuacugugu

SEQ ID NO: 2192567 - RNA, 15 nt, Human
aacaauaacuacugu

SEQ ID NO: 2192568 - RNA, 19 nt, Human
aacaauaaauguuggcuug

SEQ ID NO: 2192569 - RNA, 19 nt, Human
aacaauacucauaauguga

SEQ ID NO: 2192570 - RNA, 15 nt, Human
aacaauaaaugugca

SEQ ID NO: 2192571 - RNA, 16 nt, Human
aacaagucccuguaau

SEQ ID NO: 2192572 - RNA, 16 nt, Human
aacaagguaguuuuua

SEQ ID NO: 2192573 - RNA, 19 nt, Human
aacaaggguggcaucccag

SEQ ID NO: 2192574 - RNA, 21 nt, Human
aacaagggagagaccucauca

SEQ ID NO: 2192575 - RNA, 20 nt, Human
aacaagggagagaccucauc

SEQ ID NO: 2192576 - RNA, 23 nt, Human
aacaaggcaaggcugucaauuac

SEQ ID NO: 2192577 - RNA, 21 nt, Human
aaauuuugugauauggagccc

SEQ ID NO: 2192578 - RNA, 15 nt, Human
aaauuuuuauuuuuc

SEQ ID NO: 2192579 - RNA, 23 nt, Human
aaauuuuuaaucuuuaauuuuac

SEQ ID NO: 2192580 - RNA, 20 nt, Human
aaauuuuucagaugcuucug

SEQ ID NO: 2192581 - RNA, 18 nt, Human
aaauuuuucagaugcuuc

SEQ ID NO: 2192582 - RNA, 17 nt, Human
aaauuuuucagaugcuu

SEQ ID NO: 2192583 - RNA, 21 nt, Human
aaauuuuucagaugcuucugg

SEQ ID NO: 2192584 - RNA, 16 nt, Human
gucacaggcaggucca

SEQ ID NO: 2192585 - RNA, 14 nt, Human
gucacacagggcag

SEQ ID NO: 2192586 - RNA, 13 nt, Human
gucacaggcaggu

SEQ ID NO: 2192587 - RNA, 15 nt, Human
gucacaggcaggucc

SEQ ID NO: 2192588 - RNA, 14 nt, Human
aacaaggaagucaa

SEQ ID NO: 2192589 - RNA, 15 nt, Human
aacaaggaugaauua

SEQ ID NO: 2192590 - RNA, 21 nt, Human
aacaagccuccuuuuaaagua

SEQ ID NO: 2192591 - RNA, 20 nt, Human
aacaagaccacguuucuaaa

SEQ ID NO: 2192592 - RNA, 19 nt, Human
aacaagaccacguuucuaa

SEQ ID NO: 2192593 - RNA, 17 nt, Human
aacaagaccacguuucu

SEQ ID NO: 2192594 - RNA, 16 nt, Human
aacaagaccacguuuc

SEQ ID NO: 2192595 - RNA, 19 nt, Human
aacagacucgauucauauu

SEQ ID NO: 2192596 - RNA, 13 nt, Human
aacagacucaggu

SEQ ID NO: 2192597 - RNA, 20 nt, Human
aacagacuauuuaacuugag

SEQ ID NO: 2192598 - RNA, 13 nt, Human
aacagacuauuua

SEQ ID NO: 2192599 - RNA, 17 nt, Human
aacagacuauuuaacuu

SEQ ID NO: 2192600 - RNA, 19 nt, Human
aacagacuggaagcacagc

SEQ ID NO: 2192601 - RNA, 22 nt, Human
aacaggcugggcuucaguggca

SEQ ID NO: 2192602 - RNA, 13 nt, Human
aacaggcugggcu

SEQ ID NO: 2192603 - RNA, 23 nt, Human
aacaggcugggcuucaguggcag

SEQ ID NO: 2192604 - RNA, 14 nt, Human
aacaguaaaugugc

SEQ ID NO: 2192605 - RNA, 22 nt, Human
aacaguagugauaguuguaccg

SEQ ID NO: 2192606 - RNA, 18 nt, Human
aacaguguuucccauaau

SEQ ID NO: 2192607 - RNA, 13 nt, Human
aacaguguuuccc

SEQ ID NO: 2192608 - RNA, 22 nt, Human
aacaguguuaggccuggcacag

SEQ ID NO: 2192609 - RNA, 23 nt, Human
aacaguguuaggccuggcacagu

SEQ ID NO: 2192610 - RNA, 15 nt, Human
aacaguguuucccau

SEQ ID NO: 2192611 - RNA, 14 nt, Human
aacaguuuuccaug

SEQ ID NO: 2192612 - RNA, 13 nt, Human
aacaguuuuccau

SEQ ID NO: 2192613 - RNA, 11 nt, Human
aacaguuuucc

SEQ ID NO: 2192614 - RNA, 14 nt, Human
aacaguuuguacag

SEQ ID NO: 2192615 - RNA, 13 nt, Human
aacaguuuguaca

SEQ ID NO: 2192616 - RNA, 20 nt, Human
aacaguguuaggccuggcac

SEQ ID NO: 2192617 - RNA, 22 nt, Human
aacagugugaaguuagaauucc

SEQ ID NO: 2192618 - RNA, 13 nt, Human
aacagugugaagu

SEQ ID NO: 2192619 - RNA, 14 nt, Human
aacagugugaaguu

SEQ ID NO: 2192620 - RNA, 15 nt, Human
aacagugugaaguua

SEQ ID NO: 2192621 - RNA, 16 nt, Human
aacagugugaaguuag

SEQ ID NO: 2192622 - RNA, 17 nt, Human
aacagugugaaguuaga

SEQ ID NO: 2192623 - RNA, 18 nt, Human
aacagugugaaguuagaa

SEQ ID NO: 2192624 - RNA, 20 nt, Human
aacagugugaaguuagaauu

SEQ ID NO: 2192625 - RNA, 12 nt, Human
aacaguagcaua

SEQ ID NO: 2192626 - RNA, 15 nt, Human
aacaguggaauauaa

SEQ ID NO: 2192627 - RNA, 20 nt, Human
aacagugcuugccacagagc

SEQ ID NO: 2192628 - RNA, 23 nt, Human
aacagugcuaaaaaugggacuuc

SEQ ID NO: 2192629 - RNA, 15 nt, Human
aacagugcuaaaaau

SEQ ID NO: 2192630 - RNA, 16 nt, Human
aacagugcuaaaaaug

SEQ ID NO: 2192631 - RNA, 15 nt, Human
aacagacaggagaaa

SEQ ID NO: 2192632 - RNA, 14 nt, Human
aacagacaggagaa

SEQ ID NO: 2192633 - RNA, 11 nt, Human
aacagacauug

SEQ ID NO: 2192634 - RNA, 12 nt, Human
aacagacauugu

SEQ ID NO: 2192635 - RNA, 11 nt, Human
aacagacagga

SEQ ID NO: 2192636 - RNA, 20 nt, Human
aacagaacaucauuagaaca

SEQ ID NO: 2192637 - RNA, 18 nt, Human
aacagacccccucuagaa

SEQ ID NO: 2192638 - RNA, 22 nt, Human
aacagacauuguuuugccaaca

SEQ ID NO: 2192639 - RNA, 19 nt, Human
aacagacccccucuagaaa

SEQ ID NO: 2192640 - RNA, 18 nt, Human
aacagaccuaaugcuccu

SEQ ID NO: 2192641 - RNA, 13 nt, Human
aacagacauuguu

SEQ ID NO: 2192642 - RNA, 14 nt, Human
aacagacauuguuu

SEQ ID NO: 2192643 - RNA, 15 nt, Human
aacagacauuguuuu

SEQ ID NO: 2192644 - RNA, 18 nt, Human
aacagacauuguuuugcc

SEQ ID NO: 2192645 - RNA, 13 nt, Human
aacagaacagcuu

SEQ ID NO: 2192646 - RNA, 14 nt, Human
aacagaacagcuuc

SEQ ID NO: 2192647 - RNA, 15 nt, Human
aacagaacagcuuca

SEQ ID NO: 2192648 - RNA, 16 nt, Human
aacagaacagcuucag

SEQ ID NO: 2192649 - RNA, 18 nt, Human
aacagaaagggcaacaau

SEQ ID NO: 2192650 - RNA, 16 nt, Human
aacagaaacaaaaaca

SEQ ID NO: 2192651 - RNA, 22 nt, Human
aacagaaagccugggugacauu

SEQ ID NO: 2192652 - RNA, 21 nt, Human
aacagaaauguacagcaagga

SEQ ID NO: 2192653 - RNA, 11 nt, Human
aacagaaaugu

SEQ ID NO: 2192654 - RNA, 10 nt, Human
aacagaaaug

SEQ ID NO: 2192655 - RNA, 21 nt, Human
guccggucccugucccagugc

SEQ ID NO: 2192656 - RNA, 23 nt, Human
guccgcgcgccagcacagaaaca

SEQ ID NO: 2192657 - RNA, 18 nt, Human
guccggacacuccuagag

SEQ ID NO: 2192658 - RNA, 22 nt, Human
guccgcugggugguacccucug

SEQ ID NO: 2192659 - RNA, 21 nt, Human
guccgcccugcuccucccugg

SEQ ID NO: 2192660 - RNA, 23 nt, Human
guccgcccugcuccucccuggcu

SEQ ID NO: 2192661 - RNA, 14 nt, Human
aacagaaaacauuc

SEQ ID NO: 2192662 - RNA, 19 nt, Human
aacagaaaacauucugauu

SEQ ID NO: 2192663 - RNA, 13 nt, Human
aacagaaacaaaa

SEQ ID NO: 2192664 - RNA, 18 nt, Human
aacacuuuacaauguuca

SEQ ID NO: 2192665 - RNA, 17 nt, Human
guccggacacuccuaga

SEQ ID NO: 2192666 - RNA, 16 nt, Human
gucccaaggaaagccc

SEQ ID NO: 2192667 - RNA, 21 nt, Human
gucccaagcugggccccagcc

SEQ ID NO: 2192668 - RNA, 22 nt, Human
gucccaagcugggccccagccc

SEQ ID NO: 2192669 - RNA, 23 nt, Human
gucccaacaggaggacaauucau

SEQ ID NO: 2192670 - RNA, 13 nt, Human
gucccaagcuggg

SEQ ID NO: 2192671 - RNA, 15 nt, Human
gucccaagcugggcc

SEQ ID NO: 2192672 - RNA, 16 nt, Human
gucccaagcugggccc

SEQ ID NO: 2192673 - RNA, 15 nt, Human
gucccaacuuguaaa

SEQ ID NO: 2192674 - RNA, 20 nt, Human
gucccaacaggaggacaauu

SEQ ID NO: 2192675 - RNA, 21 nt, Human
gucccaacaggaggacaauuc

SEQ ID NO: 2192676 - RNA, 12 nt, Human
guccgcccugcu

SEQ ID NO: 2192677 - RNA, 18 nt, Human
guccgcccugcuccuccc

SEQ ID NO: 2192678 - RNA, 20 nt, Human
guccgcccugcuccucccug

SEQ ID NO: 2192679 - RNA, 23 nt, Human
gucccaagcugggccccagccca

SEQ ID NO: 2192680 - RNA, 15 nt, Human
guccgaucuuugacu

SEQ ID NO: 2192681 - RNA, 13 nt, Human
guccgagcuuuga

SEQ ID NO: 2192682 - RNA, 14 nt, Human
guccuuccaccucg

SEQ ID NO: 2192683 - RNA, 21 nt, Human
guccuucaccucacugaaaac

SEQ ID NO: 2192684 - RNA, 15 nt, Human
guccuucagauggaa

SEQ ID NO: 2192685 - RNA, 15 nt, Human
guccuucaccucacu

SEQ ID NO: 2192686 - RNA, 20 nt, Human
guccugccuggccaggcaga

SEQ ID NO: 2192687 - RNA, 19 nt, Human
guccugccuggccaggcag

SEQ ID NO: 2192688 - RNA, 23 nt, Human
guccugccugucugaagccaaug

SEQ ID NO: 2192689 - RNA, 11 nt, Human
guccugccugu

SEQ ID NO: 2192690 - RNA, 13 nt, Human
guccugccugugg

SEQ ID NO: 2192691 - RNA, 14 nt, Human
guccugccuguggc

SEQ ID NO: 2192692 - RNA, 15 nt, Human
guccugccuguggcg

SEQ ID NO: 2192693 - RNA, 15 nt, Human
guccugccuggccag

SEQ ID NO: 2192694 - RNA, 14 nt, Human
guccugccuggcca

SEQ ID NO: 2192695 - RNA, 13 nt, Human
guccugccuggcc

SEQ ID NO: 2192696 - RNA, 17 nt, Human
guccugccucagccucc

SEQ ID NO: 2192697 - RNA, 15 nt, Human
guccugccucagccu

SEQ ID NO: 2192698 - RNA, 18 nt, Human
guccugccaccuggggca

SEQ ID NO: 2192699 - RNA, 17 nt, Human
guccugccaccuggggc

SEQ ID NO: 2192700 - RNA, 16 nt, Human
guccugccaccugggg

SEQ ID NO: 2192701 - RNA, 14 nt, Human
guccugccaccugg

SEQ ID NO: 2192702 - RNA, 15 nt, Human
guccugaucagagcc

SEQ ID NO: 2192703 - RNA, 19 nt, Human
guccugcagucuggcugag

SEQ ID NO: 2192704 - RNA, 18 nt, Human
guccugaggguccccacc

SEQ ID NO: 2192705 - RNA, 21 nt, Human
guccugaggguccccaccugg

SEQ ID NO: 2192706 - RNA, 17 nt, Human
guccucugaaugaaccu

SEQ ID NO: 2192707 - RNA, 13 nt, Human
guccucugaauga

SEQ ID NO: 2192708 - RNA, 16 nt, Human
guccucucuggcuggg

SEQ ID NO: 2192709 - RNA, 17 nt, Human
guccucucuggcugggg

SEQ ID NO: 2192710 - RNA, 23 nt, Human
guccucugucagucacagccacc

SEQ ID NO: 2192711 - RNA, 20 nt, Human
guccucugucagucacagcc

SEQ ID NO: 2192712 - RNA, 19 nt, Human
guccucugucagucacagc

SEQ ID NO: 2192713 - RNA, 18 nt, Human
guccucugucagucacag

SEQ ID NO: 2192714 - RNA, 18 nt, Human
guccucucuggcugggga

SEQ ID NO: 2192715 - RNA, 19 nt, Human
guccucugauacccagagc

SEQ ID NO: 2192716 - RNA, 11 nt, Human
guccucuggau

SEQ ID NO: 2192717 - RNA, 18 nt, Human
guccucuggauggcacca

SEQ ID NO: 2192718 - RNA, 21 nt, Human
guccucuggauggcaccagag

SEQ ID NO: 2192719 - RNA, 13 nt, Human
guccugacucaac

SEQ ID NO: 2192720 - RNA, 23 nt, Human
guccugaccacccuccccucucu

SEQ ID NO: 2192721 - RNA, 17 nt, Human
guccugacuucaggggc

SEQ ID NO: 2192722 - RNA, 13 nt, Human
guccugagaccug

SEQ ID NO: 2192723 - RNA, 20 nt, Human
guccugacuucaggggcugc

SEQ ID NO: 2192724 - RNA, 21 nt, Human
guccugacuucaggggcugcc

SEQ ID NO: 2192725 - RNA, 23 nt, Human
guccugacuucaggggcugcccg

SEQ ID NO: 2192726 - RNA, 15 nt, Human
guccugaccugucuc

SEQ ID NO: 2192727 - RNA, 16 nt, Human
guccugaccugucuca

SEQ ID NO: 2192728 - RNA, 17 nt, Human
guccucuugccuccugg

SEQ ID NO: 2192729 - RNA, 17 nt, Human
guccugaccacccuccc

SEQ ID NO: 2192730 - RNA, 19 nt, Human
guccugaccacccuccccu

SEQ ID NO: 2192731 - RNA, 21 nt, Human
guccugaccacccuccccucu

SEQ ID NO: 2192732 - RNA, 13 nt, Human
guccucuucugca

SEQ ID NO: 2192733 - RNA, 14 nt, Human
guccucuugccucc

SEQ ID NO: 2192734 - RNA, 21 nt, Human
aacauugcauauaacuuauau

SEQ ID NO: 2192735 - RNA, 20 nt, Human
aacauugcauauaacuuaua

SEQ ID NO: 2192736 - RNA, 13 nt, Human
aacauuguguucc

SEQ ID NO: 2192737 - RNA, 22 nt, Human
aacauugcauauaacuuauauu

SEQ ID NO: 2192738 - RNA, 17 nt, Human
aacauucugauuuggaa

SEQ ID NO: 2192739 - RNA, 14 nt, Human
aacauuuacaugua

SEQ ID NO: 2192740 - RNA, 23 nt, Human
aacauuguguucccauuucagcu

SEQ ID NO: 2192741 - RNA, 15 nt, Human
aacauuguuccagau

SEQ ID NO: 2192742 - RNA, 17 nt, Human
aacauuguuccagauuc

SEQ ID NO: 2192743 - RNA, 18 nt, Human
aacauuguuccagauuca

SEQ ID NO: 2192744 - RNA, 19 nt, Human
aacauuguuccagauucaa

SEQ ID NO: 2192745 - RNA, 22 nt, Human
aacauuucaagggcaauaccgu

SEQ ID NO: 2192746 - RNA, 16 nt, Human
aacauuucucaauaau

SEQ ID NO: 2192747 - RNA, 20 nt, Human
aacauuuguucuauagcuuu

SEQ ID NO: 2192748 - RNA, 18 nt, Human
aacauuugguaaggggaa

SEQ ID NO: 2192749 - RNA, 19 nt, Human
aacauugaaguaaugaauu

SEQ ID NO: 2192750 - RNA, 18 nt, Human
aacauugaaguaaugaau

SEQ ID NO: 2192751 - RNA, 16 nt, Human
aacauugaaguaauga

SEQ ID NO: 2192752 - RNA, 18 nt, Human
aacauucugauuuggaaa

SEQ ID NO: 2192753 - RNA, 16 nt, Human
aacauucugauuugga

SEQ ID NO: 2192754 - RNA, 18 nt, Human
aacaguuuuccaugaaaa

SEQ ID NO: 2192755 - RNA, 17 nt, Human
aacaguuuuccaugaaa

SEQ ID NO: 2192756 - RNA, 16 nt, Human
aacaguuuuccaugaa

SEQ ID NO: 2192757 - RNA, 15 nt, Human
aacaguuuuccauga

SEQ ID NO: 2192758 - RNA, 18 nt, Human
aacauaauucuuguauau

SEQ ID NO: 2192759 - RNA, 19 nt, Human
aacaguuuuccaugaaaac

SEQ ID NO: 2192760 - RNA, 17 nt, Human
aacauaauucuuguaua

SEQ ID NO: 2192761 - RNA, 14 nt, Human
aacauacucccauc

SEQ ID NO: 2192762 - RNA, 15 nt, Human
aacauacucccaucu

SEQ ID NO: 2192763 - RNA, 16 nt, Human
aaaugcaacaacaugu

SEQ ID NO: 2192764 - RNA, 14 nt, Human
aaaugcaaauccua

SEQ ID NO: 2192765 - RNA, 21 nt, Human
aaaugcaaacacacaaaggua

SEQ ID NO: 2192766 - RNA, 13 nt, Human
aaaugcaaauccu

SEQ ID NO: 2192767 - RNA, 17 nt, Human
aaaugcaaacacacaaa

SEQ ID NO: 2192768 - RNA, 16 nt, Human
aaaugcaauauguauu

SEQ ID NO: 2192769 - RNA, 15 nt, Human
aaaugcaauauguau

SEQ ID NO: 2192770 - RNA, 14 nt, Human
aaaugcaauauuaa

SEQ ID NO: 2192771 - RNA, 17 nt, Human
aaaugcaauauuaaugc

SEQ ID NO: 2192772 - RNA, 14 nt, Human
aaaugcaagauuuu

SEQ ID NO: 2192773 - RNA, 13 nt, Human
aaaugcaauaugu

SEQ ID NO: 2192774 - RNA, 21 nt, Human
aaaugcaaauccuaugugauu

SEQ ID NO: 2192775 - RNA, 14 nt, Human
aaaugcaccuggaa

SEQ ID NO: 2192776 - RNA, 16 nt, Human
aaaugaucuuuucaag

SEQ ID NO: 2192777 - RNA, 19 nt, Human
aaaugaugauguggaagaa

SEQ ID NO: 2192778 - RNA, 19 nt, Human
aaaugaucugagucccagg

SEQ ID NO: 2192779 - RNA, 16 nt, Human
aaaugaucaguuuuuu

SEQ ID NO: 2192780 - RNA, 22 nt, Human
aaaugauccccaagugugaaca

SEQ ID NO: 2192781 - RNA, 22 nt, Human
aaaugaugauguggaagaacuu

SEQ ID NO: 2192782 - RNA, 20 nt, Human
aaaugaucugagucccagga

SEQ ID NO: 2192783 - RNA, 18 nt, Human
aaaugauguguacccaaa

SEQ ID NO: 2192784 - RNA, 23 nt, Human
aaaugauguucauuuagauugaa

SEQ ID NO: 2192785 - RNA, 15 nt, Human
aaaugauucuuagug

SEQ ID NO: 2192786 - RNA, 15 nt, Human
aaaugauuguaaaau

SEQ ID NO: 2192787 - RNA, 22 nt, Human
aaaugauuguaaaauagcuugu

SEQ ID NO: 2192788 - RNA, 21 nt, Human
aaaugauuuuaucugugaauu

SEQ ID NO: 2192789 - RNA, 23 nt, Human
aaaugauuuuuacaaguuuuaaa

SEQ ID NO: 2192790 - RNA, 22 nt, Human
aaaugcauccauuccucaggga

SEQ ID NO: 2192791 - RNA, 20 nt, Human
aaaugcauccauuccucagg

SEQ ID NO: 2192792 - RNA, 16 nt, Human
aaaugcauccauuccu

SEQ ID NO: 2192793 - RNA, 20 nt, Human
aaaugcauauccugagccau

SEQ ID NO: 2192794 - RNA, 19 nt, Human
aaaugcauauccugagcca

SEQ ID NO: 2192795 - RNA, 11 nt, Human
aaaugcauauu

SEQ ID NO: 2192796 - RNA, 15 nt, Human
aaaugcauauuguau

SEQ ID NO: 2192797 - RNA, 23 nt, Human
aaaugcauccauuccucagggac

SEQ ID NO: 2192798 - RNA, 13 nt, Human
aaaugcauguugc

SEQ ID NO: 2192799 - RNA, 18 nt, Human
aaaugcaugauuuuguaa

SEQ ID NO: 2192800 - RNA, 14 nt, Human
aaaugcaugauuuu

SEQ ID NO: 2192801 - RNA, 21 nt, Human
aaaugcaugauuuuguaaccc

SEQ ID NO: 2192802 - RNA, 20 nt, Human
aaaugcaugauuuuguaacc

SEQ ID NO: 2192803 - RNA, 20 nt, Human
aaaugcauuauaggaucauu

SEQ ID NO: 2192804 - RNA, 19 nt, Human
aaaugcacauagcuaucaa

SEQ ID NO: 2192805 - RNA, 20 nt, Human
aaaugcacccaacuagcucu

SEQ ID NO: 2192806 - RNA, 23 nt, Human
aaaugcagcgaaccaauauuugu

SEQ ID NO: 2192807 - RNA, 21 nt, Human
aaaugcagcgaaccaauauuu

SEQ ID NO: 2192808 - RNA, 22 nt, Human
aaaugcagggauugcugccacu

SEQ ID NO: 2192809 - RNA, 12 nt, Human
aaaugcagugaa

SEQ ID NO: 2192810 - RNA, 15 nt, Human
aaaugcauaaaugca

SEQ ID NO: 2192811 - RNA, 22 nt, Human
aaaugcaccuggaauauauaac

SEQ ID NO: 2192812 - RNA, 18 nt, Human
aaaugcaccuggaauaua

SEQ ID NO: 2192813 - RNA, 22 nt, Human
aaaugcccuuacacuuacuguu

SEQ ID NO: 2192814 - RNA, 16 nt, Human
aaaugccucaguguau

SEQ ID NO: 2192815 - RNA, 17 nt, Human
aaaugccucaguguauu

SEQ ID NO: 2192816 - RNA, 18 nt, Human
aaaugccucaguguauuu

SEQ ID NO: 2192817 - RNA, 19 nt, Human
aaaugccucaguguauuug

SEQ ID NO: 2192818 - RNA, 21 nt, Human
aaaugccucaguguauuugua

SEQ ID NO: 2192819 - RNA, 19 nt, Human
aaauggcuuccuggcaaua

SEQ ID NO: 2192820 - RNA, 16 nt, Human
aaaugggacuuaacuc

SEQ ID NO: 2192821 - RNA, 15 nt, Human
aaaugggacuucuuu

SEQ ID NO: 2192822 - RNA, 22 nt, Human
aaaugccucaguguauuuguau

SEQ ID NO: 2192823 - RNA, 23 nt, Human
aaaugccucaguguauuuguauu

SEQ ID NO: 2192824 - RNA, 15 nt, Human
aaaugggcagagcag

SEQ ID NO: 2192825 - RNA, 18 nt, Human
aaaugggcagagcagaga

SEQ ID NO: 2192826 - RNA, 20 nt, Human
aaaugggcagagcagagacc

SEQ ID NO: 2192827 - RNA, 13 nt, Human
aaaugcccagcuu

SEQ ID NO: 2192828 - RNA, 18 nt, Human
aaaugcccagccccuucu

SEQ ID NO: 2192829 - RNA, 14 nt, Human
aaaugcccagcccc

SEQ ID NO: 2192830 - RNA, 15 nt, Human
aaaugcccagccccu

SEQ ID NO: 2192831 - RNA, 13 nt, Human
aaaugcauggagg

SEQ ID NO: 2192832 - RNA, 12 nt, Human
aaaugcauugua

SEQ ID NO: 2192833 - RNA, 20 nt, Human
aaaugcauuguaucgauguu

SEQ ID NO: 2192834 - RNA, 13 nt, Human
aaaugcauuguau

SEQ ID NO: 2192835 - RNA, 13 nt, Human
aaaugcccagccc

SEQ ID NO: 2192836 - RNA, 14 nt, Human
aaaugcauuucuaa

SEQ ID NO: 2192837 - RNA, 21 nt, Human
aaaugaguuaccuacauuuua

SEQ ID NO: 2192838 - RNA, 22 nt, Human
aaaugaguuuuuauggggcuga

SEQ ID NO: 2192839 - RNA, 23 nt, Human
aaaugauccccagcuguuuaugc

SEQ ID NO: 2192840 - RNA, 15 nt, Human
aaaugaucaguuuuu

SEQ ID NO: 2192841 - RNA, 18 nt, Human
aaaugaguguguuuguca

SEQ ID NO: 2192842 - RNA, 12 nt, Human
aaaugagugugu

SEQ ID NO: 2192843 - RNA, 9 nt, Human
aaaugaggg

SEQ ID NO: 2192844 - RNA, 23 nt, Human
aaaugagguacucuccuggaaau

SEQ ID NO: 2192845 - RNA, 16 nt, Human
aaaugagguacucucc

SEQ ID NO: 2192846 - RNA, 17 nt, Human
aaaugaggucagagccu

SEQ ID NO: 2192847 - RNA, 19 nt, Human
aaaugaggucagagccugc

SEQ ID NO: 2192848 - RNA, 13 nt, Human
aaaugaggaaacu

SEQ ID NO: 2192849 - RNA, 14 nt, Human
aaaugaggaaugua

SEQ ID NO: 2192850 - RNA, 17 nt, Human
aaaugaggaauguauau

SEQ ID NO: 2192851 - RNA, 18 nt, Human
aaaugaggaauguauaug

SEQ ID NO: 2192852 - RNA, 19 nt, Human
aaaugaggaauguauaugu

SEQ ID NO: 2192853 - RNA, 14 nt, Human
aaaugaggacaugu

SEQ ID NO: 2192854 - RNA, 16 nt, Human
aaaugaggacauguuu

SEQ ID NO: 2192855 - RNA, 23 nt, Human
aaaugagcucgcauuugucaaug

SEQ ID NO: 2192856 - RNA, 13 nt, Human
aaaugagccauga

SEQ ID NO: 2192857 - RNA, 17 nt, Human
aaaugagaucaggcucu

SEQ ID NO: 2192858 - RNA, 22 nt, Human
aaaugagaucaggcucugccuc

SEQ ID NO: 2192859 - RNA, 19 nt, Human
aaaugagccuggcaagaau

SEQ ID NO: 2192860 - RNA, 13 nt, Human
aaaugagccuggc

SEQ ID NO: 2192861 - RNA, 20 nt, Human
aaaugagacccucguggccu

SEQ ID NO: 2192862 - RNA, 21 nt, Human
aaaugagaaggcagccaccag

SEQ ID NO: 2192863 - RNA, 20 nt, Human
aaaugagagggcaguguuuc

SEQ ID NO: 2192864 - RNA, 15 nt, Human
aaaugagaucaggcu

SEQ ID NO: 2192865 - RNA, 13 nt, Human
aaaugagaaggaa

SEQ ID NO: 2192866 - RNA, 16 nt, Human
aaaugagaaaucuaaa

SEQ ID NO: 2192867 - RNA, 13 nt, Human
aaaugagaaaucu

SEQ ID NO: 2192868 - RNA, 14 nt, Human
aaaugagaaaucua

SEQ ID NO: 2192869 - RNA, 14 nt, Human
aaaugaacugaagu

SEQ ID NO: 2192870 - RNA, 21 nt, Human
aaaugaacugaaguuucacau

SEQ ID NO: 2192871 - RNA, 11 nt, Human
aaaugaagaaa

SEQ ID NO: 2192872 - RNA, 11 nt, Human
aaaugaagugc

SEQ ID NO: 2192873 - RNA, 19 nt, Human
aaaugaagguuaggauuua

SEQ ID NO: 2192874 - RNA, 18 nt, Human
aaaugaagcagcuuuaaa

SEQ ID NO: 2192875 - RNA, 12 nt, Human
aaaugaaauugu

SEQ ID NO: 2192876 - RNA, 14 nt, Human
aaaugaaauuguaa

SEQ ID NO: 2192877 - RNA, 15 nt, Human
aaaugaaauuguaaa

SEQ ID NO: 2192878 - RNA, 15 nt, Human
aaaugaaagcaugug

SEQ ID NO: 2192879 - RNA, 18 nt, Human
aaaugaaagcaugucuca

SEQ ID NO: 2192880 - RNA, 22 nt, Human
aaaugaaauuacuacaaaauuu

SEQ ID NO: 2192881 - RNA, 20 nt, Human
aaaugaaaguauaacugagu

SEQ ID NO: 2192882 - RNA, 22 nt, Human
aaaugaaagcagggacuugaac

SEQ ID NO: 2192883 - RNA, 21 nt, Human
aaaugaaagcagggacuugaa

SEQ ID NO: 2192884 - RNA, 11 nt, Human
aaaugaauuuu

SEQ ID NO: 2192885 - RNA, 22 nt, Human
aaaugaaugugugugguuuuuu

SEQ ID NO: 2192886 - RNA, 15 nt, Human
aaaugaauguugucu

SEQ ID NO: 2192887 - RNA, 11 nt, Human
aaaugaaugug

SEQ ID NO: 2192888 - RNA, 12 nt, Human
aaaugaaugugu

SEQ ID NO: 2192889 - RNA, 14 nt, Human
aaaugaaugugugu

SEQ ID NO: 2192890 - RNA, 15 nt, Human
aaaugaaugugugug

SEQ ID NO: 2192891 - RNA, 17 nt, Human
aaaugaauguguguggu

SEQ ID NO: 2192892 - RNA, 19 nt, Human
aaaugaaugugugugguuu

SEQ ID NO: 2192893 - RNA, 18 nt, Human
aaaugaauaauuucccaa

SEQ ID NO: 2192894 - RNA, 17 nt, Human
aaaugaauaauuuccca

SEQ ID NO: 2192895 - RNA, 15 nt, Human
aaaugaauaauuucc

SEQ ID NO: 2192896 - RNA, 22 nt, Human
aaaugaagguuaggauuuaaca

SEQ ID NO: 2192897 - RNA, 20 nt, Human
aaaugaagugcaaauuugau

SEQ ID NO: 2192898 - RNA, 16 nt, Human
aaaugaauggcucacu

SEQ ID NO: 2192899 - RNA, 22 nt, Human
aaaugacuaaaaaacaaagaag

SEQ ID NO: 2192900 - RNA, 19 nt, Human
aaaugacuaaaaaacaaag

SEQ ID NO: 2192901 - RNA, 21 nt, Human
aaaugaccaguaauugugaaa

SEQ ID NO: 2192902 - RNA, 14 nt, Human
aaaugacccaaaga

SEQ ID NO: 2192903 - RNA, 16 nt, Human
aaaugacccaaagacc

SEQ ID NO: 2192904 - RNA, 17 nt, Human
aaaugacccaaagacca

SEQ ID NO: 2192905 - RNA, 14 nt, Human
aaaugacagauguu

SEQ ID NO: 2192906 - RNA, 15 nt, Human
aaaugaccaauauua

SEQ ID NO: 2192907 - RNA, 19 nt, Human
aaaugaccaguaauuguga

SEQ ID NO: 2192908 - RNA, 20 nt, Human
aaaugacuaaaaauauuaua

SEQ ID NO: 2192909 - RNA, 17 nt, Human
aaaugacuaaaaauauu

SEQ ID NO: 2192910 - RNA, 11 nt, Human
aaaugagaaau

SEQ ID NO: 2192911 - RNA, 13 nt, Human
aaaucuaugccac

SEQ ID NO: 2192912 - RNA, 14 nt, Human
aaaucuaugccacu

SEQ ID NO: 2192913 - RNA, 20 nt, Human
aaaucuaugccacucagaau

SEQ ID NO: 2192914 - RNA, 13 nt, Human
aaaucuauucaga

SEQ ID NO: 2192915 - RNA, 19 nt, Human
aaaucuauucagacaagca

SEQ ID NO: 2192916 - RNA, 16 nt, Human
aaaucuaugauuccag

SEQ ID NO: 2192917 - RNA, 14 nt, Human
aaaucuaugauucc

SEQ ID NO: 2192918 - RNA, 22 nt, Human
aaaucuagacucaagguuccca

SEQ ID NO: 2192919 - RNA, 16 nt, Human
aaaucuaccuucugua

SEQ ID NO: 2192920 - RNA, 17 nt, Human
aaaucuaccuucuguag

SEQ ID NO: 2192921 - RNA, 18 nt, Human
aaaucuaccuucuguagu

SEQ ID NO: 2192922 - RNA, 22 nt, Human
aaaucuaguauuucaugcuggg

SEQ ID NO: 2192923 - RNA, 14 nt, Human
aaaucuacaguaca

SEQ ID NO: 2192924 - RNA, 15 nt, Human
aaaucuaccuucugu

SEQ ID NO: 2192925 - RNA, 19 nt, Human
aaaucuaauauuaaaaaua

SEQ ID NO: 2192926 - RNA, 18 nt, Human
aaaucuaauauuaaaaau

SEQ ID NO: 2192927 - RNA, 19 nt, Human
aaaucuacacuccagugag

SEQ ID NO: 2192928 - RNA, 22 nt, Human
aaaucggaucuggggcucuggg

SEQ ID NO: 2192929 - RNA, 15 nt, Human
aaaucgcuuuugaua

SEQ ID NO: 2192930 - RNA, 14 nt, Human
aaaucgcuuuugau

SEQ ID NO: 2192931 - RNA, 13 nt, Human
aaaucgcuuuuga

SEQ ID NO: 2192932 - RNA, 17 nt, Human
aaaucuaauauuaaaaa

SEQ ID NO: 2192933 - RNA, 23 nt, Human
aaaucggaucuggggcucuggga

SEQ ID NO: 2192934 - RNA, 17 nt, Human
aaaugaaaaucgugaca

SEQ ID NO: 2192935 - RNA, 18 nt, Human
aaaugaaaacauguaaua

SEQ ID NO: 2192936 - RNA, 15 nt, Human
aaaugaaaaugucuu

SEQ ID NO: 2192937 - RNA, 17 nt, Human
aaaugaaaaugucuugu

SEQ ID NO: 2192938 - RNA, 16 nt, Human
aaaugaaaaugucuug

SEQ ID NO: 2192939 - RNA, 12 nt, Human
aaaugaaagaaa

SEQ ID NO: 2192940 - RNA, 11 nt, Human
aaaugaaaauu

SEQ ID NO: 2192941 - RNA, 19 nt, Human
aaaucucaaauuucuaaau

SEQ ID NO: 2192942 - RNA, 17 nt, Human
aaaucucaaauuucuaa

SEQ ID NO: 2192943 - RNA, 16 nt, Human
aaaucucaaauuucua

SEQ ID NO: 2192944 - RNA, 15 nt, Human
aaaucucaaauuucu

SEQ ID NO: 2192945 - RNA, 18 nt, Human
aaaucccuuaccucggug

SEQ ID NO: 2192946 - RNA, 15 nt, Human
aaaucccauuuaaaa

SEQ ID NO: 2192947 - RNA, 21 nt, Human
aaauccucuuccucugaggcu

SEQ ID NO: 2192948 - RNA, 12 nt, Human
aaauccucuggc

SEQ ID NO: 2192949 - RNA, 13 nt, Human
aaauccucuuccu

SEQ ID NO: 2192950 - RNA, 11 nt, Human
aaauccucugg

SEQ ID NO: 2192951 - RNA, 23 nt, Human
aaauccuaugugauuuuaacucu

SEQ ID NO: 2192952 - RNA, 14 nt, Human
aaauccucuuccuc

SEQ ID NO: 2192953 - RNA, 15 nt, Human
aaauccucuuccucu

SEQ ID NO: 2192954 - RNA, 17 nt, Human
aaauccucuuccucuga

SEQ ID NO: 2192955 - RNA, 18 nt, Human
aaauccucuuccucugag

SEQ ID NO: 2192956 - RNA, 21 nt, Human
aaaucccauucauaacuuuca

SEQ ID NO: 2192957 - RNA, 13 nt, Human
aaauccccuucuc

SEQ ID NO: 2192958 - RNA, 20 nt, Human
aaauccgaaccuccucugug

SEQ ID NO: 2192959 - RNA, 19 nt, Human
aaauccgaaccuccucugu

SEQ ID NO: 2192960 - RNA, 15 nt, Human
aaauccgaaccuccu

SEQ ID NO: 2192961 - RNA, 17 nt, Human
aaaucccuguuuaauau

SEQ ID NO: 2192962 - RNA, 15 nt, Human
aaauccuacugaaug

SEQ ID NO: 2192963 - RNA, 21 nt, Human
aaauccgaaccuccucuguga

SEQ ID NO: 2192964 - RNA, 21 nt, Human
aaauccuaugugauuuuaacu

SEQ ID NO: 2192965 - RNA, 16 nt, Human
aaauccuaugugauuu

SEQ ID NO: 2192966 - RNA, 14 nt, Human
aaauccuaugugau

SEQ ID NO: 2192967 - RNA, 16 nt, Human
aaauccuuccaugaaa

SEQ ID NO: 2192968 - RNA, 16 nt, Human
aaauccuuuacuguua

SEQ ID NO: 2192969 - RNA, 14 nt, Human
aaauccuugaagau

SEQ ID NO: 2192970 - RNA, 19 nt, Human
aaauccuuuuucuuuauaa

SEQ ID NO: 2192971 - RNA, 18 nt, Human
aaauccuuuuucuuuaua

SEQ ID NO: 2192972 - RNA, 17 nt, Human
aaauccuuuuucuuuau

SEQ ID NO: 2192973 - RNA, 14 nt, Human
aaaucgauuggcuu

SEQ ID NO: 2192974 - RNA, 15 nt, Human
aaaucgauuggcuuu

SEQ ID NO: 2192975 - RNA, 13 nt, Human
aaaucgaugcagu

SEQ ID NO: 2192976 - RNA, 19 nt, Human
guaggacuuuccuaaaugu

SEQ ID NO: 2192977 - RNA, 15 nt, Human
guaggacuguagaaa

SEQ ID NO: 2192978 - RNA, 19 nt, Human
guaggaccaagcaucuugg

SEQ ID NO: 2192979 - RNA, 18 nt, Human
guaggaagguuaauguuc

SEQ ID NO: 2192980 - RNA, 15 nt, Human
guaggaaguaggaag

SEQ ID NO: 2192981 - RNA, 19 nt, Human
guaggaaaaauaaaaacag

SEQ ID NO: 2192982 - RNA, 17 nt, Human
guaggaagaguagcauu

SEQ ID NO: 2192983 - RNA, 21 nt, Human
guaggaacgguaaauuucugu

SEQ ID NO: 2192984 - RNA, 16 nt, Human
guaggaacugcugggc

SEQ ID NO: 2192985 - RNA, 15 nt, Human
guaggaagacuuugg

SEQ ID NO: 2192986 - RNA, 18 nt, Human
guaggaacgguaaauuuc

SEQ ID NO: 2192987 - RNA, 12 nt, Human
guagcuuugcuc

SEQ ID NO: 2192988 - RNA, 17 nt, Human
guagcuuaccagaagcu

SEQ ID NO: 2192989 - RNA, 17 nt, Human
guagcuuucccaaauaa

SEQ ID NO: 2192990 - RNA, 23 nt, Human
guaggcaugagggaucacagggc

SEQ ID NO: 2192991 - RNA, 14 nt, Human
guaggcauuuccua

SEQ ID NO: 2192992 - RNA, 22 nt, Human
guaggcaugagggaucacaggg

SEQ ID NO: 2192993 - RNA, 20 nt, Human
guaggcaugagggaucacag

SEQ ID NO: 2192994 - RNA, 17 nt, Human
guaggcaugagggauca

SEQ ID NO: 2192995 - RNA, 14 nt, Human
guaggcagagccuu

SEQ ID NO: 2192996 - RNA, 15 nt, Human
guaggcagagccuuu

SEQ ID NO: 2192997 - RNA, 14 nt, Human
guaggagguuugga

SEQ ID NO: 2192998 - RNA, 23 nt, Human
guaggagcugccuuggcucagac

SEQ ID NO: 2192999 - RNA, 17 nt, Human
guaggaggaugggcucg

SEQ ID NO: 2193000 - RNA, 22 nt, Human
guaggagcugccuuggcucaga

SEQ ID NO: 2193001 - RNA, 14 nt, Human
guaggagcugccuu

SEQ ID NO: 2193002 - RNA, 18 nt, Human
guaggagcccagcucuga

SEQ ID NO: 2193003 - RNA, 11 nt, Human
guaggcagaca

SEQ ID NO: 2193004 - RNA, 12 nt, Human
guaggcagacac

SEQ ID NO: 2193005 - RNA, 13 nt, Human
guaggcagacaca

SEQ ID NO: 2193006 - RNA, 22 nt, Human
guaggcagacacagggacuuga

SEQ ID NO: 2193007 - RNA, 23 nt, Human
guaggcagacacagggacuugaa

SEQ ID NO: 2193008 - RNA, 13 nt, Human
guaggcagagccu

SEQ ID NO: 2193009 - RNA, 13 nt, Human
guaggauuacuag

SEQ ID NO: 2193010 - RNA, 17 nt, Human
guagcuggauuacaggc

SEQ ID NO: 2193011 - RNA, 15 nt, Human
guagcugccccuggc

SEQ ID NO: 2193012 - RNA, 12 nt, Human
guagcugccccu

SEQ ID NO: 2193013 - RNA, 16 nt, Human
guagcugccccuggcu

SEQ ID NO: 2193014 - RNA, 12 nt, Human
guagcugggacu

SEQ ID NO: 2193015 - RNA, 18 nt, Human
guagcugggacuacaggc

SEQ ID NO: 2193016 - RNA, 19 nt, Human
guagcugggacuacaggca

SEQ ID NO: 2193017 - RNA, 21 nt, Human
guagcugggacuacaggcacc

SEQ ID NO: 2193018 - RNA, 18 nt, Human
guagcugggauuacaggc

SEQ ID NO: 2193019 - RNA, 18 nt, Human
guagcuguggugaggugg

SEQ ID NO: 2193020 - RNA, 22 nt, Human
guagcuuaccagaagcuuccau

SEQ ID NO: 2193021 - RNA, 20 nt, Human
guagcuguaaggcaugaagg

SEQ ID NO: 2193022 - RNA, 12 nt, Human
aaaggauauuuu

SEQ ID NO: 2193023 - RNA, 15 nt, Human
aaaggauauuuucuu

SEQ ID NO: 2193024 - RNA, 18 nt, Human
aaaggaucuuuguggcca

SEQ ID NO: 2193025 - RNA, 16 nt, Human
aaaggauacuguaaca

SEQ ID NO: 2193026 - RNA, 18 nt, Human
aaaggauacuguaacacu

SEQ ID NO: 2193027 - RNA, 19 nt, Human
aaaggaucuuuguggccaa

SEQ ID NO: 2193028 - RNA, 17 nt, Human
guagcugcaaaggacag

SEQ ID NO: 2193029 - RNA, 16 nt, Human
aaaggagucaaaacua

SEQ ID NO: 2193030 - RNA, 14 nt, Human
aaaggaggcuggca

SEQ ID NO: 2193031 - RNA, 13 nt, Human
aaaggaggcuggc

SEQ ID NO: 2193032 - RNA, 19 nt, Human
aaaggagagaagagagaaa

SEQ ID NO: 2193033 - RNA, 22 nt, Human
aaaggacuguuuuuuccugagc

SEQ ID NO: 2193034 - RNA, 20 nt, Human
aaaggacuguuuuuuccuga

SEQ ID NO: 2193035 - RNA, 12 nt, Human
aaaggacucugg

SEQ ID NO: 2193036 - RNA, 15 nt, Human
aaaggacucuggggu

SEQ ID NO: 2193037 - RNA, 16 nt, Human
aaaggacucugggguu

SEQ ID NO: 2193038 - RNA, 15 nt, Human
aaauguacugagauu

SEQ ID NO: 2193039 - RNA, 16 nt, Human
aaauguagguaugaau

SEQ ID NO: 2193040 - RNA, 20 nt, Human
aaauguaggcuuaguuugug

SEQ ID NO: 2193041 - RNA, 16 nt, Human
guaguuaguagcaugu

SEQ ID NO: 2193042 - RNA, 23 nt, Human
guaguucccugaaaacccagaga

SEQ ID NO: 2193043 - RNA, 15 nt, Human
guaguuccugcuaca

SEQ ID NO: 2193044 - RNA, 20 nt, Human
guaguucccugaaaacccag

SEQ ID NO: 2193045 - RNA, 17 nt, Human
guaguucccugaaaacc

SEQ ID NO: 2193046 - RNA, 13 nt, Human
guaguucccugaa

SEQ ID NO: 2193047 - RNA, 11 nt, Human
guauaaaagau

SEQ ID NO: 2193048 - RNA, 12 nt, Human
guauaaaagaug

SEQ ID NO: 2193049 - RNA, 17 nt, Human
guauaaaagccuguuua

SEQ ID NO: 2193050 - RNA, 12 nt, Human
aaauguaauuga

SEQ ID NO: 2193051 - RNA, 22 nt, Human
aaauguaagggaaacugccagc

SEQ ID NO: 2193052 - RNA, 18 nt, Human
aaaugggggugcauuuga

SEQ ID NO: 2193053 - RNA, 17 nt, Human
aaaugggggugcauuug

SEQ ID NO: 2193054 - RNA, 16 nt, Human
aaaugggggugcauuu

SEQ ID NO: 2193055 - RNA, 15 nt, Human
aaaugggggugcauu

SEQ ID NO: 2193056 - RNA, 22 nt, Human
aaauggggccagauccagccug

SEQ ID NO: 2193057 - RNA, 21 nt, Human
aaauggggccagauccagccu

SEQ ID NO: 2193058 - RNA, 17 nt, Human
aaauggggccagaucca

SEQ ID NO: 2193059 - RNA, 16 nt, Human
aaauggggccagaucc

SEQ ID NO: 2193060 - RNA, 13 nt, Human
aaauggggccaga

SEQ ID NO: 2193061 - RNA, 16 nt, Human
aaaugggacuucuuuu

SEQ ID NO: 2193062 - RNA, 20 nt, Human
aaaugggacuucuuuucaca

SEQ ID NO: 2193063 - RNA, 21 nt, Human
aaaugggacuucuuuucacau

SEQ ID NO: 2193064 - RNA, 22 nt, Human
aaaugggacuucuuuucacauu

SEQ ID NO: 2193065 - RNA, 14 nt, Human
guauaaacaaaguu

SEQ ID NO: 2193066 - RNA, 23 nt, Human
guauaaaaucagccaauuauguu

SEQ ID NO: 2193067 - RNA, 15 nt, Human
guauaaaaucagcca

SEQ ID NO: 2193068 - RNA, 17 nt, Human
guauaaaaucagccaau

SEQ ID NO: 2193069 - RNA, 18 nt, Human
guauaaaagggacugaga

SEQ ID NO: 2193070 - RNA, 13 nt, Human
guauaaaagaugg

SEQ ID NO: 2193071 - RNA, 23 nt, Human
guauaaaagauggggucuguaaa

SEQ ID NO: 2193072 - RNA, 18 nt, Human
guauaaaagccuguuuaa

SEQ ID NO: 2193073 - RNA, 21 nt, Human
guauaaaagccuguuuaagag

SEQ ID NO: 2193074 - RNA, 13 nt, Human
guauaaagaaaag

SEQ ID NO: 2193075 - RNA, 14 nt, Human
guauaaagaaaagu

SEQ ID NO: 2193076 - RNA, 12 nt, Human
guauaaagaaca

SEQ ID NO: 2193077 - RNA, 13 nt, Human
guauaaacuauca

SEQ ID NO: 2193078 - RNA, 17 nt, Human
guauaaacuaucaguuu

SEQ ID NO: 2193079 - RNA, 18 nt, Human
guauaaauaggagaggau

SEQ ID NO: 2193080 - RNA, 12 nt, Human
guauaaaugguu

SEQ ID NO: 2193081 - RNA, 17 nt, Human
guauaaaugguugucug

SEQ ID NO: 2193082 - RNA, 13 nt, Human
guauaaauaggag

SEQ ID NO: 2193083 - RNA, 21 nt, Human
guauaaagcaacuguuaugaa

SEQ ID NO: 2193084 - RNA, 23 nt, Human
guauaaagcaacuguuaugaaau

SEQ ID NO: 2193085 - RNA, 20 nt, Human
guauaaagcaacuguuauga

SEQ ID NO: 2193086 - RNA, 18 nt, Human
guauaaagcaacuguuau

SEQ ID NO: 2193087 - RNA, 16 nt, Human
guauauucauuucaaa

SEQ ID NO: 2193088 - RNA, 19 nt, Human
guaucaaauauuagaugug

SEQ ID NO: 2193089 - RNA, 20 nt, Human
guaucaaauauuagauguga

SEQ ID NO: 2193090 - RNA, 21 nt, Human
guaucaaauauuagaugugau

SEQ ID NO: 2193091 - RNA, 24 nt, Human
guaucaaauauuagaugugauuua

SEQ ID NO: 2193092 - RNA, 22 nt, Human
guauauugauccagaaagaaaa

SEQ ID NO: 2193093 - RNA, 14 nt, Human
guauauucauuuca

SEQ ID NO: 2193094 - RNA, 15 nt, Human
guauauucauauauu

SEQ ID NO: 2193095 - RNA, 12 nt, Human
guauauucacuu

SEQ ID NO: 2193096 - RNA, 15 nt, Human
guauauuauuucuag

SEQ ID NO: 2193097 - RNA, 16 nt, Human
guauauuauguauuua

SEQ ID NO: 2193098 - RNA, 21 nt, Human
guauauuauguauuuauauuu

SEQ ID NO: 2193099 - RNA, 23 nt, Human
guauauuauguauuuauauuuug

SEQ ID NO: 2193100 - RNA, 11 nt, Human
guauauuauuu

SEQ ID NO: 2193101 - RNA, 22 nt, Human
guauauuauuucuaggaagaau

SEQ ID NO: 2193102 - RNA, 20 nt, Human
guauaacacaauaugaauac

SEQ ID NO: 2193103 - RNA, 13 nt, Human
guauaacagguua

SEQ ID NO: 2193104 - RNA, 15 nt, Human
guauaacagguuauu

SEQ ID NO: 2193105 - RNA, 20 nt, Human
guauaacagguuauuuuagu

SEQ ID NO: 2193106 - RNA, 22 nt, Human
guauaacagguuauuuuaguuu

SEQ ID NO: 2193107 - RNA, 23 nt, Human
guauaaauuuauuuacugcuagu

SEQ ID NO: 2193108 - RNA, 14 nt, Human
guauaaauuuauuu

SEQ ID NO: 2193109 - RNA, 13 nt, Human
guauaaauuuauu

SEQ ID NO: 2193110 - RNA, 12 nt, Human
guauaaauuuau

SEQ ID NO: 2193111 - RNA, 20 nt, Human
guauaacuucuuaaaaguug

SEQ ID NO: 2193112 - RNA, 15 nt, Human
guauaaguaagaaaa

SEQ ID NO: 2193113 - RNA, 16 nt, Human
guauaaguaagaaaau

SEQ ID NO: 2193114 - RNA, 17 nt, Human
guauaaguaagaaaaua

SEQ ID NO: 2193115 - RNA, 18 nt, Human
guaucaauccuuguucag

SEQ ID NO: 2193116 - RNA, 20 nt, Human
guaucacugucuuuccuaga

SEQ ID NO: 2193117 - RNA, 18 nt, Human
guaucacugucuuuccua

SEQ ID NO: 2193118 - RNA, 17 nt, Human
guaucacugucuuuccu

SEQ ID NO: 2193119 - RNA, 12 nt, Human
guaucagaggcc

SEQ ID NO: 2193120 - RNA, 14 nt, Human
guaucagaggccua

SEQ ID NO: 2193121 - RNA, 15 nt, Human
guaucagaggccuau

SEQ ID NO: 2193122 - RNA, 16 nt, Human
guaucagaggccuaua

SEQ ID NO: 2193123 - RNA, 21 nt, Human
guaucaggaaauauauaugug

SEQ ID NO: 2193124 - RNA, 17 nt, Human
guaucagaggccuauaa

SEQ ID NO: 2193125 - RNA, 14 nt, Human
guaucaggacccag

SEQ ID NO: 2193126 - RNA, 21 nt, Human
guaucaggacccagaggaagg

SEQ ID NO: 2193127 - RNA, 18 nt, Human
guaucaggacccagagga

SEQ ID NO: 2193128 - RNA, 22 nt, Human
guaucaggacccagaggaaggg

SEQ ID NO: 2193129 - RNA, 14 nt, Human
guauccccccaucu

SEQ ID NO: 2193130 - RNA, 22 nt, Human
guauccucauuugggguagcua

SEQ ID NO: 2193131 - RNA, 20 nt, Human
guauccccccccuguauagu

SEQ ID NO: 2193132 - RNA, 13 nt, Human
guauccuccaggu

SEQ ID NO: 2193133 - RNA, 14 nt, Human
guauccuccagguu

SEQ ID NO: 2193134 - RNA, 15 nt, Human
guauccuccagguuu

SEQ ID NO: 2193135 - RNA, 16 nt, Human
guauccuccagguuuu

SEQ ID NO: 2193136 - RNA, 17 nt, Human
guauccuccagguuuuu

SEQ ID NO: 2193137 - RNA, 19 nt, Human
guauccuccagguuuuuca

SEQ ID NO: 2193138 - RNA, 22 nt, Human
guaugaucacggcucacugcag

SEQ ID NO: 2193139 - RNA, 15 nt, Human
guaucccuacuguaa

SEQ ID NO: 2193140 - RNA, 17 nt, Human
guauccccccaucuugc

SEQ ID NO: 2193141 - RNA, 18 nt, Human
guauccccccaucuugcu

SEQ ID NO: 2193142 - RNA, 18 nt, Human
guaucccuguuacugaua

SEQ ID NO: 2193143 - RNA, 17 nt, Human
guauggaauacaguguu

SEQ ID NO: 2193144 - RNA, 19 nt, Human
guauggaauacaauguaau

SEQ ID NO: 2193145 - RNA, 18 nt, Human
guauggacuaucugucug

SEQ ID NO: 2193146 - RNA, 18 nt, Human
guauggaauacaguguua

SEQ ID NO: 2193147 - RNA, 13 nt, Human
guauggagcucag

SEQ ID NO: 2193148 - RNA, 18 nt, Human
guauggagagaaaacaga

SEQ ID NO: 2193149 - RNA, 18 nt, Human
guauggagcucagagagg

SEQ ID NO: 2193150 - RNA, 15 nt, Human
guauggagcucagag

SEQ ID NO: 2193151 - RNA, 22 nt, Human
guauggcacuggcauugucccu

SEQ ID NO: 2193152 - RNA, 14 nt, Human
guaugggagagaag

SEQ ID NO: 2193153 - RNA, 21 nt, Human
guauccuccagguuuuucaau

SEQ ID NO: 2193154 - RNA, 20 nt, Human
guauccuccagguuuuucaa

SEQ ID NO: 2193155 - RNA, 13 nt, Human
guaugauguguug

SEQ ID NO: 2193156 - RNA, 16 nt, Human
guaugauguguuguga

SEQ ID NO: 2193157 - RNA, 17 nt, Human
guaugauguguugugau

SEQ ID NO: 2193158 - RNA, 14 nt, Human
guaugauucccagc

SEQ ID NO: 2193159 - RNA, 13 nt, Human
guauggaaauaaa

SEQ ID NO: 2193160 - RNA, 12 nt, Human
guaugcauguga

SEQ ID NO: 2193161 - RNA, 15 nt, Human
guaugcaugugaaga

SEQ ID NO: 2193162 - RNA, 16 nt, Human
guaugcuuugaaugua

SEQ ID NO: 2193163 - RNA, 16 nt, Human
guaugugcacugucac

SEQ ID NO: 2193164 - RNA, 15 nt, Human
guauguggaagugug

SEQ ID NO: 2193165 - RNA, 17 nt, Human
guauguggaaguguggg

SEQ ID NO: 2193166 - RNA, 16 nt, Human
guauguggaagugugg

SEQ ID NO: 2193167 - RNA, 20 nt, Human
guaugugggggucugugugu

SEQ ID NO: 2193168 - RNA, 19 nt, Human
guaugugggggucugugug

SEQ ID NO: 2193169 - RNA, 21 nt, Human
guauguggaagugugggucug

SEQ ID NO: 2193170 - RNA, 18 nt, Human
guauguggaagugugggu

SEQ ID NO: 2193171 - RNA, 15 nt, Human
guauggguguguguu

SEQ ID NO: 2193172 - RNA, 21 nt, Human
guauggguuagggaaaacauu

SEQ ID NO: 2193173 - RNA, 16 nt, Human
guaugggacuggccuc

SEQ ID NO: 2193174 - RNA, 15 nt, Human
guaugggagagaaga

SEQ ID NO: 2193175 - RNA, 14 nt, Human
guaugggcaaaaaa

SEQ ID NO: 2193176 - RNA, 13 nt, Human
guaugucuccagu

SEQ ID NO: 2193177 - RNA, 13 nt, Human
guaugguggcugg

SEQ ID NO: 2193178 - RNA, 15 nt, Human
guauucuuauuuaau

SEQ ID NO: 2193179 - RNA, 16 nt, Human
guauucuucucuuccu

SEQ ID NO: 2193180 - RNA, 22 nt, Human
guauucuucucuuccuuuuauc

SEQ ID NO: 2193181 - RNA, 15 nt, Human
guauugcaucuguau

SEQ ID NO: 2193182 - RNA, 23 nt, Human
guauugcaucuguauaaguaaga

SEQ ID NO: 2193183 - RNA, 18 nt, Human
guauugcacauuguaaaa

SEQ ID NO: 2193184 - RNA, 21 nt, Human
guauugcacauuguaaaaagu

SEQ ID NO: 2193185 - RNA, 15 nt, Human
guauucuucaaccuc

SEQ ID NO: 2193186 - RNA, 13 nt, Human
guauugcacauug

SEQ ID NO: 2193187 - RNA, 14 nt, Human
guauugcacauugu

SEQ ID NO: 2193188 - RNA, 16 nt, Human
guauugcacauuguaa

SEQ ID NO: 2193189 - RNA, 19 nt, Human
guauucucugagcugugca

SEQ ID NO: 2193190 - RNA, 13 nt, Human
guauucucugagc

SEQ ID NO: 2193191 - RNA, 12 nt, Human
guauucucugag

SEQ ID NO: 2193192 - RNA, 11 nt, Human
guauucucuga

SEQ ID NO: 2193193 - RNA, 21 nt, Human
guauguguacgugugugugcg

SEQ ID NO: 2193194 - RNA, 20 nt, Human
aaauuacucaggaagaacac

SEQ ID NO: 2193195 - RNA, 21 nt, Human
aaauuacuuaucauccacauu

SEQ ID NO: 2193196 - RNA, 15 nt, Human
aaauuacuacaaaau

SEQ ID NO: 2193197 - RNA, 19 nt, Human
aaauuaccagaguuguucu

SEQ ID NO: 2193198 - RNA, 23 nt, Human
aaauuaacuuuuauaaacuuuac

SEQ ID NO: 2193199 - RNA, 22 nt, Human
aaauuaacuuuuauaaacuuua

SEQ ID NO: 2193200 - RNA, 20 nt, Human
aaauguuaaguugaugguga

SEQ ID NO: 2193201 - RNA, 19 nt, Human
aaauuaacuuuuauaaacu

SEQ ID NO: 2193202 - RNA, 15 nt, Human
aaauguuauuuaaca

SEQ ID NO: 2193203 - RNA, 21 nt, Human
aaauuaacuuuuauaaacuuu

SEQ ID NO: 2193204 - RNA, 13 nt, Human
guauuuaauuuug

SEQ ID NO: 2193205 - RNA, 16 nt, Human
aaauguuaaaauguau

SEQ ID NO: 2193206 - RNA, 16 nt, Human
guauuuaauuuugaca

SEQ ID NO: 2193207 - RNA, 16 nt, Human
guauuuaauucauguu

SEQ ID NO: 2193208 - RNA, 18 nt, Human
guauuuaauuagugcuaa

SEQ ID NO: 2193209 - RNA, 19 nt, Human
guauuuaauuagugcuaag

SEQ ID NO: 2193210 - RNA, 20 nt, Human
guauuuaauuagugcuaagu

SEQ ID NO: 2193211 - RNA, 21 nt, Human
guauuuaauuagugcuaagug

SEQ ID NO: 2193212 - RNA, 15 nt, Human
guauuggccuggagg

SEQ ID NO: 2193213 - RNA, 12 nt, Human
guauuuaauuag

SEQ ID NO: 2193214 - RNA, 12 nt, Human
guauuggccugg

SEQ ID NO: 2193215 - RNA, 14 nt, Human
guauuggccuggag

SEQ ID NO: 2193216 - RNA, 22 nt, Human
guauuggcuagagguucaaaga

SEQ ID NO: 2193217 - RNA, 20 nt, Human
aaauucagauauauuuuuca

SEQ ID NO: 2193218 - RNA, 21 nt, Human
aaauucaaaaaguguuuauuu

SEQ ID NO: 2193219 - RNA, 16 nt, Human
aaauucacuauuggcu

SEQ ID NO: 2193220 - RNA, 18 nt, Human
aaauucacuauuggcugg

SEQ ID NO: 2193221 - RNA, 14 nt, Human
aaauucaugcugcu

SEQ ID NO: 2193222 - RNA, 22 nt, Human
aaauucacccccuuuccuggac

SEQ ID NO: 2193223 - RNA, 17 nt, Human
aaauuauuuuaaacaaa

SEQ ID NO: 2193224 - RNA, 14 nt, Human
aaauucaaaaagug

SEQ ID NO: 2193225 - RNA, 15 nt, Human
aaauucccuggccuu

SEQ ID NO: 2193226 - RNA, 22 nt, Human
aaauucauuuuuuucacuggag

SEQ ID NO: 2193227 - RNA, 18 nt, Human
aaauucccuggccuuuca

SEQ ID NO: 2193228 - RNA, 16 nt, Human
aaauucccuucaucug

SEQ ID NO: 2193229 - RNA, 19 nt, Human
aaauucccuucaucuggaa

SEQ ID NO: 2193230 - RNA, 17 nt, Human
aaauucaguccuaagaa

SEQ ID NO: 2193231 - RNA, 16 nt, Human
aaauucauauucuguc

SEQ ID NO: 2193232 - RNA, 21 nt, Human
aaauucaucaaauggaagaca

SEQ ID NO: 2193233 - RNA, 13 nt, Human
aaauucauuuuuu

SEQ ID NO: 2193234 - RNA, 12 nt, Human
aaauucauuuua

SEQ ID NO: 2193235 - RNA, 16 nt, Human
aaauuauuuuggauuu

SEQ ID NO: 2193236 - RNA, 15 nt, Human
aaauuauuuuaaaca

SEQ ID NO: 2193237 - RNA, 16 nt, Human
aaauuauuuuaaacaa

SEQ ID NO: 2193238 - RNA, 22 nt, Human
aaauuauuuguguaauagaaaa

SEQ ID NO: 2193239 - RNA, 23 nt, Human
aaauuauuuguguaauagaaaac

SEQ ID NO: 2193240 - RNA, 15 nt, Human
aaauuauaucaauuu

SEQ ID NO: 2193241 - RNA, 20 nt, Human
aaauuagaaaauguuauuua

SEQ ID NO: 2193242 - RNA, 11 nt, Human
aaauuagaaaa

SEQ ID NO: 2193243 - RNA, 23 nt, Human
aaauuagaaaccuuaauaugugg

SEQ ID NO: 2193244 - RNA, 12 nt, Human
aaauuagaaaau

SEQ ID NO: 2193245 - RNA, 14 nt, Human
aaauuacuuuguga

SEQ ID NO: 2193246 - RNA, 17 nt, Human
aaauuacuuugugaaua

SEQ ID NO: 2193247 - RNA, 14 nt, Human
aaauuagaugaacu

SEQ ID NO: 2193248 - RNA, 20 nt, Human
aaauuauagaugggaaugaa

SEQ ID NO: 2193249 - RNA, 22 nt, Human
aaauuuccccaacagugugaag

SEQ ID NO: 2193250 - RNA, 23 nt, Human
aaauuuccccaacagugugaagu

SEQ ID NO: 2193251 - RNA, 23 nt, Human
guauuuuuuuaucuugggacugg

SEQ ID NO: 2193252 - RNA, 20 nt, Human
gucaaaaaguuugguucugu

SEQ ID NO: 2193253 - RNA, 18 nt, Human
guauuuuuuuuucuaaga

SEQ ID NO: 2193254 - RNA, 22 nt, Human
guauuuuuuuuucuaagagaag

SEQ ID NO: 2193255 - RNA, 14 nt, Human
guauuuuuuugcaa

SEQ ID NO: 2193256 - RNA, 16 nt, Human
guauuuuuuugcaagu

SEQ ID NO: 2193257 - RNA, 17 nt, Human
guauuuuuuugcaagug

SEQ ID NO: 2193258 - RNA, 16 nt, Human
guauuuuuuuuucuaa

SEQ ID NO: 2193259 - RNA, 21 nt, Human
guauuuuuuuacuaauagaca

SEQ ID NO: 2193260 - RNA, 17 nt, Human
guauuuuuuuacuaaua

SEQ ID NO: 2193261 - RNA, 19 nt, Human
gucaaaguggugagaggca

SEQ ID NO: 2193262 - RNA, 12 nt, Human
gucaaauaaaca

SEQ ID NO: 2193263 - RNA, 13 nt, Human
gucaaauaaacac

SEQ ID NO: 2193264 - RNA, 14 nt, Human
gucaaauaaacacu

SEQ ID NO: 2193265 - RNA, 15 nt, Human
gucaaauaaacacug

SEQ ID NO: 2193266 - RNA, 17 nt, Human
gucaaauaaacacugug

SEQ ID NO: 2193267 - RNA, 18 nt, Human
gucaaaguggugagaggc

SEQ ID NO: 2193268 - RNA, 23 nt, Human
gucaaaaaguuugguucuguguc

SEQ ID NO: 2193269 - RNA, 15 nt, Human
gucaaauuauguauu

SEQ ID NO: 2193270 - RNA, 22 nt, Human
gucaaaugguaggcauuuccua

SEQ ID NO: 2193271 - RNA, 16 nt, Human
gucaaauugugugaaa

SEQ ID NO: 2193272 - RNA, 13 nt, Human
gucaaccuccugg

SEQ ID NO: 2193273 - RNA, 19 nt, Human
gucaaccugggcaaagccu

SEQ ID NO: 2193274 - RNA, 14 nt, Human
gucaaccugggcaa

SEQ ID NO: 2193275 - RNA, 14 nt, Human
gucaaccuccugga

SEQ ID NO: 2193276 - RNA, 15 nt, Human
gucaaccuccuggac

SEQ ID NO: 2193277 - RNA, 17 nt, Human
gucacaagagcccagca

SEQ ID NO: 2193278 - RNA, 13 nt, Human
gucacacacugau

SEQ ID NO: 2193279 - RNA, 17 nt, Human
gucaacuucaacauuua

SEQ ID NO: 2193280 - RNA, 16 nt, Human
gucaaccuccuggaca

SEQ ID NO: 2193281 - RNA, 21 nt, Human
gucacaaauccuaaaagaagc

SEQ ID NO: 2193282 - RNA, 16 nt, Human
gucacacacuuuggcu

SEQ ID NO: 2193283 - RNA, 20 nt, Human
gucacacaguauuacuucug

SEQ ID NO: 2193284 - RNA, 16 nt, Human
aaauuuccaguaccuu

SEQ ID NO: 2193285 - RNA, 12 nt, Human
aaauuucagauu

SEQ ID NO: 2193286 - RNA, 19 nt, Human
aaauuuccagugagcuuau

SEQ ID NO: 2193287 - RNA, 16 nt, Human
aaauuuccccaacagu

SEQ ID NO: 2193288 - RNA, 23 nt, Human
aaauuuccaguaccuuugucaca

SEQ ID NO: 2193289 - RNA, 22 nt, Human
aaauuuccaguaccuuugucac

SEQ ID NO: 2193290 - RNA, 17 nt, Human
aaauuuccccaacagug

SEQ ID NO: 2193291 - RNA, 18 nt, Human
aaauuuccccaacagugu

SEQ ID NO: 2193292 - RNA, 19 nt, Human
aaauuuccccaacagugug

SEQ ID NO: 2193293 - RNA, 20 nt, Human
aaauuuccccaacaguguga

SEQ ID NO: 2193294 - RNA, 18 nt, Human
aaauuuaguuuuuguucu

SEQ ID NO: 2193295 - RNA, 20 nt, Human
aaauuuauacaccaauugau

SEQ ID NO: 2193296 - RNA, 15 nt, Human
aaauuuaguuuuugu

SEQ ID NO: 2193297 - RNA, 15 nt, Human
guauuuuuuuacuaa

SEQ ID NO: 2193298 - RNA, 14 nt, Human
guauuuuuuuacua

SEQ ID NO: 2193299 - RNA, 15 nt, Human
aaauuccuauuguga

SEQ ID NO: 2193300 - RNA, 18 nt, Human
aaauucccuucaucugga

SEQ ID NO: 2193301 - RNA, 16 nt, Human
aaauuccuauugugau

SEQ ID NO: 2193302 - RNA, 17 nt, Human
aaauuccuauugugauu

SEQ ID NO: 2193303 - RNA, 18 nt, Human
aaauuccuauugugauuu

SEQ ID NO: 2193304 - RNA, 22 nt, Human
aaauuccuauugugauuugacu

SEQ ID NO: 2193305 - RNA, 18 nt, Human
aaauuuaauucauguuuc

SEQ ID NO: 2193306 - RNA, 17 nt, Human
aaauuuaauucauguuu

SEQ ID NO: 2193307 - RNA, 19 nt, Human
aaauuccucuuugcuuugc

SEQ ID NO: 2193308 - RNA, 18 nt, Human
aaauuccucuuugcuuug

SEQ ID NO: 2193309 - RNA, 14 nt, Human
aaauuccucuuugc

SEQ ID NO: 2193310 - RNA, 23 nt, Human
aaauuccuauugugauuugacug

SEQ ID NO: 2193311 - RNA, 18 nt, Human
aaauuucagcagcugcag

SEQ ID NO: 2193312 - RNA, 17 nt, Human
aaauuucagcagcugca

SEQ ID NO: 2193313 - RNA, 15 nt, Human
aaaacaccuagcuuu

SEQ ID NO: 2193314 - RNA, 17 nt, Human
aaaacacauuuuucuua

SEQ ID NO: 2193315 - RNA, 14 nt, Human
aaaacacuaguuuu

SEQ ID NO: 2193316 - RNA, 18 nt, Human
aaaacacugccaucuuag

SEQ ID NO: 2193317 - RNA, 13 nt, Human
aaaacagaagccu

SEQ ID NO: 2193318 - RNA, 17 nt, Human
aaaacagacacuggcau

SEQ ID NO: 2193319 - RNA, 18 nt, Human
aaaacagaacaucauuag

SEQ ID NO: 2193320 - RNA, 21 nt, Human
aaaacagaacaucauuagaac

SEQ ID NO: 2193321 - RNA, 22 nt, Human
aaaacagaacaucauuagaaca

SEQ ID NO: 2193322 - RNA, 22 nt, Human
aaaacaccuagcuuuauucuuc

SEQ ID NO: 2193323 - RNA, 21 nt, Human
aaaacacuaaaaauaaaaaug

SEQ ID NO: 2193324 - RNA, 13 nt, Human
aaaacacugugca

SEQ ID NO: 2193325 - RNA, 19 nt, Human
aaaacacuguucucugccc

SEQ ID NO: 2193326 - RNA, 20 nt, Human
aaaacuuuuuauauuuuaua

SEQ ID NO: 2193327 - RNA, 17 nt, Human
aaaacuuuuuauauuuu

SEQ ID NO: 2193328 - RNA, 15 nt, Human
aaaacuuuucucaga

SEQ ID NO: 2193329 - RNA, 12 nt, Human
aaaagaaaaaaa

SEQ ID NO: 2193330 - RNA, 11 nt, Human
aaaagaaaaaa

SEQ ID NO: 2193331 - RNA, 9 nt, Human
aaaagaaaa

SEQ ID NO: 2193332 - RNA, 11 nt, Human
aaaagaaaaag

SEQ ID NO: 2193333 - RNA, 19 nt, Human
aaaagaaaaaaaaagaaaa

SEQ ID NO: 2193334 - RNA, 18 nt, Human
aaaagaaaaaaaaagaaa

SEQ ID NO: 2193335 - RNA, 17 nt, Human
aaaagaaaaaaaaagaa

SEQ ID NO: 2193336 - RNA, 16 nt, Human
aaaagaaaaaaaaaga

SEQ ID NO: 2193337 - RNA, 11 nt, Human
aaaacuuugga

SEQ ID NO: 2193338 - RNA, 13 nt, Human
aaaacuuuucuca

SEQ ID NO: 2193339 - RNA, 18 nt, Human
aaaacagccucacagaag

SEQ ID NO: 2193340 - RNA, 20 nt, Human
aaaacagcauugcuuucuga

SEQ ID NO: 2193341 - RNA, 16 nt, Human
aaaacagcauugcuuu

SEQ ID NO: 2193342 - RNA, 15 nt, Human
aaaacagacucaggu

SEQ ID NO: 2193343 - RNA, 13 nt, Human
aaaagacagggcu

SEQ ID NO: 2193344 - RNA, 13 nt, Human
aaaagaccagacu

SEQ ID NO: 2193345 - RNA, 13 nt, Human
aaaagacuccaaa

SEQ ID NO: 2193346 - RNA, 16 nt, Human
aaaagaaugggcaguu

SEQ ID NO: 2193347 - RNA, 20 nt, Human
aaaagaaugggcaguuacau

SEQ ID NO: 2193348 - RNA, 13 nt, Human
aaaagacaauucu

SEQ ID NO: 2193349 - RNA, 14 nt, Human
aaaagacaauucuu

SEQ ID NO: 2193350 - RNA, 19 nt, Human
aaaagacaauucuuuauac

SEQ ID NO: 2193351 - RNA, 11 nt, Human
aaaagaaugau

SEQ ID NO: 2193352 - RNA, 16 nt, Human
aaaagaauacagaaag

SEQ ID NO: 2193353 - RNA, 13 nt, Human
aaaagaaggaaaa

SEQ ID NO: 2193354 - RNA, 13 nt, Human
aaaagaauauuuu

SEQ ID NO: 2193355 - RNA, 20 nt, Human
aaaagacaaggaaaaaauaa

SEQ ID NO: 2193356 - RNA, 17 nt, Human
aaaagaacaauauugac

SEQ ID NO: 2193357 - RNA, 10 nt, Human
aaaagaaagc

SEQ ID NO: 2193358 - RNA, 17 nt, Human
aaaagaacacuagaguc

SEQ ID NO: 2193359 - RNA, 16 nt, Human
aaaagaacaguaaaca

SEQ ID NO: 2193360 - RNA, 11 nt, Human
aaaagaaggaa

SEQ ID NO: 2193361 - RNA, 12 nt, Human
aaaagaauauuu

SEQ ID NO: 2193362 - RNA, 22 nt, Human
aaaagaaaaaaaaagaaaaaag

SEQ ID NO: 2193363 - RNA, 14 nt, Human
aaaagaaaauaaaa

SEQ ID NO: 2193364 - RNA, 16 nt, Human
aaaagaaaagucaagg

SEQ ID NO: 2193365 - RNA, 15 nt, Human
aaaagaaaauaaaaa

SEQ ID NO: 2193366 - RNA, 17 nt, Human
aaaagaaagaaaaucag

SEQ ID NO: 2193367 - RNA, 15 nt, Human
aaaagaggggcuggg

SEQ ID NO: 2193368 - RNA, 12 nt, Human
aaaagagggggg

SEQ ID NO: 2193369 - RNA, 14 nt, Human
aaaagagauuucaa

SEQ ID NO: 2193370 - RNA, 22 nt, Human
aaaagaggaaagaaugaaagag

SEQ ID NO: 2193371 - RNA, 21 nt, Human
aaaagagauauuuuaaaauga

SEQ ID NO: 2193372 - RNA, 19 nt, Human
aaaagagauggccugagaa

SEQ ID NO: 2193373 - RNA, 16 nt, Human
aaaagagauuucaaga

SEQ ID NO: 2193374 - RNA, 22 nt, Human
aaaagagguuuuucuuaaauaa

SEQ ID NO: 2193375 - RNA, 21 nt, Human
aaaagagguuuuucuuaaaua

SEQ ID NO: 2193376 - RNA, 17 nt, Human
aaaagagguuuuucuua

SEQ ID NO: 2193377 - RNA, 13 nt, Human
aaaagauaaagau

SEQ ID NO: 2193378 - RNA, 14 nt, Human
aaaagauaaauauu

SEQ ID NO: 2193379 - RNA, 14 nt, Human
aaaagauaaagaug

SEQ ID NO: 2193380 - RNA, 17 nt, Human
aaaagauaaagaugauc

SEQ ID NO: 2193381 - RNA, 18 nt, Human
aaaagauaaagaugaucu

SEQ ID NO: 2193382 - RNA, 20 nt, Human
aaaagauaaagaugaucuac

SEQ ID NO: 2193383 - RNA, 16 nt, Human
aaaagacucaguguuc

SEQ ID NO: 2193384 - RNA, 16 nt, Human
aaaagagaaaagaaaa

SEQ ID NO: 2193385 - RNA, 14 nt, Human
aaaagagaaaagaa

SEQ ID NO: 2193386 - RNA, 13 nt, Human
aaaagagaaaaga

SEQ ID NO: 2193387 - RNA, 19 nt, Human
aaaagagaugaugaaaaua

SEQ ID NO: 2193388 - RNA, 16 nt, Human
aaaagagaugaugaaa

SEQ ID NO: 2193389 - RNA, 19 nt, Human
aaaagagagaaaacuuauu

SEQ ID NO: 2193390 - RNA, 21 nt, Human
aaaagagagaaaacuuauuug

SEQ ID NO: 2193391 - RNA, 14 nt, Human
aaaagagauauuuu

SEQ ID NO: 2193392 - RNA, 16 nt, Human
aaaagagauauuuuaa

SEQ ID NO: 2193393 - RNA, 13 nt, Human
aaaagaucgcagu

SEQ ID NO: 2193394 - RNA, 16 nt, Human
aaaagauccuuuuuaa

SEQ ID NO: 2193395 - RNA, 11 nt, Human
aaaagauauau

SEQ ID NO: 2193396 - RNA, 16 nt, Human
aaaagauauauuaaaa

SEQ ID NO: 2193397 - RNA, 21 nt, Human
aaaagauauauuaaaaauaua

SEQ ID NO: 2193398 - RNA, 22 nt, Human
aaaagauauauuaaaaauauaa

SEQ ID NO: 2193399 - RNA, 15 nt, Human
aaaagauauaagugc

SEQ ID NO: 2193400 - RNA, 18 nt, Human
aaaagauauaagugcugu

SEQ ID NO: 2193401 - RNA, 19 nt, Human
aaaagauauaagugcugua

SEQ ID NO: 2193402 - RNA, 23 nt, Human
aaaagauauaagugcuguauaaa

SEQ ID NO: 2193403 - RNA, 17 nt, Human
aaaagauaaauauuaua

SEQ ID NO: 2193404 - RNA, 20 nt, Human
aaaagauacgacuuuauuuu

SEQ ID NO: 2193405 - RNA, 12 nt, Human
aaaagauauaag

SEQ ID NO: 2193406 - RNA, 13 nt, Human
aaaagauauaagu

SEQ ID NO: 2193407 - RNA, 14 nt, Human
aaaagauauaagug

SEQ ID NO: 2193408 - RNA, 23 nt, Human
aaaagaucuguuuugaaggcaaa

SEQ ID NO: 2193409 - RNA, 19 nt, Human
aaaagucagacugcuggga

SEQ ID NO: 2193410 - RNA, 15 nt, Human
aaaagucaaaaggug

SEQ ID NO: 2193411 - RNA, 19 nt, Human
aaaagucuucacucucuga

SEQ ID NO: 2193412 - RNA, 23 nt, Human
aaaagucuucacucucugaagau

SEQ ID NO: 2193413 - RNA, 21 nt, Human
aaaagugaucaauaaaaugug

SEQ ID NO: 2193414 - RNA, 13 nt, Human
aaaagugacacag

SEQ ID NO: 2193415 - RNA, 14 nt, Human
aaaagugacacagc

SEQ ID NO: 2193416 - RNA, 15 nt, Human
aaaagugacacagca

SEQ ID NO: 2193417 - RNA, 17 nt, Human
aaaagugacacagcagc

SEQ ID NO: 2193418 - RNA, 23 nt, Human
aaaaguuggguuuucuccauuca

SEQ ID NO: 2193419 - RNA, 14 nt, Human
aaaauaaaacuuuu

SEQ ID NO: 2193420 - RNA, 18 nt, Human
aaaauaaaaauaaauuca

SEQ ID NO: 2193421 - RNA, 13 nt, Human
aaaauaaaacauu

SEQ ID NO: 2193422 - RNA, 14 nt, Human
aaaauaaaacauuu

SEQ ID NO: 2193423 - RNA, 15 nt, Human
aaaauaaaacauuuu

SEQ ID NO: 2193424 - RNA, 16 nt, Human
aaaauaaaacauuuua

SEQ ID NO: 2193425 - RNA, 22 nt, Human
aaaauaaaacauuuuaaaugga

SEQ ID NO: 2193426 - RNA, 15 nt, Human
aaaauaaaaaguuaa

SEQ ID NO: 2193427 - RNA, 13 nt, Human
aaaauaaaaaugg

SEQ ID NO: 2193428 - RNA, 19 nt, Human
aaaauaaaaaguuaaaaag

SEQ ID NO: 2193429 - RNA, 16 nt, Human
aaaauaaaaaguuaaa

SEQ ID NO: 2193430 - RNA, 21 nt, Human
aaaaucagccugcuccagcug

SEQ ID NO: 2193431 - RNA, 17 nt, Human
aaaaucagccugcucca

SEQ ID NO: 2193432 - RNA, 13 nt, Human
aaaaucagccugc

SEQ ID NO: 2193433 - RNA, 16 nt, Human
aaaauaaaacuuuuua

SEQ ID NO: 2193434 - RNA, 24 nt, Human
aaaaucagccaauuauguuaaacu

SEQ ID NO: 2193435 - RNA, 22 nt, Human
aaaaucagccaauuauguuaaa

SEQ ID NO: 2193436 - RNA, 10 nt, Human
aaaaucauuu

SEQ ID NO: 2193437 - RNA, 12 nt, Human
aaaaucauuucu

SEQ ID NO: 2193438 - RNA, 11 nt, Human
aaaaucauuuc

SEQ ID NO: 2193439 - RNA, 20 nt, Human
aaaaucuauuuuguaacuuu

SEQ ID NO: 2193440 - RNA, 17 nt, Human
aaaaucuaccuucugua

SEQ ID NO: 2193441 - RNA, 18 nt, Human
aaaaucuaccuucuguag

SEQ ID NO: 2193442 - RNA, 20 nt, Human
aaaaucuaccuucuguaguu

SEQ ID NO: 2193443 - RNA, 21 nt, Human
aaaaucuaccuucuguaguuu

SEQ ID NO: 2193444 - RNA, 21 nt, Human
aaaaucauuucugcaucagcu

SEQ ID NO: 2193445 - RNA, 16 nt, Human
aaaaucucaaauuucu

SEQ ID NO: 2193446 - RNA, 15 nt, Human
aaaaucucaaauuuc

SEQ ID NO: 2193447 - RNA, 18 nt, Human
aaaaucucaaauuucuaa

SEQ ID NO: 2193448 - RNA, 19 nt, Human
aaaccaguguagccuugcc

SEQ ID NO: 2193449 - RNA, 19 nt, Human
aaaccaguguuagggaagg

SEQ ID NO: 2193450 - RNA, 15 nt, Human
aaacccaauccaaau

SEQ ID NO: 2193451 - RNA, 13 nt, Human
aaaccauaaacuu

SEQ ID NO: 2193452 - RNA, 15 nt, Human
aaaccauaaacuuca

SEQ ID NO: 2193453 - RNA, 12 nt, Human
aaaccagggagc

SEQ ID NO: 2193454 - RNA, 16 nt, Human
aaacucuuaucucagu

SEQ ID NO: 2193455 - RNA, 20 nt, Human
aaacucuguugcaagugcaa

SEQ ID NO: 2193456 - RNA, 13 nt, Human
aaacucuuaucuc

SEQ ID NO: 2193457 - RNA, 15 nt, Human
aaacucuuaucucag

SEQ ID NO: 2193458 - RNA, 15 nt, Human
aaacugcacugucaa

SEQ ID NO: 2193459 - RNA, 11 nt, Human
aaagaaaaaaa

SEQ ID NO: 2193460 - RNA, 9 nt, Human
aaagaaaaa

SEQ ID NO: 2193461 - RNA, 23 nt, Human
aaacucuuaaaacccaagugccu

SEQ ID NO: 2193462 - RNA, 12 nt, Human
aaacucuuaaaa

SEQ ID NO: 2193463 - RNA, 22 nt, Human
aaacugauuuuuuuuuccuuca

SEQ ID NO: 2193464 - RNA, 23 nt, Human
aaacugauuuuuuuuuccuucag

SEQ ID NO: 2193465 - RNA, 11 nt, Human
aaacccagaga

SEQ ID NO: 2193466 - RNA, 15 nt, Human
aaacccagacugaac

SEQ ID NO: 2193467 - RNA, 12 nt, Human
aaacccagagag

SEQ ID NO: 2193468 - RNA, 23 nt, Human
aaaccgccagcgaacuugacaau

SEQ ID NO: 2193469 - RNA, 19 nt, Human
aaacucuguugcaagugca

SEQ ID NO: 2193470 - RNA, 16 nt, Human
aaaccgccaaggcugg

SEQ ID NO: 2193471 - RNA, 15 nt, Human
aaaccgccaaggcug

SEQ ID NO: 2193472 - RNA, 23 nt, Human
aaacccaccuuguuggagccugc

SEQ ID NO: 2193473 - RNA, 12 nt, Human
aaacccagcucu

SEQ ID NO: 2193474 - RNA, 16 nt, Human
aaacccagcucugguc

SEQ ID NO: 2193475 - RNA, 18 nt, Human
aaagcauuccaacaaagg

SEQ ID NO: 2193476 - RNA, 19 nt, Human
aaagccagugacuccagga

SEQ ID NO: 2193477 - RNA, 17 nt, Human
aaagccagugacuccag

SEQ ID NO: 2193478 - RNA, 15 nt, Human
aaagcccaaaguggu

SEQ ID NO: 2193479 - RNA, 13 nt, Human
aaagccugcaauu

SEQ ID NO: 2193480 - RNA, 16 nt, Human
aaagccucugcugcca

SEQ ID NO: 2193481 - RNA, 13 nt, Human
aaagccucugugu

SEQ ID NO: 2193482 - RNA, 21 nt, Human
aaagccucugugucacuggcu

SEQ ID NO: 2193483 - RNA, 18 nt, Human
aaagccugcaauuucaua

SEQ ID NO: 2193484 - RNA, 24 nt, Human
aaagccucugugucacuggcugcc

SEQ ID NO: 2193485 - RNA, 17 nt, Human
aaagccugggugacauu

SEQ ID NO: 2193486 - RNA, 18 nt, Human
aaagccugggugacauuu

SEQ ID NO: 2193487 - RNA, 13 nt, Human
aaagcaugucuca

SEQ ID NO: 2193488 - RNA, 15 nt, Human
aaagcauguacagug

SEQ ID NO: 2193489 - RNA, 16 nt, Human
aaagcauguacagugu

SEQ ID NO: 2193490 - RNA, 22 nt, Human
aaagcauucaauuuauucaaga

SEQ ID NO: 2193491 - RNA, 21 nt, Human
aaagcauguacaguguucugu

SEQ ID NO: 2193492 - RNA, 12 nt, Human
aaagcauguaca

SEQ ID NO: 2193493 - RNA, 13 nt, Human
aaagcauguacag

SEQ ID NO: 2193494 - RNA, 14 nt, Human
aaagcauguacagu

SEQ ID NO: 2193495 - RNA, 17 nt, Human
aaagcauuguaaaugug

SEQ ID NO: 2193496 - RNA, 15 nt, Human
aaagcauuguaaaug

SEQ ID NO: 2193497 - RNA, 18 nt, Human
aaagaaaaaauaauugau

SEQ ID NO: 2193498 - RNA, 16 nt, Human
aaagauauuuuuaucu

SEQ ID NO: 2193499 - RNA, 20 nt, Human
aaagauauuuugcuuuguga

SEQ ID NO: 2193500 - RNA, 18 nt, Human
aaagaaaaaagagaaaag

SEQ ID NO: 2193501 - RNA, 18 nt, Human
aaagaaaaaaaagaaagc

SEQ ID NO: 2193502 - RNA, 13 nt, Human
aaagaaaaaaaau

SEQ ID NO: 2193503 - RNA, 16 nt, Human
aaagaaaaaaaaagaa

SEQ ID NO: 2193504 - RNA, 17 nt, Human
aaacuuuuuuuugagaa

SEQ ID NO: 2193505 - RNA, 10 nt, Human
aaagaaaaaa

SEQ ID NO: 2193506 - RNA, 13 nt, Human
aaagaucuguuuu

SEQ ID NO: 2193507 - RNA, 21 nt, Human
aaagaucuguccucagccuug

SEQ ID NO: 2193508 - RNA, 16 nt, Human
aaagaucuguuuugaa

SEQ ID NO: 2193509 - RNA, 22 nt, Human
aaacucuuaucucagucaugca

SEQ ID NO: 2193510 - RNA, 20 nt, Human
aaagaucuguccucagccuu

SEQ ID NO: 2193511 - RNA, 19 nt, Human
aaagaucuguccucagccu

SEQ ID NO: 2193512 - RNA, 18 nt, Human
aaagaucuguccucagcc

SEQ ID NO: 2193513 - RNA, 15 nt, Human
aaagaucauguaaaa

SEQ ID NO: 2193514 - RNA, 20 nt, Human
aaagaucaaaauaaaaagug

SEQ ID NO: 2193515 - RNA, 22 nt, Human
aaagaucacuuguuguuuuacu

SEQ ID NO: 2193516 - RNA, 14 nt, Human
aaagaucaaaauaa

SEQ ID NO: 2193517 - RNA, 15 nt, Human
aaagaucaaaauaaa

SEQ ID NO: 2193518 - RNA, 16 nt, Human
aaagaucaaaauaaaa

SEQ ID NO: 2193519 - RNA, 17 nt, Human
aaagaucaaaauaaaaa

SEQ ID NO: 2193520 - RNA, 21 nt, Human
aacaugaagucguugugaggg

SEQ ID NO: 2193521 - RNA, 18 nt, Human
aacaugaggggacauuuu

SEQ ID NO: 2193522 - RNA, 20 nt, Human
aacaugacccuaaaucuuga

SEQ ID NO: 2193523 - RNA, 19 nt, Human
aacauggagaaacccuguc

SEQ ID NO: 2193524 - RNA, 23 nt, Human
aacauggacuuguauauuuguac

SEQ ID NO: 2193525 - RNA, 19 nt, Human
aacauggacuuguauauuu

SEQ ID NO: 2193526 - RNA, 20 nt, Human
aacauggacuuguauauuug

SEQ ID NO: 2193527 - RNA, 21 nt, Human
aacaugaggggacauuuuggu

SEQ ID NO: 2193528 - RNA, 15 nt, Human
aacauggacuuguau

SEQ ID NO: 2193529 - RNA, 16 nt, Human
aacauggacuuguaua

SEQ ID NO: 2193530 - RNA, 18 nt, Human
aacauggacuuguauauu

SEQ ID NO: 2193531 - RNA, 22 nt, Human
aacauggccuuugcuugaaaga

SEQ ID NO: 2193532 - RNA, 21 nt, Human
aacaggcucaauauuccugaa

SEQ ID NO: 2193533 - RNA, 11 nt, Human
aacaucuuuuc

SEQ ID NO: 2193534 - RNA, 15 nt, Human
aacaucuuuucuugc

SEQ ID NO: 2193535 - RNA, 20 nt, Human
aacaggcucaauauuccuga

SEQ ID NO: 2193536 - RNA, 18 nt, Human
aacaggcuacucuccucg

SEQ ID NO: 2193537 - RNA, 12 nt, Human
aacaggcccagc

SEQ ID NO: 2193538 - RNA, 13 nt, Human
aacaggcccagca

SEQ ID NO: 2193539 - RNA, 23 nt, Human
aacaggcccagcauugcugguuc

SEQ ID NO: 2193540 - RNA, 18 nt, Human
aacagccacuacauuacu

SEQ ID NO: 2193541 - RNA, 16 nt, Human
aacagccaacaggugg

SEQ ID NO: 2193542 - RNA, 17 nt, Human
aacagcauugcuuucug

SEQ ID NO: 2193543 - RNA, 15 nt, Human
aacagccaacaggug

SEQ ID NO: 2193544 - RNA, 20 nt, Human
aacagcauugcuuucugaaa

SEQ ID NO: 2193545 - RNA, 16 nt, Human
aacagcauugcuuucu

SEQ ID NO: 2193546 - RNA, 11 nt, Human
aacaggcagau

SEQ ID NO: 2193547 - RNA, 11 nt, Human
aacaggcccag

SEQ ID NO: 2193548 - RNA, 14 nt, Human
aacaggcaagugaa

SEQ ID NO: 2193549 - RNA, 14 nt, Human
aacagccucacaga

SEQ ID NO: 2193550 - RNA, 13 nt, Human
aacagccucacag

SEQ ID NO: 2193551 - RNA, 22 nt, Human
aacagccgucagccaaauguaa

SEQ ID NO: 2193552 - RNA, 21 nt, Human
aacagccgcuccugucugcca

SEQ ID NO: 2193553 - RNA, 20 nt, Human
aacagccgcuccugucugcc

SEQ ID NO: 2193554 - RNA, 23 nt, Human
aaauucuucugaacucaaacuga

SEQ ID NO: 2193555 - RNA, 18 nt, Human
aaauucuugcaaaguauc

SEQ ID NO: 2193556 - RNA, 15 nt, Human
aaauucuugcaaagu

SEQ ID NO: 2193557 - RNA, 23 nt, Human
aaauucuucuccacuuucuagcc

SEQ ID NO: 2193558 - RNA, 22 nt, Human
aacaugguaaacgcugucccua

SEQ ID NO: 2193559 - RNA, 18 nt, Human
aacauggugucuggauuc

SEQ ID NO: 2193560 - RNA, 20 nt, Human
aacaugguuacaaucauugc

SEQ ID NO: 2193561 - RNA, 23 nt, Human
aacaugggguuggcugggcccag

SEQ ID NO: 2193562 - RNA, 20 nt, Human
aacauggagaaacccugucu

SEQ ID NO: 2193563 - RNA, 23 nt, Human
aacauggccuuugcuugaaagaa

SEQ ID NO: 2193564 - RNA, 15 nt, Human
aacccucccucagcc

SEQ ID NO: 2193565 - RNA, 14 nt, Human
aacccucccucagc

SEQ ID NO: 2193566 - RNA, 13 nt, Human
aacccucccucag

SEQ ID NO: 2193567 - RNA, 19 nt, Human
aacccucagagccaccccu

SEQ ID NO: 2193568 - RNA, 12 nt, Human
aacccucagagc

SEQ ID NO: 2193569 - RNA, 19 nt, Human
aacccuccuaucaccuccc

SEQ ID NO: 2193570 - RNA, 23 nt, Human
aacccucccucagccccucuugc

SEQ ID NO: 2193571 - RNA, 21 nt, Human
aacccucccucagccccucuu

SEQ ID NO: 2193572 - RNA, 20 nt, Human
aacccucccucagccccucu

SEQ ID NO: 2193573 - RNA, 19 nt, Human
aacccucccucagccccuc

SEQ ID NO: 2193574 - RNA, 18 nt, Human
aacccucccucagccccu

SEQ ID NO: 2193575 - RNA, 17 nt, Human
aacccucccucagcccc

SEQ ID NO: 2193576 - RNA, 16 nt, Human
aacccucccucagccc

SEQ ID NO: 2193577 - RNA, 23 nt, Human
aaccggggagcccccgccccgcc

SEQ ID NO: 2193578 - RNA, 15 nt, Human
aaccgucaauaggca

SEQ ID NO: 2193579 - RNA, 21 nt, Human
aacccucucaggugaccaaaa

SEQ ID NO: 2193580 - RNA, 21 nt, Human
aacccuccuaucaccuccccu

SEQ ID NO: 2193581 - RNA, 17 nt, Human
aacccugcaaaggacug

SEQ ID NO: 2193582 - RNA, 22 nt, Human
aaccgucuguuaugcugugaca

SEQ ID NO: 2193583 - RNA, 18 nt, Human
aaccgucuguuaugcugu

SEQ ID NO: 2193584 - RNA, 16 nt, Human
aaccgucuguuaugcu

SEQ ID NO: 2193585 - RNA, 15 nt, Human
aaccguuauuauaau

SEQ ID NO: 2193586 - RNA, 20 nt, Human
aaccuaaaauaauugguucu

SEQ ID NO: 2193587 - RNA, 16 nt, Human
aaccuaaaaaagauau

SEQ ID NO: 2193588 - RNA, 21 nt, Human
aaccuaaaauaauugguucuu

SEQ ID NO: 2193589 - RNA, 18 nt, Human
aaccguuuugaagcuacu

SEQ ID NO: 2193590 - RNA, 17 nt, Human
aaccguuuugaagcuac

SEQ ID NO: 2193591 - RNA, 22 nt, Human
aaccguuauuauaauuguauca

SEQ ID NO: 2193592 - RNA, 13 nt, Human
aaccuaaaaaaga

SEQ ID NO: 2193593 - RNA, 14 nt, Human
aaccuaaaaaagau

SEQ ID NO: 2193594 - RNA, 15 nt, Human
aaccuaaaaaagaua

SEQ ID NO: 2193595 - RNA, 18 nt, Human
aaccuuuguuugcaucug

SEQ ID NO: 2193596 - RNA, 16 nt, Human
aaccuuuugagugccu

SEQ ID NO: 2193597 - RNA, 23 nt, Human
aaccuuuugagugccuuacacaa

SEQ ID NO: 2193598 - RNA, 15 nt, Human
aaccuuuuuuaagau

SEQ ID NO: 2193599 - RNA, 12 nt, Human
aaccuuuuuaaa

SEQ ID NO: 2193600 - RNA, 16 nt, Human
aaauauuuugcuaguu

SEQ ID NO: 2193601 - RNA, 12 nt, Human
aaauauuuuguc

SEQ ID NO: 2193602 - RNA, 14 nt, Human
aaauauuuugucua

SEQ ID NO: 2193603 - RNA, 15 nt, Human
aaauauuuugucuaa

SEQ ID NO: 2193604 - RNA, 16 nt, Human
aaauauuuugucuaaa

SEQ ID NO: 2193605 - RNA, 17 nt, Human
aaauauuuugucuaaaa

SEQ ID NO: 2193606 - RNA, 22 nt, Human
aaauauuuugucuaaaaugccu

SEQ ID NO: 2193607 - RNA, 14 nt, Human
aaauauuuuuagua

SEQ ID NO: 2193608 - RNA, 15 nt, Human
aaauauuuuuauaga

SEQ ID NO: 2193609 - RNA, 14 nt, Human
aaauauuuccuuaa

SEQ ID NO: 2193610 - RNA, 12 nt, Human
aaauauuuggag

SEQ ID NO: 2193611 - RNA, 15 nt, Human
aaauauuuguacaua

SEQ ID NO: 2193612 - RNA, 14 nt, Human
aaauauuuguacau

SEQ ID NO: 2193613 - RNA, 22 nt, Human
aaauauuuguacauaguuauuu

SEQ ID NO: 2193614 - RNA, 22 nt, Human
aaauauuuugaaucaauaauau

SEQ ID NO: 2193615 - RNA, 12 nt, Human
aaauauuuccuu

SEQ ID NO: 2193616 - RNA, 14 nt, Human
aaauauuucaagac

SEQ ID NO: 2193617 - RNA, 12 nt, Human
aaauauuucaag

SEQ ID NO: 2193618 - RNA, 13 nt, Human
aaauauuucaaga

SEQ ID NO: 2193619 - RNA, 15 nt, Human
aaauauuuauguaaa

SEQ ID NO: 2193620 - RNA, 15 nt, Human
aaauauuuauuuauu

SEQ ID NO: 2193621 - RNA, 21 nt, Human
aaauauuuauuuuaauaaugu

SEQ ID NO: 2193622 - RNA, 21 nt, Human
aaauauuuacauaugaaauuu

SEQ ID NO: 2193623 - RNA, 16 nt, Human
aaauauuuagcaaaua

SEQ ID NO: 2193624 - RNA, 19 nt, Human
aaauauuuacauaugaaau

SEQ ID NO: 2193625 - RNA, 17 nt, Human
aaauauuuacauaugaa

SEQ ID NO: 2193626 - RNA, 15 nt, Human
aaauauuuacauaug

SEQ ID NO: 2193627 - RNA, 12 nt, Human
aaauauuuaucu

SEQ ID NO: 2193628 - RNA, 19 nt, Human
aaauauuuauaaaacuucu

SEQ ID NO: 2193629 - RNA, 10 nt, Human
aaauauuuau

SEQ ID NO: 2193630 - RNA, 19 nt, Human
aaauagaguuugcuauuag

SEQ ID NO: 2193631 - RNA, 16 nt, Human
aaauagcaauccuaaa

SEQ ID NO: 2193632 - RNA, 21 nt, Human
aaauagauaagaguagaaacu

SEQ ID NO: 2193633 - RNA, 12 nt, Human
aaauauuuaaga

SEQ ID NO: 2193634 - RNA, 21 nt, Human
aaauagcauguauugugucuu

SEQ ID NO: 2193635 - RNA, 16 nt, Human
aaauagcauguauugu

SEQ ID NO: 2193636 - RNA, 18 nt, Human
aaauagcauguauugugu

SEQ ID NO: 2193637 - RNA, 14 nt, Human
aaauagcauguauu

SEQ ID NO: 2193638 - RNA, 15 nt, Human
aaauagcauguauug

SEQ ID NO: 2193639 - RNA, 17 nt, Human
aaauagaguauaugcac

SEQ ID NO: 2193640 - RNA, 19 nt, Human
aaauagaguauaugcacuu

SEQ ID NO: 2193641 - RNA, 22 nt, Human
aaaugcuuuaaaaacuauuuaa

SEQ ID NO: 2193642 - RNA, 18 nt, Human
aaaugcuuuaugcaaacc

SEQ ID NO: 2193643 - RNA, 19 nt, Human
aaaugcuuuaaaaacuauu

SEQ ID NO: 2193644 - RNA, 21 nt, Human
aaaugcuuuaaaaacuauuua

SEQ ID NO: 2193645 - RNA, 13 nt, Human
aaauggauacugg

SEQ ID NO: 2193646 - RNA, 22 nt, Human
aaauggagguccuucugcugga

SEQ ID NO: 2193647 - RNA, 19 nt, Human
aaaugcuuugugugauuga

SEQ ID NO: 2193648 - RNA, 18 nt, Human
aaaugcuuuuuauuucug

SEQ ID NO: 2193649 - RNA, 22 nt, Human
aaaugcugguuuuucaguuuuc

SEQ ID NO: 2193650 - RNA, 21 nt, Human
aaaugcugcgcccuuccccag

SEQ ID NO: 2193651 - RNA, 22 nt, Human
aaauagcauguauugugucuuu

SEQ ID NO: 2193652 - RNA, 19 nt, Human
aaaugcuguaacuuucuga

SEQ ID NO: 2193653 - RNA, 20 nt, Human
aaaugcugcgcccuucccca

SEQ ID NO: 2193654 - RNA, 18 nt, Human
aaaucuuuuagucauuau

SEQ ID NO: 2193655 - RNA, 11 nt, Human
aaaucuuuuac

SEQ ID NO: 2193656 - RNA, 14 nt, Human
aaaucuuuucuauu

SEQ ID NO: 2193657 - RNA, 14 nt, Human
aaaugaaaaaauau

SEQ ID NO: 2193658 - RNA, 17 nt, Human
aaaucucaccccauccc

SEQ ID NO: 2193659 - RNA, 16 nt, Human
aaaucucaauucuucc

SEQ ID NO: 2193660 - RNA, 15 nt, Human
aaaucucagcaauga

SEQ ID NO: 2193661 - RNA, 22 nt, Human
aaaucucagaauuccuuuucua

SEQ ID NO: 2193662 - RNA, 19 nt, Human
aaaucuccaaaauaaaacu

SEQ ID NO: 2193663 - RNA, 22 nt, Human
aaaucuuucuuucuuagaaauu

SEQ ID NO: 2193664 - RNA, 22 nt, Human
aaaucuuuuaaaaauucaaaug

SEQ ID NO: 2193665 - RNA, 23 nt, Human
aaaucuuucuuucuuagaaauuu

SEQ ID NO: 2193666 - RNA, 13 nt, Human
aaaucuuuuugcu

SEQ ID NO: 2193667 - RNA, 14 nt, Human
aaaucuuuuugcuu

SEQ ID NO: 2193668 - RNA, 20 nt, Human
aaauauuuuuuuguagauga

SEQ ID NO: 2193669 - RNA, 21 nt, Human
aaauauuuuuuuguagaugaa

SEQ ID NO: 2193670 - RNA, 12 nt, Human
aaauauuuuugg

SEQ ID NO: 2193671 - RNA, 23 nt, Human
aaauauuuuuauagauuugaccu

SEQ ID NO: 2193672 - RNA, 22 nt, Human
aaauauuuuuggucauuguaau

SEQ ID NO: 2193673 - RNA, 21 nt, Human
aaauauuuuuucuuuucuauu

SEQ ID NO: 2193674 - RNA, 22 nt, Human
aaauauuuuuuauauauacagu

SEQ ID NO: 2193675 - RNA, 17 nt, Human
aaauauuuuuuuguaga

SEQ ID NO: 2193676 - RNA, 18 nt, Human
aaaucucaauauuucaga

SEQ ID NO: 2193677 - RNA, 23 nt, Human
aaaucucaaauuuggauugcuaa

SEQ ID NO: 2193678 - RNA, 16 nt, Human
aaaggauguugguguu

SEQ ID NO: 2193679 - RNA, 18 nt, Human
aaaggauucauguggaau

SEQ ID NO: 2193680 - RNA, 13 nt, Human
aaaggaugugauu

SEQ ID NO: 2193681 - RNA, 23 nt, Human
aaaggaugugauauauaagugua

SEQ ID NO: 2193682 - RNA, 21 nt, Human
aaaggauguaaacagugccug

SEQ ID NO: 2193683 - RNA, 20 nt, Human
aaaggauguaaacagugccu

SEQ ID NO: 2193684 - RNA, 19 nt, Human
aaaggauguaaacagugcc

SEQ ID NO: 2193685 - RNA, 20 nt, Human
aaagccuguuccccucacug

SEQ ID NO: 2193686 - RNA, 14 nt, Human
aaaggaugcacaga

SEQ ID NO: 2193687 - RNA, 12 nt, Human
aaaggaugugau

SEQ ID NO: 2193688 - RNA, 14 nt, Human
aaaggaugugauau

SEQ ID NO: 2193689 - RNA, 17 nt, Human
aaaggaugugauauaua

SEQ ID NO: 2193690 - RNA, 19 nt, Human
aaaggaugugauauauaag

SEQ ID NO: 2193691 - RNA, 20 nt, Human
aaaggaugcccaaagaugca

SEQ ID NO: 2193692 - RNA, 17 nt, Human
aaagccuguauucucaa

SEQ ID NO: 2193693 - RNA, 13 nt, Human
aaagccuguuccc

SEQ ID NO: 2193694 - RNA, 18 nt, Human
aaauguuuuagcaauuua

SEQ ID NO: 2193695 - RNA, 19 nt, Human
aaauguuggauuuauaaau

SEQ ID NO: 2193696 - RNA, 20 nt, Human
aaauguuggauuuauaaaug

SEQ ID NO: 2193697 - RNA, 22 nt, Human
aaauguuggauuuauaaaugcu

SEQ ID NO: 2193698 - RNA, 21 nt, Human
aaauguuggauuuauaaaugc

SEQ ID NO: 2193699 - RNA, 19 nt, Human
aaauguugagaaucccaaa

SEQ ID NO: 2193700 - RNA, 18 nt, Human
aaauguuggauuuauaaa

SEQ ID NO: 2193701 - RNA, 23 nt, Human
aaauguugacaugggacauuugc

SEQ ID NO: 2193702 - RNA, 16 nt, Human
aaauguuuuucugcca

SEQ ID NO: 2193703 - RNA, 17 nt, Human
aaauguuuuucuaugua

SEQ ID NO: 2193704 - RNA, 23 nt, Human
aaauguuuuucugccagggagcu

SEQ ID NO: 2193705 - RNA, 21 nt, Human
aaauguuuuucugccagggag

SEQ ID NO: 2193706 - RNA, 15 nt, Human
aaauucuguuucuug

SEQ ID NO: 2193707 - RNA, 14 nt, Human
aaauucuguuucuu

SEQ ID NO: 2193708 - RNA, 13 nt, Human
aaauguucaucaa

SEQ ID NO: 2193709 - RNA, 16 nt, Human
aaauguucacuuuuga

SEQ ID NO: 2193710 - RNA, 13 nt, Human
aaauguucacuuu

SEQ ID NO: 2193711 - RNA, 21 nt, Human
aaauguucagaagguugcucu

SEQ ID NO: 2193712 - RNA, 15 nt, Human
aaauguucagaaggu

SEQ ID NO: 2193713 - RNA, 17 nt, Human
aaauguucaucaaugaa

SEQ ID NO: 2193714 - RNA, 22 nt, Human
aaauguugacaugggacauuug

SEQ ID NO: 2193715 - RNA, 21 nt, Human
aaauguuauuuuuuaauuauu

SEQ ID NO: 2193716 - RNA, 20 nt, Human
aaauguuauuuuuuaauuau

SEQ ID NO: 2193717 - RNA, 13 nt, Human
aaauggccauuug

SEQ ID NO: 2193718 - RNA, 16 nt, Human
aaauggccauuugcuu

SEQ ID NO: 2193719 - RNA, 15 nt, Human
aagaguccucugaau

SEQ ID NO: 2193720 - RNA, 22 nt, Human
aagaguaguugauguugcauuu

SEQ ID NO: 2193721 - RNA, 23 nt, Human
aagaguaguugauguugcauuuu

SEQ ID NO: 2193722 - RNA, 19 nt, Human
aagaguaguugauguugca

SEQ ID NO: 2193723 - RNA, 16 nt, Human
aagaguaguaauagag

SEQ ID NO: 2193724 - RNA, 20 nt, Human
aagaguaggaagacuuugga

SEQ ID NO: 2193725 - RNA, 23 nt, Human
aagaguguccuaggaguauccuc

SEQ ID NO: 2193726 - RNA, 22 nt, Human
aagaguguagaagcauuccuuc

SEQ ID NO: 2193727 - RNA, 19 nt, Human
aagaguguagaucagagca

SEQ ID NO: 2193728 - RNA, 14 nt, Human
aagaguguagaagc

SEQ ID NO: 2193729 - RNA, 15 nt, Human
aagaguguagaagca

SEQ ID NO: 2193730 - RNA, 16 nt, Human
aagaguguagaagcau

SEQ ID NO: 2193731 - RNA, 18 nt, Human
aagaguguagaagcauuc

SEQ ID NO: 2193732 - RNA, 13 nt, Human
aagaguguacugg

SEQ ID NO: 2193733 - RNA, 14 nt, Human
aagaguguacuggg

SEQ ID NO: 2193734 - RNA, 15 nt, Human
aagaguguacugggg

SEQ ID NO: 2193735 - RNA, 12 nt, Human
aagaguguagaa

SEQ ID NO: 2193736 - RNA, 13 nt, Human
aagaguguagaag

SEQ ID NO: 2193737 - RNA, 23 nt, Human
aagaguucuuaaggauugugaua

SEQ ID NO: 2193738 - RNA, 19 nt, Human
aagaguugagugauagagc

SEQ ID NO: 2193739 - RNA, 23 nt, Human
aagacaauggcuuacuccaggag

SEQ ID NO: 2193740 - RNA, 11 nt, Human
aagacaauucu

SEQ ID NO: 2193741 - RNA, 12 nt, Human
aagacaauucuu

SEQ ID NO: 2193742 - RNA, 15 nt, Human
aagacaauucuuuau

SEQ ID NO: 2193743 - RNA, 19 nt, Human
aagacaauucuuuauacaa

SEQ ID NO: 2193744 - RNA, 20 nt, Human
aagacaaugugaaaagaaaa

SEQ ID NO: 2193745 - RNA, 22 nt, Human
aagacacugaaauauacacaca

SEQ ID NO: 2193746 - RNA, 21 nt, Human
aagacacugaaauauacacac

SEQ ID NO: 2193747 - RNA, 14 nt, Human
aagacacugaaaua

SEQ ID NO: 2193748 - RNA, 13 nt, Human
aagacaccagagc

SEQ ID NO: 2193749 - RNA, 14 nt, Human
aagacaccagagca

SEQ ID NO: 2193750 - RNA, 15 nt, Human
aagacaccagagcag

SEQ ID NO: 2193751 - RNA, 16 nt, Human
aagacaccagagcaga

SEQ ID NO: 2193752 - RNA, 20 nt, Human
aagacaccagagcagaugca

SEQ ID NO: 2193753 - RNA, 21 nt, Human
aagacaccagagcagaugcag

SEQ ID NO: 2193754 - RNA, 22 nt, Human
aagacaccagagcagaugcaga

SEQ ID NO: 2193755 - RNA, 19 nt, Human
aagacaaugugaaaagaaa

SEQ ID NO: 2193756 - RNA, 22 nt, Human
aagacaaugacuuacuguacau

SEQ ID NO: 2193757 - RNA, 21 nt, Human
aagacaacauuaaaacaauau

SEQ ID NO: 2193758 - RNA, 15 nt, Human
aagacaacauuaaaa

SEQ ID NO: 2193759 - RNA, 16 nt, Human
aagacaauccauguaa

SEQ ID NO: 2193760 - RNA, 13 nt, Human
aagacaauauaau

SEQ ID NO: 2193761 - RNA, 13 nt, Human
aagacaagcugca

SEQ ID NO: 2193762 - RNA, 15 nt, Human
aagacaagacuucag

SEQ ID NO: 2193763 - RNA, 16 nt, Human
aagaagacaugaacca

SEQ ID NO: 2193764 - RNA, 17 nt, Human
aagaagacauggagacu

SEQ ID NO: 2193765 - RNA, 13 nt, Human
aagaagacauguu

SEQ ID NO: 2193766 - RNA, 12 nt, Human
aagaagacauga

SEQ ID NO: 2193767 - RNA, 15 nt, Human
aagaagacugcauua

SEQ ID NO: 2193768 - RNA, 16 nt, Human
aagaagaaacgucuau

SEQ ID NO: 2193769 - RNA, 21 nt, Human
aagaagaaaauugcugugccu

SEQ ID NO: 2193770 - RNA, 13 nt, Human
aagaagaagggca

SEQ ID NO: 2193771 - RNA, 15 nt, Human
aagaagaacuugcau

SEQ ID NO: 2193772 - RNA, 21 nt, Human
aagacaaggaaaaaauaacaa

SEQ ID NO: 2193773 - RNA, 20 nt, Human
aagaagacugcauuauauuu

SEQ ID NO: 2193774 - RNA, 21 nt, Human
aagaagaccagacuguggaga

SEQ ID NO: 2193775 - RNA, 14 nt, Human
aagaagacauguuu

SEQ ID NO: 2193776 - RNA, 15 nt, Human
aagaagacauguuuu

SEQ ID NO: 2193777 - RNA, 17 nt, Human
aagaagacauguuuuag

SEQ ID NO: 2193778 - RNA, 19 nt, Human
aagaagaccagacugugga

SEQ ID NO: 2193779 - RNA, 15 nt, Human
aagaacuugcaugga

SEQ ID NO: 2193780 - RNA, 20 nt, Human
aagaacuguguuucaaguuc

SEQ ID NO: 2193781 - RNA, 23 nt, Human
aagaacugcaggcccuggccucc

SEQ ID NO: 2193782 - RNA, 12 nt, Human
aagaacugcuuu

SEQ ID NO: 2193783 - RNA, 18 nt, Human
aagaacugcaggcccugg

SEQ ID NO: 2193784 - RNA, 22 nt, Human
aagaacugcaggcccuggccuc

SEQ ID NO: 2193785 - RNA, 15 nt, Human
aagaacugaaaucau

SEQ ID NO: 2193786 - RNA, 23 nt, Human
aagaacuauaugugaauccucuu

SEQ ID NO: 2193787 - RNA, 11 nt, Human
aagaacugaaa

SEQ ID NO: 2193788 - RNA, 12 nt, Human
aagaacugaaau

SEQ ID NO: 2193789 - RNA, 13 nt, Human
aagaacugaaauc

SEQ ID NO: 2193790 - RNA, 13 nt, Human
aacgcauggagug

SEQ ID NO: 2193791 - RNA, 18 nt, Human
aacgcauggaguguguau

SEQ ID NO: 2193792 - RNA, 22 nt, Human
aacgcauggaguguguauuguu

SEQ ID NO: 2193793 - RNA, 21 nt, Human
aacgcauggaguguguauugu

SEQ ID NO: 2193794 - RNA, 23 nt, Human
aacgcauggaguguguauuguuc

SEQ ID NO: 2193795 - RNA, 18 nt, Human
aacgccuccccugcccca

SEQ ID NO: 2193796 - RNA, 22 nt, Human
aacgccccagauaccagccccu

SEQ ID NO: 2193797 - RNA, 17 nt, Human
aacgccuccccugcccc

SEQ ID NO: 2193798 - RNA, 18 nt, Human
aagaacauggacuuguau

SEQ ID NO: 2193799 - RNA, 19 nt, Human
aagaacauggacuuguaua

SEQ ID NO: 2193800 - RNA, 21 nt, Human
aagaacauggacuuguauauu

SEQ ID NO: 2193801 - RNA, 22 nt, Human
aagaacauggacuuguauauuu

SEQ ID NO: 2193802 - RNA, 12 nt, Human
aacgcagcccug

SEQ ID NO: 2193803 - RNA, 16 nt, Human
aacgcagcccugcuuu

SEQ ID NO: 2193804 - RNA, 20 nt, Human
aacgcaggcccccaggugcc

SEQ ID NO: 2193805 - RNA, 14 nt, Human
aagaacuagcauaa

SEQ ID NO: 2193806 - RNA, 20 nt, Human
aagaacuacaaacaaaauuu

SEQ ID NO: 2193807 - RNA, 21 nt, Human
aagaacuacaaacaaaauuuc

SEQ ID NO: 2193808 - RNA, 18 nt, Human
aagaacggggcucuucuc

SEQ ID NO: 2193809 - RNA, 21 nt, Human
aagaacggggcucuucucauu

SEQ ID NO: 2193810 - RNA, 22 nt, Human
aagaacggggcucuucucauuu

SEQ ID NO: 2193811 - RNA, 23 nt, Human
aagaacggggcucuucucauuuc

SEQ ID NO: 2193812 - RNA, 14 nt, Human
aagaaccuggaacu

SEQ ID NO: 2193813 - RNA, 17 nt, Human
aagaacggggcucuucu

SEQ ID NO: 2193814 - RNA, 20 nt, Human
aagaaccaguccccccaccc

SEQ ID NO: 2193815 - RNA, 17 nt, Human
aagaaccagucccccca

SEQ ID NO: 2193816 - RNA, 11 nt, Human
aagaacaugug

SEQ ID NO: 2193817 - RNA, 22 nt, Human
aagaaccaaaaguuuuccugag

SEQ ID NO: 2193818 - RNA, 12 nt, Human
aagaccagacua

SEQ ID NO: 2193819 - RNA, 17 nt, Human
aagacuuuuccaacccu

SEQ ID NO: 2193820 - RNA, 22 nt, Human
aagagaaaaaaaguuugccaga

SEQ ID NO: 2193821 - RNA, 11 nt, Human
aagagaaaaga

SEQ ID NO: 2193822 - RNA, 13 nt, Human
aagagaaaagaaa

SEQ ID NO: 2193823 - RNA, 12 nt, Human
aagagaaaagaa

SEQ ID NO: 2193824 - RNA, 16 nt, Human
aagagaaaagaaaaaa

SEQ ID NO: 2193825 - RNA, 15 nt, Human
aagagaaaagaaaaa

SEQ ID NO: 2193826 - RNA, 14 nt, Human
aagagaaaagaaaa

SEQ ID NO: 2193827 - RNA, 14 nt, Human
aagagagaaaauaa

SEQ ID NO: 2193828 - RNA, 15 nt, Human
aagagagaaaauaaa

SEQ ID NO: 2193829 - RNA, 13 nt, Human
aagagagaaaaua

SEQ ID NO: 2193830 - RNA, 12 nt, Human
aagagagaaaau

SEQ ID NO: 2193831 - RNA, 16 nt, Human
aagagagaaaaacaaa

SEQ ID NO: 2193832 - RNA, 18 nt, Human
aagagagaaaacuuauuu

SEQ ID NO: 2193833 - RNA, 22 nt, Human
aagagacagucaccccaggacu

SEQ ID NO: 2193834 - RNA, 18 nt, Human
aagagaaagugauuucua

SEQ ID NO: 2193835 - RNA, 21 nt, Human
aagagaccuaccucagguugc

SEQ ID NO: 2193836 - RNA, 16 nt, Human
aagagaccuaccucag

SEQ ID NO: 2193837 - RNA, 17 nt, Human
aagagaccuaccucagg

SEQ ID NO: 2193838 - RNA, 18 nt, Human
aagagaccuaccucaggu

SEQ ID NO: 2193839 - RNA, 15 nt, Human
aagagacucuggccu

SEQ ID NO: 2193840 - RNA, 16 nt, Human
aagagacucuggccuc

SEQ ID NO: 2193841 - RNA, 14 nt, Human
aagagacuggagca

SEQ ID NO: 2193842 - RNA, 18 nt, Human
aagagacuggagcaucug

SEQ ID NO: 2193843 - RNA, 12 nt, Human
aagagagaaaaa

SEQ ID NO: 2193844 - RNA, 14 nt, Human
aagagagucauaaa

SEQ ID NO: 2193845 - RNA, 20 nt, Human
aagagagucauaaaccuuaa

SEQ ID NO: 2193846 - RNA, 22 nt, Human
aagagaggaguucaaugaucua

SEQ ID NO: 2193847 - RNA, 11 nt, Human
aagagagguua

SEQ ID NO: 2193848 - RNA, 12 nt, Human
aagagauauuuu

SEQ ID NO: 2193849 - RNA, 20 nt, Human
aagagauauuuuaaaaugag

SEQ ID NO: 2193850 - RNA, 21 nt, Human
aagagauauuuuaaaaugaga

SEQ ID NO: 2193851 - RNA, 18 nt, Human
aagagagaaaauaaaaag

SEQ ID NO: 2193852 - RNA, 11 nt, Human
aagagaggagu

SEQ ID NO: 2193853 - RNA, 17 nt, Human
aagagagaaaauaaaaa

SEQ ID NO: 2193854 - RNA, 16 nt, Human
aagagagaaaauaaaa

SEQ ID NO: 2193855 - RNA, 14 nt, Human
aagagaggaguuca

SEQ ID NO: 2193856 - RNA, 15 nt, Human
aagagaggaguucaa

SEQ ID NO: 2193857 - RNA, 16 nt, Human
aagagaggaguucaau

SEQ ID NO: 2193858 - RNA, 17 nt, Human
aagagaggaguucaaug

SEQ ID NO: 2193859 - RNA, 18 nt, Human
aagagaggaguucaauga

SEQ ID NO: 2193860 - RNA, 19 nt, Human
aagagaggaguucaaugau

SEQ ID NO: 2193861 - RNA, 20 nt, Human
aagagaggaguucaaugauc

SEQ ID NO: 2193862 - RNA, 21 nt, Human
aagagaggaguucaaugaucu

SEQ ID NO: 2193863 - RNA, 13 nt, Human
aagagaugaagag

SEQ ID NO: 2193864 - RNA, 15 nt, Human
aagacagagcuggga

SEQ ID NO: 2193865 - RNA, 16 nt, Human
aagacagagcugggau

SEQ ID NO: 2193866 - RNA, 12 nt, Human
aagacagagucu

SEQ ID NO: 2193867 - RNA, 23 nt, Human
aagacagauacuccuccaagguu

SEQ ID NO: 2193868 - RNA, 12 nt, Human
aagacagaagcc

SEQ ID NO: 2193869 - RNA, 13 nt, Human
aagacagaagccu

SEQ ID NO: 2193870 - RNA, 23 nt, Human
aagacaccagagcagaugcagag

SEQ ID NO: 2193871 - RNA, 22 nt, Human
aagacagaugccccagagcugu

SEQ ID NO: 2193872 - RNA, 20 nt, Human
aagacagaugccccagagcu

SEQ ID NO: 2193873 - RNA, 17 nt, Human
aagacagaugccccaga

SEQ ID NO: 2193874 - RNA, 16 nt, Human
aagacagaugccccag

SEQ ID NO: 2193875 - RNA, 14 nt, Human
aagacauaacguuu

SEQ ID NO: 2193876 - RNA, 18 nt, Human
aagacauaacguuuuucc

SEQ ID NO: 2193877 - RNA, 19 nt, Human
aagacauaacguuuuuccu

SEQ ID NO: 2193878 - RNA, 20 nt, Human
aagacauaacguuuuuccuu

SEQ ID NO: 2193879 - RNA, 21 nt, Human
aagacauaacguuuuuccuuu

SEQ ID NO: 2193880 - RNA, 22 nt, Human
aagacauaacguuuuuccuuua

SEQ ID NO: 2193881 - RNA, 23 nt, Human
aagacauacuccuuccaucaaau

SEQ ID NO: 2193882 - RNA, 17 nt, Human
aagacauccauaaagaa

SEQ ID NO: 2193883 - RNA, 21 nt, Human
aagacauccauaaagaagcaa

SEQ ID NO: 2193884 - RNA, 18 nt, Human
aagacaugaaugcacacu

SEQ ID NO: 2193885 - RNA, 13 nt, Human
aagacaugaacca

SEQ ID NO: 2193886 - RNA, 15 nt, Human
aagacaugaauauga

SEQ ID NO: 2193887 - RNA, 20 nt, Human
aagacaugauuuccuugaau

SEQ ID NO: 2193888 - RNA, 16 nt, Human
aagacaugauuuccuu

SEQ ID NO: 2193889 - RNA, 15 nt, Human
aagacaugauuuccu

SEQ ID NO: 2193890 - RNA, 14 nt, Human
aagacaugauuucc

SEQ ID NO: 2193891 - RNA, 13 nt, Human
aagagaaaaaaua

SEQ ID NO: 2193892 - RNA, 19 nt, Human
aagacuuuucuuucagcca

SEQ ID NO: 2193893 - RNA, 21 nt, Human
aagacuuuuccaacccucauc

SEQ ID NO: 2193894 - RNA, 12 nt, Human
aagacuuuucuu

SEQ ID NO: 2193895 - RNA, 17 nt, Human
aagacauugucaauaaa

SEQ ID NO: 2193896 - RNA, 17 nt, Human
aagaccacaaaaauuga

SEQ ID NO: 2193897 - RNA, 16 nt, Human
aagaccaccaccucag

SEQ ID NO: 2193898 - RNA, 19 nt, Human
aagaccaccaccucagagu

SEQ ID NO: 2193899 - RNA, 18 nt, Human
aagaccaccacuucgaaa

SEQ ID NO: 2193900 - RNA, 21 nt, Human
aagacaugauuuccuugaaug

SEQ ID NO: 2193901 - RNA, 19 nt, Human
aagacaugcacuaugagga

SEQ ID NO: 2193902 - RNA, 14 nt, Human
aagacauugucaau

SEQ ID NO: 2193903 - RNA, 18 nt, Human
aagacauuuauacucuuu

SEQ ID NO: 2193904 - RNA, 17 nt, Human
aagaccacguuucuaaa

SEQ ID NO: 2193905 - RNA, 15 nt, Human
aagaccacguuucua

SEQ ID NO: 2193906 - RNA, 13 nt, Human
aaggcaagagggg

SEQ ID NO: 2193907 - RNA, 19 nt, Human
aaggcaagaggggguggag

SEQ ID NO: 2193908 - RNA, 18 nt, Human
aaggcaagcacuuguggg

SEQ ID NO: 2193909 - RNA, 13 nt, Human
aaggcaaggcugu

SEQ ID NO: 2193910 - RNA, 18 nt, Human
aaggcaaauguguacaug

SEQ ID NO: 2193911 - RNA, 19 nt, Human
aaggagaaacagagacagg

SEQ ID NO: 2193912 - RNA, 15 nt, Human
aaggagaaggaagga

SEQ ID NO: 2193913 - RNA, 17 nt, Human
aaggacuugacuugcaa

SEQ ID NO: 2193914 - RNA, 14 nt, Human
aaggcaggugccuc

SEQ ID NO: 2193915 - RNA, 16 nt, Human
aaggcaggugccucca

SEQ ID NO: 2193916 - RNA, 17 nt, Human
aaggcaggugccuccag

SEQ ID NO: 2193917 - RNA, 20 nt, Human
aaggcaggugccuccaggug

SEQ ID NO: 2193918 - RNA, 22 nt, Human
aaggcagggagggccugggccc

SEQ ID NO: 2193919 - RNA, 19 nt, Human
aaggcagggagggccuggg

SEQ ID NO: 2193920 - RNA, 21 nt, Human
aaggcaagaggggguggaggg

SEQ ID NO: 2193921 - RNA, 15 nt, Human
aaggcaaggcuguca

SEQ ID NO: 2193922 - RNA, 20 nt, Human
aagcugcaaaucagccaugu

SEQ ID NO: 2193923 - RNA, 17 nt, Human
aagcuagaaccuggagg

SEQ ID NO: 2193924 - RNA, 17 nt, Human
aagcuagaaggccacau

SEQ ID NO: 2193925 - RNA, 19 nt, Human
aagcuagaaggccacaugu

SEQ ID NO: 2193926 - RNA, 10 nt, Human
aagcuagaau

SEQ ID NO: 2193927 - RNA, 22 nt, Human
aaggacuugaaagcauccaugu

SEQ ID NO: 2193928 - RNA, 19 nt, Human
aaggacuugaaagcaucca

SEQ ID NO: 2193929 - RNA, 17 nt, Human
aaggacuugaaagcauc

SEQ ID NO: 2193930 - RNA, 12 nt, Human
aaggacuugaaa

SEQ ID NO: 2193931 - RNA, 19 nt, Human
aagcugcacccucaggcag

SEQ ID NO: 2193932 - RNA, 13 nt, Human
aagcugcacccuc

SEQ ID NO: 2193933 - RNA, 19 nt, Human
aaggcauaucagucucuga

SEQ ID NO: 2193934 - RNA, 22 nt, Human
aaggcaggugccuccaggugug

SEQ ID NO: 2193935 - RNA, 13 nt, Human
aagcuagaaauga

SEQ ID NO: 2193936 - RNA, 23 nt, Human
aagcuacugugugugugaaugaa

SEQ ID NO: 2193937 - RNA, 17 nt, Human
aagcgugagacgccacc

SEQ ID NO: 2193938 - RNA, 16 nt, Human
aagcuagaaccuggag

SEQ ID NO: 2193939 - RNA, 19 nt, Human
aagcuacugugugugugaa

SEQ ID NO: 2193940 - RNA, 22 nt, Human
aagcuacugugugugugaauga

SEQ ID NO: 2193941 - RNA, 16 nt, Human
aagcgugagccacugc

SEQ ID NO: 2193942 - RNA, 23 nt, Human
aagcgugaaggccgagaagcaag

SEQ ID NO: 2193943 - RNA, 15 nt, Human
aagcgugagccacug

SEQ ID NO: 2193944 - RNA, 14 nt, Human
aagcggcuggcagc

SEQ ID NO: 2193945 - RNA, 21 nt, Human
aagcgaugaauuuggagacuc

SEQ ID NO: 2193946 - RNA, 20 nt, Human
aagcgaugaauuuggagacu

SEQ ID NO: 2193947 - RNA, 14 nt, Human
aagcgauucuccug

SEQ ID NO: 2193948 - RNA, 18 nt, Human
aagcgaggucaacagaga

SEQ ID NO: 2193949 - RNA, 18 nt, Human
aagcgaucacuuccuaua

SEQ ID NO: 2193950 - RNA, 16 nt, Human
aagccuuuuuccccaa

SEQ ID NO: 2193951 - RNA, 14 nt, Human
aagccuuuccauaa

SEQ ID NO: 2193952 - RNA, 15 nt, Human
aagccuuuccauaag

SEQ ID NO: 2193953 - RNA, 10 nt, Human
aagccuuugu

SEQ ID NO: 2193954 - RNA, 22 nt, Human
aagauaacaagaucuuucagga

SEQ ID NO: 2193955 - RNA, 15 nt, Human
aagauaacuugagca

SEQ ID NO: 2193956 - RNA, 21 nt, Human
aagauaaguguauuuuucaau

SEQ ID NO: 2193957 - RNA, 21 nt, Human
aagauaacaagaucuuucagg

SEQ ID NO: 2193958 - RNA, 20 nt, Human
aagauaacaagaucuuucag

SEQ ID NO: 2193959 - RNA, 19 nt, Human
aagauaacaagaucuuuca

SEQ ID NO: 2193960 - RNA, 14 nt, Human
aagauaaaugugcu

SEQ ID NO: 2193961 - RNA, 21 nt, Human
aagauaauauuaaggaagaca

SEQ ID NO: 2193962 - RNA, 19 nt, Human
aagauaauauuaaggaaga

SEQ ID NO: 2193963 - RNA, 15 nt, Human
aagauaauaauauau

SEQ ID NO: 2193964 - RNA, 12 nt, Human
aagauaauuaua

SEQ ID NO: 2193965 - RNA, 22 nt, Human
aagauacagaacucuuucaaaa

SEQ ID NO: 2193966 - RNA, 20 nt, Human
aagauacagaacucuuucaa

SEQ ID NO: 2193967 - RNA, 17 nt, Human
aagauacaguuacucag

SEQ ID NO: 2193968 - RNA, 23 nt, Human
aagccaggaauuucccaggaccc

SEQ ID NO: 2193969 - RNA, 16 nt, Human
aagauaauaauauaug

SEQ ID NO: 2193970 - RNA, 22 nt, Human
aagauacagccugcaaguggua

SEQ ID NO: 2193971 - RNA, 21 nt, Human
aagccaggcagguagccaggg

SEQ ID NO: 2193972 - RNA, 24 nt, Human
aagccaggaauuucccaggacccu

SEQ ID NO: 2193973 - RNA, 18 nt, Human
aagccaggagcaaauguu

SEQ ID NO: 2193974 - RNA, 21 nt, Human
aagccaggagcaaauguuucu

SEQ ID NO: 2193975 - RNA, 17 nt, Human
aagccagugacuccagg

SEQ ID NO: 2193976 - RNA, 18 nt, Human
aagccagugacuccagga

SEQ ID NO: 2193977 - RNA, 17 nt, Human
aagccagugcggcaggu

SEQ ID NO: 2193978 - RNA, 22 nt, Human
aagccagugacuccaggagagg

SEQ ID NO: 2193979 - RNA, 15 nt, Human
aaugauggacccaau

SEQ ID NO: 2193980 - RNA, 22 nt, Human
aaugauggacccaaugcacaca

SEQ ID NO: 2193981 - RNA, 17 nt, Human
aaugauggcaauuuugu

SEQ ID NO: 2193982 - RNA, 14 nt, Human
aaugauggcaauuu

SEQ ID NO: 2193983 - RNA, 20 nt, Human
aaugaugccaugaggaacaa

SEQ ID NO: 2193984 - RNA, 19 nt, Human
aaugauggcaauuuuguaa

SEQ ID NO: 2193985 - RNA, 18 nt, Human
aaugauggcaauuuugua

SEQ ID NO: 2193986 - RNA, 20 nt, Human
aaugauguauguugaagccu

SEQ ID NO: 2193987 - RNA, 21 nt, Human
aaugaauaauaauuauccaga

SEQ ID NO: 2193988 - RNA, 16 nt, Human
aaugaauaauuuccca

SEQ ID NO: 2193989 - RNA, 15 nt, Human
aaugaauaauaauua

SEQ ID NO: 2193990 - RNA, 19 nt, Human
aaugaaguuugaauguuaa

SEQ ID NO: 2193991 - RNA, 20 nt, Human
aaugaaguuugaauguuaaa

SEQ ID NO: 2193992 - RNA, 21 nt, Human
aaugaaguuugaauguuaaau

SEQ ID NO: 2193993 - RNA, 22 nt, Human
aaugaaguuugaauguuaaaua

SEQ ID NO: 2193994 - RNA, 20 nt, Human
aaugaauacuuuauaaagga

SEQ ID NO: 2193995 - RNA, 20 nt, Human
aaugaaagacuguacaaagu

SEQ ID NO: 2193996 - RNA, 18 nt, Human
aaugaaagacuguacaaa

SEQ ID NO: 2193997 - RNA, 21 nt, Human
aaugaaagacuguacaaagua

SEQ ID NO: 2193998 - RNA, 19 nt, Human
aaugaaagaguaaaggaaa

SEQ ID NO: 2193999 - RNA, 15 nt, Human
aaugaagcagcuuua

SEQ ID NO: 2194000 - RNA, 17 nt, Human
aaugaagcagcuuuaaa

SEQ ID NO: 2194001 - RNA, 15 nt, Human
aaugaaagcaugugg

SEQ ID NO: 2194002 - RNA, 17 nt, Human
aaugaaagcaugucuca

SEQ ID NO: 2194003 - RNA, 14 nt, Human
aaugaagcaaugcu

SEQ ID NO: 2194004 - RNA, 17 nt, Human
aaugaaguuugaauguu

SEQ ID NO: 2194005 - RNA, 18 nt, Human
aaugaaguuugaauguua

SEQ ID NO: 2194006 - RNA, 17 nt, Human
aaugaagcuuguguauc

SEQ ID NO: 2194007 - RNA, 19 nt, Human
aaugaagcuuguguaucca

SEQ ID NO: 2194008 - RNA, 22 nt, Human
aaugaagcuuguguauccauua

SEQ ID NO: 2194009 - RNA, 19 nt, Human
aaugaagcuuuauacgugu

SEQ ID NO: 2194010 - RNA, 15 nt, Human
aaugaagccuuagcc

SEQ ID NO: 2194011 - RNA, 19 nt, Human
aaugaagcagcuuuaaaca

SEQ ID NO: 2194012 - RNA, 22 nt, Human
aaugaagcagcuuuaaacaaau

SEQ ID NO: 2194013 - RNA, 12 nt, Human
aaugaagcuugu

SEQ ID NO: 2194014 - RNA, 14 nt, Human
aaugaagcuugugu

SEQ ID NO: 2194015 - RNA, 15 nt, Human
aaugaagcuugugua

SEQ ID NO: 2194016 - RNA, 16 nt, Human
aaugaagcuuguguau

SEQ ID NO: 2194017 - RNA, 17 nt, Human
aaucugauggcuucucc

SEQ ID NO: 2194018 - RNA, 18 nt, Human
aaucugauuggacauuuu

SEQ ID NO: 2194019 - RNA, 19 nt, Human
aaucugauuggacauuuuc

SEQ ID NO: 2194020 - RNA, 17 nt, Human
aaucugaggccuccucu

SEQ ID NO: 2194021 - RNA, 12 nt, Human
aaucugacccag

SEQ ID NO: 2194022 - RNA, 17 nt, Human
aaucugacccagugccc

SEQ ID NO: 2194023 - RNA, 15 nt, Human
aaucugacccagugc

SEQ ID NO: 2194024 - RNA, 14 nt, Human
aaucugacccagug

SEQ ID NO: 2194025 - RNA, 13 nt, Human
aaucugacccagu

SEQ ID NO: 2194026 - RNA, 13 nt, Human
aaucucaccccau

SEQ ID NO: 2194027 - RNA, 17 nt, Human
aaucucaauucuucccu

SEQ ID NO: 2194028 - RNA, 16 nt, Human
aaucucaauauuucag

SEQ ID NO: 2194029 - RNA, 22 nt, Human
aaucucagcaaugauuacucuu

SEQ ID NO: 2194030 - RNA, 23 nt, Human
aaucucagagguagggcugccac

SEQ ID NO: 2194031 - RNA, 22 nt, Human
aaucucagagguagggcugcca

SEQ ID NO: 2194032 - RNA, 22 nt, Human
aaucucaccccaucccacaccc

SEQ ID NO: 2194033 - RNA, 13 nt, Human
aauauuaagaaag

SEQ ID NO: 2194034 - RNA, 21 nt, Human
aauauuaaaucugcuggaguu

SEQ ID NO: 2194035 - RNA, 13 nt, Human
aauauuaaaucug

SEQ ID NO: 2194036 - RNA, 20 nt, Human
aauauuaaauacagacacua

SEQ ID NO: 2194037 - RNA, 22 nt, Human
aauauuaaauacagacacuaag

SEQ ID NO: 2194038 - RNA, 22 nt, Human
aauauguugaugaaaaauagca

SEQ ID NO: 2194039 - RNA, 13 nt, Human
aauauuaaauaca

SEQ ID NO: 2194040 - RNA, 14 nt, Human
aauauuaaauacag

SEQ ID NO: 2194041 - RNA, 16 nt, Human
aauauuaaauacagac

SEQ ID NO: 2194042 - RNA, 17 nt, Human
aauauuaaauacagaca

SEQ ID NO: 2194043 - RNA, 19 nt, Human
aauauuaaauacagacacu

SEQ ID NO: 2194044 - RNA, 20 nt, Human
aauauguucuuuaaaaauau

SEQ ID NO: 2194045 - RNA, 22 nt, Human
aauauguuaaccucagugucau

SEQ ID NO: 2194046 - RNA, 16 nt, Human
aauauguuagcaaaga

SEQ ID NO: 2194047 - RNA, 21 nt, Human
aauauguuaaccucaguguca

SEQ ID NO: 2194048 - RNA, 12 nt, Human
aauauguccugg

SEQ ID NO: 2194049 - RNA, 22 nt, Human
aauauauauauauauaaaauaa

SEQ ID NO: 2194050 - RNA, 16 nt, Human
aauauauauaaauaaa

SEQ ID NO: 2194051 - RNA, 18 nt, Human
aauauauauauauauaaa

SEQ ID NO: 2194052 - RNA, 19 nt, Human
aauauauauauauauaaaa

SEQ ID NO: 2194053 - RNA, 21 nt, Human
aauauauauauauauaaaaua

SEQ ID NO: 2194054 - RNA, 14 nt, Human
aauauauauauccu

SEQ ID NO: 2194055 - RNA, 13 nt, Human
aauauguccuggg

SEQ ID NO: 2194056 - RNA, 23 nt, Human
aauauguggaguucaucuugaau

SEQ ID NO: 2194057 - RNA, 14 nt, Human
aauauauaaauaua

SEQ ID NO: 2194058 - RNA, 12 nt, Human
aauauauauaaa

SEQ ID NO: 2194059 - RNA, 13 nt, Human
aauauauauaaac

SEQ ID NO: 2194060 - RNA, 14 nt, Human
aauauauauaaacc

SEQ ID NO: 2194061 - RNA, 15 nt, Human
aauauauauaaaccu

SEQ ID NO: 2194062 - RNA, 13 nt, Human
aauauauauaaau

SEQ ID NO: 2194063 - RNA, 15 nt, Human
aauauauauaaauaa

SEQ ID NO: 2194064 - RNA, 19 nt, Human
aauauauauaaauauauau

SEQ ID NO: 2194065 - RNA, 11 nt, Human
aauauauaaau

SEQ ID NO: 2194066 - RNA, 13 nt, Human
aauauauaaauau

SEQ ID NO: 2194067 - RNA, 17 nt, Human
aauauauaaauauauau

SEQ ID NO: 2194068 - RNA, 13 nt, Human
aaucaauaaacga

SEQ ID NO: 2194069 - RNA, 23 nt, Human
aaucaaguuggcuucuaaucaaa

SEQ ID NO: 2194070 - RNA, 18 nt, Human
aaucaaagcaaugcauuu

SEQ ID NO: 2194071 - RNA, 22 nt, Human
aaucaaagcaaugcauuuugga

SEQ ID NO: 2194072 - RNA, 16 nt, Human
aaucaauaaacgauuu

SEQ ID NO: 2194073 - RNA, 12 nt, Human
aaucaauaauau

SEQ ID NO: 2194074 - RNA, 14 nt, Human
aaucaauacacuag

SEQ ID NO: 2194075 - RNA, 18 nt, Human
aaucaauacacuaguugu

SEQ ID NO: 2194076 - RNA, 20 nt, Human
aaucaauacacuaguuguuu

SEQ ID NO: 2194077 - RNA, 19 nt, Human
aaucaauacacuaguuguu

SEQ ID NO: 2194078 - RNA, 13 nt, Human
aaucaaaauaugu

SEQ ID NO: 2194079 - RNA, 20 nt, Human
aaucaaaauaacgccccaga

SEQ ID NO: 2194080 - RNA, 16 nt, Human
aaucaaagacauggaa

SEQ ID NO: 2194081 - RNA, 16 nt, Human
aaucaaagcaaugcau

SEQ ID NO: 2194082 - RNA, 18 nt, Human
aaucaaaacucuccuaca

SEQ ID NO: 2194083 - RNA, 10 nt, Human
aaucaaaacu

SEQ ID NO: 2194084 - RNA, 17 nt, Human
aauauuuuuuuguagau

SEQ ID NO: 2194085 - RNA, 21 nt, Human
aauauuuuuuuguagaugaaa

SEQ ID NO: 2194086 - RNA, 15 nt, Human
aauauuaaugccuuu

SEQ ID NO: 2194087 - RNA, 22 nt, Human
aauauuaaugccuuuaaaguau

SEQ ID NO: 2194088 - RNA, 17 nt, Human
aaucaaugucacuuaaa

SEQ ID NO: 2194089 - RNA, 22 nt, Human
aaucaaugcuauaacuauguug

SEQ ID NO: 2194090 - RNA, 21 nt, Human
aaucaccgaaaacguggcugc

SEQ ID NO: 2194091 - RNA, 16 nt, Human
aaucacgcuuuccuga

SEQ ID NO: 2194092 - RNA, 23 nt, Human
aaucaccgaaaacguggcugcuu

SEQ ID NO: 2194093 - RNA, 22 nt, Human
aagugcuggcaaccacuaagaa

SEQ ID NO: 2194094 - RNA, 21 nt, Human
aagugcuggcaccaccaggca

SEQ ID NO: 2194095 - RNA, 23 nt, Human
aagugcuggcaaccacuaagaau

SEQ ID NO: 2194096 - RNA, 22 nt, Human
aagugcugcauuuaaaagauac

SEQ ID NO: 2194097 - RNA, 13 nt, Human
aaguggccucuuu

SEQ ID NO: 2194098 - RNA, 22 nt, Human
aaguggccucuuugucuaaaac

SEQ ID NO: 2194099 - RNA, 17 nt, Human
aaguggccucuuugucu

SEQ ID NO: 2194100 - RNA, 14 nt, Human
aaguggccucuuug

SEQ ID NO: 2194101 - RNA, 17 nt, Human
aaguugaagcuaagauu

SEQ ID NO: 2194102 - RNA, 12 nt, Human
aaguggcugcug

SEQ ID NO: 2194103 - RNA, 17 nt, Human
aaguugaaauuaaccau

SEQ ID NO: 2194104 - RNA, 20 nt, Human
aaguugaaagaguccuauuu

SEQ ID NO: 2194105 - RNA, 14 nt, Human
aaguggcugcugac

SEQ ID NO: 2194106 - RNA, 21 nt, Human
aaguugaauggccugccuuga

SEQ ID NO: 2194107 - RNA, 18 nt, Human
aaguugaagcuaagauuu

SEQ ID NO: 2194108 - RNA, 23 nt, Human
aaguugaauugaggggauuaaua

SEQ ID NO: 2194109 - RNA, 20 nt, Human
aaguggaccuugagaccaca

SEQ ID NO: 2194110 - RNA, 23 nt, Human
aaguggacucuuugguggcuuug

SEQ ID NO: 2194111 - RNA, 18 nt, Human
aaguggacuggccccugg

SEQ ID NO: 2194112 - RNA, 16 nt, Human
aaguggaggcacuuua

SEQ ID NO: 2194113 - RNA, 20 nt, Human
aaguggacuggccccugggu

SEQ ID NO: 2194114 - RNA, 20 nt, Human
aaguggaccaggacaggacc

SEQ ID NO: 2194115 - RNA, 22 nt, Human
aaguggaccuuaggccuuccuc

SEQ ID NO: 2194116 - RNA, 17 nt, Human
aaguggacucagggcag

SEQ ID NO: 2194117 - RNA, 12 nt, Human
aagugcugggau

SEQ ID NO: 2194118 - RNA, 23 nt, Human
aaguugguccuuuacacucaggc

SEQ ID NO: 2194119 - RNA, 17 nt, Human
aaguuuaaagcucgaaa

SEQ ID NO: 2194120 - RNA, 13 nt, Human
aaguuguuugcau

SEQ ID NO: 2194121 - RNA, 15 nt, Human
aaguuuaaggaauau

SEQ ID NO: 2194122 - RNA, 14 nt, Human
aaguuuaaggaaua

SEQ ID NO: 2194123 - RNA, 15 nt, Human
aaguuguuugagaaa

SEQ ID NO: 2194124 - RNA, 21 nt, Human
aaguuguuugagaaauuaagu

SEQ ID NO: 2194125 - RNA, 22 nt, Human
aaguuguuugagaaauuaagua

SEQ ID NO: 2194126 - RNA, 17 nt, Human
aaguuguuugucaucuu

SEQ ID NO: 2194127 - RNA, 10 nt, Human
aauaaacacu

SEQ ID NO: 2194128 - RNA, 23 nt, Human
aaguuuaaggaauaugggagaaa

SEQ ID NO: 2194129 - RNA, 11 nt, Human
aauaaacacuc

SEQ ID NO: 2194130 - RNA, 16 nt, Human
aauaaacacucuugaa

SEQ ID NO: 2194131 - RNA, 23 nt, Human
aauaaacauccuucaagaacucu

SEQ ID NO: 2194132 - RNA, 13 nt, Human
aauaaacauccuu

SEQ ID NO: 2194133 - RNA, 12 nt, Human
aauaaacaggag

SEQ ID NO: 2194134 - RNA, 12 nt, Human
aauaaacacugu

SEQ ID NO: 2194135 - RNA, 13 nt, Human
aauaaacacugug

SEQ ID NO: 2194136 - RNA, 19 nt, Human
aauaaacacucuugaaaaa

SEQ ID NO: 2194137 - RNA, 13 nt, Human
aauaaacuuuaau

SEQ ID NO: 2194138 - RNA, 22 nt, Human
aauaaacuuagaauaaaauugu

SEQ ID NO: 2194139 - RNA, 17 nt, Human
aauaaacuuuuuuuuga

SEQ ID NO: 2194140 - RNA, 20 nt, Human
aauaaacuuuuuuuugagaa

SEQ ID NO: 2194141 - RNA, 12 nt, Human
aauaaacuuuuu

SEQ ID NO: 2194142 - RNA, 15 nt, Human
aauaaugugaaucau

SEQ ID NO: 2194143 - RNA, 19 nt, Human
aauaauguuaacauggaca

SEQ ID NO: 2194144 - RNA, 11 nt, Human
aauaaagcccu

SEQ ID NO: 2194145 - RNA, 23 nt, Human
aauaaagcaauuuuccuugaagc

SEQ ID NO: 2194146 - RNA, 24 nt, Human
aauaaagcaauuuuccuugaagcc

SEQ ID NO: 2194147 - RNA, 16 nt, Human
aauaaagcaauuuucc

SEQ ID NO: 2194148 - RNA, 17 nt, Human
aauaaagcaauuuuccu

SEQ ID NO: 2194149 - RNA, 18 nt, Human
aauaaagcaauuuuccuu

SEQ ID NO: 2194150 - RNA, 22 nt, Human
aauaaagcaauuuuccuugaag

SEQ ID NO: 2194151 - RNA, 14 nt, Human
aauaaagcagcguu

SEQ ID NO: 2194152 - RNA, 22 nt, Human
aauaaugugaaacuggauuaaa

SEQ ID NO: 2194153 - RNA, 17 nt, Human
aauaaugugaaacugga

SEQ ID NO: 2194154 - RNA, 11 nt, Human
aauaaagacag

SEQ ID NO: 2194155 - RNA, 12 nt, Human
aauaaagacagg

SEQ ID NO: 2194156 - RNA, 13 nt, Human
aauaaagaaauug

SEQ ID NO: 2194157 - RNA, 20 nt, Human
aauaaagaucauguaaaagu

SEQ ID NO: 2194158 - RNA, 12 nt, Human
aauaaagcaauu

SEQ ID NO: 2194159 - RNA, 13 nt, Human
aauaaagcaauuu

SEQ ID NO: 2194160 - RNA, 15 nt, Human
aauaaagcaauuuuc

SEQ ID NO: 2194161 - RNA, 19 nt, Human
aauaaagaucauguaaaag

SEQ ID NO: 2194162 - RNA, 14 nt, Human
aauaaagaucaugu

SEQ ID NO: 2194163 - RNA, 15 nt, Human
aauaaagaguuagaa

SEQ ID NO: 2194164 - RNA, 18 nt, Human
aauaaagaguuagaauga

SEQ ID NO: 2194165 - RNA, 19 nt, Human
acacgcaggaacucccagc

SEQ ID NO: 2194166 - RNA, 15 nt, Human
acacgcacgcacaca

SEQ ID NO: 2194167 - RNA, 16 nt, Human
acacgcacgcacacac

SEQ ID NO: 2194168 - RNA, 17 nt, Human
acacgcacgcacacaca

SEQ ID NO: 2194169 - RNA, 18 nt, Human
acacgcacgcacacacac

SEQ ID NO: 2194170 - RNA, 19 nt, Human
acacgccuuguucuuggcc

SEQ ID NO: 2194171 - RNA, 16 nt, Human
acaccagcauuccuuu

SEQ ID NO: 2194172 - RNA, 14 nt, Human
acaccagcauuccu

SEQ ID NO: 2194173 - RNA, 19 nt, Human
acaccagcauuccuuuuga

SEQ ID NO: 2194174 - RNA, 12 nt, Human
acaccagccagg

SEQ ID NO: 2194175 - RNA, 13 nt, Human
acacgcaccugcc

SEQ ID NO: 2194176 - RNA, 17 nt, Human
acacgcaccugccucag

SEQ ID NO: 2194177 - RNA, 13 nt, Human
acacgcacgcaca

SEQ ID NO: 2194178 - RNA, 14 nt, Human
acacgcacgcacac

SEQ ID NO: 2194179 - RNA, 16 nt, Human
acacgcaccugccuca

SEQ ID NO: 2194180 - RNA, 14 nt, Human
acacgcaccugccu

SEQ ID NO: 2194181 - RNA, 17 nt, Human
acacguggaggaaugcu

SEQ ID NO: 2194182 - RNA, 23 nt, Human
acacgugcaauuuguuugugcuu

SEQ ID NO: 2194183 - RNA, 16 nt, Human
acacgugagaaucccu

SEQ ID NO: 2194184 - RNA, 21 nt, Human
acacgugagaaucccuggcaa

SEQ ID NO: 2194185 - RNA, 19 nt, Human
acacgucugacccucucca

SEQ ID NO: 2194186 - RNA, 17 nt, Human
acacgucugacccucuc

SEQ ID NO: 2194187 - RNA, 13 nt, Human
acacgugagaauc

SEQ ID NO: 2194188 - RNA, 14 nt, Human
acacguccacccca

SEQ ID NO: 2194189 - RNA, 23 nt, Human
acacguacuuaaaugaaagcaug

SEQ ID NO: 2194190 - RNA, 20 nt, Human
acacgcacgcacacacacaa

SEQ ID NO: 2194191 - RNA, 22 nt, Human
acacgccugcaaacgcugccug

SEQ ID NO: 2194192 - RNA, 24 nt, Human
acacguggaggaaugcucccccau

SEQ ID NO: 2194193 - RNA, 22 nt, Human
acacguggaggaaugcuccccc

SEQ ID NO: 2194194 - RNA, 21 nt, Human
acacguggaggaaugcucccc

SEQ ID NO: 2194195 - RNA, 20 nt, Human
acacguggaggaaugcuccc

SEQ ID NO: 2194196 - RNA, 12 nt, Human
acacguguccug

SEQ ID NO: 2194197 - RNA, 14 nt, Human
acaccagccaggcu

SEQ ID NO: 2194198 - RNA, 18 nt, Human
acacagcucuucuccagg

SEQ ID NO: 2194199 - RNA, 16 nt, Human
acaccaagcacagcag

SEQ ID NO: 2194200 - RNA, 14 nt, Human
acaccaagcacagc

SEQ ID NO: 2194201 - RNA, 21 nt, Human
acaccaagcacagcagccugg

SEQ ID NO: 2194202 - RNA, 20 nt, Human
acaccaagcacagcagccug

SEQ ID NO: 2194203 - RNA, 19 nt, Human
acaccaagcacagcagccu

SEQ ID NO: 2194204 - RNA, 18 nt, Human
acaccaagcacagcagcc

SEQ ID NO: 2194205 - RNA, 13 nt, Human
acaccaagcagca

SEQ ID NO: 2194206 - RNA, 16 nt, Human
acaccaagcagcaaca

SEQ ID NO: 2194207 - RNA, 16 nt, Human
acaccaagcugugcca

SEQ ID NO: 2194208 - RNA, 17 nt, Human
acaccaagcugugccac

SEQ ID NO: 2194209 - RNA, 18 nt, Human
acaccaagcugugccacc

SEQ ID NO: 2194210 - RNA, 20 nt, Human
acaccaagcugugccacccu

SEQ ID NO: 2194211 - RNA, 21 nt, Human
acaccaagcugugccacccug

SEQ ID NO: 2194212 - RNA, 22 nt, Human
acaccaagcugugccacccugg

SEQ ID NO: 2194213 - RNA, 18 nt, Human
acaccagagcccaccuug

SEQ ID NO: 2194214 - RNA, 23 nt, Human
acaccagagcccaccuuggcuca

SEQ ID NO: 2194215 - RNA, 13 nt, Human
acaccagagccca

SEQ ID NO: 2194216 - RNA, 15 nt, Human
acaccaauauucaua

SEQ ID NO: 2194217 - RNA, 14 nt, Human
acacacuuuuuaag

SEQ ID NO: 2194218 - RNA, 19 nt, Human
acacacuuuuuaagaaaua

SEQ ID NO: 2194219 - RNA, 12 nt, Human
acacagaaaaua

SEQ ID NO: 2194220 - RNA, 11 nt, Human
acacagaaaau

SEQ ID NO: 2194221 - RNA, 20 nt, Human
acacagaaaauauacuguaa

SEQ ID NO: 2194222 - RNA, 19 nt, Human
acacagaaaauauacugua

SEQ ID NO: 2194223 - RNA, 18 nt, Human
acacagaaaauauacugu

SEQ ID NO: 2194224 - RNA, 17 nt, Human
acacagaaaauauacug

SEQ ID NO: 2194225 - RNA, 16 nt, Human
acacagaaaauauacu

SEQ ID NO: 2194226 - RNA, 15 nt, Human
acacagaaaauauac

SEQ ID NO: 2194227 - RNA, 14 nt, Human
acacagaaaauaua

SEQ ID NO: 2194228 - RNA, 13 nt, Human
acacagaaaauau

SEQ ID NO: 2194229 - RNA, 15 nt, Human
acacagcauguguau

SEQ ID NO: 2194230 - RNA, 14 nt, Human
acacagcaugugua

SEQ ID NO: 2194231 - RNA, 22 nt, Human
acacagcagcuucaccagagca

SEQ ID NO: 2194232 - RNA, 20 nt, Human
acacagaaaauguugagaau

SEQ ID NO: 2194233 - RNA, 19 nt, Human
acacagaaaauguugagaa

SEQ ID NO: 2194234 - RNA, 18 nt, Human
acacagaaaauguugaga

SEQ ID NO: 2194235 - RNA, 23 nt, Human
acacagaaaauauacuguaaaga

SEQ ID NO: 2194236 - RNA, 22 nt, Human
acacagaaaauauacuguaaag

SEQ ID NO: 2194237 - RNA, 21 nt, Human
acacagaaaauauacuguaaa

SEQ ID NO: 2194238 - RNA, 12 nt, Human
acacagccacac

SEQ ID NO: 2194239 - RNA, 11 nt, Human
acacagccaca

SEQ ID NO: 2194240 - RNA, 18 nt, Human
acacagccacacacacag

SEQ ID NO: 2194241 - RNA, 15 nt, Human
acacagccacacaca

SEQ ID NO: 2194242 - RNA, 14 nt, Human
acacagccacacac

SEQ ID NO: 2194243 - RNA, 13 nt, Human
acacagccacaca

SEQ ID NO: 2194244 - RNA, 14 nt, Human
acacagcucuucuc

SEQ ID NO: 2194245 - RNA, 16 nt, Human
acacagcucuucucca

SEQ ID NO: 2194246 - RNA, 23 nt, Human
acacagccgauucaccugagcag

SEQ ID NO: 2194247 - RNA, 20 nt, Human
acacagccaggugccuugga

SEQ ID NO: 2194248 - RNA, 19 nt, Human
acacagccgauucaccuga

SEQ ID NO: 2194249 - RNA, 23 nt, Human
acacagccacacacacagaaaau

SEQ ID NO: 2194250 - RNA, 22 nt, Human
acacagccacacacacagaaaa

SEQ ID NO: 2194251 - RNA, 21 nt, Human
acacagccacacacacagaaa

SEQ ID NO: 2194252 - RNA, 20 nt, Human
acacagccacacacacagaa

SEQ ID NO: 2194253 - RNA, 19 nt, Human
acacagccacacacacaga

SEQ ID NO: 2194254 - RNA, 13 nt, Human
acaagugguggua

SEQ ID NO: 2194255 - RNA, 19 nt, Human
acaaguggacucagggcag

SEQ ID NO: 2194256 - RNA, 18 nt, Human
acaaguggacucagggca

SEQ ID NO: 2194257 - RNA, 15 nt, Human
acaaguggacucagg

SEQ ID NO: 2194258 - RNA, 12 nt, Human
acaagugcuggc

SEQ ID NO: 2194259 - RNA, 13 nt, Human
acaagugcuggca

SEQ ID NO: 2194260 - RNA, 14 nt, Human
acaagugcugaaca

SEQ ID NO: 2194261 - RNA, 15 nt, Human
acaaguuaaauaaau

SEQ ID NO: 2194262 - RNA, 18 nt, Human
acaaguguauaucagaaa

SEQ ID NO: 2194263 - RNA, 19 nt, Human
acaaguguauaucagaaaa

SEQ ID NO: 2194264 - RNA, 20 nt, Human
acaaguguauaucagaaaag

SEQ ID NO: 2194265 - RNA, 18 nt, Human
acaagggucuagggagag

SEQ ID NO: 2194266 - RNA, 17 nt, Human
acaagggucuagggaga

SEQ ID NO: 2194267 - RNA, 19 nt, Human
acaagggagagaccucauc

SEQ ID NO: 2194268 - RNA, 22 nt, Human
acaacuuaaguugguccuuuac

SEQ ID NO: 2194269 - RNA, 16 nt, Human
acaagguaguuuuuac

SEQ ID NO: 2194270 - RNA, 20 nt, Human
acaagggucuagggagagac

SEQ ID NO: 2194271 - RNA, 19 nt, Human
acaagggucuagggagaga

SEQ ID NO: 2194272 - RNA, 21 nt, Human
acaagguaccccuuucuggcu

SEQ ID NO: 2194273 - RNA, 14 nt, Human
acaagguaguuuuu

SEQ ID NO: 2194274 - RNA, 17 nt, Human
acaagguccaagauacc

SEQ ID NO: 2194275 - RNA, 22 nt, Human
acaagguagcccuggccagagg

SEQ ID NO: 2194276 - RNA, 18 nt, Human
acaaggguggcaucccag

SEQ ID NO: 2194277 - RNA, 23 nt, Human
acaagguccucugucagucacag

SEQ ID NO: 2194278 - RNA, 13 nt, Human
acaagguucuucc

SEQ ID NO: 2194279 - RNA, 22 nt, Human
acaagguucuucccuuuuacau

SEQ ID NO: 2194280 - RNA, 19 nt, Human
acaagguucccucugagaa

SEQ ID NO: 2194281 - RNA, 20 nt, Human
acaagguucccucugagaau

SEQ ID NO: 2194282 - RNA, 15 nt, Human
acaacuuaaauaaua

SEQ ID NO: 2194283 - RNA, 13 nt, Human
acaacuuaaguug

SEQ ID NO: 2194284 - RNA, 14 nt, Human
acaacuuaaauaau

SEQ ID NO: 2194285 - RNA, 22 nt, Human
acaacugccucgaaacacagaa

SEQ ID NO: 2194286 - RNA, 19 nt, Human
acaacuggaauaguuuuuu

SEQ ID NO: 2194287 - RNA, 20 nt, Human
acaacuggaauaguuuuuuu

SEQ ID NO: 2194288 - RNA, 20 nt, Human
acaacuccuagggccacuga

SEQ ID NO: 2194289 - RNA, 21 nt, Human
acaacugccucgaaacacaga

SEQ ID NO: 2194290 - RNA, 19 nt, Human
acaacugaguccuuaaaca

SEQ ID NO: 2194291 - RNA, 12 nt, Human
acaacugagucc

SEQ ID NO: 2194292 - RNA, 13 nt, Human
acaacugaguccu

SEQ ID NO: 2194293 - RNA, 14 nt, Human
acaacugaguccuu

SEQ ID NO: 2194294 - RNA, 16 nt, Human
acaaggcaaggcuguc

SEQ ID NO: 2194295 - RNA, 17 nt, Human
acaaggcaaggcuguca

SEQ ID NO: 2194296 - RNA, 19 nt, Human
acaaggcaaggcugucaau

SEQ ID NO: 2194297 - RNA, 18 nt, Human
acaagggagagaccucau

SEQ ID NO: 2194298 - RNA, 15 nt, Human
acaaacucucugaac

SEQ ID NO: 2194299 - RNA, 14 nt, Human
acaaacaugacccu

SEQ ID NO: 2194300 - RNA, 16 nt, Human
acaaacuacauguaau

SEQ ID NO: 2194301 - RNA, 22 nt, Human
acaaacuauuucuuauauaugu

SEQ ID NO: 2194302 - RNA, 22 nt, Human
acaaacucucugaaccccuccc

SEQ ID NO: 2194303 - RNA, 20 nt, Human
acaaacucaccaucugugca

SEQ ID NO: 2194304 - RNA, 13 nt, Human
acaaacuguaaau

SEQ ID NO: 2194305 - RNA, 18 nt, Human
acaaccaagcucucugca

SEQ ID NO: 2194306 - RNA, 20 nt, Human
acaaccaccgcuccccagcc

SEQ ID NO: 2194307 - RNA, 21 nt, Human
acaaccaccuaaucaggcuga

SEQ ID NO: 2194308 - RNA, 19 nt, Human
acaaccaccgcuccccagc

SEQ ID NO: 2194309 - RNA, 15 nt, Human
acaaccaccgcuccc

SEQ ID NO: 2194310 - RNA, 17 nt, Human
acaaccacucauucaaa

SEQ ID NO: 2194311 - RNA, 15 nt, Human
acaaccacuggucug

SEQ ID NO: 2194312 - RNA, 14 nt, Human
acaaccauuccaga

SEQ ID NO: 2194313 - RNA, 14 nt, Human
acaacauguauaau

SEQ ID NO: 2194314 - RNA, 22 nt, Human
acaacauguauaauauuuuuaa

SEQ ID NO: 2194315 - RNA, 16 nt, Human
acaacauuaaaacaau

SEQ ID NO: 2194316 - RNA, 22 nt, Human
acaaacauauuuguuaaauauu

SEQ ID NO: 2194317 - RNA, 14 nt, Human
acaaacaucacucu

SEQ ID NO: 2194318 - RNA, 19 nt, Human
acaaacauauuuguuaaau

SEQ ID NO: 2194319 - RNA, 13 nt, Human
acaaacagcucag

SEQ ID NO: 2194320 - RNA, 19 nt, Human
acaaacaugugguuaaugc

SEQ ID NO: 2194321 - RNA, 20 nt, Human
acaaacaauggaaacugaau

SEQ ID NO: 2194322 - RNA, 15 nt, Human
acaaacaccucccag

SEQ ID NO: 2194323 - RNA, 18 nt, Human
acaaacaauggaaacuga

SEQ ID NO: 2194324 - RNA, 16 nt, Human
aauuaucuauacauau

SEQ ID NO: 2194325 - RNA, 14 nt, Human
aauuaucuauacau

SEQ ID NO: 2194326 - RNA, 23 nt, Human
aauuaucgggaacaguguuuccc

SEQ ID NO: 2194327 - RNA, 20 nt, Human
aauuaucgggaacaguguuu

SEQ ID NO: 2194328 - RNA, 19 nt, Human
aauuaucgggaacaguguu

SEQ ID NO: 2194329 - RNA, 17 nt, Human
aauuaucgggaacagug

SEQ ID NO: 2194330 - RNA, 21 nt, Human
aauuaucggaagcagugccuu

SEQ ID NO: 2194331 - RNA, 20 nt, Human
aauuaucggaagcagugccu

SEQ ID NO: 2194332 - RNA, 17 nt, Human
aauuaucggaagcagug

SEQ ID NO: 2194333 - RNA, 15 nt, Human
aauuaucggaagcag

SEQ ID NO: 2194334 - RNA, 15 nt, Human
aauuauccagaguuu

SEQ ID NO: 2194335 - RNA, 19 nt, Human
aauuaugaguuauuuuuau

SEQ ID NO: 2194336 - RNA, 21 nt, Human
aauuccuuggcaugccuucca

SEQ ID NO: 2194337 - RNA, 23 nt, Human
aauuccuucagggugaugccagg

SEQ ID NO: 2194338 - RNA, 17 nt, Human
aauuccuguagcaucuu

SEQ ID NO: 2194339 - RNA, 16 nt, Human
aauuccuucaggguga

SEQ ID NO: 2194340 - RNA, 23 nt, Human
aauuccuuagcuuagaccucagc

SEQ ID NO: 2194341 - RNA, 13 nt, Human
aauuccuuagcuu

SEQ ID NO: 2194342 - RNA, 19 nt, Human
aauuccuuuucuaacucuc

SEQ ID NO: 2194343 - RNA, 15 nt, Human
aauucgaaccaggaa

SEQ ID NO: 2194344 - RNA, 14 nt, Human
aauucgaccugauu

SEQ ID NO: 2194345 - RNA, 18 nt, Human
aauucgcugcaaccuguu

SEQ ID NO: 2194346 - RNA, 15 nt, Human
aauucggugugcacc

SEQ ID NO: 2194347 - RNA, 11 nt, Human
aauuccugggc

SEQ ID NO: 2194348 - RNA, 19 nt, Human
aauuccucuuugcuuugcu

SEQ ID NO: 2194349 - RNA, 18 nt, Human
aauuccucuuugcuuugc

SEQ ID NO: 2194350 - RNA, 17 nt, Human
aauuccucuuugcuuug

SEQ ID NO: 2194351 - RNA, 21 nt, Human
aauuauguauguuuacauauc

SEQ ID NO: 2194352 - RNA, 21 nt, Human
aauuccuguagcaucuucugg

SEQ ID NO: 2194353 - RNA, 15 nt, Human
aauuaugacaguuau

SEQ ID NO: 2194354 - RNA, 12 nt, Human
aauuaugacagu

SEQ ID NO: 2194355 - RNA, 22 nt, Human
aauuaucuauacauaucuuuau

SEQ ID NO: 2194356 - RNA, 17 nt, Human
aauuaugccuuuuuuga

SEQ ID NO: 2194357 - RNA, 13 nt, Human
aauuaugacaguu

SEQ ID NO: 2194358 - RNA, 19 nt, Human
aauuaugccuuuuuugauc

SEQ ID NO: 2194359 - RNA, 15 nt, Human
aauuauguauguuua

SEQ ID NO: 2194360 - RNA, 16 nt, Human
aauuauguauguuuac

SEQ ID NO: 2194361 - RNA, 18 nt, Human
aauuauguauguuuacau

SEQ ID NO: 2194362 - RNA, 22 nt, Human
aauuauaucaguccucuuucaa

SEQ ID NO: 2194363 - RNA, 20 nt, Human
aauuauauagguugugcaaa

SEQ ID NO: 2194364 - RNA, 21 nt, Human
aauuauauagguugugcaaau

SEQ ID NO: 2194365 - RNA, 22 nt, Human
aauuauagugauguaaucuuga

SEQ ID NO: 2194366 - RNA, 20 nt, Human
aauuauacuggagaagucuu

SEQ ID NO: 2194367 - RNA, 19 nt, Human
aauuauacccccugcaaag

SEQ ID NO: 2194368 - RNA, 15 nt, Human
aauuauagaugggaa

SEQ ID NO: 2194369 - RNA, 19 nt, Human
aauuauagaugggaaugaa

SEQ ID NO: 2194370 - RNA, 14 nt, Human
aauucuaacuuuuu

SEQ ID NO: 2194371 - RNA, 19 nt, Human
aauucuaaaugaauguuua

SEQ ID NO: 2194372 - RNA, 13 nt, Human
aauucuaaaugaa

SEQ ID NO: 2194373 - RNA, 23 nt, Human
aauucgaaccaggaaauggaacc

SEQ ID NO: 2194374 - RNA, 14 nt, Human
aauucuacuuugag

SEQ ID NO: 2194375 - RNA, 15 nt, Human
aauucuacauuguca

SEQ ID NO: 2194376 - RNA, 22 nt, Human
aauucuagcuuugagcuuaaga

SEQ ID NO: 2194377 - RNA, 23 nt, Human
aauucuaggcaucccaggggacc

SEQ ID NO: 2194378 - RNA, 12 nt, Human
aauucuagugcu

SEQ ID NO: 2194379 - RNA, 16 nt, Human
aauucuagugcugcug

SEQ ID NO: 2194380 - RNA, 17 nt, Human
aauucuagugcugcuga

SEQ ID NO: 2194381 - RNA, 16 nt, Human
aauucuauaaggccau

SEQ ID NO: 2194382 - RNA, 18 nt, Human
aauucuagugcugcugaa

SEQ ID NO: 2194383 - RNA, 21 nt, Human
aauucuagugcugcugaagau

SEQ ID NO: 2194384 - RNA, 22 nt, Human
aauucuauaaggccauaaaaca

SEQ ID NO: 2194385 - RNA, 19 nt, Human
aauucucagaaucucaaau

SEQ ID NO: 2194386 - RNA, 14 nt, Human
aauucuauuugcug

SEQ ID NO: 2194387 - RNA, 17 nt, Human
aauucucaaccuaccac

SEQ ID NO: 2194388 - RNA, 22 nt, Human
aauucucaaccuaccaccccuu

SEQ ID NO: 2194389 - RNA, 13 nt, Human
aauucucauguga

SEQ ID NO: 2194390 - RNA, 16 nt, Human
aauucucaugugaucc

SEQ ID NO: 2194391 - RNA, 19 nt, Human
aauucucaugugauccuuu

SEQ ID NO: 2194392 - RNA, 20 nt, Human
aauucucaugugauccuuuu

SEQ ID NO: 2194393 - RNA, 21 nt, Human
aauucucaugugauccuuuua

SEQ ID NO: 2194394 - RNA, 15 nt, Human
aauucucuuauccaa

SEQ ID NO: 2194395 - RNA, 14 nt, Human
aauucucuuucaaa

SEQ ID NO: 2194396 - RNA, 17 nt, Human
aauucucuaguuugauu

SEQ ID NO: 2194397 - RNA, 15 nt, Human
aauucucuaguuuga

SEQ ID NO: 2194398 - RNA, 21 nt, Human
aauucucauuugucacacacu

SEQ ID NO: 2194399 - RNA, 14 nt, Human
aauucuccugccuc

SEQ ID NO: 2194400 - RNA, 15 nt, Human
aauucuccuggaggu

SEQ ID NO: 2194401 - RNA, 12 nt, Human
aauucuccugga

SEQ ID NO: 2194402 - RNA, 13 nt, Human
aauucuccuggag

SEQ ID NO: 2194403 - RNA, 16 nt, Human
aauucuccugccucag

SEQ ID NO: 2194404 - RNA, 15 nt, Human
aauucuccugccuca

SEQ ID NO: 2194405 - RNA, 14 nt, Human
aauucuuaaaauau

SEQ ID NO: 2194406 - RNA, 16 nt, Human
aauuggaggaaagcaa

SEQ ID NO: 2194407 - RNA, 18 nt, Human
aauucuguuuuucuaggc

SEQ ID NO: 2194408 - RNA, 14 nt, Human
aauucuguuuuucu

SEQ ID NO: 2194409 - RNA, 22 nt, Human
aauuguaaggaaugauuaauua

SEQ ID NO: 2194410 - RNA, 21 nt, Human
aauugggagcuugggaaugga

SEQ ID NO: 2194411 - RNA, 18 nt, Human
aauuggcauguguauguu

SEQ ID NO: 2194412 - RNA, 14 nt, Human
aauuggcagcagau

SEQ ID NO: 2194413 - RNA, 22 nt, Human
aauuggcagcagauuuuaggaa

SEQ ID NO: 2194414 - RNA, 11 nt, Human
aauuggcagca

SEQ ID NO: 2194415 - RNA, 16 nt, Human
aauucugcuaccucac

SEQ ID NO: 2194416 - RNA, 15 nt, Human
aauucugcuaccuca

SEQ ID NO: 2194417 - RNA, 19 nt, Human
aauucugcuaccucacugg

SEQ ID NO: 2194418 - RNA, 12 nt, Human
aauucuguaaau

SEQ ID NO: 2194419 - RNA, 12 nt, Human
aauucuguacau

SEQ ID NO: 2194420 - RNA, 17 nt, Human
aauucuguacauagccu

SEQ ID NO: 2194421 - RNA, 19 nt, Human
aauucuguacauagccuau

SEQ ID NO: 2194422 - RNA, 19 nt, Human
aauucugcaauguuuuccu

SEQ ID NO: 2194423 - RNA, 20 nt, Human
aauucugcaauguuuuccuu

SEQ ID NO: 2194424 - RNA, 21 nt, Human
aauucugagaaaacuucuuuu

SEQ ID NO: 2194425 - RNA, 10 nt, Human
aauucugaau

SEQ ID NO: 2194426 - RNA, 13 nt, Human
aauucuguuucuu

SEQ ID NO: 2194427 - RNA, 12 nt, Human
aauucuguuucu

SEQ ID NO: 2194428 - RNA, 16 nt, Human
aauucuguuucuugag

SEQ ID NO: 2194429 - RNA, 12 nt, Human
aauucuguuuua

SEQ ID NO: 2194430 - RNA, 21 nt, Human
aauucuguuuuagguuaaaaa

SEQ ID NO: 2194431 - RNA, 20 nt, Human
aauucuguacauagccuaua

SEQ ID NO: 2194432 - RNA, 21 nt, Human
aauucuguacauagccuauau

SEQ ID NO: 2194433 - RNA, 22 nt, Human
aauucuguacugauuuuuguaa

SEQ ID NO: 2194434 - RNA, 19 nt, Human
aauucugucacucaccacu

SEQ ID NO: 2194435 - RNA, 11 nt, Human
aauuuccagag

SEQ ID NO: 2194436 - RNA, 21 nt, Human
aauuuccacaaaaucugucca

SEQ ID NO: 2194437 - RNA, 16 nt, Human
aauuucauaugcugua

SEQ ID NO: 2194438 - RNA, 18 nt, Human
aauuucauaugcuguaua

SEQ ID NO: 2194439 - RNA, 15 nt, Human
aauuucccaaagcag

SEQ ID NO: 2194440 - RNA, 17 nt, Human
aauuucccaaagcagug

SEQ ID NO: 2194441 - RNA, 19 nt, Human
aauuucccaauuaggaagu

SEQ ID NO: 2194442 - RNA, 24 nt, Human
aauuuccagugagcuuaucaugcu

SEQ ID NO: 2194443 - RNA, 20 nt, Human
aauuuccaguaccuuuguca

SEQ ID NO: 2194444 - RNA, 17 nt, Human
aauuuccaguaccuuug

SEQ ID NO: 2194445 - RNA, 15 nt, Human
aauuuccaguaccuu

SEQ ID NO: 2194446 - RNA, 15 nt, Human
aauuuccagagaaga

SEQ ID NO: 2194447 - RNA, 15 nt, Human
aauuucccaggaccc

SEQ ID NO: 2194448 - RNA, 14 nt, Human
aauuucccaggacc

SEQ ID NO: 2194449 - RNA, 12 nt, Human
aauuucccagga

SEQ ID NO: 2194450 - RNA, 22 nt, Human
aauuucccacaccguguaaacc

SEQ ID NO: 2194451 - RNA, 22 nt, Human
aauuucccaggacccugaaggg

SEQ ID NO: 2194452 - RNA, 21 nt, Human
aauuucccaggacccugaagg

SEQ ID NO: 2194453 - RNA, 17 nt, Human
aauuucccaggacccug

SEQ ID NO: 2194454 - RNA, 16 nt, Human
aauuucccaggacccu

SEQ ID NO: 2194455 - RNA, 14 nt, Human
aauuuccccaacag

SEQ ID NO: 2194456 - RNA, 15 nt, Human
aauuuccccaacagu

SEQ ID NO: 2194457 - RNA, 17 nt, Human
aauuuccccaacagugu

SEQ ID NO: 2194458 - RNA, 18 nt, Human
aauuuccccaacagugug

SEQ ID NO: 2194459 - RNA, 19 nt, Human
aauuuccccaacaguguga

SEQ ID NO: 2194460 - RNA, 20 nt, Human
aauuuccccaacagugugaa

SEQ ID NO: 2194461 - RNA, 21 nt, Human
aauuuccccaacagugugaag

SEQ ID NO: 2194462 - RNA, 22 nt, Human
aauuuccccaacagugugaagu

SEQ ID NO: 2194463 - RNA, 18 nt, Human
aauuguaggggugugugu

SEQ ID NO: 2194464 - RNA, 13 nt, Human
aauuguauaacag

SEQ ID NO: 2194465 - RNA, 14 nt, Human
aauuguauaacagg

SEQ ID NO: 2194466 - RNA, 15 nt, Human
aauuguacauauuug

SEQ ID NO: 2194467 - RNA, 21 nt, Human
aauuguacauauuuguggaau

SEQ ID NO: 2194468 - RNA, 14 nt, Human
aauuguacauauuu

SEQ ID NO: 2194469 - RNA, 16 nt, Human
aauuguauagagauau

SEQ ID NO: 2194470 - RNA, 22 nt, Human
aauuucauaccuaucaucuuaa

SEQ ID NO: 2194471 - RNA, 15 nt, Human
aauuguauaacaggu

SEQ ID NO: 2194472 - RNA, 16 nt, Human
aauuguauaacagguu

SEQ ID NO: 2194473 - RNA, 17 nt, Human
aauuguauaacagguua

SEQ ID NO: 2194474 - RNA, 18 nt, Human
aauuguauaacagguuau

SEQ ID NO: 2194475 - RNA, 19 nt, Human
aauuguauaacagguuauu

SEQ ID NO: 2194476 - RNA, 13 nt, Human
aauuguauagaga

SEQ ID NO: 2194477 - RNA, 15 nt, Human
aauuguauagagaua

SEQ ID NO: 2194478 - RNA, 11 nt, Human
aauuguaauag

SEQ ID NO: 2194479 - RNA, 13 nt, Human
aauuuccucuauu

SEQ ID NO: 2194480 - RNA, 17 nt, Human
acaugcacucagcucuu

SEQ ID NO: 2194481 - RNA, 16 nt, Human
acaugcacuaugagga

SEQ ID NO: 2194482 - RNA, 17 nt, Human
acaugcacuaugaggaa

SEQ ID NO: 2194483 - RNA, 18 nt, Human
acaugcacucagcucuug

SEQ ID NO: 2194484 - RNA, 22 nt, Human
acaugcacuuggcugcauaaau

SEQ ID NO: 2194485 - RNA, 18 nt, Human
acaugcacuuggcugcau

SEQ ID NO: 2194486 - RNA, 13 nt, Human
acaugcacgugug

SEQ ID NO: 2194487 - RNA, 18 nt, Human
acauccccccgccaaaag

SEQ ID NO: 2194488 - RNA, 14 nt, Human
acauccccacccuu

SEQ ID NO: 2194489 - RNA, 18 nt, Human
acaucccauugcccuggu

SEQ ID NO: 2194490 - RNA, 17 nt, Human
acaucccauugcccugg

SEQ ID NO: 2194491 - RNA, 16 nt, Human
acaucccauugcccug

SEQ ID NO: 2194492 - RNA, 20 nt, Human
acaucccauguaacagaaag

SEQ ID NO: 2194493 - RNA, 13 nt, Human
acauccaagcuuc

SEQ ID NO: 2194494 - RNA, 18 nt, Human
acaucccauguaacagaa

SEQ ID NO: 2194495 - RNA, 19 nt, Human
acauccaaagcagacagcu

SEQ ID NO: 2194496 - RNA, 17 nt, Human
acaucccugccagcucu

SEQ ID NO: 2194497 - RNA, 16 nt, Human
acaucccugccagcuc

SEQ ID NO: 2194498 - RNA, 23 nt, Human
acaucccuacaaaaaauuagaaa

SEQ ID NO: 2194499 - RNA, 18 nt, Human
acaucccgggacgcagca

SEQ ID NO: 2194500 - RNA, 15 nt, Human
acaucccugccagcu

SEQ ID NO: 2194501 - RNA, 13 nt, Human
acaugugguuuau

SEQ ID NO: 2194502 - RNA, 16 nt, Human
acaugugguuuauaga

SEQ ID NO: 2194503 - RNA, 23 nt, Human
acauguggugggacagggaccca

SEQ ID NO: 2194504 - RNA, 15 nt, Human
acauguggugggaca

SEQ ID NO: 2194505 - RNA, 16 nt, Human
acaugugugcgugugc

SEQ ID NO: 2194506 - RNA, 19 nt, Human
acauguggaaagugaauuu

SEQ ID NO: 2194507 - RNA, 20 nt, Human
acaugugccgaaugugcagg

SEQ ID NO: 2194508 - RNA, 18 nt, Human
acauguggaaagugaauu

SEQ ID NO: 2194509 - RNA, 16 nt, Human
acauguggggccaggu

SEQ ID NO: 2194510 - RNA, 18 nt, Human
acauguggggccagguca

SEQ ID NO: 2194511 - RNA, 22 nt, Human
acaugugccagggcaaugauga

SEQ ID NO: 2194512 - RNA, 17 nt, Human
acaugugccgaaugugc

SEQ ID NO: 2194513 - RNA, 19 nt, Human
acaugugccgaaugugcag

SEQ ID NO: 2194514 - RNA, 17 nt, Human
acaugcgguagccagca

SEQ ID NO: 2194515 - RNA, 23 nt, Human
acaugcggagaacaaaugugaag

SEQ ID NO: 2194516 - RNA, 14 nt, Human
acaugcgggcuggg

SEQ ID NO: 2194517 - RNA, 16 nt, Human
acaugcgggcugggca

SEQ ID NO: 2194518 - RNA, 22 nt, Human
acaugccugccccaaacaaaua

SEQ ID NO: 2194519 - RNA, 17 nt, Human
acaugcggagaacaaau

SEQ ID NO: 2194520 - RNA, 17 nt, Human
acaugcgggcugggcag

SEQ ID NO: 2194521 - RNA, 19 nt, Human
acaugcgggcugggcagcu

SEQ ID NO: 2194522 - RNA, 21 nt, Human
acaugcgggcugggcagcugu

SEQ ID NO: 2194523 - RNA, 22 nt, Human
acaugcgggcugggcagcuguu

SEQ ID NO: 2194524 - RNA, 15 nt, Human
acaugccugccccaa

SEQ ID NO: 2194525 - RNA, 21 nt, Human
acaugccugccccaaacaaau

SEQ ID NO: 2194526 - RNA, 20 nt, Human
acaugccucucucaggccaa

SEQ ID NO: 2194527 - RNA, 17 nt, Human
acaugcagcccaugccc

SEQ ID NO: 2194528 - RNA, 15 nt, Human
acaugcagcccaugc

SEQ ID NO: 2194529 - RNA, 18 nt, Human
acaugcagcccaugccca

SEQ ID NO: 2194530 - RNA, 14 nt, Human
acauaacguuuuuc

SEQ ID NO: 2194531 - RNA, 15 nt, Human
acauaacguuuuucc

SEQ ID NO: 2194532 - RNA, 16 nt, Human
acauaacguuuuuccu

SEQ ID NO: 2194533 - RNA, 18 nt, Human
acauaacguuuuuccuuu

SEQ ID NO: 2194534 - RNA, 20 nt, Human
acauaacguuuuuccuuuaa

SEQ ID NO: 2194535 - RNA, 21 nt, Human
acauaacguuuuuccuuuaaa

SEQ ID NO: 2194536 - RNA, 20 nt, Human
acauaaguaauucaagaaaa

SEQ ID NO: 2194537 - RNA, 20 nt, Human
acauaacugaaaaugugcua

SEQ ID NO: 2194538 - RNA, 12 nt, Human
acauaacugaaa

SEQ ID NO: 2194539 - RNA, 23 nt, Human
acauaacguuuuuccuuuaaaaa

SEQ ID NO: 2194540 - RNA, 20 nt, Human
acauaaguauuuaauucaug

SEQ ID NO: 2194541 - RNA, 21 nt, Human
acauaaguaauucaagaaaac

SEQ ID NO: 2194542 - RNA, 19 nt, Human
acauaaguuuaggauaaaa

SEQ ID NO: 2194543 - RNA, 20 nt, Human
acauacaggaagguagaaau

SEQ ID NO: 2194544 - RNA, 15 nt, Human
acauacaccagcauu

SEQ ID NO: 2194545 - RNA, 14 nt, Human
acauacaccagcau

SEQ ID NO: 2194546 - RNA, 13 nt, Human
acauacaccagca

SEQ ID NO: 2194547 - RNA, 16 nt, Human
acauacacacauaugu

SEQ ID NO: 2194548 - RNA, 16 nt, Human
acauacaauuccaaac

SEQ ID NO: 2194549 - RNA, 22 nt, Human
acauaacguuuuuccuuuaaaa

SEQ ID NO: 2194550 - RNA, 14 nt, Human
acauaagaccauaa

SEQ ID NO: 2194551 - RNA, 23 nt, Human
acauaaucuucugccuucucaug

SEQ ID NO: 2194552 - RNA, 21 nt, Human
acauacaccuaugucauuuca

SEQ ID NO: 2194553 - RNA, 21 nt, Human
acauccaaaauaguuaagaca

SEQ ID NO: 2194554 - RNA, 18 nt, Human
acauccaaagcagacagc

SEQ ID NO: 2194555 - RNA, 17 nt, Human
acauccaaagcagacag

SEQ ID NO: 2194556 - RNA, 16 nt, Human
acauccaaagcagaca

SEQ ID NO: 2194557 - RNA, 15 nt, Human
acauccaaagcagac

SEQ ID NO: 2194558 - RNA, 19 nt, Human
acauguuuuucuucucccu

SEQ ID NO: 2194559 - RNA, 13 nt, Human
acauguuuugaua

SEQ ID NO: 2194560 - RNA, 15 nt, Human
acauguuuugauaaa

SEQ ID NO: 2194561 - RNA, 17 nt, Human
acauguuuugauaaagu

SEQ ID NO: 2194562 - RNA, 18 nt, Human
acauguuuugauaaagua

SEQ ID NO: 2194563 - RNA, 20 nt, Human
acauguuuugauaaaguagu

SEQ ID NO: 2194564 - RNA, 21 nt, Human
acauguuuugauaaaguagua

SEQ ID NO: 2194565 - RNA, 23 nt, Human
acauguuuuagacaaauacucau

SEQ ID NO: 2194566 - RNA, 21 nt, Human
acauguuuuagacaaauacuc

SEQ ID NO: 2194567 - RNA, 22 nt, Human
acauguuuuagacaaauacuca

SEQ ID NO: 2194568 - RNA, 12 nt, Human
acauguguuuua

SEQ ID NO: 2194569 - RNA, 21 nt, Human
acauguguuuuaauuccaaua

SEQ ID NO: 2194570 - RNA, 20 nt, Human
acauguuuuagacaaauacu

SEQ ID NO: 2194571 - RNA, 17 nt, Human
acauguuuuagacaaau

SEQ ID NO: 2194572 - RNA, 17 nt, Human
acauguguuggcagccu

SEQ ID NO: 2194573 - RNA, 20 nt, Human
acauguguagccugugcaug

SEQ ID NO: 2194574 - RNA, 20 nt, Human
acauguguuaaguauuuuca

SEQ ID NO: 2194575 - RNA, 17 nt, Human
acauguguagccugugc

SEQ ID NO: 2194576 - RNA, 18 nt, Human
acauguguagccugugca

SEQ ID NO: 2194577 - RNA, 23 nt, Human
acauguuuugauaaaguaguaaa

SEQ ID NO: 2194578 - RNA, 22 nt, Human
acauguuuugauaaaguaguaa

SEQ ID NO: 2194579 - RNA, 18 nt, Human
accacgucugucuucaca

SEQ ID NO: 2194580 - RNA, 23 nt, Human
accacgugcuacccccaugcugg

SEQ ID NO: 2194581 - RNA, 12 nt, Human
accagagcugcc

SEQ ID NO: 2194582 - RNA, 13 nt, Human
accagagcugcca

SEQ ID NO: 2194583 - RNA, 14 nt, Human
accagagcugccac

SEQ ID NO: 2194584 - RNA, 16 nt, Human
accagagcugccaccu

SEQ ID NO: 2194585 - RNA, 19 nt, Human
accaccccagcugcucccc

SEQ ID NO: 2194586 - RNA, 23 nt, Human
accacccacucuccucugccuca

SEQ ID NO: 2194587 - RNA, 19 nt, Human
accaacccuguuuccugag

SEQ ID NO: 2194588 - RNA, 17 nt, Human
accaccagaagcccaga

SEQ ID NO: 2194589 - RNA, 16 nt, Human
accaccagaagcccag

SEQ ID NO: 2194590 - RNA, 15 nt, Human
accaccagaagccca

SEQ ID NO: 2194591 - RNA, 18 nt, Human
accaagccuggucagccc

SEQ ID NO: 2194592 - RNA, 13 nt, Human
accaaccugacca

SEQ ID NO: 2194593 - RNA, 14 nt, Human
accaagccguggcu

SEQ ID NO: 2194594 - RNA, 21 nt, Human
accaacgucugugccauuuug

SEQ ID NO: 2194595 - RNA, 15 nt, Human
accaagccguggcuu

SEQ ID NO: 2194596 - RNA, 16 nt, Human
accaagccguggcuuc

SEQ ID NO: 2194597 - RNA, 17 nt, Human
accaagccguggcuucc

SEQ ID NO: 2194598 - RNA, 18 nt, Human
accaagccguggcuuccc

SEQ ID NO: 2194599 - RNA, 18 nt, Human
accacggaaaagagcgca

SEQ ID NO: 2194600 - RNA, 14 nt, Human
accacggaaaagag

SEQ ID NO: 2194601 - RNA, 15 nt, Human
accaccccccacucu

SEQ ID NO: 2194602 - RNA, 20 nt, Human
accacggacguuuccaucag

SEQ ID NO: 2194603 - RNA, 21 nt, Human
accacggacguuuccaucagg

SEQ ID NO: 2194604 - RNA, 14 nt, Human
accacggccacugg

SEQ ID NO: 2194605 - RNA, 17 nt, Human
accacgucugucuucac

SEQ ID NO: 2194606 - RNA, 18 nt, Human
accacggccacuggccau

SEQ ID NO: 2194607 - RNA, 22 nt, Human
accacggccacuggccaucucc

SEQ ID NO: 2194608 - RNA, 14 nt, Human
accacguccagcug

SEQ ID NO: 2194609 - RNA, 14 nt, Human
accacguuucuaaa

SEQ ID NO: 2194610 - RNA, 13 nt, Human
accacguuucuaa

SEQ ID NO: 2194611 - RNA, 22 nt, Human
accaccccagcugcuccccucc

SEQ ID NO: 2194612 - RNA, 20 nt, Human
accaccccagcugcuccccu

SEQ ID NO: 2194613 - RNA, 14 nt, Human
accaccccccacuc

SEQ ID NO: 2194614 - RNA, 16 nt, Human
accacgcuggggucug

SEQ ID NO: 2194615 - RNA, 18 nt, Human
accaccccgccugcccuc

SEQ ID NO: 2194616 - RNA, 18 nt, Human
accacgcuggaccuugaa

SEQ ID NO: 2194617 - RNA, 14 nt, Human
accacgcuggaccu

SEQ ID NO: 2194618 - RNA, 16 nt, Human
accacgcuggaccuug

SEQ ID NO: 2194619 - RNA, 23 nt, Human
acauuucuuagacuacauuuaga

SEQ ID NO: 2194620 - RNA, 13 nt, Human
acauuugccuugc

SEQ ID NO: 2194621 - RNA, 19 nt, Human
acauuucuuugugcuuugg

SEQ ID NO: 2194622 - RNA, 14 nt, Human
accaacgucugugc

SEQ ID NO: 2194623 - RNA, 17 nt, Human
accaacgucugugccau

SEQ ID NO: 2194624 - RNA, 14 nt, Human
accaacccuguuuc

SEQ ID NO: 2194625 - RNA, 16 nt, Human
accaacccuguuuccu

SEQ ID NO: 2194626 - RNA, 17 nt, Human
accaacccuguuuccug

SEQ ID NO: 2194627 - RNA, 14 nt, Human
acauuugccuugcu

SEQ ID NO: 2194628 - RNA, 15 nt, Human
acauuugccuugcug

SEQ ID NO: 2194629 - RNA, 21 nt, Human
acauuuguauaaaauaauuuu

SEQ ID NO: 2194630 - RNA, 15 nt, Human
acauuugcucaugga

SEQ ID NO: 2194631 - RNA, 16 nt, Human
acauuugcucauggaa

SEQ ID NO: 2194632 - RNA, 16 nt, Human
acauuuguauaaaaua

SEQ ID NO: 2194633 - RNA, 19 nt, Human
acauuuguauaaaauaauu

SEQ ID NO: 2194634 - RNA, 21 nt, Human
acaguggcucacgccuguaau

SEQ ID NO: 2194635 - RNA, 12 nt, Human
acagugggaaau

SEQ ID NO: 2194636 - RNA, 14 nt, Human
acagugggaaauau

SEQ ID NO: 2194637 - RNA, 13 nt, Human
acagugggagcca

SEQ ID NO: 2194638 - RNA, 15 nt, Human
acagugggaaauauu

SEQ ID NO: 2194639 - RNA, 14 nt, Human
acagugggagccag

SEQ ID NO: 2194640 - RNA, 15 nt, Human
acagugggagccagg

SEQ ID NO: 2194641 - RNA, 16 nt, Human
acagugggagccaggg

SEQ ID NO: 2194642 - RNA, 17 nt, Human
acagugggagccagggc

SEQ ID NO: 2194643 - RNA, 14 nt, Human
acagugaucuccau

SEQ ID NO: 2194644 - RNA, 21 nt, Human
acaggcaccgagaauguugua

SEQ ID NO: 2194645 - RNA, 20 nt, Human
acaggcaccgagaauguugu

SEQ ID NO: 2194646 - RNA, 17 nt, Human
acaggcaccgagaaugu

SEQ ID NO: 2194647 - RNA, 14 nt, Human
acaggcaccgagaa

SEQ ID NO: 2194648 - RNA, 23 nt, Human
acaggcacccaccaucaugucug

SEQ ID NO: 2194649 - RNA, 13 nt, Human
acagugcaucuca

SEQ ID NO: 2194650 - RNA, 19 nt, Human
acagugauuaccagggacu

SEQ ID NO: 2194651 - RNA, 21 nt, Human
acagugaucuccauauguuac

SEQ ID NO: 2194652 - RNA, 19 nt, Human
acagugaucuccauauguu

SEQ ID NO: 2194653 - RNA, 18 nt, Human
acagugaucuccauaugu

SEQ ID NO: 2194654 - RNA, 15 nt, Human
acagugaucuccaua

SEQ ID NO: 2194655 - RNA, 15 nt, Human
acagugcaucucagc

SEQ ID NO: 2194656 - RNA, 17 nt, Human
acagugcaucucagccc

SEQ ID NO: 2194657 - RNA, 18 nt, Human
acagugcaucucagccca

SEQ ID NO: 2194658 - RNA, 18 nt, Human
acaguggaauauaaggaa

SEQ ID NO: 2194659 - RNA, 17 nt, Human
acaguggauugcauuuc

SEQ ID NO: 2194660 - RNA, 22 nt, Human
acagugcuucagccugaggcug

SEQ ID NO: 2194661 - RNA, 20 nt, Human
acagugcuugccacagagcg

SEQ ID NO: 2194662 - RNA, 21 nt, Human
acagugcuugccacagagcgg

SEQ ID NO: 2194663 - RNA, 21 nt, Human
acagugcuucagccugaggcu

SEQ ID NO: 2194664 - RNA, 20 nt, Human
acagugcuucagccugaggc

SEQ ID NO: 2194665 - RNA, 18 nt, Human
acagugcuucagccugag

SEQ ID NO: 2194666 - RNA, 17 nt, Human
acagugcuucagccuga

SEQ ID NO: 2194667 - RNA, 15 nt, Human
acagugcuucagccu

SEQ ID NO: 2194668 - RNA, 14 nt, Human
acagugcuucagcc

SEQ ID NO: 2194669 - RNA, 21 nt, Human
acagugccugggaauguauua

SEQ ID NO: 2194670 - RNA, 17 nt, Human
acagugccuucaauaaa

SEQ ID NO: 2194671 - RNA, 20 nt, Human
acagugccugggaauguauu

SEQ ID NO: 2194672 - RNA, 18 nt, Human
acagugccugggaaugua

SEQ ID NO: 2194673 - RNA, 20 nt, Human
acagugccuucaauaaaugg

SEQ ID NO: 2194674 - RNA, 21 nt, Human
acagugccuucaauaaauggu

SEQ ID NO: 2194675 - RNA, 14 nt, Human
acagugcuaaaaau

SEQ ID NO: 2194676 - RNA, 16 nt, Human
acagugcuaaaaaugg

SEQ ID NO: 2194677 - RNA, 14 nt, Human
acagugccugggaa

SEQ ID NO: 2194678 - RNA, 14 nt, Human
acagugccugcuga

SEQ ID NO: 2194679 - RNA, 13 nt, Human
acagugccugcug

SEQ ID NO: 2194680 - RNA, 22 nt, Human
acagugaucuccauauguuaca

SEQ ID NO: 2194681 - RNA, 11 nt, Human
acagugccugc

SEQ ID NO: 2194682 - RNA, 24 nt, Human
acagugaugcugugcuaugaauuu

SEQ ID NO: 2194683 - RNA, 14 nt, Human
acagugcugucuga

SEQ ID NO: 2194684 - RNA, 22 nt, Human
acagugcugucugaucugugcu

SEQ ID NO: 2194685 - RNA, 23 nt, Human
acagugcugucugaucugugcuu

SEQ ID NO: 2194686 - RNA, 15 nt, Human
acaggauuagacagu

SEQ ID NO: 2194687 - RNA, 23 nt, Human
acagcugagcacauucuggcuca

SEQ ID NO: 2194688 - RNA, 22 nt, Human
acagcugagagacuuuuaauca

SEQ ID NO: 2194689 - RNA, 18 nt, Human
acagcugagcacauucug

SEQ ID NO: 2194690 - RNA, 24 nt, Human
acaggaugguucccuugaugaaga

SEQ ID NO: 2194691 - RNA, 22 nt, Human
acaggaugguucccuugaugaa

SEQ ID NO: 2194692 - RNA, 15 nt, Human
acaggcaaugcuggc

SEQ ID NO: 2194693 - RNA, 16 nt, Human
acaggcaaugcuggcu

SEQ ID NO: 2194694 - RNA, 14 nt, Human
acaggcacccacca

SEQ ID NO: 2194695 - RNA, 17 nt, Human
acaggcaaugcuggcug

SEQ ID NO: 2194696 - RNA, 19 nt, Human
acagcucuucuccaggcug

SEQ ID NO: 2194697 - RNA, 20 nt, Human
acagcucuucuccaggcugu

SEQ ID NO: 2194698 - RNA, 16 nt, Human
acagcugaauuaucua

SEQ ID NO: 2194699 - RNA, 15 nt, Human
acagcugagagacuu

SEQ ID NO: 2194700 - RNA, 16 nt, Human
acagcugagagacuuu

SEQ ID NO: 2194701 - RNA, 19 nt, Human
acagcugagagacuuuuaa

SEQ ID NO: 2194702 - RNA, 13 nt, Human
accuccacagcuu

SEQ ID NO: 2194703 - RNA, 12 nt, Human
accuccacagcu

SEQ ID NO: 2194704 - RNA, 11 nt, Human
accuccacagc

SEQ ID NO: 2194705 - RNA, 20 nt, Human
accuccaaaacuccugcccc

SEQ ID NO: 2194706 - RNA, 21 nt, Human
accuccaaaacuccugccccu

SEQ ID NO: 2194707 - RNA, 21 nt, Human
accucaugcccacccccugcc

SEQ ID NO: 2194708 - RNA, 22 nt, Human
accucaugcccacccccugccc

SEQ ID NO: 2194709 - RNA, 17 nt, Human
accucauugacaagaac

SEQ ID NO: 2194710 - RNA, 19 nt, Human
accuccaaaacuccugccc

SEQ ID NO: 2194711 - RNA, 14 nt, Human
accuccacagcuuc

SEQ ID NO: 2194712 - RNA, 23 nt, Human
accgggcugggagcucugcagag

SEQ ID NO: 2194713 - RNA, 18 nt, Human
accgugaggccagagaca

SEQ ID NO: 2194714 - RNA, 21 nt, Human
accgggcugggagcucugcag

SEQ ID NO: 2194715 - RNA, 22 nt, Human
accgggccaguaucuauauaug

SEQ ID NO: 2194716 - RNA, 16 nt, Human
accgggccgcuagaug

SEQ ID NO: 2194717 - RNA, 19 nt, Human
accggcuuuaccaaaccgc

SEQ ID NO: 2194718 - RNA, 19 nt, Human
acccugugacauggugccu

SEQ ID NO: 2194719 - RNA, 21 nt, Human
acccugugacauggugccuga

SEQ ID NO: 2194720 - RNA, 22 nt, Human
accggggagcccccgccccgcc

SEQ ID NO: 2194721 - RNA, 17 nt, Human
accguggaccuuccugc

SEQ ID NO: 2194722 - RNA, 19 nt, Human
accgugccuggccacgccc

SEQ ID NO: 2194723 - RNA, 23 nt, Human
accgugaggccagagacacaagc

SEQ ID NO: 2194724 - RNA, 12 nt, Human
accucagccucc

SEQ ID NO: 2194725 - RNA, 11 nt, Human
accucagccuc

SEQ ID NO: 2194726 - RNA, 12 nt, Human
accgggcacuca

SEQ ID NO: 2194727 - RNA, 14 nt, Human
accgggcacucaga

SEQ ID NO: 2194728 - RNA, 20 nt, Human
accgggccacagagaaagua

SEQ ID NO: 2194729 - RNA, 16 nt, Human
accgggcacucagaag

SEQ ID NO: 2194730 - RNA, 17 nt, Human
acccugugauggggccc

SEQ ID NO: 2194731 - RNA, 19 nt, Human
acccugugauggggcccug

SEQ ID NO: 2194732 - RNA, 20 nt, Human
acccugugauggggcccugc

SEQ ID NO: 2194733 - RNA, 21 nt, Human
acccugugauggggcccugcc

SEQ ID NO: 2194734 - RNA, 14 nt, Human
accucagccuugga

SEQ ID NO: 2194735 - RNA, 12 nt, Human
accucagcucug

SEQ ID NO: 2194736 - RNA, 20 nt, Human
accucagccuuccccuugcc

SEQ ID NO: 2194737 - RNA, 19 nt, Human
accucagccugugcugccc

SEQ ID NO: 2194738 - RNA, 18 nt, Human
accucagccugugcugcc

SEQ ID NO: 2194739 - RNA, 17 nt, Human
accucagccugugcugc

SEQ ID NO: 2194740 - RNA, 16 nt, Human
accucagccugugcug

SEQ ID NO: 2194741 - RNA, 12 nt, Human
accucagccugu

SEQ ID NO: 2194742 - RNA, 12 nt, Human
accucaggcagc

SEQ ID NO: 2194743 - RNA, 15 nt, Human
accucaggcagcuca

SEQ ID NO: 2194744 - RNA, 13 nt, Human
accucagcugcuu

SEQ ID NO: 2194745 - RNA, 17 nt, Human
accucaggcacuagccu

SEQ ID NO: 2194746 - RNA, 18 nt, Human
accucaggcacuagccuu

SEQ ID NO: 2194747 - RNA, 19 nt, Human
accucaggcacuagccuuu

SEQ ID NO: 2194748 - RNA, 14 nt, Human
accucagcucuggg

SEQ ID NO: 2194749 - RNA, 15 nt, Human
accucagcucuggga

SEQ ID NO: 2194750 - RNA, 17 nt, Human
accucagcucugggaga

SEQ ID NO: 2194751 - RNA, 18 nt, Human
accucagcucugggagag

SEQ ID NO: 2194752 - RNA, 22 nt, Human
accucagcucugggagaggauu

SEQ ID NO: 2194753 - RNA, 23 nt, Human
accucagcucugggagaggauuu

SEQ ID NO: 2194754 - RNA, 15 nt, Human
accucagcugcuucu

SEQ ID NO: 2194755 - RNA, 11 nt, Human
accucagccug

SEQ ID NO: 2194756 - RNA, 18 nt, Human
accguggaccuuccugcc

SEQ ID NO: 2194757 - RNA, 15 nt, Human
accguggaggaggaa

SEQ ID NO: 2194758 - RNA, 22 nt, Human
accguggaggaggaaggcaaga

SEQ ID NO: 2194759 - RNA, 15 nt, Human
accucagccuccugu

SEQ ID NO: 2194760 - RNA, 18 nt, Human
accguggaggaggaaggc

SEQ ID NO: 2194761 - RNA, 13 nt, Human
accucagccuggc

SEQ ID NO: 2194762 - RNA, 21 nt, Human
accucagccuggccagacaca

SEQ ID NO: 2194763 - RNA, 20 nt, Human
accucagccuggccagacac

SEQ ID NO: 2194764 - RNA, 19 nt, Human
accucagccuggccagaca

SEQ ID NO: 2194765 - RNA, 17 nt, Human
accucagccuggccaga

SEQ ID NO: 2194766 - RNA, 16 nt, Human
accucagccuggccag

SEQ ID NO: 2194767 - RNA, 15 nt, Human
accucagccuggcca

SEQ ID NO: 2194768 - RNA, 14 nt, Human
accucagccuggcc

SEQ ID NO: 2194769 - RNA, 21 nt, Human
accucaggccaggugcagugg

SEQ ID NO: 2194770 - RNA, 23 nt, Human
accucaggcacuagccuuuggcu

SEQ ID NO: 2194771 - RNA, 14 nt, Human
accucagguugcug

SEQ ID NO: 2194772 - RNA, 20 nt, Human
accucaggccaggugcagug

SEQ ID NO: 2194773 - RNA, 13 nt, Human
accucaggccagg

SEQ ID NO: 2194774 - RNA, 15 nt, Human
accucagucaguauu

SEQ ID NO: 2194775 - RNA, 15 nt, Human
accucagguugcugg

SEQ ID NO: 2194776 - RNA, 16 nt, Human
accucagguugcuggu

SEQ ID NO: 2194777 - RNA, 17 nt, Human
accucagguugcugguu

SEQ ID NO: 2194778 - RNA, 19 nt, Human
accucagguugcugguugc

SEQ ID NO: 2194779 - RNA, 22 nt, Human
accucagucaguauuguuuugg

SEQ ID NO: 2194780 - RNA, 17 nt, Human
accucagucaguauugu

SEQ ID NO: 2194781 - RNA, 18 nt, Human
accucagucaguauuguu

SEQ ID NO: 2194782 - RNA, 16 nt, Human
accucaugcaucucca

SEQ ID NO: 2194783 - RNA, 18 nt, Human
accucaugcaucuccacc

SEQ ID NO: 2194784 - RNA, 19 nt, Human
accucaugcaucuccaccu

SEQ ID NO: 2194785 - RNA, 20 nt, Human
accucaugcaucuccaccug

SEQ ID NO: 2194786 - RNA, 21 nt, Human
accucaugcaucuccaccugc

SEQ ID NO: 2194787 - RNA, 13 nt, Human
accucaugcccac

SEQ ID NO: 2194788 - RNA, 16 nt, Human
accucaugcccacccc

SEQ ID NO: 2194789 - RNA, 20 nt, Human
accucaugcccacccccugc

SEQ ID NO: 2194790 - RNA, 23 nt, Human
accucaugcccacccccugcccu

SEQ ID NO: 2194791 - RNA, 15 nt, Human
accucaggcaggaag

SEQ ID NO: 2194792 - RNA, 12 nt, Human
accucaggcagg

SEQ ID NO: 2194793 - RNA, 16 nt, Human
accucaggcagcucaa

SEQ ID NO: 2194794 - RNA, 17 nt, Human
accucaggcagcucaag

SEQ ID NO: 2194795 - RNA, 11 nt, Human
accucaggccu

SEQ ID NO: 2194796 - RNA, 20 nt, Human
accucaggugauccacccac

SEQ ID NO: 2194797 - RNA, 21 nt, Human
accucaggugauccacccacc

SEQ ID NO: 2194798 - RNA, 22 nt, Human
acccuaaggucauuaccacagg

SEQ ID NO: 2194799 - RNA, 16 nt, Human
acccuaagacuccucg

SEQ ID NO: 2194800 - RNA, 14 nt, Human
acccuaccccacca

SEQ ID NO: 2194801 - RNA, 16 nt, Human
acccuaagccuccuuu

SEQ ID NO: 2194802 - RNA, 13 nt, Human
acccuaccugugc

SEQ ID NO: 2194803 - RNA, 17 nt, Human
acccuaccugugccuga

SEQ ID NO: 2194804 - RNA, 16 nt, Human
acccuaccugugccug

SEQ ID NO: 2194805 - RNA, 15 nt, Human
acccuaccccaccac

SEQ ID NO: 2194806 - RNA, 13 nt, Human
acccuaccuguuc

SEQ ID NO: 2194807 - RNA, 14 nt, Human
acccuacuucuuuu

SEQ ID NO: 2194808 - RNA, 18 nt, Human
acccuacuucuuuugcuc

SEQ ID NO: 2194809 - RNA, 23 nt, Human
acccuagccauuccugguaccca

SEQ ID NO: 2194810 - RNA, 16 nt, Human
acccuagccauuccug

SEQ ID NO: 2194811 - RNA, 17 nt, Human
acccuagccauuccugg

SEQ ID NO: 2194812 - RNA, 19 nt, Human
acccuagccauuccuggua

SEQ ID NO: 2194813 - RNA, 19 nt, Human
acccuaaaaagcagagcuu

SEQ ID NO: 2194814 - RNA, 23 nt, Human
acccguucugcuggccuggaucu

SEQ ID NO: 2194815 - RNA, 16 nt, Human
acccuaaaucuugacu

SEQ ID NO: 2194816 - RNA, 16 nt, Human
acccguucacauuuuu

SEQ ID NO: 2194817 - RNA, 21 nt, Human
acccguucaacuuuuccuuug

SEQ ID NO: 2194818 - RNA, 13 nt, Human
acccguucaacuu

SEQ ID NO: 2194819 - RNA, 18 nt, Human
acccguucugcuggccug

SEQ ID NO: 2194820 - RNA, 20 nt, Human
acccguucugcuggccugga

SEQ ID NO: 2194821 - RNA, 22 nt, Human
acccguucugcuggccuggauc

SEQ ID NO: 2194822 - RNA, 19 nt, Human
acccuauugcugcuugagg

SEQ ID NO: 2194823 - RNA, 14 nt, Human
acccuauugcugcu

SEQ ID NO: 2194824 - RNA, 11 nt, Human
acccucagagc

SEQ ID NO: 2194825 - RNA, 18 nt, Human
acccucagaaacacuggg

SEQ ID NO: 2194826 - RNA, 21 nt, Human
acccucagaaacacuggggcu

SEQ ID NO: 2194827 - RNA, 21 nt, Human
acccucaaccucuucuggcuc

SEQ ID NO: 2194828 - RNA, 15 nt, Human
acccucacacuggga

SEQ ID NO: 2194829 - RNA, 17 nt, Human
acccuauauguaguaua

SEQ ID NO: 2194830 - RNA, 13 nt, Human
acccuauugcugc

SEQ ID NO: 2194831 - RNA, 22 nt, Human
acccuagucccuuccccucccu

SEQ ID NO: 2194832 - RNA, 15 nt, Human
acccuaguucuaccu

SEQ ID NO: 2194833 - RNA, 16 nt, Human
acccuaguuucccuga

SEQ ID NO: 2194834 - RNA, 21 nt, Human
acccuaguucuaccucaggca

SEQ ID NO: 2194835 - RNA, 23 nt, Human
acccuauauuuugcauaguacca

SEQ ID NO: 2194836 - RNA, 22 nt, Human
acccuggccgcccccugccccc

SEQ ID NO: 2194837 - RNA, 23 nt, Human
acccugggaccuaggggcgccgc

SEQ ID NO: 2194838 - RNA, 12 nt, Human
acccugggaccu

SEQ ID NO: 2194839 - RNA, 14 nt, Human
acccugggcccugg

SEQ ID NO: 2194840 - RNA, 15 nt, Human
acccugggcccuggg

SEQ ID NO: 2194841 - RNA, 17 nt, Human
acccugggcccugggcu

SEQ ID NO: 2194842 - RNA, 22 nt, Human
acccuggccgaguccaagcugg

SEQ ID NO: 2194843 - RNA, 16 nt, Human
acccuggccgcccccu

SEQ ID NO: 2194844 - RNA, 17 nt, Human
acccuggccgcccccug

SEQ ID NO: 2194845 - RNA, 19 nt, Human
acccuggccgcccccugcc

SEQ ID NO: 2194846 - RNA, 21 nt, Human
acccuggccgaguccaagcug

SEQ ID NO: 2194847 - RNA, 18 nt, Human
acccuggccgaguccaag

SEQ ID NO: 2194848 - RNA, 22 nt, Human
acccugggcccugggcuggaau

SEQ ID NO: 2194849 - RNA, 18 nt, Human
acccugggcccugggcug

SEQ ID NO: 2194850 - RNA, 20 nt, Human
acccugggcccugggcugga

SEQ ID NO: 2194851 - RNA, 19 nt, Human
acccugggcucugggagca

SEQ ID NO: 2194852 - RNA, 20 nt, Human
acccugggcucugggagcag

SEQ ID NO: 2194853 - RNA, 21 nt, Human
acccugggcucugggagcagc

SEQ ID NO: 2194854 - RNA, 17 nt, Human
acccugggcucuguggg

SEQ ID NO: 2194855 - RNA, 18 nt, Human
acccugggcucugugggc

SEQ ID NO: 2194856 - RNA, 19 nt, Human
acccugggcucugugggcu

SEQ ID NO: 2194857 - RNA, 16 nt, Human
acccuggggagaaagu

SEQ ID NO: 2194858 - RNA, 17 nt, Human
acccuggggccuggacc

SEQ ID NO: 2194859 - RNA, 18 nt, Human
acccuggggccuggaccu

SEQ ID NO: 2194860 - RNA, 19 nt, Human
acccuggggccuggaccug

SEQ ID NO: 2194861 - RNA, 13 nt, Human
acccuggggccug

SEQ ID NO: 2194862 - RNA, 20 nt, Human
acccugggcucugugggcug

SEQ ID NO: 2194863 - RNA, 15 nt, Human
acccuguauauagcc

SEQ ID NO: 2194864 - RNA, 18 nt, Human
acccuguauauagcccag

SEQ ID NO: 2194865 - RNA, 20 nt, Human
acccuguacuguucuguguc

SEQ ID NO: 2194866 - RNA, 22 nt, Human
acccuguacuguucugugucuu

SEQ ID NO: 2194867 - RNA, 20 nt, Human
acccuguauauagcccagcc

SEQ ID NO: 2194868 - RNA, 19 nt, Human
acccuguccaaacugccua

SEQ ID NO: 2194869 - RNA, 17 nt, Human
acccuggugguugcugu

SEQ ID NO: 2194870 - RNA, 15 nt, Human
acccuggugggccaa

SEQ ID NO: 2194871 - RNA, 19 nt, Human
acccuggugguugcuguuu

SEQ ID NO: 2194872 - RNA, 18 nt, Human
acccuggugguugcuguu

SEQ ID NO: 2194873 - RNA, 22 nt, Human
acccuggggccuggaccugccu

SEQ ID NO: 2194874 - RNA, 18 nt, Human
acccugggugggcucugu

SEQ ID NO: 2194875 - RNA, 19 nt, Human
acccugggugggcucugug

SEQ ID NO: 2194876 - RNA, 20 nt, Human
acccugggugggcucugugc

SEQ ID NO: 2194877 - RNA, 11 nt, Human
acccugucucu

SEQ ID NO: 2194878 - RNA, 20 nt, Human
acccugucccccagcucugg

SEQ ID NO: 2194879 - RNA, 21 nt, Human
acccugucccccagcucuggu

SEQ ID NO: 2194880 - RNA, 14 nt, Human
acccugucccccag

SEQ ID NO: 2194881 - RNA, 16 nt, Human
acccugucccccagcu

SEQ ID NO: 2194882 - RNA, 19 nt, Human
acccugucccccagcucug

SEQ ID NO: 2194883 - RNA, 21 nt, Human
acccugucucuacuaaaaaua

SEQ ID NO: 2194884 - RNA, 21 nt, Human
acccugucucuuaaagaaaaa

SEQ ID NO: 2194885 - RNA, 22 nt, Human
acccugucccccagcucuggug

SEQ ID NO: 2194886 - RNA, 14 nt, Human
acccugucucuacu

SEQ ID NO: 2194887 - RNA, 22 nt, Human
acccugucuguagagggcccug

SEQ ID NO: 2194888 - RNA, 23 nt, Human
acccugucuguagagggcccugg

SEQ ID NO: 2194889 - RNA, 16 nt, Human
acccugugauggggcc

SEQ ID NO: 2194890 - RNA, 16 nt, Human
acccucaggcaggugg

SEQ ID NO: 2194891 - RNA, 15 nt, Human
acccucaggcaggug

SEQ ID NO: 2194892 - RNA, 23 nt, Human
acccucaggcauaggccugggug

SEQ ID NO: 2194893 - RNA, 22 nt, Human
acccucaggcauaggccugggu

SEQ ID NO: 2194894 - RNA, 20 nt, Human
acccucaggcauaggccugg

SEQ ID NO: 2194895 - RNA, 19 nt, Human
acccucaggcauaggccug

SEQ ID NO: 2194896 - RNA, 13 nt, Human
acccucaucacca

SEQ ID NO: 2194897 - RNA, 14 nt, Human
acccucaggcaggu

SEQ ID NO: 2194898 - RNA, 13 nt, Human
acccucaggcagg

SEQ ID NO: 2194899 - RNA, 18 nt, Human
acccucagagccaccccu

SEQ ID NO: 2194900 - RNA, 14 nt, Human
acccucagcacccc

SEQ ID NO: 2194901 - RNA, 16 nt, Human
acccucagcaccccuu

SEQ ID NO: 2194902 - RNA, 17 nt, Human
acccucagcaccccuuc

SEQ ID NO: 2194903 - RNA, 18 nt, Human
acccucagcaccccuucc

SEQ ID NO: 2194904 - RNA, 19 nt, Human
acccucagcaccccuucca

SEQ ID NO: 2194905 - RNA, 22 nt, Human
acccucagcaccccuuccaugu

SEQ ID NO: 2194906 - RNA, 15 nt, Human
acccucaggacaaug

SEQ ID NO: 2194907 - RNA, 13 nt, Human
acccucaugcugu

SEQ ID NO: 2194908 - RNA, 16 nt, Human
acccuggaucaguccu

SEQ ID NO: 2194909 - RNA, 13 nt, Human
acccuggagccca

SEQ ID NO: 2194910 - RNA, 23 nt, Human
acccuggcacuauaauguaagcu

SEQ ID NO: 2194911 - RNA, 15 nt, Human
acccuggcauuaugu

SEQ ID NO: 2194912 - RNA, 18 nt, Human
acccuggcacccagggug

SEQ ID NO: 2194913 - RNA, 23 nt, Human
acccucaucaccaacgucugugc

SEQ ID NO: 2194914 - RNA, 12 nt, Human
acccucaugcug

SEQ ID NO: 2194915 - RNA, 17 nt, Human
acgcaaagggcugaaag

SEQ ID NO: 2194916 - RNA, 12 nt, Human
acgcacacacac

SEQ ID NO: 2194917 - RNA, 13 nt, Human
acgcacacacaca

SEQ ID NO: 2194918 - RNA, 21 nt, Human
acgcaaagggcugaaagccau

SEQ ID NO: 2194919 - RNA, 20 nt, Human
acgcacacacacacacagga

SEQ ID NO: 2194920 - RNA, 19 nt, Human
acgcacacacacacacagg

SEQ ID NO: 2194921 - RNA, 18 nt, Human
acgcacacacacacacag

SEQ ID NO: 2194922 - RNA, 14 nt, Human
acgcacacacacaa

SEQ ID NO: 2194923 - RNA, 21 nt, Human
acgcacacacacacacaggag

SEQ ID NO: 2194924 - RNA, 22 nt, Human
acgcacacguacuuaaaugaaa

SEQ ID NO: 2194925 - RNA, 14 nt, Human
acgcaccacaucuc

SEQ ID NO: 2194926 - RNA, 15 nt, Human
acgcacagccaagga

SEQ ID NO: 2194927 - RNA, 17 nt, Human
acgcacagccaaggacu

SEQ ID NO: 2194928 - RNA, 19 nt, Human
acgauuucuguuuagauaa

SEQ ID NO: 2194929 - RNA, 23 nt, Human
acgauuucuguuuagauaauaca

SEQ ID NO: 2194930 - RNA, 20 nt, Human
acgauuucuguuuagauaau

SEQ ID NO: 2194931 - RNA, 15 nt, Human
acggacacccccucg

SEQ ID NO: 2194932 - RNA, 16 nt, Human
acggacacccccucgc

SEQ ID NO: 2194933 - RNA, 17 nt, Human
acggacacucaaaagcu

SEQ ID NO: 2194934 - RNA, 19 nt, Human
acggaauaguuggcuagga

SEQ ID NO: 2194935 - RNA, 13 nt, Human
acgcuucuucuuu

SEQ ID NO: 2194936 - RNA, 20 nt, Human
acgcuugcguaugucuguua

SEQ ID NO: 2194937 - RNA, 12 nt, Human
acgucugugcca

SEQ ID NO: 2194938 - RNA, 13 nt, Human
acgucugugccau

SEQ ID NO: 2194939 - RNA, 12 nt, Human
acgucuucuaaa

SEQ ID NO: 2194940 - RNA, 15 nt, Human
acgcuugcucauuuu

SEQ ID NO: 2194941 - RNA, 23 nt, Human
acgucuuccuucugccugagcuu

SEQ ID NO: 2194942 - RNA, 14 nt, Human
acgcugugggcagg

SEQ ID NO: 2194943 - RNA, 21 nt, Human
acgcuuaaaggugucuuccuc

SEQ ID NO: 2194944 - RNA, 15 nt, Human
acgcugugggcaggu

SEQ ID NO: 2194945 - RNA, 16 nt, Human
acgcaggaacucccag

SEQ ID NO: 2194946 - RNA, 17 nt, Human
acgcaggaacucccagc

SEQ ID NO: 2194947 - RNA, 18 nt, Human
acgcuugcguaugucugu

SEQ ID NO: 2194948 - RNA, 18 nt, Human
acgcuucugaaugcugcu

SEQ ID NO: 2194949 - RNA, 22 nt, Human
acgcuucugaaugcugcuacuu

SEQ ID NO: 2194950 - RNA, 12 nt, Human
acgcuucugaau

SEQ ID NO: 2194951 - RNA, 13 nt, Human
acgcuucugaaug

SEQ ID NO: 2194952 - RNA, 22 nt, Human
acgcugugcugcccugcccacc

SEQ ID NO: 2194953 - RNA, 19 nt, Human
acgcugugcugcccugccc

SEQ ID NO: 2194954 - RNA, 19 nt, Human
acgcaccucccauccuaau

SEQ ID NO: 2194955 - RNA, 18 nt, Human
acgcagcccuagagccug

SEQ ID NO: 2194956 - RNA, 19 nt, Human
acgcagcccuagagccugc

SEQ ID NO: 2194957 - RNA, 20 nt, Human
acgcagcccuagagccugcc

SEQ ID NO: 2194958 - RNA, 14 nt, Human
acgcagcccuagag

SEQ ID NO: 2194959 - RNA, 16 nt, Human
acgcaccugccucagg

SEQ ID NO: 2194960 - RNA, 15 nt, Human
acgcaccucccaucc

SEQ ID NO: 2194961 - RNA, 13 nt, Human
acgcaccucccau

SEQ ID NO: 2194962 - RNA, 15 nt, Human
acgcaccugccucag

SEQ ID NO: 2194963 - RNA, 14 nt, Human
acgcaccugccuca

SEQ ID NO: 2194964 - RNA, 12 nt, Human
acgcagcccugc

SEQ ID NO: 2194965 - RNA, 21 nt, Human
acgcagcccuagagccugccu

SEQ ID NO: 2194966 - RNA, 22 nt, Human
acgcagcccuagagccugccug

SEQ ID NO: 2194967 - RNA, 23 nt, Human
acgcagcccuagagccugccugg

SEQ ID NO: 2194968 - RNA, 24 nt, Human
acgcagcccuagagccugccugga

SEQ ID NO: 2194969 - RNA, 22 nt, Human
acgcagcccugcuuugggcugc

SEQ ID NO: 2194970 - RNA, 23 nt, Human
acgcagcccugcuuugggcugcc

SEQ ID NO: 2194971 - RNA, 18 nt, Human
acuaauggggcggugaga

SEQ ID NO: 2194972 - RNA, 19 nt, Human
acuaaugccuuacucuucu

SEQ ID NO: 2194973 - RNA, 24 nt, Human
acuaaugccuuacucuucuugaaa

SEQ ID NO: 2194974 - RNA, 23 nt, Human
acuaaugccuuacucuucuugaa

SEQ ID NO: 2194975 - RNA, 21 nt, Human
acgugccaggcccggggcugg

SEQ ID NO: 2194976 - RNA, 15 nt, Human
acgugccuuuugcac

SEQ ID NO: 2194977 - RNA, 17 nt, Human
acgugccuuuugcaccc

SEQ ID NO: 2194978 - RNA, 19 nt, Human
acgugccuuuugcaccccu

SEQ ID NO: 2194979 - RNA, 19 nt, Human
acgugccaggcccggggcu

SEQ ID NO: 2194980 - RNA, 18 nt, Human
acgugccaggcccggggc

SEQ ID NO: 2194981 - RNA, 14 nt, Human
acgugccaggcccg

SEQ ID NO: 2194982 - RNA, 13 nt, Human
acgugccaggccc

SEQ ID NO: 2194983 - RNA, 20 nt, Human
acgugccuuuugcaccccuc

SEQ ID NO: 2194984 - RNA, 21 nt, Human
acgugccuuuugcaccccucc

SEQ ID NO: 2194985 - RNA, 22 nt, Human
acgugccuuuugcaccccuccc

SEQ ID NO: 2194986 - RNA, 19 nt, Human
acguggagagcuggugccc

SEQ ID NO: 2194987 - RNA, 18 nt, Human
acguggagagcuggugcc

SEQ ID NO: 2194988 - RNA, 16 nt, Human
acguggagagcuggug

SEQ ID NO: 2194989 - RNA, 15 nt, Human
acguggagagcuggu

SEQ ID NO: 2194990 - RNA, 17 nt, Human
acguggacguuuuuaau

SEQ ID NO: 2194991 - RNA, 14 nt, Human
acguggagagcugg

SEQ ID NO: 2194992 - RNA, 19 nt, Human
accuguaaucccagcacuu

SEQ ID NO: 2194993 - RNA, 16 nt, Human
accuguaaucccagca

SEQ ID NO: 2194994 - RNA, 19 nt, Human
accuguaaucccagcuacu

SEQ ID NO: 2194995 - RNA, 20 nt, Human
accuguaaucccagcuacuu

SEQ ID NO: 2194996 - RNA, 19 nt, Human
accugugaguuuaaagcaa

SEQ ID NO: 2194997 - RNA, 14 nt, Human
accugugccucggc

SEQ ID NO: 2194998 - RNA, 18 nt, Human
accugugaguuuaaagca

SEQ ID NO: 2194999 - RNA, 14 nt, Human
accuguaaucccag

SEQ ID NO: 2195000 - RNA, 15 nt, Human
accuguaaucccagc

SEQ ID NO: 2195001 - RNA, 11 nt, Human
accuguaauca

SEQ ID NO: 2195002 - RNA, 21 nt, Human
accuguaauaaauaugagugc

SEQ ID NO: 2195003 - RNA, 23 nt, Human
accuguaauaaauaugagugcca

SEQ ID NO: 2195004 - RNA, 20 nt, Human
accuguaacuuuuguaaaua

SEQ ID NO: 2195005 - RNA, 13 nt, Human
accuguaauaaau

SEQ ID NO: 2195006 - RNA, 15 nt, Human
accuguaauaaauau

SEQ ID NO: 2195007 - RNA, 16 nt, Human
accuguaauaaauaug

SEQ ID NO: 2195008 - RNA, 17 nt, Human
accuguaauaaauauga

SEQ ID NO: 2195009 - RNA, 18 nt, Human
accuguaauaaauaugag

SEQ ID NO: 2195010 - RNA, 17 nt, Human
accuguggccaaguucu

SEQ ID NO: 2195011 - RNA, 19 nt, Human
accugugaugaggggagga

SEQ ID NO: 2195012 - RNA, 23 nt, Human
accugugcuucgggcccuuccca

SEQ ID NO: 2195013 - RNA, 16 nt, Human
accugugccucggcuu

SEQ ID NO: 2195014 - RNA, 15 nt, Human
accugugccucggcu

SEQ ID NO: 2195015 - RNA, 22 nt, Human
accugugcuucgggcccuuccc

SEQ ID NO: 2195016 - RNA, 19 nt, Human
accugugcuucgggcccuu

SEQ ID NO: 2195017 - RNA, 17 nt, Human
accuguaacuuuuguaa

SEQ ID NO: 2195018 - RNA, 23 nt, Human
accugccccgcccagcugcaccu

SEQ ID NO: 2195019 - RNA, 15 nt, Human
accuguaacuuuugu

SEQ ID NO: 2195020 - RNA, 17 nt, Human
accugccccgcccagcu

SEQ ID NO: 2195021 - RNA, 16 nt, Human
accugccccgcccagc

SEQ ID NO: 2195022 - RNA, 20 nt, Human
accugccccucaacucuccu

SEQ ID NO: 2195023 - RNA, 12 nt, Human
accugccccuca

SEQ ID NO: 2195024 - RNA, 15 nt, Human
accugccccucaacu

SEQ ID NO: 2195025 - RNA, 23 nt, Human
accugcccccuucucccacacug

SEQ ID NO: 2195026 - RNA, 22 nt, Human
accugcccccuucucccacacu

SEQ ID NO: 2195027 - RNA, 20 nt, Human
accugcccccuucucccaca

SEQ ID NO: 2195028 - RNA, 19 nt, Human
accugcccccuucucccac

SEQ ID NO: 2195029 - RNA, 14 nt, Human
accucuguuguccu

SEQ ID NO: 2195030 - RNA, 16 nt, Human
accucuguuguccucc

SEQ ID NO: 2195031 - RNA, 13 nt, Human
accugccaggcag

SEQ ID NO: 2195032 - RNA, 15 nt, Human
accugccaggcaggg

SEQ ID NO: 2195033 - RNA, 23 nt, Human
accugccaggaagccagcaggcu

SEQ ID NO: 2195034 - RNA, 21 nt, Human
accugccaggaagccagcagg

SEQ ID NO: 2195035 - RNA, 22 nt, Human
accugccaggaagccagcaggc

SEQ ID NO: 2195036 - RNA, 19 nt, Human
accucugucuuggcuuuca

SEQ ID NO: 2195037 - RNA, 22 nt, Human
accucugucuuggcuuucaugu

SEQ ID NO: 2195038 - RNA, 14 nt, Human
accucugugaccuc

SEQ ID NO: 2195039 - RNA, 15 nt, Human
accucugugaccuca

SEQ ID NO: 2195040 - RNA, 16 nt, Human
accucugugaccucag

SEQ ID NO: 2195041 - RNA, 17 nt, Human
accucugugaccucagg

SEQ ID NO: 2195042 - RNA, 18 nt, Human
accucugugaccucaggc

SEQ ID NO: 2195043 - RNA, 19 nt, Human
accucugugaccucaggca

SEQ ID NO: 2195044 - RNA, 15 nt, Human
accucugugugcucc

SEQ ID NO: 2195045 - RNA, 15 nt, Human
accucuguucagugu

SEQ ID NO: 2195046 - RNA, 14 nt, Human
accucuguucagug

SEQ ID NO: 2195047 - RNA, 11 nt, Human
accucugugug

SEQ ID NO: 2195048 - RNA, 12 nt, Human
accucugugugc

SEQ ID NO: 2195049 - RNA, 22 nt, Human
accucuguucaguguaaauagu

SEQ ID NO: 2195050 - RNA, 19 nt, Human
accucuguucaguguaaau

SEQ ID NO: 2195051 - RNA, 18 nt, Human
accucuguucaguguaaa

SEQ ID NO: 2195052 - RNA, 17 nt, Human
accucuguucaguguaa

SEQ ID NO: 2195053 - RNA, 17 nt, Human
accucuguuguccuccc

SEQ ID NO: 2195054 - RNA, 12 nt, Human
accucugccuga

SEQ ID NO: 2195055 - RNA, 20 nt, Human
accucugccugaagucacac

SEQ ID NO: 2195056 - RNA, 23 nt, Human
accucugccugaagucacacagu

SEQ ID NO: 2195057 - RNA, 18 nt, Human
accuuggcaccagacacc

SEQ ID NO: 2195058 - RNA, 17 nt, Human
accuuggcaccagacac

SEQ ID NO: 2195059 - RNA, 16 nt, Human
accuuggcaccagaca

SEQ ID NO: 2195060 - RNA, 14 nt, Human
accuuggcaccaga

SEQ ID NO: 2195061 - RNA, 19 nt, Human
accuugcuuugauggaaua

SEQ ID NO: 2195062 - RNA, 18 nt, Human
accuuggacauccuccuc

SEQ ID NO: 2195063 - RNA, 19 nt, Human
accuuggacauccuccucc

SEQ ID NO: 2195064 - RNA, 22 nt, Human
accuuggcaccagacacccagg

SEQ ID NO: 2195065 - RNA, 22 nt, Human
acuucuuggcuuggugaggaaa

SEQ ID NO: 2195066 - RNA, 16 nt, Human
acuucaaacugagauc

SEQ ID NO: 2195067 - RNA, 16 nt, Human
acuucagagagcuggu

SEQ ID NO: 2195068 - RNA, 15 nt, Human
acuucagagagcugg

SEQ ID NO: 2195069 - RNA, 19 nt, Human
acuucagacugaacaugua

SEQ ID NO: 2195070 - RNA, 13 nt, Human
acuucagacugaa

SEQ ID NO: 2195071 - RNA, 21 nt, Human
acuucagacauagaauuaaca

SEQ ID NO: 2195072 - RNA, 20 nt, Human
acuucagagagcugguaguu

SEQ ID NO: 2195073 - RNA, 18 nt, Human
acuucagagagcugguag

SEQ ID NO: 2195074 - RNA, 17 nt, Human
acuucagagagcuggua

SEQ ID NO: 2195075 - RNA, 20 nt, Human
acuucuugaaggugcugacg

SEQ ID NO: 2195076 - RNA, 23 nt, Human
acuuggggggcugaggugggagg

SEQ ID NO: 2195077 - RNA, 15 nt, Human
acuugggucuucccu

SEQ ID NO: 2195078 - RNA, 13 nt, Human
acuuggucuguga

SEQ ID NO: 2195079 - RNA, 12 nt, Human
acuugaaaauua

SEQ ID NO: 2195080 - RNA, 14 nt, Human
acuugaaaauuaac

SEQ ID NO: 2195081 - RNA, 14 nt, Human
acuuguauauuugu

SEQ ID NO: 2195082 - RNA, 15 nt, Human
acuuguauauuugua

SEQ ID NO: 2195083 - RNA, 17 nt, Human
acuuguagggaugccuu

SEQ ID NO: 2195084 - RNA, 14 nt, Human
acuuggucaccagc

SEQ ID NO: 2195085 - RNA, 18 nt, Human
acuuguaauuuuuuuaau

SEQ ID NO: 2195086 - RNA, 20 nt, Human
acuuguacaaaauaaacaaa

SEQ ID NO: 2195087 - RNA, 18 nt, Human
acuuguacaaaauaaaca

SEQ ID NO: 2195088 - RNA, 14 nt, Human
acuuguacaaaaua

SEQ ID NO: 2195089 - RNA, 18 nt, Human
acuuguauauuuguacaa

SEQ ID NO: 2195090 - RNA, 16 nt, Human
acuuguauauuuguac

SEQ ID NO: 2195091 - RNA, 17 nt, Human
acuuguauauuuguaca

SEQ ID NO: 2195092 - RNA, 14 nt, Human
acuuaaaaaauguc

SEQ ID NO: 2195093 - RNA, 23 nt, Human
acuuaaaaaacuuguaaaugcug

SEQ ID NO: 2195094 - RNA, 13 nt, Human
acuuaaaaaacuu

SEQ ID NO: 2195095 - RNA, 22 nt, Human
acuuaaaaaaaugacagauguu

SEQ ID NO: 2195096 - RNA, 17 nt, Human
acuuaaaaaaaugacag

SEQ ID NO: 2195097 - RNA, 16 nt, Human
acuuaaaaaaaugaca

SEQ ID NO: 2195098 - RNA, 15 nt, Human
acuuaaaaaaaugac

SEQ ID NO: 2195099 - RNA, 14 nt, Human
acuuaaaaaaauga

SEQ ID NO: 2195100 - RNA, 13 nt, Human
acuuaaaaaaaug

SEQ ID NO: 2195101 - RNA, 19 nt, Human
acuguuuuuuccugagcuu

SEQ ID NO: 2195102 - RNA, 18 nt, Human
acuguuuuuuccugagcu

SEQ ID NO: 2195103 - RNA, 17 nt, Human
acuguuuuuuccugagc

SEQ ID NO: 2195104 - RNA, 19 nt, Human
acuuaaaaauguaaauauu

SEQ ID NO: 2195105 - RNA, 23 nt, Human
acuuaaaaauguaaauauucuau

SEQ ID NO: 2195106 - RNA, 14 nt, Human
acuuaaaaauguaa

SEQ ID NO: 2195107 - RNA, 16 nt, Human
acuuaaaaauguaaau

SEQ ID NO: 2195108 - RNA, 17 nt, Human
acuuaaaaauguaaaua

SEQ ID NO: 2195109 - RNA, 18 nt, Human
acuuaaaaauguaaauau

SEQ ID NO: 2195110 - RNA, 22 nt, Human
acuuaaaaaugguuuaaauggu

SEQ ID NO: 2195111 - RNA, 17 nt, Human
acuucaaauccuugaag

SEQ ID NO: 2195112 - RNA, 18 nt, Human
acuucaaauccuugaaga

SEQ ID NO: 2195113 - RNA, 23 nt, Human
acuguuuuucagggagguggcug

SEQ ID NO: 2195114 - RNA, 14 nt, Human
acuguuuuuaccca

SEQ ID NO: 2195115 - RNA, 15 nt, Human
acuguuuuuacccau

SEQ ID NO: 2195116 - RNA, 16 nt, Human
acuguuuuuacccaua

SEQ ID NO: 2195117 - RNA, 17 nt, Human
acuguuuuuacccauau

SEQ ID NO: 2195118 - RNA, 21 nt, Human
acuguuuuuacccauaucccc

SEQ ID NO: 2195119 - RNA, 23 nt, Human
acuguuuuuacccauauccccuc

SEQ ID NO: 2195120 - RNA, 14 nt, Human
acuguuuuuuccug

SEQ ID NO: 2195121 - RNA, 12 nt, Human
acuguuucucug

SEQ ID NO: 2195122 - RNA, 19 nt, Human
acuguuucaaacuuuacua

SEQ ID NO: 2195123 - RNA, 18 nt, Human
acuguuucaaacuuuacu

SEQ ID NO: 2195124 - RNA, 15 nt, Human
acuguuucaaacuuu

SEQ ID NO: 2195125 - RNA, 17 nt, Human
acugcccacccccucaa

SEQ ID NO: 2195126 - RNA, 15 nt, Human
acugcccacccccuc

SEQ ID NO: 2195127 - RNA, 16 nt, Human
acugcccacccccuca

SEQ ID NO: 2195128 - RNA, 14 nt, Human
acugcccaaagugc

SEQ ID NO: 2195129 - RNA, 19 nt, Human
acugcccaaagugcuucca

SEQ ID NO: 2195130 - RNA, 13 nt, Human
acugcccaccccc

SEQ ID NO: 2195131 - RNA, 14 nt, Human
acugcccacccccu

SEQ ID NO: 2195132 - RNA, 16 nt, Human
acugcccauggacagg

SEQ ID NO: 2195133 - RNA, 19 nt, Human
acugcccaggccugccugu

SEQ ID NO: 2195134 - RNA, 23 nt, Human
acugccgaccgaggcuggagcug

SEQ ID NO: 2195135 - RNA, 22 nt, Human
acugccgaccgaggcuggagcu

SEQ ID NO: 2195136 - RNA, 22 nt, Human
acugccgcaagucugcagcccg

SEQ ID NO: 2195137 - RNA, 18 nt, Human
acugccgaccgaggcugg

SEQ ID NO: 2195138 - RNA, 19 nt, Human
acugccgaccgaggcugga

SEQ ID NO: 2195139 - RNA, 14 nt, Human
acugccuaagcccu

SEQ ID NO: 2195140 - RNA, 15 nt, Human
acugccuaagcccuc

SEQ ID NO: 2195141 - RNA, 18 nt, Human
acugccauggaggcacac

SEQ ID NO: 2195142 - RNA, 21 nt, Human
acugccauggaggcacacagc

SEQ ID NO: 2195143 - RNA, 14 nt, Human
acugccaugccagc

SEQ ID NO: 2195144 - RNA, 11 nt, Human
acuggagcccc

SEQ ID NO: 2195145 - RNA, 15 nt, Human
acuggaaccagggag

SEQ ID NO: 2195146 - RNA, 16 nt, Human
acuggaaccagggaga

SEQ ID NO: 2195147 - RNA, 16 nt, Human
acuggaggagagaaga

SEQ ID NO: 2195148 - RNA, 16 nt, Human
acuggagcccaggagu

SEQ ID NO: 2195149 - RNA, 17 nt, Human
acuggaggagagaagaa

SEQ ID NO: 2195150 - RNA, 18 nt, Human
acuggaggagagaagaau

SEQ ID NO: 2195151 - RNA, 20 nt, Human
acuggaggagagaagaauga

SEQ ID NO: 2195152 - RNA, 12 nt, Human
acuggaacucuc

SEQ ID NO: 2195153 - RNA, 20 nt, Human
acuggaaaggggagagccug

SEQ ID NO: 2195154 - RNA, 21 nt, Human
acuggaaaggggagagccugc

SEQ ID NO: 2195155 - RNA, 22 nt, Human
acuggaaaggggagagccugcu

SEQ ID NO: 2195156 - RNA, 23 nt, Human
acuggaaaggggagagccugcug

SEQ ID NO: 2195157 - RNA, 15 nt, Human
acugccuauuuuaau

SEQ ID NO: 2195158 - RNA, 14 nt, Human
acugccuacugcau

SEQ ID NO: 2195159 - RNA, 16 nt, Human
acugccuacugcaucg

SEQ ID NO: 2195160 - RNA, 17 nt, Human
acuggaaaggggagagc

SEQ ID NO: 2195161 - RNA, 15 nt, Human
acuggaaaggggaga

SEQ ID NO: 2195162 - RNA, 17 nt, Human
acuggaguccagucucu

SEQ ID NO: 2195163 - RNA, 13 nt, Human
acuggagugcagg

SEQ ID NO: 2195164 - RNA, 17 nt, Human
acuggagugcagggagg

SEQ ID NO: 2195165 - RNA, 12 nt, Human
acuggaguccag

SEQ ID NO: 2195166 - RNA, 19 nt, Human
acuggagguugaagccaag

SEQ ID NO: 2195167 - RNA, 17 nt, Human
acuggagguugaagcca

SEQ ID NO: 2195168 - RNA, 18 nt, Human
acuggagguugaagccaa

SEQ ID NO: 2195169 - RNA, 22 nt, Human
acuggaggggacgcugguagag

SEQ ID NO: 2195170 - RNA, 21 nt, Human
acuggaggggacgcugguaga

SEQ ID NO: 2195171 - RNA, 14 nt, Human
acuggaggucacau

SEQ ID NO: 2195172 - RNA, 19 nt, Human
acuggaggucacauucagg

SEQ ID NO: 2195173 - RNA, 20 nt, Human
acuggaggucacauucagga

SEQ ID NO: 2195174 - RNA, 21 nt, Human
acuggaggucacauucaggaa

SEQ ID NO: 2195175 - RNA, 23 nt, Human
acuggaggucacauucaggaaga

SEQ ID NO: 2195176 - RNA, 16 nt, Human
acuggagguugaagcc

SEQ ID NO: 2195177 - RNA, 17 nt, Human
acuggaguggagcauug

SEQ ID NO: 2195178 - RNA, 18 nt, Human
acuggagugcagggagga

SEQ ID NO: 2195179 - RNA, 14 nt, Human
acuggaguggagca

SEQ ID NO: 2195180 - RNA, 16 nt, Human
acuggugagcagacug

SEQ ID NO: 2195181 - RNA, 14 nt, Human
acuggugagcagac

SEQ ID NO: 2195182 - RNA, 12 nt, Human
acuggugacugc

SEQ ID NO: 2195183 - RNA, 21 nt, Human
acuggugacugcgaucuucag

SEQ ID NO: 2195184 - RNA, 12 nt, Human
acugguggcccg

SEQ ID NO: 2195185 - RNA, 17 nt, Human
acuguaaaauaauaacu

SEQ ID NO: 2195186 - RNA, 16 nt, Human
acuguaaaaugaaauu

SEQ ID NO: 2195187 - RNA, 23 nt, Human
acuggugcuauaggcuggagaag

SEQ ID NO: 2195188 - RNA, 16 nt, Human
acuguaaagaaagaga

SEQ ID NO: 2195189 - RNA, 15 nt, Human
acuguaaagaaagag

SEQ ID NO: 2195190 - RNA, 14 nt, Human
acuguaaagaaaga

SEQ ID NO: 2195191 - RNA, 13 nt, Human
acuguaaagaaag

SEQ ID NO: 2195192 - RNA, 16 nt, Human
acugucuuuuuucuaa

SEQ ID NO: 2195193 - RNA, 17 nt, Human
acuguaaagagaccuac

SEQ ID NO: 2195194 - RNA, 23 nt, Human
acuguaaagagaccuaccucagg

SEQ ID NO: 2195195 - RNA, 20 nt, Human
acuguaacacuuuacaaugu

SEQ ID NO: 2195196 - RNA, 10 nt, Human
acuguaacac

SEQ ID NO: 2195197 - RNA, 13 nt, Human
acuguaacacuuu

SEQ ID NO: 2195198 - RNA, 18 nt, Human
acuguaaauaaaaagaaa

SEQ ID NO: 2195199 - RNA, 23 nt, Human
acuguaaagaaagagagaaaaua

SEQ ID NO: 2195200 - RNA, 22 nt, Human
acuguaaagaaagagagaaaau

SEQ ID NO: 2195201 - RNA, 21 nt, Human
acuguaaagaaagagagaaaa

SEQ ID NO: 2195202 - RNA, 20 nt, Human
acuguaaagaaagagagaaa

SEQ ID NO: 2195203 - RNA, 19 nt, Human
acuguaaagaaagagagaa

SEQ ID NO: 2195204 - RNA, 18 nt, Human
acuguaaagaaagagaga

SEQ ID NO: 2195205 - RNA, 16 nt, Human
acugugaagagaacca

SEQ ID NO: 2195206 - RNA, 22 nt, Human
acuguaacugugucaugauuca

SEQ ID NO: 2195207 - RNA, 14 nt, Human
acugucuuuccuag

SEQ ID NO: 2195208 - RNA, 16 nt, Human
acugugccaugugcca

SEQ ID NO: 2195209 - RNA, 22 nt, Human
acugucuuuuuucuaaaguaaa

SEQ ID NO: 2195210 - RNA, 23 nt, Human
acugucuuuuuucuaaaguaaaa

SEQ ID NO: 2195211 - RNA, 17 nt, Human
acugugccaugugccag

SEQ ID NO: 2195212 - RNA, 18 nt, Human
acugugccaugugccagg

SEQ ID NO: 2195213 - RNA, 21 nt, Human
acugucuuuuuuucccuacca

SEQ ID NO: 2195214 - RNA, 12 nt, Human
acugugcccugg

SEQ ID NO: 2195215 - RNA, 13 nt, Human
acugugcccuggu

SEQ ID NO: 2195216 - RNA, 14 nt, Human
acugugcccuggug

SEQ ID NO: 2195217 - RNA, 15 nt, Human
acugugcccuggugg

SEQ ID NO: 2195218 - RNA, 17 nt, Human
acugugcccugguggag

SEQ ID NO: 2195219 - RNA, 18 nt, Human
acugugcccugguggaga

SEQ ID NO: 2195220 - RNA, 13 nt, Human
acuccggcccucc

SEQ ID NO: 2195221 - RNA, 15 nt, Human
acuccggagacaggg

SEQ ID NO: 2195222 - RNA, 16 nt, Human
acuccggagacagggu

SEQ ID NO: 2195223 - RNA, 23 nt, Human
acuccggagugagaagcuuugcc

SEQ ID NO: 2195224 - RNA, 21 nt, Human
acucccuucuaccugccacuc

SEQ ID NO: 2195225 - RNA, 14 nt, Human
acuccgcuggaggu

SEQ ID NO: 2195226 - RNA, 22 nt, Human
acuccgcuggagguggggccug

SEQ ID NO: 2195227 - RNA, 14 nt, Human
acuccggagacagg

SEQ ID NO: 2195228 - RNA, 14 nt, Human
acucccuuucaaca

SEQ ID NO: 2195229 - RNA, 22 nt, Human
acuccgagaggugggccagucu

SEQ ID NO: 2195230 - RNA, 23 nt, Human
acuccgagaggugggccagucug

SEQ ID NO: 2195231 - RNA, 17 nt, Human
acucccuucuaccugcc

SEQ ID NO: 2195232 - RNA, 18 nt, Human
acucccuucuaccugcca

SEQ ID NO: 2195233 - RNA, 19 nt, Human
acucccuucuaccugccac

SEQ ID NO: 2195234 - RNA, 20 nt, Human
acucccuucuaccugccacu

SEQ ID NO: 2195235 - RNA, 22 nt, Human
acucccuccucaccucuggacu

SEQ ID NO: 2195236 - RNA, 20 nt, Human
acucccuccucaccucugga

SEQ ID NO: 2195237 - RNA, 19 nt, Human
acucccuccucaccucugg

SEQ ID NO: 2195238 - RNA, 16 nt, Human
acucccuccucaccuc

SEQ ID NO: 2195239 - RNA, 15 nt, Human
acucccuccucaccu

SEQ ID NO: 2195240 - RNA, 22 nt, Human
acucccauuccugaagaaccag

SEQ ID NO: 2195241 - RNA, 15 nt, Human
acucccuucccauaa

SEQ ID NO: 2195242 - RNA, 21 nt, Human
acucccuucccaugacccagg

SEQ ID NO: 2195243 - RNA, 23 nt, Human
acucccuucccaugacccaggcu

SEQ ID NO: 2195244 - RNA, 15 nt, Human
acucccuucuaccug

SEQ ID NO: 2195245 - RNA, 18 nt, Human
acucccuggcucucagaa

SEQ ID NO: 2195246 - RNA, 13 nt, Human
acucccuucccau

SEQ ID NO: 2195247 - RNA, 17 nt, Human
acucccuggcucucaga

SEQ ID NO: 2195248 - RNA, 18 nt, Human
acucccugccccccagcc

SEQ ID NO: 2195249 - RNA, 21 nt, Human
acucccucgucgagcuggaug

SEQ ID NO: 2195250 - RNA, 22 nt, Human
acucccaguccaaauguccucc

SEQ ID NO: 2195251 - RNA, 13 nt, Human
acucccaggcagc

SEQ ID NO: 2195252 - RNA, 20 nt, Human
acucccauuccugaagaacc

SEQ ID NO: 2195253 - RNA, 16 nt, Human
acucccauuccugaag

SEQ ID NO: 2195254 - RNA, 13 nt, Human
acucccauuccug

SEQ ID NO: 2195255 - RNA, 17 nt, Human
acucccagacacccacc

SEQ ID NO: 2195256 - RNA, 17 nt, Human
acucccacuucccugac

SEQ ID NO: 2195257 - RNA, 20 nt, Human
acucccacuucccugacacu

SEQ ID NO: 2195258 - RNA, 14 nt, Human
acucccacuucccu

SEQ ID NO: 2195259 - RNA, 16 nt, Human
acucccacuucccuga

SEQ ID NO: 2195260 - RNA, 22 nt, Human
acucccaucugugaaaggaaag

SEQ ID NO: 2195261 - RNA, 17 nt, Human
acuccaugagcacccca

SEQ ID NO: 2195262 - RNA, 21 nt, Human
acuccaugcuuagucacugcc

SEQ ID NO: 2195263 - RNA, 17 nt, Human
acuccaugagaagccgu

SEQ ID NO: 2195264 - RNA, 13 nt, Human
acuccaugagcac

SEQ ID NO: 2195265 - RNA, 15 nt, Human
acucccaagcuggac

SEQ ID NO: 2195266 - RNA, 14 nt, Human
acucccaaguaugg

SEQ ID NO: 2195267 - RNA, 23 nt, Human
acucccaaguaugggguucaaga

SEQ ID NO: 2195268 - RNA, 19 nt, Human
acucccaagucuacagagu

SEQ ID NO: 2195269 - RNA, 16 nt, Human
acucccacacccaaga

SEQ ID NO: 2195270 - RNA, 14 nt, Human
acuccggcccuccu

SEQ ID NO: 2195271 - RNA, 18 nt, Human
acuccggagugagaagcu

SEQ ID NO: 2195272 - RNA, 15 nt, Human
acuccggcccuccua

SEQ ID NO: 2195273 - RNA, 19 nt, Human
acuccggccugaugacaga

SEQ ID NO: 2195274 - RNA, 23 nt, Human
acuccggccugaugacagagcga

SEQ ID NO: 2195275 - RNA, 16 nt, Human
acuccggugugccugc

SEQ ID NO: 2195276 - RNA, 15 nt, Human
acuccggugugccug

SEQ ID NO: 2195277 - RNA, 17 nt, Human
acuccggggagcgcccg

SEQ ID NO: 2195278 - RNA, 20 nt, Human
acuccggugugccugcagcc

SEQ ID NO: 2195279 - RNA, 19 nt, Human
acuccggugugccugcagc

SEQ ID NO: 2195280 - RNA, 21 nt, Human
acuccggugugccugcagccc

SEQ ID NO: 2195281 - RNA, 15 nt, Human
acuccgucucaagga

SEQ ID NO: 2195282 - RNA, 22 nt, Human
acuccggguuugagauggacac

SEQ ID NO: 2195283 - RNA, 15 nt, Human
acuccguuggccacu

SEQ ID NO: 2195284 - RNA, 17 nt, Human
acuccguuggccacucc

SEQ ID NO: 2195285 - RNA, 16 nt, Human
acuccgucucaaggaa

SEQ ID NO: 2195286 - RNA, 18 nt, Human
acuccguuggccacuccg

SEQ ID NO: 2195287 - RNA, 21 nt, Human
acuccguuggccacuccgaga

SEQ ID NO: 2195288 - RNA, 15 nt, Human
acucuacagaggcca

SEQ ID NO: 2195289 - RNA, 16 nt, Human
acucuacacugugaac

SEQ ID NO: 2195290 - RNA, 14 nt, Human
acucuaccagacug

SEQ ID NO: 2195291 - RNA, 13 nt, Human
acucuacauaauu

SEQ ID NO: 2195292 - RNA, 19 nt, Human
acucuacauaauuuagagu

SEQ ID NO: 2195293 - RNA, 12 nt, Human
acucuaaaagau

SEQ ID NO: 2195294 - RNA, 14 nt, Human
acucuaaaagaucc

SEQ ID NO: 2195295 - RNA, 15 nt, Human
acucuaaaagauccu

SEQ ID NO: 2195296 - RNA, 21 nt, Human
acucuaaaagauccuuuuuaa

SEQ ID NO: 2195297 - RNA, 15 nt, Human
acucuaaaagguuca

SEQ ID NO: 2195298 - RNA, 16 nt, Human
acucuaaaagguucag

SEQ ID NO: 2195299 - RNA, 18 nt, Human
acucuaaaagguucaggg

SEQ ID NO: 2195300 - RNA, 19 nt, Human
acucuaaaagguucaggga

SEQ ID NO: 2195301 - RNA, 14 nt, Human
acucguuaauuugu

SEQ ID NO: 2195302 - RNA, 19 nt, Human
acucguuaauuuguagugu

SEQ ID NO: 2195303 - RNA, 13 nt, Human
acugauuuccuuu

SEQ ID NO: 2195304 - RNA, 14 nt, Human
acugauuuccuuug

SEQ ID NO: 2195305 - RNA, 16 nt, Human
acugauuuggagauau

SEQ ID NO: 2195306 - RNA, 22 nt, Human
acugauuuuguuauuuuuauau

SEQ ID NO: 2195307 - RNA, 14 nt, Human
acugauuuuuguaa

SEQ ID NO: 2195308 - RNA, 16 nt, Human
acugauuuuuuuuucc

SEQ ID NO: 2195309 - RNA, 17 nt, Human
acugauuuuuuuuuccu

SEQ ID NO: 2195310 - RNA, 18 nt, Human
acugauuuuuuuuuccuu

SEQ ID NO: 2195311 - RNA, 19 nt, Human
acugauuuuuuuuuccuuc

SEQ ID NO: 2195312 - RNA, 20 nt, Human
acugauuuuuuuuuccuuca

SEQ ID NO: 2195313 - RNA, 15 nt, Human
acugaucacaaaaac

SEQ ID NO: 2195314 - RNA, 18 nt, Human
acugaucaugcauuguug

SEQ ID NO: 2195315 - RNA, 16 nt, Human
acugaucaugcauugu

SEQ ID NO: 2195316 - RNA, 15 nt, Human
acugaucaugcauug

SEQ ID NO: 2195317 - RNA, 17 nt, Human
acugauccagcccugag

SEQ ID NO: 2195318 - RNA, 16 nt, Human
acugauccagcccuga

SEQ ID NO: 2195319 - RNA, 17 nt, Human
acugauauauuuuacaa

SEQ ID NO: 2195320 - RNA, 22 nt, Human
acugacauguggggccagguca

SEQ ID NO: 2195321 - RNA, 20 nt, Human
acugacaggcagccuggaca

SEQ ID NO: 2195322 - RNA, 19 nt, Human
acugauaugggucuugaua

SEQ ID NO: 2195323 - RNA, 20 nt, Human
acugauguaugaggaauuuc

SEQ ID NO: 2195324 - RNA, 17 nt, Human
acugaucaugcauuguu

SEQ ID NO: 2195325 - RNA, 23 nt, Human
acugaugggcaacccccagccug

SEQ ID NO: 2195326 - RNA, 21 nt, Human
acugauguuacaucacagugu

SEQ ID NO: 2195327 - RNA, 22 nt, Human
acugauguuacaucacaguguu

SEQ ID NO: 2195328 - RNA, 14 nt, Human
acugauuacugccu

SEQ ID NO: 2195329 - RNA, 17 nt, Human
acugaauuguccccagu

SEQ ID NO: 2195330 - RNA, 23 nt, Human
acugaauuucuuuugccguuauu

SEQ ID NO: 2195331 - RNA, 16 nt, Human
acugacacccauguuu

SEQ ID NO: 2195332 - RNA, 21 nt, Human
acugacacccauguuucucug

SEQ ID NO: 2195333 - RNA, 22 nt, Human
acugacacccauguuucucugg

SEQ ID NO: 2195334 - RNA, 23 nt, Human
acugacacaaaaaguagauuaag

SEQ ID NO: 2195335 - RNA, 18 nt, Human
acugacagccucccaccc

SEQ ID NO: 2195336 - RNA, 21 nt, Human
acugacaggcagccuggacau

SEQ ID NO: 2195337 - RNA, 12 nt, Human
acugacaugugg

SEQ ID NO: 2195338 - RNA, 18 nt, Human
acugacauguggggccag

SEQ ID NO: 2195339 - RNA, 17 nt, Human
acugacaccuuugcagg

SEQ ID NO: 2195340 - RNA, 20 nt, Human
acugacaccuuugcaggcau

SEQ ID NO: 2195341 - RNA, 17 nt, Human
acugacauuguuggcca

SEQ ID NO: 2195342 - RNA, 18 nt, Human
acugacauuguuggccaa

SEQ ID NO: 2195343 - RNA, 22 nt, Human
acugaaugcuucugacuucaua

SEQ ID NO: 2195344 - RNA, 21 nt, Human
acugaaugccucaaugugacc

SEQ ID NO: 2195345 - RNA, 16 nt, Human
acugaaugcucugugc

SEQ ID NO: 2195346 - RNA, 19 nt, Human
acugaauguuuauuccuug

SEQ ID NO: 2195347 - RNA, 23 nt, Human
acugaaugaaacccccacacaca

SEQ ID NO: 2195348 - RNA, 20 nt, Human
acugaaugaggucagcaugu

SEQ ID NO: 2195349 - RNA, 12 nt, Human
acugaaugaggu

SEQ ID NO: 2195350 - RNA, 19 nt, Human
acucuacccucccaccccc

SEQ ID NO: 2195351 - RNA, 18 nt, Human
acucuacccucccacccc

SEQ ID NO: 2195352 - RNA, 16 nt, Human
acucuacccucccacc

SEQ ID NO: 2195353 - RNA, 15 nt, Human
acucuacccucccac

SEQ ID NO: 2195354 - RNA, 13 nt, Human
acucuacccuccc

SEQ ID NO: 2195355 - RNA, 19 nt, Human
acucuacccauauuacaga

SEQ ID NO: 2195356 - RNA, 17 nt, Human
acucuacccauauuaca

SEQ ID NO: 2195357 - RNA, 19 nt, Human
acucuaccagacuguguau

SEQ ID NO: 2195358 - RNA, 22 nt, Human
acugaauuaaugacagagccag

SEQ ID NO: 2195359 - RNA, 21 nt, Human
acugaauuaaucaucuauaaa

SEQ ID NO: 2195360 - RNA, 13 nt, Human
acugaauuaauca

SEQ ID NO: 2195361 - RNA, 12 nt, Human
acugaauuucuu

SEQ ID NO: 2195362 - RNA, 19 nt, Human
acugaauuauaagaggcug

SEQ ID NO: 2195363 - RNA, 23 nt, Human
acugaauuauaagaggcugauaa

SEQ ID NO: 2195364 - RNA, 15 nt, Human
acugauuuuugugau

SEQ ID NO: 2195365 - RNA, 15 nt, Human
acugauuuuuguaag

SEQ ID NO: 2195366 - RNA, 18 nt, Human
acugauuuuuguaagaca

SEQ ID NO: 2195367 - RNA, 19 nt, Human
acugauuuuuguaagacaa

SEQ ID NO: 2195368 - RNA, 14 nt, Human
acugauuuuuguga

SEQ ID NO: 2195369 - RNA, 22 nt, Human
aggaaaaaaaucguccagggag

SEQ ID NO: 2195370 - RNA, 15 nt, Human
aggaaaaaaaugacu

SEQ ID NO: 2195371 - RNA, 14 nt, Human
aggaaaaaaaugac

SEQ ID NO: 2195372 - RNA, 23 nt, Human
aggaaaaaauguuggauuuauaa

SEQ ID NO: 2195373 - RNA, 17 nt, Human
aggaaaaacacaagcaa

SEQ ID NO: 2195374 - RNA, 19 nt, Human
aggaaaaacacaagcaaaa

SEQ ID NO: 2195375 - RNA, 19 nt, Human
aggaaaaccaagccguggc

SEQ ID NO: 2195376 - RNA, 13 nt, Human
aggaaaaacaggu

SEQ ID NO: 2195377 - RNA, 15 nt, Human
aggaaaaauguguaa

SEQ ID NO: 2195378 - RNA, 19 nt, Human
aggaaaaauguguaauuuu

SEQ ID NO: 2195379 - RNA, 18 nt, Human
aggaaaaaauaacaauga

SEQ ID NO: 2195380 - RNA, 21 nt, Human
aggaaaaaaaucguccaggga

SEQ ID NO: 2195381 - RNA, 18 nt, Human
agcuuuuuuacacaaaug

SEQ ID NO: 2195382 - RNA, 21 nt, Human
agcuuuuuuccuuaauccagc

SEQ ID NO: 2195383 - RNA, 14 nt, Human
agcuuuuuucuuua

SEQ ID NO: 2195384 - RNA, 17 nt, Human
agcuuuuugucuuuucu

SEQ ID NO: 2195385 - RNA, 21 nt, Human
agcuuuguuuguugucagcug

SEQ ID NO: 2195386 - RNA, 22 nt, Human
agcuuuguuuguugucagcuga

SEQ ID NO: 2195387 - RNA, 19 nt, Human
agcuuuguuucaaccaagu

SEQ ID NO: 2195388 - RNA, 18 nt, Human
agcuuuguucuucuuaaa

SEQ ID NO: 2195389 - RNA, 12 nt, Human
agcuuuguucuu

SEQ ID NO: 2195390 - RNA, 21 nt, Human
agcuuugugacuguauauaaa

SEQ ID NO: 2195391 - RNA, 13 nt, Human
aggaagaaaucac

SEQ ID NO: 2195392 - RNA, 15 nt, Human
aggaagaaaucacag

SEQ ID NO: 2195393 - RNA, 14 nt, Human
aggaacuuccaggu

SEQ ID NO: 2195394 - RNA, 19 nt, Human
aggaacauaugaaaauaca

SEQ ID NO: 2195395 - RNA, 23 nt, Human
aggaacacccgacuccucaaaag

SEQ ID NO: 2195396 - RNA, 16 nt, Human
aggaacauaugaaaau

SEQ ID NO: 2195397 - RNA, 23 nt, Human
aggaacuuaaauaaugugaaacu

SEQ ID NO: 2195398 - RNA, 21 nt, Human
aggaacagcuaugggagcccc

SEQ ID NO: 2195399 - RNA, 21 nt, Human
aggaacagaaggaugaaugag

SEQ ID NO: 2195400 - RNA, 14 nt, Human
aggaacagaaggau

SEQ ID NO: 2195401 - RNA, 13 nt, Human
aggaacagaagga

SEQ ID NO: 2195402 - RNA, 15 nt, Human
aggaacacuccuuca

SEQ ID NO: 2195403 - RNA, 20 nt, Human
aggaaaaccaagccguggcu

SEQ ID NO: 2195404 - RNA, 21 nt, Human
aggaaaaccaagccguggcuu

SEQ ID NO: 2195405 - RNA, 22 nt, Human
aggaaaaccaagccguggcuuc

SEQ ID NO: 2195406 - RNA, 23 nt, Human
aggaaaaccaagccguggcuucc

SEQ ID NO: 2195407 - RNA, 12 nt, Human
aggaacacuccu

SEQ ID NO: 2195408 - RNA, 23 nt, Human
aggaagaauuuuaaaaaugaauc

SEQ ID NO: 2195409 - RNA, 17 nt, Human
aggaagaauuuuaaaaa

SEQ ID NO: 2195410 - RNA, 20 nt, Human
aggaagaauuuuaaaaauga

SEQ ID NO: 2195411 - RNA, 14 nt, Human
aggaagguagaaau

SEQ ID NO: 2195412 - RNA, 16 nt, Human
aggaagaagcuuaggc

SEQ ID NO: 2195413 - RNA, 17 nt, Human
aggaagaagcuuaggca

SEQ ID NO: 2195414 - RNA, 18 nt, Human
aggaagaagcuuaggcag

SEQ ID NO: 2195415 - RNA, 15 nt, Human
aggaagaauuuuaaa

SEQ ID NO: 2195416 - RNA, 20 nt, Human
aggaagaagcuuaggcaggg

SEQ ID NO: 2195417 - RNA, 21 nt, Human
aggaagaacacccucuaaaug

SEQ ID NO: 2195418 - RNA, 12 nt, Human
aggaagaacggg

SEQ ID NO: 2195419 - RNA, 18 nt, Human
aggaagaacggggcucuu

SEQ ID NO: 2195420 - RNA, 22 nt, Human
aggaagaacggggcucuucuca

SEQ ID NO: 2195421 - RNA, 15 nt, Human
aggaagguggauggc

SEQ ID NO: 2195422 - RNA, 16 nt, Human
aggaagguggauggcc

SEQ ID NO: 2195423 - RNA, 21 nt, Human
aggaagguucuggugugaacu

SEQ ID NO: 2195424 - RNA, 16 nt, Human
aggaagguucuggugu

SEQ ID NO: 2195425 - RNA, 14 nt, Human
aggaagguucuggu

SEQ ID NO: 2195426 - RNA, 14 nt, Human
aggaaggugguggg

SEQ ID NO: 2195427 - RNA, 11 nt, Human
aggaaguacug

SEQ ID NO: 2195428 - RNA, 15 nt, Human
aggaaguacuggaga

SEQ ID NO: 2195429 - RNA, 15 nt, Human
agcuguauugaauca

SEQ ID NO: 2195430 - RNA, 16 nt, Human
agcuguauugaaucau

SEQ ID NO: 2195431 - RNA, 11 nt, Human
agcuguauuga

SEQ ID NO: 2195432 - RNA, 17 nt, Human
agcugguuagaaaugca

SEQ ID NO: 2195433 - RNA, 19 nt, Human
agcuguauugaaucaugua

SEQ ID NO: 2195434 - RNA, 17 nt, Human
agcuguaugauucccag

SEQ ID NO: 2195435 - RNA, 18 nt, Human
agcuguaugauucccagc

SEQ ID NO: 2195436 - RNA, 21 nt, Human
agcuggugguaucugaguuga

SEQ ID NO: 2195437 - RNA, 15 nt, Human
agcuggugggaagcg

SEQ ID NO: 2195438 - RNA, 13 nt, Human
agcuggugggaag

SEQ ID NO: 2195439 - RNA, 12 nt, Human
agcuggugguuu

SEQ ID NO: 2195440 - RNA, 14 nt, Human
agcuggugguuuca

SEQ ID NO: 2195441 - RNA, 16 nt, Human
agcuggugguuucacg

SEQ ID NO: 2195442 - RNA, 18 nt, Human
agcuggugucugauuguu

SEQ ID NO: 2195443 - RNA, 15 nt, Human
agcugguuagaaaug

SEQ ID NO: 2195444 - RNA, 15 nt, Human
agcugguaguuagua

SEQ ID NO: 2195445 - RNA, 20 nt, Human
agcugguaaucuugcucugc

SEQ ID NO: 2195446 - RNA, 18 nt, Human
agcugcgcuugcuuuucu

SEQ ID NO: 2195447 - RNA, 20 nt, Human
agcuggguuggaaaacagua

SEQ ID NO: 2195448 - RNA, 16 nt, Human
agcuggguuggaaaac

SEQ ID NO: 2195449 - RNA, 14 nt, Human
agcuggguuggaaa

SEQ ID NO: 2195450 - RNA, 21 nt, Human
agcugguaguuaguagcaugu

SEQ ID NO: 2195451 - RNA, 19 nt, Human
agcugguaguuaguagcau

SEQ ID NO: 2195452 - RNA, 22 nt, Human
agcugguaguuaguagcauguu

SEQ ID NO: 2195453 - RNA, 15 nt, Human
agcuggucccacuca

SEQ ID NO: 2195454 - RNA, 22 nt, Human
agcugccuugagccuuaaaacc

SEQ ID NO: 2195455 - RNA, 17 nt, Human
agcugcgcuugcuuuuc

SEQ ID NO: 2195456 - RNA, 20 nt, Human
agcugccuuggcucagacau

SEQ ID NO: 2195457 - RNA, 19 nt, Human
agcugccuuggcucagaca

SEQ ID NO: 2195458 - RNA, 17 nt, Human
agcugccuuggcucaga

SEQ ID NO: 2195459 - RNA, 16 nt, Human
agcugccuuggcucag

SEQ ID NO: 2195460 - RNA, 14 nt, Human
agcugccuuggcuc

SEQ ID NO: 2195461 - RNA, 16 nt, Human
agcugccuucccuagc

SEQ ID NO: 2195462 - RNA, 17 nt, Human
agcugccuucccuagcu

SEQ ID NO: 2195463 - RNA, 18 nt, Human
agcugccuucccuagcuu

SEQ ID NO: 2195464 - RNA, 19 nt, Human
agcugccuucccuagcuuu

SEQ ID NO: 2195465 - RNA, 10 nt, Human
agcugccuuc

SEQ ID NO: 2195466 - RNA, 12 nt, Human
agcugccuuccc

SEQ ID NO: 2195467 - RNA, 13 nt, Human
agcugccuucccu

SEQ ID NO: 2195468 - RNA, 14 nt, Human
agcugccuucccua

SEQ ID NO: 2195469 - RNA, 20 nt, Human
agcugcugaaacaacaaaua

SEQ ID NO: 2195470 - RNA, 16 nt, Human
agcugcugaaacaaca

SEQ ID NO: 2195471 - RNA, 15 nt, Human
agcugcugaaacaac

SEQ ID NO: 2195472 - RNA, 14 nt, Human
agcugcugaaacaa

SEQ ID NO: 2195473 - RNA, 19 nt, Human
agcugacgaacuuccaugg

SEQ ID NO: 2195474 - RNA, 22 nt, Human
agcucuuuggcagucuauaugu

SEQ ID NO: 2195475 - RNA, 23 nt, Human
agcucuuuccuccuuccauggaa

SEQ ID NO: 2195476 - RNA, 22 nt, Human
agcucuuuccuccuuccaugga

SEQ ID NO: 2195477 - RNA, 21 nt, Human
agcugaccucuguuguccucc

SEQ ID NO: 2195478 - RNA, 22 nt, Human
agcugaccucuguuguccuccc

SEQ ID NO: 2195479 - RNA, 21 nt, Human
agcugacuuuucuguccgagc

SEQ ID NO: 2195480 - RNA, 15 nt, Human
agcugacuuuucugu

SEQ ID NO: 2195481 - RNA, 16 nt, Human
agcucuuggcuccacu

SEQ ID NO: 2195482 - RNA, 15 nt, Human
agcucuugcuaauca

SEQ ID NO: 2195483 - RNA, 19 nt, Human
agcucuugcuaaucagugu

SEQ ID NO: 2195484 - RNA, 20 nt, Human
agcucuugcuaaucaguguc

SEQ ID NO: 2195485 - RNA, 21 nt, Human
agcucuugcuaaucagugucu

SEQ ID NO: 2195486 - RNA, 15 nt, Human
agcuccucugggcag

SEQ ID NO: 2195487 - RNA, 18 nt, Human
agcucuugcccuucccug

SEQ ID NO: 2195488 - RNA, 14 nt, Human
agcuccucugggca

SEQ ID NO: 2195489 - RNA, 12 nt, Human
agcuccucuggg

SEQ ID NO: 2195490 - RNA, 19 nt, Human
agcucuugcccuucccugu

SEQ ID NO: 2195491 - RNA, 21 nt, Human
agcucuugcccuucccugucc

SEQ ID NO: 2195492 - RNA, 22 nt, Human
agcucuugcccuucccuguccc

SEQ ID NO: 2195493 - RNA, 13 nt, Human
agcucuugcuaau

SEQ ID NO: 2195494 - RNA, 17 nt, Human
agcucuuuccuccuucc

SEQ ID NO: 2195495 - RNA, 15 nt, Human
agcucuuuccuccuu

SEQ ID NO: 2195496 - RNA, 13 nt, Human
agcucuuuccucc

SEQ ID NO: 2195497 - RNA, 23 nt, Human
agcucuugcuaaucagugucuca

SEQ ID NO: 2195498 - RNA, 12 nt, Human
agcucuuuccuc

SEQ ID NO: 2195499 - RNA, 21 nt, Human
agcucuugugaggaaagucau

SEQ ID NO: 2195500 - RNA, 12 nt, Human
agcucuugugag

SEQ ID NO: 2195501 - RNA, 13 nt, Human
agcucuugugagg

SEQ ID NO: 2195502 - RNA, 16 nt, Human
agcucuugugaggaaa

SEQ ID NO: 2195503 - RNA, 17 nt, Human
agcucuugugaggaaag

SEQ ID NO: 2195504 - RNA, 24 nt, Human
agcuccucuccccagcccagagac

SEQ ID NO: 2195505 - RNA, 13 nt, Human
agcuccucuccug

SEQ ID NO: 2195506 - RNA, 14 nt, Human
agcuccucuccugg

SEQ ID NO: 2195507 - RNA, 15 nt, Human
agcuccucuccugga

SEQ ID NO: 2195508 - RNA, 16 nt, Human
agcuccucuccuggag

SEQ ID NO: 2195509 - RNA, 17 nt, Human
agcuccucuccuggagg

SEQ ID NO: 2195510 - RNA, 18 nt, Human
agcuccucuccuggagga

SEQ ID NO: 2195511 - RNA, 23 nt, Human
agcuccucuccccagcccagaga

SEQ ID NO: 2195512 - RNA, 22 nt, Human
agcuccucuccccagcccagag

SEQ ID NO: 2195513 - RNA, 21 nt, Human
agcuccucuccccagcccaga

SEQ ID NO: 2195514 - RNA, 20 nt, Human
agcuccucuccccagcccag

SEQ ID NO: 2195515 - RNA, 19 nt, Human
agcuccucuccccagccca

SEQ ID NO: 2195516 - RNA, 18 nt, Human
agcuccucuccccagccc

SEQ ID NO: 2195517 - RNA, 17 nt, Human
agcuccucuccccagcc

SEQ ID NO: 2195518 - RNA, 16 nt, Human
agcuccucuccccagc

SEQ ID NO: 2195519 - RNA, 17 nt, Human
agcuccucgagggcagg

SEQ ID NO: 2195520 - RNA, 20 nt, Human
agcuccucgagggcagggac

SEQ ID NO: 2195521 - RNA, 23 nt, Human
agcucacaguuccucgcccuggg

SEQ ID NO: 2195522 - RNA, 21 nt, Human
agcucacaguuccucgcccug

SEQ ID NO: 2195523 - RNA, 17 nt, Human
agcucacccaauaaaca

SEQ ID NO: 2195524 - RNA, 22 nt, Human
agcucaccagccccagugccca

SEQ ID NO: 2195525 - RNA, 23 nt, Human
agcucaccagccccagugcccac

SEQ ID NO: 2195526 - RNA, 15 nt, Human
agccuuucuuuugga

SEQ ID NO: 2195527 - RNA, 23 nt, Human
agccuuuccauaaggaauguagc

SEQ ID NO: 2195528 - RNA, 16 nt, Human
agccuuucucccaggc

SEQ ID NO: 2195529 - RNA, 22 nt, Human
agccuuuccauaaggaauguag

SEQ ID NO: 2195530 - RNA, 14 nt, Human
agccuuuccauaag

SEQ ID NO: 2195531 - RNA, 18 nt, Human
agccugggcagccaggcu

SEQ ID NO: 2195532 - RNA, 17 nt, Human
agccugggcagccaggc

SEQ ID NO: 2195533 - RNA, 20 nt, Human
agccuugugucuacagagaa

SEQ ID NO: 2195534 - RNA, 13 nt, Human
agccuuuaaugca

SEQ ID NO: 2195535 - RNA, 23 nt, Human
agccuugugucuacagagaaccu

SEQ ID NO: 2195536 - RNA, 14 nt, Human
agccuuuaaugcau

SEQ ID NO: 2195537 - RNA, 15 nt, Human
agccuuuaaugcauc

SEQ ID NO: 2195538 - RNA, 12 nt, Human
agcgaaacuccg

SEQ ID NO: 2195539 - RNA, 18 nt, Human
agcgaaccaauauuugua

SEQ ID NO: 2195540 - RNA, 16 nt, Human
agccuuugccuccccg

SEQ ID NO: 2195541 - RNA, 21 nt, Human
agccuuugaauaaaaaugcac

SEQ ID NO: 2195542 - RNA, 15 nt, Human
agccuuugccucccc

SEQ ID NO: 2195543 - RNA, 11 nt, Human
agccuuugaau

SEQ ID NO: 2195544 - RNA, 16 nt, Human
agccuuuuucuaggcc

SEQ ID NO: 2195545 - RNA, 15 nt, Human
agccugggcagccag

SEQ ID NO: 2195546 - RNA, 20 nt, Human
agccugggcagcauagcaag

SEQ ID NO: 2195547 - RNA, 17 nt, Human
agccugggcagcauagc

SEQ ID NO: 2195548 - RNA, 20 nt, Human
agccugggcaacagagcaag

SEQ ID NO: 2195549 - RNA, 18 nt, Human
agccugggcaaugugaua

SEQ ID NO: 2195550 - RNA, 20 nt, Human
agccugggaggucaaggcug

SEQ ID NO: 2195551 - RNA, 18 nt, Human
agccugggcaacagagca

SEQ ID NO: 2195552 - RNA, 17 nt, Human
agccugggcaacagagc

SEQ ID NO: 2195553 - RNA, 15 nt, Human
agccugggcaacaga

SEQ ID NO: 2195554 - RNA, 18 nt, Human
agccuggccagacacagg

SEQ ID NO: 2195555 - RNA, 16 nt, Human
agccuggccagacaca

SEQ ID NO: 2195556 - RNA, 15 nt, Human
agccuggccagacac

SEQ ID NO: 2195557 - RNA, 14 nt, Human
agccuggccagaca

SEQ ID NO: 2195558 - RNA, 22 nt, Human
agccuggccagacacaggcccu

SEQ ID NO: 2195559 - RNA, 21 nt, Human
agccuggccagacacaggccc

SEQ ID NO: 2195560 - RNA, 17 nt, Human
agccuggccagccuaca

SEQ ID NO: 2195561 - RNA, 12 nt, Human
agccuggcccag

SEQ ID NO: 2195562 - RNA, 13 nt, Human
agccuggcccagc

SEQ ID NO: 2195563 - RNA, 17 nt, Human
agccuggccccaugguc

SEQ ID NO: 2195564 - RNA, 16 nt, Human
agccuggccccauggu

SEQ ID NO: 2195565 - RNA, 18 nt, Human
agccuggcccagcucccc

SEQ ID NO: 2195566 - RNA, 14 nt, Human
agccuggcccagcu

SEQ ID NO: 2195567 - RNA, 15 nt, Human
agccuggcccagcuc

SEQ ID NO: 2195568 - RNA, 16 nt, Human
agccuggcccagcucc

SEQ ID NO: 2195569 - RNA, 17 nt, Human
agccuggcccagcuccc

SEQ ID NO: 2195570 - RNA, 12 nt, Human
agccugcugcau

SEQ ID NO: 2195571 - RNA, 10 nt, Human
agccugcugg

SEQ ID NO: 2195572 - RNA, 17 nt, Human
agccugcuggcacccac

SEQ ID NO: 2195573 - RNA, 11 nt, Human
agccugcuggc

SEQ ID NO: 2195574 - RNA, 18 nt, Human
agccugcuggcacccacc

SEQ ID NO: 2195575 - RNA, 20 nt, Human
agccugcuggucacagccuc

SEQ ID NO: 2195576 - RNA, 21 nt, Human
agccugcuggucacagccucc

SEQ ID NO: 2195577 - RNA, 22 nt, Human
agccugcuggucacagccuccu

SEQ ID NO: 2195578 - RNA, 23 nt, Human
agccugcuggucacagccuccuc

SEQ ID NO: 2195579 - RNA, 11 nt, Human
agccugcugca

SEQ ID NO: 2195580 - RNA, 17 nt, Human
agccugcugccugcuuu

SEQ ID NO: 2195581 - RNA, 14 nt, Human
agccuggacccugu

SEQ ID NO: 2195582 - RNA, 14 nt, Human
agccugcuuuuuaa

SEQ ID NO: 2195583 - RNA, 15 nt, Human
agccuggacccccag

SEQ ID NO: 2195584 - RNA, 19 nt, Human
agccuggaacaucaucaag

SEQ ID NO: 2195585 - RNA, 20 nt, Human
agccuggaacaucaucaagg

SEQ ID NO: 2195586 - RNA, 21 nt, Human
agccuggaacaucaucaaggc

SEQ ID NO: 2195587 - RNA, 16 nt, Human
agccuggacccccagc

SEQ ID NO: 2195588 - RNA, 17 nt, Human
agccuggacccccagcu

SEQ ID NO: 2195589 - RNA, 18 nt, Human
agccuggacccccagcuu

SEQ ID NO: 2195590 - RNA, 11 nt, Human
agccuggagaa

SEQ ID NO: 2195591 - RNA, 13 nt, Human
agccuggagaagc

SEQ ID NO: 2195592 - RNA, 14 nt, Human
agccuggagaagcu

SEQ ID NO: 2195593 - RNA, 14 nt, Human
agccuggccaacau

SEQ ID NO: 2195594 - RNA, 20 nt, Human
agccuggcacagggcagugg

SEQ ID NO: 2195595 - RNA, 13 nt, Human
agccuggccagac

SEQ ID NO: 2195596 - RNA, 12 nt, Human
agccuggccaga

SEQ ID NO: 2195597 - RNA, 23 nt, Human
agccuggaggccgggugcucagg

SEQ ID NO: 2195598 - RNA, 11 nt, Human
agccuggaggc

SEQ ID NO: 2195599 - RNA, 17 nt, Human
agccuggcacagggcag

SEQ ID NO: 2195600 - RNA, 18 nt, Human
agccuggcacagggcagu

SEQ ID NO: 2195601 - RNA, 21 nt, Human
agcuacaccuuucuccuuugu

SEQ ID NO: 2195602 - RNA, 22 nt, Human
agcuacaccuuucuccuuugua

SEQ ID NO: 2195603 - RNA, 16 nt, Human
agcucacacaugagau

SEQ ID NO: 2195604 - RNA, 20 nt, Human
agcucacaguuccucgcccu

SEQ ID NO: 2195605 - RNA, 21 nt, Human
agcucacaauaaaaauggcuc

SEQ ID NO: 2195606 - RNA, 13 nt, Human
agcuacaaaugca

SEQ ID NO: 2195607 - RNA, 13 nt, Human
agcucaccagccc

SEQ ID NO: 2195608 - RNA, 14 nt, Human
agcucaccagcccc

SEQ ID NO: 2195609 - RNA, 15 nt, Human
agcucaccagcccca

SEQ ID NO: 2195610 - RNA, 21 nt, Human
agcucaccagccccagugccc

SEQ ID NO: 2195611 - RNA, 19 nt, Human
agcuaaggacauuucccag

SEQ ID NO: 2195612 - RNA, 16 nt, Human
agcuaaggacauuucc

SEQ ID NO: 2195613 - RNA, 18 nt, Human
agcuaagcuaggaaugaa

SEQ ID NO: 2195614 - RNA, 16 nt, Human
agcuaagaaccuggaa

SEQ ID NO: 2195615 - RNA, 14 nt, Human
agcuaagaaccugg

SEQ ID NO: 2195616 - RNA, 17 nt, Human
agcuaagaaccuggaac

SEQ ID NO: 2195617 - RNA, 17 nt, Human
agcuaagcuaggaauga

SEQ ID NO: 2195618 - RNA, 23 nt, Human
agcuaaucuguagggcuggaccu

SEQ ID NO: 2195619 - RNA, 19 nt, Human
agcuaaucuguagggcugg

SEQ ID NO: 2195620 - RNA, 20 nt, Human
agcuaaucuguagggcugga

SEQ ID NO: 2195621 - RNA, 19 nt, Human
agcuaagugaaaaggucau

SEQ ID NO: 2195622 - RNA, 13 nt, Human
agcuaaucuguag

SEQ ID NO: 2195623 - RNA, 17 nt, Human
agcuaaucuguagggcu

SEQ ID NO: 2195624 - RNA, 13 nt, Human
agcuaaugggaca

SEQ ID NO: 2195625 - RNA, 14 nt, Human
agcuaaugggacac

SEQ ID NO: 2195626 - RNA, 15 nt, Human
agcuaaugggacacu

SEQ ID NO: 2195627 - RNA, 12 nt, Human
agcuacaaaugc

SEQ ID NO: 2195628 - RNA, 17 nt, Human
agcgauucuucugcuuc

SEQ ID NO: 2195629 - RNA, 19 nt, Human
agcgauucuucugcuucag

SEQ ID NO: 2195630 - RNA, 15 nt, Human
agcgauucuucugcu

SEQ ID NO: 2195631 - RNA, 14 nt, Human
agcgacaaagauga

SEQ ID NO: 2195632 - RNA, 15 nt, Human
agcgacaaagaugau

SEQ ID NO: 2195633 - RNA, 15 nt, Human
agcgacagugagacu

SEQ ID NO: 2195634 - RNA, 13 nt, Human
agcgacagugaga

SEQ ID NO: 2195635 - RNA, 16 nt, Human
agcgaauuuuaaaaga

SEQ ID NO: 2195636 - RNA, 15 nt, Human
agcgaauuuuaaaag

SEQ ID NO: 2195637 - RNA, 13 nt, Human
agcgaauuuuaaa

SEQ ID NO: 2195638 - RNA, 12 nt, Human
agcgaagggagu

SEQ ID NO: 2195639 - RNA, 16 nt, Human
agcgaacuugacaauu

SEQ ID NO: 2195640 - RNA, 20 nt, Human
agcgaaugcuaggucucgga

SEQ ID NO: 2195641 - RNA, 23 nt, Human
agcuaacccccuucuacugagcc

SEQ ID NO: 2195642 - RNA, 22 nt, Human
agcuaacauuuuaaauaaaaga

SEQ ID NO: 2195643 - RNA, 18 nt, Human
agcuaacauuuuaaauaa

SEQ ID NO: 2195644 - RNA, 20 nt, Human
agcuaacauuuuaaauaaaa

SEQ ID NO: 2195645 - RNA, 23 nt, Human
agcuaacauuuuaaauaaaagaa

SEQ ID NO: 2195646 - RNA, 14 nt, Human
agcuaagaaaagau

SEQ ID NO: 2195647 - RNA, 13 nt, Human
agcuaagaaauaa

SEQ ID NO: 2195648 - RNA, 15 nt, Human
agcuaagaaauaaaa

SEQ ID NO: 2195649 - RNA, 19 nt, Human
agcuaagaaauaaaacugu

SEQ ID NO: 2195650 - RNA, 13 nt, Human
agcuaagaaccug

SEQ ID NO: 2195651 - RNA, 12 nt, Human
agcuaagaaccu

SEQ ID NO: 2195652 - RNA, 20 nt, Human
agcuaacauggaaguacuau

SEQ ID NO: 2195653 - RNA, 17 nt, Human
agcuaacauuuuaaaua

SEQ ID NO: 2195654 - RNA, 19 nt, Human
agcuaacacuggccccuag

SEQ ID NO: 2195655 - RNA, 18 nt, Human
agcuaacacuggccccua

SEQ ID NO: 2195656 - RNA, 17 nt, Human
agcuaacacuggccccu

SEQ ID NO: 2195657 - RNA, 16 nt, Human
agcuaacacuggcccc

SEQ ID NO: 2195658 - RNA, 16 nt, Human
agcuaacacacagcuc

SEQ ID NO: 2195659 - RNA, 17 nt, Human
agcuaacacacagcucc

SEQ ID NO: 2195660 - RNA, 18 nt, Human
agcuaacacacagcuccc

SEQ ID NO: 2195661 - RNA, 19 nt, Human
agcuaacacacagcuccca

SEQ ID NO: 2195662 - RNA, 19 nt, Human
agcuaacauggaaguacua

SEQ ID NO: 2195663 - RNA, 16 nt, Human
agcuaaagcccaaccu

SEQ ID NO: 2195664 - RNA, 21 nt, Human
agcuaaagaggcugaaagagg

SEQ ID NO: 2195665 - RNA, 15 nt, Human
agcuaaagaggcuga

SEQ ID NO: 2195666 - RNA, 13 nt, Human
agcuaaagaggcu

SEQ ID NO: 2195667 - RNA, 13 nt, Human
agcuaaauccuuu

SEQ ID NO: 2195668 - RNA, 18 nt, Human
agcuaaauuacaauuguc

SEQ ID NO: 2195669 - RNA, 17 nt, Human
agcuaaacggauuccaa

SEQ ID NO: 2195670 - RNA, 18 nt, Human
agcuaaacggauuccaaa

SEQ ID NO: 2195671 - RNA, 14 nt, Human
aggcuuacacccac

SEQ ID NO: 2195672 - RNA, 18 nt, Human
aggcuuaauaccugggug

SEQ ID NO: 2195673 - RNA, 19 nt, Human
agggaccaaggaccccuca

SEQ ID NO: 2195674 - RNA, 21 nt, Human
agggacucugaagccucuggg

SEQ ID NO: 2195675 - RNA, 21 nt, Human
agggaccaaggaccccucacc

SEQ ID NO: 2195676 - RNA, 20 nt, Human
agggacucugaagccucugg

SEQ ID NO: 2195677 - RNA, 18 nt, Human
agggaccaaggaccccuc

SEQ ID NO: 2195678 - RNA, 14 nt, Human
agggaccaaggacc

SEQ ID NO: 2195679 - RNA, 19 nt, Human
agggaccaacugggcccaa

SEQ ID NO: 2195680 - RNA, 17 nt, Human
agggaccaacugggccc

SEQ ID NO: 2195681 - RNA, 16 nt, Human
agggaccaacugggcc

SEQ ID NO: 2195682 - RNA, 20 nt, Human
agggacauguuuugauaaag

SEQ ID NO: 2195683 - RNA, 22 nt, Human
agggacauguuuugauaaagua

SEQ ID NO: 2195684 - RNA, 24 nt, Human
agggacauguuuugauaaaguagu

SEQ ID NO: 2195685 - RNA, 23 nt, Human
agggacauauucauuuggaaaua

SEQ ID NO: 2195686 - RNA, 15 nt, Human
agggacauauucauu

SEQ ID NO: 2195687 - RNA, 19 nt, Human
agggacauguuuugauaaa

SEQ ID NO: 2195688 - RNA, 13 nt, Human
agggacauauuca

SEQ ID NO: 2195689 - RNA, 17 nt, Human
agggacaggauaagagg

SEQ ID NO: 2195690 - RNA, 24 nt, Human
aggcuguaucccaugagccucagc

SEQ ID NO: 2195691 - RNA, 17 nt, Human
aggcugccaaggccaga

SEQ ID NO: 2195692 - RNA, 19 nt, Human
aggcugucaauuacaggaa

SEQ ID NO: 2195693 - RNA, 20 nt, Human
aggcuguucccauguagccc

SEQ ID NO: 2195694 - RNA, 12 nt, Human
aggcugucaauu

SEQ ID NO: 2195695 - RNA, 19 nt, Human
aggcugcagugagccgaga

SEQ ID NO: 2195696 - RNA, 17 nt, Human
aggcugcagugagccga

SEQ ID NO: 2195697 - RNA, 21 nt, Human
aggcugcagucagucaugaug

SEQ ID NO: 2195698 - RNA, 14 nt, Human
aggcugaggcagaa

SEQ ID NO: 2195699 - RNA, 23 nt, Human
aggcuguaucccaugagccucag

SEQ ID NO: 2195700 - RNA, 21 nt, Human
aggcucugugcugacccuccu

SEQ ID NO: 2195701 - RNA, 22 nt, Human
aggcucugugcugacccuccug

SEQ ID NO: 2195702 - RNA, 16 nt, Human
aggcucugugcugacc

SEQ ID NO: 2195703 - RNA, 17 nt, Human
aggcucugugcugaccc

SEQ ID NO: 2195704 - RNA, 18 nt, Human
aggcucugugcugacccu

SEQ ID NO: 2195705 - RNA, 16 nt, Human
aggcucuucuccccag

SEQ ID NO: 2195706 - RNA, 17 nt, Human
aggcucuucuccccaga

SEQ ID NO: 2195707 - RNA, 18 nt, Human
aggcucuucuccccagag

SEQ ID NO: 2195708 - RNA, 19 nt, Human
aggcucuuagcagcuucca

SEQ ID NO: 2195709 - RNA, 22 nt, Human
aggcucuuagcagcuuccagau

SEQ ID NO: 2195710 - RNA, 22 nt, Human
aggcucuggagcccacuguacu

SEQ ID NO: 2195711 - RNA, 13 nt, Human
aggcucugugcug

SEQ ID NO: 2195712 - RNA, 18 nt, Human
aggcuagcuucugcuuuu

SEQ ID NO: 2195713 - RNA, 15 nt, Human
aggcuagcuucugcu

SEQ ID NO: 2195714 - RNA, 17 nt, Human
aggcuagcuucugcuuu

SEQ ID NO: 2195715 - RNA, 11 nt, Human
aggcugaggca

SEQ ID NO: 2195716 - RNA, 22 nt, Human
aggcugaggaaaggccagcugg

SEQ ID NO: 2195717 - RNA, 18 nt, Human
aggcugaggcaagagaau

SEQ ID NO: 2195718 - RNA, 13 nt, Human
aggcugaggacuu

SEQ ID NO: 2195719 - RNA, 20 nt, Human
aggcugaggaaaggccagcu

SEQ ID NO: 2195720 - RNA, 19 nt, Human
aggcugaggaaaggccagc

SEQ ID NO: 2195721 - RNA, 18 nt, Human
aggcugaggaaaggccag

SEQ ID NO: 2195722 - RNA, 15 nt, Human
aggcugaggaaaggc

SEQ ID NO: 2195723 - RNA, 11 nt, Human
aggcugaggac

SEQ ID NO: 2195724 - RNA, 13 nt, Human
aggcucuucuccu

SEQ ID NO: 2195725 - RNA, 11 nt, Human
aggcugagccu

SEQ ID NO: 2195726 - RNA, 14 nt, Human
aggcugaggaaagg

SEQ ID NO: 2195727 - RNA, 19 nt, Human
aggcucuucuccccagagu

SEQ ID NO: 2195728 - RNA, 13 nt, Human
aggcugagccuca

SEQ ID NO: 2195729 - RNA, 12 nt, Human
aggccaggguca

SEQ ID NO: 2195730 - RNA, 23 nt, Human
aggccagggcuauagcucaggac

SEQ ID NO: 2195731 - RNA, 20 nt, Human
aggccagggucacugaaggc

SEQ ID NO: 2195732 - RNA, 19 nt, Human
aggcccucugcccacuccc

SEQ ID NO: 2195733 - RNA, 20 nt, Human
aggcccucugcccacucccu

SEQ ID NO: 2195734 - RNA, 20 nt, Human
agggauucugguuccagggu

SEQ ID NO: 2195735 - RNA, 22 nt, Human
agggauuuggggcucagagugg

SEQ ID NO: 2195736 - RNA, 13 nt, Human
agggccuggcuca

SEQ ID NO: 2195737 - RNA, 14 nt, Human
agggccuggcucag

SEQ ID NO: 2195738 - RNA, 19 nt, Human
agggcguggaaaggggcag

SEQ ID NO: 2195739 - RNA, 19 nt, Human
agggcgugacucacccaag

SEQ ID NO: 2195740 - RNA, 17 nt, Human
agggcgugacucaccca

SEQ ID NO: 2195741 - RNA, 13 nt, Human
agggcuaagagcu

SEQ ID NO: 2195742 - RNA, 13 nt, Human
agggcguggaggg

SEQ ID NO: 2195743 - RNA, 14 nt, Human
agggcgugggagcg

SEQ ID NO: 2195744 - RNA, 23 nt, Human
agggcuaagagcuagcgcugccg

SEQ ID NO: 2195745 - RNA, 22 nt, Human
agggcuaagagcuagcgcugcc

SEQ ID NO: 2195746 - RNA, 21 nt, Human
agggcuaagagcuagcgcugc

SEQ ID NO: 2195747 - RNA, 14 nt, Human
agggcuaagagcua

SEQ ID NO: 2195748 - RNA, 19 nt, Human
agggcuacccucccccagg

SEQ ID NO: 2195749 - RNA, 15 nt, Human
agggcuacccugagc

SEQ ID NO: 2195750 - RNA, 16 nt, Human
agggauugcugccacu

SEQ ID NO: 2195751 - RNA, 12 nt, Human
agggauuugagg

SEQ ID NO: 2195752 - RNA, 18 nt, Human
agggccuggcucaggugg

SEQ ID NO: 2195753 - RNA, 19 nt, Human
aggggcauguauuggccug

SEQ ID NO: 2195754 - RNA, 18 nt, Human
aggggcauggccagcagc

SEQ ID NO: 2195755 - RNA, 22 nt, Human
aggggcaucugccccuccccca

SEQ ID NO: 2195756 - RNA, 21 nt, Human
aggggcaucugccccuccccc

SEQ ID NO: 2195757 - RNA, 20 nt, Human
aggggcaucugccccucccc

SEQ ID NO: 2195758 - RNA, 19 nt, Human
aggggcaucugccccuccc

SEQ ID NO: 2195759 - RNA, 17 nt, Human
aggggcaucugccccuc

SEQ ID NO: 2195760 - RNA, 16 nt, Human
aggggcaucugccccu

SEQ ID NO: 2195761 - RNA, 20 nt, Human
agggcuagaaucuggagagc

SEQ ID NO: 2195762 - RNA, 16 nt, Human
agggcuagcaucccug

SEQ ID NO: 2195763 - RNA, 22 nt, Human
agggcuagaaccuguagagcua

SEQ ID NO: 2195764 - RNA, 17 nt, Human
agggcuagaacuggaga

SEQ ID NO: 2195765 - RNA, 18 nt, Human
agggcuagaacuggagag

SEQ ID NO: 2195766 - RNA, 18 nt, Human
agggcuagaaucuggaga

SEQ ID NO: 2195767 - RNA, 19 nt, Human
agggcuauagcucaggacc

SEQ ID NO: 2195768 - RNA, 22 nt, Human
agggcuagugacuuguguccca

SEQ ID NO: 2195769 - RNA, 24 nt, Human
agggcuagugacuugugucccaug

SEQ ID NO: 2195770 - RNA, 23 nt, Human
agggcuacccugagcugaggcag

SEQ ID NO: 2195771 - RNA, 22 nt, Human
agggcuacccugagcugaggca

SEQ ID NO: 2195772 - RNA, 21 nt, Human
agggcuacugcagcuuuacau

SEQ ID NO: 2195773 - RNA, 17 nt, Human
agggcuagaaccuagaa

SEQ ID NO: 2195774 - RNA, 21 nt, Human
agggcuagaaccuagaagggc

SEQ ID NO: 2195775 - RNA, 22 nt, Human
agggcuagaaccuagaagggcu

SEQ ID NO: 2195776 - RNA, 21 nt, Human
agggcuacccugagcugaggc

SEQ ID NO: 2195777 - RNA, 20 nt, Human
agggcuacccugagcugagg

SEQ ID NO: 2195778 - RNA, 18 nt, Human
agggcuacccugagcuga

SEQ ID NO: 2195779 - RNA, 17 nt, Human
agggcuacccugagcug

SEQ ID NO: 2195780 - RNA, 16 nt, Human
agggcuagaaccugga

SEQ ID NO: 2195781 - RNA, 17 nt, Human
agggcuagaaccuggaa

SEQ ID NO: 2195782 - RNA, 18 nt, Human
agggcuagaaccuggaag

SEQ ID NO: 2195783 - RNA, 19 nt, Human
agggcuagaaccuggaagg

SEQ ID NO: 2195784 - RNA, 22 nt, Human
agggcuagaaccuggaagggcu

SEQ ID NO: 2195785 - RNA, 17 nt, Human
agggcuagaaccuggag

SEQ ID NO: 2195786 - RNA, 18 nt, Human
agggcuagaaccuggaga

SEQ ID NO: 2195787 - RNA, 19 nt, Human
agggcuagaaccuggagaa

SEQ ID NO: 2195788 - RNA, 19 nt, Human
agggcuagaaccuggagag

SEQ ID NO: 2195789 - RNA, 20 nt, Human
agggcuagaaccuggagagc

SEQ ID NO: 2195790 - RNA, 18 nt, Human
agggcuagaaccuggagg

SEQ ID NO: 2195791 - RNA, 22 nt, Human
agggcuagaaccuggagggcua

SEQ ID NO: 2195792 - RNA, 22 nt, Human
agggcuagaaccuggagggcug

SEQ ID NO: 2195793 - RNA, 21 nt, Human
agggcuagaaccuggaggggc

SEQ ID NO: 2195794 - RNA, 23 nt, Human
agggcuagaaccuggaggggcua

SEQ ID NO: 2195795 - RNA, 18 nt, Human
agggcuagaaccuggcag

SEQ ID NO: 2195796 - RNA, 22 nt, Human
agggaucugguccuacccaucc

SEQ ID NO: 2195797 - RNA, 19 nt, Human
agggaucuugcauucccag

SEQ ID NO: 2195798 - RNA, 20 nt, Human
agggaucuugcauucccagu

SEQ ID NO: 2195799 - RNA, 15 nt, Human
agggaugacuaaaau

SEQ ID NO: 2195800 - RNA, 22 nt, Human
agggaucuugcauucccagugg

SEQ ID NO: 2195801 - RNA, 17 nt, Human
agggaugaaagagaagg

SEQ ID NO: 2195802 - RNA, 17 nt, Human
agggaugaggugcuggg

SEQ ID NO: 2195803 - RNA, 16 nt, Human
agggaugaggugcugg

SEQ ID NO: 2195804 - RNA, 20 nt, Human
agggaugagcauggagcugg

SEQ ID NO: 2195805 - RNA, 21 nt, Human
agggaugagcauggagcuggc

SEQ ID NO: 2195806 - RNA, 22 nt, Human
agggaugacuaaaauauuuauu

SEQ ID NO: 2195807 - RNA, 18 nt, Human
agggaugaaggccucccu

SEQ ID NO: 2195808 - RNA, 19 nt, Human
agggaugagcauggagcug

SEQ ID NO: 2195809 - RNA, 19 nt, Human
agggaugcugccugaguca

SEQ ID NO: 2195810 - RNA, 18 nt, Human
agggaugcugccugaguc

SEQ ID NO: 2195811 - RNA, 17 nt, Human
agggaugcugccugagu

SEQ ID NO: 2195812 - RNA, 16 nt, Human
agggaugcugccugag

SEQ ID NO: 2195813 - RNA, 22 nt, Human
agggauggaaaaggaagacuag

SEQ ID NO: 2195814 - RNA, 15 nt, Human
agggauggaaaagga

SEQ ID NO: 2195815 - RNA, 21 nt, Human
agggaugcccuggagguggcu

SEQ ID NO: 2195816 - RNA, 13 nt, Human
agggauggacuga

SEQ ID NO: 2195817 - RNA, 17 nt, Human
agggauggacugaugcu

SEQ ID NO: 2195818 - RNA, 18 nt, Human
agggaugccaucuguggg

SEQ ID NO: 2195819 - RNA, 20 nt, Human
agggaugcccuggagguggc

SEQ ID NO: 2195820 - RNA, 19 nt, Human
agggaugcccuggaggugg

SEQ ID NO: 2195821 - RNA, 17 nt, Human
agggaugcccuggaggu

SEQ ID NO: 2195822 - RNA, 15 nt, Human
agggaugcccuggag

SEQ ID NO: 2195823 - RNA, 23 nt, Human
agggaugaggugcugggagggau

SEQ ID NO: 2195824 - RNA, 19 nt, Human
agggaugaggugcugggag

SEQ ID NO: 2195825 - RNA, 16 nt, Human
agggaugaugccacac

SEQ ID NO: 2195826 - RNA, 18 nt, Human
agggaugaugccacacca

SEQ ID NO: 2195827 - RNA, 15 nt, Human
agggaugcauggaga

SEQ ID NO: 2195828 - RNA, 15 nt, Human
agggauucaggcugc

SEQ ID NO: 2195829 - RNA, 14 nt, Human
agggauucaggcug

SEQ ID NO: 2195830 - RNA, 13 nt, Human
agggauggugccc

SEQ ID NO: 2195831 - RNA, 18 nt, Human
agggauucacaucugcau

SEQ ID NO: 2195832 - RNA, 18 nt, Human
agggauucaggcugcuug

SEQ ID NO: 2195833 - RNA, 16 nt, Human
agggauucaggcugcu

SEQ ID NO: 2195834 - RNA, 19 nt, Human
agggauucaggcugcuugg

SEQ ID NO: 2195835 - RNA, 13 nt, Human
agggauggcgggu

SEQ ID NO: 2195836 - RNA, 18 nt, Human
agggauggacugaugcuu

SEQ ID NO: 2195837 - RNA, 16 nt, Human
agggauggauuccaac

SEQ ID NO: 2195838 - RNA, 17 nt, Human
agggauggauuccaacc

SEQ ID NO: 2195839 - RNA, 15 nt, Human
agggauggccguugg

SEQ ID NO: 2195840 - RNA, 19 nt, Human
agggauggccguuggccac

SEQ ID NO: 2195841 - RNA, 18 nt, Human
agggauggcggguggggg

SEQ ID NO: 2195842 - RNA, 17 nt, Human
agggacugagaaauuua

SEQ ID NO: 2195843 - RNA, 14 nt, Human
agggacugaagcca

SEQ ID NO: 2195844 - RNA, 22 nt, Human
agggacucugaagccucuggga

SEQ ID NO: 2195845 - RNA, 15 nt, Human
agggacugagaaauu

SEQ ID NO: 2195846 - RNA, 13 nt, Human
agggacugagaaa

SEQ ID NO: 2195847 - RNA, 14 nt, Human
agggacugagaaau

SEQ ID NO: 2195848 - RNA, 17 nt, Human
aggaguucgaggcugca

SEQ ID NO: 2195849 - RNA, 16 nt, Human
aggaguucgaggcugc

SEQ ID NO: 2195850 - RNA, 22 nt, Human
aggaguucgagaccagccuggc

SEQ ID NO: 2195851 - RNA, 18 nt, Human
aggaguuucguuuucaaa

SEQ ID NO: 2195852 - RNA, 14 nt, Human
aggaguugcuguuu

SEQ ID NO: 2195853 - RNA, 21 nt, Human
aggaguugcuguuuguuugac

SEQ ID NO: 2195854 - RNA, 12 nt, Human
aggauggagggg

SEQ ID NO: 2195855 - RNA, 19 nt, Human
aggaguuucgagguagagu

SEQ ID NO: 2195856 - RNA, 15 nt, Human
aggauggccaguguc

SEQ ID NO: 2195857 - RNA, 19 nt, Human
aggauggaggggugguccu

SEQ ID NO: 2195858 - RNA, 16 nt, Human
aggauggccagugucu

SEQ ID NO: 2195859 - RNA, 18 nt, Human
aggauggccagugucugu

SEQ ID NO: 2195860 - RNA, 19 nt, Human
aggauggccagugucuguc

SEQ ID NO: 2195861 - RNA, 23 nt, Human
aggaguucagggucauagcaugc

SEQ ID NO: 2195862 - RNA, 18 nt, Human
aggaguggaggaggccug

SEQ ID NO: 2195863 - RNA, 19 nt, Human
aggaguucaaugaucuagg

SEQ ID NO: 2195864 - RNA, 21 nt, Human
aggaguucgagaccagccugg

SEQ ID NO: 2195865 - RNA, 16 nt, Human
aggaguucgagaccag

SEQ ID NO: 2195866 - RNA, 20 nt, Human
aggaguuccuugaucuguau

SEQ ID NO: 2195867 - RNA, 19 nt, Human
aggaguuccuaaccagccu

SEQ ID NO: 2195868 - RNA, 14 nt, Human
aggagugagcacua

SEQ ID NO: 2195869 - RNA, 22 nt, Human
aggagugaaaccuuuagggcag

SEQ ID NO: 2195870 - RNA, 23 nt, Human
aggagugaaaccuuuagggcagc

SEQ ID NO: 2195871 - RNA, 17 nt, Human
aggagugagaggggaca

SEQ ID NO: 2195872 - RNA, 14 nt, Human
aggagugagaucau

SEQ ID NO: 2195873 - RNA, 21 nt, Human
aggagugagaucauuuucuua

SEQ ID NO: 2195874 - RNA, 12 nt, Human
aggagugaggaa

SEQ ID NO: 2195875 - RNA, 22 nt, Human
aggagugaggaaggcaggaaga

SEQ ID NO: 2195876 - RNA, 23 nt, Human
aggagguggcagcccuguaggga

SEQ ID NO: 2195877 - RNA, 21 nt, Human
aggagguggcagcccuguagg

SEQ ID NO: 2195878 - RNA, 20 nt, Human
aggagguggcagcccuguag

SEQ ID NO: 2195879 - RNA, 18 nt, Human
aggagguggcagcccugu

SEQ ID NO: 2195880 - RNA, 17 nt, Human
aggagguggcagcccug

SEQ ID NO: 2195881 - RNA, 14 nt, Human
aggagguggcagcc

SEQ ID NO: 2195882 - RNA, 20 nt, Human
aggagguggagguugcagug

SEQ ID NO: 2195883 - RNA, 16 nt, Human
aggaggugccaacagu

SEQ ID NO: 2195884 - RNA, 20 nt, Human
aggagguggaggcugcagug

SEQ ID NO: 2195885 - RNA, 15 nt, Human
aggaggucucuaaga

SEQ ID NO: 2195886 - RNA, 13 nt, Human
aggaggugaggga

SEQ ID NO: 2195887 - RNA, 14 nt, Human
aggaggugagggau

SEQ ID NO: 2195888 - RNA, 15 nt, Human
aggaggugccaacag

SEQ ID NO: 2195889 - RNA, 12 nt, Human
aggagugagcac

SEQ ID NO: 2195890 - RNA, 21 nt, Human
aggaguaaucuguguacaaag

SEQ ID NO: 2195891 - RNA, 18 nt, Human
aggaguacaggugaagca

SEQ ID NO: 2195892 - RNA, 24 nt, Human
aggagucugcacaugcagcugcac

SEQ ID NO: 2195893 - RNA, 18 nt, Human
aggagguuuaggucaaga

SEQ ID NO: 2195894 - RNA, 14 nt, Human
aggagguuuggaug

SEQ ID NO: 2195895 - RNA, 23 nt, Human
aggagguuuggggucugccacca

SEQ ID NO: 2195896 - RNA, 20 nt, Human
aggaguaaucuguguacaaa

SEQ ID NO: 2195897 - RNA, 14 nt, Human
aggagacccacagg

SEQ ID NO: 2195898 - RNA, 17 nt, Human
aggagaccaaggcggga

SEQ ID NO: 2195899 - RNA, 11 nt, Human
aggagacucac

SEQ ID NO: 2195900 - RNA, 21 nt, Human
aggagaccuggcacuggaugc

SEQ ID NO: 2195901 - RNA, 21 nt, Human
aggagacucaccucugccuca

SEQ ID NO: 2195902 - RNA, 19 nt, Human
aggagacucaccucugccu

SEQ ID NO: 2195903 - RNA, 18 nt, Human
aggagacucaccucugcc

SEQ ID NO: 2195904 - RNA, 17 nt, Human
aggagacucaccucugc

SEQ ID NO: 2195905 - RNA, 16 nt, Human
aggagacucaccucug

SEQ ID NO: 2195906 - RNA, 15 nt, Human
aggagacucaccucu

SEQ ID NO: 2195907 - RNA, 14 nt, Human
aggagacucaccuc

SEQ ID NO: 2195908 - RNA, 13 nt, Human
aggagacucaccu

SEQ ID NO: 2195909 - RNA, 16 nt, Human
aggagagcccuucauu

SEQ ID NO: 2195910 - RNA, 14 nt, Human
aggagagccagaga

SEQ ID NO: 2195911 - RNA, 15 nt, Human
aggagagccagagaa

SEQ ID NO: 2195912 - RNA, 21 nt, Human
aggagagccagagaagugaca

SEQ ID NO: 2195913 - RNA, 23 nt, Human
aggagagccagagaagugacagg

SEQ ID NO: 2195914 - RNA, 12 nt, Human
aggagagccaga

SEQ ID NO: 2195915 - RNA, 11 nt, Human
aggagagcagc

SEQ ID NO: 2195916 - RNA, 12 nt, Human
aggagagcagcg

SEQ ID NO: 2195917 - RNA, 14 nt, Human
aggagagaguugaa

SEQ ID NO: 2195918 - RNA, 14 nt, Human
aggaagguuuucuc

SEQ ID NO: 2195919 - RNA, 18 nt, Human
aggaagguuuucuccacu

SEQ ID NO: 2195920 - RNA, 14 nt, Human
aggagaccaaggcg

SEQ ID NO: 2195921 - RNA, 18 nt, Human
aggagacaguucaagaaa

SEQ ID NO: 2195922 - RNA, 19 nt, Human
aggaaguacuggagaaaau

SEQ ID NO: 2195923 - RNA, 13 nt, Human
aggaaguagagga

SEQ ID NO: 2195924 - RNA, 20 nt, Human
aggagagccugcugcauggg

SEQ ID NO: 2195925 - RNA, 18 nt, Human
aggagagccugcugcaug

SEQ ID NO: 2195926 - RNA, 16 nt, Human
aggagagccugcugca

SEQ ID NO: 2195927 - RNA, 15 nt, Human
aggagagccugcugc

SEQ ID NO: 2195928 - RNA, 14 nt, Human
aggagagccugcug

SEQ ID NO: 2195929 - RNA, 13 nt, Human
aggagagccugcu

SEQ ID NO: 2195930 - RNA, 12 nt, Human
aggagagccugc

SEQ ID NO: 2195931 - RNA, 15 nt, Human
aggagagccagcccu

SEQ ID NO: 2195932 - RNA, 14 nt, Human
aggagagccagccc

SEQ ID NO: 2195933 - RNA, 23 nt, Human
aggagggagguauucgugcagca

SEQ ID NO: 2195934 - RNA, 16 nt, Human
aggagagccagcccuc

SEQ ID NO: 2195935 - RNA, 15 nt, Human
aggagggagggggcu

SEQ ID NO: 2195936 - RNA, 19 nt, Human
aggagggaugcugccugag

SEQ ID NO: 2195937 - RNA, 16 nt, Human
aggagggcaagggcca

SEQ ID NO: 2195938 - RNA, 20 nt, Human
aggagggcaagggccaugcu

SEQ ID NO: 2195939 - RNA, 22 nt, Human
aggagggcgugacucacccaag

SEQ ID NO: 2195940 - RNA, 17 nt, Human
aggagggcgugacucac

SEQ ID NO: 2195941 - RNA, 18 nt, Human
aggagggucaggaaggau

SEQ ID NO: 2195942 - RNA, 20 nt, Human
aggagggcccuaccugauug

SEQ ID NO: 2195943 - RNA, 14 nt, Human
aggagggcagcaga

SEQ ID NO: 2195944 - RNA, 18 nt, Human
aggaggguuagggagggg

SEQ ID NO: 2195945 - RNA, 14 nt, Human
aggaggucucuaag

SEQ ID NO: 2195946 - RNA, 22 nt, Human
aggaugggucugguuugcagag

SEQ ID NO: 2195947 - RNA, 19 nt, Human
aggaugucacucagaugga

SEQ ID NO: 2195948 - RNA, 13 nt, Human
aggaugucugggc

SEQ ID NO: 2195949 - RNA, 14 nt, Human
aggaugugauauau

SEQ ID NO: 2195950 - RNA, 18 nt, Human
aggauggcuuugaaugcg

SEQ ID NO: 2195951 - RNA, 22 nt, Human
aggauggccuggccagggccug

SEQ ID NO: 2195952 - RNA, 23 nt, Human
aggauggccuggccagggccugg

SEQ ID NO: 2195953 - RNA, 20 nt, Human
aggauggccagugucugucc

SEQ ID NO: 2195954 - RNA, 13 nt, Human
aggauggccuggc

SEQ ID NO: 2195955 - RNA, 16 nt, Human
aggauggccuggccag

SEQ ID NO: 2195956 - RNA, 17 nt, Human
aggauggccuggccagg

SEQ ID NO: 2195957 - RNA, 12 nt, Human
aggaugggaagg

SEQ ID NO: 2195958 - RNA, 11 nt, Human
aggaugggcuc

SEQ ID NO: 2195959 - RNA, 17 nt, Human
aggaugggaaggaggga

SEQ ID NO: 2195960 - RNA, 19 nt, Human
aggaugggggcuggccucu

SEQ ID NO: 2195961 - RNA, 14 nt, Human
aggaugugugcaug

SEQ ID NO: 2195962 - RNA, 16 nt, Human
aggaugugugcaugug

SEQ ID NO: 2195963 - RNA, 21 nt, Human
aggaugugggggaagaccugg

SEQ ID NO: 2195964 - RNA, 15 nt, Human
aggaugugugcaugu

SEQ ID NO: 2195965 - RNA, 20 nt, Human
aggaugugauuguggaaugg

SEQ ID NO: 2195966 - RNA, 18 nt, Human
aggaugugauauauaagu

SEQ ID NO: 2195967 - RNA, 21 nt, Human
aggaugugauauauaagugua

SEQ ID NO: 2195968 - RNA, 22 nt, Human
aggcaugugccacccacccaac

SEQ ID NO: 2195969 - RNA, 14 nt, Human
aggcaugccugugu

SEQ ID NO: 2195970 - RNA, 13 nt, Human
aggcaugccugug

SEQ ID NO: 2195971 - RNA, 22 nt, Human
aggcaugagggaucacagggcc

SEQ ID NO: 2195972 - RNA, 20 nt, Human
aggcaugagggaucacaggg

SEQ ID NO: 2195973 - RNA, 12 nt, Human
aggcauguucuc

SEQ ID NO: 2195974 - RNA, 23 nt, Human
aggcaugugaugagaggaaauca

SEQ ID NO: 2195975 - RNA, 24 nt, Human
aggcaugugaugagaggaaaucac

SEQ ID NO: 2195976 - RNA, 19 nt, Human
aggcaucugugggcauggu

SEQ ID NO: 2195977 - RNA, 23 nt, Human
aggcaugagggaucacagggccc

SEQ ID NO: 2195978 - RNA, 15 nt, Human
aggcaugagggauca

SEQ ID NO: 2195979 - RNA, 14 nt, Human
aggcaucugcaccc

SEQ ID NO: 2195980 - RNA, 11 nt, Human
aggcaugaagg

SEQ ID NO: 2195981 - RNA, 17 nt, Human
aggcaucgcaauguaag

SEQ ID NO: 2195982 - RNA, 13 nt, Human
aggcauucucuga

SEQ ID NO: 2195983 - RNA, 24 nt, Human
aggcauuccagcuccuccgugcuu

SEQ ID NO: 2195984 - RNA, 12 nt, Human
aggcauucaagu

SEQ ID NO: 2195985 - RNA, 13 nt, Human
aggcauuccagcu

SEQ ID NO: 2195986 - RNA, 12 nt, Human
aggccagcugcu

SEQ ID NO: 2195987 - RNA, 22 nt, Human
aggcauuccccaggaggccagc

SEQ ID NO: 2195988 - RNA, 23 nt, Human
aggcauuccccaggaggccagcc

SEQ ID NO: 2195989 - RNA, 16 nt, Human
aggcaugccuguguga

SEQ ID NO: 2195990 - RNA, 15 nt, Human
aggcaugccugugug

SEQ ID NO: 2195991 - RNA, 14 nt, Human
aggcauuaaauuuu

SEQ ID NO: 2195992 - RNA, 22 nt, Human
aggcauuaaauuuuagcaaaga

SEQ ID NO: 2195993 - RNA, 21 nt, Human
aggcauuccccaggaggccag

SEQ ID NO: 2195994 - RNA, 20 nt, Human
aggcauguucucugaggaca

SEQ ID NO: 2195995 - RNA, 22 nt, Human
aggcauguucucugaggacacu

SEQ ID NO: 2195996 - RNA, 14 nt, Human
aggccaugggccuc

SEQ ID NO: 2195997 - RNA, 16 nt, Human
aggccaugggccuccu

SEQ ID NO: 2195998 - RNA, 17 nt, Human
aggccaugggccuccug

SEQ ID NO: 2195999 - RNA, 17 nt, Human
aggcccucugcccacuc

SEQ ID NO: 2196000 - RNA, 22 nt, Human
aggccaggcuccuuccugucuu

SEQ ID NO: 2196001 - RNA, 17 nt, Human
aggccaggcuccuuccu

SEQ ID NO: 2196002 - RNA, 12 nt, Human
aggccaggcucc

SEQ ID NO: 2196003 - RNA, 15 nt, Human
aggccagggcagagu

SEQ ID NO: 2196004 - RNA, 13 nt, Human
aggccagggcaga

SEQ ID NO: 2196005 - RNA, 11 nt, Human
aggccaggcuc

SEQ ID NO: 2196006 - RNA, 18 nt, Human
aggcauugcacagggaga

SEQ ID NO: 2196007 - RNA, 12 nt, Human
aggccaggccgg

SEQ ID NO: 2196008 - RNA, 23 nt, Human
aggccagggggccagucccugag

SEQ ID NO: 2196009 - RNA, 19 nt, Human
aggccagggggccaguccc

SEQ ID NO: 2196010 - RNA, 23 nt, Human
aggccaugggcacuguggguaga

SEQ ID NO: 2196011 - RNA, 13 nt, Human
aggccagcugcuu

SEQ ID NO: 2196012 - RNA, 14 nt, Human
aggccagcugcuug

SEQ ID NO: 2196013 - RNA, 16 nt, Human
aggccagcugcuuggg

SEQ ID NO: 2196014 - RNA, 16 nt, Human
aggccaggcccucugc

SEQ ID NO: 2196015 - RNA, 17 nt, Human
aggccaggcccucugcc

SEQ ID NO: 2196016 - RNA, 18 nt, Human
aggccaggcccucugccc

SEQ ID NO: 2196017 - RNA, 19 nt, Human
aggccaggcccucugccca

SEQ ID NO: 2196018 - RNA, 23 nt, Human
aggccaggcccucugcccacucc

SEQ ID NO: 2196019 - RNA, 11 nt, Human
aggcagaucca

SEQ ID NO: 2196020 - RNA, 16 nt, Human
aggcagauccaggacu

SEQ ID NO: 2196021 - RNA, 15 nt, Human
aggcagauccaggac

SEQ ID NO: 2196022 - RNA, 14 nt, Human
aggcagccaggcca

SEQ ID NO: 2196023 - RNA, 15 nt, Human
aggcagccaggccac

SEQ ID NO: 2196024 - RNA, 16 nt, Human
aggcagccaggccaca

SEQ ID NO: 2196025 - RNA, 15 nt, Human
aggcagaagaauuga

SEQ ID NO: 2196026 - RNA, 21 nt, Human
aggcagaagaauugaacccag

SEQ ID NO: 2196027 - RNA, 22 nt, Human
aggcagaacucaucuagguaaa

SEQ ID NO: 2196028 - RNA, 13 nt, Human
aggcagauacagg

SEQ ID NO: 2196029 - RNA, 20 nt, Human
aggcagagguugcagugagc

SEQ ID NO: 2196030 - RNA, 22 nt, Human
aggcacuuuagggcuguaaaau

SEQ ID NO: 2196031 - RNA, 19 nt, Human
aggcagaaagcaaaauuau

SEQ ID NO: 2196032 - RNA, 16 nt, Human
aggcagaaagcaaaau

SEQ ID NO: 2196033 - RNA, 14 nt, Human
aggcagaaagcaaa

SEQ ID NO: 2196034 - RNA, 20 nt, Human
aggcacuuuagggcuguaaa

SEQ ID NO: 2196035 - RNA, 16 nt, Human
aggcagaaaauugcac

SEQ ID NO: 2196036 - RNA, 20 nt, Human
agaccuuugaggauaucaaa

SEQ ID NO: 2196037 - RNA, 22 nt, Human
agaccuuguucacacucucaca

SEQ ID NO: 2196038 - RNA, 12 nt, Human
agaccuuuucaa

SEQ ID NO: 2196039 - RNA, 17 nt, Human
agaccuuuucaacuugg

SEQ ID NO: 2196040 - RNA, 18 nt, Human
agacgaaacauuuguucu

SEQ ID NO: 2196041 - RNA, 16 nt, Human
agaccaugcagagcgc

SEQ ID NO: 2196042 - RNA, 17 nt, Human
agaccaugcagagcgcc

SEQ ID NO: 2196043 - RNA, 14 nt, Human
agaccacguuucua

SEQ ID NO: 2196044 - RNA, 23 nt, Human
agaccaucccugaaggccccgcc

SEQ ID NO: 2196045 - RNA, 13 nt, Human
agacagcccucca

SEQ ID NO: 2196046 - RNA, 11 nt, Human
agacagccugu

SEQ ID NO: 2196047 - RNA, 20 nt, Human
agacagccuguaucuugggg

SEQ ID NO: 2196048 - RNA, 14 nt, Human
agaccaccccgccu

SEQ ID NO: 2196049 - RNA, 19 nt, Human
agaccacgcccguccugcc

SEQ ID NO: 2196050 - RNA, 16 nt, Human
agaccaccccgccugc

SEQ ID NO: 2196051 - RNA, 20 nt, Human
agaccacgcccguccugccu

SEQ ID NO: 2196052 - RNA, 21 nt, Human
agaccacgcccguccugccug

SEQ ID NO: 2196053 - RNA, 23 nt, Human
agaccacgcccguccugccugug

SEQ ID NO: 2196054 - RNA, 24 nt, Human
agaccacgcccguccugccugugg

SEQ ID NO: 2196055 - RNA, 21 nt, Human
agacagcccgggcucugccuc

SEQ ID NO: 2196056 - RNA, 14 nt, Human
agacaauuuauuau

SEQ ID NO: 2196057 - RNA, 22 nt, Human
agacagcccgggcucugccucc

SEQ ID NO: 2196058 - RNA, 23 nt, Human
agacagcccgggcucugccuccc

SEQ ID NO: 2196059 - RNA, 17 nt, Human
agacuauauuguacaca

SEQ ID NO: 2196060 - RNA, 15 nt, Human
agacuaucagcccaa

SEQ ID NO: 2196061 - RNA, 22 nt, Human
agacuaguuuuuauuccuugug

SEQ ID NO: 2196062 - RNA, 19 nt, Human
agacuagauugccuuuguu

SEQ ID NO: 2196063 - RNA, 16 nt, Human
agacuagauugccuuu

SEQ ID NO: 2196064 - RNA, 20 nt, Human
agacgcugugcugcccugcc

SEQ ID NO: 2196065 - RNA, 22 nt, Human
agacuagaauucuagugcugcu

SEQ ID NO: 2196066 - RNA, 23 nt, Human
agacuagaauucuagugcugcug

SEQ ID NO: 2196067 - RNA, 17 nt, Human
agacgcugugcugcccu

SEQ ID NO: 2196068 - RNA, 21 nt, Human
agacgacaaggaaaggcaaau

SEQ ID NO: 2196069 - RNA, 15 nt, Human
agacgagaggacgag

SEQ ID NO: 2196070 - RNA, 13 nt, Human
agacgaggcccuc

SEQ ID NO: 2196071 - RNA, 17 nt, Human
agacgaggcccucgggc

SEQ ID NO: 2196072 - RNA, 20 nt, Human
agacgaggcccucgggccca

SEQ ID NO: 2196073 - RNA, 22 nt, Human
agacgaggcccucgggcccagc

SEQ ID NO: 2196074 - RNA, 23 nt, Human
agacgaggcccucgggcccagcc

SEQ ID NO: 2196075 - RNA, 18 nt, Human
agacgcugugcugcccug

SEQ ID NO: 2196076 - RNA, 19 nt, Human
agacgcugugcugcccugc

SEQ ID NO: 2196077 - RNA, 13 nt, Human
agacaauucuuua

SEQ ID NO: 2196078 - RNA, 22 nt, Human
agacaauucuuuauacaacagu

SEQ ID NO: 2196079 - RNA, 14 nt, Human
agacaauucuuuau

SEQ ID NO: 2196080 - RNA, 18 nt, Human
agacaauucuuuauacaa

SEQ ID NO: 2196081 - RNA, 20 nt, Human
agacaaugugaaaagaaaaa

SEQ ID NO: 2196082 - RNA, 23 nt, Human
agacaaugacuuacuguacauga

SEQ ID NO: 2196083 - RNA, 16 nt, Human
agacaagguagcccug

SEQ ID NO: 2196084 - RNA, 13 nt, Human
agacaagcugcaa

SEQ ID NO: 2196085 - RNA, 17 nt, Human
agacaagccuggccuac

SEQ ID NO: 2196086 - RNA, 22 nt, Human
agacaaaaacagccucacagaa

SEQ ID NO: 2196087 - RNA, 17 nt, Human
agacaaaaacagccuca

SEQ ID NO: 2196088 - RNA, 14 nt, Human
agacaagcaacagg

SEQ ID NO: 2196089 - RNA, 19 nt, Human
agacaaggaaaaaauaaca

SEQ ID NO: 2196090 - RNA, 21 nt, Human
agaauuuucagaccccagcgg

SEQ ID NO: 2196091 - RNA, 20 nt, Human
agaauuuucagaccccagcg

SEQ ID NO: 2196092 - RNA, 15 nt, Human
agaauuuugagcagg

SEQ ID NO: 2196093 - RNA, 16 nt, Human
agacaaaaacagccuc

SEQ ID NO: 2196094 - RNA, 14 nt, Human
agagaggcagagag

SEQ ID NO: 2196095 - RNA, 15 nt, Human
agagaggcagagagc

SEQ ID NO: 2196096 - RNA, 16 nt, Human
agagaggcagagagcg

SEQ ID NO: 2196097 - RNA, 13 nt, Human
agagaggcagaga

SEQ ID NO: 2196098 - RNA, 18 nt, Human
agagaggaguucaaugau

SEQ ID NO: 2196099 - RNA, 21 nt, Human
agagaggaguucaaugaucua

SEQ ID NO: 2196100 - RNA, 13 nt, Human
agagaggaguuca

SEQ ID NO: 2196101 - RNA, 14 nt, Human
agagaggaguucaa

SEQ ID NO: 2196102 - RNA, 15 nt, Human
agagaggaguucaau

SEQ ID NO: 2196103 - RNA, 17 nt, Human
agagaggaguucaauga

SEQ ID NO: 2196104 - RNA, 18 nt, Human
agagcccacgcccccacu

SEQ ID NO: 2196105 - RNA, 20 nt, Human
agagaggagucagagagaau

SEQ ID NO: 2196106 - RNA, 13 nt, Human
agagaggagucag

SEQ ID NO: 2196107 - RNA, 17 nt, Human
agagaggagaggagaga

SEQ ID NO: 2196108 - RNA, 14 nt, Human
agagagauguuuug

SEQ ID NO: 2196109 - RNA, 23 nt, Human
agagagcaagacgcugugcugcc

SEQ ID NO: 2196110 - RNA, 11 nt, Human
agagagcaaga

SEQ ID NO: 2196111 - RNA, 19 nt, Human
agagagcaagacgcugugc

SEQ ID NO: 2196112 - RNA, 14 nt, Human
agagcccagccauu

SEQ ID NO: 2196113 - RNA, 21 nt, Human
agagcccagcagggccucaaa

SEQ ID NO: 2196114 - RNA, 22 nt, Human
agagcccagagguaacagaaca

SEQ ID NO: 2196115 - RNA, 24 nt, Human
agagcccagagguaacagaacagc

SEQ ID NO: 2196116 - RNA, 14 nt, Human
agagcccagaggua

SEQ ID NO: 2196117 - RNA, 16 nt, Human
agagcccagagguaac

SEQ ID NO: 2196118 - RNA, 20 nt, Human
agagcccagagguaacagaa

SEQ ID NO: 2196119 - RNA, 17 nt, Human
agagcccacgcccccac

SEQ ID NO: 2196120 - RNA, 13 nt, Human
agagcccagcucc

SEQ ID NO: 2196121 - RNA, 12 nt, Human
agagcccagcuc

SEQ ID NO: 2196122 - RNA, 14 nt, Human
agagcccagcucca

SEQ ID NO: 2196123 - RNA, 11 nt, Human
agagccugagg

SEQ ID NO: 2196124 - RNA, 14 nt, Human
agagccugagggau

SEQ ID NO: 2196125 - RNA, 13 nt, Human
agagccugaggga

SEQ ID NO: 2196126 - RNA, 12 nt, Human
agagccugcugc

SEQ ID NO: 2196127 - RNA, 20 nt, Human
agagccugcucccccacccc

SEQ ID NO: 2196128 - RNA, 19 nt, Human
agagccugcucccccaccc

SEQ ID NO: 2196129 - RNA, 15 nt, Human
agagccugcugcaug

SEQ ID NO: 2196130 - RNA, 11 nt, Human
agagccugcug

SEQ ID NO: 2196131 - RNA, 18 nt, Human
agagccugcucccccacc

SEQ ID NO: 2196132 - RNA, 16 nt, Human
agagccugcuccccca

SEQ ID NO: 2196133 - RNA, 15 nt, Human
agagccugcuccccc

SEQ ID NO: 2196134 - RNA, 13 nt, Human
agagccugcuccc

SEQ ID NO: 2196135 - RNA, 15 nt, Human
agagccugccuggag

SEQ ID NO: 2196136 - RNA, 16 nt, Human
agagccugccuggagc

SEQ ID NO: 2196137 - RNA, 17 nt, Human
agagccugccuggagcg

SEQ ID NO: 2196138 - RNA, 17 nt, Human
agagccugcaggugcug

SEQ ID NO: 2196139 - RNA, 18 nt, Human
agagccugcaggugcugc

SEQ ID NO: 2196140 - RNA, 19 nt, Human
agagccugcaggugcugcu

SEQ ID NO: 2196141 - RNA, 21 nt, Human
agacugaccaauauuguacag

SEQ ID NO: 2196142 - RNA, 18 nt, Human
agagaaaauaaaaaguua

SEQ ID NO: 2196143 - RNA, 19 nt, Human
agagaaaauaaaaaguuaa

SEQ ID NO: 2196144 - RNA, 20 nt, Human
agagaaaauaaaaaguuaaa

SEQ ID NO: 2196145 - RNA, 12 nt, Human
agacugaccaau

SEQ ID NO: 2196146 - RNA, 18 nt, Human
agacugaacuuaccguga

SEQ ID NO: 2196147 - RNA, 23 nt, Human
agacucuuuuuguaccuggugac

SEQ ID NO: 2196148 - RNA, 17 nt, Human
agacugaacauguacac

SEQ ID NO: 2196149 - RNA, 22 nt, Human
agacucuuuuuguaccugguga

SEQ ID NO: 2196150 - RNA, 15 nt, Human
agacucuuugcauau

SEQ ID NO: 2196151 - RNA, 21 nt, Human
agacucuuuuuguaccuggug

SEQ ID NO: 2196152 - RNA, 15 nt, Human
agagaaagaaaauga

SEQ ID NO: 2196153 - RNA, 16 nt, Human
agagaaagaaaaugaa

SEQ ID NO: 2196154 - RNA, 18 nt, Human
agagaaagugauuucuag

SEQ ID NO: 2196155 - RNA, 19 nt, Human
agagaaagugauuucuaga

SEQ ID NO: 2196156 - RNA, 24 nt, Human
agagaaagugggugagaugcugga

SEQ ID NO: 2196157 - RNA, 14 nt, Human
agagaaagaagaga

SEQ ID NO: 2196158 - RNA, 18 nt, Human
agagaaacaauaaagaga

SEQ ID NO: 2196159 - RNA, 20 nt, Human
agagaaccucacgcaccucc

SEQ ID NO: 2196160 - RNA, 20 nt, Human
agagaaccgagcaaagauca

SEQ ID NO: 2196161 - RNA, 21 nt, Human
agagaaccgagcaaagaucaa

SEQ ID NO: 2196162 - RNA, 15 nt, Human
agagaaccgagcaaa

SEQ ID NO: 2196163 - RNA, 17 nt, Human
agagaaccgagcaaaga

SEQ ID NO: 2196164 - RNA, 23 nt, Human
agagaaccucacgcaccucccau

SEQ ID NO: 2196165 - RNA, 22 nt, Human
agagaaccucacgcaccuccca

SEQ ID NO: 2196166 - RNA, 18 nt, Human
agagaaguauacauaagu

SEQ ID NO: 2196167 - RNA, 16 nt, Human
agagaaguauuauaaa

SEQ ID NO: 2196168 - RNA, 14 nt, Human
agagaaauauggaa

SEQ ID NO: 2196169 - RNA, 14 nt, Human
agagaaauaugaag

SEQ ID NO: 2196170 - RNA, 22 nt, Human
agagaauauuagcuuuacuguu

SEQ ID NO: 2196171 - RNA, 12 nt, Human
agagaaucaaca

SEQ ID NO: 2196172 - RNA, 15 nt, Human
agagaaucaacauuu

SEQ ID NO: 2196173 - RNA, 13 nt, Human
agagaauauuuua

SEQ ID NO: 2196174 - RNA, 21 nt, Human
agagagaucaaauggaaagga

SEQ ID NO: 2196175 - RNA, 17 nt, Human
agagagaugggagcucc

SEQ ID NO: 2196176 - RNA, 18 nt, Human
agagagaugggagcuccu

SEQ ID NO: 2196177 - RNA, 19 nt, Human
agagagaugggagcuccuc

SEQ ID NO: 2196178 - RNA, 18 nt, Human
agagaagugccccugcug

SEQ ID NO: 2196179 - RNA, 17 nt, Human
agagaagugccccugcu

SEQ ID NO: 2196180 - RNA, 15 nt, Human
agagaagugccccug

SEQ ID NO: 2196181 - RNA, 14 nt, Human
agagaagugccccu

SEQ ID NO: 2196182 - RNA, 14 nt, Human
agagaagugacagg

SEQ ID NO: 2196183 - RNA, 15 nt, Human
agagaagugacaggg

SEQ ID NO: 2196184 - RNA, 17 nt, Human
agagaagugacagggaa

SEQ ID NO: 2196185 - RNA, 18 nt, Human
agagaagugacagggaag

SEQ ID NO: 2196186 - RNA, 20 nt, Human
agagaagugacagggaagcu

SEQ ID NO: 2196187 - RNA, 16 nt, Human
agacucuuuggacacu

SEQ ID NO: 2196188 - RNA, 11 nt, Human
agaacauagaa

SEQ ID NO: 2196189 - RNA, 14 nt, Human
agaacaucauuaga

SEQ ID NO: 2196190 - RNA, 21 nt, Human
agaacagugcuugccacagag

SEQ ID NO: 2196191 - RNA, 14 nt, Human
agaacaguaaacau

SEQ ID NO: 2196192 - RNA, 15 nt, Human
agaacaguuuguaca

SEQ ID NO: 2196193 - RNA, 17 nt, Human
agaacaguuuguacaga

SEQ ID NO: 2196194 - RNA, 13 nt, Human
agaacaguaaaca

SEQ ID NO: 2196195 - RNA, 22 nt, Human
agaacagugauuaccagggacu

SEQ ID NO: 2196196 - RNA, 23 nt, Human
agaacagccgcuccugucugcca

SEQ ID NO: 2196197 - RNA, 22 nt, Human
agaacagccgcuccugucugcc

SEQ ID NO: 2196198 - RNA, 18 nt, Human
agaacagcagagguucuu

SEQ ID NO: 2196199 - RNA, 12 nt, Human
agaacagcuuca

SEQ ID NO: 2196200 - RNA, 16 nt, Human
agaacaggcaagugaa

SEQ ID NO: 2196201 - RNA, 22 nt, Human
agaacagcuucagguuaucgaa

SEQ ID NO: 2196202 - RNA, 13 nt, Human
agaacagcuucag

SEQ ID NO: 2196203 - RNA, 14 nt, Human
agaacagcuucagg

SEQ ID NO: 2196204 - RNA, 16 nt, Human
agaacagcuucagguu

SEQ ID NO: 2196205 - RNA, 18 nt, Human
agaacagcuucagguuau

SEQ ID NO: 2196206 - RNA, 20 nt, Human
agaacagccgcuccugucug

SEQ ID NO: 2196207 - RNA, 19 nt, Human
agaacagccgcuccugucu

SEQ ID NO: 2196208 - RNA, 18 nt, Human
agaacagccgcuccuguc

SEQ ID NO: 2196209 - RNA, 13 nt, Human
agaacagcagagg

SEQ ID NO: 2196210 - RNA, 23 nt, Human
agaacagcaggguagucugguuu

SEQ ID NO: 2196211 - RNA, 17 nt, Human
agaacacugugaaaaca

SEQ ID NO: 2196212 - RNA, 19 nt, Human
agaacauggacuuguauau

SEQ ID NO: 2196213 - RNA, 18 nt, Human
agaacaucuguccuguga

SEQ ID NO: 2196214 - RNA, 16 nt, Human
agaacauggacuugua

SEQ ID NO: 2196215 - RNA, 13 nt, Human
agaacaugugaga

SEQ ID NO: 2196216 - RNA, 22 nt, Human
agaacaugugagagguuugacu

SEQ ID NO: 2196217 - RNA, 17 nt, Human
agaaccaaaaagaggcu

SEQ ID NO: 2196218 - RNA, 18 nt, Human
agaaccaaaaagaggcua

SEQ ID NO: 2196219 - RNA, 17 nt, Human
agaacaucccugccagc

SEQ ID NO: 2196220 - RNA, 16 nt, Human
agaacaucccugccag

SEQ ID NO: 2196221 - RNA, 18 nt, Human
agaacauccaaggagaaa

SEQ ID NO: 2196222 - RNA, 15 nt, Human
agaacauccaaggag

SEQ ID NO: 2196223 - RNA, 15 nt, Human
agaacaucauuagaa

SEQ ID NO: 2196224 - RNA, 16 nt, Human
agaacaucauuagaac

SEQ ID NO: 2196225 - RNA, 18 nt, Human
agaacaucauuagaacaa

SEQ ID NO: 2196226 - RNA, 20 nt, Human
agaacaucauuagaacaaag

SEQ ID NO: 2196227 - RNA, 19 nt, Human
agaacaucccugccagcuc

SEQ ID NO: 2196228 - RNA, 18 nt, Human
agaacaucccugccagcu

SEQ ID NO: 2196229 - RNA, 20 nt, Human
agaacaucuguauacccucu

SEQ ID NO: 2196230 - RNA, 14 nt, Human
agaacauggacuug

SEQ ID NO: 2196231 - RNA, 13 nt, Human
agaacaucccucc

SEQ ID NO: 2196232 - RNA, 17 nt, Human
agaacaucccuccuggg

SEQ ID NO: 2196233 - RNA, 14 nt, Human
agaacacugugaaa

SEQ ID NO: 2196234 - RNA, 19 nt, Human
agaacagauaaucagugug

SEQ ID NO: 2196235 - RNA, 21 nt, Human
agaacacagccgauucaccug

SEQ ID NO: 2196236 - RNA, 15 nt, Human
agaacacccucuaaa

SEQ ID NO: 2196237 - RNA, 14 nt, Human
agaacacgcuuuca

SEQ ID NO: 2196238 - RNA, 12 nt, Human
agaacacuaacc

SEQ ID NO: 2196239 - RNA, 13 nt, Human
agaacacuaaccu

SEQ ID NO: 2196240 - RNA, 14 nt, Human
agaacacuaaccug

SEQ ID NO: 2196241 - RNA, 17 nt, Human
agaacaauauugacuuu

SEQ ID NO: 2196242 - RNA, 19 nt, Human
agaacaauauugacuuugu

SEQ ID NO: 2196243 - RNA, 19 nt, Human
agaacaagguaguuuuuac

SEQ ID NO: 2196244 - RNA, 17 nt, Human
agaacaagguaguuuuu

SEQ ID NO: 2196245 - RNA, 17 nt, Human
agaacaaccaaaaucuu

SEQ ID NO: 2196246 - RNA, 20 nt, Human
agaacaaagugagacagucc

SEQ ID NO: 2196247 - RNA, 16 nt, Human
agaacacaaggucauu

SEQ ID NO: 2196248 - RNA, 19 nt, Human
agaacacagaaagccuauc

SEQ ID NO: 2196249 - RNA, 21 nt, Human
agaacacagaaagccuaucaa

SEQ ID NO: 2196250 - RNA, 20 nt, Human
agaacaauauugacuuuguc

SEQ ID NO: 2196251 - RNA, 21 nt, Human
agaacaauauugacuuugucu

SEQ ID NO: 2196252 - RNA, 15 nt, Human
agaacaaugugcuau

SEQ ID NO: 2196253 - RNA, 19 nt, Human
agaaucuacccaaaggaua

SEQ ID NO: 2196254 - RNA, 18 nt, Human
agaaucuauauuuaacaa

SEQ ID NO: 2196255 - RNA, 13 nt, Human
agaaucuggagag

SEQ ID NO: 2196256 - RNA, 16 nt, Human
agaaucuggagagcua

SEQ ID NO: 2196257 - RNA, 19 nt, Human
agaaucuguuucccagcag

SEQ ID NO: 2196258 - RNA, 15 nt, Human
agaaucuaaagccag

SEQ ID NO: 2196259 - RNA, 17 nt, Human
agaaucuacccaaagga

SEQ ID NO: 2196260 - RNA, 16 nt, Human
agaaucuaaagccagu

SEQ ID NO: 2196261 - RNA, 17 nt, Human
agaaucucaaauaacua

SEQ ID NO: 2196262 - RNA, 21 nt, Human
agaaucuuuauugagaaagag

SEQ ID NO: 2196263 - RNA, 24 nt, Human
agaaucuuuauugagaaagagcac

SEQ ID NO: 2196264 - RNA, 16 nt, Human
agaaugaaaacucauu

SEQ ID NO: 2196265 - RNA, 17 nt, Human
agaaugaaaauuguaug

SEQ ID NO: 2196266 - RNA, 12 nt, Human
agaaugaaagag

SEQ ID NO: 2196267 - RNA, 19 nt, Human
agaaugaaagaguaaagga

SEQ ID NO: 2196268 - RNA, 14 nt, Human
agaaucuuuagaga

SEQ ID NO: 2196269 - RNA, 23 nt, Human
agaaucuuuagagaaguauacau

SEQ ID NO: 2196270 - RNA, 16 nt, Human
agaaucuuuauugaga

SEQ ID NO: 2196271 - RNA, 17 nt, Human
agaaucuuuauugagaa

SEQ ID NO: 2196272 - RNA, 18 nt, Human
agaaucuuuauugagaaa

SEQ ID NO: 2196273 - RNA, 19 nt, Human
agaaucuuuauugagaaag

SEQ ID NO: 2196274 - RNA, 16 nt, Human
agaaugaggaggaagg

SEQ ID NO: 2196275 - RNA, 13 nt, Human
agaaugaggagga

SEQ ID NO: 2196276 - RNA, 12 nt, Human
agaaugagccuc

SEQ ID NO: 2196277 - RNA, 15 nt, Human
agaaugaaagcuccu

SEQ ID NO: 2196278 - RNA, 21 nt, Human
agaaugaaagaguaaaggaaa

SEQ ID NO: 2196279 - RNA, 16 nt, Human
agaaugaaagggccca

SEQ ID NO: 2196280 - RNA, 16 nt, Human
agaaugagggccaaga

SEQ ID NO: 2196281 - RNA, 17 nt, Human
agaaugaggaggaagga

SEQ ID NO: 2196282 - RNA, 23 nt, Human
agaaugcacaaacagaggccgcc

SEQ ID NO: 2196283 - RNA, 20 nt, Human
agaaugaggcugcuuuccaa

SEQ ID NO: 2196284 - RNA, 14 nt, Human
agaaugaggcugcu

SEQ ID NO: 2196285 - RNA, 13 nt, Human
agaaugaggcugc

SEQ ID NO: 2196286 - RNA, 12 nt, Human
agaaugaggcug

SEQ ID NO: 2196287 - RNA, 18 nt, Human
agaaugcucuuuacuuca

SEQ ID NO: 2196288 - RNA, 13 nt, Human
agaacauuuuaau

SEQ ID NO: 2196289 - RNA, 16 nt, Human
agaacauuuuaauuca

SEQ ID NO: 2196290 - RNA, 18 nt, Human
agaaccaaaaguuuuccu

SEQ ID NO: 2196291 - RNA, 20 nt, Human
agaaccaaaaguuuuccuga

SEQ ID NO: 2196292 - RNA, 21 nt, Human
agaaccaaaaagaggcuaugu

SEQ ID NO: 2196293 - RNA, 17 nt, Human
agaaccaggcaacuugg

SEQ ID NO: 2196294 - RNA, 16 nt, Human
agaaccaagaagggcu

SEQ ID NO: 2196295 - RNA, 18 nt, Human
agaaccaaaucuggaagc

SEQ ID NO: 2196296 - RNA, 13 nt, Human
agaaccaaaucug

SEQ ID NO: 2196297 - RNA, 16 nt, Human
agaaccaaaucuggaa

SEQ ID NO: 2196298 - RNA, 13 nt, Human
agaaccacuauga

SEQ ID NO: 2196299 - RNA, 20 nt, Human
agaaccaggcaacuugggaa

SEQ ID NO: 2196300 - RNA, 20 nt, Human
agaaccaguccccccacccu

SEQ ID NO: 2196301 - RNA, 19 nt, Human
agaaccaguccccccaccc

SEQ ID NO: 2196302 - RNA, 16 nt, Human
agaaccagucccccca

SEQ ID NO: 2196303 - RNA, 22 nt, Human
agaaccaucccuauuuuguauu

SEQ ID NO: 2196304 - RNA, 18 nt, Human
agaaccaguuucaggugu

SEQ ID NO: 2196305 - RNA, 21 nt, Human
agaagacugcauuauauuuau

SEQ ID NO: 2196306 - RNA, 22 nt, Human
agaagagaauauuagcuuuacu

SEQ ID NO: 2196307 - RNA, 13 nt, Human
agaagagcuguuc

SEQ ID NO: 2196308 - RNA, 15 nt, Human
agaagagaaugcaca

SEQ ID NO: 2196309 - RNA, 23 nt, Human
agaagagaaugcacaaacagagg

SEQ ID NO: 2196310 - RNA, 20 nt, Human
agaagagccggagccuccag

SEQ ID NO: 2196311 - RNA, 22 nt, Human
agaagauauuagucuuggggca

SEQ ID NO: 2196312 - RNA, 19 nt, Human
agaagaucacgcuccccgc

SEQ ID NO: 2196313 - RNA, 23 nt, Human
agaagaucacgcuccccgccugu

SEQ ID NO: 2196314 - RNA, 13 nt, Human
agaagauccccuc

SEQ ID NO: 2196315 - RNA, 14 nt, Human
agaagauccccuca

SEQ ID NO: 2196316 - RNA, 17 nt, Human
agaagauccuaaaacaa

SEQ ID NO: 2196317 - RNA, 18 nt, Human
agaagauccuaaaacaaa

SEQ ID NO: 2196318 - RNA, 16 nt, Human
agaagauccuacccca

SEQ ID NO: 2196319 - RNA, 20 nt, Human
agaagagcuguucacagcca

SEQ ID NO: 2196320 - RNA, 16 nt, Human
agaagggagaagaaag

SEQ ID NO: 2196321 - RNA, 13 nt, Human
agaagggagaagg

SEQ ID NO: 2196322 - RNA, 17 nt, Human
agaagaugaucagaccu

SEQ ID NO: 2196323 - RNA, 15 nt, Human
agaagggagaagaaa

SEQ ID NO: 2196324 - RNA, 14 nt, Human
agaagggagaagga

SEQ ID NO: 2196325 - RNA, 11 nt, Human
agaagggaggc

SEQ ID NO: 2196326 - RNA, 18 nt, Human
agaagaugaaugagcaaa

SEQ ID NO: 2196327 - RNA, 13 nt, Human
agaagaugaauac

SEQ ID NO: 2196328 - RNA, 16 nt, Human
agaagaugaucagacc

SEQ ID NO: 2196329 - RNA, 14 nt, Human
agaagaugaauaca

SEQ ID NO: 2196330 - RNA, 19 nt, Human
agaagaugaauacaaacaa

SEQ ID NO: 2196331 - RNA, 14 nt, Human
agaagggagaagaa

SEQ ID NO: 2196332 - RNA, 20 nt, Human
agaagggccaguccugccug

SEQ ID NO: 2196333 - RNA, 19 nt, Human
agaagggccaguccugccu

SEQ ID NO: 2196334 - RNA, 21 nt, Human
agaagggauggauuccaaccc

SEQ ID NO: 2196335 - RNA, 21 nt, Human
agaagggcuagaaccuggagg

SEQ ID NO: 2196336 - RNA, 13 nt, Human
agaagggcuagaa

SEQ ID NO: 2196337 - RNA, 14 nt, Human
agaagggcuagaac

SEQ ID NO: 2196338 - RNA, 21 nt, Human
agaagggcuagaaccuggaga

SEQ ID NO: 2196339 - RNA, 23 nt, Human
agaagggcuagaaccuggagagc

SEQ ID NO: 2196340 - RNA, 17 nt, Human
agaagucaaaguaaaac

SEQ ID NO: 2196341 - RNA, 19 nt, Human
agaagucuuagauguauau

SEQ ID NO: 2196342 - RNA, 17 nt, Human
agaagucuuagauguau

SEQ ID NO: 2196343 - RNA, 15 nt, Human
agaagucuuagacuu

SEQ ID NO: 2196344 - RNA, 21 nt, Human
agaauccuaggcuccacccca

SEQ ID NO: 2196345 - RNA, 20 nt, Human
agaauccuggcccucugugu

SEQ ID NO: 2196346 - RNA, 22 nt, Human
agaauccuggcccucuguguug

SEQ ID NO: 2196347 - RNA, 14 nt, Human
agaagucacacagu

SEQ ID NO: 2196348 - RNA, 20 nt, Human
agaagucaugaagcccaagu

SEQ ID NO: 2196349 - RNA, 13 nt, Human
agcccacccuccu

SEQ ID NO: 2196350 - RNA, 14 nt, Human
agcccacccuccug

SEQ ID NO: 2196351 - RNA, 15 nt, Human
agcccacccuccugu

SEQ ID NO: 2196352 - RNA, 13 nt, Human
agcccaaagaagg

SEQ ID NO: 2196353 - RNA, 23 nt, Human
agcccaccccucaacaccucugc

SEQ ID NO: 2196354 - RNA, 13 nt, Human
agcccaccuuggc

SEQ ID NO: 2196355 - RNA, 16 nt, Human
agcccacccuccuguc

SEQ ID NO: 2196356 - RNA, 17 nt, Human
agcccacccuccugucu

SEQ ID NO: 2196357 - RNA, 18 nt, Human
agcccacccuccugucuu

SEQ ID NO: 2196358 - RNA, 19 nt, Human
agcccacccuccugucuuc

SEQ ID NO: 2196359 - RNA, 23 nt, Human
agcccacccuccugucuucccag

SEQ ID NO: 2196360 - RNA, 21 nt, Human
agcccacccuccugucuuccc

SEQ ID NO: 2196361 - RNA, 17 nt, Human
agcccacgcccccacug

SEQ ID NO: 2196362 - RNA, 18 nt, Human
agcccacgcccccacugg

SEQ ID NO: 2196363 - RNA, 19 nt, Human
agcccacgcccccacuggu

SEQ ID NO: 2196364 - RNA, 23 nt, Human
agccaaggugggcugagcccugg

SEQ ID NO: 2196365 - RNA, 22 nt, Human
agccaaggugggcugagcccug

SEQ ID NO: 2196366 - RNA, 23 nt, Human
agccagcaggcucucaggccagc

SEQ ID NO: 2196367 - RNA, 22 nt, Human
agccagcaggcucucaggccag

SEQ ID NO: 2196368 - RNA, 21 nt, Human
agccagcaggcucucaggcca

SEQ ID NO: 2196369 - RNA, 22 nt, Human
agcccaaaccaccagaagccca

SEQ ID NO: 2196370 - RNA, 20 nt, Human
agcccaaaccaccagaagcc

SEQ ID NO: 2196371 - RNA, 19 nt, Human
agcccaaaccaccagaagc

SEQ ID NO: 2196372 - RNA, 17 nt, Human
agcccaaaccaccagaa

SEQ ID NO: 2196373 - RNA, 17 nt, Human
agccauuuugugaaugg

SEQ ID NO: 2196374 - RNA, 19 nt, Human
agccauuuugugaauggau

SEQ ID NO: 2196375 - RNA, 20 nt, Human
agccauuuuggggggccccc

SEQ ID NO: 2196376 - RNA, 14 nt, Human
agccauuuugugaa

SEQ ID NO: 2196377 - RNA, 15 nt, Human
agccauuuugugaau

SEQ ID NO: 2196378 - RNA, 16 nt, Human
agccauuuugugaaug

SEQ ID NO: 2196379 - RNA, 22 nt, Human
agccaagguuuuauaaggcuga

SEQ ID NO: 2196380 - RNA, 17 nt, Human
agccauuuguuggggca

SEQ ID NO: 2196381 - RNA, 18 nt, Human
agccauuuguuggggcag

SEQ ID NO: 2196382 - RNA, 22 nt, Human
agccauuuguuggggcaguggu

SEQ ID NO: 2196383 - RNA, 20 nt, Human
agccaaggugggcugagccc

SEQ ID NO: 2196384 - RNA, 19 nt, Human
agccaaggugggcugagcc

SEQ ID NO: 2196385 - RNA, 22 nt, Human
agccaaggguucagagacucag

SEQ ID NO: 2196386 - RNA, 15 nt, Human
agccaagggccucuu

SEQ ID NO: 2196387 - RNA, 18 nt, Human
agccaaggguucagagac

SEQ ID NO: 2196388 - RNA, 15 nt, Human
agccaagaggcugca

SEQ ID NO: 2196389 - RNA, 16 nt, Human
agccaagggaaccugu

SEQ ID NO: 2196390 - RNA, 14 nt, Human
agccaagaggcugc

SEQ ID NO: 2196391 - RNA, 17 nt, Human
agccaagggaaccugug

SEQ ID NO: 2196392 - RNA, 19 nt, Human
agccaagggaaccuguguc

SEQ ID NO: 2196393 - RNA, 20 nt, Human
agccaagggaaccugugucc

SEQ ID NO: 2196394 - RNA, 21 nt, Human
agccaagggaaccuguguccg

SEQ ID NO: 2196395 - RNA, 14 nt, Human
agccagauuucacu

SEQ ID NO: 2196396 - RNA, 17 nt, Human
agccagauuucacucuc

SEQ ID NO: 2196397 - RNA, 20 nt, Human
agccagauuucacucuccuu

SEQ ID NO: 2196398 - RNA, 22 nt, Human
agccagauuucacucuccuugg

SEQ ID NO: 2196399 - RNA, 17 nt, Human
agcaucucuugaggcca

SEQ ID NO: 2196400 - RNA, 22 nt, Human
agcaucucccucacugaaacca

SEQ ID NO: 2196401 - RNA, 20 nt, Human
agcaucucccucacugaaac

SEQ ID NO: 2196402 - RNA, 13 nt, Human
agcaucucccagu

SEQ ID NO: 2196403 - RNA, 22 nt, Human
agcaucucuugaggccaggagu

SEQ ID NO: 2196404 - RNA, 19 nt, Human
agcaucucuugaggccagg

SEQ ID NO: 2196405 - RNA, 13 nt, Human
agcaucugcuaau

SEQ ID NO: 2196406 - RNA, 15 nt, Human
agccaacuuuugcau

SEQ ID NO: 2196407 - RNA, 20 nt, Human
agccaacuuguaaauacacc

SEQ ID NO: 2196408 - RNA, 20 nt, Human
agccaacuuggcuuucccgg

SEQ ID NO: 2196409 - RNA, 15 nt, Human
agccaacuuguaaau

SEQ ID NO: 2196410 - RNA, 18 nt, Human
agccaacuuguaaauaca

SEQ ID NO: 2196411 - RNA, 19 nt, Human
agccaacuuguaaauacac

SEQ ID NO: 2196412 - RNA, 12 nt, Human
agccaacuccau

SEQ ID NO: 2196413 - RNA, 13 nt, Human
agccaacugcugc

SEQ ID NO: 2196414 - RNA, 14 nt, Human
agccaacugcugcu

SEQ ID NO: 2196415 - RNA, 21 nt, Human
agccaacugcugcuuuuugag

SEQ ID NO: 2196416 - RNA, 14 nt, Human
agccaacuuggcuu

SEQ ID NO: 2196417 - RNA, 19 nt, Human
agccaacuuggcuuucccg

SEQ ID NO: 2196418 - RNA, 21 nt, Human
agccaacgacaaagccaaacu

SEQ ID NO: 2196419 - RNA, 17 nt, Human
agccaacuauggccugu

SEQ ID NO: 2196420 - RNA, 13 nt, Human
agcaucggaggga

SEQ ID NO: 2196421 - RNA, 14 nt, Human
agcaucucaugagu

SEQ ID NO: 2196422 - RNA, 20 nt, Human
agcaucucagccuaccauga

SEQ ID NO: 2196423 - RNA, 15 nt, Human
agcaucuaucucauc

SEQ ID NO: 2196424 - RNA, 16 nt, Human
agcaucuaugugagac

SEQ ID NO: 2196425 - RNA, 19 nt, Human
agcacagagagggggccac

SEQ ID NO: 2196426 - RNA, 20 nt, Human
agcacagagagggggccacc

SEQ ID NO: 2196427 - RNA, 21 nt, Human
agcacagagagggggccaccu

SEQ ID NO: 2196428 - RNA, 23 nt, Human
agcacagagagggggccaccucc

SEQ ID NO: 2196429 - RNA, 17 nt, Human
agcacagagaagacaaa

SEQ ID NO: 2196430 - RNA, 20 nt, Human
agcacuaaggugugcucuga

SEQ ID NO: 2196431 - RNA, 17 nt, Human
agcacuacucugugcca

SEQ ID NO: 2196432 - RNA, 12 nt, Human
agcacagagagg

SEQ ID NO: 2196433 - RNA, 14 nt, Human
agcaauuuucgaac

SEQ ID NO: 2196434 - RNA, 15 nt, Human
agcacagagaagaca

SEQ ID NO: 2196435 - RNA, 21 nt, Human
agcacagacccugcccugugg

SEQ ID NO: 2196436 - RNA, 22 nt, Human
agcaauuucgccguugaagagg

SEQ ID NO: 2196437 - RNA, 21 nt, Human
agcaauuucgccguugaagag

SEQ ID NO: 2196438 - RNA, 24 nt, Human
agcaauuuaauauuuugcacaguu

SEQ ID NO: 2196439 - RNA, 12 nt, Human
agcaauuuuccu

SEQ ID NO: 2196440 - RNA, 13 nt, Human
agcaauuuuccuu

SEQ ID NO: 2196441 - RNA, 14 nt, Human
agcaauuuuccuug

SEQ ID NO: 2196442 - RNA, 15 nt, Human
agcaauuuuccuuga

SEQ ID NO: 2196443 - RNA, 16 nt, Human
agcaauuuuccuugaa

SEQ ID NO: 2196444 - RNA, 17 nt, Human
agcaauuuuccuugaag

SEQ ID NO: 2196445 - RNA, 18 nt, Human
agcaauuuuccuugaagc

SEQ ID NO: 2196446 - RNA, 19 nt, Human
agcaauuuuccuugaagcc

SEQ ID NO: 2196447 - RNA, 20 nt, Human
agcaauuuuccuugaagccg

SEQ ID NO: 2196448 - RNA, 21 nt, Human
agcaauuuuccuugaagccga

SEQ ID NO: 2196449 - RNA, 23 nt, Human
agcaauuuaauauuuugcacagu

SEQ ID NO: 2196450 - RNA, 20 nt, Human
agcaauuuauacaauaucau

SEQ ID NO: 2196451 - RNA, 20 nt, Human
agcaauucuccugccucagc

SEQ ID NO: 2196452 - RNA, 19 nt, Human
agcaauucuccugccucag

SEQ ID NO: 2196453 - RNA, 18 nt, Human
agcaauucuccugccuca

SEQ ID NO: 2196454 - RNA, 17 nt, Human
agcaauucuccugccuc

SEQ ID NO: 2196455 - RNA, 15 nt, Human
agcaauucuccugcc

SEQ ID NO: 2196456 - RNA, 15 nt, Human
agcaauuccaaccuu

SEQ ID NO: 2196457 - RNA, 23 nt, Human
agcagugccuuccauaauuauga

SEQ ID NO: 2196458 - RNA, 21 nt, Human
agcagcucaggcacacuucuu

SEQ ID NO: 2196459 - RNA, 20 nt, Human
agcagcucaaaggcacagug

SEQ ID NO: 2196460 - RNA, 17 nt, Human
agcagugcaugcugucc

SEQ ID NO: 2196461 - RNA, 15 nt, Human
agcaguggacaccag

SEQ ID NO: 2196462 - RNA, 12 nt, Human
agcaguggacac

SEQ ID NO: 2196463 - RNA, 13 nt, Human
agcagugcaggca

SEQ ID NO: 2196464 - RNA, 15 nt, Human
agcagugcaggcaca

SEQ ID NO: 2196465 - RNA, 14 nt, Human
agcagugcuucuca

SEQ ID NO: 2196466 - RNA, 19 nt, Human
agcaguggacaccaggagu

SEQ ID NO: 2196467 - RNA, 14 nt, Human
agcagugggccugg

SEQ ID NO: 2196468 - RNA, 22 nt, Human
agcaguggcugguccagggcua

SEQ ID NO: 2196469 - RNA, 11 nt, Human
agcaguggcug

SEQ ID NO: 2196470 - RNA, 12 nt, Human
agcaguggcugg

SEQ ID NO: 2196471 - RNA, 13 nt, Human
agcaguggcuggu

SEQ ID NO: 2196472 - RNA, 16 nt, Human
agcaguggcuggucca

SEQ ID NO: 2196473 - RNA, 17 nt, Human
agcaguggcugguccag

SEQ ID NO: 2196474 - RNA, 18 nt, Human
agcaguggcugguccagg

SEQ ID NO: 2196475 - RNA, 19 nt, Human
agcaguggcugguccaggg

SEQ ID NO: 2196476 - RNA, 21 nt, Human
agcaguggcugguccagggcu

SEQ ID NO: 2196477 - RNA, 14 nt, Human
agcagccuguggca

SEQ ID NO: 2196478 - RNA, 13 nt, Human
agcagccuguggc

SEQ ID NO: 2196479 - RNA, 18 nt, Human
agcagcguuucuaugaca

SEQ ID NO: 2196480 - RNA, 19 nt, Human
agcagcguuucuaugacac

SEQ ID NO: 2196481 - RNA, 20 nt, Human
agcagccuggacccugugga

SEQ ID NO: 2196482 - RNA, 23 nt, Human
agcagccugagcaacucuugauu

SEQ ID NO: 2196483 - RNA, 14 nt, Human
agcagcucaggcac

SEQ ID NO: 2196484 - RNA, 13 nt, Human
agcagcucaggca

SEQ ID NO: 2196485 - RNA, 12 nt, Human
agcagcucaggc

SEQ ID NO: 2196486 - RNA, 19 nt, Human
agcagcucaaaggcacagu

SEQ ID NO: 2196487 - RNA, 16 nt, Human
agcagcucaaaggcac

SEQ ID NO: 2196488 - RNA, 15 nt, Human
agcagcucaaaggca

SEQ ID NO: 2196489 - RNA, 19 nt, Human
agcagcuaucucucaguga

SEQ ID NO: 2196490 - RNA, 17 nt, Human
agcagcuaucucucagu

SEQ ID NO: 2196491 - RNA, 11 nt, Human
agcagcuacca

SEQ ID NO: 2196492 - RNA, 18 nt, Human
agcagccuuuaaugcauc

SEQ ID NO: 2196493 - RNA, 16 nt, Human
agcagccuuuaaugca

SEQ ID NO: 2196494 - RNA, 13 nt, Human
agcagugcaugcu

SEQ ID NO: 2196495 - RNA, 16 nt, Human
agcagugcaugcuguc

SEQ ID NO: 2196496 - RNA, 21 nt, Human
agcacuccucgguacucccau

SEQ ID NO: 2196497 - RNA, 13 nt, Human
agcacucccaagu

SEQ ID NO: 2196498 - RNA, 14 nt, Human
agcacucccaaguc

SEQ ID NO: 2196499 - RNA, 19 nt, Human
agcacucccaagucuacag

SEQ ID NO: 2196500 - RNA, 20 nt, Human
agcacucccaagucuacaga

SEQ ID NO: 2196501 - RNA, 17 nt, Human
agcacugacuucuaagu

SEQ ID NO: 2196502 - RNA, 14 nt, Human
agcacucacacagg

SEQ ID NO: 2196503 - RNA, 14 nt, Human
agcacuauacagau

SEQ ID NO: 2196504 - RNA, 16 nt, Human
agcacucacacaggac

SEQ ID NO: 2196505 - RNA, 16 nt, Human
agcacuacauaaacug

SEQ ID NO: 2196506 - RNA, 17 nt, Human
agcacuacauaaacuga

SEQ ID NO: 2196507 - RNA, 21 nt, Human
agcacuacauaaacugacuuu

SEQ ID NO: 2196508 - RNA, 16 nt, Human
agcacugagcaaagca

SEQ ID NO: 2196509 - RNA, 10 nt, Human
agcacugagg

SEQ ID NO: 2196510 - RNA, 11 nt, Human
agcacugagga

SEQ ID NO: 2196511 - RNA, 14 nt, Human
agcacugaggaaga

SEQ ID NO: 2196512 - RNA, 19 nt, Human
agcacugacuucuaaguaa

SEQ ID NO: 2196513 - RNA, 16 nt, Human
agcagccuggacccug

SEQ ID NO: 2196514 - RNA, 21 nt, Human
agcacugaggaagaacggggc

SEQ ID NO: 2196515 - RNA, 13 nt, Human
agcacugauuuca

SEQ ID NO: 2196516 - RNA, 17 nt, Human
agcacugauuucacaac

SEQ ID NO: 2196517 - RNA, 18 nt, Human
agcacugauuucacaaca

SEQ ID NO: 2196518 - RNA, 18 nt, Human
agaucucugcuuuggaaa

SEQ ID NO: 2196519 - RNA, 23 nt, Human
agaucucugcuuuggaaaucaca

SEQ ID NO: 2196520 - RNA, 21 nt, Human
agaucugacaugauuccuucc

SEQ ID NO: 2196521 - RNA, 21 nt, Human
agaucugcagggggugugucu

SEQ ID NO: 2196522 - RNA, 17 nt, Human
agaugggucuggcugag

SEQ ID NO: 2196523 - RNA, 19 nt, Human
agaugggucuggcugagcu

SEQ ID NO: 2196524 - RNA, 21 nt, Human
agaugggucuggcugagcuga

SEQ ID NO: 2196525 - RNA, 22 nt, Human
agaugggucuggcugagcugaa

SEQ ID NO: 2196526 - RNA, 20 nt, Human
agaugggugcuuggaggaag

SEQ ID NO: 2196527 - RNA, 22 nt, Human
agaugggugcuuggaggaagga

SEQ ID NO: 2196528 - RNA, 23 nt, Human
agaugggucuggcugagcugaac

SEQ ID NO: 2196529 - RNA, 19 nt, Human
agauucuacauauucuuua

SEQ ID NO: 2196530 - RNA, 12 nt, Human
agauucuuuccc

SEQ ID NO: 2196531 - RNA, 14 nt, Human
agauucuuuccuga

SEQ ID NO: 2196532 - RNA, 21 nt, Human
agauggcugugccucugccug

SEQ ID NO: 2196533 - RNA, 22 nt, Human
agauggcugugccucugccugu

SEQ ID NO: 2196534 - RNA, 16 nt, Human
agauggggucuguaaa

SEQ ID NO: 2196535 - RNA, 18 nt, Human
agauggggucuguaaaau

SEQ ID NO: 2196536 - RNA, 19 nt, Human
agauggggucuguaaaauc

SEQ ID NO: 2196537 - RNA, 17 nt, Human
agauggcugugccucug

SEQ ID NO: 2196538 - RNA, 18 nt, Human
agauggcugugccucugc

SEQ ID NO: 2196539 - RNA, 19 nt, Human
agauggcugugccucugcc

SEQ ID NO: 2196540 - RNA, 20 nt, Human
agauggcugugccucugccu

SEQ ID NO: 2196541 - RNA, 11 nt, Human
agaugacaaaa

SEQ ID NO: 2196542 - RNA, 15 nt, Human
agaugacauugcuaa

SEQ ID NO: 2196543 - RNA, 21 nt, Human
agaugacauugcuaagaugcu

SEQ ID NO: 2196544 - RNA, 22 nt, Human
agaugacauugcuaagaugcuc

SEQ ID NO: 2196545 - RNA, 18 nt, Human
agaugacaucugucuagg

SEQ ID NO: 2196546 - RNA, 16 nt, Human
agaugaaugccgugga

SEQ ID NO: 2196547 - RNA, 23 nt, Human
agaucugacaugauuccuuccug

SEQ ID NO: 2196548 - RNA, 13 nt, Human
agaugaaucaaug

SEQ ID NO: 2196549 - RNA, 18 nt, Human
agaugaaucaaugggaaa

SEQ ID NO: 2196550 - RNA, 13 nt, Human
agauugaggccug

SEQ ID NO: 2196551 - RNA, 19 nt, Human
agauugaggccugcccuca

SEQ ID NO: 2196552 - RNA, 22 nt, Human
agauugaggccugcccucaggg

SEQ ID NO: 2196553 - RNA, 16 nt, Human
agauugcaacaggcug

SEQ ID NO: 2196554 - RNA, 17 nt, Human
agauugagauguguuca

SEQ ID NO: 2196555 - RNA, 22 nt, Human
agauugagaaguuuuguacaga

SEQ ID NO: 2196556 - RNA, 19 nt, Human
agauugagagaagagacaa

SEQ ID NO: 2196557 - RNA, 18 nt, Human
agauugagagaagagaca

SEQ ID NO: 2196558 - RNA, 15 nt, Human
agauugagaaggaga

SEQ ID NO: 2196559 - RNA, 15 nt, Human
agauugacgacaagu

SEQ ID NO: 2196560 - RNA, 16 nt, Human
agauugagaaggagag

SEQ ID NO: 2196561 - RNA, 17 nt, Human
agauugagaaggagaga

SEQ ID NO: 2196562 - RNA, 18 nt, Human
agauugagaaggagagaa

SEQ ID NO: 2196563 - RNA, 19 nt, Human
agauugagaaggagagaaa

SEQ ID NO: 2196564 - RNA, 18 nt, Human
agauucuuuccugaggcu

SEQ ID NO: 2196565 - RNA, 17 nt, Human
agauugacgacaagugc

SEQ ID NO: 2196566 - RNA, 15 nt, Human
agauucuuuccugag

SEQ ID NO: 2196567 - RNA, 16 nt, Human
agauucuuuccugagg

SEQ ID NO: 2196568 - RNA, 16 nt, Human
agauugcaccacugca

SEQ ID NO: 2196569 - RNA, 17 nt, Human
agauugcaacaggcugg

SEQ ID NO: 2196570 - RNA, 19 nt, Human
agauugcaacaggcugggc

SEQ ID NO: 2196571 - RNA, 21 nt, Human
agauugcgccauugcacucca

SEQ ID NO: 2196572 - RNA, 22 nt, Human
agauugcaugugacucugaagc

SEQ ID NO: 2196573 - RNA, 13 nt, Human
agauugcugaaau

SEQ ID NO: 2196574 - RNA, 23 nt, Human
agauugcaugugacucugaagcu

SEQ ID NO: 2196575 - RNA, 19 nt, Human
agauugcaugugacucuga

SEQ ID NO: 2196576 - RNA, 18 nt, Human
agauugcaugugacucug

SEQ ID NO: 2196577 - RNA, 16 nt, Human
agauugcaugugacuc

SEQ ID NO: 2196578 - RNA, 15 nt, Human
agauugcaugugacu

SEQ ID NO: 2196579 - RNA, 13 nt, Human
agauugcauguga

SEQ ID NO: 2196580 - RNA, 15 nt, Human
agcaaaaucauuuua

SEQ ID NO: 2196581 - RNA, 14 nt, Human
agauugcugaaauu

SEQ ID NO: 2196582 - RNA, 14 nt, Human
agcaaaaucauuuu

SEQ ID NO: 2196583 - RNA, 13 nt, Human
agcaaaauugaug

SEQ ID NO: 2196584 - RNA, 19 nt, Human
agcaaaauugauguguuua

SEQ ID NO: 2196585 - RNA, 19 nt, Human
agcaaauuaauuggcagca

SEQ ID NO: 2196586 - RNA, 21 nt, Human
agcaaauuaauuggcagcaga

SEQ ID NO: 2196587 - RNA, 22 nt, Human
agcaaauuaauuggcagcagau

SEQ ID NO: 2196588 - RNA, 11 nt, Human
agcaaauugau

SEQ ID NO: 2196589 - RNA, 12 nt, Human
agcaaauuuggg

SEQ ID NO: 2196590 - RNA, 20 nt, Human
agcaaaucagaaacuuguga

SEQ ID NO: 2196591 - RNA, 16 nt, Human
agcaaaucagaaacuu

SEQ ID NO: 2196592 - RNA, 19 nt, Human
agcaaauucuguuuuucua

SEQ ID NO: 2196593 - RNA, 13 nt, Human
agcaaauguuucu

SEQ ID NO: 2196594 - RNA, 14 nt, Human
agcaaauguuucug

SEQ ID NO: 2196595 - RNA, 16 nt, Human
agcaaauguuucugca

SEQ ID NO: 2196596 - RNA, 17 nt, Human
agcaaauguuucugcag

SEQ ID NO: 2196597 - RNA, 18 nt, Human
agcaaauguuucugcagu

SEQ ID NO: 2196598 - RNA, 15 nt, Human
agcaaauuaauuggc

SEQ ID NO: 2196599 - RNA, 16 nt, Human
agcaaauuaauuggca

SEQ ID NO: 2196600 - RNA, 19 nt, Human
agcaaauaaacuaggaaau

SEQ ID NO: 2196601 - RNA, 22 nt, Human
agcaaagucuaaaguuuacagu

SEQ ID NO: 2196602 - RNA, 23 nt, Human
agcaaagucuaaaguuuacagua

SEQ ID NO: 2196603 - RNA, 11 nt, Human
agcaaauacau

SEQ ID NO: 2196604 - RNA, 19 nt, Human
agcaaagccccaugcugga

SEQ ID NO: 2196605 - RNA, 23 nt, Human
agcaaaggaguagaaagacagag

SEQ ID NO: 2196606 - RNA, 19 nt, Human
agcaaaggcugagaacacu

SEQ ID NO: 2196607 - RNA, 14 nt, Human
agcaaagucuaaag

SEQ ID NO: 2196608 - RNA, 15 nt, Human
agcaaagucuaaagu

SEQ ID NO: 2196609 - RNA, 20 nt, Human
agcaaagucuaaaguuuaca

SEQ ID NO: 2196610 - RNA, 22 nt, Human
agcaaagcaccagcuucuccag

SEQ ID NO: 2196611 - RNA, 15 nt, Human
agcaaagcaccagcu

SEQ ID NO: 2196612 - RNA, 20 nt, Human
agcaaagauaucucaucucu

SEQ ID NO: 2196613 - RNA, 22 nt, Human
agcaaagagugggcugcaucug

SEQ ID NO: 2196614 - RNA, 12 nt, Human
agcaaagaucaa

SEQ ID NO: 2196615 - RNA, 13 nt, Human
agcaaagaucaaa

SEQ ID NO: 2196616 - RNA, 14 nt, Human
agcaaagaucaaaa

SEQ ID NO: 2196617 - RNA, 15 nt, Human
agcaaagaucaaaau

SEQ ID NO: 2196618 - RNA, 17 nt, Human
agcaaagaucaaaauaa

SEQ ID NO: 2196619 - RNA, 12 nt, Human
agcaaagagugg

SEQ ID NO: 2196620 - RNA, 16 nt, Human
agcaaagagugggcug

SEQ ID NO: 2196621 - RNA, 13 nt, Human
agcaaacuuggaa

SEQ ID NO: 2196622 - RNA, 17 nt, Human
agcaaacucuuuuccca

SEQ ID NO: 2196623 - RNA, 13 nt, Human
agcaaacucuuuu

SEQ ID NO: 2196624 - RNA, 14 nt, Human
agcaaacucugcug

SEQ ID NO: 2196625 - RNA, 15 nt, Human
agcaaacucugcugu

SEQ ID NO: 2196626 - RNA, 23 nt, Human
agcaaaauuuuuucucuaggaaa

SEQ ID NO: 2196627 - RNA, 23 nt, Human
agcaaaauugauguguuuauuua

SEQ ID NO: 2196628 - RNA, 14 nt, Human
agcaaaaugugaau

SEQ ID NO: 2196629 - RNA, 15 nt, Human
agcaaaaugugaaug

SEQ ID NO: 2196630 - RNA, 23 nt, Human
agcaaaaugugaaugggaaaaga

SEQ ID NO: 2196631 - RNA, 13 nt, Human
agcaaacucugcu

SEQ ID NO: 2196632 - RNA, 15 nt, Human
agauauaaaagacug

SEQ ID NO: 2196633 - RNA, 22 nt, Human
agauaggcucugcacagaugga

SEQ ID NO: 2196634 - RNA, 21 nt, Human
agauaggcucugcacagaugg

SEQ ID NO: 2196635 - RNA, 23 nt, Human
agauaguuuugccagaacaguuu

SEQ ID NO: 2196636 - RNA, 15 nt, Human
agauauaaauggcug

SEQ ID NO: 2196637 - RNA, 17 nt, Human
agauauaaauggcuggu

SEQ ID NO: 2196638 - RNA, 20 nt, Human
agauauaacuauugcccagg

SEQ ID NO: 2196639 - RNA, 13 nt, Human
agauauaagugcu

SEQ ID NO: 2196640 - RNA, 15 nt, Human
agauauaagugcugu

SEQ ID NO: 2196641 - RNA, 16 nt, Human
agauaggcucugcaca

SEQ ID NO: 2196642 - RNA, 14 nt, Human
agauaggcucugca

SEQ ID NO: 2196643 - RNA, 13 nt, Human
agauaggcucugc

SEQ ID NO: 2196644 - RNA, 20 nt, Human
agauagauaggucagugcaa

SEQ ID NO: 2196645 - RNA, 20 nt, Human
agauagccaaggccaaagga

SEQ ID NO: 2196646 - RNA, 19 nt, Human
agauagccccacaggaggu

SEQ ID NO: 2196647 - RNA, 18 nt, Human
agaguggucuuucuggag

SEQ ID NO: 2196648 - RNA, 15 nt, Human
agagugguauuugca

SEQ ID NO: 2196649 - RNA, 18 nt, Human
agagugguauuugcagac

SEQ ID NO: 2196650 - RNA, 12 nt, Human
agaguguagaag

SEQ ID NO: 2196651 - RNA, 13 nt, Human
agaguguagaagc

SEQ ID NO: 2196652 - RNA, 14 nt, Human
agaguguagaagca

SEQ ID NO: 2196653 - RNA, 15 nt, Human
agaguguagaagcau

SEQ ID NO: 2196654 - RNA, 16 nt, Human
agaguguagaagcauu

SEQ ID NO: 2196655 - RNA, 17 nt, Human
agaguguagaagcauuc

SEQ ID NO: 2196656 - RNA, 18 nt, Human
agaguguagaagcauucc

SEQ ID NO: 2196657 - RNA, 18 nt, Human
agaguguagaucagagca

SEQ ID NO: 2196658 - RNA, 13 nt, Human
agaguugaagaca

SEQ ID NO: 2196659 - RNA, 13 nt, Human
agaguugaaccua

SEQ ID NO: 2196660 - RNA, 12 nt, Human
agaguugaaccu

SEQ ID NO: 2196661 - RNA, 22 nt, Human
agaguguagaagcauuccuucu

SEQ ID NO: 2196662 - RNA, 16 nt, Human
agauagaagaacugca

SEQ ID NO: 2196663 - RNA, 15 nt, Human
agauagaagaacugc

SEQ ID NO: 2196664 - RNA, 14 nt, Human
agauagaagaacug

SEQ ID NO: 2196665 - RNA, 13 nt, Human
agauagaagaacu

SEQ ID NO: 2196666 - RNA, 13 nt, Human
agaguugagcucu

SEQ ID NO: 2196667 - RNA, 14 nt, Human
agauagagagcuau

SEQ ID NO: 2196668 - RNA, 16 nt, Human
agauagaauuuccaau

SEQ ID NO: 2196669 - RNA, 13 nt, Human
agauagaauuucc

SEQ ID NO: 2196670 - RNA, 14 nt, Human
agaguugaagacag

SEQ ID NO: 2196671 - RNA, 15 nt, Human
agaguugaagacaga

SEQ ID NO: 2196672 - RNA, 16 nt, Human
agaguggguuucacaa

SEQ ID NO: 2196673 - RNA, 22 nt, Human
agagugggggagagcaggcugg

SEQ ID NO: 2196674 - RNA, 19 nt, Human
agagugggguagguuggga

SEQ ID NO: 2196675 - RNA, 22 nt, Human
agaguggccuggccaggagcuc

SEQ ID NO: 2196676 - RNA, 18 nt, Human
agagugggggagagcagg

SEQ ID NO: 2196677 - RNA, 20 nt, Human
agagugggggagagcaggcu

SEQ ID NO: 2196678 - RNA, 15 nt, Human
agaguggcuccuccc

SEQ ID NO: 2196679 - RNA, 19 nt, Human
agaguggccuggccaggag

SEQ ID NO: 2196680 - RNA, 17 nt, Human
agaguggccuggccagg

SEQ ID NO: 2196681 - RNA, 12 nt, Human
agaguggcuccu

SEQ ID NO: 2196682 - RNA, 13 nt, Human
agaguggcuccuc

SEQ ID NO: 2196683 - RNA, 14 nt, Human
agaguggcuccucc

SEQ ID NO: 2196684 - RNA, 20 nt, Human
agagggucugaggaauccag

SEQ ID NO: 2196685 - RNA, 18 nt, Human
agagggucuggagaagca

SEQ ID NO: 2196686 - RNA, 22 nt, Human
agagggugacaagauagagagc

SEQ ID NO: 2196687 - RNA, 19 nt, Human
agagggguggagacugcuu

SEQ ID NO: 2196688 - RNA, 19 nt, Human
agagggguacauuucccug

SEQ ID NO: 2196689 - RNA, 16 nt, Human
agagggguggagacug

SEQ ID NO: 2196690 - RNA, 16 nt, Human
agaguggccuggccag

SEQ ID NO: 2196691 - RNA, 15 nt, Human
agaguggccuggcca

SEQ ID NO: 2196692 - RNA, 14 nt, Human
agaguggccuggcc

SEQ ID NO: 2196693 - RNA, 13 nt, Human
agaguggccuggc

SEQ ID NO: 2196694 - RNA, 22 nt, Human
agagggucuggagaagcaguga

SEQ ID NO: 2196695 - RNA, 23 nt, Human
agaggggguggccucccaacuca

SEQ ID NO: 2196696 - RNA, 20 nt, Human
agagggguacauuucccugu

SEQ ID NO: 2196697 - RNA, 17 nt, Human
agauaugauauguaaac

SEQ ID NO: 2196698 - RNA, 16 nt, Human
agauaugauauguaaa

SEQ ID NO: 2196699 - RNA, 15 nt, Human
agauaugaguuguuu

SEQ ID NO: 2196700 - RNA, 18 nt, Human
agauaugaacauauuguu

SEQ ID NO: 2196701 - RNA, 17 nt, Human
agauaucuugaaaugaa

SEQ ID NO: 2196702 - RNA, 21 nt, Human
agauaucugagggaggaggcc

SEQ ID NO: 2196703 - RNA, 13 nt, Human
agauauauaucau

SEQ ID NO: 2196704 - RNA, 23 nt, Human
agauauaagugcuguauaaaauc

SEQ ID NO: 2196705 - RNA, 21 nt, Human
agauauaagugcuguauaaaa

SEQ ID NO: 2196706 - RNA, 22 nt, Human
agauauaagugcuguauaaaau

SEQ ID NO: 2196707 - RNA, 16 nt, Human
agauauaagugcugua

SEQ ID NO: 2196708 - RNA, 17 nt, Human
agauauaagugcuguau

SEQ ID NO: 2196709 - RNA, 18 nt, Human
agauauaagugcuguaua

SEQ ID NO: 2196710 - RNA, 20 nt, Human
agauauaagugcuguauaaa

SEQ ID NO: 2196711 - RNA, 16 nt, Human
aucaugacauguuaua

SEQ ID NO: 2196712 - RNA, 18 nt, Human
aucaugacauguuauaua

SEQ ID NO: 2196713 - RNA, 23 nt, Human
aucaugagugaauaaaugucuug

SEQ ID NO: 2196714 - RNA, 13 nt, Human
aucaugacauguu

SEQ ID NO: 2196715 - RNA, 16 nt, Human
aucaucuauaaagaag

SEQ ID NO: 2196716 - RNA, 16 nt, Human
aucauccuuuccagca

SEQ ID NO: 2196717 - RNA, 19 nt, Human
aucaugcaaaugcuguauu

SEQ ID NO: 2196718 - RNA, 22 nt, Human
aucaugcaucuuacugaaggua

SEQ ID NO: 2196719 - RNA, 21 nt, Human
aucaugcauguccuguaaagg

SEQ ID NO: 2196720 - RNA, 21 nt, Human
aucaugcauuguugagguggu

SEQ ID NO: 2196721 - RNA, 14 nt, Human
aucaugcauuguug

SEQ ID NO: 2196722 - RNA, 13 nt, Human
aucaugcauuguu

SEQ ID NO: 2196723 - RNA, 12 nt, Human
aucaugcauugu

SEQ ID NO: 2196724 - RNA, 22 nt, Human
aucaugcauuguugaggugguc

SEQ ID NO: 2196725 - RNA, 12 nt, Human
aucaugcccugu

SEQ ID NO: 2196726 - RNA, 19 nt, Human
aucauggaaugguuauaaa

SEQ ID NO: 2196727 - RNA, 20 nt, Human
aucauggaaugguuauaaaa

SEQ ID NO: 2196728 - RNA, 15 nt, Human
aucauccuaagcuau

SEQ ID NO: 2196729 - RNA, 14 nt, Human
aucauccagaaguu

SEQ ID NO: 2196730 - RNA, 13 nt, Human
aucaaauacuuua

SEQ ID NO: 2196731 - RNA, 18 nt, Human
aucaaaguaggcaggacc

SEQ ID NO: 2196732 - RNA, 20 nt, Human
aucaugacaaagacugagua

SEQ ID NO: 2196733 - RNA, 21 nt, Human
aucaugaauuaguuuuauaug

SEQ ID NO: 2196734 - RNA, 12 nt, Human
aucauccuacug

SEQ ID NO: 2196735 - RNA, 11 nt, Human
aucaaauacuu

SEQ ID NO: 2196736 - RNA, 14 nt, Human
aucaucccagcugc

SEQ ID NO: 2196737 - RNA, 13 nt, Human
aucauccuuucca

SEQ ID NO: 2196738 - RNA, 18 nt, Human
aucauccuuuccagcaug

SEQ ID NO: 2196739 - RNA, 19 nt, Human
auccacucugccugcuuac

SEQ ID NO: 2196740 - RNA, 23 nt, Human
auccacuuuaucuugaauaaugu

SEQ ID NO: 2196741 - RNA, 23 nt, Human
auccacucuacccucccaccccc

SEQ ID NO: 2196742 - RNA, 22 nt, Human
auccacucuacccucccacccc

SEQ ID NO: 2196743 - RNA, 21 nt, Human
auccacugugccaugugccag

SEQ ID NO: 2196744 - RNA, 20 nt, Human
auccagauacacccaaagua

SEQ ID NO: 2196745 - RNA, 22 nt, Human
auccagaguuuagaggaaaaaa

SEQ ID NO: 2196746 - RNA, 12 nt, Human
auccacuuugca

SEQ ID NO: 2196747 - RNA, 20 nt, Human
auccagaucauuccucagaa

SEQ ID NO: 2196748 - RNA, 19 nt, Human
auccagccggaggccagag

SEQ ID NO: 2196749 - RNA, 14 nt, Human
auccagccucuccc

SEQ ID NO: 2196750 - RNA, 21 nt, Human
auccagcccugaguuccuagc

SEQ ID NO: 2196751 - RNA, 12 nt, Human
auccagccuggg

SEQ ID NO: 2196752 - RNA, 16 nt, Human
auccagccucuccccu

SEQ ID NO: 2196753 - RNA, 17 nt, Human
auccagccucuccccug

SEQ ID NO: 2196754 - RNA, 21 nt, Human
auccagccucuccccugauua

SEQ ID NO: 2196755 - RNA, 24 nt, Human
auccaggcagucgggggcuggccu

SEQ ID NO: 2196756 - RNA, 19 nt, Human
auccaggcagauccaggac

SEQ ID NO: 2196757 - RNA, 22 nt, Human
auccaggcagauccaggacuau

SEQ ID NO: 2196758 - RNA, 17 nt, Human
auccagccuggggucug

SEQ ID NO: 2196759 - RNA, 21 nt, Human
auccagggacagaggccccag

SEQ ID NO: 2196760 - RNA, 20 nt, Human
auccagggacagaggcccca

SEQ ID NO: 2196761 - RNA, 19 nt, Human
auccagggacagaggcccc

SEQ ID NO: 2196762 - RNA, 16 nt, Human
auccagggacagaggc

SEQ ID NO: 2196763 - RNA, 14 nt, Human
auccagggacagag

SEQ ID NO: 2196764 - RNA, 13 nt, Human
auccagggacaga

SEQ ID NO: 2196765 - RNA, 12 nt, Human
auccagggacag

SEQ ID NO: 2196766 - RNA, 18 nt, Human
auccuuuuucuuuauaaa

SEQ ID NO: 2196767 - RNA, 15 nt, Human
aucgaaccguuuuga

SEQ ID NO: 2196768 - RNA, 20 nt, Human
aucgaaauaacaauguuaag

SEQ ID NO: 2196769 - RNA, 22 nt, Human
aucgaaauaacaauguuaagga

SEQ ID NO: 2196770 - RNA, 13 nt, Human
aucgaaauaacaa

SEQ ID NO: 2196771 - RNA, 17 nt, Human
aucgaaauaacaauguu

SEQ ID NO: 2196772 - RNA, 18 nt, Human
aucgaaauaacaauguua

SEQ ID NO: 2196773 - RNA, 19 nt, Human
aucgaaauaacaauguuaa

SEQ ID NO: 2196774 - RNA, 23 nt, Human
aucgaaauaacaauguuaaggaa

SEQ ID NO: 2196775 - RNA, 21 nt, Human
aucgacuuguuuuugcacaug

SEQ ID NO: 2196776 - RNA, 14 nt, Human
aucgaccugccucg

SEQ ID NO: 2196777 - RNA, 20 nt, Human
aucgaaucuacuaauuccac

SEQ ID NO: 2196778 - RNA, 18 nt, Human
aucgaaucuacuaauucc

SEQ ID NO: 2196779 - RNA, 17 nt, Human
auccuuccucacaccag

SEQ ID NO: 2196780 - RNA, 14 nt, Human
aucccccugcccuc

SEQ ID NO: 2196781 - RNA, 15 nt, Human
aucccccugcccucg

SEQ ID NO: 2196782 - RNA, 14 nt, Human
aucccccuugccac

SEQ ID NO: 2196783 - RNA, 18 nt, Human
aucccccuugccacccca

SEQ ID NO: 2196784 - RNA, 11 nt, Human
auccuuccucc

SEQ ID NO: 2196785 - RNA, 13 nt, Human
auccuuccuccca

SEQ ID NO: 2196786 - RNA, 14 nt, Human
auccuuccuuccca

SEQ ID NO: 2196787 - RNA, 16 nt, Human
auccuuccuucccacc

SEQ ID NO: 2196788 - RNA, 22 nt, Human
auccuuccuucccacccaucgc

SEQ ID NO: 2196789 - RNA, 12 nt, Human
auccuucuaguu

SEQ ID NO: 2196790 - RNA, 13 nt, Human
auccuucuaguuu

SEQ ID NO: 2196791 - RNA, 17 nt, Human
auccuucuaguuuccca

SEQ ID NO: 2196792 - RNA, 19 nt, Human
auccuucuaguuucccaca

SEQ ID NO: 2196793 - RNA, 22 nt, Human
auccuucuaguuucccacaaua

SEQ ID NO: 2196794 - RNA, 11 nt, Human
auccuucugcc

SEQ ID NO: 2196795 - RNA, 13 nt, Human
auccuucugccuu

SEQ ID NO: 2196796 - RNA, 12 nt, Human
auccuugaagau

SEQ ID NO: 2196797 - RNA, 19 nt, Human
aucccccccaccucucccu

SEQ ID NO: 2196798 - RNA, 20 nt, Human
auccccccaucuugcuuccc

SEQ ID NO: 2196799 - RNA, 17 nt, Human
auccccauccuccagcu

SEQ ID NO: 2196800 - RNA, 14 nt, Human
auccccccucacca

SEQ ID NO: 2196801 - RNA, 12 nt, Human
aucccccugccc

SEQ ID NO: 2196802 - RNA, 13 nt, Human
aucccccugcccu

SEQ ID NO: 2196803 - RNA, 12 nt, Human
aucccccagacu

SEQ ID NO: 2196804 - RNA, 12 nt, Human
aucccccagccu

SEQ ID NO: 2196805 - RNA, 15 nt, Human
auccccccaucuugc

SEQ ID NO: 2196806 - RNA, 17 nt, Human
auccccccaucuugcuu

SEQ ID NO: 2196807 - RNA, 18 nt, Human
auccagggaugccaucug

SEQ ID NO: 2196808 - RNA, 15 nt, Human
auccccaguaaaauu

SEQ ID NO: 2196809 - RNA, 21 nt, Human
auccccaguaaaauugccaua

SEQ ID NO: 2196810 - RNA, 19 nt, Human
auccagggcucugaccagu

SEQ ID NO: 2196811 - RNA, 15 nt, Human
auccccauccuccag

SEQ ID NO: 2196812 - RNA, 20 nt, Human
auccccauccuccagcuucu

SEQ ID NO: 2196813 - RNA, 22 nt, Human
aucuaggaagacuuuggaaaga

SEQ ID NO: 2196814 - RNA, 22 nt, Human
auagcaauccauguuaguuuuu

SEQ ID NO: 2196815 - RNA, 23 nt, Human
auagcaaauguuuugacaugaaa

SEQ ID NO: 2196816 - RNA, 22 nt, Human
auagcaagugaauuuuucucua

SEQ ID NO: 2196817 - RNA, 19 nt, Human
auagcaagugaauuuuucu

SEQ ID NO: 2196818 - RNA, 13 nt, Human
auagcaagugaau

SEQ ID NO: 2196819 - RNA, 17 nt, Human
auagcaagauugcuuaa

SEQ ID NO: 2196820 - RNA, 19 nt, Human
auagcaagacacaucccua

SEQ ID NO: 2196821 - RNA, 14 nt, Human
auagcacagacccu

SEQ ID NO: 2196822 - RNA, 16 nt, Human
aucaaacugaagccag

SEQ ID NO: 2196823 - RNA, 15 nt, Human
aucaaacugaagcca

SEQ ID NO: 2196824 - RNA, 14 nt, Human
aucaaacugaagcc

SEQ ID NO: 2196825 - RNA, 19 nt, Human
aucaaagagguuuuaaaaa

SEQ ID NO: 2196826 - RNA, 17 nt, Human
aucaaacugaagccaga

SEQ ID NO: 2196827 - RNA, 12 nt, Human
aucaaaggacac

SEQ ID NO: 2196828 - RNA, 18 nt, Human
aucaaagagagaaaauaa

SEQ ID NO: 2196829 - RNA, 20 nt, Human
aucaaaagguuaauaaagua

SEQ ID NO: 2196830 - RNA, 21 nt, Human
aucaaaaccuuucaaauauca

SEQ ID NO: 2196831 - RNA, 13 nt, Human
aucaaaagacaau

SEQ ID NO: 2196832 - RNA, 14 nt, Human
aucaaaagacaauu

SEQ ID NO: 2196833 - RNA, 15 nt, Human
aucaaaagacaauuc

SEQ ID NO: 2196834 - RNA, 16 nt, Human
aucaaaagacaauucu

SEQ ID NO: 2196835 - RNA, 17 nt, Human
aucaaaagacaauucuu

SEQ ID NO: 2196836 - RNA, 18 nt, Human
aucaaaagacaauucuuu

SEQ ID NO: 2196837 - RNA, 19 nt, Human
aucaaaagacaauucuuua

SEQ ID NO: 2196838 - RNA, 22 nt, Human
aucaaacccggcgguccccucc

SEQ ID NO: 2196839 - RNA, 24 nt, Human
aucaaaagguuaauaaaguaauua

SEQ ID NO: 2196840 - RNA, 21 nt, Human
aucaaaagacaauucuuuaua

SEQ ID NO: 2196841 - RNA, 23 nt, Human
aucaaaagacaauucuuuauaca

SEQ ID NO: 2196842 - RNA, 18 nt, Human
auauuuuuuucuuuucuu

SEQ ID NO: 2196843 - RNA, 15 nt, Human
auauuuuuuuguaga

SEQ ID NO: 2196844 - RNA, 16 nt, Human
aucaaaaauauuccau

SEQ ID NO: 2196845 - RNA, 15 nt, Human
aucaaaacuuucuuu

SEQ ID NO: 2196846 - RNA, 21 nt, Human
aucaaaacuuucuuuucugga

SEQ ID NO: 2196847 - RNA, 14 nt, Human
aucaaaagaaagaa

SEQ ID NO: 2196848 - RNA, 15 nt, Human
augggaauuguguga

SEQ ID NO: 2196849 - RNA, 18 nt, Human
augggaaugaggugggag

SEQ ID NO: 2196850 - RNA, 14 nt, Human
augggaauugugug

SEQ ID NO: 2196851 - RNA, 15 nt, Human
augggacagggagga

SEQ ID NO: 2196852 - RNA, 20 nt, Human
augggacauuugcucaugga

SEQ ID NO: 2196853 - RNA, 14 nt, Human
augggaagacauga

SEQ ID NO: 2196854 - RNA, 21 nt, Human
augggaaaguauucuguacuc

SEQ ID NO: 2196855 - RNA, 17 nt, Human
augggaaugagguggga

SEQ ID NO: 2196856 - RNA, 13 nt, Human
augggaaaguauu

SEQ ID NO: 2196857 - RNA, 23 nt, Human
augggaaagccaccucucccuca

SEQ ID NO: 2196858 - RNA, 17 nt, Human
augggaaagccaccucu

SEQ ID NO: 2196859 - RNA, 18 nt, Human
augggaaagccaccucuc

SEQ ID NO: 2196860 - RNA, 20 nt, Human
augggaaagcauuguaaaug

SEQ ID NO: 2196861 - RNA, 14 nt, Human
augggaaagcauug

SEQ ID NO: 2196862 - RNA, 21 nt, Human
auggaguguguauuguuccca

SEQ ID NO: 2196863 - RNA, 18 nt, Human
auggaguguguauuguuc

SEQ ID NO: 2196864 - RNA, 15 nt, Human
auggaguucuugugc

SEQ ID NO: 2196865 - RNA, 17 nt, Human
auggaguuaacggguga

SEQ ID NO: 2196866 - RNA, 21 nt, Human
auggaguuaacgggugaauaa

SEQ ID NO: 2196867 - RNA, 19 nt, Human
auggcuuccuccucccucc

SEQ ID NO: 2196868 - RNA, 16 nt, Human
auggaguguacaagua

SEQ ID NO: 2196869 - RNA, 19 nt, Human
auggaguggcaauauagaa

SEQ ID NO: 2196870 - RNA, 14 nt, Human
augggaaaagagau

SEQ ID NO: 2196871 - RNA, 18 nt, Human
auggcuugccacagcucu

SEQ ID NO: 2196872 - RNA, 14 nt, Human
auggcuucuaacaa

SEQ ID NO: 2196873 - RNA, 23 nt, Human
auggcuuccuggcaauagucaaa

SEQ ID NO: 2196874 - RNA, 15 nt, Human
augcuuuccaaaacc

SEQ ID NO: 2196875 - RNA, 21 nt, Human
augcuuucagauuaaaauugu

SEQ ID NO: 2196876 - RNA, 16 nt, Human
augcuuugaucccuuc

SEQ ID NO: 2196877 - RNA, 18 nt, Human
auggagagaaaacagacc

SEQ ID NO: 2196878 - RNA, 21 nt, Human
augcuuugaaguacaauugug

SEQ ID NO: 2196879 - RNA, 17 nt, Human
auggagagaggggaaua

SEQ ID NO: 2196880 - RNA, 15 nt, Human
auggagagaggggaa

SEQ ID NO: 2196881 - RNA, 14 nt, Human
auggagagagggga

SEQ ID NO: 2196882 - RNA, 13 nt, Human
auggagagagggg

SEQ ID NO: 2196883 - RNA, 20 nt, Human
auggagagcuagaacccggc

SEQ ID NO: 2196884 - RNA, 23 nt, Human
auggagauagccccacaggaggu

SEQ ID NO: 2196885 - RNA, 19 nt, Human
auggagauucaguuuucau

SEQ ID NO: 2196886 - RNA, 13 nt, Human
auggagagcugga

SEQ ID NO: 2196887 - RNA, 18 nt, Human
auggagccagcucccucu

SEQ ID NO: 2196888 - RNA, 15 nt, Human
auggagccagcuccc

SEQ ID NO: 2196889 - RNA, 23 nt, Human
auggagccagcucccucuauuua

SEQ ID NO: 2196890 - RNA, 11 nt, Human
auggagugacg

SEQ ID NO: 2196891 - RNA, 22 nt, Human
auggagugacggucccacacug

SEQ ID NO: 2196892 - RNA, 20 nt, Human
auggagauucaguuuucauu

SEQ ID NO: 2196893 - RNA, 23 nt, Human
auggagagcuggagccuggugcc

SEQ ID NO: 2196894 - RNA, 11 nt, Human
auggagccagc

SEQ ID NO: 2196895 - RNA, 23 nt, Human
augcucugugcgaggguuacuau

SEQ ID NO: 2196896 - RNA, 13 nt, Human
augcucuucugug

SEQ ID NO: 2196897 - RNA, 16 nt, Human
augcucuuagaaaauu

SEQ ID NO: 2196898 - RNA, 19 nt, Human
augcucugcauguuacaua

SEQ ID NO: 2196899 - RNA, 18 nt, Human
augcucugcauguuacau

SEQ ID NO: 2196900 - RNA, 14 nt, Human
augcuucuucagag

SEQ ID NO: 2196901 - RNA, 17 nt, Human
augcuucuucagagacu

SEQ ID NO: 2196902 - RNA, 20 nt, Human
augcuucuucagagacuccu

SEQ ID NO: 2196903 - RNA, 21 nt, Human
augcuuuaggauguacaguua

SEQ ID NO: 2196904 - RNA, 14 nt, Human
augcucuucugugg

SEQ ID NO: 2196905 - RNA, 22 nt, Human
augcuucuucagagacuccugc

SEQ ID NO: 2196906 - RNA, 11 nt, Human
augccuggugg

SEQ ID NO: 2196907 - RNA, 12 nt, Human
augccugguggc

SEQ ID NO: 2196908 - RNA, 16 nt, Human
augcauguccuguaaa

SEQ ID NO: 2196909 - RNA, 22 nt, Human
augcauggugccccaggaccag

SEQ ID NO: 2196910 - RNA, 21 nt, Human
augcauggugccccaggacca

SEQ ID NO: 2196911 - RNA, 23 nt, Human
augcauggugcaguugacagcag

SEQ ID NO: 2196912 - RNA, 13 nt, Human
augccugguggca

SEQ ID NO: 2196913 - RNA, 14 nt, Human
augccugguggcag

SEQ ID NO: 2196914 - RNA, 19 nt, Human
augccugguggcagcugcg

SEQ ID NO: 2196915 - RNA, 18 nt, Human
augccugguggcagcugc

SEQ ID NO: 2196916 - RNA, 16 nt, Human
augccuguccagccug

SEQ ID NO: 2196917 - RNA, 21 nt, Human
augccuguacucgcuugugca

SEQ ID NO: 2196918 - RNA, 23 nt, Human
augccuguacucgcuugugcaga

SEQ ID NO: 2196919 - RNA, 21 nt, Human
augccugguggcagcugcggu

SEQ ID NO: 2196920 - RNA, 19 nt, Human
augcauggugcaguugaca

SEQ ID NO: 2196921 - RNA, 16 nt, Human
augcauggugccccag

SEQ ID NO: 2196922 - RNA, 16 nt, Human
augcauggaaauuccc

SEQ ID NO: 2196923 - RNA, 23 nt, Human
augcauggagggcugcccuguac

SEQ ID NO: 2196924 - RNA, 20 nt, Human
augcauggugccccaggacc

SEQ ID NO: 2196925 - RNA, 19 nt, Human
augcauggugccccaggac

SEQ ID NO: 2196926 - RNA, 18 nt, Human
augcauggugccccagga

SEQ ID NO: 2196927 - RNA, 17 nt, Human
augcauggugccccagg

SEQ ID NO: 2196928 - RNA, 18 nt, Human
augcaucauucuuguuaa

SEQ ID NO: 2196929 - RNA, 22 nt, Human
augcauccauuccucagggaca

SEQ ID NO: 2196930 - RNA, 18 nt, Human
augcauccauuccucagg

SEQ ID NO: 2196931 - RNA, 17 nt, Human
augcauccauuccucag

SEQ ID NO: 2196932 - RNA, 14 nt, Human
augcauccauuccu

SEQ ID NO: 2196933 - RNA, 23 nt, Human
augcauccauuccucagggacag

SEQ ID NO: 2196934 - RNA, 14 nt, Human
augcaucuagauua

SEQ ID NO: 2196935 - RNA, 19 nt, Human
augcauccuuugcacuguc

SEQ ID NO: 2196936 - RNA, 15 nt, Human
augcauacuucaaaa

SEQ ID NO: 2196937 - RNA, 23 nt, Human
augcauacacacacacacacagc

SEQ ID NO: 2196938 - RNA, 22 nt, Human
augcauacacacacacacacag

SEQ ID NO: 2196939 - RNA, 20 nt, Human
augcauauuauuuuauguug

SEQ ID NO: 2196940 - RNA, 16 nt, Human
augcauacuucaaaag

SEQ ID NO: 2196941 - RNA, 17 nt, Human
augcauacuucaaaagu

SEQ ID NO: 2196942 - RNA, 18 nt, Human
augcauacuucaaaagua

SEQ ID NO: 2196943 - RNA, 20 nt, Human
augcauacuucaaaaguauu

SEQ ID NO: 2196944 - RNA, 24 nt, Human
augcauauuauuuuauguugcaua

SEQ ID NO: 2196945 - RNA, 15 nt, Human
augcauauuguauua

SEQ ID NO: 2196946 - RNA, 16 nt, Human
augcauauuguauuac

SEQ ID NO: 2196947 - RNA, 22 nt, Human
augcauacuucaaaaguauuuu

SEQ ID NO: 2196948 - RNA, 21 nt, Human
augcauacuucaaaaguauuu

SEQ ID NO: 2196949 - RNA, 13 nt, Human
augcauauuguau

SEQ ID NO: 2196950 - RNA, 14 nt, Human
augcauaaaugcau

SEQ ID NO: 2196951 - RNA, 10 nt, Human
augcauacac

SEQ ID NO: 2196952 - RNA, 12 nt, Human
augcauacacac

SEQ ID NO: 2196953 - RNA, 11 nt, Human
augcauacaca

SEQ ID NO: 2196954 - RNA, 17 nt, Human
augcauacacacacaca

SEQ ID NO: 2196955 - RNA, 15 nt, Human
augcauacacacaca

SEQ ID NO: 2196956 - RNA, 14 nt, Human
augcauacacacac

SEQ ID NO: 2196957 - RNA, 13 nt, Human
augcauacacaca

SEQ ID NO: 2196958 - RNA, 17 nt, Human
augaccuucuaggaagc

SEQ ID NO: 2196959 - RNA, 18 nt, Human
augaccuucuaggaagcu

SEQ ID NO: 2196960 - RNA, 16 nt, Human
augaccuuacauuucc

SEQ ID NO: 2196961 - RNA, 13 nt, Human
augaccuuucaau

SEQ ID NO: 2196962 - RNA, 15 nt, Human
augaccuuucaauag

SEQ ID NO: 2196963 - RNA, 14 nt, Human
augaccuuacauuu

SEQ ID NO: 2196964 - RNA, 18 nt, Human
augaccuuucaauaggaa

SEQ ID NO: 2196965 - RNA, 12 nt, Human
augagccuggca

SEQ ID NO: 2196966 - RNA, 11 nt, Human
augagccuggc

SEQ ID NO: 2196967 - RNA, 21 nt, Human
augagccucagcauccuggca

SEQ ID NO: 2196968 - RNA, 19 nt, Human
augagccucagcauccugg

SEQ ID NO: 2196969 - RNA, 21 nt, Human
augagcuggaaggagugagag

SEQ ID NO: 2196970 - RNA, 16 nt, Human
augagcucuucauguu

SEQ ID NO: 2196971 - RNA, 13 nt, Human
augagcugagggg

SEQ ID NO: 2196972 - RNA, 12 nt, Human
augagcugaggg

SEQ ID NO: 2196973 - RNA, 13 nt, Human
augagcuggaagg

SEQ ID NO: 2196974 - RNA, 18 nt, Human
augagcuuuauguaauaa

SEQ ID NO: 2196975 - RNA, 22 nt, Human
augagcuuuauguaauaaugug

SEQ ID NO: 2196976 - RNA, 20 nt, Human
augagcuuuauguaauaaug

SEQ ID NO: 2196977 - RNA, 18 nt, Human
augaggccucaguggacu

SEQ ID NO: 2196978 - RNA, 15 nt, Human
augaggccucuugga

SEQ ID NO: 2196979 - RNA, 21 nt, Human
augaggccgcuagaggccuga

SEQ ID NO: 2196980 - RNA, 15 nt, Human
augaggccgcuagag

SEQ ID NO: 2196981 - RNA, 22 nt, Human
augaggcugcuuuccaaagcca

SEQ ID NO: 2196982 - RNA, 21 nt, Human
augaggccucuuggaccucug

SEQ ID NO: 2196983 - RNA, 22 nt, Human
augaggccucuuggaccucugc

SEQ ID NO: 2196984 - RNA, 23 nt, Human
augaggccucuuggaccucugcu

SEQ ID NO: 2196985 - RNA, 13 nt, Human
augaggcuugcug

SEQ ID NO: 2196986 - RNA, 23 nt, Human
augaggccacugcugcuucucca

SEQ ID NO: 2196987 - RNA, 12 nt, Human
augaaagacugu

SEQ ID NO: 2196988 - RNA, 13 nt, Human
augaaacuuggau

SEQ ID NO: 2196989 - RNA, 23 nt, Human
augaaaccuuauuuuuucccaaa

SEQ ID NO: 2196990 - RNA, 16 nt, Human
augaagcccaauaaac

SEQ ID NO: 2196991 - RNA, 17 nt, Human
augaagcccaagugaaa

SEQ ID NO: 2196992 - RNA, 15 nt, Human
augaagcccaaguga

SEQ ID NO: 2196993 - RNA, 12 nt, Human
augaagcccaag

SEQ ID NO: 2196994 - RNA, 14 nt, Human
augaagcuaccuca

SEQ ID NO: 2196995 - RNA, 16 nt, Human
augaagccuuagccag

SEQ ID NO: 2196996 - RNA, 23 nt, Human
augaagcauuuacuuuguguuca

SEQ ID NO: 2196997 - RNA, 14 nt, Human
augaaagaaaggcc

SEQ ID NO: 2196998 - RNA, 15 nt, Human
augaagcuaccucaa

SEQ ID NO: 2196999 - RNA, 13 nt, Human
augaagcuugugu

SEQ ID NO: 2197000 - RNA, 13 nt, Human
augaaguacucau

SEQ ID NO: 2197001 - RNA, 23 nt, Human
augaaguaauaugcacacauuuu

SEQ ID NO: 2197002 - RNA, 21 nt, Human
augaaguaauaugcacacauu

SEQ ID NO: 2197003 - RNA, 14 nt, Human
augaaguaauaugc

SEQ ID NO: 2197004 - RNA, 15 nt, Human
augaauaauuuccca

SEQ ID NO: 2197005 - RNA, 23 nt, Human
augaagcucaccuguugcuuaca

SEQ ID NO: 2197006 - RNA, 15 nt, Human
augaagcuuguguau

SEQ ID NO: 2197007 - RNA, 23 nt, Human
augaaguuuuuuuuauacaggau

SEQ ID NO: 2197008 - RNA, 17 nt, Human
augaauaaagacaccua

SEQ ID NO: 2197009 - RNA, 21 nt, Human
augaauacagggcaugcauuu

SEQ ID NO: 2197010 - RNA, 22 nt, Human
augaauaauuucccaauuagga

SEQ ID NO: 2197011 - RNA, 20 nt, Human
augaauacaaacaauggaaa

SEQ ID NO: 2197012 - RNA, 21 nt, Human
augaauacuguauuuuguauu

SEQ ID NO: 2197013 - RNA, 19 nt, Human
aucuaggauuuuaagggaa

SEQ ID NO: 2197014 - RNA, 11 nt, Human
aucuaggauuu

SEQ ID NO: 2197015 - RNA, 23 nt, Human
aucuaggaagacuuuggaaagag

SEQ ID NO: 2197016 - RNA, 18 nt, Human
augaggcuugcugagagg

SEQ ID NO: 2197017 - RNA, 15 nt, Human
augaggcuugcugag

SEQ ID NO: 2197018 - RNA, 17 nt, Human
augaggcuugcugagag

SEQ ID NO: 2197019 - RNA, 17 nt, Human
auacugucucuuucaug

SEQ ID NO: 2197020 - RNA, 19 nt, Human
auacuguauuuuguauugu

SEQ ID NO: 2197021 - RNA, 15 nt, Human
auacuguugugcgca

SEQ ID NO: 2197022 - RNA, 16 nt, Human
auacuguuugagguuu

SEQ ID NO: 2197023 - RNA, 12 nt, Human
auacuguuugag

SEQ ID NO: 2197024 - RNA, 21 nt, Human
auacuuaaauggaaaaaauga

SEQ ID NO: 2197025 - RNA, 20 nt, Human
auacuguuugagguuuuuaa

SEQ ID NO: 2197026 - RNA, 19 nt, Human
auacuugaaaauuaacaug

SEQ ID NO: 2197027 - RNA, 21 nt, Human
auacugucgguuuuuuuuaaa

SEQ ID NO: 2197028 - RNA, 16 nt, Human
auacugugcuggagcc

SEQ ID NO: 2197029 - RNA, 20 nt, Human
auacugugcuggagccacua

SEQ ID NO: 2197030 - RNA, 17 nt, Human
auacugugcuggagcca

SEQ ID NO: 2197031 - RNA, 17 nt, Human
auagaaaacugaaaauc

SEQ ID NO: 2197032 - RNA, 16 nt, Human
auagaaaaacccugcc

SEQ ID NO: 2197033 - RNA, 21 nt, Human
auacuuuuuuuucuuuaaaaa

SEQ ID NO: 2197034 - RNA, 14 nt, Human
auacuuuuuuucac

SEQ ID NO: 2197035 - RNA, 15 nt, Human
auacuuuuuuucaca

SEQ ID NO: 2197036 - RNA, 16 nt, Human
auagcaacacucuaua

SEQ ID NO: 2197037 - RNA, 19 nt, Human
auagcaaauguuuugacau

SEQ ID NO: 2197038 - RNA, 19 nt, Human
auacuuuuuucuuauuuaa

SEQ ID NO: 2197039 - RNA, 20 nt, Human
auacuuuuuacaauuaaaaa

SEQ ID NO: 2197040 - RNA, 13 nt, Human
auacuuuuuacaa

SEQ ID NO: 2197041 - RNA, 19 nt, Human
auacuuuuuaaauguaaag

SEQ ID NO: 2197042 - RNA, 16 nt, Human
auacuuuugcccuuug

SEQ ID NO: 2197043 - RNA, 17 nt, Human
auacuugaagggccaga

SEQ ID NO: 2197044 - RNA, 16 nt, Human
auacuugaagggccag

SEQ ID NO: 2197045 - RNA, 21 nt, Human
auacuugaagggccagagcca

SEQ ID NO: 2197046 - RNA, 20 nt, Human
auacuugaagggccagagcc

SEQ ID NO: 2197047 - RNA, 19 nt, Human
auacuugaagggccagagc

SEQ ID NO: 2197048 - RNA, 18 nt, Human
auacuugaagggccagag

SEQ ID NO: 2197049 - RNA, 22 nt, Human
auacuugaagggccagagccag

SEQ ID NO: 2197050 - RNA, 21 nt, Human
auacacugaaguuaacagaga

SEQ ID NO: 2197051 - RNA, 19 nt, Human
auacacuaauuccuuucua

SEQ ID NO: 2197052 - RNA, 17 nt, Human
auacacgagguaugagg

SEQ ID NO: 2197053 - RNA, 21 nt, Human
auacacuaugaagauguuuca

SEQ ID NO: 2197054 - RNA, 22 nt, Human
auacacuauuugugagcaaagg

SEQ ID NO: 2197055 - RNA, 19 nt, Human
auacaccagagauaauaug

SEQ ID NO: 2197056 - RNA, 18 nt, Human
auacaccagcauuccuuu

SEQ ID NO: 2197057 - RNA, 17 nt, Human
auacaccagcauuccuu

SEQ ID NO: 2197058 - RNA, 14 nt, Human
auacaccgggccug

SEQ ID NO: 2197059 - RNA, 18 nt, Human
auacaccgggccuggaga

SEQ ID NO: 2197060 - RNA, 17 nt, Human
auacaccacuacauucu

SEQ ID NO: 2197061 - RNA, 20 nt, Human
auacaccaccucacuccugu

SEQ ID NO: 2197062 - RNA, 21 nt, Human
auacaccaccucacuccuguu

SEQ ID NO: 2197063 - RNA, 23 nt, Human
auacacauaauuaaaguguccau

SEQ ID NO: 2197064 - RNA, 16 nt, Human
auacaccaauugauuu

SEQ ID NO: 2197065 - RNA, 21 nt, Human
auaagcuaacaccagacagac

SEQ ID NO: 2197066 - RNA, 17 nt, Human
auaagcuaaagaggcug

SEQ ID NO: 2197067 - RNA, 16 nt, Human
auaagcuaaagaggcu

SEQ ID NO: 2197068 - RNA, 13 nt, Human
auaagcuaaagag

SEQ ID NO: 2197069 - RNA, 18 nt, Human
auaagcggcguaaguuua

SEQ ID NO: 2197070 - RNA, 16 nt, Human
auaagcucagaaucca

SEQ ID NO: 2197071 - RNA, 17 nt, Human
auaagguuuaaaaagau

SEQ ID NO: 2197072 - RNA, 19 nt, Human
auaagguuucguuucugua

SEQ ID NO: 2197073 - RNA, 20 nt, Human
auaagguuucguuucuguau

SEQ ID NO: 2197074 - RNA, 23 nt, Human
auaagguuucguuucuguauaca

SEQ ID NO: 2197075 - RNA, 12 nt, Human
auaaguaagaaa

SEQ ID NO: 2197076 - RNA, 13 nt, Human
auaaguaagaaaa

SEQ ID NO: 2197077 - RNA, 15 nt, Human
auaaguaaaugcuag

SEQ ID NO: 2197078 - RNA, 15 nt, Human
auaagcucagaaucc

SEQ ID NO: 2197079 - RNA, 12 nt, Human
auaauguuaaca

SEQ ID NO: 2197080 - RNA, 23 nt, Human
auaauguuaaauuuguaaguuuc

SEQ ID NO: 2197081 - RNA, 16 nt, Human
auaauguuaaauuugu

SEQ ID NO: 2197082 - RNA, 18 nt, Human
auaauguuaaauuuguaa

SEQ ID NO: 2197083 - RNA, 19 nt, Human
auaauguuaaauuuguaag

SEQ ID NO: 2197084 - RNA, 22 nt, Human
auaauguuaaauuuguaaguuu

SEQ ID NO: 2197085 - RNA, 15 nt, Human
auacaauucuacauu

SEQ ID NO: 2197086 - RNA, 20 nt, Human
auacaauguauuuauuuaaa

SEQ ID NO: 2197087 - RNA, 21 nt, Human
auacaauguauuuauuuaaaa

SEQ ID NO: 2197088 - RNA, 18 nt, Human
auacaauguauuuauuua

SEQ ID NO: 2197089 - RNA, 23 nt, Human
auacaaugcugugcccuaaagug

SEQ ID NO: 2197090 - RNA, 15 nt, Human
auacaccacuacauu

SEQ ID NO: 2197091 - RNA, 14 nt, Human
auacacaggauccu

SEQ ID NO: 2197092 - RNA, 10 nt, Human
auacacauaa

SEQ ID NO: 2197093 - RNA, 12 nt, Human
auacacauaauu

SEQ ID NO: 2197094 - RNA, 22 nt, Human
auacacauaauuaaagugucca

SEQ ID NO: 2197095 - RNA, 18 nt, Human
auaaguacuguguacaga

SEQ ID NO: 2197096 - RNA, 16 nt, Human
auaaguacuguguaca

SEQ ID NO: 2197097 - RNA, 13 nt, Human
auaaguacugugu

SEQ ID NO: 2197098 - RNA, 13 nt, Human
auaaguaaguuug

SEQ ID NO: 2197099 - RNA, 17 nt, Human
auaaguaauucaagaaa

SEQ ID NO: 2197100 - RNA, 14 nt, Human
auaaguaagaaaau

SEQ ID NO: 2197101 - RNA, 15 nt, Human
auaaguaagaaaaua

SEQ ID NO: 2197102 - RNA, 17 nt, Human
auaaguaagaaaauauu

SEQ ID NO: 2197103 - RNA, 18 nt, Human
auaaguaagaaaauauuu

SEQ ID NO: 2197104 - RNA, 13 nt, Human
auaagugcuguau

SEQ ID NO: 2197105 - RNA, 14 nt, Human
auaagugcuguaua

SEQ ID NO: 2197106 - RNA, 15 nt, Human
auaagugcuguauaa

SEQ ID NO: 2197107 - RNA, 16 nt, Human
auaagugcuguauaaa

SEQ ID NO: 2197108 - RNA, 16 nt, Human
auaaugugaaguguua

SEQ ID NO: 2197109 - RNA, 12 nt, Human
auaaugugaagu

SEQ ID NO: 2197110 - RNA, 10 nt, Human
auaauguuaa

SEQ ID NO: 2197111 - RNA, 11 nt, Human
auaauguuaaa

SEQ ID NO: 2197112 - RNA, 12 nt, Human
auaauguuaaau

SEQ ID NO: 2197113 - RNA, 20 nt, Human
auaaguggaggcacuuuagg

SEQ ID NO: 2197114 - RNA, 19 nt, Human
auaaguggaggcacuuuag

SEQ ID NO: 2197115 - RNA, 19 nt, Human
auaaguaagaaaauauuuu

SEQ ID NO: 2197116 - RNA, 18 nt, Human
auaaguggaggcacuuua

SEQ ID NO: 2197117 - RNA, 22 nt, Human
auaagugcuguauaaaaucagc

SEQ ID NO: 2197118 - RNA, 17 nt, Human
auaagugcuguauaaaa

SEQ ID NO: 2197119 - RNA, 18 nt, Human
auaagugcuguauaaaau

SEQ ID NO: 2197120 - RNA, 19 nt, Human
auaagugcuguauaaaauc

SEQ ID NO: 2197121 - RNA, 20 nt, Human
auaagugcuguauaaaauca

SEQ ID NO: 2197122 - RNA, 11 nt, Human
auaaagacagg

SEQ ID NO: 2197123 - RNA, 10 nt, Human
auaaaagaug

SEQ ID NO: 2197124 - RNA, 18 nt, Human
auaaaacauuaagaaaau

SEQ ID NO: 2197125 - RNA, 17 nt, Human
auaaaacauuaagaaaa

SEQ ID NO: 2197126 - RNA, 14 nt, Human
auaaaacauuaaga

SEQ ID NO: 2197127 - RNA, 14 nt, Human
auaaagaccacuuu

SEQ ID NO: 2197128 - RNA, 15 nt, Human
auaaagagagaaaaa

SEQ ID NO: 2197129 - RNA, 19 nt, Human
auaaagaucauguaaaagu

SEQ ID NO: 2197130 - RNA, 21 nt, Human
auaaagaugagugagcaugcc

SEQ ID NO: 2197131 - RNA, 21 nt, Human
auaaagagagaaaaacaaauu

SEQ ID NO: 2197132 - RNA, 13 nt, Human
auaaagaguuaga

SEQ ID NO: 2197133 - RNA, 18 nt, Human
auaaagaucgcccccacc

SEQ ID NO: 2197134 - RNA, 19 nt, Human
auaaagaugaucuacucag

SEQ ID NO: 2197135 - RNA, 11 nt, Human
auaaagaugau

SEQ ID NO: 2197136 - RNA, 14 nt, Human
auaaagaugaucua

SEQ ID NO: 2197137 - RNA, 14 nt, Human
auaaaaaaaauagu

SEQ ID NO: 2197138 - RNA, 17 nt, Human
auaaaaaaacaaucauu

SEQ ID NO: 2197139 - RNA, 15 nt, Human
auaaaaaaaauaguu

SEQ ID NO: 2197140 - RNA, 19 nt, Human
auaaaaaaacaaucauuug

SEQ ID NO: 2197141 - RNA, 23 nt, Human
aguuugcuagcagaaaucuagaa

SEQ ID NO: 2197142 - RNA, 18 nt, Human
auaaaaaaaagaaaaaag

SEQ ID NO: 2197143 - RNA, 17 nt, Human
auaaaaaaaagaaaaaa

SEQ ID NO: 2197144 - RNA, 21 nt, Human
auaaaaaauaaucuauuucua

SEQ ID NO: 2197145 - RNA, 17 nt, Human
auaaaaaccaagaagau

SEQ ID NO: 2197146 - RNA, 12 nt, Human
auaaaaacuaaa

SEQ ID NO: 2197147 - RNA, 16 nt, Human
auaaaaacuaaauugu

SEQ ID NO: 2197148 - RNA, 22 nt, Human
auaaaaagaaaagauaaagaug

SEQ ID NO: 2197149 - RNA, 18 nt, Human
auaaaaacuaaauuguaa

SEQ ID NO: 2197150 - RNA, 20 nt, Human
auaaaaagacauucuuccaa

SEQ ID NO: 2197151 - RNA, 14 nt, Human
auaaaaagaucacu

SEQ ID NO: 2197152 - RNA, 12 nt, Human
auaaaaacaaau

SEQ ID NO: 2197153 - RNA, 11 nt, Human
auaaaaaaugg

SEQ ID NO: 2197154 - RNA, 12 nt, Human
auaaaaaaugga

SEQ ID NO: 2197155 - RNA, 12 nt, Human
auaaaaaauggu

SEQ ID NO: 2197156 - RNA, 18 nt, Human
auaaaaaauggugccuga

SEQ ID NO: 2197157 - RNA, 12 nt, Human
auaaaaauggau

SEQ ID NO: 2197158 - RNA, 18 nt, Human
auaaaaagaucacuuucu

SEQ ID NO: 2197159 - RNA, 23 nt, Human
auaaaaauauuguguugugaaug

SEQ ID NO: 2197160 - RNA, 22 nt, Human
auaaaaagaucacuuucucagu

SEQ ID NO: 2197161 - RNA, 16 nt, Human
auaaaacaggucaaua

SEQ ID NO: 2197162 - RNA, 18 nt, Human
auaaaacaggucaauaca

SEQ ID NO: 2197163 - RNA, 12 nt, Human
auaaaacaggua

SEQ ID NO: 2197164 - RNA, 15 nt, Human
auaaaaauucugaau

SEQ ID NO: 2197165 - RNA, 14 nt, Human
auaaaaauucugaa

SEQ ID NO: 2197166 - RNA, 12 nt, Human
auaaaaauguuu

SEQ ID NO: 2197167 - RNA, 15 nt, Human
auaaaagacagugaa

SEQ ID NO: 2197168 - RNA, 16 nt, Human
auaaaagacagugaaa

SEQ ID NO: 2197169 - RNA, 21 nt, Human
aguuugcagaaaagcaccugc

SEQ ID NO: 2197170 - RNA, 20 nt, Human
aguuugcagaaaagcaccug

SEQ ID NO: 2197171 - RNA, 14 nt, Human
aguuugcagaaaag

SEQ ID NO: 2197172 - RNA, 13 nt, Human
aguuugcagaaaa

SEQ ID NO: 2197173 - RNA, 11 nt, Human
aguuugcaguu

SEQ ID NO: 2197174 - RNA, 23 nt, Human
aguuugcagaaaagcaccugccg

SEQ ID NO: 2197175 - RNA, 22 nt, Human
aguuugcagaaaagcaccugcc

SEQ ID NO: 2197176 - RNA, 15 nt, Human
aguuugcauuccuga

SEQ ID NO: 2197177 - RNA, 20 nt, Human
aguuugcauuccugauauga

SEQ ID NO: 2197178 - RNA, 21 nt, Human
aguuugcccugguuucacugg

SEQ ID NO: 2197179 - RNA, 12 nt, Human
aguuugcccugg

SEQ ID NO: 2197180 - RNA, 13 nt, Human
aguuugccagaag

SEQ ID NO: 2197181 - RNA, 17 nt, Human
aguuugaggcugcagcg

SEQ ID NO: 2197182 - RNA, 14 nt, Human
aguuugaggcugca

SEQ ID NO: 2197183 - RNA, 23 nt, Human
aguuugagcugccuucccuagcu

SEQ ID NO: 2197184 - RNA, 15 nt, Human
aguuucuuagcuuuu

SEQ ID NO: 2197185 - RNA, 16 nt, Human
aguuugagcugccuuc

SEQ ID NO: 2197186 - RNA, 17 nt, Human
aguuugauauuaaagga

SEQ ID NO: 2197187 - RNA, 14 nt, Human
aguuugauuaaauu

SEQ ID NO: 2197188 - RNA, 13 nt, Human
aguuucuguucug

SEQ ID NO: 2197189 - RNA, 15 nt, Human
aguuucuguucugug

SEQ ID NO: 2197190 - RNA, 16 nt, Human
aguuucuguucugugg

SEQ ID NO: 2197191 - RNA, 17 nt, Human
aguuucuguucugugga

SEQ ID NO: 2197192 - RNA, 18 nt, Human
aguuucuguucuguggaa

SEQ ID NO: 2197193 - RNA, 19 nt, Human
aguuucuguucuguggaaa

SEQ ID NO: 2197194 - RNA, 21 nt, Human
aguuucuguucuguggaaagu

SEQ ID NO: 2197195 - RNA, 22 nt, Human
aguuucuguucuguggaaagug

SEQ ID NO: 2197196 - RNA, 23 nt, Human
aguuucuguucuguggaaagugu

SEQ ID NO: 2197197 - RNA, 14 nt, Human
aguuucuuagcuuu

SEQ ID NO: 2197198 - RNA, 16 nt, Human
aguuucuggcccuggc

SEQ ID NO: 2197199 - RNA, 17 nt, Human
aguuucuguccugcugg

SEQ ID NO: 2197200 - RNA, 17 nt, Human
aguuucugggaccucag

SEQ ID NO: 2197201 - RNA, 13 nt, Human
aguuacacauuuu

SEQ ID NO: 2197202 - RNA, 20 nt, Human
aguuacaaauugcuugaaag

SEQ ID NO: 2197203 - RNA, 16 nt, Human
aguuacacauuuuuca

SEQ ID NO: 2197204 - RNA, 19 nt, Human
aguuacacauuuuucagau

SEQ ID NO: 2197205 - RNA, 14 nt, Human
aguucauacccugu

SEQ ID NO: 2197206 - RNA, 21 nt, Human
aguuacaacuuccuaauuuua

SEQ ID NO: 2197207 - RNA, 20 nt, Human
aguucauagggucucuucag

SEQ ID NO: 2197208 - RNA, 19 nt, Human
aguucauauuccauauuua

SEQ ID NO: 2197209 - RNA, 20 nt, Human
aguucauauuccauauuuau

SEQ ID NO: 2197210 - RNA, 18 nt, Human
aguucauauguaccaugu

SEQ ID NO: 2197211 - RNA, 22 nt, Human
aguucauauguaccauguacau

SEQ ID NO: 2197212 - RNA, 22 nt, Human
aguucauccaauccucacuggg

SEQ ID NO: 2197213 - RNA, 20 nt, Human
aguucauccaauccucacug

SEQ ID NO: 2197214 - RNA, 18 nt, Human
aguucauccaauccucac

SEQ ID NO: 2197215 - RNA, 16 nt, Human
aguucauccaauccuc

SEQ ID NO: 2197216 - RNA, 17 nt, Human
aguucauccauucuauu

SEQ ID NO: 2197217 - RNA, 18 nt, Human
aguuccaccaucaagcca

SEQ ID NO: 2197218 - RNA, 21 nt, Human
aguuccaccaucaagccacca

SEQ ID NO: 2197219 - RNA, 18 nt, Human
aguugaaaaacagcugag

SEQ ID NO: 2197220 - RNA, 14 nt, Human
aguugaaaagacuc

SEQ ID NO: 2197221 - RNA, 21 nt, Human
aguucuuuguucauagcccag

SEQ ID NO: 2197222 - RNA, 22 nt, Human
aguucuuuguucauagcccagu

SEQ ID NO: 2197223 - RNA, 16 nt, Human
aguugaagacagagcu

SEQ ID NO: 2197224 - RNA, 17 nt, Human
aguugaagacagagcua

SEQ ID NO: 2197225 - RNA, 17 nt, Human
aguugaaaaacagcuga

SEQ ID NO: 2197226 - RNA, 21 nt, Human
aguucuuugggccagacaugc

SEQ ID NO: 2197227 - RNA, 19 nt, Human
aguucuuuguucauagccc

SEQ ID NO: 2197228 - RNA, 22 nt, Human
aguuccaugaagaccacaucca

SEQ ID NO: 2197229 - RNA, 19 nt, Human
aguucuuugggccagacau

SEQ ID NO: 2197230 - RNA, 14 nt, Human
aguuccacugagcu

SEQ ID NO: 2197231 - RNA, 15 nt, Human
aguuccacugagcuc

SEQ ID NO: 2197232 - RNA, 21 nt, Human
aguuccacugagcuccaugug

SEQ ID NO: 2197233 - RNA, 22 nt, Human
aguggccacuaagcagaggagg

SEQ ID NO: 2197234 - RNA, 20 nt, Human
aguggccacuaagcagagga

SEQ ID NO: 2197235 - RNA, 19 nt, Human
aguggccacuaagcagagg

SEQ ID NO: 2197236 - RNA, 14 nt, Human
aguggccacuaagc

SEQ ID NO: 2197237 - RNA, 14 nt, Human
aguggccacucagc

SEQ ID NO: 2197238 - RNA, 21 nt, Human
aguguuuggguauauucauuu

SEQ ID NO: 2197239 - RNA, 21 nt, Human
aguguuucuguuauuaacaaa

SEQ ID NO: 2197240 - RNA, 16 nt, Human
aguggcccccacagaa

SEQ ID NO: 2197241 - RNA, 15 nt, Human
aguguuucuguuauu

SEQ ID NO: 2197242 - RNA, 16 nt, Human
aguggcauuggcagca

SEQ ID NO: 2197243 - RNA, 18 nt, Human
aguggcauuggcagcagg

SEQ ID NO: 2197244 - RNA, 20 nt, Human
aguggcauuggcagcaggug

SEQ ID NO: 2197245 - RNA, 18 nt, Human
aguggcauggcuccaguc

SEQ ID NO: 2197246 - RNA, 14 nt, Human
agugcucgcuguug

SEQ ID NO: 2197247 - RNA, 15 nt, Human
aguggcauggcucca

SEQ ID NO: 2197248 - RNA, 17 nt, Human
agugcucccucacaugu

SEQ ID NO: 2197249 - RNA, 14 nt, Human
agugcucccucaca

SEQ ID NO: 2197250 - RNA, 11 nt, Human
agugcucccuc

SEQ ID NO: 2197251 - RNA, 17 nt, Human
agugcucauuucaggau

SEQ ID NO: 2197252 - RNA, 13 nt, Human
aguguuuucuggg

SEQ ID NO: 2197253 - RNA, 18 nt, Human
aguguuuuggaauaaaau

SEQ ID NO: 2197254 - RNA, 20 nt, Human
aguguuuuaagauaaauuau

SEQ ID NO: 2197255 - RNA, 23 nt, Human
aguuaaauagaguauaugcacuu

SEQ ID NO: 2197256 - RNA, 15 nt, Human
aguguuuucugggau

SEQ ID NO: 2197257 - RNA, 21 nt, Human
aguuaaauagaguauaugcac

SEQ ID NO: 2197258 - RNA, 14 nt, Human
aguuaaauuucugg

SEQ ID NO: 2197259 - RNA, 13 nt, Human
aguuaacaaugau

SEQ ID NO: 2197260 - RNA, 16 nt, Human
aguuaacaaugauaua

SEQ ID NO: 2197261 - RNA, 17 nt, Human
aguuaacaaugauauau

SEQ ID NO: 2197262 - RNA, 12 nt, Human
aguuaacagaga

SEQ ID NO: 2197263 - RNA, 20 nt, Human
aguuaacaccuuuaaagugu

SEQ ID NO: 2197264 - RNA, 13 nt, Human
aguuaacggguga

SEQ ID NO: 2197265 - RNA, 17 nt, Human
aguuaacgggugaauaa

SEQ ID NO: 2197266 - RNA, 21 nt, Human
aguuaacgggugaauaauaaa

SEQ ID NO: 2197267 - RNA, 20 nt, Human
aguuaauuacauccucaugc

SEQ ID NO: 2197268 - RNA, 16 nt, Human
aguugaagcuaagauu

SEQ ID NO: 2197269 - RNA, 19 nt, Human
aguugaaugacaacagaag

SEQ ID NO: 2197270 - RNA, 21 nt, Human
aguugaaugacaacagaagcu

SEQ ID NO: 2197271 - RNA, 17 nt, Human
aguuguuagugugucuu

SEQ ID NO: 2197272 - RNA, 22 nt, Human
aguuguuagugugucuuagugu

SEQ ID NO: 2197273 - RNA, 20 nt, Human
aguuguucaauaauaaauau

SEQ ID NO: 2197274 - RNA, 21 nt, Human
aguaaaugggggugcauuuga

SEQ ID NO: 2197275 - RNA, 20 nt, Human
aguaaaugggggugcauuug

SEQ ID NO: 2197276 - RNA, 19 nt, Human
aguaaaugggggugcauuu

SEQ ID NO: 2197277 - RNA, 19 nt, Human
aguaaauaaauuguuugac

SEQ ID NO: 2197278 - RNA, 16 nt, Human
aguaaauaaauuguuu

SEQ ID NO: 2197279 - RNA, 18 nt, Human
aguaaauaaauuguuuga

SEQ ID NO: 2197280 - RNA, 14 nt, Human
aguaaauaaauugu

SEQ ID NO: 2197281 - RNA, 15 nt, Human
aguaaauaaauuguu

SEQ ID NO: 2197282 - RNA, 19 nt, Human
aguaaagugauaauuucug

SEQ ID NO: 2197283 - RNA, 18 nt, Human
aguaaagugauaauuucu

SEQ ID NO: 2197284 - RNA, 20 nt, Human
aguaaagaaauuuaaaagac

SEQ ID NO: 2197285 - RNA, 13 nt, Human
aguaaagaaauuu

SEQ ID NO: 2197286 - RNA, 17 nt, Human
aguaaagcuaaaaugau

SEQ ID NO: 2197287 - RNA, 19 nt, Human
aguaaaggaguaagaaccu

SEQ ID NO: 2197288 - RNA, 17 nt, Human
aguaaagccguuguuua

SEQ ID NO: 2197289 - RNA, 18 nt, Human
aguaaagccguuguuuac

SEQ ID NO: 2197290 - RNA, 14 nt, Human
aguaaagcuaaaau

SEQ ID NO: 2197291 - RNA, 17 nt, Human
aguaacuuacuuaggug

SEQ ID NO: 2197292 - RNA, 19 nt, Human
aguaacuucuuauggaauu

SEQ ID NO: 2197293 - RNA, 17 nt, Human
aguaacuucuuauggaa

SEQ ID NO: 2197294 - RNA, 14 nt, Human
aguaacuuggcuuu

SEQ ID NO: 2197295 - RNA, 15 nt, Human
aguaacuuggcuuuc

SEQ ID NO: 2197296 - RNA, 18 nt, Human
aguaacuuggcuuucauu

SEQ ID NO: 2197297 - RNA, 14 nt, Human
aguaacuuuaugug

SEQ ID NO: 2197298 - RNA, 16 nt, Human
aguaacuuuaugugua

SEQ ID NO: 2197299 - RNA, 17 nt, Human
aguaacuuuauguguaa

SEQ ID NO: 2197300 - RNA, 15 nt, Human
aguaccugaaaagua

SEQ ID NO: 2197301 - RNA, 12 nt, Human
aguaagaaaaua

SEQ ID NO: 2197302 - RNA, 17 nt, Human
aguaccugaaaaaaugc

SEQ ID NO: 2197303 - RNA, 14 nt, Human
aguaccugaaaagu

SEQ ID NO: 2197304 - RNA, 20 nt, Human
aguaacuuuauguguaaaua

SEQ ID NO: 2197305 - RNA, 19 nt, Human
aguaacuuuauguguaaau

SEQ ID NO: 2197306 - RNA, 13 nt, Human
aguaagaaaagug

SEQ ID NO: 2197307 - RNA, 14 nt, Human
aguaacugacaacu

SEQ ID NO: 2197308 - RNA, 14 nt, Human
aguaacucaucugu

SEQ ID NO: 2197309 - RNA, 19 nt, Human
aguaacugccaucaagaug

SEQ ID NO: 2197310 - RNA, 23 nt, Human
aguaaccuuuugcaccugcucuc

SEQ ID NO: 2197311 - RNA, 14 nt, Human
aguaacuuaaguua

SEQ ID NO: 2197312 - RNA, 19 nt, Human
aguaacgcgucuuccugag

SEQ ID NO: 2197313 - RNA, 22 nt, Human
aguaacgcgucuuccugagugg

SEQ ID NO: 2197314 - RNA, 16 nt, Human
aguaacgcgucuuccu

SEQ ID NO: 2197315 - RNA, 12 nt, Human
aguaaccugggu

SEQ ID NO: 2197316 - RNA, 21 nt, Human
aguaaccuuuugcaccugcuc

SEQ ID NO: 2197317 - RNA, 17 nt, Human
aguaacgcgucuuccug

SEQ ID NO: 2197318 - RNA, 18 nt, Human
aguaacgcgucuuccuga

SEQ ID NO: 2197319 - RNA, 19 nt, Human
aguacuccugcaaaauuuu

SEQ ID NO: 2197320 - RNA, 18 nt, Human
aguacuccugcaaaauuu

SEQ ID NO: 2197321 - RNA, 16 nt, Human
aguacuccugcaaaau

SEQ ID NO: 2197322 - RNA, 18 nt, Human
aguacgugcuaacaggcu

SEQ ID NO: 2197323 - RNA, 13 nt, Human
aguacguuauugu

SEQ ID NO: 2197324 - RNA, 15 nt, Human
aguacguuauuguug

SEQ ID NO: 2197325 - RNA, 21 nt, Human
aguacuccugcaaaauuuuau

SEQ ID NO: 2197326 - RNA, 20 nt, Human
aguacuccugcaaaauuuua

SEQ ID NO: 2197327 - RNA, 15 nt, Human
aguacuggcauggua

SEQ ID NO: 2197328 - RNA, 15 nt, Human
aguacuggagaaaau

SEQ ID NO: 2197329 - RNA, 15 nt, Human
aguaccuuugucaca

SEQ ID NO: 2197330 - RNA, 14 nt, Human
aguaccuuugucac

SEQ ID NO: 2197331 - RNA, 13 nt, Human
aguaccuuuguca

SEQ ID NO: 2197332 - RNA, 13 nt, Human
aguacucauacau

SEQ ID NO: 2197333 - RNA, 15 nt, Human
aguaccuggaggagg

SEQ ID NO: 2197334 - RNA, 12 nt, Human
aguaccuggagg

SEQ ID NO: 2197335 - RNA, 13 nt, Human
aguaccuggagga

SEQ ID NO: 2197336 - RNA, 14 nt, Human
aguaccuggaggag

SEQ ID NO: 2197337 - RNA, 22 nt, Human
aguauaucuggacaagccaacu

SEQ ID NO: 2197338 - RNA, 13 nt, Human
aguauaucuggac

SEQ ID NO: 2197339 - RNA, 15 nt, Human
aguauaucuggacaa

SEQ ID NO: 2197340 - RNA, 16 nt, Human
aguauaucuggacaag

SEQ ID NO: 2197341 - RNA, 18 nt, Human
aguauaucuggacaagcc

SEQ ID NO: 2197342 - RNA, 22 nt, Human
aguauauugauccagaaagaaa

SEQ ID NO: 2197343 - RNA, 13 nt, Human
aguauauuuucuu

SEQ ID NO: 2197344 - RNA, 18 nt, Human
aguauauuuauagucaca

SEQ ID NO: 2197345 - RNA, 14 nt, Human
aguauauuuauagu

SEQ ID NO: 2197346 - RNA, 14 nt, Human
aguauauuauguau

SEQ ID NO: 2197347 - RNA, 15 nt, Human
aguauauuauguauu

SEQ ID NO: 2197348 - RNA, 17 nt, Human
aguauauuauguauuua

SEQ ID NO: 2197349 - RNA, 20 nt, Human
aguacuucuccacccugcuc

SEQ ID NO: 2197350 - RNA, 19 nt, Human
aguacuucuccacccugcu

SEQ ID NO: 2197351 - RNA, 21 nt, Human
aguacuucuccacccugcucu

SEQ ID NO: 2197352 - RNA, 17 nt, Human
aguacugcucuuguuuc

SEQ ID NO: 2197353 - RNA, 19 nt, Human
aguauauaaugguuucaaa

SEQ ID NO: 2197354 - RNA, 16 nt, Human
aguaaacuauuuaucu

SEQ ID NO: 2197355 - RNA, 14 nt, Human
aguaaacuauuuau

SEQ ID NO: 2197356 - RNA, 12 nt, Human
aguaaagaaauu

SEQ ID NO: 2197357 - RNA, 15 nt, Human
aguaaagaaaugaca

SEQ ID NO: 2197358 - RNA, 13 nt, Human
aguaaagaaauga

SEQ ID NO: 2197359 - RNA, 22 nt, Human
aguaaaauugccauauugcaca

SEQ ID NO: 2197360 - RNA, 23 nt, Human
aguaaaauugccauauugcacau

SEQ ID NO: 2197361 - RNA, 17 nt, Human
aguaaaauugccauauu

SEQ ID NO: 2197362 - RNA, 19 nt, Human
aguaaaauugccauauugc

SEQ ID NO: 2197363 - RNA, 20 nt, Human
aguaaaauugccauauugca

SEQ ID NO: 2197364 - RNA, 21 nt, Human
aguaaaauugccauauugcac

SEQ ID NO: 2197365 - RNA, 14 nt, Human
aguaaaauugccau

SEQ ID NO: 2197366 - RNA, 16 nt, Human
aguaaaauugccauau

SEQ ID NO: 2197367 - RNA, 20 nt, Human
aggggcauguauuggccugg

SEQ ID NO: 2197368 - RNA, 21 nt, Human
aggggcauguauuggccugga

SEQ ID NO: 2197369 - RNA, 22 nt, Human
aggggcauguauuggccuggag

SEQ ID NO: 2197370 - RNA, 23 nt, Human
aggggcauguauuggccuggagg

SEQ ID NO: 2197371 - RNA, 15 nt, Human
aggggccagaggcuc

SEQ ID NO: 2197372 - RNA, 14 nt, Human
aggggccagaggcu

SEQ ID NO: 2197373 - RNA, 13 nt, Human
aggggccagaggc

SEQ ID NO: 2197374 - RNA, 12 nt, Human
aggggccagagg

SEQ ID NO: 2197375 - RNA, 17 nt, Human
aggggccagaggcucgu

SEQ ID NO: 2197376 - RNA, 22 nt, Human
aggggccagaggaacuguccag

SEQ ID NO: 2197377 - RNA, 14 nt, Human
aguccucugaauga

SEQ ID NO: 2197378 - RNA, 21 nt, Human
aguccucuccaccuaguggcu

SEQ ID NO: 2197379 - RNA, 22 nt, Human
aguccucuggauggcaccagag

SEQ ID NO: 2197380 - RNA, 12 nt, Human
aguccucugaau

SEQ ID NO: 2197381 - RNA, 14 nt, Human
aguccucuccaccu

SEQ ID NO: 2197382 - RNA, 19 nt, Human
aguccucuccaccuagugg

SEQ ID NO: 2197383 - RNA, 21 nt, Human
aguccucguagccaucucucu

SEQ ID NO: 2197384 - RNA, 23 nt, Human
aguccuccccucacagccucuga

SEQ ID NO: 2197385 - RNA, 13 nt, Human
aguccucuccacc

SEQ ID NO: 2197386 - RNA, 17 nt, Human
aguccucguagccaucu

SEQ ID NO: 2197387 - RNA, 15 nt, Human
aguccucguagccau

SEQ ID NO: 2197388 - RNA, 19 nt, Human
agucauuuuaacuuuauca

SEQ ID NO: 2197389 - RNA, 21 nt, Human
agucauuuuaacuuuaucaca

SEQ ID NO: 2197390 - RNA, 19 nt, Human
agucauuugcugagcaugu

SEQ ID NO: 2197391 - RNA, 22 nt, Human
agucauuugcugagcauguacu

SEQ ID NO: 2197392 - RNA, 20 nt, Human
aguccuccccucacagccuc

SEQ ID NO: 2197393 - RNA, 21 nt, Human
aguccuccccucacagccucu

SEQ ID NO: 2197394 - RNA, 22 nt, Human
aguccuccccucacagccucug

SEQ ID NO: 2197395 - RNA, 14 nt, Human
aguccucuuuucug

SEQ ID NO: 2197396 - RNA, 22 nt, Human
aguccugugaaugccacugccu

SEQ ID NO: 2197397 - RNA, 20 nt, Human
aguccucuggguaggaauca

SEQ ID NO: 2197398 - RNA, 21 nt, Human
aguccugugaaugccacugcc

SEQ ID NO: 2197399 - RNA, 13 nt, Human
aguccugugaauu

SEQ ID NO: 2197400 - RNA, 14 nt, Human
aguccugugaauuu

SEQ ID NO: 2197401 - RNA, 23 nt, Human
aguccugugaauuucuucacugu

SEQ ID NO: 2197402 - RNA, 16 nt, Human
aguccuuaccagcaga

SEQ ID NO: 2197403 - RNA, 18 nt, Human
aguccuuaccagcagagc

SEQ ID NO: 2197404 - RNA, 13 nt, Human
agucauuuaauaa

SEQ ID NO: 2197405 - RNA, 23 nt, Human
agucugucaugaacauguuccug

SEQ ID NO: 2197406 - RNA, 15 nt, Human
agucugguuucuaga

SEQ ID NO: 2197407 - RNA, 13 nt, Human
agucugucaugaa

SEQ ID NO: 2197408 - RNA, 20 nt, Human
agucugguuucuagacuugu

SEQ ID NO: 2197409 - RNA, 17 nt, Human
agucuggugggaggacg

SEQ ID NO: 2197410 - RNA, 15 nt, Human
agucuggugaagcuc

SEQ ID NO: 2197411 - RNA, 17 nt, Human
agucuggcugagcccug

SEQ ID NO: 2197412 - RNA, 14 nt, Human
agucugggcugccg

SEQ ID NO: 2197413 - RNA, 16 nt, Human
agucugggcugccggg

SEQ ID NO: 2197414 - RNA, 17 nt, Human
agucugucucaaaagaa

SEQ ID NO: 2197415 - RNA, 14 nt, Human
agucugucucuguc

SEQ ID NO: 2197416 - RNA, 15 nt, Human
agucugucucuguca

SEQ ID NO: 2197417 - RNA, 18 nt, Human
agucugucucugucaugg

SEQ ID NO: 2197418 - RNA, 18 nt, Human
agucugugagauucauuc

SEQ ID NO: 2197419 - RNA, 13 nt, Human
agugaauaaaugu

SEQ ID NO: 2197420 - RNA, 22 nt, Human
agucuggaggggcauggccagc

SEQ ID NO: 2197421 - RNA, 15 nt, Human
agucugcaagauucu

SEQ ID NO: 2197422 - RNA, 23 nt, Human
agucugcacaugcagcugcaccc

SEQ ID NO: 2197423 - RNA, 15 nt, Human
agucuggaucuggga

SEQ ID NO: 2197424 - RNA, 13 nt, Human
agucuggaggggc

SEQ ID NO: 2197425 - RNA, 17 nt, Human
agucuggaucugggacc

SEQ ID NO: 2197426 - RNA, 15 nt, Human
agucuggccaacauc

SEQ ID NO: 2197427 - RNA, 18 nt, Human
agucuggcccuuccuuuu

SEQ ID NO: 2197428 - RNA, 21 nt, Human
agucugauucccaagcucugc

SEQ ID NO: 2197429 - RNA, 22 nt, Human
agucugauucccaagcucugcu

SEQ ID NO: 2197430 - RNA, 20 nt, Human
agucugauucccaagcucug

SEQ ID NO: 2197431 - RNA, 19 nt, Human
agucgauagagcuguauua

SEQ ID NO: 2197432 - RNA, 15 nt, Human
agucgaugaacuauu

SEQ ID NO: 2197433 - RNA, 13 nt, Human
agucugcaaaaug

SEQ ID NO: 2197434 - RNA, 22 nt, Human
agucugcaaaaugaggaaugua

SEQ ID NO: 2197435 - RNA, 23 nt, Human
agucugcaacuuuaagcagcucu

SEQ ID NO: 2197436 - RNA, 18 nt, Human
aguccuugcaagaaucag

SEQ ID NO: 2197437 - RNA, 12 nt, Human
aguccuugcuug

SEQ ID NO: 2197438 - RNA, 16 nt, Human
aguccugugaauuucu

SEQ ID NO: 2197439 - RNA, 17 nt, Human
aguccuuaaacagggca

SEQ ID NO: 2197440 - RNA, 18 nt, Human
aguccuuaaacagggcau

SEQ ID NO: 2197441 - RNA, 14 nt, Human
aguccuuuaugugg

SEQ ID NO: 2197442 - RNA, 13 nt, Human
aguccuugcuugg

SEQ ID NO: 2197443 - RNA, 18 nt, Human
aguccuugcuuggcugcu

SEQ ID NO: 2197444 - RNA, 16 nt, Human
agucgaggacagggag

SEQ ID NO: 2197445 - RNA, 17 nt, Human
aguccuuuauguggaaa

SEQ ID NO: 2197446 - RNA, 16 nt, Human
aguccuuuuuuuccau

SEQ ID NO: 2197447 - RNA, 21 nt, Human
aguccuuuuuuuccaucuuua

SEQ ID NO: 2197448 - RNA, 18 nt, Human
agucgaauuaauagcuuu

SEQ ID NO: 2197449 - RNA, 21 nt, Human
agucgaauuaauagcuuuuau

SEQ ID NO: 2197450 - RNA, 19 nt, Human
aguauauuuucuuuuccuc

SEQ ID NO: 2197451 - RNA, 18 nt, Human
aguauauuuucuuuuccu

SEQ ID NO: 2197452 - RNA, 15 nt, Human
aguaucaaauauuag

SEQ ID NO: 2197453 - RNA, 19 nt, Human
aguaucaaauauuagaugu

SEQ ID NO: 2197454 - RNA, 21 nt, Human
aguaucaaauauuagauguga

SEQ ID NO: 2197455 - RNA, 22 nt, Human
aguaucaaauauuagaugugau

SEQ ID NO: 2197456 - RNA, 23 nt, Human
aguaucaaauauuagaugugauu

SEQ ID NO: 2197457 - RNA, 22 nt, Human
aguaucacugucuuuccuagau

SEQ ID NO: 2197458 - RNA, 17 nt, Human
aguaucacugucuuucc

SEQ ID NO: 2197459 - RNA, 13 nt, Human
aguaucacugucu

SEQ ID NO: 2197460 - RNA, 19 nt, Human
aguaucaauccuuguucag

SEQ ID NO: 2197461 - RNA, 15 nt, Human
aguaucaggccugcc

SEQ ID NO: 2197462 - RNA, 15 nt, Human
aguaucaggucuccc

SEQ ID NO: 2197463 - RNA, 13 nt, Human
aguaucaugaagc

SEQ ID NO: 2197464 - RNA, 18 nt, Human
aguaucaggucucccacg

SEQ ID NO: 2197465 - RNA, 15 nt, Human
aguaucaugcccugu

SEQ ID NO: 2197466 - RNA, 11 nt, Human
aguaucaugca

SEQ ID NO: 2197467 - RNA, 12 nt, Human
aguaucaugcau

SEQ ID NO: 2197468 - RNA, 19 nt, Human
aguaucaugcccugugcaa

SEQ ID NO: 2197469 - RNA, 14 nt, Human
aguaucaugcauuc

SEQ ID NO: 2197470 - RNA, 14 nt, Human
agugaauaaauguc

SEQ ID NO: 2197471 - RNA, 17 nt, Human
agugaauaaaugucuug

SEQ ID NO: 2197472 - RNA, 23 nt, Human
agugaaucuaaaagcuuuugcuu

SEQ ID NO: 2197473 - RNA, 13 nt, Human
agugaaugauuca

SEQ ID NO: 2197474 - RNA, 13 nt, Human
agugaaugaaaca

SEQ ID NO: 2197475 - RNA, 14 nt, Human
agugacagaggcag

SEQ ID NO: 2197476 - RNA, 19 nt, Human
agugaaugauucaguguua

SEQ ID NO: 2197477 - RNA, 18 nt, Human
agugaaugcucaaguuuu

SEQ ID NO: 2197478 - RNA, 17 nt, Human
agugaaugauucagugu

SEQ ID NO: 2197479 - RNA, 16 nt, Human
agugaaugauucagug

SEQ ID NO: 2197480 - RNA, 15 nt, Human
agugacagaguucac

SEQ ID NO: 2197481 - RNA, 14 nt, Human
agugaaugcuggga

SEQ ID NO: 2197482 - RNA, 19 nt, Human
agugacagaguucacuaua

SEQ ID NO: 2197483 - RNA, 16 nt, Human
agugacagaggcagcc

SEQ ID NO: 2197484 - RNA, 19 nt, Human
agugacagaggcagcccca

SEQ ID NO: 2197485 - RNA, 19 nt, Human
agugauucuccugccucag

SEQ ID NO: 2197486 - RNA, 18 nt, Human
agugauucuccugccuca

SEQ ID NO: 2197487 - RNA, 20 nt, Human
agugauucuccugccucagc

SEQ ID NO: 2197488 - RNA, 18 nt, Human
agugccuuauggaacacu

SEQ ID NO: 2197489 - RNA, 19 nt, Human
agugccuuauggaacacuc

SEQ ID NO: 2197490 - RNA, 20 nt, Human
agugccuuauggaacacucu

SEQ ID NO: 2197491 - RNA, 21 nt, Human
agugccuuauggaacacucug

SEQ ID NO: 2197492 - RNA, 22 nt, Human
agugccuuauggaacacucuga

SEQ ID NO: 2197493 - RNA, 15 nt, Human
agugccuuccauaau

SEQ ID NO: 2197494 - RNA, 13 nt, Human
agugccuuccaua

SEQ ID NO: 2197495 - RNA, 18 nt, Human
agugccuucaauaaaugg

SEQ ID NO: 2197496 - RNA, 20 nt, Human
agugccuucaauaaauggua

SEQ ID NO: 2197497 - RNA, 16 nt, Human
agugccuuccauaauu

SEQ ID NO: 2197498 - RNA, 16 nt, Human
agugccuucuaaaggu

SEQ ID NO: 2197499 - RNA, 19 nt, Human
agugccuuccuguuuuuca

SEQ ID NO: 2197500 - RNA, 21 nt, Human
agugccuuggggaauuuccuc

SEQ ID NO: 2197501 - RNA, 22 nt, Human
agugccuuggggaauuuccucu

SEQ ID NO: 2197502 - RNA, 17 nt, Human
agugcgauucuggauaa

SEQ ID NO: 2197503 - RNA, 17 nt, Human
agugcgaguauguguuu

SEQ ID NO: 2197504 - RNA, 14 nt, Human
agugcgaguaugug

SEQ ID NO: 2197505 - RNA, 15 nt, Human
agugcgaguaugugu

SEQ ID NO: 2197506 - RNA, 14 nt, Human
agugcgugcucagu

SEQ ID NO: 2197507 - RNA, 15 nt, Human
agugcguccacgagc

SEQ ID NO: 2197508 - RNA, 13 nt, Human
agugcguguguag

SEQ ID NO: 2197509 - RNA, 16 nt, Human
agugcguguguagagu

SEQ ID NO: 2197510 - RNA, 18 nt, Human
agugcguguguagaguua

SEQ ID NO: 2197511 - RNA, 22 nt, Human
agugcguguguagaguuaagaa

SEQ ID NO: 2197512 - RNA, 14 nt, Human
agugcuaaaaaugg

SEQ ID NO: 2197513 - RNA, 16 nt, Human
agugcuaaaaauggga

SEQ ID NO: 2197514 - RNA, 20 nt, Human
agugcuaaaaaugggacuuc

SEQ ID NO: 2197515 - RNA, 13 nt, Human
agugcuaagugug

SEQ ID NO: 2197516 - RNA, 19 nt, Human
agugauccucccaccucag

SEQ ID NO: 2197517 - RNA, 20 nt, Human
agugauccucccaccucagc

SEQ ID NO: 2197518 - RNA, 22 nt, Human
agugauccucccaccucagccu

SEQ ID NO: 2197519 - RNA, 23 nt, Human
agugauccucccaccucagccuc

SEQ ID NO: 2197520 - RNA, 20 nt, Human
agugauggguuaguggaugg

SEQ ID NO: 2197521 - RNA, 19 nt, Human
agugaugucacuagggcag

SEQ ID NO: 2197522 - RNA, 16 nt, Human
agugauguaccaugaa

SEQ ID NO: 2197523 - RNA, 13 nt, Human
agugauuaccagg

SEQ ID NO: 2197524 - RNA, 14 nt, Human
caauaucagacuuu

SEQ ID NO: 2197525 - RNA, 21 nt, Human
caagugcuggcaccaccaggc

SEQ ID NO: 2197526 - RNA, 13 nt, Human
caauaucagugcu

SEQ ID NO: 2197527 - RNA, 16 nt, Human
caagugccugcuuuua

SEQ ID NO: 2197528 - RNA, 14 nt, Human
caagugcugaacag

SEQ ID NO: 2197529 - RNA, 16 nt, Human
caagugcugaacagug

SEQ ID NO: 2197530 - RNA, 17 nt, Human
caagugcugaacagugg

SEQ ID NO: 2197531 - RNA, 20 nt, Human
caagugcugaacaguggagg

SEQ ID NO: 2197532 - RNA, 18 nt, Human
caagugcugaacagugga

SEQ ID NO: 2197533 - RNA, 13 nt, Human
caagugccuuaau

SEQ ID NO: 2197534 - RNA, 12 nt, Human
caagugcuggca

SEQ ID NO: 2197535 - RNA, 13 nt, Human
caauauuauaauu

SEQ ID NO: 2197536 - RNA, 17 nt, Human
caauauuaaugccuuua

SEQ ID NO: 2197537 - RNA, 23 nt, Human
caauauuaaugccuuuaaaguau

SEQ ID NO: 2197538 - RNA, 15 nt, Human
caauauuaaaucugc

SEQ ID NO: 2197539 - RNA, 23 nt, Human
caauauuaaauacagacacuaag

SEQ ID NO: 2197540 - RNA, 14 nt, Human
caauauuaaaucug

SEQ ID NO: 2197541 - RNA, 20 nt, Human
caauaucaguuauuuuuuga

SEQ ID NO: 2197542 - RNA, 23 nt, Human
caauauuauacuaagaaaagaua

SEQ ID NO: 2197543 - RNA, 22 nt, Human
caauauuauacuaagaaaagau

SEQ ID NO: 2197544 - RNA, 13 nt, Human
caauauucaaaug

SEQ ID NO: 2197545 - RNA, 15 nt, Human
caauauucaaaugcg

SEQ ID NO: 2197546 - RNA, 21 nt, Human
caauauuauacuaagaaaaga

SEQ ID NO: 2197547 - RNA, 19 nt, Human
caauauuauacuaagaaaa

SEQ ID NO: 2197548 - RNA, 18 nt, Human
caauauuauacuaagaaa

SEQ ID NO: 2197549 - RNA, 14 nt, Human
caauauuauacuaa

SEQ ID NO: 2197550 - RNA, 14 nt, Human
caauauuauaauuu

SEQ ID NO: 2197551 - RNA, 22 nt, Human
caauauuauaauuuuuuucaau

SEQ ID NO: 2197552 - RNA, 18 nt, Human
caauccugugggugaaga

SEQ ID NO: 2197553 - RNA, 17 nt, Human
caauccugucuuucuga

SEQ ID NO: 2197554 - RNA, 13 nt, Human
caauauuccugaa

SEQ ID NO: 2197555 - RNA, 20 nt, Human
caaucucaaauucucaaccu

SEQ ID NO: 2197556 - RNA, 21 nt, Human
caaucucaaauucucaaccua

SEQ ID NO: 2197557 - RNA, 22 nt, Human
caaucuauuaauagcugccuua

SEQ ID NO: 2197558 - RNA, 15 nt, Human
caaucuaaccacauc

SEQ ID NO: 2197559 - RNA, 20 nt, Human
caaucuaaccacaucaauau

SEQ ID NO: 2197560 - RNA, 20 nt, Human
caaucuauuaauagcugccu

SEQ ID NO: 2197561 - RNA, 14 nt, Human
caauccuuguucag

SEQ ID NO: 2197562 - RNA, 19 nt, Human
caaucgacuggguuuaugu

SEQ ID NO: 2197563 - RNA, 20 nt, Human
caaucgacuggguuuauguc

SEQ ID NO: 2197564 - RNA, 17 nt, Human
caaucucccgcugcugc

SEQ ID NO: 2197565 - RNA, 18 nt, Human
caaucucggcucacugca

SEQ ID NO: 2197566 - RNA, 13 nt, Human
caaugauggucac

SEQ ID NO: 2197567 - RNA, 21 nt, Human
caaugauggcaauuuuguaac

SEQ ID NO: 2197568 - RNA, 24 nt, Human
caaugauggcaauuuuguaacgaa

SEQ ID NO: 2197569 - RNA, 13 nt, Human
caaugaaaugaau

SEQ ID NO: 2197570 - RNA, 15 nt, Human
caaugaccuuucaau

SEQ ID NO: 2197571 - RNA, 16 nt, Human
caaugaccuuucaaua

SEQ ID NO: 2197572 - RNA, 17 nt, Human
caaugaaaguuugcacu

SEQ ID NO: 2197573 - RNA, 15 nt, Human
caaugaaaaaaugua

SEQ ID NO: 2197574 - RNA, 13 nt, Human
caaugaccuuuca

SEQ ID NO: 2197575 - RNA, 11 nt, Human
caaugaaauga

SEQ ID NO: 2197576 - RNA, 22 nt, Human
caaugaaauacacaaguaaaca

SEQ ID NO: 2197577 - RNA, 23 nt, Human
caaugaaauacacaaguaaacau

SEQ ID NO: 2197578 - RNA, 14 nt, Human
caaugaccuuucaa

SEQ ID NO: 2197579 - RNA, 15 nt, Human
caaugauuguuaauu

SEQ ID NO: 2197580 - RNA, 14 nt, Human
caaugauguccaga

SEQ ID NO: 2197581 - RNA, 14 nt, Human
caaugcaaaccauc

SEQ ID NO: 2197582 - RNA, 14 nt, Human
caaugauggucacc

SEQ ID NO: 2197583 - RNA, 21 nt, Human
caaugcaaaccaucauugaaa

SEQ ID NO: 2197584 - RNA, 22 nt, Human
caaugcaaaccaucauugaaau

SEQ ID NO: 2197585 - RNA, 22 nt, Human
caaugauuguuaauuuacagcu

SEQ ID NO: 2197586 - RNA, 23 nt, Human
caaugcaaaccaucauugaaauc

SEQ ID NO: 2197587 - RNA, 14 nt, Human
caaugcacugacau

SEQ ID NO: 2197588 - RNA, 13 nt, Human
caaugcacuuugu

SEQ ID NO: 2197589 - RNA, 12 nt, Human
cacaaauaaaau

SEQ ID NO: 2197590 - RNA, 10 nt, Human
cacaaauaaa

SEQ ID NO: 2197591 - RNA, 16 nt, Human
cacaaagguauaauuu

SEQ ID NO: 2197592 - RNA, 13 nt, Human
cacaaacuguaaa

SEQ ID NO: 2197593 - RNA, 17 nt, Human
cacaaagguagcuuuuc

SEQ ID NO: 2197594 - RNA, 21 nt, Human
cacaaauauuuauuuucuuuc

SEQ ID NO: 2197595 - RNA, 13 nt, Human
cacaaauauuuau

SEQ ID NO: 2197596 - RNA, 23 nt, Human
cacaaauauuuauuuucuuucug

SEQ ID NO: 2197597 - RNA, 13 nt, Human
cacaagaaaugaa

SEQ ID NO: 2197598 - RNA, 15 nt, Human
cacaagaaaugaaag

SEQ ID NO: 2197599 - RNA, 20 nt, Human
cacaacuuguuuuugguuuu

SEQ ID NO: 2197600 - RNA, 12 nt, Human
cacaacuuguuu

SEQ ID NO: 2197601 - RNA, 19 nt, Human
cacaaggcugaccaagaga

SEQ ID NO: 2197602 - RNA, 18 nt, Human
cacaaggcugaccaagag

SEQ ID NO: 2197603 - RNA, 14 nt, Human
cacaaggcugacca

SEQ ID NO: 2197604 - RNA, 15 nt, Human
cacaaggccaucugg

SEQ ID NO: 2197605 - RNA, 23 nt, Human
cacaagacccaaaaggcagaagc

SEQ ID NO: 2197606 - RNA, 23 nt, Human
cacaagaaaugaaagcagggacu

SEQ ID NO: 2197607 - RNA, 19 nt, Human
cacaagaagaccagacugu

SEQ ID NO: 2197608 - RNA, 12 nt, Human
cacaagaaauuu

SEQ ID NO: 2197609 - RNA, 14 nt, Human
cacaagaaauuuga

SEQ ID NO: 2197610 - RNA, 20 nt, Human
cacaagaaauuugauuucua

SEQ ID NO: 2197611 - RNA, 16 nt, Human
cacaagugaaaaacau

SEQ ID NO: 2197612 - RNA, 12 nt, Human
cacaagugaaaa

SEQ ID NO: 2197613 - RNA, 21 nt, Human
cacaaggcugaccaagagaga

SEQ ID NO: 2197614 - RNA, 16 nt, Human
cacaaguccugugaau

SEQ ID NO: 2197615 - RNA, 20 nt, Human
cacaaguccugugaauuucu

SEQ ID NO: 2197616 - RNA, 13 nt, Human
cacaaguaaacau

SEQ ID NO: 2197617 - RNA, 17 nt, Human
cacaaggugcaaaucaa

SEQ ID NO: 2197618 - RNA, 16 nt, Human
cacaaggcuguugcau

SEQ ID NO: 2197619 - RNA, 22 nt, Human
cacaagugccacugcccgagcu

SEQ ID NO: 2197620 - RNA, 13 nt, Human
cacaagugguggu

SEQ ID NO: 2197621 - RNA, 23 nt, Human
cacaauccuaacacauuaucggg

SEQ ID NO: 2197622 - RNA, 22 nt, Human
cacaauccuaacacauuaucgg

SEQ ID NO: 2197623 - RNA, 20 nt, Human
cacaauccuaacacauuauc

SEQ ID NO: 2197624 - RNA, 19 nt, Human
cacaaucucggcucacugc

SEQ ID NO: 2197625 - RNA, 13 nt, Human
caaugguuugcaa

SEQ ID NO: 2197626 - RNA, 16 nt, Human
caaugguuugcaagga

SEQ ID NO: 2197627 - RNA, 17 nt, Human
caaugguuugcaaggaa

SEQ ID NO: 2197628 - RNA, 18 nt, Human
caaugguuugcaaggaag

SEQ ID NO: 2197629 - RNA, 18 nt, Human
caaugguuuucuugugug

SEQ ID NO: 2197630 - RNA, 14 nt, Human
caaugcacuuuguu

SEQ ID NO: 2197631 - RNA, 16 nt, Human
caaugcacacaaaaca

SEQ ID NO: 2197632 - RNA, 22 nt, Human
caaugcacacaaaacaacccua

SEQ ID NO: 2197633 - RNA, 19 nt, Human
caaugguuugcaaggaagc

SEQ ID NO: 2197634 - RNA, 20 nt, Human
caaugguuugcaaggaagcc

SEQ ID NO: 2197635 - RNA, 16 nt, Human
caauuagggccuagcc

SEQ ID NO: 2197636 - RNA, 23 nt, Human
caauuauaucaguccucuuucaa

SEQ ID NO: 2197637 - RNA, 13 nt, Human
caauuauguuaaa

SEQ ID NO: 2197638 - RNA, 15 nt, Human
caauuauguuaaacu

SEQ ID NO: 2197639 - RNA, 12 nt, Human
caauuuuguaac

SEQ ID NO: 2197640 - RNA, 13 nt, Human
caauuauuuuuac

SEQ ID NO: 2197641 - RNA, 20 nt, Human
caauuuucuggaauacauga

SEQ ID NO: 2197642 - RNA, 18 nt, Human
caauuuugcaugcucgau

SEQ ID NO: 2197643 - RNA, 11 nt, Human
caauuuuguaa

SEQ ID NO: 2197644 - RNA, 17 nt, Human
cacaaacgggcucagca

SEQ ID NO: 2197645 - RNA, 12 nt, Human
cacaaacuguaa

SEQ ID NO: 2197646 - RNA, 15 nt, Human
cacaaaccugccugg

SEQ ID NO: 2197647 - RNA, 22 nt, Human
cacaaacguauguaaauguaua

SEQ ID NO: 2197648 - RNA, 23 nt, Human
cacaaacguuuacuuaucuuaug

SEQ ID NO: 2197649 - RNA, 13 nt, Human
cacaaacucacca

SEQ ID NO: 2197650 - RNA, 15 nt, Human
cacaaaccaugcaaa

SEQ ID NO: 2197651 - RNA, 14 nt, Human
caauuuuucugcac

SEQ ID NO: 2197652 - RNA, 13 nt, Human
cacaaaccugccu

SEQ ID NO: 2197653 - RNA, 17 nt, Human
cacaaaccugccugggu

SEQ ID NO: 2197654 - RNA, 11 nt, Human
caauuuuucca

SEQ ID NO: 2197655 - RNA, 13 nt, Human
caauuuuucugca

SEQ ID NO: 2197656 - RNA, 18 nt, Human
caauuuuucugcacugag

SEQ ID NO: 2197657 - RNA, 19 nt, Human
cacacagcaagucaggguu

SEQ ID NO: 2197658 - RNA, 15 nt, Human
cacacagcagcaguu

SEQ ID NO: 2197659 - RNA, 22 nt, Human
cacacagauuugagcucagccc

SEQ ID NO: 2197660 - RNA, 13 nt, Human
cacacagcucugu

SEQ ID NO: 2197661 - RNA, 14 nt, Human
cacacagcucuguc

SEQ ID NO: 2197662 - RNA, 15 nt, Human
cacacagcucugucc

SEQ ID NO: 2197663 - RNA, 20 nt, Human
cacaccaggcugugggccuc

SEQ ID NO: 2197664 - RNA, 13 nt, Human
cacaccaggcugu

SEQ ID NO: 2197665 - RNA, 23 nt, Human
cacaccaggccguccucccgggc

SEQ ID NO: 2197666 - RNA, 15 nt, Human
cacacagaguggucu

SEQ ID NO: 2197667 - RNA, 12 nt, Human
cacaccagccau

SEQ ID NO: 2197668 - RNA, 22 nt, Human
cacaccaggccguccucccggg

SEQ ID NO: 2197669 - RNA, 21 nt, Human
cacaccagagcccaccuuggc

SEQ ID NO: 2197670 - RNA, 22 nt, Human
cacaccagagcccaccuuggcu

SEQ ID NO: 2197671 - RNA, 19 nt, Human
cacaccaggcugugggccu

SEQ ID NO: 2197672 - RNA, 12 nt, Human
cacacccagccu

SEQ ID NO: 2197673 - RNA, 17 nt, Human
cacaccaggcugugggc

SEQ ID NO: 2197674 - RNA, 14 nt, Human
cacaccaggcugug

SEQ ID NO: 2197675 - RNA, 13 nt, Human
cacacccagccuc

SEQ ID NO: 2197676 - RNA, 14 nt, Human
cacacccagccuca

SEQ ID NO: 2197677 - RNA, 15 nt, Human
cacacccagccucag

SEQ ID NO: 2197678 - RNA, 16 nt, Human
cacacccagccucagu

SEQ ID NO: 2197679 - RNA, 14 nt, Human
cacacccagcuacu

SEQ ID NO: 2197680 - RNA, 18 nt, Human
cacacccagccucagucc

SEQ ID NO: 2197681 - RNA, 19 nt, Human
cacacccagccucaguccu

SEQ ID NO: 2197682 - RNA, 20 nt, Human
cacaccguguaaaccaaagc

SEQ ID NO: 2197683 - RNA, 16 nt, Human
cacaccuaagggacau

SEQ ID NO: 2197684 - RNA, 14 nt, Human
cacacccagcccac

SEQ ID NO: 2197685 - RNA, 20 nt, Human
cacacccagcccacuucugc

SEQ ID NO: 2197686 - RNA, 21 nt, Human
cacaccucaguucccuuggcc

SEQ ID NO: 2197687 - RNA, 20 nt, Human
cacaccucaguucccuuggc

SEQ ID NO: 2197688 - RNA, 18 nt, Human
cacaccucaguucccuug

SEQ ID NO: 2197689 - RNA, 17 nt, Human
cacaccucaguucccuu

SEQ ID NO: 2197690 - RNA, 13 nt, Human
cacaccucaguuc

SEQ ID NO: 2197691 - RNA, 23 nt, Human
cacaccuaagggacauguuuuga

SEQ ID NO: 2197692 - RNA, 15 nt, Human
cacaccucagaggcu

SEQ ID NO: 2197693 - RNA, 14 nt, Human
cacaccuagcguca

SEQ ID NO: 2197694 - RNA, 22 nt, Human
cacaccucaguucccuuggccu

SEQ ID NO: 2197695 - RNA, 12 nt, Human
cacaccuccaca

SEQ ID NO: 2197696 - RNA, 13 nt, Human
cacaccuccacag

SEQ ID NO: 2197697 - RNA, 16 nt, Human
cacaccucccugaacc

SEQ ID NO: 2197698 - RNA, 14 nt, Human
cacaccucccugaa

SEQ ID NO: 2197699 - RNA, 17 nt, Human
cacaccucccugaacca

SEQ ID NO: 2197700 - RNA, 23 nt, Human
cacacgcacacacacacacagga

SEQ ID NO: 2197701 - RNA, 16 nt, Human
cacacgcacacacaca

SEQ ID NO: 2197702 - RNA, 18 nt, Human
cacacaagaagaagggca

SEQ ID NO: 2197703 - RNA, 16 nt, Human
cacacaagaagaaggg

SEQ ID NO: 2197704 - RNA, 19 nt, Human
cacacaaggauagaugcug

SEQ ID NO: 2197705 - RNA, 24 nt, Human
cacaaucucggcucacugcauccu

SEQ ID NO: 2197706 - RNA, 23 nt, Human
cacaaucucggcucacugcaucc

SEQ ID NO: 2197707 - RNA, 22 nt, Human
cacaaucucggcucacugcauc

SEQ ID NO: 2197708 - RNA, 20 nt, Human
cacaaucucggcucacugca

SEQ ID NO: 2197709 - RNA, 15 nt, Human
cacacaccagagccc

SEQ ID NO: 2197710 - RNA, 16 nt, Human
cacacaccagagccca

SEQ ID NO: 2197711 - RNA, 20 nt, Human
cacacaccagagcccaccuu

SEQ ID NO: 2197712 - RNA, 13 nt, Human
cacacaccccaau

SEQ ID NO: 2197713 - RNA, 12 nt, Human
cacacacacaca

SEQ ID NO: 2197714 - RNA, 11 nt, Human
cacacacacac

SEQ ID NO: 2197715 - RNA, 14 nt, Human
cacacacugaugcu

SEQ ID NO: 2197716 - RNA, 20 nt, Human
cacacacucgcccgcccacu

SEQ ID NO: 2197717 - RNA, 21 nt, Human
cacacacucgcccgcccacug

SEQ ID NO: 2197718 - RNA, 14 nt, Human
cacacacuuuggcu

SEQ ID NO: 2197719 - RNA, 12 nt, Human
cacacacuuuug

SEQ ID NO: 2197720 - RNA, 22 nt, Human
cacacacugugcuuucuauugu

SEQ ID NO: 2197721 - RNA, 23 nt, Human
cacacacugugcuuucuauugua

SEQ ID NO: 2197722 - RNA, 12 nt, Human
cacacagaaaau

SEQ ID NO: 2197723 - RNA, 11 nt, Human
cacacagaaaa

SEQ ID NO: 2197724 - RNA, 21 nt, Human
cacacagaggcugccucuccc

SEQ ID NO: 2197725 - RNA, 16 nt, Human
cacacagaaaauauac

SEQ ID NO: 2197726 - RNA, 15 nt, Human
cacacagaaaauaua

SEQ ID NO: 2197727 - RNA, 14 nt, Human
cacacagaaaauau

SEQ ID NO: 2197728 - RNA, 13 nt, Human
cacacagaaaaua

SEQ ID NO: 2197729 - RNA, 20 nt, Human
cacacagaguggucuuucug

SEQ ID NO: 2197730 - RNA, 14 nt, Human
cacacagagugguc

SEQ ID NO: 2197731 - RNA, 19 nt, Human
cacacagaaaauauacugu

SEQ ID NO: 2197732 - RNA, 18 nt, Human
cacacagaaaauauacug

SEQ ID NO: 2197733 - RNA, 17 nt, Human
cacacagaaaauauacu

SEQ ID NO: 2197734 - RNA, 20 nt, Human
cacacagauuugagcucagc

SEQ ID NO: 2197735 - RNA, 18 nt, Human
cacacagauuugagcuca

SEQ ID NO: 2197736 - RNA, 13 nt, Human
cacacacacacaa

SEQ ID NO: 2197737 - RNA, 21 nt, Human
cacacuaaccuggguucccuu

SEQ ID NO: 2197738 - RNA, 15 nt, Human
caccacagacacaca

SEQ ID NO: 2197739 - RNA, 14 nt, Human
caaccucauugaca

SEQ ID NO: 2197740 - RNA, 22 nt, Human
caaccuaccaccccuuccuguc

SEQ ID NO: 2197741 - RNA, 18 nt, Human
caaccucaacugccuacu

SEQ ID NO: 2197742 - RNA, 18 nt, Human
caaccuaaccccuuuccu

SEQ ID NO: 2197743 - RNA, 13 nt, Human
caaccuaaauuug

SEQ ID NO: 2197744 - RNA, 18 nt, Human
caaccuaccaccccuucc

SEQ ID NO: 2197745 - RNA, 20 nt, Human
caaccuaccaccccuuccug

SEQ ID NO: 2197746 - RNA, 21 nt, Human
caaccuaccaccccuuccugu

SEQ ID NO: 2197747 - RNA, 16 nt, Human
caacauacucccaucu

SEQ ID NO: 2197748 - RNA, 14 nt, Human
caacaguuccuuca

SEQ ID NO: 2197749 - RNA, 20 nt, Human
caacaguguuaggccuggca

SEQ ID NO: 2197750 - RNA, 22 nt, Human
caacaguguuaggccuggcaca

SEQ ID NO: 2197751 - RNA, 23 nt, Human
caacaguguuaggccuggcacag

SEQ ID NO: 2197752 - RNA, 22 nt, Human
caacaguuuuuuaugcuaauca

SEQ ID NO: 2197753 - RNA, 14 nt, Human
caacauacucccau

SEQ ID NO: 2197754 - RNA, 15 nt, Human
caacauacucccauc

SEQ ID NO: 2197755 - RNA, 17 nt, Human
caacaggcugggcuuca

SEQ ID NO: 2197756 - RNA, 15 nt, Human
caaauuaauuggcag

SEQ ID NO: 2197757 - RNA, 11 nt, Human
caacagugagu

SEQ ID NO: 2197758 - RNA, 12 nt, Human
caacagugaguc

SEQ ID NO: 2197759 - RNA, 12 nt, Human
caacagugcuaa

SEQ ID NO: 2197760 - RNA, 12 nt, Human
caacagugugaa

SEQ ID NO: 2197761 - RNA, 18 nt, Human
caacagugcuaaaaaugg

SEQ ID NO: 2197762 - RNA, 13 nt, Human
caacagugugaag

SEQ ID NO: 2197763 - RNA, 13 nt, Human
caacagugcuaaa
